United States Patent 11,078,247 (RNA ENCODING A THERAPEUTIC PROTEIN) - sequence listing, part 28

SEQ ID NO: 48349 - RNA, 4326 nt, Artificial Sequence
  derived and/or modified sequence opt2 from PTPRT__Homo_sapiens__NP_008981
auggccucccucgccgcccucgcccucucccuccuccuccgccuccagcuccccccccuccccggcgcccgcgcccaguccgccgccggcggcugcuccuucgacgagcacuacuccaacugcggcuacuccgucgcccucggcaccaacggcuucaccugggagcagaucaacaccugggagaagcccaugcucgaccaggccguccccaccggcuccuucaugauggucaacuccuccggccgcgccuccggccagaaggcccaccuccuccuccccacccucaaggagaacgacacccacugcaucgacuuccacuacuacuucuccucccgcgaccgcuccucccccggcgcccucaacgucuacgucaaggucaacggcggcccccagggcaaccccgucuggaacgucuccggcgucgucaccgagggcugggucaaggccgagcucgccaucuccaccuucuggccccacuucuaccaggucaucuucgaguccgucucccucaagggccaccccggcuacaucgccgucgacgagguccgcguccucgcccaccccugccgcaaggccccccacuuccuccgccuccagaacgucgaggucaacgucggccagaacgccaccuuccagugcaucgccggcggcaaguggucccagcacgacaagcucuggcuccagcaguggaacggccgcgacaccgcccucauggucacccgcgucgucaaccaccgccgcuucuccgccaccgucuccgucgccgacaccgcccagcgcuccgucuccaaguaccgcugcgucauccgcuccgacggcggcuccggcgucuccaacuacgccgagcucaucgucaaggagccccccacccccaucgccccccccgagcuccucgccgucggcgccaccuaccucuggaucaagcccaacgccaacuccaucaucggcgacggccccaucauccucaaggaggucgaguaccgcaccaccaccggcaccugggccgagacccacaucgucgacucccccaacuacaagcucuggcaccucgaccccgacgucgaguacgagauccgcguccuccucacccgccccggcgagggcggcaccggcccccccggccccccccucaccacccgcaccaagugcgccgaccccguccacggcccccagaacgucgagaucgucgacauccgcgcccgccagcucacccuccagugggagcccuucggcuacgccgucacccgcugccacuccuacaaccucaccguccaguaccaguacgucuucaaccagcagcaguacgaggccgaggaggucauccagaccuccucccacuacacccuccgcggccuccgccccuucaugaccauccgccuccgccuccuccucuccaaccccgagggccgcauggaguccgaggagcucgucguccagaccgaggaggacguccccggcgccgucccccucgaguccauccagggcggccccuucgaggagaagaucuacauccaguggaagccccccaacgagaccaacggcgucaucacccucuacgagaucaacuacaaggccgucggcucccucgaccccuccgccgaccucuccucccagcgcggcaaggucuucaagcuccgcaacgagacccaccaccucuucgucggccucuaccccggcaccaccuacuccuucaccaucaaggccuccaccgccaagggcuucggcccccccgucaccacccgcaucgccaccaagaucuccgcccccuccaugcccgaguacgacaccgacaccccccucaacgagaccgacaccaccaucaccgucaugcucaagcccgcccagucccgcggcgcccccgucuccgucuaccagcucgucgucaaggaggagcgccuccagaagucccgccgcgccgccgacaucaucgagugcuucuccguccccgucuccuaccgcaacgccuccucccucgacucccuccacuacuucgccgccgagcucaagcccgccaaccuccccgucacccagcccuucaccgucggcgacaacaagaccuacaacggcuacuggaaccccccccucuccccccucaaguccuacuccaucuacuuccaggcccucuccaaggccaacggcgagaccaagaucaacugcguccgccucgccaccaagggcgccuccacccagaacuccaacaccgucgagcccgagaagcaggucgacaacaccgucaagauggccggcgucaucgccggccuccucauguucaucaucauccuccucggcgucaugcucaccaucaagcgccgccgcaacgccuacuccuacuccuacuaccucaagcucgccaagaagcagaaggagacccaguccggcgcccagcgcgagaugggccccgucgccuccgccgacaagcccaccaccaagcucuccgccucccgcaacgacgagggcuucuccuccuccucccaggacgucaacggcuucaccgacggcucccgcggcgagcucucccagcccacccucaccauccagacccaccccuaccgcaccugcgaccccgucgagauguccuacccccgcgaccaguuccagcccgccauccgcgucgccgaccuccuccagcacaucacccagaugaagcgcggccagggcuacggcuucaaggaggaguacgaggcccuccccgagggccagaccgccuccugggacaccgccaaggaggacgagaaccgcaacaagaaccgcuacggcaacaucaucuccuacgaccacucccgcguccgccuccucguccucgacggcgacccccacuccgacuacaucaacgccaacuacaucgacggcuaccaccgcccccgccacuacaucgccacccagggccccaugcaggagaccgucaaggacuucuggcgcaugaucuggcaggagaacuccgccuccaucgucauggucaccaaccucgucgaggucggccgcgucaagugcguccgcuacuggcccgacgacaccgaggucuacggcgacaucaaggucacccucaucgagaccgagccccucgccgaguacgucauccgcaccuucaccguccagaagaagggcuaccacgagauccgcgagcuccgccucuuccacuucaccuccuggcccgaccacggcguccccugcuacgccaccggccuccucggcuucguccgccaggucaaguuccucaacccccccgaggccggccccaucgucguccacugcuccgccggcgccggccgcaccggcugcuucaucgccaucgacaccaugcucgacauggccgagaacgagggcgucgucgacaucuucaacugcguccgcgagcuccgcgcccagcgcgucaaccucguccagaccgaggagcaguacgucuucguccacgacgccauccucgaggccugccucugcggcaacaccgccauccccgucugcgaguuccgcucccucuacuacaacaucucccgccucgacccccagaccaacuccucccagaucaaggacgaguuccagacccucaacaucgucaccccccgcguccgccccgaggacugcuccaucggccuccucccccgcaaccacgacaagaaccgcuccauggacguccucccccucgaccgcugccuccccuuccucaucuccgucgacggcgaguccuccaacuacaucaacgccgcccucauggacucccacaagcagcccgccgccuucgucgucacccagcacccccuccccaacaccgucgccgacuucuggcgccucgucuucgacuacaacugcuccuccgucgucaugcucaacgagauggacaccgcccaguucugcaugcaguacuggcccgagaagaccuccggcugcuacggccccauccaggucgaguucgucuccgccgacaucgacgaggacaucauccaccgcaucuuccgcaucugcaacauggcccgcccccaggacggcuaccgcaucguccagcaccuccaguacaucggcuggcccgccuaccgcgacaccccccccuccaagcgcucccuccucaaggucguccgccgccucgagaaguggcaggagcaguacgacggccgcgagggccgcaccgucguccacugccucaacggcggcggccgcuccggcaccuucugcgccaucugcuccgucugcgagaugauccagcagcagaacaucaucgacgucuuccacaucgucaagacccuccgcaacaacaaguccaacauggucgagacccucgagcaguacaaguucgucuacgaggucgcccucgaguaccucuccuccuucuga

SEQ ID NO: 48350 - RNA, 4347 nt, Artificial Sequence
  derived and/or modified sequence opt2 from PTPRZ1__Homo_sapiens__NP_001193768
augcgcauccucaagcgcuuccucgccugcauccagcuccucugcgucugccgccucgacugggccaacggcuacuaccgccagcagcgcaagcucgucgaggagaucggcugguccuacaccggcgcccucaaccagaagaacuggggcaagaaguaccccaccugcaacucccccaagcagucccccaucaacaucgacgaggaccucacccaggucaacgucaaccucaagaagcucaaguuccagggcugggacaagaccucccucgagaacaccuucauccacaacaccggcaagaccgucgagaucaaccucaccaacgacuaccgcgucuccggcggcgucuccgagauggucuucaaggccuccaagaucaccuuccacuggggcaagugcaacauguccuccgacggcuccgagcacucccucgagggccagaaguucccccucgagaugcagaucuacugcuucgacgccgaccgcuucuccuccuucgaggaggccgucaagggcaagggcaagcuccgcgcccucuccauccucuucgaggucggcaccgaggagaaccucgacuucaaggccaucaucgacggcgucgaguccgucucccgcuucggcaagcaggccgcccucgaccccuucauccuccucaaccuccuccccaacuccaccgacaaguacuacaucuacaacggcucccucaccuccccccccugcaccgacaccgucgacuggaucgucuucaaggacaccgucuccaucuccgagucccagcucgccgucuucugcgagguccucaccaugcagcaguccggcuacgucaugcucauggacuaccuccagaacaacuuccgcgagcagcaguacaaguucucccgccaggucuucuccuccuacaccggcaaggaggagauccacgaggccgucugcuccuccgagcccgagaacguccaggccgaccccgagaacuacaccucccuccucgucaccugggagcgcccccgcgucgucuacgacaccaugaucgagaaguucgccguccucuaccagcagcucgacggcgaggaccagaccaagcacgaguuccucaccgacggcuaccaggaccucggcgccauccucaacaaccuccuccccaacauguccuacguccuccagaucgucgccaucugcaccaacggccucuacggcaaguacuccgaccagcucaucgucgacaugcccaccgacaaccccgagcucgaccucuuccccgagcucaucggcaccgaggagaucaucaaggaggaggaggagggcaaggacaucgaggagggcgccaucgucaaccccggccgcgacuccgccaccaaccagauccgcaagaaggagccccagaucuccaccaccacccacuacaaccgcaucggcaccaaguacaacgaggccaagaccaaccgcucccccacccgcggcuccgaguucuccggcaagggcgacguccccaacaccucccucaacuccaccucccagcccgucaccaagcucgccaccgagaaggacaucucccucaccucccagaccgucaccgagcuccccccccacaccgucgagggcaccuccgccucccucaacgacggcuccaagaccguccuccgcuccccccacaugaaccucuccggcaccgccgagucccucaacaccgucuccaucaccgaguacgaggaggagucccuccucaccuccuucaagcucgacaccggcgccgaggacuccuccggcuccucccccgccaccuccgccauccccuucaucuccgagaacaucucccagggcuacaucuucuccuccgagaaccccgagaccaucaccuacgacguccucauccccgaguccgcccgcaacgccuccgaggacuccaccuccuccggcuccgaggagucccucaaggaccccuccauggagggcaacgucugguuccccuccuccaccgacaucaccgcccagcccgacgucggcuccggccgcgaguccuuccuccagaccaacuacaccgagauccgcgucgacgaguccgagaagaccaccaaguccuucuccgccggccccgucaugucccagggccccuccgucaccgaccucgagaugccccacuacuccaccuucgccuacuuccccaccgaggucaccccccacgccuucacccccuccucccgccagcaggaccucgucuccaccgucaacgucgucuacucccagaccacccagcccgucuacaacgaggccuccaacuccucccacgagucccgcaucggccucgccgagggccucgaguccgagaagaaggccgucaucccccucgucaucgucuccgcccucaccuucaucugccucgucguccucgucggcauccucaucuacuggcgcaagugcuuccagaccgcccacuucuaccucgaggacuccaccuccccccgcgucaucuccaccccccccacccccaucuuccccaucuccgacgacgucggcgccauccccaucaagcacuuccccaagcacgucgccgaccuccacgccuccuccggcuucaccgaggaguucgaggagguccaguccugcaccgucgaccucggcaucaccgccgacuccuccaaccaccccgacaacaagcacaagaaccgcuacaucaacaucgucgccuacgaccacucccgcgucaagcucgcccagcucgccgagaaggacggcaagcucaccgacuacaucaacgccaacuacgucgacggcuacaaccgccccaaggccuacaucgccgcccagggcccccucaaguccaccgccgaggacuucuggcgcaugaucugggagcacaacgucgaggucaucgucaugaucaccaaccucgucgagaagggccgccgcaagugcgaccaguacuggcccgccgacggcuccgaggaguacggcaacuuccucgucacccagaaguccguccagguccucgccuacuacaccguccgcaacuucacccuccgcaacaccaagaucaagaagggcucccagaagggccgccccuccggccgcgucgucacccaguaccacuacacccaguggcccgacaugggcguccccgaguacucccuccccguccucaccuucguccgcaaggccgccuacgccaagcgccacgccgucggccccgucgucguccacugcuccgccggcgucggccgcaccggcaccuacaucguccucgacuccaugcuccagcagauccagcacgagggcaccgucaacaucuucggcuuccucaagcacauccgcucccagcgcaacuaccucguccagaccgaggagcaguacgucuucauccacgacacccucgucgaggccauccucuccaaggagaccgagguccucgacucccacauccacgccuacgucaacgcccuccucauccccggccccgccggcaagaccaagcucgagaagcaguuccagcuccucucccaguccaacauccagcaguccgacuacuccgccgcccucaagcagugcaaccgcgagaagaaccgcaccuccuccaucauccccgucgagcgcucccgcgucggcaucuccucccucuccggcgagggcaccgacuacaucaacgccuccuacaucaugggcuacuaccaguccaacgaguucaucaucacccagcacccccuccuccacaccaucaaggacuucuggcgcaugaucugggaccacaacgcccagcucgucgucaugauccccgacggccagaacauggccgaggacgaguucgucuacuggcccaacaaggacgagcccaucaacugcgaguccuucaaggucacccucauggccgaggagcacaagugccucuccaacgaggagaagcucaucauccaggacuucauccucgaggccacccaggacgacuacguccucgagguccgccacuuccagugccccaaguggcccaaccccgacucccccaucuccaagaccuucgagcucaucuccgucaucaaggaggaggccgccaaccgcgacggccccaugaucguccacgacgagcacggcggcgucaccgccggcaccuucugcgcccucaccacccucaugcaccagcucgagaaggagaacuccgucgacgucuaccaggucgccaagaugaucaaccucaugcgccccggcgucuucgccgacaucgagcaguaccaguuccucuacaaggucauccucucccucgucuccacccgccaggaggagaaccccuccaccucccucgacuccaacggcgccgcccuccccgacggcaacaucgccgagucccucgagucccucgucuga

SEQ ID NO: 48351 - RNA, 1173 nt, Artificial Sequence
  derived and/or modified sequence opt2 from PTRF__Homo_sapiens__NP_036364
auggaggaccccacccucuacaucgucgagcgcccccuccccggcuaccccgacgccgaggcccccgagcccuccuccgccggcgcccaggccgccgaggagcccuccggcgccggcuccgaggagcucaucaaguccgaccaggucaacggcguccucguccucucccuccucgacaagaucaucggcgccgucgaccagauccagcucacccaggcccagcucgaggagcgccaggccgagauggagggcgccguccaguccauccagggcgagcucuccaagcucggcaaggcccacgccaccaccuccaacaccgucuccaagcuccucgagaagguccgcaaggucuccgucaacgucaagaccguccgcggcucccucgagcgccaggccggccagaucaagaagcucgaggucaacgaggccgagcuccuccgccgccgcaacuucaaggucaugaucuaccaggacgaggucaagcuccccgccaagcucuccaucuccaagucccucaaggaguccgaggcccuccccgagaaggagggcgaggagcucggcgagggcgagcgccccgaggaggacgccgccgcccucgagcucuccuccgacgaggccgucgaggucgaggaggucaucgaggagucccgcgccgagcgcaucaagcgcuccggccuccgccgcgucgacgacuucaagaaggccuucuccaaggagaagauggagaagaccaagguccgcacccgcgagaaccucgagaagacccgccucaagaccaaggagaaccucgagaagacccgccacacccucgagaagcgcaugaacaagcucggcacccgccucguccccgccgagcgccgcgagaagcucaagaccucccgcgacaagcuccgcaaguccuucacccccgaccacgucgucuacgcccgcuccaagaccgccgucuacaaggucccccccuucaccuuccacgucaagaagauccgcgagggccaggucgagguccucaaggccaccgagauggucgaggucggcgccgacgacgacgagggcggcgccgagcgcggcgaggccggcgaccuccgccgcggcuccucccccgacguccacgcccuccucgagaucaccgaggaguccgacgccguccucgucgacaaguccgacuccgacuga

SEQ ID NO: 48352 - RNA, 645 nt, Artificial Sequence
  derived and/or modified sequence opt2 from PTRH1__Homo_sapiens__NP_001002913
augcgccccggcggcuuccucggcgccggccagcgccucucccgcgccaugucccgcugcguccucgagccccgcccccccggcaagcgcuggauggucgccggccucggcaaccccggccuccccggcacccgccacuccgucggcauggccguccucggccagcucgcccgccgccucggcgucgccgaguccuggacccgcgaccgccacugcgccgccgaccucgcccucgccccccucggcgacgcccagcucguccuccuccgcccccgccgccucaugaacgccaacggccgcuccgucgcccgcgccgccgagcucuucggccucaccgccgaggaggucuaccucguccacgacgagcucgacaagccccucggccgccucgcccucaagcucggcggcuccgcccgcggccacaacggcguccgcuccugcaucuccugccucaacuccaacgccaugccccgccuccgcgucggcaucggccgccccgcccaccccgaggccguccaggcccacguccucggcugcuucucccccgccgagcaggagcuccucccccuccuccucgaccgcgccaccgaccucauccucgaccacauccgcgagcgcucccagggccccucccucggccccuga

SEQ ID NO: 48353 - RNA, 540 nt, Artificial Sequence
  derived and/or modified sequence opt2 from PTRH2__Homo_sapiens__NP_057161
augcccuccaagucccucgucauggaguaccucgcccaccccuccacccucggccucgccgucggcgucgccugcggcaugugccucggcuggucccuccgcgucugcuucggcaugcuccccaaguccaagaccuccaagacccacaccgacaccgaguccgaggccuccauccucggcgacuccggcgaguacaagaugauccucgucguccgcaacgaccucaagaugggcaagggcaaggucgccgcccagugcucccacgccgccgucuccgccuacaagcagauccagcgccgcaaccccgagaugcucaagcagugggaguacugcggccagcccaaggucgucgucaaggcccccgacgaggagacccucaucgcccuccucgcccacgccaagaugcucggccucaccgucucccucauccaggacgccggccgcacccagaucgcccccggcucccagaccguccucggcaucggccccggccccgccgaccucaucgacaaggucaccggccaccucaagcucuacuga

SEQ ID NO: 48354 - RNA, 423 nt, Artificial Sequence
  derived and/or modified sequence opt2 from PTRHD1__Homo_sapiens__NP_001013685
augcaccgcggcgucggccccgccuuccgcgucguccgcaagauggccgccuccggcgccgagccccagguccucguccaguaccucguccuccgcaaggaccucucccaggcccccuucuccuggcccgccggcgcccucgucgcccaggccugccacgccgccaccgccgcccuccacacccaccgcgaccacccccacaccgccgccuaccuccaggagcucggccgcaugcgcaaggucguccucgaggcccccgacgagaccacccucaaggagcucgccgagacccuccagcagaagaacaucgaccacaugcucuggcucgagcagcccgagaacaucgccaccugcaucgcccuccgccccuaccccaaggaggaggucggccaguaccucaagaaguuccgccucuucaaguga

SEQ ID NO: 48355 - RNA, 438 nt, Artificial Sequence
  derived and/or modified sequence opt2 from PTS__Homo_sapiens__NP_000308
auguccaccgagggcggcggccgccgcugccaggcccaggucucccgccgcaucuccuucuccgccucccaccgccucuacuccaaguuccucuccgacgaggagaaccucaagcucuucggcaagugcaacaaccccaacggccacggccacaacuacaaggucgucgucaccguccacggcgagaucgaccccgccaccggcauggucaugaaccucgccgaccucaagaaguacauggaggaggccaucaugcagccccucgaccacaagaaccucgacauggacguccccuacuucgccgacgucgucuccaccaccgagaacgucgccgucuacaucugggacaaccuccagaagguccuccccgucggcguccucuacaaggucaaggucuacgagaccgacaacaacaucgucgucuacaagggcgaguga

SEQ ID NO: 48356 - RNA, 609 nt, Artificial Sequence
  derived and/or modified sequence opt2 from PTTG1__Homo_sapiens__NP_001269312
auggccacccucaucuacgucgacaaggagaacggcgagcccggcacccgcgucgucgccaaggacggccucaagcucggcuccggccccuccaucaaggcccucgacggccgcucccaggucuccaccccccgcuucggcaagaccuucgacgccccccccgcccuccccaaggccacccgcaaggcccucggcaccgucaaccgcgccaccgagaaguccgucaagaccaagggcccccucaagcagaagcagcccuccuucuccgccaagaagaugaccgagaagaccgucaaggccaaguccuccguccccgccuccgacgacgccuaccccgagaucgagaaguucuuccccuucaacccccucgacuucgaguccuucgaccuccccgaggagcaccagaucgcccaccucccccucuccggcgucccccucaugauccucgacgaggagcgcgagcucgagaagcucuuccagcucggcccccccucccccgucaagaugcccuccccccccugggaguccaaccuccuccagucccccuccuccauccucuccacccucgacgucgagcucccccccgucugcugcgacaucgacaucuga

SEQ ID NO: 48357 - RNA, 429 nt, Artificial Sequence
  derived and/or modified sequence opt2 from PTTG1IP__Homo_sapiens__NP_001273751
auggcccccggcgucgcccgcggccccacccccuacuggcgccuccgccucggcggcgccgcccuccuccuccuccucauccccgucgccgccgcccaggagccccccggcgccgccugcucccagaacaccaacaagaccugcgaggagugccucaagaacgucuccgccugccucaagaagaagacccgcaugcucgaccucaagaccaccaaggcccuccagcacaucucccccgacgccuccugcgagguccacgccccccagcccucccccgccggccgcccccgcggccacugcggccuccucacccucgccuccgagcccgccucccuccccggccaggccgccggcgagcucccccucaaggacuccccccucguccuccagaccggcgaccuccucuuccccguccaccucugcuucuga

SEQ ID NO: 48358 - RNA, 576 nt, Artificial Sequence
  derived and/or modified sequence opt2 from PTTG2__Homo_sapiens__NP_006598
auggccacccucaucuacgucgacaaggagaucggcgagcccggcacccgcgucgccgccaaggacguccucaagcucgagucccgccccuccaucaaggcccucgacggcaucucccagguccucacccgccgcuucggcaagaccuacgacgcccccuccgcccuccccaaggccacccgcaaggcccucggcaccgucaaccgcgccaccgagaaguccgucaagaccaacggcccccgcaagcagaagcagcccuccuucuccgccaagaagaugaccgagaagaccgucaagaccaaguccuccguccccgccuccgacgacgccuaccccgagaucgagaaguucuuccccuucaaccuccucgacuucgaguccuucgaccuccccgaggagcgccagaucgcccaccucccccucuccggcgucccccucaugauccucgacgaggagggcgagcucgagaagcucuuccagcucggcccccccucccccgucaagaugcccuccccccccugggagugcaaccucuucgccgucuccuucaagcacuccgucgaccccggcugcuga

SEQ ID NO: 48359 - RNA, 1146 nt, Artificial Sequence
  derived and/or modified sequence opt2 from PTX3__Homo_sapiens__NP_002843
augcaccuccucgccauccucuucugcgcccucugguccgccguccucgccgagaacuccgacgacuacgaccucauguacgucaaccucgacaacgagaucgacaacggccuccaccccaccgaggaccccacccccugcgccugcggccaggagcacuccgagugggacaagcucuucaucaugcucgagaacucccagaugcgcgagcgcaugcuccuccaggccaccgacgacguccuccgcggcgagcuccagcgccuccgcgaggagcucggccgccucgccgagucccucgcccgccccugcgcccccggcgcccccgccgaggcccgccucaccuccgcccucgacgagcuccuccaggccacccgcgacgccggccgccgccucgcccgcauggagggcgccgaggcccagcgccccgaggaggccggccgcgcccucgccgccguccucgaggagcuccgccagacccgcgccgaccuccacgccguccagggcugggccgcccgcuccuggcuccccgccggcugcgagaccgccauccucuuccccaugcgcuccaagaagaucuucggcuccguccaccccguccgccccaugcgccucgaguccuucuccgccugcaucugggucaaggccaccgacguccucaacaagaccauccucuucuccuacggcaccaagcgcaaccccuacgagauccagcucuaccucuccuaccaguccaucgucuucgucgucggcggcgaggagaacaagcucgucgccgaggccauggucucccucggccgcuggacccaccucugcggcaccuggaacuccgaggagggccucaccucccucugggucaacggcgagcucgccgccaccaccgucgagauggccaccggccacaucguccccgagggcggcauccuccagaucggccaggagaagaacggcugcugcgucggcggcggcuucgacgagacccucgccuucuccggccgccucaccggcuucaacaucugggacuccguccucuccaacgaggagauccgcgagaccggcggcgccgaguccugccacauccgcggcaacaucgucggcuggggcgucaccgagauccagccccacggcggcgcccaguacgucuccuga

SEQ ID NO: 48360 - RNA, 1551 nt, Artificial Sequence
  derived and/or modified sequence opt2 from PUF60__Homo_sapiens__NP_001129505
auggagaacggccaguccaccgccgccaagcucggccuccccccccucacccccgagcagcaggaggcccuccagaaggccaagaaguacgccauggagcaguccaucaaguccguccucgucaagcagaccaucgcccaccagcagcagcagcucaccaaccuccagauggccgccgucaccaugggcuucggcgacccccucuccccccuccaguccauggccgcccagcgccagcgcgcccucgccaucaugugccgcgucuacgucggcuccaucuacuacgagcucggcgaggacaccauccgccaggccuucgcccccuucggccccaucaaguccaucgacauguccugggacuccgucaccaugaagcacaagggcuucgccuucgucgaguacgagguccccgaggccgcccagcucgcccucgagcagaugaacuccgucaugcucggcggccgcaacaucaaggucggccgccccuccaacaucggccaggcccagcccaucaucgaccagcucgccgaggaggcccgcgccuucaaccgcaucuacgucgccuccguccaccaggaccucuccgacgacgacaucaaguccgucuucgaggccuucggcaagaucaaguccugcacccucgcccgcgaccccaccaccggcaagcacaagggcuacggcuucaucgaguacgagaaggcccaguccucccaggacgccgucuccuccaugaaccucuucgaccucggcggccaguaccuccgcgucggcaaggccgucaccccccccaugccccuccucacccccgccacccccggcggccucccccccgccgccgccgucgccgccgccgccgccaccgccaagaucaccgcccaggaggccgucgccggcgccgccguccucggcacccucggcacccccggccucgucucccccgcccucacccucgcccagccccucggcacccucccccaggccgucauggccgcccaggcccccggcgucaucaccggcgucacccccgcccgcccccccauccccgucaccauccccuccgucggcgucgucaaccccauccucgccuccccccccacccucggccuccucgagcccaagaaggagaaggaggaggaggagcucuuccccgaguccgagcgccccgagaugcucuccgagcaggagcacauguccaucuccggcuccuccgcccgccacauggucaugcagaagcuccuccgcaagcaggaguccaccgucaugguccuccgcaacauggucgaccccaaggacaucgacgacgaccucgagggcgaggucaccgaggagugcggcaaguucggcgccgucaaccgcgucaucaucuaccaggagaagcagggcgaggaggaggacgccgagaucaucgucaagaucuucgucgaguucuccaucgccuccgagacccacaaggccauccaggcccucaacggccgcugguucgccggccgcaaggucgucgccgaggucuacgaccaggagcgcuucgacaacuccgaccucuccgccuga

SEQ ID NO: 48361 - RNA, 3027 nt, Artificial Sequence
  derived and/or modified sequence opt2 from PUM2__Homo_sapiens__NP_001269681
augucccagcccaucaugguccagcgccgcuccggccagggcuuccacggcaacuccgaggucaacgccauccucuccccccgcuccgaguccggcggccucggcgucuccauggucgaguacguccucuccuccucccccgccgacaagcucgacucccgcuuccgcaagggcaacuucggcacccgcgacgccgagaccgacggccccgagaagggcgaccagaagggcaaggccucccccuucgaggaggaccagaaccgcgaccucaagcagggcgacgacgacgacuccaagaucaacggccgcggccuccccaacggcauggacgccgacugcaaggacuucaaccgcacccccggcucccgccaggccucccccaccgaggucgucgagcgccucggccccaacaccaaccccuccgagggccucggcccccuccccaaccccaccgccaacaagccccucgucgaggaguucuccaaccccgagacccagaaccucgacgccauggagcaggucggccucgagucccuccaguucgacuaccccggcaaccagguccccauggacuccuccggcgccaccgucggccucuucgacuacaacucccagcagcagcucuuccagcgcaccaacgcccucaccguccagcagcucaccgccgcccagcagcagcaguacgcccucgccgccgcccagcagccccacaucgccggcgucuucuccgccggccucgcccccgccgccuucguccccaaccccuacaucaucuccgccgccccccccggcaccgaccccuacaccgccgccggccucgccgccgccgccacccucgccggccccgccgucguccccccccaguacuacggcguccccuggggcgucuaccccgccaaccucuuccagcagcaggccgccgccgccgccaacaacaccgccucccagcaggccgccucccaggcccagcccggccagcagcagguccuccgcgccggcgccggccagcgcccccucacccccaaccagggccagcagggccagcaggccgagucccucgccgccgccgccgccgccaaccccacccucgccuucggccagggccucgccaccggcaugcccggcuaccagguccucgcccccaccgccuacuacgaccagaccggcgcccucgucgucggccccggcgcccgcaccggccucggcgcccccguccgccucauggcccccacccccguccucaucuccuccgccgccgcccaggccgccgccgccgccgccgccggcggcaccgccuccucccucaccggcuccaccaacggccucuuccgccccaucggcacccagcccccccagcagcagcagcagcagcccuccaccaaccuccaguccaacuccuucuacggcuccuccucccucaccaacuccucccaguccuccucccucuucucccacggccccggccagcccggcuccaccucccucggcuucggcuccggcaacucccucggcgccgccaucggcuccgcccucuccggcuucggcuccuccgucggcuccuccgccuccuccuccgccacccgccgcgagucccucuccaccuccuccgaccucuacaagcgcuccuccuccucccucgcccccaucggccagcccuucuacaacucccucggcuucuccuccucccccucccccaucggcaugccccuccccucccagacccccggccacucccucacccccccccccucccucuccucccacggcuccuccuccucccuccaccucggcggccucaccaacggcuccggccgcuacaucuccgccgcccccggcgccgaggccaaguaccgcuccgccuccuccaccuccucccucuucuccuccuccucccagcucuucccccccucccgccuccgcuacaaccgcuccgacaucaugcccuccggccgcucccgccuccucgaggacuuccgcaacaaccgcuuccccaaccuccagcuccgcgaccucaucggccacaucgucgaguucucccaggaccagcacggcucccgcuucauccagcagaagcucgagcgcgccacccccgccgagcgccagauggucuucaacgagauccuccaggccgccuaccagcucaugaccgacgucuucggcaacuacgucauccagaaguucuucgaguucggcucccucgaccagaagcucgcccucgccacccgcauccgcggccacguccucccccucgcccuccagauguacggcugccgcgucauccagaaggcccucgaguccaucuccuccgaccagcaguccgagauggucaaggagcucgacggccacguccucaagugcgucaaggaccagaacggcaaccacgucguccagaagugcaucgagugcguccagccccagucccuccaguucaucaucgacgccuucaagggccaggucuucguccucuccacccaccccuacggcugccgcgucauccagcgcauccucgagcacugcaccgccgagcagacccuccccauccucgaggagcuccaccagcacaccgagcagcucguccaggaccaguacggcaacuacgucauccagcacguccucgagcacggccgccccgaggacaaguccaagaucgucuccgagauccgcggcaagguccucgcccucucccagcacaaguucgccuccaacgucgucgagaagugcgucacccacgccucccgcgccgagcgcgcccuccucaucgacgaggucugcugccagaacgacggcccccacuccgcccucuacaccaugaugaaggaccaguacgccaacuacgucguccagaagaugaucgacauggccgagcccgcccagcgcaagaucaucaugcacaagauccgcccccacaucaccacccuccgcaaguacaccuacggcaagcacauccucgccaagcucgagaaguacuaccucaagaacucccccgaccucggccccaucggcggcccccccaacggcaugcucuga

SEQ ID NO: 48362 - RNA, 969 nt, Artificial Sequence
  derived and/or modified sequence opt2 from PURA__Homo_sapiens__NP_005850
auggccgaccgcgacuccggcuccgagcagggcggcgccgcccucggcuccggcggcucccucggccaccccggcuccggcuccggcuccggcggcggcggcggcggcggcggcggcggcggcggcuccggcggcggcggcggcggcgcccccggcggccuccagcacgagacccaggagcucgccuccaagcgcgucgacauccagaacaagcgcuucuaccucgacgucaagcagaacgccaagggccgcuuccucaagaucgccgaggucggcgccggcggcaacaagucccgccucacccucuccauguccgucgccgucgaguuccgcgacuaccucggcgacuucaucgagcacuacgcccagcucggccccucccagccccccgaccucgcccaggcccaggacgagccccgccgcgcccucaaguccgaguuccucguccgcgagaaccgcaaguacuacauggaccucaaggagaaccagcgcggccgcuuccuccgcauccgccagaccgucaaccgcggccccggccucggcuccacccagggccagaccaucgcccuccccgcccagggccucaucgaguuccgcgacgcccucgccaagcucaucgacgacuacggcgucgaggaggagcccgccgagcuccccgagggcaccucccucaccgucgacaacaagcgcuucuucuucgacgucggcuccaacaaguacggcgucuucaugcgcgucuccgaggucaagcccaccuaccgcaacuccaucaccguccccuacaaggucugggccaaguucggccacaccuucugcaaguacuccgaggagaugaagaagauccaggagaagcagcgcgagaagcgcgccgccugcgagcagcuccaccagcagcagcagcagcagcaggaggagaccgccgccgccacccuccuccuccagggcgaggaggagggcgaggaggacuga

SEQ ID NO: 48363 - RNA, 939 nt, Artificial Sequence
  derived and/or modified sequence opt2 from PURB__Homo_sapiens__NP_150093
auggccgacggcgacuccggcuccgagcgcggcggcggcggcggccccugcggcuuccagcccgccucccgcggcggcggcgagcaggagacccaggagcucgccuccaagcgccucgacauccagaacaagcgcuucuaccucgacgucaagcagaacgccaagggccgcuuccucaagaucgccgaggucggcgccggcggcuccaagucccgccucacccucuccauggccgucgccgccgaguuccgcgacucccucggcgacuucaucgagcacuacgcccagcucggccccuccucccccgagcagcucgccgccggcgccgaggagggcggcggcccccgccgcgcccucaaguccgaguuccucguccgcgagaaccgcaaguacuaccucgaccucaaggagaaccagcgcggccgcuuccuccgcauccgccagaccgucaaccgcggcggcggcggcuucggcgccggccccggccccggcggccuccaguccggccagaccaucgcccuccccgcccagggccucaucgaguuccgcgacgcccucgccaagcucaucgacgacuacggcggcgaggacgacgagcucgccggcggccccggcggcggcgccggcggccccggcggcggccucuacggcgagcuccccgagggcaccuccaucaccgucgacuccaagcgcuucuucuucgacgucggcugcaacaaguacggcgucuuccuccgcgucuccgaggucaagcccuccuaccgcaacgccaucaccguccccuucaaggccuggggcaaguucggcggcgccuucugccgcuacgccgacgagaugaaggagauccaggagcgccagcgcgacaagcucuacgagcgccgcggcggcggcuccggcggcggcgaggaguccgagggcgaggaggucgacgaggacuga

SEQ ID NO: 48364 - RNA, 1590 nt, Artificial Sequence
  derived and/or modified sequence opt2 from PUS10__Homo_sapiens__XP_011530879
auguucccccucaccgaggagaacaagcacgucgcccagcuccuccucaacaccggcaccugcccccgcugcaucuuccgcuucugcggcgucgacuuccacgcccccuacaagcuccccuacaaggagcuccucaacgagcuccagaaguuccucgagaccgagaaggacgagcucauccucgaggucaugaaccccccccccaagaagauccgccuccaggagcucgaggacuccaucgacaaccucucccagaacggcgagggccgcaucuccgucucccacgucggcuccaccgccuccaagaacuccaaccucaacgucugcaacgucugccucggcauccuccaggaguucugcgagaaggacuucaucaagaaggucugccagaaggucgaggccuccggcuucgaguucaccucccucgucuucuccgucuccuuccccccccagcucuccguccgcgagcacgccgccuggcuccucgucaagcaggagaugggcaagcagucccucucccucggccgcgacgacaucguccagcucaaggaggccuacaaguggaucacccacccccucuucuccgaggagcucggcguccccaucgacggcaagucccucuucgaggucuccgucgucuucgcccaccccgagaccgucgaggacugccacuuccucgccgccaucugccccgacugcuucaagcccgccaagaacaagcaguccgucuucacccgcauggccgucaugaaggcccucaacaagaucaaggaggaggacuuccucaagcaguuccccugcccccccaacucccccaaggccgucugcgccguccucgagaucgagugcgcccacggcgccgucuucgucgccggccgcuacaacaaguacucccgcaaccucccccagacccccuggaucaucgacggcgagcgcaagcucgaguccuccgucgaggagcucaucuccgaccaccuccucgccgucuucaaggccgaguccuucaacuucuccuccuccggccgcgaggacgucgacguccgcacccucggcaacggccgccccuucgccaucgagcucgucaacccccaccgcguccacuucaccucccaggagaucaaggagcuccagcagaagaucaacaacuccuccaacaagauccagguccgcgaccuccagcucgucacccgcgaggccaucggccacaugaaggagggcgaggaggagaagaccaagaccuacuccgcccucaucuggaccaacaaggccauccagaagaaggacaucgaguuccucaacgacaucaaggaccucaagaucgaccagaagaccccccuccgcguccuccaccgccgcccccucgccguccgcgcccgcgucauccacuucauggagacccaguacgucgacgagcaccacuuccgccuccaccucaagacccaggccggcaccuacaucaaggaguucguccacggcgacuucggccgcaccaagcccaacaucggcucccucaugaacgucaccgccgacauccucgagcucgacgucgaguccgucgacgucgacuggccccccgcccucgacgacuga

SEQ ID NO: 48365 - RNA, 1200 nt, Artificial Sequence
  derived and/or modified sequence opt2 from PUS1__Homo_sapiens__NP_001002019
auggccggcaacgccgagcccccccccgccggcgccgccugcccccaggaccgccgcuccugcuccggccgcgccggcggcgaccgcgucugggaggacggcgagcaccccgccaagaagcucaaguccggcggcgacgaggagcgccgcgagaagccccccaagcgcaagaucguccuccucauggccuacuccggcaagggcuaccacggcaugcagcgcaacgucggcuccucccaguucaagaccaucgaggacgaccucgucuccgcccucguccgcuccggcugcauccccgagaaccacggcgaggacaugcgcaagauguccuuccagcgcugcgcccgcaccgacaagggcgucuccgccgccggccaggucgucucccucaaggucuggcucaucgacgacauccucgagaagaucaacucccaccuccccucccacauccgcauccucggccucaagcgcgucaccggcggcuucaacuccaagaaccgcugcgacgcccgcaccuacugcuaccuccuccccaccuucgccuucgcccacaaggaccgcgacguccaggacgagaccuaccgccucuccgccgagacccuccagcaggucaaccgccuccucgccugcuacaagggcacccacaacuuccacaacuucaccucccagaagggcccccaggaccccuccgccugccgcuacauccucgagauguacugcgaggagcccuucguccgcgagggccucgaguucgccgucauccgcgucaagggccaguccuucaugaugcaccagauccgcaagauggucggccucgucgucgccaucgucaagggcuacgcccccgaguccguccucgagcgcuccuggggcaccgagaaggucgacguccccaaggcccccggccucggccucguccucgagcgcguccacuucgagaaguacaaccagcgcuucggcaacgacggccuccacgagccccucgacugggcccaggaggagggcaaggucgccgccuucaaggaggagcacaucuaccccaccaucaucggcaccgagcgcgacgagcgcuccauggcccaguggcucuccacccuccccauccacaacuucuccgccaccgcccucaccgccggcggcaccggcgccaagguccccuccccccucgagggcuccgagggcgacggcgacaccgacuga

SEQ ID NO: 48366 - RNA, 324 nt, Artificial Sequence
  derived and/or modified sequence opt2 from PVALB__Homo_sapiens__XP_011545203
auguccaugaccgaccuccucaacgccgaggacaucaagaaggccgucggcgccuucuccgccaccgacuccuucgaccacaagaaguucuuccagauggucggccucaagaagaaguccgccgacgacgucaagaaggucuuccacaugcucgacaaggacaaguccggcuucaucgaggaggacgagcucggcuucauccucaagggcuucucccccgacgcccgcgaccucuccgccaaggagaccaagaugcucauggccgccggcgacaaggacggcgacggcaagaucggcgucgacgaccccgccgacgucgacuga

SEQ ID NO: 48367 - RNA, 1119 nt, Artificial Sequence
  derived and/or modified sequence opt2 from PVR__Homo_sapiens__NP_001129240
auggcccgcgccauggccgccgccuggccccuccuccucgucgcccuccucguccucuccuggcccccccccggcaccggcgacgucgucguccaggcccccacccagguccccggcuuccucggcgacuccgucacccuccccugcuaccuccagguccccaacauggaggucacccacgucucccagcucaccugggcccgccacggcgaguccggcuccauggccgucuuccaccagacccagggccccuccuacuccgaguccaagcgccucgaguucgucgccgcccgccucggcgccgagcuccgcaacgccucccuccgcauguucggccuccgcgucgaggacgagggcaacuacaccugccucuucgucaccuucccccagggcucccgcuccgucgacaucuggcuccgcguccucgccaagccccagaacaccgccgagguccagaagguccagcucaccggcgagcccguccccauggcccgcugcgucuccaccggcggccgcccccccgcccagaucaccuggcacuccgaccucggcggcaugcccaacaccucccagguccccggcuuccucuccggcaccgucaccgucaccucccucuggauccucguccccuccucccaggucgacggcaagaacgucaccugcaaggucgagcacgaguccuucgagaagccccagcuccucaccgucaaccucaccgucuacuacccccccgaggucuccaucuccggcuacgacaacaacugguaccucggccagaacgaggccacccucaccugcgacgcccgcuccaaccccgagcccaccggcuacaacugguccaccaccaugggcccccucccccccuucgccgucgcccagggcgcccagcuccucauccgccccgucgacaagcccaucaacaccacccucaucugcaacgucaccaacgcccucggcgcccgccaggccgagcucaccguccaggucaaggagggcccccccuccgagcacuccggcaccgagcacgccuccgccuccgccaacggccacgucuccuacuccgccgucucccgcgagaacuccuccucccaggacccccagaccgagggcacccgcuga

SEQ ID NO: 48368 - RNA, 1554 nt, Artificial Sequence
  derived and/or modified sequence opt2 from PVRL1__Homo_sapiens__NP_002846
auggcccgcaugggccucgccggcgccgccggccgcugguggggccucgcccucggccucaccgccuucuuccuccccggcguccacucccaggucguccaggucaacgacuccauguacggcuucaucggcaccgacgucguccuccacugcuccuucgccaacccccuccccuccgucaagaucacccaggucaccuggcagaaguccaccaacggcuccaagcagaacgucgccaucuacaaccccuccaugggcgucuccguccucgcccccuaccgcgagcgcgucgaguuccuccgccccuccuucaccgacggcaccauccgccucucccgccucgagcucgaggacgagggcgucuacaucugcgaguucgccaccuuccccaccggcaaccgcgagucccagcucaaccucaccgucauggccaagcccaccaacuggaucgagggcacccaggccguccuccgcgccaagaagggccaggacgacaagguccucgucgccaccugcaccuccgccaacggcaagccccccuccgucgucuccugggagacccgccucaagggcgaggccgaguaccaggagauccgcaaccccaacggcaccgucaccgucaucucccgcuaccgccucguccccucccgcgaggcccaccagcagucccucgccugcaucgucaacuaccacauggaccgcuucaaggagucccucacccucaacguccaguacgagcccgaggucaccaucgagggcuucgacggcaacugguaccuccagcgcauggacgucaagcucaccugcaaggccgacgccaacccccccgccaccgaguaccacuggaccacccucaacggcucccuccccaagggcgucgaggcccagaaccgcacccucuucuucaagggccccaucaacuacucccucgccggcaccuacaucugcgaggccaccaaccccaucggcacccgcuccggccaggucgaggucaacaucaccgaguuccccuacacccccuccccccccgagcacggccgccgcgccggccccguccccaccgccaucaucggcggcgucgccggcuccauccuccucguccucaucgucgucggcggcaucgucgucgcccuccgccgccgccgccacaccuucaagggcgacuacuccaccaagaagcacgucuacggcaacggcuacuccaaggccggcaucccccagcaccacccccccauggcccagaaccuccaguaccccgacgacuccgacgacgagaagaaggccggcccccucggcggcuccuccuacgaggaggaggaggaggaggaggagggcggcggcggcggcgagcgcaaggucggcggcccccaccccaaguacgacgaggacgccaagcgccccuacuucaccgucgacgaggccgaggcccgccaggacggcuacggcgaccgcacccucggcuaccaguacgaccccgagcagcucgaccucgccgagaacauggucucccagaacgacggcuccuucaucuccaagaaggagugguacgucuga

SEQ ID NO: 48369 - RNA, 1617 nt, Artificial Sequence
  derived and/or modified sequence opt2 from PVRL2__Homo_sapiens__NP_001036189
auggcccgcgccgccgcccuccuccccucccgcuccccccccaccccccuccucuggccccuccuccuccuccuccuccucgagaccggcgcccaggacguccgcguccagguccuccccgagguccgcggccagcucggcggcaccgucgagcuccccugccaccuccucccccccguccccggccucuacaucucccucgucaccuggcagcgccccgacgcccccgccaaccaccagaacgucgccgccuuccaccccaagaugggccccuccuuccccucccccaagcccggcuccgagcgccucuccuucgucuccgccaagcaguccaccggccaggacaccgaggccgagcuccaggacgccacccucgcccuccacggccucaccgucgaggacgagggcaacuacaccugcgaguucgccaccuuccccaagggcuccguccgcggcaugaccuggcuccgcgucaucgccaagcccaagaaccaggccgaggcccagaaggucaccuucucccaggaccccaccaccgucgcccucugcaucuccaaggagggccgcccccccgcccgcaucuccuggcucuccucccucgacugggaggccaaggagacccaggucuccggcacccucgccggcaccgucaccgucaccucccgcuucacccucguccccuccggccgcgccgacggcgucaccgucaccugcaaggucgagcacgaguccuucgaggagcccgcccucauccccgucacccucuccguccgcuacccccccgaggucuccaucuccggcuacgacgacaacugguaccucggccgcaccgacgccacccucuccugcgacguccgcuccaaccccgagcccaccggcuacgacugguccaccaccuccggcaccuuccccaccuccgccgucgcccagggcucccagcucgucauccacgccgucgacucccucuucaacaccaccuucgucugcaccgucaccaacgccgucggcaugggccgcgccgagcaggucaucuucguccgcgagacccccaacaccgccggcgccggcgccaccggcggcaucaucggcggcaucaucgccgccaucaucgccaccgccgucgccgccaccggcauccucaucugccgccagcagcgcaaggagcagacccuccagggcgccgaggaggacgaggaccucgagggcccccccuccuacaagccccccacccccaaggccaagcucgaggcccaggagaugcccucccagcucuucacccucggcgccuccgagcacuccccccucaagacccccuacuucgacgccggcgccuccugcaccgagcaggagaugccccgcuaccacgagcuccccacccucgaggagcgcuccggcccccuccaccccggcgccaccucccucggcucccccauccccgucccccccggcccccccgccgucgaggacgucucccucgaccucgaggacgaggagggcgaggaggaggaggaguaccucgacaagaucaaccccaucuacgacgcccucuccuacuccucccccuccgacuccuaccagggcaagggcuucgucaugucccgcgccauguacgucuga

SEQ ID NO: 48370 - RNA, 1101 nt, Artificial Sequence
  derived and/or modified sequence opt2 from PVRL3__Homo_sapiens__NP_001230215
auggcccgcacccuccgccccuccccccucugccccggcggcggcaaggcccagcucuccuccgccucccuccucggcgccggccuccuccuccagccccccaccccccccccccuccuccuccuccucuucccccuccuccucuucucccgccucugcggcgcccucgccggccccaucaucgucgagccccacgucaccgccgucuggggcaagaacgucucccucaagugccucaucgaggucaacgagaccaucacccagaucuccugggagaagauccacggcaaguccucccagaccgucgccguccaccacccccaguacggcuucuccguccagggcgaguaccagggccgcguccucuucaagaacuacucccucaacgacgccaccaucacccuccacaacaucggcuucuccgacuccggcaaguacaucugcaaggccgucaccuucccccucggcaacgcccaguccuccaccaccgucaccguccucgucgagcccaccgucucccucaucaagggccccgacucccucaucgacggcggcaacgagaccgucgccgccaucugcaucgccgccaccggcaagcccgucgcccacaucgacugggagggcgaccucggcgagauggaguccaccaccaccuccuuccccaacgagaccgccaccaucaucucccaguacaagcucuuccccacccgcuucgcccgcggccgccgcaucaccugcgucgucaagcaccccgcccucgagaaggacauccgcuacuccuucauccucgacauccaguacgcccccgaggucuccgucaccggcuacgacggcaacugguucgucggccgcaagggcgucaaccucaagugcaacgccgacgccaaccccccccccuucaaguccgucuggucccgccucgacggccaguggcccgacggccuccucgccuccgacaacacccuccacuucguccacccccucaccuucaacuacuccggcgucuacaucugcaaggucaccaacucccucggccagcgcuccgaccagaaggucaucuacaucuccgccuacaacuccgucgccucccucaacugcuga

SEQ ID NO: 48371 - RNA, 1533 nt, Artificial Sequence
  derived and/or modified sequence opt2 from PVRL4__Homo_sapiens__NP_112178
augccccucucccucggcgccgagauguggggccccgaggccuggcuccuccuccuccuccuccucgccuccuucaccggccgcugccccgccggcgagcucgagaccuccgacgucgucaccgucguccucggccaggacgccaagcuccccugcuucuaccgcggcgacuccggcgagcaggucggccaggucgccugggcccgcgucgacgccggcgagggcgcccaggagcucgcccuccuccacuccaaguacggccuccacgucucccccgccuacgagggccgcgucgagcagcccccccccccccgcaacccccucgacggcuccguccuccuccgcaacgccguccaggccgacgagggcgaguacgagugccgcgucuccaccuuccccgccggcuccuuccaggcccgccuccgccuccgcguccucguccccccccuccccucccucaaccccggccccgcccucgaggagggccagggccucacccucgccgccuccugcaccgccgagggcucccccgcccccuccgucaccugggacaccgaggucaagggcaccaccuccucccgcuccuucaagcacucccgcuccgccgccgucaccuccgaguuccaccucguccccucccgcuccaugaacggccagccccucaccugcgucgucucccaccccggccuccuccaggaccagcgcaucacccacauccuccacgucuccuuccucgccgaggccuccguccgcggccucgaggaccagaaccucuggcacaucggccgcgagggcgccaugcucaagugccucuccgagggccagcccccccccuccuacaacuggacccgccucgacggcccccuccccuccggcguccgcgucgacggcgacacccucggcuuccccccccucaccaccgagcacuccggcaucuacgucugccacgucuccaacgaguucuccucccgcgacucccaggucaccgucgacguccucgacccccaggaggacuccggcaagcaggucgaccucgucuccgccuccgucgucgucgucggcgucaucgccgcccuccucuucugccuccucgucgucgucgucguccucaugucccgcuaccaccgccgcaaggcccagcagaugacccagaaguacgaggaggagcucacccucacccgcgagaacuccauccgccgccuccacucccaccacaccgacccccgcucccagcccgaggaguccgucggccuccgcgccgagggccaccccgacucccucaaggacaacuccuccugcuccgucauguccgaggagcccgagggccgcuccuacuccacccucaccaccguccgcgagaucgagacccagaccgagcuccucucccccggcuccggccgcgccgaggaggaggaggaccaggacgagggcaucaagcaggccaugaaccacuucguccaggagaacggcacccuccgcgccaagcccaccggcaacggcaucuacaucaacggccgcggccaccucgucuga

SEQ ID NO: 48372 - RNA, 2760 nt, Artificial Sequence
  derived and/or modified sequence opt2 from PWP2__Homo_sapiens__NP_005040
augaaguucgccuaccgcuucuccaaccuccucggcaccgucuaccgccgcggcaaccucaacuucaccugcgacggcaacuccgucaucucccccgucggcaaccgcgucaccgucuucgaccucaagaacaacaaguccgacacccucccccucgccacccgcuacaacgucaagugcgucggccucucccccgacggccgccucgccaucaucgucgacgagggcggcgacgcccuccucgucucccucgucugccgcuccguccuccaccacuuccacuucaagggcuccguccacuccgucuccuucucccccgacggccgcaaguucgucgucaccaagggcaacaucgcccagauguaccacgcccccggcaagaagcgcgaguucaacgccuucguccucgacaagaccuacuucggccccuacgacgagaccaccugcaucgacuggaccgacgacucccgcugcuucgucgucggcuccaaggacauguccaccugggucuucggcgccgagcgcugggacaaccucaucuacuacgcccucggcggccacaaggacgccaucgucgccugcuucuucgaguccaacucccucgaccucuacucccucucccaggacggcguccucugcauguggcagugcgacaccccccccgagggccuccgccucaagccccccgccggcuggaaggccgaccuccuccagcgcgaggaggaggaggaggaggaggaggaccaggagggcgaccgcgagaccaccauccgcggcaaggccacccccgccgaggaggagaagaccggcaaggucaaguacucccgccucgccaaguacuucuucaacaaggagggcgacuucaacaaccucaccgccgccgccuuccacaagaagucccaccuccucgucaccggcuucgccuccggcaucuuccaccuccacgagcuccccgaguucaaccucauccacucccucuccaucuccgaccaguccaucgccuccgucgccaucaacuccuccggcgacuggaucgccuucggcugcuccggccucggccagcuccucgucugggaguggcaguccgaguccuacguccucaagcagcagggccacuucaacuccauggucgcccucgccuacucccccgacggccaguacaucgucaccggcggcgacgacggcaaggucaaggucuggaacacccucuccggcuucugcuucgucaccuucaccgagcacuccuccggcgucaccggcgucaccuucaccgccaccggcuacgucgucgucaccuccuccauggacggcaccguccgcgccuucgaccuccaccgcuaccgcaacuuccgcaccuucaccuccccccgccccacccaguucuccugcgucgccgucgacgccuccggcgagaucgucuccgccggcgcccaggacuccuucgagaucuucgucugguccaugcagaccggccgccuccucgacguccucuccggccacgagggccccaucuccggccucugcuucaaccccaugaaguccguccucgccuccgccuccugggacaagaccguccgccucugggacauguucgacuccuggcgcaccaaggagacccucgcccucaccuccgacgcccucgccgucaccuuccgccccgacggcgccgagcucgccgucgccacccucaacucccagaucaccuucugggaccccgagaacgccguccagaccggcuccaucgagggccgccacgaccucaagaccggccgcaaggagcucgacaagaucaccgccaagcacgccgccaagggcaaggccuucaccgcccucugcuacuccgccgacggccacuccauccucgccggcggcauguccaaguucgucugcaucuaccacguccgcgagcagauccucaugaagcgcuucgagaucuccugcaaccucucccucgacgccauggaggaguuccucaaccgccgcaagaugaccgaguucggcaaccucgcccucaucgaccaggacgccggccaggaggacggcgucgccaucccccuccccggcguccgcaagggcgacauguccucccgccacuucaagcccgagauccgcgucaccucccuccgcuucucccccaccggccgcugcugggccgccaccaccaccgagggccuccucaucuacucccucgacacccgcguccucuucgaccccuucgagcucgacaccuccgucacccccggccgcguccgcgaggcccuccgccagcaggacuucacccgcgccauccucauggcccuccgccucaacgaguccaagcucguccaggaggcccucgaggccgucccccgcggcgagaucgaggucgucaccuccucccuccccgagcucuacgucgagaagguccucgaguuccucgccuccuccuucgaggucucccgccaccucgaguucuaccuccucuggacccacaagcuccucaugcuccacggccagaagcucaagucccgcgccggcacccuccuccccgucauccaguuccuccagaaguccauccagcgccaccucgacgaccucuccaagcucugcuccuggaaccacuacaacaugcaguacgcccucgccgucuccaagcagcgcggcaccaagcgcucccucgacccccucggcuccgaggaggaggccgaggccuccgaggacgacucccuccaccuccucggcggcggcggccgcgacuccgaggaggagaugcucgccuga

SEQ ID NO: 48373 - RNA, 1500 nt, Artificial Sequence
  derived and/or modified sequence opt2 from PWWP2B__Homo_sapiens__NP_001092107
auggagccccgcgccggcugccgccuccccguccgcgucgagcaggucgucaacggcgcccucgucgucaccgucuccugcggcgagcgcuccuucgccggcauccuccucgacugcaccaagaaguccggccucuucggccuccccccccucgccccccucccccaggucgacgagucccccgucaacgacucccacggccgcgcccccgaggagggcgacgccgaggucaugcagcucggcuccuccucccccccccccgcccgcggcguccagccccccgagaccacccgccccgagcccccccccccccucguccccccccuccccgccggcucccucccccccuacccccccuacuucgagggcgcccccuucccccacccccucuggcuccgcgacaccuacaagcucugggucccccagccccccccccgcaccaucaagcgcacccgccgccgccucucccgcaaccgcgaccccggccgccucauccucuccaccauccgccuccgcccccgccagguccucugcgagaagugcaaguccacccucuccccccccgaggccucccccggcccccccgccgccccccgcgcccgccgccgccucggcuccggccccgaccgcgagcuccgcaagcccgaggagcccgagaacggcgagcccaccgccgccgccaccgcccgccgcuccaagcgcgagcgccgcgaggaggaccgcgcccccgccgagcaggucccccgcucccccgucaucaagaucuccuacuccaccccccagggcaagggcgaggucgucaagauccccucccgcguccacggcucccucgagcccuuccgcccccagcaggccccccaggacgacggcucccaggaccccgagguccucgaccgcgagucccgcgaccgccccuccugcgcccccuccgccuccauccccaagcucaagcucacccgccccguccccgccggcgccgaccuccccccccccaagauccgccucaagccccaccgccucggcgacuccgagcacgagcccgucuaccgcgccgagcucgucggcgagcucaacggcuaccuccgcgacuccucccccgcccccugcgccgacggccccgccggcggccucgccgaccucuccuccggcuccuccggcgaggacgacgacuucaaguccugcccccagggcccccagggccgcgagggccucgccuuccucgucuccugccccgagggccgcgccgacugcgccuccgaguccgccugcuccuccgacucccucgacgaggcccgcuccuccggcuccgagggcacccccgccgacaccggcgaccucucccccggccacggcgccuccgcccccuccgucucccgcgaggcccgccagaccguccccccccucaccguccgccuccacacccaguccgucuccgagugcaucaccgaggacggccgcaccgucgccgucggcgacaucgucuggggccaccgccgcuga

SEQ ID NO: 48374 - RNA, 4440 nt, Artificial Sequence
  derived and/or modified sequence opt2 from PXDN__Homo_sapiens__NP_036425
auggccaagcgcucccgcggccccggccgccgcugccuccucgcccucguccucuucugcgccuggggcacccucgccgucgucgcccagaagcccggcgccggcugccccucccgcugccucugcuuccgcaccaccguccgcugcaugcaccuccuccucgaggccguccccgccgucgccccccagaccuccauccucgaccuccgcuucaaccgcauccgcgagauccagcccggcgccuuccgccgccuccgcaaccucaacacccuccuccucaacaacaaccagaucaagcgcauccccuccggcgccuucgaggaccucgagaaccucaaguaccucuaccucuacaagaacgagauccaguccaucgaccgccaggccuucaagggccucgccucccucgagcagcucuaccuccacuucaaccagaucgagacccucgaccccgacuccuuccagcaccuccccaagcucgagcgccucuuccuccacaacaaccgcaucacccaccucguccccggcaccuucaaccaccucgaguccaugaagcgccuccgccucgacuccaacacccuccacugcgacugcgagauccucuggcucgccgaccuccucaagaccuacgccgaguccggcaacgcccaggccgccgccaucugcgaguacccccgccgcauccagggccgcuccgucgccaccaucacccccgaggagcucaacugcgagcgcccccgcaucaccuccgagccccaggacgccgacgucaccuccggcaacaccgucuacuucaccugccgcgccgagggcaaccccaagcccgagaucaucuggcuccgcaacaacaacgagcucuccaugaagaccgacucccgccucaaccuccucgacgacggcacccucaugauccagaacacccaggagaccgaccagggcaucuaccagugcauggccaagaacgucgccggcgaggucaagacccaggaggucacccuccgcuacuucggcucccccgcccgccccaccuucgucauccagccccagaacaccgagguccucgucggcgaguccgucacccucgagugcuccgccaccggccacccccccccccgcaucuccuggacccgcggcgaccgcaccccccuccccgucgacccccgcgucaacaucacccccuccggcggccucuacauccagaacgucguccagggcgacuccggcgaguacgccugcuccgccaccaacaacaucgacuccguccacgccaccgccuucaucaucguccaggcccucccccaguucaccgucaccccccaggaccgcgucgucaucgagggccagaccgucgacuuccagugcgaggccaagggcaaccccccccccgucaucgccuggaccaagggcggcucccagcucuccgucgaccgccgccaccucguccucuccuccggcacccuccgcaucuccggcgucgcccuccacgaccagggccaguacgagugccaggccgucaacaucaucggcucccagaaggucgucgcccaccucaccguccagccccgcgucacccccgucuucgccuccauccccuccgacaccaccgucgaggucggcgccaacguccagcuccccugcuccucccagggcgagcccgagcccgccaucaccuggaacaaggacggcguccaggucaccgaguccggcaaguuccacaucucccccgagggcuuccucaccaucaacgacgucggccccgccgacgccggccgcuacgagugcgucgcccgcaacaccaucggcuccgccuccgucuccaugguccucuccgucaacguccccgacgucucccgcaacggcgaccccuucgucgccaccuccaucgucgaggccaucgccaccgucgaccgcgccaucaacuccacccgcacccaccucuucgacucccgcccccgcucccccaacgaccuccucgcccucuuccgcuacccccgcgaccccuacaccgucgagcaggcccgcgccggcgagaucuucgagcgcacccuccagcucauccaggagcacguccagcacggccucauggucgaccucaacggcaccuccuaccacuacaacgaccucgucuccccccaguaccucaaccucaucgccaaccucuccggcugcaccgcccaccgccgcgucaacaacugcuccgacaugugcuuccaccagaaguaccgcacccacgacggcaccugcaacaaccuccagcaccccauguggggcgccucccucaccgccuucgagcgccuccucaaguccgucuacgagaacggcuucaacaccccccgcggcaucaacccccaccgccucuacaacggccacgcccuccccaugccccgccucgucuccaccacccucaucggcaccgagaccgucacccccgacgagcaguucacccacaugcucaugcaguggggccaguuccucgaccacgaccucgacuccaccgucgucgcccucucccaggcccgcuucuccgacggccagcacugcuccaacgucugcuccaacgacccccccugcuucuccgucaugaucccccccaacgacucccgcgcccgcuccggcgcccgcugcauguucuucguccgcuccucccccgucugcggcuccggcaugaccucccuccucaugaacuccgucuacccccgcgagcagaucaaccagcucaccuccuacaucgacgccuccaacgucuacggcuccaccgagcacgaggcccgcuccauccgcgaccucgccucccaccgcggccuccuccgccagggcaucguccagcgcuccggcaagccccuccuccccuucgccaccggcccccccaccgagugcaugcgcgacgagaacgagucccccauccccugcuuccucgccggcgaccaccgcgccaacgagcagcucggccucaccuccaugcacacccucugguuccgcgagcacaaccgcaucgccaccgagcuccucaagcucaacccccacugggacggcgacaccaucuacuacgagacccgcaagaucgucggcgccgagauccagcacaucaccuaccagcacuggcuccccaagauccucggcgaggucggcaugcgcacccucggcgaguaccacggcuacgaccccggcaucaacgccggcaucuucaacgccuucgccaccgccgccuuccgcuucggccacacccucgucaacccccuccucuaccgccucgacgagaacuuccagcccaucgcccaggaccaccucccccuccacaaggccuucuucucccccuuccgcaucgucaacgagggcggcaucgacccccuccuccgcggccucuucggcgucgccggcaagaugcgcguccccucccagcuccucaacaccgagcucaccgagcgccucuucuccauggcccacaccgucgcccucgaccucgccgccaucaacauccagcgcggccgcgaccacggcaucccccccuaccacgacuaccgcgucuacugcaaccucuccgccgcccacaccuucgaggaccucaagaacgagaucaagaaccccgagauccgcgagaagcucaagcgccucuacggcuccacccucaacaucgaccucuuccccgcccucgucgucgaggaccucguccccggcucccgccucggccccacccucaugugccuccucuccacccaguucaagcgccuccgcgacggcgaccgccucugguacgagaaccccggcgucuucucccccgcccagcucacccagaucaagcagaccucccucgcccgcauccucugcgacaacgccgacaacaucacccgcguccaguccgacgucuuccgcgucgccgaguucccccacggcuacggcuccugcgacgagaucccccgcgucgaccuccgcgucuggcaggacugcugcgaggacugccgcacccgcggccaguucaacgccuucuccuaccacuuccgcggccgccgcucccucgaguucuccuaccaggaggacaagcccaccaagaagacccgcccccgcaagauccccuccgucggccgccagggcgagcaccucuccaacuccaccuccgccuucuccacccgcuccgacgccuccggcaccaacgacuuccgcgaguucguccucgagaugcagaagaccaucaccgaccuccgcacccagaucaagaagcucgagucccgccucuccaccaccgagugcgucgacgccggcggcgagucccacgccaacaacaccaaguggaagaaggacgccugcaccaucugcgagugcaaggacggccaggucaccugcuucgucgaggccugcccccccgccaccugcgccguccccgucaacauccccggcgccugcugccccgucugccuccagaagcgcgccgaggagaagcccuga

SEQ ID NO: 48375 - RNA, 4392 nt, Artificial Sequence
  derived and/or modified sequence opt2 from PXDNL__Homo_sapiens__NP_653252
auggagccccgccucuucugcuggaccacccucuuccuccucgccggcuggugccuccccggccuccccugccccucccgcugccucugcuucaaguccaccguccgcugcaugcaccucaugcucgaccacaucccccaggucccccagcagaccaccguccucgaccuccgcuucaaccgcauccgcgagauccccggcuccgccuucaagaagcucaagaaccucaacacccuccuccucaacaacaaccacauccgcaagaucucccgcaacgccuucgagggccucgagaaccuccucuaccucuaccucuacaagaacgagauccacgcccucgacaagcagaccuucaagggccucaucucccucgagcaccucuacauccacuucaaccagcucgagaugcuccagcccgagaccuucggcgaccuccuccgccucgagcgccucuuccuccacaacaacaagcucuccaagauccccgccggcuccuucuccaaccucgacucccucaagcgccuccgccucgacuccaacgcccucgucugcgacugcgaccucauguggcucggcgagcuccuccagggcuucgcccagcacggccacacccaggccgccgccaccugcgaguacccccgccgccuccacggccgcgccgucgccuccgucaccgucgaggaguucaacugccaguccccccgcaucaccuucgagccccaggacgucgagguccccuccggcaacaccgucuacuucaccugccgcgccgagggcaaccccaagcccgagaucaucuggauccacaacaaccacucccucgaccucgaggacgacacccgccucaacgucuucgacgacggcacccucaugauccgcaacacccgcgaguccgaccagggcgucuaccagugcauggcccgcaacuccgccggcgaggccaagacccaguccgccaugcuccgcuacuccucccuccccgccaagcccuccuucgucauccagccccaggacaccgagguccucaucggcaccuccaccacccucgagugcauggccaccggccacccccacccccucaucaccuggacccgcgacaacggccucgagcucgacggcucccgccacgucgccaccuccuccggccucuaccuccagaacaucacccagcgcgaccacggccgcuucaccugccacgccaacaacucccacggcaccguccaggccgccgccaacaucaucguccaggcccccccccaguucaccgucacccccaaggaccaggucguccucgaggagcacgccgucgaguggcucugcgaggccgacggcaaccccccccccgucaucgucuggaccaagaccggcggccagcuccccgucgagggccagcacaccguccucuccuccggcacccuccgcaucgaccgcgccgcccagcacgaccagggccaguacgagugccaggccgucuccucccucggcgucaagaaggucuccguccagcucaccgucaagcccaaggcccucgccgucuucacccagcucccccaggacaccuccgucgaggucggcaagaacaucaacaucuccugccacgcccagggcgagccccagcccaucaucaccuggaacaaggagggcguccagaucaccgaguccggcaaguuccacgucgacgacgagggcacccucaccaucuacgacgccggcuuccccgaccagggccgcuacgagugcgucgcccgcaacuccuucggccucgccgucaccaacauguuccucaccgucaccgccauccagggccgccaggccggcgacgacuucgucgaguccuccauccucgacgccguccagcgcgucgacuccgccaucaacuccacccgccgccaccucuucucccagaagccccacaccuccuccgaccuccucgcccaguuccacuacccccgcgacccccucaucgucgagauggcccgcgccggcgagaucuucgagcacacccuccagcucauccgcgagcgcgucaagcagggccucaccgucgaccucgagggcaaggaguuccgcuacaacgaccucgucuccccccgcucccucucccucaucgccaaccucuccggcugcaccgcccgccgcccccuccccaacugcuccaaccgcugcuuccacgccaaguaccgcgcccacgacggcaccugcaacaaccuccagcagcccaccuggggcgccgcccucaccgccuucgcccgccuccuccagcccgccuaccgcgacggcauccgcgccccccgcggccucggccuccccgucggcucccgccagccccucccccccccccgccucgucgccaccgucugggcccgcgccgccgccgucacccccgaccacuccuacacccgcaugcucaugcacuggggcugguuccucgagcacgaccucgaccacaccguccccgcccucuccaccgcccgcuucuccgacggccgccccugcuccuccgucugcaccaacgacccccccugcuuccccaugaacacccgccacgccgacccccgcggcacccacgcccccugcaugcucuucgcccgcuccucccccgccugcgccuccggccgccccuccgccaccgucgacuccgucuacgcccgcgagcagaucaaccagcagaccgccuacaucgacggcuccaacgucuacggcuccuccgagcgcgagucccaggcccuccgcgaccccuccgucccccgcggccuccucaagaccggcuuccccuggccccccuccggcaagccccuccuccccuucuccaccggcccccccaccgagugcgcccgccaggagcaggagucccccugcuuccucgccggcgaccaccgcgccaacgagcaccucgcccucgccgccaugcacacccucugguuccgcgagcacaaccgcgucgccaccgagcucuccgcccucaacccccacugggagggcaacaccgucuaccaggaggcccgcaagaucgucggcgccgagcuccagcacaucaccuacucccacuggcuccccaagguccucggcgaccccggcacccgcaugcuccgcggcuaccgcggcuacaaccccaacgucaacgccggcaucaucaacuccuucgccaccgccgccuuccgcuucggccacacccucaucaaccccauccucuaccgccucaacgccacccucggcgagaucuccgagggccaccuccccuuccacaaggcccucuucucccccucccgcaucaucaaggagggcggcaucgaccccguccuccgcggccucuucggcgucgccgccaaguggcgcgcccccuccuaccuccucucccccgagcucacccagcgccucuucuccgccgccuacuccgccgccgucgacuccgccgccaccaucauccagcgcggccgcgaccacggcaucccccccuacgucgacuuccgcgucuucugcaaccucaccuccgucaagaacuucgaggaccuccagaacgagaucaaggacuccgagauccgccagaagcuccgcaagcucuacggcucccccggcgacaucgaccucuggcccgcccucauggucgaggaccucauccccggcacccgcgucggccccacccucaugugccucuucgucacccaguuccagcgccuccgcgacggcgaccgcuucugguacgagaaccccggcgucuucacccccgcccagcucacccagcucaagcaggccucccucucccgcguccucugcgacaacggcgacuccauccagcagguccaggccgacgucuucgucaaggccgaguacccccaggacuaccucaacugcuccgagauccccaaggucgaccuccgcgucuggcaggacugcugcgccgacugccgcucccgcggccaguuccgcgccgucacccaggagucccagaagaagcgcuccgcccaguacuccuaccccgucgacaaggacauggagcucucccaccuccgcucccgccagcaggacaagaucuacgucggcgaggacgcccgcaacgucaccguccucgccaagaccaaguucucccaggacuucuccaccuucgccgccgagauccaggagaccaucaccgcccuccgcgagcagaucaacaagcucgaggcccgccuccgccaggccggcugcaccgacguccgcggcgucccccgcaaggccgaggagcgcuggaugaaggaggacugcacccacugcaucugcgaguccggccaggucaccugcgucgucgagaucugcccccccgcccccugccccucccccgagcucgucaagggcaccugcugccccgucugccgcgaccgcggcaugcccuccgacucccccgagaagcgcuga

SEQ ID NO: 48376 - RNA, 1638 nt, Artificial Sequence
  derived and/or modified sequence opt2 from PXK__Homo_sapiens__NP_001276025
auggccuucauggagaagccccccgccggcaagguccuccucgacgacaccgucccccucaccgccgccaucgaggccucccagucccuccagucccacaccaucgccggccucucccucccccucccccccaagaagcucaucggcaacauggaccgcgaguucaucgccgagcgccagaagggccuccagaacuaccucaacgucaucaccaccaaccacauccucuccaacugcgagcucgucaagaaguuccucgaccccaacaacuacuccgccaacuacaccgagaucgcccuccagcaggucuccauguucuuccgcuccgagcccaagugggaggucgucgagccccucaaggacaucggcuggcgcauccgcaagaaguacuuccucaugaagaucaagaaccagcccaaggagcgccucguccucuccugggccgaccucggccccgacaaguaccucuccgacaaggacuuccagugccucaucaagcuccuccccuccugccuccaccccuacaucuaccgcgucaccuucgccaccgccaacgaguccuccgcccuccucauccgcauguucaacgagaagggcacccucaaggaccucaucuacaaggccaagcccaaggaccccuuccucaagaaguacugcaaccccaagaagauccagggccucgagcuccagcagaucaagaccuacggccgccagauccucgagguccucaaguuccuccacgacaagggcuuccccuacggccaccuccacgccuccaacgucaugcucgacggcgacaccugccgccuccucgaccucgagaacucccuccucggccuccccuccuucuaccgcuccuacuucucccaguuccgcaagaucaacacccucgaguccgucgacguccacugcuucggccaccuccucuacgagaugaccuacggccgcccccccgacuccguccccgucgacuccuucccccccgcccccuccauggccgucgucgccguccucgaguccacccucuccugcgaggccugcaagaacggcaugcccaccaucucccgccuccuccagaugccccucuucuccgacguccuccucaccaccuccgagaagccccaguucaagauccccaccaagcucaaggaggcccuccgcaucgccaaggagugcaucgagaagcgccucaucgaggagcagaagcagauccaccagcaccgccgccucacccgcgcccagucccaccacggcuccgaggaggagcgcaagaagcgcaagauccucgcccgcaagaaguccaagcgcuccgcccucgagaacuccgaggagcacuccgccaaguacuccaacuccaacaacuccgccggcuccggcgccuccuccccccucaccucccccuccucccccaccccccccuccaccuccggcaucuccgcccucccccccccccccccccccccccccccccccgccgccccccucccccccgccuccaccgaggcccccgcccagcucuccucccaggccgucaacggcaugucccgcggcgcccuccucuccuccauccagaacuuccagaagggcacccuccgcaaggccaagaccugcgaccacuccgcccccaagaucggcuga

SEQ ID NO: 48377 - RNA, 588 nt, Artificial Sequence
  derived and/or modified sequence opt2 from PXMP2__Homo_sapiens__NP_061133
auggcccccgccgccucccgccuccgcgccgaggccggccucggcgcccucccccgccgcgcccucgcccaguaccuccucuuccuccgccucuaccccguccucaccaaggccgccaccuccggcauccucuccgcccucggcaacuuccucgcccagaugaucgagaagaagcgcaagaaggagaacucccgcucccucgacgucggcggcccccuccgcuacgccgucuacggcuucuucuucaccggcccccucucccacuucuucuacuucuucauggagcacuggaucccccccgaggucccccucgccggccuccgccgccuccuccucgaccgccucgucuucgcccccgccuuccucaugcucuucuuccucaucaugaacuuccucgagggcaaggacgccuccgccuucgccgccaagaugcgcggcggcuucuggcccgcccuccgcaugaacuggcgcgucuggaccccccuccaguucaucaacaucaacuacgucccccucaaguuccgcguccucuucgccaaccucgccgcccucuucugguacgccuaccucgccucccucggcaaguga

SEQ ID NO: 48378 - RNA, 1776 nt, Artificial Sequence
  derived and/or modified sequence opt2 from PXN__Homo_sapiens__NP_001074324
auggacgaccucgacgcccuccucgccgaccucgaguccaccaccucccacaucuccaagcgccccgucuuccucuccgaggagacccccuacuccuaccccaccggcaaccacaccuaccaggagaucgccguccccccccccgucccccccccccccuccuccgaggcccucaacggcaccauccucgacccccucgaccaguggcagcccuccuccucccgcuucauccaccagcagccccaguccuccucccccgucuacggcuccuccgccaagaccuccuccgucuccaacccccaggacuccgucggcucccccugcucccgcgucggcgaggaggagcacgucuacuccuuccccaacaagcagaaguccgccgagcccucccccaccgucauguccaccucccucggcuccaaccucuccgagcucgaccgccuccuccucgagcucaacgccguccagcacaacccccccggcuuccccgccgacgaggccaacuccucccccccccuccccggcgcccucuccccccucuacggcguccccgagaccaacuccccccucggcggcaaggccggcccccucaccaaggagaagcccaagcgcaacggcggccgcggccucgaggacguccgccccuccgucgagucccuccucgacgagcucgaguccuccguccccucccccguccccgccaucaccgucaaccagggcgagauguccuccccccagcgcgucaccuccacccagcagcagacccgcaucuccgccuccuccgccacccgcgagcucgacgagcucauggccucccucuccgacuucaagauccagggccucgagcagcgcgccgacggcgagcgcugcugggccgccggcuggccccgcgacggcggccgcuccucccccggcggccaggacgagggcggcuucauggcccagggcaagaccggcuccuccuccccccccggcggcccccccaagcccggcucccagcucgacuccaugcucggcucccuccaguccgaccucaacaagcucggcgucgccaccgucgccaagggcgucugcggcgccugcaagaagcccaucgccggccaggucgucaccgccaugggcaagaccuggcaccccgagcacuucgucugcacccacugccaggaggagaucggcucccgcaacuucuucgagcgcgacggccagcccuacugcgagaaggacuaccacaaccucuucuccccccgcugcuacuacugcaacggccccauccucgacaaggucgucaccgcccucgaccgcaccuggcaccccgagcacuucuucugcgcccagugcggcgccuucuucggccccgagggcuuccacgagaaggacggcaaggccuacugccgcaaggacuacuucgacauguucgcccccaagugcggcggcugcgcccgcgccauccucgagaacuacaucuccgcccucaacacccucuggcaccccgagugcuucgucugccgcgagugcuucacccccuucgucaacggcuccuucuucgagcacgacggccagcccuacugcgagguccacuaccacgagcgccgcggcucccucugcuccggcugccagaagcccaucaccggccgcugcaucaccgccauggccaagaaguuccaccccgagcacuucgucugcgccuucugccucaagcagcucaacaagggcaccuucaaggagcagaacgacaagcccuacugccagaacugcuuccucaagcucuucugcuga

SEQ ID NO: 48379 - RNA, 420 nt, Artificial Sequence
  derived and/or modified sequence opt2 from PXT1__Homo_sapiens__XP_011512702
augaagggcaagaacaugaagaagaagcacgacggcaucgucuacgagaccaaggagguccucaaccccucccccaaggucacccacugcugcaagucccucuggcucaaguacuccuuccagaaggccuacaugacccagcucgucuccucccagcccguccccgccaugucccgcaaccccgaccacaaccuccucucccagcccaaggagcacuccaucguccagaagcaccaccaggaggagaucauccacaagcucgccaugcagcuccgccacaucggcgacaacaucgaccaccgcaugguccgcgaggaccuccagcaggacggccgcgacgcccucgaccacuucgucuucuucuucuuccgccgcguccagguccuccuccacuucuucuggaacaaccaccuccucuga

SEQ ID NO: 48380 - RNA, 588 nt, Artificial Sequence
  derived and/or modified sequence opt2 from PYCARD__Homo_sapiens__NP_037390
augggccgcgcccgcgacgccauccucgacgcccucgagaaccucaccgccgaggagcucaagaaguucaagcucaagcuccucuccgucccccuccgcgagggcuacggccgcaucccccgcggcgcccuccucuccauggacgcccucgaccucaccgacaagcucgucuccuucuaccucgagaccuacggcgccgagcucaccgccaacguccuccgcgacaugggccuccaggagauggccggccagcuccaggccgccacccaccagggcuccggcgccgcccccgccggcauccaggcccccccccaguccgccgccaagcccggccuccacuucaucgaccagcaccgcgccgcccucaucgcccgcgucaccaacgucgaguggcuccucgacgcccucuacggcaagguccucaccgacgagcaguaccaggccguccgcgccgagcccaccaaccccuccaagaugcgcaagcucuucuccuucacccccgccuggaacuggaccugcaaggaccuccuccuccaggcccuccgcgagucccaguccuaccucgucgaggaccucgagcgcuccuga

SEQ ID NO: 48381 - RNA, 867 nt, Artificial Sequence
  derived and/or modified sequence opt2 from PYCR1__Homo_sapiens__NP_001269208
auguccgucggcuucaucggcgccggccagcucgccuucgcccucgccaagggcuucaccgccgccggcguccucgccgcccacaagaucauggccuccucccccgacauggaccucgccaccgucuccgcccuccgcaagaugggcgucaagcucaccccccacaacaaggagaccguccagcacuccgacguccucuuccucgccgucaagccccacaucauccccuucauccucgacgagaucggcgccgacaucgaggaccgccacaucgucgucuccugcgccgccggcgucaccaucuccuccaucgagaagaagcucuccgccuuccgccccgccccccgcgucauccgcugcaugaccaacacccccgucgucguccgcgagggcgccaccgucuacgccaccggcacccacgcccaggucgaggacggccgccucauggagcagcuccucuccuccgucggcuucugcaccgaggucgaggaggaccucaucgacgccgucaccggccucuccggcuccggccccgccuacggcgccgccaagaugcuccuccacuccgagcagcaccccggccagcucaaggacaacgucuccucccccggcggcgccaccauccacgcccuccacguccucgaguccggcggcuuccgcucccuccucaucaacgccgucgaggccuccugcauccgcacccgcgagcuccaguccauggccgaccaggagcaggucucccccgccgccaucaagaagaccauccucgacaaggucaagcucgacucccccgccggcaccgcccucucccccuccggccacaccaagcuccucccccgcucccucgcccccgccggcaaggacuga

SEQ ID NO: 48382 - RNA, 270 nt, Artificial Sequence
  derived and/or modified sequence opt2 from PYDC1__Homo_sapiens__NP_690865
augggcaccaagcgcgaggccauccucaagguccucgagaaccucacccccgaggagcucaagaaguucaagaugaagcucggcaccgucccccuccgcgagggcuucgagcgcaucccccgcggcgcccucggccagcucgacaucgucgaccucaccgacaagcucgucgccuccuacuacgaggacuacgccgccgagcucgucgucgccguccuccgcgacaugcgcaugcucgaggaggccgcccgccuccagcgcgccgccuga

SEQ ID NO: 48383 - RNA, 294 nt, Artificial Sequence
  derived and/or modified sequence opt2 from PYDC2__Homo_sapiens__NP_001076777
auggccuccuccgccgagcucgacuucaaccuccaggcccuccucgagcagcucucccaggacgagcucuccaaguucaagucccucauccgcaccaucucccucggcaaggagcuccagaccgucccccagaccgaggucgacaaggccaacggcaagcagcucgucgagaucuucaccucccacuccugcuccuacugggccggcauggccgccauccaggucuucgagaagaugaaccagacccaccucuccggccgcgccgacgagcacugcgucaugcccccccccuga

SEQ ID NO: 48384 - RNA, 2532 nt, Artificial Sequence
  derived and/or modified sequence opt2 from PYGB__Homo_sapiens__NP_002853
auggccaagccccucaccgacuccgagaagcgcaagcagaucuccguccgcggccucgccggccucggcgacgucgccgagguccgcaaguccuucaaccgccaccuccacuucacccucgucaaggaccgcaacgucgccaccccccgcgacuacuucuucgcccucgcccacaccguccgcgaccaccucgucggccgcuggauccgcacccagcagcacuacuacgagcgcgaccccaagcgcaucuacuaccucucccucgaguucuacaugggccgcacccuccagaacaccauggucaaccucggccuccagaacgccugcgacgaggccaucuaccagcucggccucgaccucgaggagcucgaggagaucgaggaggacgccggccucggcaacggcggccucggccgccucgccgccugcuuccucgacuccauggccacccucggccucgccgccuacggcuacggcauccgcuacgaguucggcaucuucaaccagaagaucgucaacggcuggcaggucgaggaggccgacgacuggcuccgcuacggcaaccccugggagaaggcccgccccgaguacaugcuccccguccacuucuacggccgcgucgagcacacccccgacggcgucaaguggcucgacacccaggucguccucgccaugcccuacgacacccccguccccggcuacaagaacaacaccgucaacaccaugcgccucugguccgccaaggcccccaacgacuucaagcuccaggacuucaacgucggcgacuacaucgaggccguccucgaccgcaaccucgccgagaacaucucccgcguccucuaccccaacgacaacuucuucgagggcaaggagcuccgccucaagcaggaguacuucgucgucgccgccacccuccaggacaucauccgccgcuucaaguccuccaaguucggcugccgcgaccccguccgcaccugcuucgagaccuuccccgacaaggucgccauccagcucaacgacacccaccccgcccucuccauccccgagcucaugcgcauccucgucgacgucgagaaggucgacugggacaaggccugggagaucaccaagaagaccugcgccuacaccaaccacaccguccuccccgaggcccucgagcgcuggcccgucuccauguucgagaagcuccucccccgccaccucgagaucaucuacgccaucaaccagcgccaccucgaccacgucgccgcccucuuccccggcgacgucgaccgccuccgccgcauguccgucaucgaggagggcgacugcaagcgcaucaacauggcccaccucugcgucaucggcucccacgccgucaacggcgucgcccgcauccacuccgagaucgucaagcaguccgucuucaaggacuucuacgagcucgagcccgagaaguuccagaacaagaccaacggcaucaccccccgccgcuggcuccuccucugcaaccccggccucgccgacaccaucgucgagaagaucggcgaggaguuccucaccgaccucucccagcucaagaagcuccucccccucgucuccgacgaggucuucauccgcgacgucgccaaggucaagcaggagaacaagcucaaguucuccgccuuccucgagaaggaguacaaggucaagaucaaccccuccuccauguucgacguccacgucaagcgcauccacgaguacaagcgccagcuccucaacugccuccacgucgucacccucuacaaccgcaucaagcgcgaccccgccaaggccuucgucccccgcaccgucaugaucggcggcaaggccgcccccggcuaccacauggccaagcucaucaucaagcucgucaccuccaucggcgacgucgucaaccacgaccccgucgucggcgaccgccucaaggucaucuuccucgagaacuaccgcgucucccucgccgagaaggucauccccgccgccgaccucucccagcagaucuccaccgccggcaccgaggccuccggcaccggcaacaugaaguucaugcucaacggcgcccucaccaucggcaccauggacggcgccaacgucgagauggccgaggaggccggcgccgagaaccucuucaucuucggccuccgcgucgaggacgucgaggcccucgaccgcaagggcuacaacgcccgcgaguacuacgaccaccuccccgagcucaagcaggccgucgaccagaucuccuccggcuucuucucccccaaggagcccgacugcuucaaggacaucgucaacaugcucaugcaccacgaccgcuucaaggucuucgccgacuacgaggccuacaugcagugccaggcccaggucgaccagcucuaccgcaaccccaaggaguggaccaagaaggucauccgcaacaucgccugcuccggcaaguucuccuccgaccgcaccaucaccgaguacgcccgcgagaucuggggcgucgagcccuccgaccuccagauccccccccccaacaucccccgcgacuga

SEQ ID NO: 48385 - RNA, 2442 nt, Artificial Sequence
  derived and/or modified sequence opt2 from PYGL__Homo_sapiens__NP_001157412
auggccaagccccucaccgaccaggagaagcgccgccagaucuccauccgcggcaucgucggcgucgagaacgucgccgagcucaagaaguccuucaaccgccaccuccacuucacccucgucaaggaccgcaacgucgccaccacccgcgacuacuacuucgcccucgcccacaccguccgcgaccaccucgucggccgcuggauccgcacccagcagcacuacuacgacaagugccccaagcucggccucgacaucgaggagcucgaggagaucgaggaggacgccggccucggcaacggcggccucggccgccucgccgccugcuuccucgacuccauggccacccucggccucgccgccuacggcuacggcauccgcuacgaguacggcaucuucaaccagaagauccgcgacggcuggcaggucgaggaggccgacgacuggcuccgcuacggcaaccccugggagaagucccgccccgaguucaugcuccccguccacuucuacggcaaggucgagcacaccaacaccggcaccaaguggaucgacacccaggucguccucgcccuccccuacgacacccccguccccggcuacaugaacaacaccgucaacaccaugcgccucugguccgcccgcgcccccaacgacuucaaccuccgcgacuucaacgucggcgacuacauccaggccguccucgaccgcaaccucgccgagaacaucucccgcguccucuaccccaacgacaacuucuucgagggcaaggagcuccgccucaagcaggaguacuucgucgucgccgccacccuccaggacaucauccgccgcuucaaggccuccaaguucggcuccacccgcggcgccggcaccgucuucgacgccuuccccgaccaggucgccauccagcucaacgacacccaccccgcccucgccauccccgagcucaugcgcaucuucgucgacaucgagaagcuccccugguccaaggccugggagcucacccagaagaccuucgccuacaccaaccacaccguccuccccgaggcccucgagcgcuggcccgucgaccucgucgagaagcuccucccccgccaccucgagaucaucuacgagaucaaccagaagcaccucgaccgcaucgucgcccucuuccccaaggacgucgaccgccuccgccgcaugucccucaucgaggaggagggcuccaagcgcaucaacauggcccaccucugcaucgucggcucccacgccgucaacggcgucgccaagauccacuccgacaucgucaagaccaaggucuucaaggacuucuccgagcucgagcccgacaaguuccagaacaagaccaacggcaucaccccccgccgcuggcuccuccucugcaaccccggccucgccgagcucaucgccgagaagaucggcgaggacuacgucaaggaccucucccagcucaccaagcuccacuccuuccucggcgacgacgucuuccuccgcgagcucgccaaggucaagcaggagaacaagcucaaguucucccaguuccucgagaccgaguacaaggucaagaucaaccccuccuccauguucgacguccaggucaagcgcauccacgaguacaagcgccagcuccucaacugccuccacgucaucaccauguacaaccgcaucaagaaggaccccaagaagcucuucgucccccgcaccgucaucaucggcggcaaggccgcccccggcuaccacauggccaagaugaucaucaagcucaucaccuccgucgccgacgucgucaacaacgaccccauggucggcuccaagcucaaggucaucuuccucgagaacuaccgcgucucccucgccgagaaggucauccccgccaccgaccucuccgagcagaucuccaccgccggcaccgaggccuccggcaccggcaacaugaaguucaugcucaacggcgcccucaccaucggcaccauggacggcgccaacgucgagauggccgaggaggccggcgaggagaaccucuucaucuucggcaugcgcaucgacgacgucgccgcccucgacaagaagggcuacgaggccaaggaguacuacgaggcccuccccgagcucaagcucgucaucgaccagaucgacaacggcuucuucucccccaagcagcccgaccucuucaaggacaucaucaacaugcucuucuaccacgaccgcuucaaggucuucgccgacuacgaggccuacgucaagugccaggacaaggucucccagcucuacaugaaccccaaggccuggaacaccaugguccucaagaacaucgccgccuccggcaaguucuccuccgaccgcaccaucaaggaguacgcccagaacaucuggaacgucgagcccuccgaccucaagaucucccucuccaacgaguccaacaaggucaacggcaacuga

SEQ ID NO: 48386 - RNA, 2265 nt, Artificial Sequence
  derived and/or modified sequence opt2 from PYGM__Homo_sapiens__NP_001158188
augucccgcccccucuccgaccaggagaagcgcaagcagaucuccguccgcggccucgccggcgucgagaacgucaccgagcucaagaagaacuucaaccgccaccuccacuucacccucgucaaggaccgcaacgucgccaccccccgcgacuacuacuucgcccucgcccacaccguccgcgaccaccucgucggccgcuggauccgcacccagcagcacuacuacgagaaggaccccaagaagaucuccggcggcuggcagauggaggaggccgacgacuggcuccgcuacggcaaccccugggagaaggcccgccccgaguucacccuccccguccacuucuacggccacgucgagcacaccucccagggcgccaagugggucgacacccaggucguccucgccaugcccuacgacacccccguccccggcuaccgcaacaacgucgucaacaccaugcgccucugguccgccaaggcccccaacgacuucaaccucaaggacuucaacgucggcggcuacauccaggccguccucgaccgcaaccucgccgagaacaucucccgcguccucuaccccaacgacaacuucuucgagggcaaggagcuccgccucaagcaggaguacuucgucgucgccgccacccuccaggacaucauccgccgcuucaaguccuccaaguucggcugccgcgaccccguccgcaccaacuucgacgccuuccccgacaaggucgccauccagcucaacgacacccaccccucccucgccauccccgagcucaugcgcauccucgucgaccucgagcgcauggacugggacaaggccugggacgucaccguccgcaccugcgccuacaccaaccacaccguccuccccgaggcccucgagcgcuggcccguccaccuccucgagacccuccucccccgccaccuccagaucaucuacgagaucaaccagcgcuuccucaaccgcgucgccgccgccuuccccggcgacgucgaccgccuccgccgcaugucccucgucgaggagggcgccgucaagcgcaucaacauggcccaccucugcaucgccggcucccacgccgucaacggcgucgcccgcauccacuccgagauccucaagaagaccaucuucaaggacuucuacgagcucgagccccacaaguuccagaacaagaccaacggcaucaccccccgccgcuggcucguccucugcaaccccggccucgccgaggucaucgccgagcgcaucggcgaggacuucaucuccgaccucgaccagcuccgcaagcuccucuccuucgucgacgacgaggccuucauccgcgacgucgccaaggucaagcaggagaacaagcucaaguucgccgccuaccucgagcgcgaguacaagguccacaucaaccccaacucccucuucgacauccaggucaagcgcauccacgaguacaagcgccagcuccucaacugccuccacgucaucacccucuacaaccgcaucaagcgcgagcccaacaaguucuucgucccccgcaccgucaugaucggcggcaaggccgcccccggcuaccacauggccaagaugaucauccgccucgucaccgccaucggcgacgucgucaaccacgaccccgccgucggcgaccgccuccgcgucaucuuccucgagaacuaccgcgucucccucgccgagaaggucauccccgccgccgaccucuccgagcagaucuccaccgccggcaccgaggccuccggcaccggcaacaugaaguucaugcucaacggcgcccucaccaucggcaccauggacggcgccaacgucgagauggccgaggaggccggcgaggagaacuucuucaucuucggcaugcgcgucgaggacgucgacaagcucgaccagcgcggcuacaacgcccaggaguacuacgaccgcauccccgagcuccgccaggucaucgagcagcucuccuccggcuucuucucccccaagcagcccgaccucuucaaggacaucgucaacaugcucaugcaccacgaccgcuucaaggucuucgccgacuacgaggacuacaucaagugccaggagaaggucuccgcccucuacaagaacccccgcgaguggacccgcauggucauccgcaacaucgccaccuccggcaaguucuccuccgaccgcaccaucgcccaguacgcccgcgagaucuggggcgucgagcccucccgccagcgccuccccgcccccgacgaggccaucuga

SEQ ID NO: 48387 - RNA, 1260 nt, Artificial Sequence
  derived and/or modified sequence opt2 from PYGO1__Homo_sapiens__NP_056432
augcccgccgagaacucccccgcccccgccuacaaggucuccucccacggcggcgacuccggccucgacggccucggcggccccggcguccagcucggcucccccgacaagaagaagcgcaaggccaacacccagggccccuccuuccccccccucuccgaguacgcccccccccccaaccccaacuccgaccaccucgucgccgccaaccccuucgacgacaacuacaacaccaucuccuacaagccccuccccuccuccaaccccuaccucggccccggcuaccccggcuucggcggcuacuccaccuuccgcaugcccccccacguccccccccgcauguccucccccuacugcggccccuacucccuccgcaaccagccccaccccuucccccagaacccccucggcaugggcuucaaccgcccccacgccuucaacuucggcccccacgacaacuccuccuucggcaaccccuccuacaacaacgcccucucccagaacgucaacaugcccaaccagcacuuccgccagaaccccgccgagaacuucucccagauccccccccagaacgccucccaggucuccaaccccgaccucgccuccaacuucguccccggcaacaacuccaacuucaccuccccccucgaguccaaccacuccuucauccccccccccaacaccuucggccaggccaaggcccccccccccaagcaggacuucacccagggcgccaccaagaacaccaaccagaacuccuccgcccaccccccccaccucaacauggacgacaccgucaaccaguccaacaucgagcucaagaacgucaaccgcaacaacgccgucaaccaggagaacucccgcuccuccuccaccgaggccaccaacaacaaccccgccaacggcacccagaacaagccccgccagccccgcggcgccgccgacgccugcaccaccgagaaguccaacaaguccucccuccaccccaaccgccacggccacuccuccuccgaccccgucuaccccugcggcaucugcaccaacgaggucaacgacgaccaggacgccauccucugcgaggccuccugccagaagugguuccaccgcaucugcaccggcaugaccgagaccgccuacggccuccucaccgccgaggccuccgccgucuggggcugcgacaccugcauggccgacaaggacguccagcucaugcgcacccgcgagaccuucggccccuccgccgucggcuccgacgccuga

SEQ ID NO: 48388 - RNA, 1221 nt, Artificial Sequence
  derived and/or modified sequence opt2 from PYGO2__Homo_sapiens__NP_612157
auggccgccuccgccccccccccccccgacaagcucgagggcggcggcggccccgcccccccccccgccccccccuccaccggccgcaagcagggcaaggccggccuccagaugaagucccccgagaagaagcgccgcaaguccaacacccagggccccgccuacucccaccucaccgaguucgcccccccccccacccccauggucgaccaccucgucgccuccaaccccuucgaggacgacuucggcgcccccaaggucggcgucgccgccccccccuuccucggcucccccguccccuucggcggcuuccgcguccagggcggcauggccggccaggucccccccggcuacuccaccggcggcggcggcggcccccagccccuccgccgccagcccccccccuucccccccaaccccaugggccccgccuucaacaugcccccccagggccccggcuaccccccccccggcaacaugaacuuccccucccagcccuucaaccagccccucggccagaacuucuccccccccuccggccagaugaugcccggccccgucggcggcuucggccccaugaucucccccaccaugggccagcccccccgcgccgagcucggcccccccucccucucccagcgcuucgcccagcccggcgcccccuucggccccuccccccuccagcgccccggccagggccuccccucccucccccccaacaccucccccuuccccggccccgaccccggcuuccccggccccggcggcgaggacggcggcaagccccucaacccccccgccuccaccgccuucccccaggagccccacuccggcucccccgccgccgccgucaacggcaaccagcccuccuucccccccaacuccuccggccgcggcggcggcacccccgacgccaacucccucgccccccccggcaaggccggcggcggcuccggcccccagcccccccccggccucgucuaccccugcggcgccugccgcuccgaggucaacgacgaccaggacgccauccucugcgaggccuccugccagaagugguuccaccgcgagugcaccggcaugaccgaguccgccuacggccuccucaccaccgaggccuccgccgucugggccugcgaccucugccucaagaccaaggagauccaguccgucuacauccgcgagggcaugggccagcucgucgccgccaacgacggcuga

SEQ ID NO: 48389 - RNA, 1479 nt, Artificial Sequence
  derived and/or modified sequence opt2 from PYHIN1__Homo_sapiens__NP_689714
auggccaacaacuacaagaagaucguccuccucaagggccucgaggucaucaacgacuaccacuuccgcaucgucaagucccuccucuccaacgaccucaagcucaaccccaagaugaaggaggaguacgacaagauccagaucgccgaccucauggaggagaaguuccccggcgacgccggccucggcaagcucaucgaguucuucaaggagauccccacccucggcgaccucgccgagacccucaagcgcgagaagcucaaggucgccaacaagaucgaguccauccccgucaagggcaucauccccuccaagaagaccaagcagaaggaggucuaccccgccacccccgccugcacccccuccaaccgccucaccgccaagggcgccgaggagacccucggcccccagaagcgcaagaagcccuccgaggaggagaccggcaccaagcgcuccaagauguccaaggagcagacccgccccuccugcuccgccggcgccuccaccuccaccgccaugggccgcuccccccccccccagaccuccuccuccgccccccccaacaccuccuccaccgagucccucaagccccucgccaaccgccacgccaccgccuccaagaacaucuuccgcgaggaccccaucaucgccaugguccucaacgccaccaaggucuucaaguacgaguccuccgagaacgagcagcgccgcauguuccacgccaccgucgccacccagacccaguucuuccacgucaagguccucaacaucaaccucaagcgcaaguucaucaagaagcgcaucaucaucaucuccaacuacuccaagcgcaacucccuccucgaggucaacgaggccuccuccgucuccgaggccggccccgaccagaccuucgagguccccaaggacaucauccgccgcgccaagaagauccccaagaucaacauccuccacaagcagaccuccggcuacaucgucuacggccucuucaugcuccacaccaagaucgucaaccgcaagaccaccaucuacgagauccaggacaagaccggcuccauggccgucgucggcaagggcgagugccacaacauccccugcgagaagggcgacaagcuccgccucuucugcuuccgccuccgcaagcgcgagaacauguccaagcucauguccgagaugcacuccuucauccagauccagaagaacaccaaccagcgcucccacgacucccgcuccauggcccucccccaggagcagucccagcaccccaagcccuccgaggccuccaccacccuccccgagucccaccucaagaccccccagaugccccccaccacccccuccuccuccuccuucaccaagaaggacgagacccaccccggcgcccaguccucccccgccaacuuccgcaucaccucccccaccgucgcccccccccucuccuccgacaccuccaccaaccgccaccccgccguccccuga

SEQ ID NO: 48390 - RNA, 1503 nt, Artificial Sequence
  derived and/or modified sequence opt2 from PYROXD1__Homo_sapiens__NP_079130
auggaggccgcccgccccccccccaccgccggcaaguucgucgucgucggcggcggcaucgccggcgucaccugcgccgagcagcucgccacccacuuccccuccgaggacauccuccucgucaccgccucccccgucaucaaggccgucaccaacuucaagcagaucuccaagauccucgaggaguucgacgucgaggagcaguccuccaccaugcucggcaagcgcuuccccaacaucaaggucaucgaguccggcgucaagcagcucaaguccgaggagcacugcaucgucaccgaggacggcaaccagcacgucuacaagaagcucugccucugcgccggcgccaagcccaagcucaucugcgagggcaaccccuacguccucggcauccgcgacaccgacuccgcccaggaguuccagaagcagcucaccaaggccaagcgcaucaugaucaucggcaacggcggcaucgcccucgagcucgucuacgagaucgagggcugcgaggucaucugggccaucaaggacaaggccaucggcaacaccuucuucgacgccggcgccgccgaguuccucaccuccaagcucaucgccgagaaguccgaggccaagaucgcccacaagcgcacccgcuacaccaccgagggccgcaagaaggaggcccgcuccaaguccaaggccgacaacgucggcuccgcccucggccccgacuggcacgagggccucaaccucaagggcaccaaggaguucucccacaagauccaccucgagaccaugugcgaggucaagaagaucuaccuccaggacgaguuccgcauccucaagaagaaguccuucaccuucccccgcgaccacaaguccgucaccgccgacaccgagauguggcccgucuacgucgagcucaccaacgagaagaucuacggcugcgacuucaucgucuccgccaccggcgucacccccaacgucgagcccuuccuccacggcaacuccuucgaccucggcgaggacggcggccucaaggucgacgaccacaugcacaccucccuccccgacaucuacgccgccggcgacaucugcaccaccuccuggcagcucucccccgucuggcagcagaugcgccucuggacccaggcccgccagaugggcugguacgccgccaagugcauggccgccgccuccuccggcgacuccaucgacauggacuucuccuucgagcucuucgcccacgucaccaaguucuucaacuacaaggucguccuccucggcaaguacaacgcccagggccucggcuccgaccacgagcucaugcuccgcugcaccaagggccgcgaguacaucaaggucgucaugcagaacggccgcaugaugggcgccguccucaucggcgagaccgaccucgaggagaccuucgagaaccucauccucaaccagaugaaccucuccuccuacggcgaggaccuccucgaccccaacaucgacaucgaggacuacuucgacuga

SEQ ID NO: 48391 - RNA, 294 nt, Artificial Sequence
  derived and/or modified sequence opt2 from PYY__Homo_sapiens__NP_004151
auggucuucguccgccgccccuggcccgcccucaccaccguccuccucgcccuccucgucugccucggcgcccucgucgacgccuaccccaucaagcccgaggcccccggcgaggacgccucccccgaggagcucaaccgcuacuacgccucccuccgccacuaccucaaccucgucacccgccagcgcuacggcaagcgcgacggccccgacacccuccucuccaagaccuucuuccccgacggcgaggaccgccccguccgcucccgcuccgagggccccgaccucugguga

SEQ ID NO: 48392 - RNA, 4449 nt, Artificial Sequence
  derived and/or modified sequence opt2 from PZP__Homo_sapiens__NP_002855
augcgcaaggaccgccuccuccaccucugccucguccuccuccucauccuccucuccgccuccgacuccaacuccaccgagccccaguacaugguccucguccccucccuccuccacaccgaggcccccaagaagggcugcguccuccucucccaccucaacgagaccgucaccgucuccgccucccucgaguccggccgcgagaaccgcucccucuucaccgaccucgucgccgagaaggaccucuuccacugcgucuccuucacccucccccgcaucuccgccuccuccgaggucgccuuccucuccauccagaucaagggccccacccaggacuuccgcaagcgcaacaccguccucguccucaacacccagucccucgucuucguccagaccgacaagcccauguacaagcccggccagaccguccgcuuccgcgucgucuccgucgacgagaacuuccgcccccgcaacgagcucaucccccucaucuaccucgagaacccccgccgcaaccgcaucgcccaguggcagucccucaagcucgaggccggcaucaaccagcucuccuucccccucuccuccgagcccauccagggcuccuaccgcgucgucguccagaccgaguccggcggccgcauccagcaccccuucaccgucgaggaguucguccuccccaaguucgaggucaagguccagguccccaagaucaucuccaucauggacgagaaggucaacaucaccgucugcggcgaguacaccuacggcaagcccguccccggccucgccaccgucucccucugccgcaagcucucccgcguccucaacugcgacaagcaggaggucugcgaggaguucucccagcagcucaacuccaacggcugcaucacccagcagguccacaccaagaugcuccagaucaccaacaccggcuucgagaugaagcuccgcgucgaggcccgcauccgcgaggagggcaccgaccucgaggucaccgccaaccgcaucuccgagaucaccaacaucgucuccaagcucaaguucgucaaggucgacucccacuuccgccagggcauccccuucuucgcccagguccuccucgucgacggcaagggcguccccauccccaacaagcucuucuucaucuccgucaacgacgccaacuacuacuccaacgccaccaccaacgagcagggccucgcccaguucuccaucaacaccaccuccaucuccgucaacaagcucuucguccgcgucuucaccguccaccccaaccucugcuuccacuacuccugggucgccgaggaccaccagggcgcccagcacaccgccaaccgcgucuucucccucuccggcuccuacauccaccucgagcccgucgccggcacccuccccugcggccacaccgagaccaucaccgcccacuacacccucaaccgccaggccaugggcgagcucuccgagcucuccuuccacuaccucaucauggccaagggcgucaucguccgcuccggcacccacacccuccccgucgaguccggcgacaugaagggcuccuucgcccucuccuuccccgucgaguccgacgucgcccccaucgcccgcauguucaucuucgccauccuccccgacggcgaggucgucggcgacuccgagaaguucgagaucgagaacugccucgccaacaaggucgaccucuccuucucccccgcccaguccccccccgccucccacgcccaccuccaggucgccgccgccccccagucccucugcgcccuccgcgccgucgaccaguccguccuccucaugaagcccgaggccgagcucuccgucuccuccgucuacaaccuccucaccgucaaggaccucaccaacuuccccgacaacgucgaccagcaggaggaggagcagggccacugcccccgccccuucuucauccacaacggcgccaucuacgucccccucuccuccaacgaggccgacaucuacuccuuccucaagggcaugggccucaaggucuucaccaacuccaagauccgcaagcccaaguccugcuccgucauccccuccgucuccgccggcgccgucggccagggcuacuacggcgccggccucggcgucgucgagcgccccuacgucccccagcucggcaccuacaacgucaucccccucaacaacgagcaguccuccggccccguccccgagaccguccgcuccuacuuccccgagaccuggaucugggagcucgucgccgucaacuccuccggcgucgccgaggucggcgucaccguccccgacaccaucaccgaguggaaggccggcgccuucugccucuccgaggacgccggccucggcaucuccuccaccgccucccuccgcgccuuccagcccuucuucgucgagcucaccaugcccuacuccgucauccgcggcgaggucuucacccucaaggccaccguccucaacuaccuccccaagugcauccgcgucuccguccagcucaaggccucccccgccuuccucgccucccagaacaccaagggcgaggaguccuacugcaucugcggcaacgagcgccagacccucuccuggaccgucacccccaagacccucggcaacgucaacuucuccgucuccgccgaggccaugcagucccucgagcucugcggcaacgaggucgucgagguccccgagaucaagcgcaaggacaccgucaucaagacccuccucgucgaggccgagggcaucgagcaggagaagaccuucuccuccaugaccugcgccuccggcgccaacgucuccgagcagcucucccucaagcuccccuccaacgucgucaaggaguccgcccgcgccuccuucuccguccucggcgacauccucggcuccgccaugcagaacauccagaaccuccuccagaugcccuacggcugcggcgagcagaacaugguccucuucgcccccaacaucuacguccucaacuaccucaacgagacccagcagcucacccaggagaucaaggccaaggccgucggcuaccucaucaccggcuaccagcgccagcucaacuacaagcaccaggacggcuccuacuccaccuucggcgagcgcuacggccgcaaccagggcaacaccuggcucaccgccuucguccucaagaccuucgcccaggcccgcuccuacaucuucaucgacgaggcccacaucacccagucccucaccuggcucucccagaugcagaaggacaacggcugcuuccgcuccuccggcucccuccucaacaacgccaucaagggcggcgucgaggacgaggccacccucuccgccuacgucaccaucgcccuccucgagaucccccuccccgucaccaaccccaucguccgcaacgcccucuucugccucgaguccgccuggaacgucgccaaggagggcacccacggcucccacgucuacaccaaggcccuccucgccuacgccuucucccuccucggcaagcagaaccagaaccgcgagauccucaacucccucgacaaggaggccgucaaggaggacaaccucguccacugggagcgcccccagcgccccaaggcccccgucggccaccucuaccagacccaggcccccuccgccgaggucgagaugaccuccuacguccuccucgccuaccucaccgcccagcccgcccccaccuccggcgaccucaccuccgccaccaacaucgucaaguggaucaugaagcagcagaacgcccagggcggcuucuccuccacccaggacaccgucgucgcccuccacgcccucucccgcuacggcgccgccaccuucacccgcaccgagaagaccgcccaggucaccguccaggacucccagaccuucuccaccaacuuccaggucgacaacaacaaccuccuccuccuccagcagaucucccuccccgagcuccccggcgaguacgucaucaccgucaccggcgagcgcugcgucuaccuccagaccuccaugaaguacaacauccuccccgagaaggaggacucccccuucgcccucaagguccagaccgucccccagaccugcgacggccacaaggcccacaccuccuuccagaucucccucaccaucuccuacaccggcaaccgccccgccuccaacauggucaucgucgacgucaagauggucuccggcuucaucccccucaagcccaccgucaagaugcucgagcgcuccuccuccgucucccgcaccgaggucuccaacaaccacguccucaucuacgucgagcaggucaccaaccagacccucuccuucuccuucaugguccuccaggacauccccgucggcgaccucaagcccgccaucgucaaggucuacgacuacuacgagaccgacgaguccgucgucgccgaguacaucgcccccugcuccaccgacaccgagcacggcaacgucuga

SEQ ID NO: 48393 - RNA, 2295 nt, Artificial Sequence
  derived and/or modified sequence opt2 from QARS__Homo_sapiens__NP_001259002
auggccgcccucgacucccucucccucuucaccucccucggccucuccgagcagaaggcccgcgagacccucaagaacuccgcccucuccgcccagcuccgcgaggccgccacccaggcccagcagacccucggcuccaccaucgacaaggccaccggcauccuccucuacggccucgccucccgccuccgcgacacccgccgccucuccuuccucgucuccuacaucgccaccgcccucgaguacguccgcucccacccccucgaccccaucgacaccgucgacuucgagcgcgagugcggcgucggcgucaucgucacccccgagcagaucgaggaggccgucgaggccgccaucaaccgccaccgcccccagcuccucgucgagcgcuaccacuucaacaugggccuccucaugggcgaggcccgcgccguccucaagugggccgacggcaagaugaucaagaacgaggucgacaugcagguccuccaccuccucggccccaagcucgaggccgaccucgagaagaaguucaaggucgccaaggcccgccucgaggagaccgaccgccgcaccgccaaggacgucgucgagaacggcgagaccgccgaccagacccucucccucauggagcagcuccgcggcgaggcccucaaguuccacaagcccggcgagaacuacaagacccccggcuacgucgucaccccccacaccaugaaccuccucaagcagcaccucgagaucaccggcggccagguccgcacccgcuucccccccgagcccaacggcauccuccacaucggccacgccaaggccaucaacuucaacuucggcuacgccaaggccaacaacggcaucugcuuccuccgcuucgacgacaccaaccccgagaaggaggaggccaaguucuucaccgccaucugcgacauggucgccuggcucggcuacacccccuacaaggucaccuacgccuccgacuacuucgaccagcucuacgccugggccgucgagcucauccgccgcggccucgccuacgucugccaccagcgcggcgaggagcucaagggccacaacacccuccccucccccuggcgcgaccgccccauggaggagucccuccuccucuucgaggccaugcgcaagggcaaguucuccgagggcgaggccacccuccgcaugaagcucgucauggaggacggcaagauggaccccgucgccuaccgcgucaaguacaccccccaccaccgcaccggcgacaaguggugcaucuaccccaccuacgacuacacccacugccucugcgacuccaucgagcacaucacccacucccucugcaccaaggaguuccaggcccgccgcuccuccuacuucuggcucugcaacgcccucgacgucuacugccccguccagugggaguacggccgccucaaccuccacuacgccgucgucuccaagcgcaagauccuccagcucgucgccaccggcgccguccgcgacugggacgacccccgccucuucacccucaccgcccuccgccgccgcggcuucccccccgaggccaucaacaacuucugcgcccgcgucggcgucaccgucgcccagaccaccauggagccccaccuccucgaggccugcguccgcgacguccucaacgacaccgccccccgcgccauggccguccucgagucccuccgcgucaucaucaccaacuuccccgccgccaagucccucgacauccagguccccaacuuccccgccgacgagaccaagggcuuccaccagguccccuucgcccccaucgucuucaucgagcgcaccgacuucaaggaggagcccgagcccggcuucaagcgccucgccuggggccagcccgucggccuccgccacaccggcuacgucaucgagcuccagcacgucgucaagggccccuccggcugcgucgagucccucgaggucaccugccgccgcgccgacgccggcgagaagcccaaggccuucauccacugggucucccagccccucaugugcgagguccgccucuacgagcgccucuuccagcacaagaaccccgaggaccccaccgagguccccggcggcuuccucuccgaccucaaccucgccucccuccacgucgucgacgccgcccucgucgacugcuccgucgcccucgccaagcccuucgacaaguuccaguucgagcgccucggcuacuucuccgucgaccccgacucccaccagggcaagcucgucuucaaccgcaccgucacccucaaggaggaccccggcaaggucuga

SEQ ID NO: 48394 - RNA, 735 nt, Artificial Sequence
  derived and/or modified sequence opt2 from QDPR__Homo_sapiens__NP_000311
auggccgccgccgccgccgccggcgaggcccgccgcguccucgucuacggcggccgcggcgcccucggcucccgcugcguccaggccuuccgcgcccgcaacuggugggucgccuccgucgacgucgucgagaacgaggaggccuccgccuccaucaucgucaagaugaccgacuccuucaccgagcaggccgaccaggucaccgccgaggucggcaagcuccucggcgaggagaaggucgacgccauccucugcgucgccggcggcugggccggcggcaacgccaaguccaagucccucuucaagaacugcgaccucauguggaagcaguccaucuggaccuccaccaucuccucccaccucgccaccaagcaccucaaggagggcggccuccucacccucgccggcgccaaggccgcccucgacggcacccccggcaugaucggcuacggcauggccaagggcgccguccaccagcucugccagucccucgccggcaagaacuccggcaugccccccggcgccgccgccaucgccguccuccccgucacccucgacacccccaugaaccgcaaguccaugcccgaggccgacuucuccuccuggaccccccucgaguuccucgucgagaccuuccacgacuggaucaccggcaagaaccgccccuccuccggcucccucauccaggucgucaccaccgagggccgcaccgagcucacccccgccuacuucuga

SEQ ID NO: 48395 - RNA, 1002 nt, Artificial Sequence
  derived and/or modified sequence opt2 from QKI__Homo_sapiens__NP_001288014
auggucggcgagauggagaccaaggagaagcccaagcccacccccgacuaccucaugcagcucaugaacgacaagaagcucauguccucccuccccaacuucugcggcaucuucaaccaccucgagcgccuccucgacgaggagaucucccgcguccgcaaggacauguacaacgacacccucaacggcuccaccgagaagcgcuccgccgagcuccccgacgccgucggccccaucguccagcuccaggagaagcucuacguccccgucaaggaguaccccgacuucaacuucgucggccgcauccucggcccccgcggccucaccgccaagcagcucgaggccgagaccggcugcaagaucaugguccgcggcaagggcuccaugcgcgacaagaagaaggaggagcagaaccgcggcaagcccaacugggagcaccucaacgaggaccuccacguccucaucaccgucgaggacgcccagaaccgcgccgagaucaagcucaagcgcgccgucgaggaggucaagaagcuccucguccccgccgccgagggcgaggacucccucaagaagaugcagcucauggagcucgccauccucaacggcaccuaccgcgacgccaacaucaagucccccaccgcccaggccgccccccgcaucaucaccggccccgcccccguccucccccccgccgcccuccgcacccccacccccgccggccccaccaucaugccccucauccgccagauccagaccgccgucaugcccaacggcaccccccaccccaccgccgccaucgucccccccggccccgaggccggccucaucuacacccccuacgaguaccccuacacccucgcccccgccaccuccauccucgaguaccccaucgagcccuccggcguccucggcgccgucgccaccaagguccgccgccacgacaugcgcguccaccccuaccagcgcaucgucaccgccgaccgcgccgccaccggcaacuga

SEQ ID NO: 48396 - RNA, 1086 nt, Artificial Sequence
  derived and/or modified sequence opt2 from QPCT__Homo_sapiens__NP_036545
auggccggcggccgccaccgccgcgucgucggcacccuccaccuccuccuccucgucgccgcccuccccugggccucccgcggcgucucccccuccgccuccgccuggcccgaggagaagaacuaccaccagcccgccauccucaacuccuccgcccuccgccagaucgccgagggcaccuccaucuccgagauguggcagaacgaccuccagccccuccucaucgagcgcuaccccggcucccccggcuccuacgccgcccgccagcacaucaugcagcgcauccagcgccuccaggccgacuggguccucgagaucgacaccuuccucucccagacccccuacggcuaccgcuccuucuccaacaucaucuccacccucaaccccaccgccaagcgccaccucguccucgccugccacuacgacuccaaguacuucucccacuggaacaaccgcgucuucgucggcgccaccgacuccgccguccccugcgccaugaugcucgagcucgcccgcgcccucgacaagaagcuccucucccucaagaccgucuccgacuccaagcccgaccucucccuccagcucaucuucuucgacggcgaggaggccuuccuccacugguccccccaggacucccucuacggcucccgccaccucgccgccaagauggccuccaccccccacccccccggcgcccgcggcaccucccagcuccacggcauggaccuccucguccuccucgaccucaucggcgcccccaaccccaccuuccccaacuucuuccccaacuccgcccgcugguucgagcgccuccaggccaucgagcacgagcuccacgagcucggccuccucaaggaccacucccucgagggccgcuacuuccagaacuacuccuacggcggcgucauccaggacgaccacauccccuuccuccgccgcggcguccccguccuccaccucauccccucccccuuccccgaggucuggcacaccauggacgacaacgaggagaaccucgacgaguccaccaucgacaaccucaacaagauccuccaggucuucguccucgaguaccuccaccucuga

SEQ ID NO: 48397 - RNA, 867 nt, Artificial Sequence
  derived and/or modified sequence opt2 from QPCTL__Homo_sapiens__NP_001156849
augcgcuccggcggccgcggccgcccccgccuccgccucggcgagcgcggccucauggagccccuccucccccccaagcgccgccuccucccccgcguccgccuccucccccuccuccucgcccucgccgucggcuccgccuucuacaccaucugguccggcuggcaccgccgcaccgaggagcucccccucggccgcgagcuccgcgucccccucaucggcucccuccccgaggcccgccuccgccgcgucgucggccagcucgacccccagcgccucugguccaccuaccuccgcccccuccucgucguccgcacccccggcucccccggcaaccuccagguccgcaaggccgcccccgucacccuccagcuccucuuccucgacggcgaggaggcccucaaggaguggggccccaaggacucccucuacggcucccgccaccucgcccagcucauggaguccaucccccacucccccggccccacccgcauccaggccaucgagcucuucaugcuccucgaccuccucggcgcccccaaccccaccuucuacucccacuucccccgcaccguccgcugguuccaccgccuccgcuccaucgagaagcgccuccaccgccucaaccuccuccagucccacccccaggaggucauguacuuccagcccggcgagcccuucggcuccgucgaggacgaccacauccccuuccuccgccgcggcguccccguccuccaccucaucuccacccccuuccccgccgucuggcacacccccgccgacaccgaggucaaccuccacccccccaccguccacaaccucugccgcauccucgccgucuuccucgccgaguaccucggccucuga

SEQ ID NO: 48398 - RNA, 894 nt, Artificial Sequence
  derived and/or modified sequence opt2 from QPRT__Homo_sapiens__NP_055113
auggacgccgagggccucgcccuccuccucccccccgucacccucgccgcccucgucgacuccuggcuccgcgaggacugccccggccucaacuacgccgcccucgucuccggcgccggccccucccaggccgcccucugggccaagucccccggcguccucgccggccagcccuucuucgacgccaucuucacccagcucaacugccaggucuccugguuccuccccgagggcuccaagcucguccccgucgcccgcgucgccgagguccgcggccccgcccacugccuccuccucggcgagcgcgucgcccucaacacccucgcccgcugcuccggcaucgccuccgccgccgccgccgccgucgaggccgcccgcggcgccggcuggaccggccacgucgccggcacccgcaagaccacccccggcuuccgccucgucgagaaguacggccuccucgucggcggcgccgccucccaccgcuacgaccucggcggccucgucauggucaaggacaaccacgucgucgccgccggcggcgucgagaaggccguccgcgccgcccgccaggccgccgacuucgcccucaaggucgaggucgagugcuccucccuccaggaggccguccaggccgccgaggccggcgccgaccucguccuccucgacaacuucaagcccgaggagcuccaccccaccgccaccguccucaaggcccaguuccccuccgucgccgucgaggccuccggcggcaucacccucgacaaccucccccaguucugcggcccccacaucgacgucaucuccaugggcaugcucacccaggccgcccccgcccucgacuucucccucaagcucuucgccaaggaggucgcccccguccccaagauccacuga

SEQ ID NO: 48399 - RNA, 411 nt, Artificial Sequence
  derived and/or modified sequence opt2 from QRFP__Homo_sapiens__NP_937823
augguccgccccuacccccucaucuacuuccucuuccucccccucggcgccugcuucccccuccucgaccgccgcgagcccaccgacgccaugggcggccucggcgccggcgagcgcugggccgaccucgccaugggcccccgcccccacuccgucuggggcuccucccgcuggcuccgcgccucccagccccaggcccuccucgucaucgcccgcggccuccagaccuccggccgcgagcacgccggcugccgcuuccgcuucggccgccaggacgagggcuccgaggccaccggcuuccuccccgccgccggcgagaagaccuccggcccccucggcaaccucgccgaggagcucaacggcuacucccgcaagaagggcggcuucuccuuccgcuucggccgccgcuga

SEQ ID NO: 48400 - RNA, 1296 nt, Artificial Sequence
  derived and/or modified sequence opt2 from QRFPR__Homo_sapiens__NP_937822
augcaggcccucaacaucacccccgagcaguucucccgccuccuccgcgaccacaaccucacccgcgagcaguucaucgcccucuaccgccuccgcccccucgucuacacccccgagcuccccggccgcgccaagcucgcccucguccucaccggcguccucaucuucgcccucgcccucuucggcaacgcccucgucuucuacgucgucacccgcuccaaggccaugcgcaccgucaccaacaucuucaucugcucccucgcccucuccgaccuccucaucaccuucuucugcauccccgucaccaugcuccagaacaucuccgacaacuggcucggcggcgccuucaucugcaagaugguccccuucguccaguccaccgccgucgucaccgagauccucaccaugaccugcaucgccgucgagcgccaccagggccucguccaccccuucaagaugaaguggcaguacaccaaccgccgcgccuucaccaugcucggcgucgucuggcucgucgccgucaucgucggcucccccauguggcacguccagcagcucgagaucaaguacgacuuccucuacgagaaggagcacaucugcugccucgaggaguggaccucccccguccaccagaagaucuacaccaccuucauccucgucauccucuuccuccucccccucauggucaugcucauccucuacuccaagaucggcuacgagcucuggaucaagaagcgcgucggcgacggcuccguccuccgcaccauccacggcaaggagauguccaagaucgcccgcaagaagaagcgcgccgucaucaugauggucaccgucgucgcccucuucgccgucugcugggcccccuuccacgucguccacaugaugaucgaguacuccaacuucgagaaggaguacgacgacgucaccaucaagaugaucuucgccaucguccagaucaucggcuucuccaacuccaucugcaaccccaucgucuacgccuucaugaacgagaacuucaagaagaacguccucuccgccgucugcuacugcaucgucaacaagaccuucucccccgcccagcgccacggcaacuccggcaucaccaugaugcgcaagaaggccaaguucucccuccgcgagaaccccgucgaggagaccaagggcgaggccuucuccgacggcaacaucgaggucaagcucugcgagcagaccgaggagaagaagaagcucaagcgccaccucgcccucuuccgcuccgagcucgccgagaacuccccccucgacuccggccacuga

SEQ ID NO: 48401 - RNA, 1587 nt, Artificial Sequence
  derived and/or modified sequence opt2 from QRSL1__Homo_sapiens__NP_060762
augcucggccgcucccuccgcgaggucuccgccgcccucaagcagggccagaucacccccaccgagcucugccagaagugccucucccucaucaagaagaccaaguuccucaacgccuacaucaccgucuccgaggaggucgcccucaagcaggccgaggaguccgagaagcgcuacaagaacggccagucccucggcgaccucgacggcauccccaucgccgucaaggacaacuucuccaccuccggcaucgagaccaccugcgccuccaacaugcucaagggcuacaucccccccuacaacgccaccgucguccagaagcuccucgaccagggcgcccuccucaugggcaagaccaaccucgacgaguucgccaugggcuccggcuccaccgacggcgucuucggccccgucaagaaccccugguccuacuccaagcaguaccgcgagaagcgcaagcagaacccccacuccgagaacgaggacuccgacuggcucaucaccggcggcuccuccggcggcuccgccgccgccgucuccgccuucaccugcuacgccgcccucggcuccgacaccggcggcuccacccgcaaccccgccgcccacugcggccucgucggcuucaagcccuccuacggccucgucucccgccacggccucaucccccucgucaacuccauggacguccccggcauccucacccgcugcgucgacgacgccgccaucguccucggcgcccucgccggccccgacccccgcgacuccaccaccguccacgagcccaucaacaagcccuucaugcuccccucccucgccgacgucuccaagcucugcaucggcauccccaaggaguaccucguccccgagcucuccuccgagguccagucccucugguccaaggccgccgaccucuucgaguccgagggcgccaaggucaucgaggucucccucccccacaccuccuacuccaucgucugcuaccacguccucugcaccuccgaggucgccuccaacauggcccgcuucgacggccuccaguacggccaccgcugcgacaucgacgucuccaccgaggccauguacgccgccacccgccgcgagggcuucaacgacgucguccgcggccgcauccucuccggcaacuucuuccuccucaaggagaacuacgagaacuacuucgucaaggcccagaagguccgccgccucaucgccaacgacuucgucaacgccuucaacuccggcgucgacguccuccucacccccaccacccucuccgaggccguccccuaccucgaguucaucaaggaggacaaccgcacccgcuccgcccaggacgacaucuucacccaggccgucaacauggccggccuccccgccgucuccauccccgucgcccucuccaaccagggccuccccaucggccuccaguucaucggccgcgccuucugcgaccagcagcuccucaccgucgccaagugguucgagaagcagguccaguuccccgucauccagcuccaggagcucauggacgacugcuccgccguccucgagaacgagaagcucgccuccgucucccucaagcaguga

SEQ ID NO: 48402 - RNA, 1815 nt, Artificial Sequence
  derived and/or modified sequence opt2 from QSOX1__Homo_sapiens__NP_001004128
augcgccgcugcaacuccggcuccggccccccccccucccuccuccuccuccuccucuggcuccucgccguccccggcgccaacgccgccccccgcuccgcccucuacucccccuccgacccccucacccuccuccaggccgacaccguccgcggcgccguccucggcucccgcuccgccugggccgucgaguucuucgccuccuggugcggccacugcaucgccuucgcccccaccuggaaggcccucgccgaggacgucaaggccuggcgccccgcccucuaccucgccgcccucgacugcgccgaggagaccaacuccgccgucugccgcgacuucaacauccccggcuuccccaccguccgcuucuucaaggccuucaccaagaacggcuccggcgccgucuuccccgucgccggcgccgacguccagacccuccgcgagcgccucaucgacgcccucgagucccaccacgacaccuggccccccgccugccccccccucgagcccgccaagcucgaggagaucgacggcuucuucgcccgcaacaacgaggaguaccucgcccucaucuucgagaagggcggcuccuaccucggccgcgaggucgcccucgaccucucccagcacaagggcgucgccguccgccgcguccucaacaccgaggccaacgucguccgcaaguucggcgucaccgacuuccccuccugcuaccuccucuuccgcaacggcuccgucucccgcguccccguccucauggagucccgcuccuucuacaccgccuaccuccagcgccucuccggccucacccgcgaggccgcccagaccaccgucgcccccaccaccgccaacaagaucgcccccaccgucuggaagcucgccgaccgcuccaagaucuacauggccgaccucgaguccgcccuccacuacauccuccgcaucgaggucggccgcuuccccguccucgagggccagcgccucgucgcccucaagaaguucgucgccguccucgccaaguacuuccccggccgcccccucguccagaacuuccuccacuccgucaacgaguggcucaagcgccagaagcgcaacaagauccccuacuccuucuucaagaccgcccucgacgaccgcaaggagggcgccguccucgccaagaaggucaacuggaucggcugccagggcuccgagccccacuuccgcggcuuccccugcucccucuggguccucuuccacuuccucaccguccaggccgcccgccagaacgucgaccacucccaggaggccgccaaggccaaggagguccuccccgccauccgcggcuacguccacuacuucuucggcugccgcgacugcgccucccacuucgagcagauggccgccgccuccaugcaccgcgucggcucccccaacgccgccguccucuggcucugguccucccacaaccgcgucaacgcccgccucgccggcgcccccuccgaggacccccaguuccccaagguccaguggcccccccgcgagcucugcuccgccugccacaacgagcgccucgacguccccgucugggacgucgaggccacccucaacuuccucaaggcccacuucucccccuccaacaucauccucgacuuccccgccgccggcuccgccgcccgccgcgacguccagaacgucgccgccgcccccgagcucgccaugggcgcccucgagcucgagucccgcaacuccacccucgaccccggcaagcccgagaugaugaagucccccaccaacaccaccccccacguccccgccgagggccccgagcucaucuga

SEQ ID NO: 48403 - RNA, 2097 nt, Artificial Sequence
  derived and/or modified sequence opt2 from QSOX2__Homo_sapiens__NP_859052
auggccgccgccggcgccgccgucgcccgcucccccggcaucggcgccggccccgcccuccgcgcccgccgcuccccccccccccgcgccgcccgccucccccgccuccucguccuccucgccgccgccgccgucggccccggcgccggcggcgccgcccgccucuaccgcgccggcgaggacgccgucuggguccucgacuccggcuccguccgcggcgccaccgccaacuccuccgccgccuggcucguccaguucuacuccuccuggugcggccacugcaucggcuacgcccccaccuggcgcgcccucgccggcgacguccgcgacugggccuccgccauccgcgucgccgcccucgacugcauggaggagaagaaccaggccgucugccacgacuacgacauccacuucuaccccaccuuccgcuacuucaaggccuucaccaaggaguucaccaccggcgagaacuucaagggccccgaccgcgagcuccgcaccguccgccagaccaugaucgacuuccuccagaaccacaccgagggcucccgcccccccgccugcccccgccucgaccccauccagcccuccgacguccucucccuccucgacaaccgcggcucccacuacgucgccaucgucuucgaguccaacuccuccuaccucggccgcgaggucauccucgaccucauccccuacgaguccaucgucgucacccgcgcccucgacggcgacaaggccuuccucgagaagcucggcgucuccuccguccccuccugcuaccucaucuaccccaacggcucccacggccucaucaacgucgucaagccccuccgcgccuucuucuccuccuaccucaagucccuccccgacguccgcaagaagucccucccccuccccgagaagccccacaaggaggagaacuccgagaucgucgucuggcgcgaguucgacaaguccaagcucuacaccgucgaccucgaguccggccuccacuaccuccuccgcgucgagcucgccgcccacaagucccucgccggcgccgagcucaagacccucaaggacuucgucaccguccucgccaagcucuuccccggccgcccccccgucaagaagcuccucgagaugcuccaggaguggcucgccucccucccccucgaccgcauccccuacaacgccguccucgaccucgucaacaacaagaugcgcaucuccggcaucuuccucaccaaccacaucaagugggucggcugccagggcucccgcuccgagcuccgcggcuaccccugcucccucuggaagcucuuccacacccucaccgucgaggccuccacccaccccgacgcccucgucggcaccggcuucgaggacgacccccaggccguccuccagaccaugcgccgcuacguccacaccuucuucggcugcaaggagugcggcgagcacuucgaggagauggccaaggaguccauggacuccgucaagacccccgaccaggccauccucuggcucuggaagaagcacaacauggucaacggccgccucgccggccaccucuccgaggacccccgcuuccccaagcuccaguggcccacccccgaccucugccccgccugccacgaggagaucaagggccucgccuccugggacgagggccacguccucaccuuccucaagcagcacuacggccgcgacaaccuccucgacaccuacuccgccgaccagggcgacuccuccgagggcggcacccucgcccgcggcgaggaggaggagaagcgccucaccccccccgaggucucccacggcgaccgcgacacccaguccguccgcccccccggcgcccucggcccccgccccgcccuccccgagucccuccaccacucccucgacggcaagcuccagucccucgacggccccggcgcccacaaggaggucggcggcgccgcccccuuccucggcgucgacuucuccucccucgacaugucccucugcgucguccucuacgucgccuccucccucuuccucauggucauguacuucuucuuccgcguccgcucccgccgcuggaaggucaagcaccaccaccccgccgucuga

SEQ ID NO: 48404 - RNA, 1212 nt, Artificial Sequence
  derived and/or modified sequence opt2 from QTRT1__Homo_sapiens__NP_112486
auggccggcgccgccacccaggccucccucgaguccgccccccgcaucaugcgccucgucgccgagugcucccgcucccgcgcccgcgccggcgagcucuggcucccccacggcaccgucgccacccccgucuucaugcccgucggcacccaggccaccaugaagggcaucaccaccgagcagcucgacgcccucggcugccgcaucugccucggcaacaccuaccaccucggccuccgccccggccccgagcucauccagaaggccaacggccuccacggcuucaugaacuggccccacaaccuccucaccgacuccggcggcuuccagauggucucccucgucucccucuccgaggucaccgaggagggcguccgcuuccgcucccccuacgacggcaacgagacccuccucucccccgagaaguccguccagauccagaacgcccucggcuccgacaucaucaugcagcucgacgacgucgucuccuccaccgucaccggcccccgcgucgaggaggccauguaccgcuccauccgcuggcucgaccgcugcaucgccgcccaccagcgccccgacaagcagaaccucuucgccaucauccagggcggccucgacgccgaccuccgcgccaccugccucgaggagaugaccaagcgcgacguccccggcuucgccaucggcggccucuccggcggcgaguccaagucccaguucuggcgcauggucgcccucuccaccucccgccuccccaaggacaagccccgcuaccucaugggcgucggcuacgccaccgaccucgucgucugcgucgcccucggcugcgacauguucgacugcgucuuccccacccgcaccgcccgcuucggcuccgcccucguccccaccggcaaccuccagcuccgcaagaaggucuucgagaaggacuucggccccaucgaccccgagugcaccugccccaccugccagaagcacucccgcgccuuccuccacgcccuccuccacuccgacaacaccgccgcccuccaccaccucaccguccacaacaucgccuaccagcuccagcucauguccgccguccgcaccuccaucgucgagaagcgcuuccccgacuucguccgcgacuucaugggcgccauguacggcgaccccacccucugccccaccugggccaccgacgcccucgccuccgucggcaucacccucggcuga

SEQ ID NO: 48405 - RNA, 1323 nt, Artificial Sequence
  derived and/or modified sequence opt2 from R3HCC1__Homo_sapiens__NP_001129580
auggcccuccucugccucgacggcgucuuccucuccuccgccgagaacgacuucguccaccgcauccaggaggagcucgaccgcuuccuccuccagaagcagcucuccaagguccuccucuuccccccccucuccucccgccuccgcuaccucauccaccgcaccgccgagaacuucgaccuccucuccuccuucuccgucggcgagggcuggaagcgccgcaccgucaucugccaccaggacauccgcguccccuccuccgacggccucuccggccccugccgcgcccccgccuccugccccucccgcuaccacggcccccgccccaucuccaaccagggcgccgccgccgucccccgcggcgcccgcgccggccgcugguaccgcggccgcaagcccgaccagccccucuacgucccccgcguccuccgccgccaggaggaguggggccucaccuccaccuccguccucaagcgcgaggcccccgccggccgcgaccccgaggagcccggcgacgucggcgccggcgaccccaacuccgaccagggccuccccguccucaugacccagggcaccgaggaccucaagggccccggccagcgcugcgagaacgagccccuccucgaccccgucggccccgagccccucggccccgagucccaguccggcaagggcgacauggucgagauggccacccgcuucggcuccacccuccagcucgaccucgagaagggcaaggagucccuccucgagaagcgccucgucgccgaggaggaggaggacgaggaggaggucgaggaggacggccccuccuccugcuccgaggacgacuacuccgagcuccuccaggagaucaccgacaaccucaccaagaaggagauccagaucgagaagauccaccucgacaccuccuccuucgucgaggagcuccccggcgagaaggaccucgcccacgucgucgagaucuacgacuucgagcccgcccucaagaccgaggaccuccucgccaccuucuccgaguuccaggagaagggcuuccgcauccagugggucgacgacacccacgcccucggcaucuuccccugccucgccuccgccgccgaggcccucacccgcgaguucuccguccucaagauccgcccccucacccagggcaccaagcaguccaagcucaaggcccuccagcgccccaagcuccuccgccucgucaaggagcgcccccagaccaacgccaccgucgcccgccgccucgucgcccgcgcccucggccuccagcacaagaagaaggagcgccccgccguccgcggcccccucccccccuga

SEQ ID NO: 48406 - RNA, 2379 nt, Artificial Sequence
  derived and/or modified sequence opt2 from R3HCC1L__Homo_sapiens__NP_001243548
augcagcaggaguccgagcgcugccgcguccgcgcccgccgccccgacauggcccucuacguccccaaggcccgccgcggcgccguccuccucaagaccggcgacgaggaggaguccugcggcucccccaacuccgucgucaaggagaagcagaaggaguccucccucucccagaaggaggucuucaaggacaagcccgaggcccgccgccucaacaucaaccccgaccgcaaggagcacaacugccgcgaggagaagaaguccuccaccaagcuccgcauggacaccugccuccagaagaccaaccgcgucugcuccaagcgcggcaccaccgaguccaaggagguccucucccagggccagcagcagggcgcccccaacgccggcgucaucaccaacgccccccuccagcgccacuucaagcccaagaaggucgagugccucgaggucgagaccaccgacgucaccggccacgagcgcauccuccucucccaggccugccucgagaucuccgaggcccagguccccuccaagcccuuccagaacgucgaguucugcgacuucucccgccacgagcccgacggcgaggccuucgaggacaaggaccucgagggccgcaucgagaccgacaccaagguccucgagauccucuacgaguucccccgcgucuucuccuccgucaugaagcccgagaacaugaucguccccaucaagcucuccuccgacuccgagaucguccagcaguccaugcagaccuccgacggcauccucaaccccuccuccggcggcaucaccaccaccuccguccccggcucccccgacggcgucuucgaccagaccugcgucgacuucgaggucgaguccgucggcggcaucgccaacuccaccggcuucauccucgaccagaaggacaccgacuccauccccgccaccaugggccacaucucccucuccgaguccaccaacgacaccgucucccccgucaugauccgcgagugcgagaagaacgacuccaccgccgacgagcuccacgucaagcacgagccccccgacaccgccguccucgcccacgagacccaccgcgacuccggcuucaagaacgucggcgacaucaccaacaaggccugcaugauggacaccaccggcauguccugcuccgaccacgucaccgucgacucccccuacgucgucgccguccgcaucgccgacgagaccuccaucaacacccgcuccuucuccaaguucgucggcauguccgccgacgccaccccccuccacgucgcccgcuccggcaacgacaccgaggacuucuccaaccccuccgccugcuccgacaucuacggcgaguccaucuccucccacuucaccgaguccaccggcaagcucaucgagucccucuccgacugcgccuccucccuccccaucaagaagaucgccggcuccaacuacaacaccuuccucgacuccgagcucuccaugcucaacggcaccaagguccucuccgacuccgccgucggcaucgaccucggcuccaccggcgacaccaccgaggcccuccacgagcuccgcaccgccgaggaguucaagaccgaggagcaggacgacuccggcuccaucgaguucggcgucuccuuccccgaccgcgaguccuccuccauggagaccuccaucgagcccaaggccaccgagaccucccacaccgagggcaucaccgccaucgaggaguccugggaguccauguucaacgacgacggcgacugccucgacccccgccuccuccaggagggcauccucaugcacaucaagcccgagaaccacugcuccaagcucuccggcaacaccaagucccgcgaguccauccaggagccccgcuccgacuacuacaaccacgagguccccgacaucgaccucuccgacugcgaguucccccacgucaucgagaucuacgacuucccccaggaguuccgcaccgaggaccuccuccgcgucuucugcuccuaccagaagaagggcuucgacaucaagugggucgacgacacccacgcccucggcgucuucuccucccccaucaccgcccgcgacgcccucggcaucaagcacaccauggucaagauccgcccccucucccaggccacccgcgccgccaaggccaaggcccgcgccuacgccgaguuccuccagcccgccaaggagcgccccgagaccuccgccgcccucgcccgccgccucgucaucuccgcccucggcguccgcuccaagcaguccaagaccgagcgcgaggccgagcucaagaagcuccaggaggcccgcgagcgcaagcgccucgaggccaagcagcgcgaggacaucugggagggccgcgaccaguccaccgucuga

SEQ ID NO: 48407 - RNA, 2916 nt, Artificial Sequence
  derived and/or modified sequence opt2 from R3HDM1__Homo_sapiens__NP_001269728
augcgcauguccgacaccgucaccgucaaggacgagaccgccaccaugaaggaccucgaggccgaggucaaggacaccacccgcgucgagaaccucaucaaguccgagaacuacggcaagauccucgucgagaagaacgagcacugcaucgagaacaacaucgaccuccaggagaagauccagauccagcucacccaguccuucgagaaggaggagaagcccuccaaggacgaggccgagaaggagaaggccuccgacaagcucccccgcaagaugcucucccgcgacuccucccaggaguacaccgacuccaccggcaucgaccuccacgaguuccucgucaacacccucaagaacaacccccgcgaccgcaugaugcuccucaagcucgagcaggagauccucgacuucaucggcaacaacgaguccccccgcaagaaguucccccccaugaccuccuaccaccgcaugcuccuccaccgcgucgccgccuacuucggccucgaccacaacgucgaccaguccggcaaguccgucaucgucaacaagaccuccaacacccgcauccccgaccagaaguucaacgagcacaucaaggacgacaagggcgaggacuuccagaagcgcuacauccucaagcgcgacaacuccuccuucgacaaggacgacaaccagaugcgcauccgccucaaggacgaccgccgcuccaaguccaucgaggagcgcgaggaggaguaccagcgcgcccgcgaccgcaucuucucccaggacucccucugcucccaggagaacuacaucaucgacaagcgccuccaggacgaggacgccuccuccacccagcagcgccgccagaucuuccgcgucaacaaggacgccuccggccgcuccaccaacucccaccaguccuccaccgagaacgagcucaaguacuccgagccccgccccugguccuccaccgacuccgacuccucccuccgcaaccucaagcccgccgucaccaaggccuccuccuucuccggcaucuccguccucacccgcggcgacuccuccggcuccuccaaguccaucggccgccucuccaagaccggccagcccuucaucaaccccgacggcucccccgucgucuacaacccccccaugacccagcagcccguccgcucccagguccccggccccccccagcccccccuccccgcccccccccagcagcccgccgccaaccacaucuucucccagcaggacaaccucggcucccaguucucccacaugucccucgcccgccagcccuccgccgacggcuccgacccccacgccgccauguuccaguccaccgucguccuccaguccccccagcaguccggcuacaucaugaccgccgccccccccccccacccccccccccccccccccccccccccccccccccccccccucccccccggccagcccguccccaccgccggcuaccccgccuccggccaccccgucucccagcccguccuccagcagcagggcuacauccagcagcccuccccccagaugcccgccugcuacugcgcccccggccacuaccacuccucccagccccaguaccgccccguccccuccguccacuacaacucccaccucaaccagccccucccccagcccgcccagcagaccggcuaccaggucauccccaaccagcagcagaacuaccagggcaucgucggcguccagcagccccagucccagucccucgucuccggccagcccaacuccaucggcaaccagauccagggcgucgucauccccuacaccuccguccccaccuaccaggucucccucccccagggcucccagggcaucccccaccagaccuaccagcagcccgucauguuccccaaccaguccaaccagggcuccaugcccaccaccggcaugcccgucuacuacuccgucaucccccccggccagcagaacaaccucuccuccuccgucggcuaccuccagcaccccggcuccgagcagguccaguucccccgcaccaccucccccugcuccucccagcagcuccagggccaccagugcaccgccggccccccccccccccccggcggcggcauggucaugaugcagcucuccguccccaacaacccccaguccugcgcccacucccccccccaguggaagcagaacaaguacuacugcgaccaccagcgcggccagaagugcgucgaguucuccuccgucgacaacaucguccagcacuccccccagcucuccucccccaucaucucccccgcccagucccccgcccccgcccagcucuccacccucaagaccguccgccccuccggccccccccucuccaucaugccccaguucucccgccccuucguccccggccagggcgacucccgcuacccccuccucggccagccccuccaguacaacccccccgccguccuccacggccacauccccaaccagcagggccagcccggcucccgccacggcaaccgcggccgccgccaggccaagaaggccgccuccaccgaccucggcgccggcgagaccgucgucggcaagguccucgagaucaccgagcuccccgacggcaucacccgcauggaggccgagaagcucuucggcgagcucuucaagaucggcgccaagauccgcuggcuccgcgacccccagucccagccccgccgccacccccucugcugcggcuccggcgacaacaccgccaaccccgagcgcuccaagcccuccgaccucgccuccaccuacaccguccucgccaccuuccccuccaucuccgccgcccagaacgcccucaagaagcagaucaacuccgucaacaaguucaagcuccgcaccuccaagaagcacuacgacuuccacauccucgagcgcgccuccucccaguga

SEQ ID NO: 48408 - RNA, 762 nt, Artificial Sequence
  derived and/or modified sequence opt2 from R3HDML__Homo_sapiens__NP_848586
augccccuccuccccuccaccgucggccucgccggccuccucuucugggccggccaggccgucaacgcccucaucaugcccaacgccacccccgcccccgcccagcccgaguccaccgccaugcgccuccucuccggccucgaggucccccgcuaccgccgcaagcgccacaucuccguccgcgacaugaacgcccuccucgacuaccacaaccacauccgcgccuccgucuacccccccgccgccaacauggaguacauggucugggacaagcgccucgcccgcgccgccgaggccugggccacccagugcaucugggcccacggccccucccagcucaugcgcuacgucggccagaaccucuccauccacuccggccaguaccgcuccgucgucgaccucaugaaguccugguccgaggagaaguggcacuaccucuuccccgccccccgcgacugcaacccccacugccccuggcgcugcgacggccccaccugcucccacuacacccagauggucugggccuccuccaaccgccucggcugcgccauccacaccugcuccuccaucuccgucuggggcaacaccuggcaccgcgccgccuaccucgucugcaacuacgccaucaagggcaacuggaucggcgagucccccuacaagaugggcaagcccugcuccuccugcccccccuccuaccagggcuccugcaacuccaacaugugcuucaagggccucaaguccaacaaguucaccugguucuga

SEQ ID NO: 48409 - RNA, 468 nt, Artificial Sequence
  derived and/or modified sequence opt2 from RAB11A__Homo_sapiens__NP_001193765
augggcacccgcgacgacgaguacgacuaccucuucaaggucguccucaucggcgacuccggcgucggcaaguccaaccuccucucccgcuucacccgcaacgaguucaaccucgaguccaaguccaccaucggcgucgaguucgccacccgcuccauccaggucgacggcaagaccaucaaggcccagaucugggacaccgccggccaggagcgcuaccgcgccaucaccuccgccuacuaccgcggcgccgucggcgcccuccucgucuacgacaucgccaagcaccucaccuacgagaacgucgagcgcuggcucaaggagcuccgcgaccacgccgacuccaacaucgucaucaugcucgucggcaacaaguccgaccuccgccaccuccgcgccguccccaccgacgaggcccgcgccuucgccgagaagaacgaggccaacguccgccagacccgcaaguga

SEQ ID NO: 48410 - RNA, 657 nt, Artificial Sequence
  derived and/or modified sequence opt2 from RAB11B__Homo_sapiens__NP_004209
augggcacccgcgacgacgaguacgacuaccucuucaaggucguccucaucggcgacuccggcgucggcaaguccaaccuccucucccgcuucacccgcaacgaguucaaccucgaguccaaguccaccaucggcgucgaguucgccacccgcuccauccaggucgacggcaagaccaucaaggcccagaucugggacaccgccggccaggagcgcuaccgcgccaucaccuccgccuacuaccgcggcgccgucggcgcccuccucgucuacgacaucgccaagcaccucaccuacgagaacgucgagcgcuggcucaaggagcuccgcgaccacgccgacuccaacaucgucaucaugcucgucggcaacaaguccgaccuccgccaccuccgcgccguccccaccgacgaggcccgcgccuucgccgagaagaacaaccucuccuucaucgagaccuccgcccucgacuccaccaacgucgaggaggccuucaagaacauccucaccgagaucuaccgcaucgucucccagaagcagaucgccgaccgcgccgcccacgacgagucccccggcaacaacgucgucgacaucuccgucccccccaccaccgacggccagaagcccaacaagcuccagugcugccagaaccucuga

SEQ ID NO: 48411 - RNA, 3852 nt, Artificial Sequence
  derived and/or modified sequence opt2 from RAB11FIP1__Homo_sapiens__NP_001002814
augucccucauggucuccgccggccgcggccucggcgccgucuggucccccacccacguccaggucaccguccuccaggcccgcggccuccgcgccaagggccccggcggcaccuccgacgccuacgccgucauccaggucggcaaggagaaguacgccaccuccgucuccgagcgcucccucggcgcccccgucuggcgcgaggaggccaccuucgagcuccccucccuccucuccuccggccccgccgccgccgccacccuccagcucaccguccuccaccgcgcccuccucggccucgacaaguuccucggccgcgccgaggucgaccuccgcgaccuccaccgcgaccagggccgccgcaagacccagugguacaagcucaaguccaagcccggcaagaaggacaaggagcgcggcgagaucgaggucgacauccaguucaugcgcaacaacaugaccgccuccauguucgaccucuccaugaaggacaagucccgcaaccccuucggcaagcucaaggacaagaucaagggcaagaacaaggacuccggcuccgacaccgccuccgccaucauccccuccaccacccccuccgucgacuccgacgacgaguccgucgucaaggacaagaagaagaaguccaagaucaagacccuccucuccaaguccaaccuccagaagaccccccucucccaguccauguccguccuccccaccuccaagcccgagaagguccuccuccgccccggcgacuuccagucccagugggacgaggacgacaacgaggacgaguccuccuccgccuccgacgucaugucccacaagcgcaccgccuccaccgaccucaagcagcucaaccaggucaacuucacccuccccaagaaggagggccucuccuuccucggcggccuccgcuccaagaacgacguccucucccgcuccaacgucugcaucaacggcaaccacgucuaccucgagcagcccgaggccaagggcgagaucaaggacuccucccccuccuccucccccucccccaagggcuuccgcaagaagcaccucuucuccuccaccgagaaccucgccgccggcuccuggaaggagcccgccgagggcggcggccucuccuccgaccgccagcucuccgaguccuccaccaaggacucccucaaguccaugacccuccccuccuaccgccccgccccccucgucuccggcgaccuccgcgagaacauggcccccgccaacuccgaggccaccaaggaggccaaggaguccaagaagcccgagucccgccgcuccucccuccucucccucaugaccggcaagaaggacgucgccaagggcuccgagggcgagaacccccucaccguccccggccgcgagaaggagggcaugcucaugggcgucaagcccggcgaggacgccuccggccccgccgaggaccucguccgccgcuccgagaaggacaccgccgccgucgucucccgccagggcuccucccucaaccucuucgaggacguccagaucaccgagcccgaggccgagcccgaguccaaguccgagccccgcccccccaucuccuccccccgcgccccccagacccgcgccgucaagccccgccucgaggucucccccgaggcccagcccaccgcccgccuccccucccccaccgacucccccuccucccuccccccccuccccuccuccuccggccaggccuccguccccuccgagcucggccacggcgccgacacccaguccuccgagucccccuccgucuucuccucccucuccucccccaucgccgcccccaucuccaccuccacccccaucgaguccuggccccucgucgaccgcggccaggccaaguccgagggccccccccuccuccccaaggccgagcuccagaccgagucccucacccccguccccaacuccggcuccuccgcccucggcucccucuucaagcagcccuccuuccccgccaacaagggcaccgaggacucccucaugggccgcacccgcgagaccggcaccgagaagaacaccuccucccucgagcucgaggagucccuccccgagcagcccgagaccggccgccaggaggaggagcucccccgcuuccccugcaagaagcaggacuacucccccuccuccggcgaggcccaggagguccccuucgcccucucccucuccuccgacggcgccgucucccccgucggcgagcucgccgccggcggcgaccgcgaccucgagucccaggccggcucccucgucgaguccaaggcccgcgacgccgccgaggaggucgcccccccccuccccaugggcgccuccguccccuccaucgacuccaugaugcgcaagcucgaggagaugggccucaaccuccgcaaggaccagaagaagaccaagaagcgcgucuccuucuccgagcagcucuucaccgaggaggccgucgccggcgccgcccuccucgucgagggccacuccuccugcccccaggagcucaaccccgccugguccgucgccggcaacgccuccgacggcgagccccccgaguccccccacgccgaggacuccgagcgcgaguccgucaccacccccggccccgccaccugcggcgcccccgccucccccgccgaccaccuccuccuccccucccaggaggaguccuucuccgagguccccauguccgaggccuccuccgccaaggacaccccccucuuccgcauggagggcgaggacgcccucgucacccaguaccaguccaaggccuccgaccacgagggccuccucuccgacccccucuccgaccuccagcucgucuccgacuucaagucccccaucauggccgaccucaaccucucccuccccuccauccccgaggucgccuccgacgacgagcgcaucgaccaggucgaggacgacggcgaccaggucgaggacgacggcgagaccgccaaguccuccacccucgacaucggcgcccucucccucggccucgucguccccugccccgagcgcggcaagggccccuccggcgaggccgaccgccucguccucggcgagggccucugcgacuuccgccuccaggccccccaggccuccgucaccgcccccuccgagcagaccaccgaguucggcauccacaagccccaccucggcaaguccuccucccucgacaagcagcuccccggccccuccggcggcgaggaggagaagcccaugggcaacggcucccccucccccccccccggcaccucccucgacaaccccguccccucccccucccccuccgagaucuuccccgucacccacuccuuccccuccuccgcccacuccgacacccaccacaccuccaccgccgagucccagaagaaggccaccgccgagggcuccgccggccgcgucgagaacuucggcaagcgcaagccccuccuccaggccugggucucccccuccgagacccaccccgucuccgcccagcccggcgccggcaccggcuccgccaagcaccgccuccaccccgucaagcccaugaacgccauggccaccaaggucgccaacugcucccucggcaccgccaccaucaucuccgagaaccucaacaacgaggucaugaugaagaaguacucccccuccgaccccgccuucgccuacgcccagcucacccacgacgagcucauccagcucguccucaagcagaaggagaccaucuccaagaaggaguuccagguccgcgagcucgaggacuacaucgacaaccuccucguccgcgucauggaggagacccccaacauccuccgcauccccacccaggucggcaagaaggccggcaagauguga

SEQ ID NO: 48412 - RNA, 1539 nt, Artificial Sequence
  derived and/or modified sequence opt2 from RAB11FIP2__Homo_sapiens__NP_055719
augaugcucuccgagcaggcccagaagugguuccccacccacguccaggucaccguccuccaggccaaggaccucaagcccaagggcaaguccggcaccaacgacaccuacaccaucauccagcucggcaaggagaaguacuccaccuccgucgccgagaagacccucgagcccgucuggaaggaggaggccuccuucgagcuccccggccuccucauccagggcucccccgagaaguacauccucuuccucaucgucaugcaccgcucccucgucggccucgacaaguuccucggccaggucgccaucaaccucaacgacaucuucgaggacaagcagcgccgcaagaccgagugguuccgccucgaguccaagcagggcaagcgcaucaagaaccgcggcgagaucaaggucaacauccaguucaugcgcaacaacaugaccgccuccauguucgaccucuccaugaaggacaagacccgcucccccuucgccaagcucaaggacaagaugaagggccgcaagaacgacggcaccuucuccgacaccuccuccgccaucauccccuccacccacaugcccgacgccaacuccgaguucuccuccggcgagauccagaugaaguccaagcccaagaagcccuuccuccucggcccccagcgccucuccuccgcccacuccauguccgaccucuccggcucccacauguccuccgagaagcucaaggccggcaccaucggccagacccaccuccucggccaccagcucgacuccuucggcaccguccccgaguccggcucccucaaguccccccaccgccgcacccucuccuucgacaccuccaagaugaaccagcccgacuccaucgucgacgagggcgagcucugcuucggccgccagaacgaccccuucaccaacgucaccgccucccucccccagaaguucgccacccucccccgcaagaagaaccccuucgaggaguccuccgagaccugggacuccuccaugaaccucuucuccaagcccaucgagauccgcaaggagaacaagcgcgagaagcgcgagaaggucucccucuucgagcgcgucaccggcaagaaggacucccgccgcuccgacaagcucaacaacggcggcuccgacucccccugcgaccucaagucccccaacgccuucuccgagaaccgccaggacuacuucgacuacgaguccaccaaccccuucaccgccaaguuccgcgccuccaacaucaugcccuccuccuccuuccacaugucccccaccuccaacgaggaccuccgcaagauccccgacuccaaccccuucgacgccaccgccggcuaccgcucccucaccuacgaggagguccuccaggagcucgucaagcacaaggagcuccuccgccgcaaggacacccacauccgcgagcucgaggacuacaucgacaaccuccucguccgcgucauggaggagacccccuccauccuccgcguccccuacgagcccucccgcaaggccggcaaguucuccaacuccuga

SEQ ID NO: 48413 - RNA, 1383 nt, Artificial Sequence
  derived and/or modified sequence opt2 from RAB11FIP3__Homo_sapiens__NP_001135744
augcccuuccucaaggccaacgaggucaccgacuccgccuacaugggcuccgaguccaccuacuccgagugcgagaccuucaccgacgaggacaccuccacccucguccaccccgagcuccagcccgagggcgacgccgacuccgccggcggcuccgccguccccuccgagugccucgacgccauggaggagcccgaccacggcgcccuccuccuccuccccggccgcccccacccccacggccaguccgucaucaccgucaucggcggcgaggagcacuucgaggacuacggcgagggcuccgaggccgagcucucccccgagacccucugcaacggccagcucggcugcuccgaccccgccuuccucacccccucccccaccaagcgccucuccuccaagaaggucgcccgcuaccuccaccaguccggcgcccucaccauggaggcccucgaggaccccucccccgagcucauggagggccccgaggaggacaucgccgacaaggucgucuuccucgagcgccgcguccucgagcucgagaaggacaccgccgccaccggcgagcagcacucccgccuccgccaggagaaccuccagcucguccaccgcgccaacgcccucgaggagcagcucaaggagcaggagcuccgcgccugcgagaugguccucgaggagacccgccgccagaaggagcuccucugcaagauggagcgcgagaaguccaucgagaucgagaaccuccagacccgccuccagcagcucgacgaggagaacuccgagcuccgcuccugcacccccugccucaaggccaacaucgagcgccucgaggaggagaagcagaagcuccucgacgagaucgagucccucacccuccgccucuccgaggagcaggagaacaagcgccgcaugggcgaccgccucucccacgagcgccaccaguuccagcgcgacaaggaggccacccaggagcucaucgaggaccuccgcaagcagcucgagcaccuccagcuccucaagcucgaggccgagcagcgccgcggccgcuccuccuccaugggccuccaggaguaccacucccgcgcccgcgaguccgagcucgagcaggagguccgccgccucaagcaggacaaccgcaaccucaaggagcagaacgaggagcucaacggccagaucaucacccucuccauccagggcgccaagucccucuucuccaccgccuucuccgagucccucgccgccgagaucuccuccgucucccgcgacgagcucauggaggccauccagaagcaggaggagaucaacuuccgccuccaggacuacaucgaccgcaucaucgucgccaucauggagaccaaccccuccauccucgaggucaaguga

SEQ ID NO: 48414 - RNA, 1914 nt, Artificial Sequence
  derived and/or modified sequence opt2 from RAB11FIP4__Homo_sapiens__NP_116321
auggccggcggcgccggcugguccggcgcccccgccgcccuccuccgcuccguccgccgccuccgcgaggucuucgaggucugcggccgcgaccccgacggcuuccuccgcgucgagcgcgucgccgcccucggccuccgcuucggccagggcgaggaggucgagaagcucgucaaguaccucgaccccaacgaccucggccgcaucaacuucaaggacuucugccgcggcgucuucgccaugaagggcugcgaggagcuccucaaggacguccucuccgucgaguccgccggcacccuccccugcgcccccgagauccccgacugcgucgagcagggcuccgaggucaccggccccaccuucgccgacggcgagcucaucccccgcgagcccggcuucuuccccgaggacgaggaggaggccaugacccucgccccccccgagggcccccaggagcucuacaccgacucccccauggaguccacccagucccucgagggcuccgucggcucccccgccgagaaggacggcggccucggcggccucuuccuccccgaggacaagucccucguccacacccccuccaugaccaccuccgaccucuccacccacuccaccaccucccucaucuccaacgaggagcaguucgaggacuacggcgagggcgacgacgucgacugcgcccccuccucccccugccccgacgacgagacccgcaccaacgucuacuccgaccucggcuccuccgucuccuccuccgccggccagaccccccgcaagaugcgccacgucuacaacuccgagcuccucgacgucuacugcucccagugcugcaagaagaucaaccuccucaacgaccucgaggcccgccucaagaaccucaaggccaacucccccaaccgcaagaucuccuccaccgccuucggccgccagcucaugcacuccuccaacuucuccuccuccaacggcuccaccgaggaccucuuccgcgacuccaucgacuccugcgacaacgacaucaccgagaaggucuccuuccucgagaagaaggucaccgagcucgagaacgacucccucaccaacggcgaccucaaguccaagcucaagcaggagaacacccagcucguccaccgcguccacgagcucgaggagauggucaaggaccaggagaccaccgccgagcaggcccucgaggaggaggcccgccgccaccgcgaggccuacggcaagcucgagcgcgagaaggccaccgaggucgagcuccucaacgcccgcguccagcagcucgaggaggagaacaccgagcuccgcaccaccgucacccgccucaagucccagaccgagaagcucgacgaggagcgccagcgcauguccgaccgccucgaggacaccucccuccgccucaaggacgagauggaccucuacaagcgcaugauggacaagcuccgccagaaccgccucgaguuccagaaggagcgcgaggccacccaggagcucaucgaggaccuccgcaaggagcucgagcaccuccagauguacaagcucgacugcgagcgccccggccgcggccgcuccgccuccuccggccucggcgaguucaacgcccgcgcccgcgaggucgagcucgagcacgaggucaagcgccucaagcaggagaacuacaagcuccgcgaccagaacgacgaccucaacggccagauccucucccucucccucuacgaggccaagaaccucuucgccgcccagaccaaggcccagucccucgccgccgagaucgacaccgccucccgcgacgagcucauggaggcccucaaggagcaggaggagaucaacuuccgccuccgccaguacauggacaagaucauccucgccauccucgaccacaaccccuccauccucgagaucaagcacuga

SEQ ID NO: 48415 - RNA, 1962 nt, Artificial Sequence
  derived and/or modified sequence opt2 from RAB11FIP5__Homo_sapiens__NP_056285
auggcccucguccgcggcgccgagcccgccgccggccccucccgcuggcuccccacccacguccaggucaccguccuccgcgcccgcggccuccgcggcaaguccuccggcgccggcuccaccuccgacgccuacaccgucauccaggucggccgcgagaaguacuccaccuccgucgucgagaagacccacggcugccccgaguggcgcgaggagugcuccuucgagcucccccccggcgcccucgacggccuccuccgcgcccaggaggccgacgccggccccgcccccugggccgccuccuccgccgccgccugcgagcucguccucaccaccaugcaccgcucccucaucggcgucgacaaguuccucggccaggccaccgucgcccucgacgaggucuucggcgccggccgcgcccagcacacccagugguacaagcuccacuccaagcccggcaagaaggagaaggagcgcggcgagaucgaggucaccauccaguucacccgcaacaaccucuccgccuccauguucgaccucuccaugaaggacaagccccgcucccccuucuccaagauccgcgacaagaugaagggcaagaagaaguacgaccucgaguccgccuccgccauccuccccuccuccgccaucgaggaccccgaccucggcucccucggcaagaugggcaaggccaagggcuucuuccuccgcaacaagcuccgcaaguccucccucacccaguccaacaccucccucggcuccgacuccacccucuccuccgccuccggcucccucgccuaccagggccccggcgccgagcuccucacccgcucccccucccgcuccuccuggcucuccaccgagggcggccgcgacuccgcccagucccccaagcucuucacccacaagcgcaccuacuccgacgaggccaaccagaugcgcgucgcccccccccgcgcccuccucgaccuccagggccaccucgacgccgccucccgcuccucccucugcgucaacggcucccacaucuacaacgaggagccccagggccccguccgccaccgcuccuccaucuccggcucccuccccuccuccggcucccuccaggccgucuccucccgcuucuccgaggagggcccccgcuccaccgacgacaccuggccccgcggcucccgcuccaacuccuccuccgaggccguccucggccaggaggagcucuccgcccaggccaagguccucgcccccggcgccucccaccccggcgaggaggagggcgcccgccuccccgagggcaagcccguccaggucgccacccccaucgucgccuccuccgaggccgucgccgagaaggagggcgcccgcaaggaggagcgcaagccccgcaugggccucuuccaccaccaccaccagggccucucccgcuccgagcucggccgccgcuccucccucggcgagaagggcggccccauccucggcgccuccccccaccacuccuccuccggcgaggagaaggccaaguccuccugguucggccuccgcgaggccaaggaccccacccagaagcccuccccccaccccgucaagccccucuccgccgcccccgucgagggcucccccgaccgcaagcagucccgcuccucccucuccaucgcccucuccuccggccucgagaagcucaagaccgucaccuccggcuccauccagcccgucacccaggccccccaggccggccagauggucgacaccaagcgccucaaggacuccgccguccucgaccaguccgccaaguacuaccaccucacccacgacgagcucaucucccuccuccuccagcgcgagcgcgagcucucccagcgcgacgagcacguccaggagcucgaguccuacaucgaccgccuccucguccgcaucauggagaccucccccacccuccuccagaucccccccggcccccccaaguga

SEQ ID NO: 48416 - RNA, 735 nt, Artificial Sequence
  derived and/or modified sequence opt2 from RAB12__Homo_sapiens__NP_001020471
auggaccccggcgccgcccuccagcgccgcgccggcggcggcggcggccucggcgccggcucccccgcccucuccggcggccagggccgccgccgcaagcagcccccccgccccgccgacuucaagcuccaggucaucaucaucggcucccgcggcgucggcaagaccucccucauggagcgcuucaccgacgacaccuucugcgaggccugcaaguccaccgucggcgucgacuucaagaucaagaccgucgagcuccgcggcaagaagauccgccuccagaucugggacaccgccggccaggagcgcuucaacuccaucaccuccgccuacuaccgcuccgccaagggcaucauccucgucuacgacaucaccaagaaggagaccuucgacgaccuccccaaguggaugaagaugaucgacaaguacgccuccgaggacgccgagcuccuccucgucggcaacaagcucgacugcgagaccgaccgcgagaucacccgccagcagggcgagaaguucgcccagcagaucaccggcaugcgcuucugcgaggccuccgccaaggacaacuucaacgucgacgagaucuuccucaagcucgucgacgacauccucaagaagaugccccucgacauccuccgcaacgagcucuccaacuccauccucucccuccagcccgagcccgagaucccccccgagcucccccccccccgcccccacguccgcugcugcuga

SEQ ID NO: 48417 - RNA, 648 nt, Artificial Sequence
  derived and/or modified sequence opt2 from RAB14__Homo_sapiens__NP_057406
auggccaccgcccccuacaacuacuccuacaucuucaaguacaucaucaucggcgacaugggcgucggcaaguccugccuccuccaccaguucaccgagaagaaguucauggccgacugcccccacaccaucggcgucgaguucggcacccgcaucaucgaggucuccggccagaagaucaagcuccagaucugggacaccgccggccaggagcgcuuccgcgccgucacccgcuccuacuaccgcggcgccgccggcgcccucauggucuacgacaucacccgccgcuccaccuacaaccaccucuccuccuggcucaccgacgcccgcaaccucaccaaccccaacaccgucaucauccucaucggcaacaaggccgaccucgaggcccagcgcgacgucaccuacgaggaggccaagcaguucgccgaggagaacggccuccucuuccucgaggccuccgccaagaccggcgagaacgucgaggacgccuuccucgaggccgccaagaagaucuaccagaacauccaggacggcucccucgaccucaacgccgccgaguccggcguccagcacaagcccuccgccccccagggcggccgccucaccuccgagccccagccccagcgcgagggcugcggcugcuga

SEQ ID NO: 48418 - RNA, 627 nt, Artificial Sequence
  derived and/or modified sequence opt2 from RAB15__Homo_sapiens__NP_941959
auggccaagcaguacgacguccucuuccgccuccuccucaucggcgacuccggcgucggcaagaccugccuccucugccgcuucaccgacaacgaguuccacuccucccacaucuccaccaucggcgucgacuucaagaugaagaccaucgaggucgacggcaucaagguccgcauccagaucugggacaccgccggccaggagcgcuaccagaccaucaccaagcaguacuaccgccgcgcccagggcaucuuccucgucuacgacaucuccuccgagcgcuccuaccagcacaucaugaagugggucuccgacgucgacgaggucggcgacgccaccucccuccccggcugcggcgagggcgccucccccggcaaggcccgccgcggccccgacggcaaggccaacgccucccgcaagcucugccucccccagcccuggaugaagaccuccggcacccaccagaaggccucccgccgcucccuccucggcauccgccucaugcgcucccgcaacggccgcugggaggaguccaagggcuccuccuggcgccgcuccauggccuggaccuccaugaagcagguccccgcccccaccuccacccucaagucccacucccgcgucuga

SEQ ID NO: 48419 - RNA, 708 nt, Artificial Sequence
  derived and/or modified sequence opt2 from RAB18__Homo_sapiens__NP_001243339
auggacgaggacguccucaccacccucaagauccucaucaucggcgaguccggcgucggcaaguccucccuccuccuccgcuucaccgacgacaccuucgaccccgagcucgccgccaccaucggcgucgacuucaaggucaagaccaucuccgucgacggcaacaaggccaagcucgccaucugggucacccuccaccagcagaccgccaacuucuuccucaagucccagaucggcaacucccccauccucaagugggccauguggcaguacgacaccgccggccaggagcgcuuccgcacccucacccccuccuacuaccgcggcgcccagggcgucauccucgucuacgacgucacccgccgcgacaccuucgucaagcucgacaacuggcucaacgagcucgagaccuacugcacccgcaacgacaucgucaacaugcucgucggcaacaagaucgacaaggagaaccgcgaggucgaccgcaacgagggccucaaguucgcccgcaagcacuccaugcucuucaucgaggccuccgccaagaccugcgacggcguccagugcgccuucgaggagcucgucgagaagaucauccagacccccggccucugggaguccgagaaccagaacaagggcgucaagcucucccaccgcgaggagggccagggcggcggcgccugcggcggcuacugcuccguccucuga

SEQ ID NO: 48420 - RNA, 618 nt, Artificial Sequence
  derived and/or modified sequence opt2 from RAB1A__Homo_sapiens__NP_004152
auguccuccaugaaccccgaguacgacuaccucuucaagcuccuccucaucggcgacuccggcgucggcaaguccugccuccuccuccgcuucgccgacgacaccuacaccgaguccuacaucuccaccaucggcgucgacuucaagauccgcaccaucgagcucgacggcaagaccaucaagcuccagaucugggacaccgccggccaggagcgcuuccgcaccaucaccuccuccuacuaccgcggcgcccacggcaucaucgucgucuacgacgucaccgaccaggaguccuucaacaacgucaagcaguggcuccaggagaucgaccgcuacgccuccgagaacgucaacaagcuccucgucggcaacaagugcgaccucaccaccaagaaggucgucgacuacaccaccgccaaggaguucgccgacucccucggcauccccuuccucgagaccuccgccaagaacgccaccaacgucgagcaguccuucaugaccauggccgccgagaucaagaagcgcaugggccccggcgccaccgccggcggcgccgagaaguccaacgucaagauccaguccacccccgucaagcaguccggcggcggcugcugcuga

SEQ ID NO: 48421 - RNA, 606 nt, Artificial Sequence
  derived and/or modified sequence opt2 from RAB1B__Homo_sapiens__NP_112243
augaaccccgaguacgacuaccucuucaagcuccuccucaucggcgacuccggcgucggcaaguccugccuccuccuccgcuucgccgacgacaccuacaccgaguccuacaucuccaccaucggcgucgacuucaagauccgcaccaucgagcucgacggcaagaccaucaagcuccagaucugggacaccgccggccaggagcgcuuccgcaccaucaccuccuccuacuaccgcggcgcccacggcaucaucgucgucuacgacgucaccgaccaggaguccuacgccaacgucaagcaguggcuccaggagaucgaccgcuacgccuccgagaacgucaacaagcuccucgucggcaacaaguccgaccucaccaccaagaaggucgucgacaacaccaccgccaaggaguucgccgacucccucggcauccccuuccucgagaccuccgccaagaacgccaccaacgucgagcaggccuucaugaccauggccgccgagaucaagaagcgcaugggccccggcgccgccuccggcggcgagcgccccaaccucaagaucgacuccacccccgucaagcccgccggcggcggcugcugcuga

SEQ ID NO: 48422 - RNA, 705 nt, Artificial Sequence
  derived and/or modified sequence opt2 from RAB20__Homo_sapiens__NP_060287
augcgcaagcccgacuccaagaucguccuccucggcgacaugaacgucggcaagaccucccuccuccagcgcuacauggagcgccgcuuccccgacaccgucuccaccgucggcggcgccuucuaccucaagcaguggcgcuccuacaacaucuccaucugggacaccgccggccgcgagcaguuccacggccucggcuccauguacugccgcggcgccgccgccaucauccucaccuacgacgucaaccaccgccagucccucgucgagcucgaggaccgcuuccucggccucaccgacaccgccuccaaggacugccucuucgccaucgucggcaacaaggucgaccucaccgaggagggcgcccucgccggccaggagaaggaggagugcucccccaacauggacgccggcgaccgcgucuccccccgcgcccccaagcagguccagcucgaggacgccgucgcccucuacaagaagauccucaaguacaagaugcucgacgagcaggacguccccgccgccgagcagaugugcuucgagaccuccgccaagaccggcuacaacgucgaccuccucuucgagacccucuucgaccucgucguccccaugauccuccagcagcgcgccgagcgccccucccacaccgucgacaucuccucccacaagccccccaagcgcacccgcuccggcugcugcgccuga

SEQ ID NO: 48423 - RNA, 678 nt, Artificial Sequence
  derived and/or modified sequence opt2 from RAB21__Homo_sapiens__NP_055814
auggccgccgccggcggcggcggcggcggcgccgccgccgccggccgcgccuacuccuucaaggucguccuccucggcgagggcugcgucggcaagaccucccucguccuccgcuacugcgagaacaaguucaacgacaagcacaucaccacccuccaggccuccuuccucaccaagaagcucaacaucggcggcaagcgcgucaaccucgccaucugggacaccgccggccaggagcgcuuccacgcccucggccccaucuacuaccgcgacuccaacggcgccauccucgucuacgacaucaccgacgaggacuccuuccagaaggucaagaacugggucaaggagcuccgcaagaugcucggcaacgagaucugccucugcaucgucggcaacaagaucgaccucgagaaggagcgccacgucuccauccaggaggccgaguccuacgccgaguccgucggcgccaagcacuaccacaccuccgccaagcagaacaagggcaucgaggagcucuuccucgaccucugcaagcgcaugaucgagaccgcccaggucgacgagcgcgccaagggcaacggcuccucccagcccggcaccgcccgccgcggcguccagaucaucgacgacgagccccaggcccagaccuccggcggcggcugcugcuccuccggcuga

SEQ ID NO: 48424 - RNA, 585 nt, Artificial Sequence
  derived and/or modified sequence opt2 from RAB22A__Homo_sapiens__NP_065724
auggcccuccgcgagcucaaggucugccuccucggcgacaccggcgucggcaaguccuccaucgucuggcgcuucgucgaggacuccuucgaccccaacaucaaccccaccaucggcgccuccuucaugaccaagaccguccaguaccagaacgagcuccacaaguuccucaucugggacaccgccggccaggagcgcuuccgcgcccucgcccccauguacuaccgcggcuccgccgccgccaucaucgucuacgacaucaccaaggaggagaccuucuccacccucaagaacugggucaaggagcuccgccagcacggcccccccaacaucgucgucgccaucgccggcaacaagugcgaccucaucgacguccgcgaggucauggagcgcgacgccaaggacuacgccgacuccauccacgccaucuucgucgagaccuccgccaagaacgccaucaacaucaacgagcucuucaucgagaucucccgccgcauccccuccaccgacgccaaccuccccuccggcggcaagggcuucaagcuccgccgccagcccuccgagcccaagcgcuccugcugcuga

SEQ ID NO: 48425 - RNA, 714 nt, Artificial Sequence
  derived and/or modified sequence opt2 from RAB23__Homo_sapiens__NP_001265595
augcucgaggaggacauggaggucgccaucaagauggucgucgucggcaacggcgccgucggcaaguccuccaugauccagcgcuacugcaagggcaucuucaccaaggacuacaagaagaccaucggcgucgacuuccucgagcgccagauccaggucaacgacgaggacguccgccucaugcucugggacaccgccggccaggaggaguucgacgccaucaccaaggccuacuaccgcggcgcccaggccugcguccucgucuucuccaccaccgaccgcgaguccuucgaggccgucuccuccuggcgcgagaaggucgucgccgaggucggcgacauccccaccguccucguccagaacaagaucgaccuccucgacgacuccugcaucaagaacgaggaggccgaggcccucgccaagcgccucaagcuccgcuucuaccgcaccuccgucaaggaggaccucaacgucaacgaggucuucaaguaccucgccgagaaguaccuccagaagcucaagcagcagaucgccgaggaccccgagcucacccacuccuccuccaacaagaucggcgucuucaacaccuccggcggcucccacuccggccagaacuccggcacccucaacggcggcgacgucaucaaccuccgccccaacaagcagcgcaccaagaagaaccgcaaccccuucuccuccugcuccauccccuga

SEQ ID NO: 48426 - RNA, 612 nt, Artificial Sequence
  derived and/or modified sequence opt2 from RAB24__Homo_sapiens__NP_570137
auguccggccagcgcgucgacgucaaggucgucaugcucggcaaggaguacgucggcaagaccucccucgucgagcgcuacguccacgaccgcuuccucgucggccccuaccagaacaccaucggcgccgccuucgucgccaaggucauguccgucggcgaccgcaccgucacccucggcaucugggacaccgccggcuccgagcgcuacgaggccaugucccgcaucuacuaccgcggcgccaaggccgccaucgucugcuacgaccucaccgacuccuccuccuucgagcgcgccaaguucugggucaaggagcuccgcucccucgaggagggcugccagaucuaccucugcggcaccaaguccgaccuccucgaggaggaccgccgccgccgccgcgucgacuuccacgacguccaggacuacgccgacaacaucaaggcccagcucuucgagaccuccuccaagaccggccaguccgucgacgagcucuuccagaaggucgccgaggacuacgucuccgucgccgccuuccaggucaugaccgaggacaagggcgucgaccucggccagaagcccaaccccuacuucuacuccugcugccaccacuga

SEQ ID NO: 48427 - RNA, 642 nt, Artificial Sequence
  derived and/or modified sequence opt2 from RAB25__Homo_sapiens__NP_065120
augggcaacggcaccgaggaggacuacaacuucgucuucaaggucguccucaucggcgaguccggcgucggcaagaccaaccuccucucccgcuucacccgcaacgaguucucccacgacucccgcaccaccaucggcgucgaguucuccacccgcaccgucaugcucggcaccgccgccgucaaggcccagaucugggacaccgccggccucgagcgcuaccgcgccaucaccuccgccuacuaccgcggcgccgucggcgcccuccucgucuucgaccucaccaagcaccagaccuacgccgucgucgagcgcuggcucaaggagcucuacgaccacgccgaggccaccaucgucgucaugcucgucggcaacaaguccgaccucucccaggcccgcgagguccccaccgaggaggcccgcauguucgccgagaacaacggccuccucuuccucgagaccuccgcccucgacuccaccaacgucgagcucgccuucgagaccguccucaaggagaucuucgccaaggucuccaagcagcgccagaacuccauccgcaccaacgccaucacccucggcuccgcccaggccggccaggagcccggccccggcgagaagcgcgccugcugcaucucccucuga

SEQ ID NO: 48428 - RNA, 666 nt, Artificial Sequence
  derived and/or modified sequence opt2 from RAB27A__Homo_sapiens__NP_899059
auguccgacggcgacuacgacuaccucaucaaguuccucgcccucggcgacuccggcgucggcaagaccuccguccucuaccaguacaccgacggcaaguucaacuccaaguucaucaccaccgucggcaucgacuuccgcgagaagcgcgucgucuaccgcgccuccggccccgacggcgccaccggccgcggccagcgcauccaccuccagcucugggacaccgccggccaggagcgcuuccgcucccucaccaccgccuucuuccgcgacgccaugggcuuccuccuccucuucgaccucaccaacgagcaguccuuccucaacguccgcaacuggaucucccagcuccagaugcacgccuacugcgagaaccccgacaucguccucugcggcaacaaguccgaccucgaggaccagcgcgucgucaaggaggaggaggccaucgcccucgccgagaaguacggcauccccuacuucgagaccuccgccgccaacggcaccaacaucucccaggccaucgagaugcuccucgaccucaucaugaagcgcauggagcgcugcgucgacaaguccuggauccccgagggcgucguccgcuccaacggccacgccuccaccgaccagcucuccgaggagaaggagaagggcgccugcggcugcuga

SEQ ID NO: 48429 - RNA, 657 nt, Artificial Sequence
  derived and/or modified sequence opt2 from RAB27B__Homo_sapiens__XP_005266790
augaccgacggcgacuacgacuaccucaucaagcuccucgcccucggcgacuccggcgucggcaagaccaccuuccucuaccgcuacaccgacaacaaguucaaccccaaguucaucaccaccgucggcaucgacuuccgcgagaagcgcgucgucuacaacgcccagggccccaacggcuccuccggcaaggccuucaagguccaccuccagcucugggacaccgccggccaggagcgcuuccgcucccucaccaccgccuucuuccgcgacgccaugggcuuccuccucauguucgaccucaccucccagcaguccuuccucaacguccgcaacuggaugucccagcuccaggccaacgccuacugcgagaaccccgacaucguccucaucggcaacaaggccgaccuccccgaccagcgcgaggucaacgagcgccaggcccgcgagcucgccgacaaguacggcauccccuacuucgagaccuccgccgccaccggccagaacgucgagaaggccgucgagacccuccucgaccucaucaugaagcgcauggagcagugcgucgagaagacccagauccccgacaccgucaacggcggcaacuccggcaaccucgacggcgagaagccccccgagaagaagugcaucugcuga

SEQ ID NO: 48430 - RNA, 666 nt, Artificial Sequence
  derived and/or modified sequence opt2 from RAB28__Homo_sapiens__NP_001017979
auguccgacuccgaggaggagucccaggaccgccagcucaagaucgucguccucggcgacggcgccuccggcaagaccucccucaccaccugcuucgcccaggagaccuucggcaagcaguacaagcagaccaucggccucgacuucuuccuccgccgcaucacccuccccggcaaccucaacgucacccuccagaucugggacaucggcggccagaccaucggcggcaagaugcucgacaaguacaucuacggcgcccagggcguccuccucgucuacgacaucaccaacuaccaguccuucgagaaccucgaggacugguacaccgucgucaagaaggucuccgaggaguccgagacccagccccucgucgcccucgucggcaacaagaucgaccucgagcacaugcgcaccaucaagcccgagaagcaccuccgcuucugccaggagaacggcuucuccucccacuucgucuccgccaagaccggcgacuccgucuuccucugcuuccagaaggucgccgccgagauccucggcaucaagcucaacaaggccgagaucgagcagucccagcgcgucgucaaggccgacaucgucaacuacaaccaggagcccaugucccgcaccgucaaccccccccgcuccuccaugugcgccguccaguga

SEQ ID NO: 48431 - RNA, 540 nt, Artificial Sequence
  derived and/or modified sequence opt2 from RAB29__Homo_sapiens__NP_001129135
augggcucccgcgaccaccucuucaagguccucgucgucggcgacgccgccgucggcaagaccucccucguccagcgcuacucccaggacuccuucuccaagcacuacaaguccaccgucggcggccaggagcgcuucaccuccaugacccgccucuacuaccgcgacgccuccgccugcgucaucauguucgacgucaccaacgccaccaccuucuccaacucccagcgcuggaagcaggaccucgacuccaagcucacccuccccaacggcgagcccguccccugccuccuccucgccaacaagugcgaccucucccccugggccgucucccgcgaccagaucgaccgcuucuccaaggagaacggcuucaccggcuggaccgagaccuccgucaaggagaacaagaacaucaacgaggccaugcgcguccucaucgagaagaugaugcgcaacuccaccgaggacaucaugucccucuccacccagggcgacuacaucaaccuccagaccaaguccuccuccugguccugcugcuga

SEQ ID NO: 48432 - RNA, 567 nt, Artificial Sequence
  derived and/or modified sequence opt2 from RAB2A__Homo_sapiens__NP_001229573
auggccuacgccuaccucuucaaguacaucaucaucggcgacaccggcgucgaguucggcgcccgcaugaucaccaucgacggcaagcagaucaagcuccagaucugggacaccgccggccaggaguccuuccgcuccaucacccgcuccuacuaccgcggcgccgccggcgcccuccucgucuacgacaucacccgccgcgacaccuucaaccaccucaccaccuggcucgaggacgcccgccagcacuccaacuccaacauggucaucaugcucaucggcaacaaguccgaccucgagucccgccgcgaggucaagaaggaggagggcgaggccuucgcccgcgagcacggccucaucuucauggagaccuccgccaagaccgccuccaacgucgaggaggccuucaucaacaccgccaaggagaucuacgagaagauccaggagggcgucuucgacaucaacaacgaggccaacggcaucaagaucggcccccagcacgccgccaccaacgccacccacgccggcaaccagggcggccagcaggccggcggcggcugcugcuga

SEQ ID NO: 48433 - RNA, 588 nt, Artificial Sequence
  derived and/or modified sequence opt2 from RAB31__Homo_sapiens__NP_006859
augauggccauccgcgagcucaaggucugccuccucggcgacaccggcgucggcaaguccuccaucgucugccgcuucguccaggaccacuucgaccacaacaucucccccaccaucggcgccuccuucaugaccaagaccguccccugcggcaacgagcuccacaaguuccucaucugggacaccgccggccaggagcgcuuccacucccucgcccccauguacuaccgcggcuccgccgccgccgucaucgucuacgacaucaccaagcaggacuccuucuacacccucaagaagugggucaaggagcucaaggagcacggccccgagaacaucgucauggccaucgccggcaacaagugcgaccucuccgacauccgcgaggucccccucaaggacgccaaggaguacgccgaguccaucggcgccaucgucgucgagaccuccgccaagaacgccaucaacaucgaggagcucuuccagggcaucucccgccagauccccccccucgacccccacgagaacggcaacaacggcaccaucaaggucgagaagcccaccaugcaggccucccgccgcugcugcuga

SEQ ID NO: 48434 - RNA, 678 nt, Artificial Sequence
  derived and/or modified sequence opt2 from RAB32__Homo_sapiens__NP_006825
auggccggcggcggcgccggcgaccccggccucggcgccgccgccgcccccgcccccgagacccgcgagcaccucuucaagguccucgucaucggcgagcucggcgucggcaagaccuccaucaucaagcgcuacguccaccagcucuucucccagcacuaccgcgccaccaucggcgucgacuucgcccucaagguccucaacugggacucccgcacccucguccgccuccagcucugggacaucgccggccaggagcgcuucggcaacaugacccgcgucuacuacaaggaggccgucggcgccuucgucgucuucgacaucucccgcuccuccaccuucgaggccguccucaaguggaaguccgaccucgacuccaagguccaccuccccaacggcucccccauccccgccguccuccucgccaacaagugcgaccagaacaaggacuccucccagucccccucccaggucgaccaguucugcaaggagcacggcuucgccggcugguucgagaccuccgccaaggacaacaucaacaucgaggaggccgcccgcuuccucgucgagaagauccucgucaaccaccaguccuuccccaacgaggagaacgacgucgacaagaucaagcucgaccaggagacccuccgcgccgagaacaagucccagugcugcuga

SEQ ID NO: 48435 - RNA, 690 nt, Artificial Sequence
  derived and/or modified sequence opt2 from RAB33B__Homo_sapiens__NP_112586
auggccgaggagauggaguccucccucgaggccuccuucuccuccuccggcgccgucuccggcgccuccggcuuccucccccccgcccgcucccgcaucuucaagaucaucgucaucggcgacuccaacgucggcaagaccugccucaccuaccgcuucugcgccggccgcuuccccgaccgcaccgaggccaccaucggcgucgacuuccgcgagcgcgccgucgagaucgacggcgagcgcaucaagauccagcucugggacaccgccggccaggagcgcuuccgcaaguccaugguccagcacuacuaccgcaacguccacgccgucgucuucgucuacgacaugaccaacauggccuccuuccacucccuccccuccuggaucgaggagugcaagcagcaccuccucgccaacgacaucccccgcauccucgucggcaacaagugcgaccuccgcuccgccauccagguccccaccgaccucgcccagaaguucgccgacacccacuccaugccccucuucgagaccuccgccaagaaccccaacgacaacgaccacgucgaggccaucuucaugacccucgcccacaagcucaagucccacaagccccucaugcucucccagccccccgacaacggcaucauccucaagcccgagcccaagcccgccaugaccugcuggugcuga

SEQ ID NO: 48436 - RNA, 927 nt, Artificial Sequence
  derived and/or modified sequence opt2 from RAB34__Homo_sapiens__NP_001136096
augucccaccuccccggccucgagcuccgccgcgaggcccccccccuccucggcccccuccucucccccuucccccuccccgccggcuccuggcaccgccagaugcuccgcuccucccuccgcuuccccaucaccaacuccgccggcgcccccugcaaggccgccggccgcaugaacauccucgcccccguccgccgcgaccgcguccucgccgagcucccccagugccuccgcaaggaggccgcccuccacggccacaaggacuuccacccccgcgucaccugcgccugccaggagcaccgcaccggcaccgucggcuucaagaucuccaaggucaucgucgucggcgaccucuccgucggcaagaccugccucaucaaccgcuucugcaaggacaccuucgacaagaacuacaaggccaccaucggcgucgacuucgagauggagcgcuucgagguccucggcauccccuucucccuccagcucugggacaccgccggccaggagcgcuucaagugcaucgccuccaccuacuaccgcggcgcccaggccaucaucaucgucuucaaccucaacgacgucgccucccucgagcacaccaagcaguggcucgccgacgcccucaaggagaacgaccccuccuccguccuccucuuccucacccccgcccaguacgcccucauggagaaggacgcccuccaggucgcccaggagaugaaggccgaguacugggccgucuccucccucaccggcgagaacguccgcgaguucuucuuccgcgucgccgcccucaccuucgaggccaacguccucgccgagcucgagaaguccggcgcccgccgcaucggcgacgucguccgcaucaacuccgacgacuccaaccucuaccucaccgccuccaagaagaagcccaccugcugccccuga

SEQ ID NO: 48437 - RNA, 459 nt, Artificial Sequence
  derived and/or modified sequence opt2 from RAB35__Homo_sapiens__NP_001161078
auggcccgcgacuacgaccaccucuucaagcuccucaucaucggcgacuccggcgucggcaaguccucccuccuccuccgcuucgccgacaacaccuucuccggcuccuacaucaccaccaucggcgucgacuucaagauccgcaccgucgagaucaacggcgagaaggucaagcuccagaucugggacaccgccggccaggagcgcuuccgcaccaucaccuccaccuacuaccgcggcacccacggcgucaucgucgucuacgacgucaccuccgccgaguccuucgucaacgucaagcgcuggcuccacgagaucaaccagaacugcgacgacgucugccgcauccucgacguccagcuccaccacggcgccggcccccccuccaaggagcgccagcccggcaagaccgccgccgccaccaccgagcgcugcggcgaggcccacgaggagcaguga

SEQ ID NO: 48438 - RNA, 1002 nt, Artificial Sequence
  derived and/or modified sequence opt2 from RAB36__Homo_sapiens__NP_004905
auggucaucgccggcgccuccuggaugcucggccgcgccgccgccucccccacccagaccccccccaccaccuccaccauccgcgucgcccgccgcucccgcgucgcccucgucgccauggucaucgccgccgccggcuccggcggccccggccgcgccgagccccagcucucccagcccucccucgacugcggccgcaugcgcuccucccucaccccccucggcccccccgucucccgcgaccgcgucaucgccuccuuccccaagugguacacccccgaggccugccuccagcuccgcgagcacuuccacggccaggucuccgccgccugccagcgccgcaacaccggcaccgucggccucaagcucuccaaggucgucgucgucggcgaccucuacgucggcaagaccucccucauccaccgcuucugcaagaacgucuucgaccgcgacuacaaggccaccaucggcgucgacuucgagaucgagcgcuucgagaucgccggcauccccuacucccuccagaucugggacaccgccggccaggagaaguucaagugcaucgccuccgccuacuaccgcggcgcccaggucaucaucaccgccuucgaccucaccgacguccagacccucgagcacacccgccaguggcucgaggacgcccuccgcgagaacgaggccggcuccugcuucaucuuccucgucggcaccaagaaggaccuccucuccggcgccgccugcgagcaggccgaggccgacgccguccaccucgcccgcgagaugcaggccgaguacugguccgucuccgccaagaccggcgagaacgucaaggccuucuucucccgcgucgccgcccucgccuucgagcaguccguccuccaggaccucgagcgccaguccuccgcccgccuccaggucggcaacggcgaccucauccagauggagggcuccccccccgagacccaggaguccaagcgccccuccucccucggcugcugcuga

SEQ ID NO: 48439 - RNA, 672 nt, Artificial Sequence
  derived and/or modified sequence opt2 from RAB37__Homo_sapiens__NP_001006639
augaccggcacccccggcgccgucgccacccgcgacggcgaggcccccgagcgcuccccccccugcucccccuccuacgaccucaccggcaaggucaugcuccucggcgacaccggcgucggcaagaccugcuuccucauccaguucaaggacggcgccuuccucuccggcaccuucaucgccaccgucggcaucgacuuccgcaacaaggucgucaccgucgacggcguccgcgucaagcuccagaucugggacaccgccggccaggagcgcuuccgcuccgucacccacgccuacuaccgcgacgcccaggcccuccuccuccucuacgacaucaccaacaaguccuccuucgacaacauccgcgccuggcucaccgagauccacgaguacgcccagcgcgacgucgucaucaugcuccucggcaacaaggccgacauguccuccgagcgcgucauccgcuccgaggacggcgagacccucgcccgcgaguacggcguccccuuccucgagaccuccgccaagaccggcaugaacgucgagcucgccuuccucgccaucgccaaggagcucaaguaccgcgccggccaccaggccgacgagcccuccuuccagauccgcgacuacgucgagucccagaagaagcgcuccuccugcugcuccuucauguga

SEQ ID NO: 48440 - RNA, 636 nt, Artificial Sequence
  derived and/or modified sequence opt2 from RAB38__Homo_sapiens__NP_071732
augcaggccccccacaaggagcaccucuacaagcuccucgucaucggcgaccucggcgucggcaagaccuccaucaucaagcgcuacguccaccagaacuucuccucccacuaccgcgccaccaucggcgucgacuucgcccucaagguccuccacugggaccccgagaccgucguccgccuccagcucugggacaucgccggccaggagcgcuucggcaacaugacccgcgucuacuaccgcgaggccaugggcgccuucaucgucuucgacgucacccgccccgccaccuucgaggccgucgccaaguggaagaacgaccucgacuccaagcucucccuccccaacggcaagcccgucuccgucguccuccucgccaacaagugcgaccagggcaaggacguccucaugaacaacggccucaagauggaccaguucugcaaggagcacggcuucgucggcugguucgagaccuccgccaaggagaacaucaacaucgacgaggccucccgcugccucgucaagcacauccucgccaacgagugcgaccucauggaguccaucgagcccgacgucgucaagccccaccucaccuccaccaaggucgccuccugcuccggcugcgccaaguccuga

SEQ ID NO: 48441 - RNA, 654 nt, Artificial Sequence
  derived and/or modified sequence opt2 from RAB39A__Homo_sapiens__NP_059986
auggagaccaucuggaucuaccaguuccgccucaucgucaucggcgacuccaccgucggcaaguccugccuccuccaccgcuucacccagggccgcuuccccggccuccgcucccccgccugcgaccccaccgucggcgucgacuucuucucccgccuccucgagaucgagcccggcaagcgcaucaagcuccagcucugggacaccgccggccaggagcgcuuccgcuccaucacccgcuccuacuaccgcaacuccgucggcggcuuccucgucuucgacaucaccaaccgccgcuccuucgagcacgucaaggacuggcucgaggaggccaagauguacguccagcccuuccgcaucgucuuccuccucgucggccacaagugcgaccucgccucccagcgccaggucacccgcgaggaggccgagaagcucuccgccgacugcggcaugaaguacaucgagaccuccgccaaggacgccaccaacgucgaggaguccuucaccauccucacccgcgacaucuacgagcucaucaagaagggcgagaucugcauccaggacggcugggagggcgucaaguccggcuucguccccaacaccguccacuccuccgaggaggccgucaagccccgcaaggagugcuucugcuga

SEQ ID NO: 48442 - RNA, 642 nt, Artificial Sequence
  derived and/or modified sequence opt2 from RAB39B__Homo_sapiens__NP_741995
auggaggccaucuggcucuaccaguuccgccucaucgucaucggcgacuccaccgucggcaaguccugccucauccgccgcuucaccgagggccgcuucgcccaggucuccgaccccaccgucggcgucgacuucuucucccgccucgucgagaucgagcccggcaagcgcaucaagcuccagaucugggacaccgccggccaggagcgcuuccgcuccaucacccgcgccuacuaccgcaacuccgucggcggccuccuccucuucgacaucaccaaccgccgcuccuuccagaacguccacgaguggcucgaggagaccaagguccacguccagcccuaccagaucgucuucguccucgucggccacaagugcgaccucgacacccagcgccaggucacccgccacgaggccgagaagcucgccgccgccuacggcaugaaguacaucgagaccuccgcccgcgacgccaucaacgucgagaaggccuucaccgaccucacccgcgacaucuacgagcucgucaagcgcggcgagaucaccauccaggagggcugggagggcgucaaguccggcuucguccccaacgucguccacuccuccgaggaggucgucaaguccgagcgccgcugccucugcuga

SEQ ID NO: 48443 - RNA, 663 nt, Artificial Sequence
  derived and/or modified sequence opt2 from RAB3A__Homo_sapiens__XP_011526466
auggccuccgccaccgacucccgcuacggccagaaggaguccuccgaccagaacuucgacuacauguucaagauccucaucaucggcaacuccuccgucggcaagaccuccuuccucuuccgcuacgccgacgacuccuucacccccgccuucgucuccaccgucggcaucgacuucaaggucaagaccaucuaccgcaacgacaagcgcaucaagcuccagaucugggacaccgccggccaggagcgcuaccgcaccaucaccaccgccuacuaccgcggcgccaugggcuucauccucauguacgacaucaccaacgaggaguccuucaacgccguccaggacugguccacccagaucaagaccuacuccugggacaacgcccagguccuccucgucggcaacaagugcgacauggaggacgagcgcgucgucuccuccgagcgcggccgccagcucgccgaccaccucggcuucgaguucuucgaggccuccgccaaggacaacaucaacgucaagcagaccuucgagcgccucgucgacgucaucugcgagaagauguccgagucccucgacaccgccgaccccgccgucaccggcgccaagcagggcccccagcucuccgaccagcagguccccccccaccaggacugcgccugcuga

SEQ ID NO: 48444 - RNA, 660 nt, Artificial Sequence
  derived and/or modified sequence opt2 from RAB3D__Homo_sapiens__NP_004274
auggccuccgccggcgacacccaggccggcccccgcgacgccgccgaccagaacuucgacuacauguucaagcuccuccucaucggcaacuccuccgucggcaagaccuccuuccucuuccgcuacgccgacgacuccuucacccccgccuucgucuccaccgucggcaucgacuucaaggucaagaccgucuaccgccacgacaagcgcaucaagcuccagaucugggacaccgccggccaggagcgcuaccgcaccaucaccaccgccuacuaccgcggcgccaugggcuuccuccucauguacgacaucgccaaccaggaguccuucgccgccguccaggacugggccacccagaucaagaccuacuccugggacaacgcccaggucauccucgucggcaacaagugcgaccucgaggacgagcgcgucguccccgccgaggacggccgccgccucgccgacgaccucggcuucgaguucuucgaggccuccgccaaggagaacaucaacgucaagcaggucuucgagcgccucgucgacgucaucugcgagaagaugaacgagucccucgagcccuccuccuccuccggcuccaacggcaagggccccgccgucggcgacgcccccgccccccagcccuccuccugcuccugcuga

SEQ ID NO: 48445 - RNA, 2967 nt, Artificial Sequence
  derived and/or modified sequence opt2 from RAB3GAP1__Homo_sapiens__NP_001165906
auggccgccgacuccgagcccgaguccgaggucuucgagaucaccgacuucaccaccgccuccgagugggagcgcuucaucuccaaggucgaggagguccucaacgacuggaagcucaucggcaacucccucggcaagccccucgagaagggcaucuucaccuccggcaccugggaggagaaguccgacgagaucuccuucgccgacuucaaguucuccgucacccaccacuaccucguccaggaguccaccgacaaggagggcaaggacgagcuccucgaggacgucgucccccaguccaugcaggaccuccucggcaugaacaacgacuuccccccccgcgcccacugccucguccgcugguacggccuccgcgaguucgucgucaucgcccccgccgcccacuccgacgccguccucuccgaguccaagugcaaccuccuccucuccuccgucuccaucgcccucggcaacaccggcugccaggucccccucuucguccagauccaccacaaguggcgccgcauguacgucggcgagugccagggccccggcguccgcaccgacuucgagaugguccaccuccgcaagguccccaaccaguacacccaccucuccggccuccucgacaucuucaaguccaagaucggcugcccccucaccccccucccccccgucuccaucgccauccgcuucaccuacguccuccaggacuggcagcaguacuucuggccccagcagccccccgacaucgacgcccucgucggcggcgaggucggcggccucgaguucggcaagcuccccuucggcgccugcgaggaccccaucuccgagcuccaccucgccaccaccuggccccaccucaccgagggcaucaucgucgacaacgacgucuacuccgaccucgaccccauccaggccccccacugguccguccgcguccgcaaggccgagaacccccagugccuccucggcgacuucgucaccgaguucuucaagaucugccgccgcaaggaguccaccgacgagauccucggccgcuccgccuucgaggaggagggcaaggagaccgccgacaucacccacgcccucuccaagcucaccgagcccgccuccguccccauccacaagcucuccgucuccaacaugguccacaccgccaagaagaagauccgcaagcaccgcggcgucgaggaguccccccucaacaacgacguccucaacaccauccuccucuuccucuuccccgacgccgucuccgagaagccccucgacggcaccaccuccaccgacaacaacaacccccccuccgaguccgaggacuacaaccucuacaaccaguucaaguccgcccccuccgacucccucaccuacaagcucgcccucugccucugcaugaucaacuucuaccacggcggccucaagggcgucgcccaccucuggcaggaguucguccucgagaugcgcuuccgcugggagaacaacuuccucauccccggccucgccuccggcccccccgaccuccgcugcugccuccuccaccagaagcuccagaugcucaacugcugcaucgagcgcaagaaggcccgcgacgagggcaagaagaccuccgccuccgacgucaccaacaucuaccccggcgacgccggcaaggccggcgaccagcucguccccgacaaccucaaggagaccgacaaggagaagggcgaggucggcaaguccugggacuccugguccgacuccgaggaggaguucuucgagugccucuccgacaccgaggagcucaagggcaacggccaggaguccggcaagaagggcggccccaaggagauggccaaccuccgccccgagggccgccucuaccagcacggcaagcucacccuccuccacaacggcgagccccucuacauccccgucacccaggagcccgcccccaugaccgaggaccuccucgaggagcaguccgagguccucgccaagcucggcaccuccgccgagggcgcccaccuccgcgcccgcaugcaguccgccugccuccucuccgacauggaguccuucaaggccgccaaccccggcugcucccucgaggacuucguccgcugguacuccccccgcgacuacaucgaggaggaggucaucgacgagaagggcaacgucguccucaagggcgagcucuccgcccgcaugaagauccccuccaacaugugggucgaggccugggagaccgccaagcccauccccgcccgccgccagcgccgccucuucgacgacacccgcgaggccgagaagguccuccacuaccucgccauccagaagcccgccgaccucgcccgccaccuccuccccugcgucauccacgccgccguccucaaggucaaggaggaggagucccucgagaacaucuccuccgucaagaagaucaucaagcagaucaucucccacuccuccaagguccuccacuuccccaaccccgaggacaagaagcucgaggagaucauccaccagaucaccaacgucgaggcccucaucgcccgcgcccgcucccucaaggccaaguucggcaccgagaagugcgagcaggaggaggagaaggaggaccucgagcgcuucgucuccugccuccucgagcagcccgagguccucgucaccggcgccggccgcggccacgccggccgcaucauccacaagcucuucgucaacgcccagcgccucaccgaguccuccgacgaggccgccgccaugaccccccccgaggaggagcucaagcgcaugggcucccccgaggagcgccgccagaacuccgucuccgacuuccccccccccgccggccgcgaguucauccuccgcaccaccgucccccgccccgcccccuacuccaaggcccucccccagcgcauguacuccguccucaccaaggaggacuuccgccucgccggcgccuucuccuccgacaccuccuucuucuga

SEQ ID NO: 48446 - RNA, 4182 nt, Artificial Sequence
  derived and/or modified sequence opt2 from RAB3GAP2__Homo_sapiens__NP_036546
auggccugcuccaucguccaguucugcuacuuccaggaccuccaggccgcccgcgacuuccucuucccccaccuccgcgaggagauccucuccggcgcccuccgccgcgaccccuccaaguccaccgacugggaggacgacggcuggggcgccugggaggagaacgagccccaggagcccgaggaggagggcaacaccugcaagacccagaagaccuccuggcuccaggacugcguccucucccucucccccaccaacgaccucauggucaucgcccgcgagcagaaggccgucuuccucguccccaaguggaaguacuccgacaagggcaaggaggagaugcaguucgccgucggcugguccggcucccucaacgucgaggagggcgagugcgucaccuccgcccucugcaucccccucgccucccagaagcgcuccuccaccggccgccccgacuggaccugcaucgucgucggcuucaccuccggcuacguccgcuucuacaccgagaacggcguccuccuccucgcccagcuccucaacgaggaccccguccuccagcucaagugccgcaccuacgagaucccccgccaccccggcgucaccgagcagaacgaggagcucuccauccucuaccccgccgccaucgucaccaucgacggcuucucccucuuccagucccuccgcgccugccgcaaccaggucgccaaggccgccgccuccggcaacgagaacauccagccccccccccucgccuacaagaaguggggccuccaggacaucgacaccaucaucgaccacgccuccgucggcaucaugacccucucccccuucgaccagaugaagaccgccuccaacaucggcggcuucaacgccgccaucaagaacuccccccccgccaugucccaguacaucaccgucggcuccaaccccuucaccggcuucuucuacgcccucgagggcuccacccagccccuccucucccacgucgcccucgccgucgccuccaagcucaccuccgcccucuucaacgccgccuccggcuggcucggcuggaaguccaagcacgaggaggaggccguccagaagcagaagcccaaggucgagcccgccaccccccucgccguccgcuucggccuccccgacucccgccgccacggcgaguccaucugccucucccccugcaacacccucgccgccgucaccgacgacuucggccgcgucauccuccucgacgucgcccgcggcaucgccauccgcauguggaagggcuaccgcgacgcccagaucggcuggauccagaccgucgaggaccuccacgagcgcguccccgagaaggccgacuucucccccuucggcaacucccagggccccucccgcgucgcccaguuccucgucaucuacgccccccgccgcggcauccucgaggucugguccacccagcagggcccccgcgucggcgccuucaacgucggcaagcacugccgccuccucuaccccggcuacaagaucaugggccucaacaacgucaccucccaguccuggcagccccagaccuaccagaucugccucgucgaccccgucuccggcuccgucaagaccgucaacguccccuuccaccucgcccucuccgacaagaaguccgagcgcgccaaggacaugcaccucgucaagaagcucgccgcccuccucaagaccaagucccccaaccucgaccucgucgagaccgagaucaaggagcucauccucgacaucaaguaccccgccaccaagaagcaggcccucgaguccauccucgccuccgagcgccuccccuucuccugccuccgcaacaucacccagacccucauggacacccucaagucccaggagcucgaguccgucgacgagggccuccuccaguucugcgccaacaagcucaagcuccuccagcucuacgaguccgucucccagcucaacucccucgacuuccaccucgacacccccuucuccgacaacgaccucgcccuccuccuccgccucgacgagaaggagcuccucaagcuccaggcccuccucgagaaguacaagcaggagaacacccgcaccaacguccgcuucuccgacgacaaggacggcguccuccccgucaagaccuuccucgaguaccucgaguacgagaaggacguccucaacaucaagaagaucuccgaggaggaguacgucgcccucggcuccuucuucuucuggaagugccuccacggcgaguccuccaccgaggacaugugccacacccucgaguccgccggccucuccccccagcuccuccucucccuccuccucuccgucuggcucuccaaggagaaggacauccucgacaagccccaguccaucugcugccuccacaccaugcucucccuccucuccaagaugaaggucgccaucgacgagaccugggacucccaguccgucucccccugguggcagcagaugcgcaccgccugcauccaguccgagaacaacggcgccgcccuccucuccgcccacgucggccacuccgucgccgcccagaucuccaacaacaugaccgagaagaaguucucccagaccguccucggcgccgacuccgaggcccucaccgacuccugggaggcccucucccucgacaccgaguacuggaagcuccuccucaagcagcucgaggacugccucauccuccagacccuccuccacuccaagggcaacacccagaccuccaaggucuccucccuccaggccgagccccucccccgccucuccgucaagaagcuccucgagggcggcaagggcggcaucgccgacuccgucgccaaguggaucuucaagcaggacuucucccccgagguccucaagcucgccaacgaggagcgcgacgccgagaaccccgacgagcccaaggagggcgucaaccgcuccuuccucgaggucuccgagauggagauggaccucggcgccauccccgaccuccuccaccucgccuacgagcaguuccccugcucccucgagcucgacguccuccacgcccacugcugcugggaguacgucguccaguggaacaaggaccccgaggaggcccgcuucuucguccgcuccaucgagcaccucaagcagaucuucaacgcccacguccagaacggcaucgcccucaugauguggaacaccuuccucgucaagcgcuucuccgccgccaccuaccucauggacaaggucggcaagucccccaaggaccgccucugccgccgcgacgucggcauguccgacaccgccaugaccuccuuccucggcuccugccucgaccuccuccagauccucauggaggccgacgucucccgcgacgagauccagguccccguccucgacaccgaggacgccuggcucuccgucgagggccccaucuccaucgucgagcucgcccucgagcagaagcacauccacuacccccucgucgagcaccacuccauccucugcuccauccucuacgccgucaugcgcuucucccucaagaccgucaagccccucucccucuucgacuccaagggcaagaacgccuucuucaaggaccucaccuccauccagcuccuccccuccggcgagauggaccccaacuucaucuccguccgccagcaguuccuccucaaggucgucuccgccgccguccaggcccagcacuccgccaccaaggucaaggaccccaccgaggaggccacccccacccccuucggcaaggaccaggacuggcccgcccucgccgucgaccucgcccaccaccuccaggucuccgaggacgucguccgccgccacuacgucggcgagcucuacaacuacggcgucgaccaccucggcgaggaggccauccuccagguccacgacaaggagguccucgccucccagcuccucguccucaccggccagcgccucgcccacgcccuccuccacacccagaccaaggagggcauggagcuccucgcccgccucccccccacccucugcaccuggcucaaggccauggacccccaggaccuccagaacaccgagguccccaucgccaccaccgccaagcucgucaacaaggucaucgagcuccuccccgagaagcacggccaguacggccucgcccuccaccucaucgaggccgucgaggccaucucccuccccucccucuga

SEQ ID NO: 48447 - RNA, 1071 nt, Artificial Sequence
  derived and/or modified sequence opt2 from RAB3IL1__Homo_sapiens__NP_001258615
auggacuccuccgaggagcacgccggcugccccgcccgcggcaccugccccgucuuccucgccauguccgccggcaccguccgcuacgcccccuccggccucugccccguccucgagggcaaccuccgcgaggagcccuggggcaccgacucccccccccagcccgaccagggccucccccccccccucgccgccguccccguccccuggaaguccaccgaccccugccagggccaccgcgagucccccggcgcccucgucgagaccuccgccggcgaggaggcccagggccaggagggccccgccgccgcccagcucgacguccuccgccuccgcuccuccuccauggagauccgcgagaagggcuccgaguuccucaaggaggagcuccaccgcgcccagaaggagcucaagcucaaggacgaggagugcgagcgccucuccaagguccgcgagcagcucgagcaggagcucgaggagcucaccgccucccucuucgaggaggcccacaagaugguccgcgaggccaacaugaagcaggccgccuccgagaagcagcucaaggaggcccgcggcaaggucgacaccauccucuucgccgaguuccaggccuggcgcgagucccccacccucgacaagaccugccccuuccucgagcgcgucuaccgcgaggacgucggccccugccucgacuucaccaugcaggagcucuccguccucguccgcgccgccgucgaggacaacacccucaccaucgagcccgucgccucccagacccuccccaccgucaaggucgccgaggucgacugcuccuccaccaacaccugcgcccucuccggccucacccgcaccugccgccaccgcauccgccucggcgacuccaagucccacuacuacaucucccccuccucccgcgcccgcaucaccgccgucugcaacuucuucaccuacauccgcuacauccagcagggccucguccgccaggacgccgagcccauguucugggagaucaugcgccuccgcaaggagaugucccucgccaagcucggcuucuucccccaggaggccuga

SEQ ID NO: 48448 - RNA, 765 nt, Artificial Sequence
  derived and/or modified sequence opt2 from RAB3IP__Homo_sapiens__NP_001019818
augguccgcgaggccaacaucaagcaggccaccgccgagaagcagcucaaggaggcccagggcaagaucgacguccuccaggccgaggucgccgcccucaagacccucguccucuccuccucccccaccucccccacccaggagccccuccccggcggcaagacccccuucaagaagggccacacccgcaacaaguccaccuccuccgccauguccggcucccaccaggaccucuccgucauccagcccaucgucaaggacugcaaggaggccgaccucucccucuacaacgaguuccgccucuggaaggacgagcccaccauggaccgcaccugccccuuccucgacaagaucuaccaggaggacaucuuccccugccucaccuucuccaaguccgagcucgccuccgccguccucgaggccgucgagaacaacacccucuccaucgagcccgucggccuccagcccauccgcuucgucaaggccuccgccgucgagugcggcggccccaagaagugcgcccucaccggccaguccaaguccugcaagcaccgcaucaagcucggcgacuccuccaacuacuacuacaucucccccuucugccgcuaccgcaucaccuccgucugcaacuucuucaccuacauccgcuacauccagcagggccucgucaagcagcaggacgucgaccagauguucugggaggucaugcagcuccgcaaggagaugucccucgccaagcucggcuacuucaaggaggagcucuga

SEQ ID NO: 48449 - RNA, 837 nt, Artificial Sequence
  derived and/or modified sequence opt2 from RAB40AL__Homo_sapiens__NP_001027004
auguccgcccccggcucccccgaccaggccuacgacuuccuccucaaguuccuccucgucggcgaccgcgacgucggcaaguccgagauccucgagucccuccaggacggcaccgccgagucccccuacucccaccucggcggcaucgacuacaagaccaccaccauccuccucgacggccagcgcgucaagcucaagcucugggacaccuccggccagggccgcuucugcaccaucuuccgcuccuacucccgcggcgcccagggcgucauccucgucuacgacaucgccaaccgcugguccuucgagggcauggaccgcuggaucaagaagaucgaggagcacgcccccggcguccccaagauccucgucggcaaccgccuccaccucgccuucaagcgccaggucccccgcgagcaggcccaggccuacgccgagcgccucggcgucaccuucuucgaggucuccccccucugcaacuucaacaucaucgaguccuucaccgagcucgcccgcaucguccuccuccgccaccgccucaacuggcucggccgccccuccaagguccucucccuccaggaccucugcugccgcaccaucgucuccugcacccccguccaccucgucgacaagcucccccuccccaucgcccuccgcucccaccucaaguccuucuccauggccaagggccucaacgcccgcaugaugcgcggccucuccuacucccucaccaccuccuccacccacaagcgcuccucccucugcaaggucaagaucgucugccccccccaguccccccccaagaacugcacccgcaacuccugcaagaucuccuga

SEQ ID NO: 48450 - RNA, 837 nt, Artificial Sequence
  derived and/or modified sequence opt2 from RAB40B__Homo_sapiens__NP_006813
auguccgcccucggcucccccguccgcgccuacgacuuccuccucaaguuccuccucgucggcgacuccgacgucggcaagggcgagauccucgccucccuccaggacggcgccgccgagucccccuacggccaccccgccggcaucgacuacaagaccaccaccauccuccucgacggccgccgcgucaagcuccagcucugggacaccuccggccagggccgcuucugcaccaucuuccgcuccuacucccgcggcgcccagggcgucauccucgucuacgacaucgccaaccgcugguccuucgacggcaucgaccgcuggaucaaggagaucgacgagcacgcccccggcguccccaagauccucgucggcaaccgccuccaccucgccuucaagcgccagguccccaccgagcaggcccaggccuacgccgagcgccucggcgucaccuucuucgaggucuccccccucugcaacuucaacaucaccgaguccuucaccgagcucgcccgcaucguccuccuccgccacggcauggaccgccucuggcgccccuccaagguccucucccuccaggaccucugcugccgcgccgucgucuccugcacccccguccaccucgucgacaagcucccccuccccaucgcccuccgcucccaccucaaguccuucuccauggccaacggccucaacgcccgcaugaugcacggcggcuccuacucccucaccaccuccuccacccacaagcgcuccucccuccgcaaggucaagcucguccgccccccccaguccccccccaagaacugcacccgcaacuccugcaagaucuccuga

SEQ ID NO: 48451 - RNA, 846 nt, Artificial Sequence
  derived and/or modified sequence opt2 from RAB40C__Homo_sapiens__NP_001166136
augggcucccagggcucccccgucaaguccuacgacuaccuccucaaguuccuccucgucggcgacuccgacgucggcaagggcgagauccucgagucccuccaggacggcgccgccgagucccccuacgccuacuccaacggcaucgacuacaagaccaccaccauccuccucgacggccgccgcgucaagcucgagcucugggacaccuccggccagggccgcuucugcaccaucuuccgcuccuacucccgcggcgcccagggcauccuccucgucuacgacaucaccaaccgcugguccuucgacggcaucgaccgcuggaucaaggagaucgacgagcacgcccccggcgucccccgcauccucgucggcaaccgccuccaccucgccuucaagcgccagguccccaccgagcaggcccgcgccuacgccgagaagaacugcaugaccuucuucgaggucuccccccucugcaacuucaacgucaucgaguccuucaccgagcucucccgcaucguccucaugcgccacggcauggagaagaucuggcgccccaaccgcgucuucucccuccaggaccucugcugccgcgccaucgucuccugcacccccguccaccucaucgacaagcucccccuccccgucaccaucaagucccaccucaaguccuucuccauggccaacggcaugaacgccgucaugaugcacggccgcuccuacucccucgccuccggcgccggcggcggcggcuccaagggcaacucccucaagcgcuccaaguccauccgccccccccagucccccccccagaacugcucccgcuccaacugcaagaucuccuga

SEQ ID NO: 48452 - RNA, 657 nt, Artificial Sequence
  derived and/or modified sequence opt2 from RAB4A__Homo_sapiens__NP_004569
augucccagaccgccauguccgagaccuacgacuuccucuucaaguuccucgucaucggcaacgccggcaccggcaaguccugccuccuccaccaguucaucgagaagaaguucaaggacgacuccaaccacaccaucggcgucgaguucggcuccaagaucaucaacgucggcggcaaguacgucaagcuccagaucugggacaccgccggccaggagcgcuuccgcuccgucacccgcuccuacuaccgcggcgccgccggcgcccuccucgucuacgacaucaccucccgcgagaccuacaacgcccucaccaacuggcucaccgacgcccgcaugcucgccucccagaacaucgucaucauccucugcggcaacaagaaggaccucgacgccgaccgcgaggucaccuuccucgaggccucccgcuucgcccaggagaacgagcucauguuccucgagaccuccgcccucaccggcgagaacgucgaggaggccuucguccagugcgcccgcaagauccucaacaagaucgaguccggcgagcucgaccccgagcgcaugggcuccggcauccaguacggcgacgccgcccuccgccagcuccgcuccccccgccgcgcccaggcccccaacgcccaggagugcggcugcuga

SEQ ID NO: 48453 - RNA, 642 nt, Artificial Sequence
  derived and/or modified sequence opt2 from RAB4B__Homo_sapiens__NP_057238
auggccgagaccuacgacuuccucuucaaguuccucgucaucggcuccgccggcaccggcaaguccugccuccuccaccaguucaucgagaacaaguucaagcaggacuccaaccacaccaucggcgucgaguucggcucccgcgucgucaacgucggcggcaagaccgucaagcuccagaucugggacaccgccggccaggagcgcuuccgcuccgucacccgcuccuacuaccgcggcgccgccggcgcccuccucgucuacgacaucaccucccgcgagaccuacaacucccucgccgccuggcucaccgacgcccgcacccucgccucccccaacaucgucgucauccucugcggcaacaagaaggaccucgaccccgagcgcgaggucaccuuccucgaggccucccgcuucgcccaggagaacgagcucauguuccucgagaccuccgcccucaccggcgagaacgucgaggaggccuuccucaagugcgcccgcaccauccucaacaagaucgacuccggcgagcucgaccccgagcgcaugggcuccggcauccaguacggcgacgccucccuccgccagcuccgccagccccgcuccgcccaggccgucgccccccagcccugcggcugcuga

SEQ ID NO: 48454 - RNA, 606 nt, Artificial Sequence
  derived and/or modified sequence opt2 from RAB5A__Homo_sapiens__NP_001278977
auggccucccgcggcgccacccgccccaacggccccaacaccggcaacaagaucugccaguucaagcucguccuccucggcgaguccgccgucggcaaguccucccucguccuccgcuucgucaagggccaguuccacgaguuccaggaguccaccaucggcgucaaguucgagaucugggacaccgccggccaggagcgcuaccacucccucgcccccauguacuaccgcggcgcccaggccgccaucgucgucuacgacaucaccaacgaggaguccuucgcccgcgccaagaacugggucaaggagcuccagcgccaggccucccccaacaucgucaucgcccucuccggcaacaaggccgaccucgccaacaagcgcgccgucgacuuccaggaggcccaguccuacgccgacgacaacucccuccucuucauggagaccuccgccaagaccuccaugaacgucaacgagaucuucauggccaucgccaagaagcuccccaagaacgagccccagaaccccggcgccaacuccgcccgcggccgcggcgucgaccucaccgagcccacccagcccacccgcaaccagugcugcuccaacuga

SEQ ID NO: 48455 - RNA, 525 nt, Artificial Sequence
  derived and/or modified sequence opt2 from RAB5B__Homo_sapiens__NP_001238966
augaccucccgcuccaccgcccgccccaacggccagccccaggccuccaagaucugccaguucaagcucguccuccucggcgaguccgccgucggcaaguccucccucguccuccgcuucgucaagggccaguuccacgaguaccaggaguccaccaucggcgccgccuuccucacccaguccgucugccucgacgacaccaccgucaaguucgagaucugggacaccgccggccaggagcgcuaccacucccucgcccccauguacuaccgcggcgcccaggccgccaucgucgucuacgacaucaccaaccaggaggcccaggccuacgccgacgacaacucccuccucuucauggagaccuccgccaagaccgccaugaacgucaacgaccucuuccucgccaucgccaagaagcuccccaaguccgagccccagaaccucggcggcgccgccggccgcucccgcggcgucgaccuccacgagcagucccagcagaacaagucccagugcugcuccaacuga

SEQ ID NO: 48456 - RNA, 750 nt, Artificial Sequence
  derived and/or modified sequence opt2 from RAB5C__Homo_sapiens__NP_001238968
auggagcucuccuggcgcucccccuccccccucuccgccucccuccacuccaccuccccccacccccacgcccucuggaccaccaccgccggccgcgccauggccggccgcggcggcgccgcccgccccaacggccccgccgccggcaacaagaucugccaguucaagcucguccuccucggcgaguccgccgucggcaaguccucccucguccuccgcuucgucaagggccaguuccacgaguaccaggaguccaccaucggcgccgccuuccucacccagaccgucugccucgacgacaccaccgucaaguucgagaucugggacaccgccggccaggagcgcuaccacucccucgcccccauguacuaccgcggcgcccaggccgccaucgucgucuacgacaucaccaacaccgacaccuucgcccgcgccaagaacugggucaaggagcuccagcgccaggccucccccaacaucgucaucgcccucgccggcaacaaggccgaccucgccuccaagcgcgccgucgaguuccaggaggcccaggccuacgccgacgacaacucccuccucuucauggagaccuccgccaagaccgccaugaacgucaacgagaucuucauggccaucgccaagaagcuccccaagaacgagccccagaacgccaccggcgcccccggccgcaaccgcggcgucgaccuccaggagaacaaccccgccucccgcucccagugcugcuccaacuga

SEQ ID NO: 48457 - RNA, 315 nt, Artificial Sequence
  derived and/or modified sequence opt2 from RAB6A__Homo_sapiens__NP_001230647
auguccaccggcggcgacuucggcaacccccuccgcaaguucaagcucgucuuccucggcgagcaguccgucggcaagaccucccucaucacccgcuucauguacgacuccuucgacaacaccuaccaggccaccaucggcaucgacuuccucuccaagaccauguaccucgaggaccgcacccucuuccgccgcgucgccgccgcccuccccggcauggaguccacccaggaccgcucccgcgaggacaugaucgacaucaagcucgagaagccccaggagcagcccgucuccgagggcggcugcuccugcuga

SEQ ID NO: 48458 - RNA, 627 nt, Artificial Sequence
  derived and/or modified sequence opt2 from RAB6B__Homo_sapiens__NP_057661
auguccgccggcggcgacuucggcaacccccuccgcaaguucaagcucgucuuccucggcgagcaguccgucggcaagaccucccucaucacccgcuucauguacgacuccuucgacaacaccuaccaggccaccaucggcaucgacuuccucuccaagaccauguaccucgaggaccgcaccguccgccuccagcucugggacaccgccggccaggagcgcuuccgcucccucauccccuccuacauccgcgacuccaccgucgccgucgucgucuacgacaucaccaaccucaacuccuuccagcagaccuccaaguggaucgacgacguccgcaccgagcgcggcuccgacgucaucaucaugcucgucggcaacaagaccgaccucgccgacaagcgccagaucaccaucgaggagggcgagcagcgcgccaaggagcucuccgucauguucaucgagaccuccgccaagaccggcuacaacgucaagcagcucuuccgccgcgucgccuccgcccuccccggcauggagaacguccaggagaaguccaaggagggcaugaucgacaucaagcucgacaagccccaggagccccccgccuccgagggcggcugcuccugcuga

SEQ ID NO: 48459 - RNA, 765 nt, Artificial Sequence
  derived and/or modified sequence opt2 from RAB6C__Homo_sapiens__NP_115520
auguccgccggcggcgacuucggcaacccccuccgcaaguucaagcucgucuuccucggcgagcaguccgucgccaagaccucccucaucacccgcuuccgcuacgacuccuucgacaacaccuaccaggccaucaucggcaucgacuuccucuccaagaccauguaccucgaggacggcaccaucggccuccgccucugggacaccgccggccaggagcgccuccgcucccucaucccccgcuacauccgcgacuccgccgccgccgucgucgucuacgacaucaccaacgucaacuccuuccagcagaccaccaaguggaucgacgacguccgcaccgagcgcggcuccgacgucaucaucacccucgucggcaaccgcaccgaccucgccgacaagcgccaggucuccgucgaggagggcgagcgcaaggccaagggccucaacgucaccuucaucgagacccgcgccaaggccggcuacaacgucaagcagcucuuccgccgcgucgccgccgcccuccccggcauggaguccacccaggacggcucccgcgaggacauguccgacaucaagcucgagaagccccaggagcagaccgucuccgagggcggcugcuccugcuacucccccauguccuccuccacccucccccagaagccccccuacuccuucaucgacugcuccgucaacaucggccucaaccucuuccccucccucaucaccuucugcaacuccucccuccuccccgucuccuggcgcuga

SEQ ID NO: 48460 - RNA, 624 nt, Artificial Sequence
  derived and/or modified sequence opt2 from RAB7A__Homo_sapiens__NP_004628
augaccucccgcaagaagguccuccucaaggucaucauccucggcgacuccggcgucggcaagaccucccucaugaaccaguacgucaacaagaaguucuccaaccaguacaaggccaccaucggcgccgacuuccucaccaaggaggucauggucgacgaccgccucgucaccaugcagaucugggacaccgccggccaggagcgcuuccagucccucggcgucgccuucuaccgcggcgccgacugcugcguccucgucuucgacgucaccgcccccaacaccuucaagacccucgacuccuggcgcgacgaguuccucauccaggccuccccccgcgaccccgagaacuuccccuucgucguccucggcaacaagaucgaccucgagaaccgccaggucgccaccaagcgcgcccaggccuggugcuacuccaagaacaacauccccuacuucgagaccuccgccaaggaggccaucaacgucgagcaggccuuccagaccaucgcccgcaacgcccucaagcaggagaccgaggucgagcucuacaacgaguuccccgagcccaucaagcucgacaagaacgaccgcgccaaggccuccgccgaguccugcuccugcuga

SEQ ID NO: 48461 - RNA, 624 nt, Artificial Sequence
  derived and/or modified sequence opt2 from RAB8A__Homo_sapiens__NP_005361
auggccaagaccuacgacuaccucuucaagcuccuccucaucggcgacuccggcgucggcaagaccugcguccucuuccgcuucuccgaggacgccuucaacuccaccuucaucuccaccaucggcaucgacuucaagauccgcaccaucgagcucgacggcaagcgcaucaagcuccagaucugggacaccgccggccaggagcgcuuccgcaccaucaccaccgccuacuaccgcggcgccaugggcaucaugcucgucuacgacaucaccaacgagaaguccuucgacaacauccgcaacuggauccgcaacaucgaggagcacgccuccgccgacgucgagaagaugauccucggcaacaagugcgacgucaacgacaagcgccaggucuccaaggagcgcggcgagaagcucgcccucgacuacggcaucaaguucauggagaccuccgccaaggccaacaucaacgucgagaacgccuucuucacccucgcccgcgacaucaaggccaagauggacaagaagcucgagggcaacuccccccagggcuccaaccagggcgucaagaucacccccgaccagcagaagcgcuccuccuucuuccgcugcguccuccucuga

SEQ ID NO: 48462 - RNA, 624 nt, Artificial Sequence
  derived and/or modified sequence opt2 from RAB8B__Homo_sapiens__NP_057614
auggccaagaccuacgacuaccucuucaagcuccuccucaucggcgacuccggcgucggcaagaccugccuccucuuccgcuucuccgaggacgccuucaacaccaccuucaucuccaccaucggcaucgacuucaagauccgcaccaucgagcucgacggcaagaagaucaagcuccagaucugggacaccgccggccaggagcgcuuccgcaccaucaccaccgccuacuaccgcggcgccaugggcaucaugcucgucuacgacaucaccaacgagaaguccuucgacaacaucaagaacuggauccgcaacaucgaggagcacgccuccuccgacgucgagcgcaugauccucggcaacaagugcgacaugaacgacaagcgccaggucuccaaggagcgcggcgagaagcucgccaucgacuacggcaucaaguuccucgagaccuccgccaaguccuccgccaacgucgaggaggccuucuucacccucgcccgcgacaucaugaccaagcucaaccgcaagaugaacgacuccaacuccgccggcgccggcggccccgucaagaucaccgagaaccgcuccaagaagaccuccuucuuccgcugcucccuccucuga

SEQ ID NO: 48463 - RNA, 606 nt, Artificial Sequence
  derived and/or modified sequence opt2 from RAB9A__Homo_sapiens__NP_001182257
auggccggcaaguccucccucuucaaggucauccuccucggcgacggcggcgucggcaaguccucccucaugaaccgcuacgucaccaacaaguucgacacccagcucuuccacaccaucggcgucgaguuccucaacaaggaccucgaggucgacggccacuucgucaccaugcagaucugggacaccgccggccaggagcgcuuccgcucccuccgcacccccuucuaccgcggcuccgacugcugccuccucaccuucuccgucgacgacucccaguccuuccagaaccucuccaacuggaagaaggaguucaucuacuacgccgacgucaaggagcccgaguccuuccccuucgucauccucggcaacaagaucgacaucuccgagcgccaggucuccaccgaggaggcccaggccuggugccgcgacaacggcgacuaccccuacuucgagaccuccgccaaggacgccaccaacgucgccgccgccuucgaggaggccguccgccgcguccucgccaccgaggaccgcuccgaccaccucauccagaccgacaccgucaaccuccaccgcaagcccaagcccuccuccuccugcugcuga

SEQ ID NO: 48464 - RNA, 558 nt, Artificial Sequence
  derived and/or modified sequence opt2 from RABAC1__Homo_sapiens__NP_006414
auggccgcccagaaggaccagcagaaggacgccgaggccgagggccucuccggcaccacccuccuccccaagcucauccccuccggcgccggccgcgaguggcucgagcgccgccgcgccaccauccgccccugguccaccuucgucgaccagcagcgcuucucccgcccccgcaaccucggcgagcucugccagcgccucguccgcaacgucgaguacuaccaguccaacuacgucuucgucuuccucggccucauccucuacugcgucgucaccucccccaugcuccucgucgcccucgccgucuucuucggcgccugcuacauccucuaccuccgcacccucgaguccaagcucguccucuucggccgcgaggucucccccgcccaccaguacgcccucgccggcggcaucuccuuccccuucuucuggcucgccggcgccggcuccgccgucuucuggguccucggcgccacccucgucgucaucggcucccacgccgccuuccaccagaucgaggccgucgacggcgaggagcuccagauggagcccgucuga

SEQ ID NO: 48465 - RNA, 2490 nt, Artificial Sequence
  derived and/or modified sequence opt2 from RABEP1__Homo_sapiens__NP_001077054
auggcccagcccggccccgccucccagcccgacgucucccuccagcagcgcgucgccgagcucgagaagaucaacgccgaguuccuccgcgcccagcagcagcucgagcaggaguucaaccagaagcgcgccaaguucaaggagcucuaccucgccaaggaggaggaccucaagcgccagaacgccguccuccaggccgcccaggacgaccucggccaccuccgcacccagcucugggaggcccaggccgagauggagaacaucaaggccaucgccaccgucuccgagaacaccaagcaggaggccaucgacgaggucaagcgccaguggcgcgaggaggucgccucccuccaggccgucaugaaggagaccguccgcgacuacgagcaccaguuccaccuccgccucgagcaggagcgcacccagugggcccaguaccgcgaguccgccgagcgcgagaucgccgaccuccgccgccgccucuccgagggccaggaggaggagaaccucgagaacgagaugaagaaggcccaggaggacgccgagaagcuccgcuccgucgucaugcccauggagaaggagaucgccgcccucaaggacaagcucaccgaggccgaggacaagaucaaggagcucgaggccuccaaggucaaggagcucaaccacuaccucgaggccgagaaguccugccgcaccgaccucgagauguacgucgccguccucaacacccagaaguccguccuccaggaggacgccgagaagcuccgcaaggagcuccacgaggucugccaccuccucgagcaggagcgccagcagcacaaccagcucaagcacaccuggcagaaggccaacgaccaguuccucgagucccagcgccuccucaugcgcgacaugcagcgcauggagaucguccucaccuccgagcagcuccgccaggucgaggagcucaagaagaaggaccaggaggacgacgagcagcagcgccucaacaagcgcaaggaccacaagaaggccgacgucgaggaggagaucaagauccccgucgucugcgcccucacccaggaggaguccuccgcccagcucuccaacgaggaggagcaccucgacuccacccgcggcuccguccacucccucgacgccggccuccuccuccccuccggcgaccccuucuccaaguccgacaacgacauguucaaggacggccuccgccgcgcccaguccaccgacucccucggcaccuccggcucccuccaguccaaggcccucggcuacaacuacaaggccaaguccgccggcaaccucgacgaguccgacuucggcccccucgucggcgccgacuccgucuccgagaacuucgacaccgccucccucggcucccuccagaugcccuccggcuucaugcucaccaaggaccaggagcgcgccaucaaggccaugacccccgagcaggaggagaccgccucccuccucuccuccgucacccagggcauggaguccgccuacgucucccccuccggcuaccgccucgucuccgagaccgaguggaaccuccuccagaaggagguccacaacgccggcaacaagcucggccgccgcugcgacaugugcuccaacuacgagaagcagcuccagggcauccagauccaggaggccgagacccgcgaccaggucaagaagcuccagcucaugcuccgccaggccaacgaccagcucgagaagaccaugaaggacaagcaggagcucgaggacuucaucaagcaguccuccgaggacuccucccaccagaucuccgcccucguccuccgcgcccaggccuccgagauccuccucgaggagcuccagcagggccucucccaggccaagcgcgacguccaggagcagauggccguccucaugcagucccgcgagcaggucuccgaggagcucguccgccuccagaaggacaacgacucccuccagggcaagcacucccuccacgucucccuccagcaggccgaggacuucauccuccccgacaccaccgaggcccuccgcgagcucguccucaaguaccgcgaggacaucaucaacguccgcaccgccgccgaccacgucgaggagaagcucaaggccgagauccucuuccucaaggagcagauccaggccgagcagugccucaaggagaaccucgaggagacccuccagcucgagaucgagaacugcaaggaggagaucgccuccaucuccucccucaaggccgagcucgagcgcaucaaggucgagaagggccaggccaccgucgagcagcucauguucgaggagaagaacaaggcccagcgccuccagaccgagcucgacgucuccgagcagguccagcgcgacuucgucaagcucucccagacccuccagguccagcucgagcgcauccgccaggccgacucccucgagcgcauccgcgccauccucaacgacaccaagcucaccgacaucaaccagcuccccgagaccuga

SEQ ID NO: 48466 - RNA, 1710 nt, Artificial Sequence
  derived and/or modified sequence opt2 from RABEP2__Homo_sapiens__NP_079092
auggccgccgccgcccccgucgccgccgacgacgacgagcgccgccgccgccccggcgccgcccucgaggacucccgcucccaggagggcgccaacggcgaggccgaguccggcgagcucucccgccuccgcgccgagcucgccggcgcccucgccgagauggagaccaugaaggccgucgccgaggucuccgaguccaccaaggccgaggccgucgccgccguccagcgccagugccaggaggaggucgccucccuccaggccauccucaaggacuccaucuccuccuacgaggcccagaucaccgcccucaagcaggagcgccagcagcagcagcaggacugcgaggagaaggagcgcgagcucggccgccucaagcagcuccucucccgcgccuacccccucgacucccucgagaagcagauggagaaggcccacgaggacuccgagaagcuccgcgagaucguccuccccauggagaaggagaucgaggagcucaaggccaagcuccuccgcgccgaggagcucauccaggagauccagcgccgcccccgccacgcccccucccuccacggcuccaccgagcuccucccccucucccgcgaccccucccccccccucgagccccucgaggagcucuccggcgacggcggccccgccgccgaggccuucgcccacaacugcgacgacuccgccuccaucuccuccuucucccucggcggcggcgucggcuccuccuccucccucccccagucccgccagggccucucccccgagcaggaggagaccgccucccucgucuccaccggcacccucguccccgagggcaucuaccuccccccccccggcuaccagcucguccccgacacccagugggagcagcuccagaccgagggccgccagcuccagaaggaccucgaguccgucucccgcgagcgcgacgagcuccaggagggccuccgccgcuccaacgaggacugcgccaagcagaugcagguccuccucgcccagguccagaacuccgagcagcuccuccgcacccuccagggcaccgucucccaggcccaggagcgcguccagcuccagauggccgagcucgucaccacccacaagugccuccaccacgaggucaagcgccucaacgaggagaaccagggccuccgcgccgagcagcuccccuccuccgccccccagggcucccagcaggagcagggcgaggaggagucccuccccuccuccguccccgagcuccagcagcuccucugcugcacccgccaggaggcccgcgcccgccuccaggcccaggagcacggcgccgagcgccuccgcaucgagaucgucacccuccgcgaggcccucgaggaggagaccgucgcccgcgccucccucgagggccagcuccgcguccagcgcgaggagaccgagguccucgaggccucccucugcucccuccgcaccgagauggagcgcguccagcaggagcaguccaaggcccagcuccccgaccuccucuccgagcagcgcgccaagguccuccgccuccaggccgagcucgagaccuccgagcagguccagcgcgacuucguccgccucucccaggcccuccagguccgccucgagcgcauccgccaggccgagacccucgagcagguccgcuccaucauggacgaggccccccucaccgacguccgcgacaucaaggacaccuga

SEQ ID NO: 48467 - RNA, 1119 nt, Artificial Sequence
  derived and/or modified sequence opt2 from RABEPK__Homo_sapiens__NP_001167623
augaagcagcuccccguccucgagcccggcgacaagccccgcaaggccaccugguacacccucaccguccccggcgacucccccugcgcccgcgucggccacuccugcuccuaccucccccccgucggcaacgccaagcgcggcaaggucuucaucgucggcggcgccaaccccaaccgcuccuucuccgacguccacaccauggaccucggcaagcaccagugggaccucgacaccugcaagggccuccucccccgcuacgagcacgccuccuucauccccuccugcacccccgaccgcaucugggucuucggcggcgccaaccaguccggcaaccgcaacugccuccagguccucaaccccgagacccgcaccuggaccacccccgaggucaccucccccccccccuccccccgcaccuuccacaccuccuccgccgccaucggcaaccagcucuacgucuucggcggcggcgagcgcggcgcccagcccguccaggacaccaagcuccacgucuucgacgccaacacccucaccuggucccagcccgagacccucggcaacccccccuccccccgccacggccacgucauggucgccgccggcaccaagcucuucauccacggcggccucgccggcgaccgcuucuacgacgaccuccacugcaucgacaucuccgacaugaaguggcagaagcucaaccccaccggcgccgcccccgccggcugcgccgcccacuccgccgucgccaugggcaagcacgucuacaucuucggcggcaugacccccgccggcgcccucgacaccauguaccaguaccacaccgaggagcagcacuggacccuccucaaguucgacacccuccucccccccggccgccucgaccacuccaugugcaucauccccuggcccgucaccugcgccuccgagaaggaggacuccaacucccucacccucaaccacgaggccgagaaggaggacuccgccgacaaggucaugucccacuccggcgacucccacgaggagucccagaccgccacccuccucugccucgucuucggcggcaugaacaccgagggcgagaucuacgacgacugcaucgucaccgucgucgacuga

SEQ ID NO: 48468 - RNA, 219 nt, Artificial Sequence
  derived and/or modified sequence opt2 from RABGAP1L__Homo_sapiens__NP_001230692
augauggaggagaucuccaucauggucgccuacgacgcccacgucuucucccagcuccacgacgaggacuuccucaccucccucgucgccaucuccaagccccgcuccaugguccccaccaagaagcucaagaaguacgagaaggaguaccagaccaugcgcgagucccagcuccagcaggaggaccccauggaccgcuacaaguucgucuaccucuga

SEQ ID NO: 48469 - RNA, 900 nt, Artificial Sequence
  derived and/or modified sequence opt2 from RABGEF1__Homo_sapiens__NP_001273989
augcagacccgcggcaaggucccccccgagcgcgucgagaagaucauggaccagaucgagaaguacaucaugacccgccucuacaaguacgucuucugccccgagaccaccgacgacgagaagaaggaccucgccauccagaagcgcauccgcgcccuccgcugggucaccccccagaugcucugcguccccgucaacgaggacauccccgaggucuccgacauggucgucaaggccaucaccgacaucaucgagauggacuccaagcgcgucccccgcgacaagcucgccugcaucaccaagugcuccaagcacaucuucaacgccaucaagaucaccaagaacgagcccgccuccgccgacgacuuccuccccacccucaucuacaucguccucaagggcaaccccccccgccuccaguccaacauccaguacaucacccgcuucugcaaccccucccgccucaugaccggcgaggacggcuacuacuucaccaaccucugcugcgccgucgccuucaucgagaagcucgacgcccagucccucaaccucucccaggaggacuucgaccgcuacauguccggccagaccuccccccgcaagcaggaggccgaguccuggucccccgacgccugccucggcgucaagcagauguacaagaaccucgaccuccucucccagcucaacgagcgccaggagcgcaucaugaacgaggccaagaagcucgagaaggaccucaucgacuggaccgacggcaucgcccgcgagguccaggacaucgucgagaaguacccccucgagaucaagccccccaaccagccccucgccgccaucgacuccgagaacgucgagaacgacaagcucccccccccccuccagccccaggucuacgccggcuga

SEQ ID NO: 48470 - RNA, 372 nt, Artificial Sequence
  derived and/or modified sequence opt2 from RABIF__Homo_sapiens__NP_002862
auggagcccgccgagcagcccuccgagcucgucuccgccgagggccgcaaccgcaaggccguccucugccagcgcugcggcucccgcguccuccagcccggcaccgcccucuucucccgccgccagcucuuccuccccuccaugcgcaagaagcccgcccucuccgacggcuccaaccccgacggcgaccuccuccaggagcacuggcucgucgaggacauguucaucuucgagaacgucggcuucaccaaggacgucggcaacaucaaguuccucgucugcgccgacugcgagaucggccccaucggcuggcacugccucgacgacaagaacuccuucuacgucgcccucgagcgcgucucccacgaguga

SEQ ID NO: 48471 - RNA, 2193 nt, Artificial Sequence
  derived and/or modified sequence opt2 from RABL6__Homo_sapiens__NP_001167459
auguucuccgcccucaagaagcucgucggcuccgaccaggcccccggccgcgacaagaacauccccgccggccuccaguccaugaaccaggcccuccagcgccgcuucgccaagggcguccaguacaacaugaagaucgucauccgcggcgaccgcaacaccggcaagaccgcccucuggcaccgccuccagggccgccccuucgucgaggaguacauccccacccaggagauccaggucaccuccauccacugguccuacaagaccaccgacgacaucgucaaggucgaggucugggacgucgucgacaagggcaagugcaagaagcgcggcgacggccucaagauggagaacgacccccaggaggccgaguccgagauggcccucgacgccgaguuccucgacgucuacaagaacugcaacggcgucgucaugauguucgacaucaccaagcaguggaccuucaacuacauccuccgcgagcuccccaagguccccacccacguccccgucugcguccucggcaacuaccgcgacaugggcgagcaccgcgucauccuccccgacgacguccgcgacuucaucgacaaccucgacucccgcccccccggcuccuccuacuuccgcuacgccgaguccuccaugaagaacuccuucggccucaaguaccuccacaaguucuucaacauccccuuccuccagcuccagcgcgagacccuccuccgccagcucgagaccaaccagcucgacauggacgccacccucgaggagcucuccguccagcaggagaccgaggaccagaacuacggcaucuuccucgagaugauggaggcccgcucccgcggccacgccuccccccucgccgccaacggccagucccccucccccggcucccagucccccgucguccccgccggcgccgucuccaccggcuccuccucccccggcaccccccagcccgccccccagcucccccucaacgccgccccccccuccuccgucccccccgucccccccuccgaggcccuccccccccccgccugccccuccgcccccgccccccgccgcuccaucaucucccgccucuucggcaccucccccgccaccgaggccgccccccccccccccgagcccguccccgccgccgagggccccgccaccguccaguccgucgaggacuucguccccgacgaccgccucgaccgcuccuuccucgaggacaccacccccgcccgcgacgagaagaaggucggcgccaaggccgcccagcaggacuccgacuccgacggcgaggcccucggcggcaaccccauggucgccggcuuccaggacgacgucgaccucgaggaccagccccgcggcucccccccccuccccgccggccccguccccucccaggacaucacccucuccuccgaggaggaggccgaggucgccgcccccaccaagggccccgcccccgccccccagcagugcuccgagcccgagaccaagugguccuccauccccgccuccaagccccgccgcggcaccgcccccacccgcaccgccgccccccccuggcccggcggcgucuccguccgcaccggccccgagaagcgcuccuccacccgcccccccgccgagauggagcccggcaagggcgagcaggccuccuccuccgaguccgaccccgagggccccaucgccgcccagaugcucuccuucgucauggacgaccccgacuucgaguccgagggcuccgacacccagcgccgcgccgacgacuuccccguccgcgacgaccccuccgacgucaccgacgaggacgagggccccgccgagcccccccccccccccaagcucccccuccccgccuuccgccucaagaacgacuccgaccucuucggccucggccucgaggaggccggccccaaggaguccuccgaggagggcaaggagggcaagacccccuccaaggagaagaagaagaagaagaagaagggcaaggaggaggaggagaaggccgccaagaagaaguccaagcacaagaaguccaaggacaaggaggagggcaaggaggagcgccgccgccgccagcagcgccccccccgcucccgcgagcgcaccgccgccgacgagcucgaggccuuccucggcggcggcgcccccggcggccgccaccccggcggcggcgacuacgaggagcucuga

SEQ ID NO: 48472 - RNA, 579 nt, Artificial Sequence
  derived and/or modified sequence opt2 from RAC1__Homo_sapiens__NP_008839
augcaggccaucaagugcgucgucgucggcgacggcgccgucggcaagaccugccuccucaucuccuacaccaccaacgccuuccccggcgaguacauccccaccgucuucgacaacuacuccgccaacgucauggucgacggcaagcccgucaaccucggccucugggacaccgccggccaggaggacuacgaccgccuccgcccccucuccuacccccagaccgacgucuuccucaucugcuucucccucgucucccccgccuccuucgagaacguccgcgccaagugguaccccgagguccgccaccacugccccaacacccccaucauccucgucggcaccaagcucgaccuccgcgacgacaaggacaccaucgagaagcucaaggagaagaagcucacccccaucaccuacccccagggccucgccauggccaaggagaucggcgccgucaaguaccucgagugcuccgcccucacccagcgcggccucaagaccgucuucgacgaggccauccgcgccguccucugccccccccccgucaagaagcgcaagcgcaagugccuccuccucuga

SEQ ID NO: 48473 - RNA, 579 nt, Artificial Sequence
  derived and/or modified sequence opt2 from RAC2__Homo_sapiens__NP_002863
augcaggccaucaagugcgucgucgucggcgacggcgccgucggcaagaccugccuccucaucuccuacaccaccaacgccuuccccggcgaguacauccccaccgucuucgacaacuacuccgccaacgucauggucgacuccaagcccgucaaccucggccucugggacaccgccggccaggaggacuacgaccgccuccgcccccucuccuacccccagaccgacgucuuccucaucugcuucucccucgucucccccgccuccuacgagaacguccgcgccaagugguuccccgagguccgccaccacugccccuccacccccaucauccucgucggcaccaagcucgaccuccgcgacgacaaggacaccaucgagaagcucaaggagaagaagcucgcccccaucaccuacccccagggccucgcccucgccaaggagaucgacuccgucaaguaccucgagugcuccgcccucacccagcgcggccucaagaccgucuucgacgaggccauccgcgccguccucugcccccagcccacccgccagcagaagcgcgccugcucccuccucuga

SEQ ID NO: 48474 - RNA, 579 nt, Artificial Sequence
  derived and/or modified sequence opt2 from RAC3__Homo_sapiens__NP_005043
augcaggccaucaagugcgucgucgucggcgacggcgccgucggcaagaccugccuccucaucuccuacaccaccaacgccuuccccggcgaguacauccccaccgucuucgacaacuacuccgccaacgucauggucgacggcaagcccgucaaccucggccucugggacaccgccggccaggaggacuacgaccgccuccgcccccucuccuacccccagaccgacgucuuccucaucugcuucucccucgucucccccgccuccuucgagaacguccgcgccaagugguaccccgagguccgccaccacugcccccacacccccauccuccucgucggcaccaagcucgaccuccgcgacgacaaggacaccaucgagcgccuccgcgacaagaagcucgcccccaucaccuacccccagggccucgccauggcccgcgagaucggcuccgucaaguaccucgagugcuccgcccucacccagcgcggccucaagaccgucuucgacgaggccauccgcgccguccucugccccccccccgucaagaagcccggcaagaagugcaccgucuucuga

SEQ ID NO: 48475 - RNA, 1935 nt, Artificial Sequence
  derived and/or modified sequence opt2 from RACGAP1__Homo_sapiens__NP_001306935
auguccugccccugcuucugccccgucgcccuccgcauggacaccaugaugcucaacguccgcaaccucuucgagcagcucguccgccgcgucgagauccucuccgagggcaacgagguccaguucauccagcucgccaaggacuucgaggacuuccgcaagaaguggcagcgcaccgaccacgagcucggcaaguacaaggaccuccucaugaaggccgagaccgagcgcuccgcccucgacgucaagcucaagcacgcccgcaaccaggucgacgucgagaucaagcgccgccagcgcgccgaggccgacugcgagaagcucgagcgccagauccagcucauccgcgagaugcucaugugcgacaccuccggcuccauccagcucuccgaggagcagaaguccgcccucgccuuccucaaccgcggccagcccuccuccuccaacgccggcaacaagcgccucuccaccaucgacgaguccggcuccauccucuccgacaucuccuucgacaagaccgacgagucccucgacugggacuccucccucgucaagaccuucaagcucaagaagcgcgagaagcgccgcuccaccucccgccaguucgucgacggcccccccggccccgucaagaagacccgcuccaucggcuccgccgucgaccagggcaacgaguccaucgucgccaagaccaccgucaccguccccaacgacggcggccccaucgaggccgucuccaccaucgagaccguccccuacuggacccgcucccgccgcaagaccggcacccuccagcccuggaacuccgacuccacccucaacucccgccagcucgagccccgcaccgagaccgacuccgucggcaccccccaguccaacggcggcaugcgccuccacgacuucgucuccaagaccgucaucaagcccgaguccugcguccccugcggcaagcgcaucaaguucggcaagcucucccucaagugccgcgacugccgcgucgucucccaccccgagugccgcgaccgcugcccccuccccugcauccccacccucaucggcacccccgucaagaucggcgagggcaugcucgccgacuucgucucccagaccucccccaugauccccuccaucgucguccacugcgucaacgagaucgagcagcgcggccucaccgagaccggccucuaccgcaucuccggcugcgaccgcaccgucaaggagcucaaggagaaguuccuccgcgucaagaccgucccccuccucuccaaggucgacgacauccacgccaucugcucccuccucaaggacuuccuccgcaaccucaaggagccccuccucaccuuccgccucaaccgcgccuucauggaggccgccgagaucaccgacgaggacaacuccaucgccgccauguaccaggccgucggcgagcucccccaggccaaccgcgacacccucgccuuccucaugauccaccuccagcgcgucgcccaguccccccacaccaagauggacgucgccaaccucgccaaggucuucggccccaccaucgucgcccacgccguccccaaccccgaccccgucaccaugcuccaggacaucaagcgccagcccaaggucgucgagcgccuccucucccucccccucgaguacuggucccaguucaugauggucgagcaggagaacaucgacccccuccacgucaucgagaacuccaacgccuucuccaccccccagacccccgacaucaaggucucccuccucggccccgucaccacccccgagcaccagcuccucaagacccccuccuccuccucccucucccagcgcguccgcuccacccucaccaagaacaccccccgcuucggcuccaaguccaaguccgccaccaaccucggccgccagggcaacuucuucgccucccccaugcucaaguga

SEQ ID NO: 48476 - RNA, 2046 nt, Artificial Sequence
  derived and/or modified sequence opt2 from RAD17__Homo_sapiens__NP_579917
auguccaagaccuuccuccgccccaaggucuccuccaccaaggucaccgacugggucgaccccuccuucgacgacuuccucgagugcuccggcgucuccaccaucaccgccaccucccucggcgucaacaacuccucccaccgccgcaagaacggccccuccacccucgaguccucccgcuuccccgcccgcaagcgcggcaaccucuccucccucgagcagaucuacggccucgagaacuccaaggaguaccucuccgagaacgagcccugggucgacaaguacaagcccgagacccagcacgagcucgccguccacaagaagaagaucgaggaggucgagaccuggcucaaggcccagguccucgagcgccagcccaagcagggcggcuccauccuccucaucaccggcccccccggcugcggcaagaccaccacccucaagauccucuccaaggagcacggcauccagguccaggaguggaucaaccccguccuccccgacuuccagaaggacgacuucaagggcauguucaacaccgaguccuccuuccacauguuccccuaccagucccagaucgccgucuucaaggaguuccuccuccgcgccaccaaguacaacaagcuccagaugcucggcgacgaccuccgcaccgacaagaagaucauccucgucgaggaccuccccaaccaguucuaccgcgacucccacacccuccacgagguccuccgcaaguacguccgcaucggccgcugcccccucaucuucaucaucuccgacucccucuccggcgacaacaaccagcgccuccucuuccccaaggagauccaggaggagugcuccaucuccaacaucuccuucaaccccgucgcccccaccaucaugaugaaguuccucaaccgcaucgucaccaucgaggccaacaagaacggcggcaagaucaccguccccgacaagaccucccucgagcuccucugccagggcugcuccggcgacauccgcuccgccaucaacucccuccaguucuccuccuccaagggcgagaacaaccuccgcccccgcaagaagggcaugucccucaaguccgacgccguccucuccaaguccaagcgccgcaagaagcccgaccgcgucuucgagaaccaggagguccaggccaucggcggcaaggacgucucccucuuccucuuccgcgcccucggcaagauccucuacugcaagcgcgccucccucaccgagcucgacuccccccgccuccccucccaccucuccgaguacgagcgcgacacccuccucgucgagcccgaggaggucgucgagaugucccacaugcccggcgaccucuucaaccucuaccuccaccagaacuacaucgacuucuucauggagaucgacgacaucguccgcgccuccgaguuccucuccuucgccgacauccucuccggcgacuggaacacccgcucccuccuccgcgaguacuccaccuccaucgccacccgcggcgucaugcacuccaacaaggcccgcggcuacgcccacugccagggcggcggcuccuccuuccgcccccuccacaagccccagugguuccucaucaacaagaaguaccgcgagaacugccucgccgccaaggcccucuuccccgacuucugccuccccgcccucugccuccagacccagcuccuccccuaccucgcccuccucaccauccccaugcgcaaccaggcccagaucuccuucauccaggacaucggccgccucccccucaagcgccacuucggccgccucaagauggaggcccucaccgaccgcgagcacggcaugaucgaccccgacuccggcgacgaggcccagcucaacggcggccacuccgccgaggagucccucggcgagcccacccaggccaccguccccgagaccuggucccucccccucucccagaacuccgccuccgagcuccccgccucccagccccagcccuucuccgcccagggcgacauggaggagaacaucaucaucgaggacuacgaguccgacggcaccuga

SEQ ID NO: 48477 - RNA, 1488 nt, Artificial Sequence
  derived and/or modified sequence opt2 from RAD18__Homo_sapiens__NP_064550
auggacucccucgccgagucccgcuggccccccggccucgccgucaugaagaccaucgacgaccuccuccgcugcggcaucugcuucgaguacuucaacaucgccaugaucaucccccagugcucccacaacuacugcucccucugcauccgcaaguuccucuccuacaagacccagugccccaccugcugcgucaccgucaccgagcccgaccucaagaacaaccgcauccucgacgagcucgucaagucccucaacuucgcccgcaaccaccuccuccaguucgcccucgagucccccgccaagucccccgccuccuccuccuccaagaaccucgccgucaaggucuacacccccgucgccucccgccagucccucaagcagggcucccgccucauggacaacuuccucauccgcgagauguccggcuccaccuccgagcuccucaucaaggagaacaaguccaaguucuccccccagaaggaggccucccccgccgccaagaccaaggagacccgcuccgucgaggagaucgcccccgaccccuccgaggccaagcgccccgagccccccuccaccuccacccucaagcaggucaccaaggucgacugccccgucugcggcgucaacauccccgagucccacaucaacaagcaccucgacuccugccucucccgcgaggagaagaaggagucccuccgcuccuccguccacaagcgcaagccccuccccaagaccgucuacaaccuccucuccgaccgcgaccucaagaagaagcucaaggagcacggccucuccauccagggcaacaagcagcagcucaucaagcgccaccaggaguucguccacauguacaacgcccagugcgacgcccuccaccccaaguccgccgccgagaucguccgcgagaucgagaacaucgagaagacccgcaugcgccucgaggccuccaagcucaacgaguccgucauggucuucaccaaggaccagaccgagaaggagaucgacgagauccacuccaaguaccgcaagaagcacaaguccgaguuccagcuccucgucgaccaggcccgcaagggcuacaagaagaucgccggcaugucccagaagaccgucaccaucaccaaggaggacgaguccaccgagaagcucuccuccgucugcaugggccaggaggacaacaugaccuccgucaccaaccacuucucccaguccaagcucgacucccccgaggagcucgagcccgaccgcgaggaggacuccuccuccugcaucgacauccaggagguccucuccuccuccgaguccgacuccugcaacuccuccuccuccgacaucauccgcgaccuccucgaggaggaggaggccugggaggccucccacaagaacgaccuccaggacaccgagaucuccccccgccagaaccgccgcacccgcgccgccgaguccgccgagaucgagccccgcaacaagcgcaaccgcaacuga

SEQ ID NO: 48478 - RNA, 849 nt, Artificial Sequence
  derived and/or modified sequence opt2 from RAD1__Homo_sapiens__NP_002844
augccccuccucacccagcagauccaggacgaggacgaccaguacucccucgucgccucccucgacaacguccgcaaccucuccaccauccucaaggccauccacuuccgcgagcacgccaccugcuucgccaccaagaacggcaucaaggucaccgucgagaacgccaagugcguccaggccaacgccuucauccaggccggcaucuuccaggaguucaagguccaggaggaguccgucaccuuccgcaucaaccucaccguccuccucgacugccucuccaucuucggcuccucccccaugcccggcacccucaccgcccuccgcaugugcuaccagggcuacggcuacccccucaugcucuuccucgaggagggcggcgucgucaccgucugcaagaucaacacccaggagcccgaggagacccucgacuucgacuucugcuccaccaacgucaucaacaagaucauccuccaguccgagggccuccgcgaggccuucuccgagcucgacaugaccuccgagguccuccagaucaccaugucccccgacaagcccuacuuccgccucuccaccuucggcaacgccggcuccucccaccucgacuaccccaaggacuccgaccucauggaggccuuccacugcaaccagacccaggucaaccgcuacaagaucucccuccucaagcccuccaccaaggcccucguccucuccugcaaggucuccauccgcaccgacaaccgcggcuuccucucccuccaguacaugauccgcaacgaggacggccagaucugcuucgucgaguacuacugcugccccgacgaggagguccccgaguccgaguccuga

SEQ ID NO: 48479 - RNA, 1896 nt, Artificial Sequence
  derived and/or modified sequence opt2 from RAD21__Homo_sapiens__NP_006256
auguucuacgcccacuucguccucuccaagcgcggcccccucgccaagaucuggcucgccgcccacugggacaagaagcucaccaaggcccacgucuucgagugcaaccucgaguccuccgucgaguccaucaucucccccaaggucaagauggcccuccgcaccuccggccaccuccuccucggcgucguccgcaucuaccaccgcaaggccaaguaccuccucgccgacugcaacgaggccuucaucaagaucaagauggccuuccgccccggcgucgucgaccuccccgaggagaaccgcgaggccgccuacaacgccaucacccuccccgaggaguuccacgacuucgaccagccccuccccgaccucgacgacaucgacgucgcccagcaguucucccucaaccagucccgcgucgaggagaucaccaugcgcgaggaggucggcaacaucuccauccuccaggagaacgacuucggcgacuucggcauggacgaccgcgagaucaugcgcgagggcuccgccuucgaggacgacgacaugcucgucuccaccaccaccuccaaccuccuccucgaguccgagcaguccaccuccaaccucaacgagaagaucaaccaccucgaguacgaggaccaguacaaggacgacaacuucggcgagggcaacgacggcggcauccucgacgacaagcucaucuccaacaacgacggcggcaucuucgacgacccccccgcccucuccgaggccggcgucaugcuccccgagcagcccgcccacgacgacauggacgaggacgacaacgucuccaugggcggccccgacucccccgacuccgucgaccccgucgagcccaugcccaccaugaccgaccagaccacccucguccccaacgaggaggaggccuucgcccucgagcccaucgacaucaccgucaaggagaccaaggccaagcgcaagcgcaagcucaucgucgacuccgucaaggagcucgacuccaagaccauccgcgcccagcucuccgacuacuccgacaucgucaccacccucgaccucgccccccccaccaagaagcucaugauguggaaggagaccggcggcgucgagaagcucuucucccuccccgcccagccccucuggaacaaccgccuccucaagcucuucacccgcugccucaccccccucguccccgaggaccuccgcaagcgccgcaagggcggcgaggccgacaaccucgacgaguuccucaaggaguucgagaaccccgaggucccccgcgaggaccagcagcagcagcaccagcagcgcgacgucaucgacgagcccaucaucgaggagcccucccgccuccaggaguccgucauggaggccucccgcaccaacaucgacgaguccgccaugccccccccccccccccagggcgucaagcgcaaggccggccagaucgaccccgagcccgucaugcccccccagcaggucgagcagauggagaucccccccgucgagcucccccccgaggagccccccaacaucugccagcucauccccgagcucgagcuccuccccgagaaggagaaggagaaggagaaggagaaggaggacgacgaggaggaggaggacgaggacgccuccggcggcgaccaggaccaggaggagcgccgcuggaacaagcgcacccagcagaugcuccacggccuccagcgcgcccucgccaagaccggcgccgaguccaucucccuccucgagcucugccgcaacaccaaccgcaagcaggccgccgccaaguucuacuccuuccucguccucaagaagcagcaggccaucgagcucacccaggaggagcccuacuccgacaucaucgccacccccggcccccgcuuccacaucaucuga

SEQ ID NO: 48480 - RNA, 1671 nt, Artificial Sequence
  derived and/or modified sequence opt2 from RAD21L1__Homo_sapiens__NP_001130038
auguucuacacccacguccucauguccaagcgcggcccccucgccaagaucuggcucgccgcccacugggagaagaagcucaccaaggcccacgucuucgagugcaaccucgagaucaccaucgagaagauccucucccccaaggucaagaucgcccuccgcaccuccggccaccuccuccucggcgucguccgcaucuacaaccgcaaggccaaguaccuccucgccgacugcuccgaggccuuccucaagaugaagaugaccuucugccccggccucgucgaccuccccaaggagaacuucgaggccuccuacaacgccaucacccuccccgaggaguuccacgacuucgacacccagaacaugaacgccaucgacgucuccgagcacuucacccagaaccagucccgccccgaggagaucacccuccgcgagaacuucgacaacgaccucaucuuccaggccgaguccuucggcgaggaguccgagauccuccgccgccacuccuucuucgacgacaacauccuccucaacuccuccggcccccucaucgagcacuccuccggcucccucaccggcgagcgcucccucuucuacgacuccggcgacggcuucggcgacgagggcgccgccggcgagaugaucgacaaccuccuccaggacgaccagaacauccuccucgaggacaugcaccucaaccgcgagaucucccuccccuccgagccccccaacucccucgccgucgagcccgacaacuccgagugcaucugcguccccgagaacgagaagaugaacgagaccauccuccucuccaccgaggaggagggcuucacccucgaccccaucgacaucuccgacaucgccgagaagcgcaagggcaagaagcgccgccuccucaucgaccccaucaaggagcucuccuccaaggucauccacaagcagcucaccuccuucgccgacacccucaugguccucgagcucgccccccccacccagcgccucaugauguggaagaagcgcggcggcguccacacccuccucuccaccgccgcccaggaccucauccacgccgagcucaagaugcucuucaccaagugcuuccucuccuccggcuucaagcucggccgcaagaugauccagaaggaguccguccgcgaggaggucggcaaccagaacaucgucgagaccuccaugaugcaggagcccaacuaccagcaggagcucuccaagccccagaccuggaaggacgucaucggcggcucccagcacuccucccacgaggacaccaacaagaacaucaacuccgagcaggacaucgucgagauggucucccucgccgccgaggaguccucccucaugaacgaccucuucgcccaggagaucgaguacucccccgucgagcucgagucccucuccaacgaggagaacaucgagaccgagcgcuggaacggccgcauccuccagaugcucaaccgccuccgcgaguccaacaagaugggcaugcaguccuucucccucaugaagcucugccgcaacuccgaccgcaagcaggccgccgccaaguucuacuccuuccucguccucaagaagcagcucgccaucgagcucucccaguccgcccccuacgccgacaucaucgccaccaugggccccauguucuacaacaucuga

SEQ ID NO: 48481 - RNA, 927 nt, Artificial Sequence
  derived and/or modified sequence opt2 from RAD23A__Homo_sapiens__NP_001257292
auggccgucaccaucacccucaagacccuccagcagcagaccuucaagauccgcauggagcccgacgagaccgucaagguccucaaggagaagaucgaggccgagaagggccgcgacgccuuccccgucgccggccagaagcucaucuacgccggcaagauccucuccgacgacguccccauccgcgacuaccgcaucgacgagaagaacuucgucgucgucauggucaccaagaccaaggccggccagggcaccuccgccccccccgaggccucccccaccgccgcccccgaguccuccaccuccuucccccccgcccccaccuccggcaugucccaccccccccccgccgcccgcgaggacaagucccccuccgaggaguccgcccccaccaccucccccgaguccgucuccggcuccguccccuccuccggcuccuccggccgcgaggaggacgccgccuccacccucgucaccggcuccgaguacgagaccaugcucaccgagaucauguccaugggcuacgagcgcgagcgcgucgucgccgcccuccgcgccuccuacaacaacccccaccgcgccgucgaguaccuccucaccggcauccccggcucccccgagcccgagcacggcuccguccaggagucccaggucuccgagcagcccgccaccgaggccgccggcgagaacccccucgaguuccuccgcgaccagccccaguuccagaacaugcgccaggucauccagcagaaccccgcccuccuccccgcccuccuccagcagcucggccaggagaacccccagcuccuccagcucaaggcccucggcuuccccgagucccucgucauccaggccuacuucgccugcgagaagaacgagaaccucgccgccaacuuccuccucucccagaacuucgacgacgaguga

SEQ ID NO: 48482 - RNA, 1167 nt, Artificial Sequence
  derived and/or modified sequence opt2 from RAD23B__Homo_sapiens__NP_001231642
auggucaaggcccucaaggagaagaucgaguccgagaagggcaaggacgccuuccccgucgccggccagaagcucaucuacgccggcaagauccucaacgacgacaccgcccucaaggaguacaagaucgacgagaagaacuucgucgucgucauggucaccaagcccaaggccgucuccacccccgcccccgccaccacccagcaguccgcccccgccuccaccaccgccgucaccuccuccaccaccaccaccgucgcccaggcccccacccccguccccgcccucgcccccaccuccacccccgccuccaucacccccgccuccgccaccgccuccuccgagcccgcccccgccuccgccgccaagcaggagaagcccgccgagaagcccgccgagacccccgucgccaccucccccaccgccaccgacuccaccuccggcgacuccucccgcuccaaccucuucgaggacgccaccuccgcccucgucaccggccaguccuacgagaacauggucaccgagaucauguccaugggcuacgagcgcgagcaggucaucgccgcccuccgcgccuccuucaacaaccccgaccgcgccgucgaguaccuccucaugggcauccccggcgaccgcgagucccaggccgucgucgaccccccccaggccgccuccaccggcgccccccaguccuccgccgucgccgccgccgccgccaccaccaccgccaccaccaccaccaccuccuccggcggccacccccucgaguuccuccgcaaccagccccaguuccagcagaugcgccagaucauccagcagaaccccucccuccuccccgcccuccuccagcagaucggccgcgagaacccccagcuccuccagcagaucucccagcaccaggagcacuucauccagaugcucaacgagcccguccaggaggccggcggccagggcggcggcggcggcggcggcuccggcggcaucgccgaggccggcuccggccacaugaacuacauccaggucaccccccaggagaaggaggccaucgagcgccucaaggcccucggcuuccccgagggccucgucauccaggccuacuucgccugcgagaagaacgagaaccucgccgccaacuuccuccuccagcagaacuucgacgaggacuga

SEQ ID NO: 48483 - RNA, 3939 nt, Artificial Sequence
  derived and/or modified sequence opt2 from RAD50__Homo_sapiens__NP_005723
augucccgcaucgagaagauguccauccucggcguccgcuccuucggcaucgaggacaaggacaagcagaucaucaccuucuucuccccccucaccauccucgucggccccaacggcgccggcaagaccaccaucaucgagugccucaaguacaucugcaccggcgacuucccccccggcaccaagggcaacaccuucguccacgaccccaaggucgcccaggagaccgacguccgcgcccagauccgccuccaguuccgcgacgucaacggcgagcucaucgccguccagcgcuccauggucugcacccagaaguccaagaagaccgaguucaagacccucgagggcgucaucacccgcaccaagcacggcgagaaggucucccucuccuccaagugcgccgagaucgaccgcgagaugaucuccucccucggcgucuccaaggccguccucaacaacgucaucuucugccaccaggaggacuccaacuggccccucuccgagggcaaggcccucaagcagaaguucgacgagaucuucuccgccacccgcuacaucaaggcccucgagacccuccgccagguccgccagacccagggccagaaggucaaggaguaccagauggagcucaaguaccucaagcaguacaaggagaaggccugcgagauccgcgaccagaucaccuccaaggaggcccagcucaccuccuccaaggagaucgucaaguccuacgagaacgagcucgacccccucaagaaccgccucaaggagaucgagcacaaccucuccaagaucaugaagcucgacaacgagaucaaggcccucgacucccgcaagaagcagauggagaaggacaacuccgagcucgaggagaagauggagaaggucuuccagggcaccgacgagcagcucaacgaccucuaccacaaccaccagcgcaccguccgcgagaaggagcgcaagcucgucgacugccaccgcgagcucgagaagcucaacaaggagucccgccuccucaaccaggagaaguccgagcuccucgucgagcagggccgccuccagcuccaggccgaccgccaccaggagcacauccgcgcccgcgacucccucauccagucccucgccacccagcucgagcucgacggcuucgagcgcggccccuucuccgagcgccagaucaagaacuuccacaagcucguccgcgagcgccaggagggcgaggccaagaccgccaaccagcucaugaacgacuucgccgagaaggagacccucaagcagaagcagaucgacgagauccgcgacaagaagaccggccucggccgcaucaucgagcucaaguccgagauccucuccaagaagcagaacgagcucaagaacgucaaguacgagcuccagcagcucgagggcuccuccgaccgcauccucgagcucgaccaggagcucaucaaggccgagcgcgagcucuccaaggccgagaagaacuccaacgucgagacccucaagauggaggucaucucccuccagaacgagaaggccgaccucgaccgcacccuccgcaagcucgaccaggagauggagcagcucaaccaccacaccaccacccgcacccagauggagaugcucaccaaggacaaggccgacaaggacgagcagauccgcaagaucaagucccgccacuccgacgagcucaccucccuccucggcuacuuccccaacaagaagcagcucgaggacuggcuccacuccaaguccaaggagaucaaccagacccgcgaccgccucgccaagcucaacaaggagcucgccuccuccgagcagaacaagaaccacaucaacaacgagcucaagcgcaaggaggagcagcucuccuccuacgaggacaagcucuucgacgucugcggcucccaggacuucgaguccgaccucgaccgccucaaggaggagaucgagaaguccuccaagcagcgcgccaugcucgccggcgccaccgccgucuacucccaguucaucacccagcucaccgacgagaaccaguccugcugccccgucugccagcgcgucuuccagaccgaggccgagcuccaggaggucaucuccgaccuccaguccaagcuccgccucgcccccgacaagcucaaguccaccgaguccgagcucaagaagaaggagaagcgccgcgacgagaugcucggccucguccccaugcgccaguccaucaucgaccucaaggagaaggagauccccgagcuccgcaacaagcuccagaacgucaaccgcgacauccagcgccucaagaacgacaucgaggagcaggagacccuccucggcaccaucaugcccgaggaggaguccgccaaggucugccucaccgacgucaccaucauggagcgcuuccagauggagcucaaggacgucgagcgcaagaucgcccagcaggccgccaagcuccagggcaucgaccucgaccgcaccguccagcaggucaaccaggagaagcaggagaagcagcacaagcucgacaccgucuccuccaagaucgagcucaaccgcaagcucauccaggaccagcaggagcagauccagcaccucaaguccaccaccaacgagcucaaguccgagaagcuccagaucuccaccaaccuccagcgccgccagcagcucgaggagcagaccgucgagcucuccaccgagguccagucccucuaccgcgagaucaaggacgccaaggagcaggucuccccccucgagaccacccucgagaaguuccagcaggagaaggaggagcucaucaacaagaagaacaccuccaacaagaucgcccaggacaagcucaacgacaucaaggagaaggucaagaacauccacggcuacaugaaggacaucgagaacuacauccaggacggcaaggacgacuacaagaagcagaaggagaccgagcucaacaaggucaucgcccagcucuccgagugcgagaagcacaaggagaagaucaacgaggacaugcgccucaugcgccaggacaucgacacccagaagauccaggagcgcuggcuccaggacaaccucacccuccgcaagcgcaacgaggagcucaaggaggucgaggaggagcgcaagcagcaccucaaggagaugggccagaugcagguccuccagaugaaguccgagcaccagaagcucgaggagaacaucgacaacaucaagcgcaaccacaaccucgcccucggccgccagaagggcuacgaggaggagaucauccacuucaagaaggagcuccgcgagccccaguuccgcgacgccgaggagaaguaccgcgagaugaugaucgucaugcgcaccaccgagcucgucaacaaggaccucgacaucuacuacaagacccucgaccaggccaucaugaaguuccacuccaugaagauggaggagaucaacaagaucauccgcgaccucuggcgcuccaccuaccgcggccaggacaucgaguacaucgagauccgcuccgacgccgacgagaacgucuccgccuccgacaagcgccgcaacuacaacuaccgcgucgucaugcucaagggcgacaccgcccucgacaugcgcggccgcugcuccgccggccagaagguccucgccucccucaucauccgccucgcccucgccgagaccuucugccucaacugcggcaucaucgcccucgacgagcccaccaccaaccucgaccgcgagaacaucgagucccucgcccacgcccucgucgagaucaucaagucccgcucccagcagcgcaacuuccagcuccucgucaucacccacgacgaggacuucgucgagcuccucggccgcuccgaguacgucgagaaguucuaccgcaucaagaagaacaucgaccagugcuccgagaucgucaagugcuccgucuccucccucggcuucaacguccacuga

SEQ ID NO: 48484 - RNA, 1059 nt, Artificial Sequence
  derived and/or modified sequence opt2 from RAD51AP1__Homo_sapiens__NP_001124334
augguccgccccguccgccacaagaagcccgucaacuacucccaguucgaccacuccgacuccgacgacgacuucgucuccgccaccgucccccucaacaagaagucccgcaccgcccccaaggagcucaagcaggacaagcccaagcccaaccucaacaaccuccgcaaggaggagauccccguccaggagaagacccccaagaagcgccuccccgagggcaccuucuccauccccgccuccgccguccccugcaccaagauggcccucgacgacaagcucuaccagcgcgaccucgaggucgcccucgcccucuccgucaaggagcuccccaccgucaccaccaacguccagaacucccaggacaaguccaucgagaagcacggcuccuccaagaucgagaccaugaacaaguccccccacaucuccaacugcuccgucgccuccgacuaccucgaccucgacaagaucaccgucgaggacgacgucggcggcguccagggcaagcgcaaggccgccuccaaggccgccgcccagcagcgcaagauccuccucgagggcuccgacggcgacuccgccaacgacaccgagcccgacuucgcccccggcgaggacuccgaggacgacuccgacuucugcgaguccgaggacaacgacgaggacuucuccaugcgcaaguccaaggucaaggagaucaagaagaaggaggucaaggucaagucccccgucgagaagaaggagaagaaguccaaguccaagugcaacgcccucgucaccuccgucgacuccgcccccgccgccgucaaguccgagucccagucccuccccaagaaggucucccucuccuccgacaccacccgcaagccccucgagauccgcucccccuccgccgaguccaagaagcccaagugggucccccccgccgccuccggcggcucccgcuccuccuccuccccccucgucgucgucuccgucaagucccccaaccagucccuccgccucggccucucccgccucgcccgcgucaagccccuccaccccaacgccaccuccaccuga

SEQ ID NO: 48485 - RNA, 1053 nt, Artificial Sequence
  derived and/or modified sequence opt2 from RAD51B__Homo_sapiens__NP_002868
augggcuccaagaagcucaagcgcgucggccucucccaggagcucugcgaccgccucucccgccaccagauccucaccugccaggacuuccucugccucuccccccucgagcucaugaaggucaccggccucuccuaccgcggcguccacgagcuccucugcauggucucccgcgccugcgcccccaagaugcagaccgccuacggcaucaaggcccagcgcuccgccgacuucucccccgccuuccucuccaccacccucuccgcccucgacgaggcccuccacggcggcgucgccugcggcucccucaccgagaucaccggcccccccggcugcggcaagacccaguucugcaucaugauguccauccucgccacccuccccaccaacaugggcggccucgagggcgccgucgucuacaucgacaccgaguccgccuucuccgccgagcgccucgucgagaucgccgagucccgcuucccccgcuacuucaacaccgaggagaagcuccuccucaccuccuccaagguccaccucuaccgcgagcucaccugcgacgagguccuccagcgcaucgagucccucgaggaggagaucaucuccaagggcaucaagcucgucauccucgacuccgucgccuccgucguccgcaaggaguucgacgcccagcuccagggcaaccucaaggagcgcaacaaguuccucgcccgcgaggccuccucccucaaguaccucgccgaggaguucuccauccccgucauccucaccaaccagaucaccacccaccucuccggcgcccucgccucccaggccgaccucgucucccccgccgacgaccucucccucuccgagggcaccuccggcuccuccugcgucaucgccgcccucggcaacaccuggucccacuccgucaacacccgccucauccuccaguaccucgacuccgagcgccgccagauccucaucgccaaguccccccucgcccccuucaccuccuucgucuacaccaucaaggaggagggccucguccuccaggccuacggcaacuccuga

SEQ ID NO: 48486 - RNA, 408 nt, Artificial Sequence
  derived and/or modified sequence opt2 from RAD51C__Homo_sapiens__NP_002867
augcgcggcaagaccuuccgcuucgagaugcagcgcgaccucgucuccuucccccucucccccgccguccgcgucaagcucgucuccgccggcuuccagaccgccgaggagcuccucgaggucaagcccuccgagcucuccaaggaggucggcaucuccaaggccgaggcccucgagacccuccagaucauccgccgcgagugccucaccaacaagccccgcuacgccggcaccuccgagucccacaagaagugcaccgcccucgagcuccucgagcaggagcacacccagggcuucaucaucaccuucugcuccgcccucgacgacauccucggcggcggcgucccccucaugaagaccaccgagaucugcggcgcccccggcgucggcaagacccagcucugguga

SEQ ID NO: 48487 - RNA, 1047 nt, Artificial Sequence
  derived and/or modified sequence opt2 from RAD51D__Homo_sapiens__NP_001136043
augggcguccuccgcgucggccucugccccggccucaccgaggagaugauccagcuccuccgcucccaccgcaucaagaccgucgucgaccucgucuccgccgaccucgaggaggucgcccagaagugcggccucuccuacaagaccuggcgcgcccacuccuccggcaaccucggcggccuccagcucccccagguccccgccggccgcuccugguccggcguccgcaacgcccucaagaaggccggccucggccacggcggcaccgacggccucucccucaacgccuucgacgagcgcggcaccgccgucuccaccucccgccucgacaagcuccucgacgccggccucuacaccggcgaggucaccgagaucgucggcggccccggcuccggcaagacccaggucugccucugcauggccgccaacgucgcccacggccuccagcagaacguccucuacgucgacuccaacggcggccucaccgccucccgccuccuccagcuccuccaggccaagacccaggacgaggaggagcaggccgaggcccuccgccgcauccaggucguccacgccuucgacaucuuccagaugcucgacguccuccaggagcuccgcggcaccgucgcccagcaggucaccggcuccuccggcaccgucaaggucgucgucgucgacuccgucaccgccgucgucuccccccuccucggcggccagcagcgcgagggccucgcccucaugaugcagcucgcccgcgagcucaagacccucgcccgcgaccucggcauggccgucgucgucaccaaccacaucacccgcgaccgcgacuccggccgccucaagcccgcccucggccgcuccugguccuucguccccuccacccgcauccuccucgacaccaucgagggcgccggcgccuccggcggccgccgcauggccugccucgccaaguccucccgccagcccaccggcuuccaggagauggucgacaucggcaccuggggcaccuccgagcaguccgccacccuccagggcgaccagaccuga

SEQ ID NO: 48488 - RNA, 843 nt, Artificial Sequence
  derived and/or modified sequence opt2 from RAD51__Homo_sapiens__NP_001157742
auggccaugcagaugcagcucgaggccaacgccgacaccuccgucgaggaggaguccuucggcccccagcccaucucccgccucgagcagugcggcaucaacgccaacgacgucaagaagcucgaggaggccggcuuccacaccgucgaggccgucgccuacgcccccaagaaggagcucaucaacaucaagggcaucuccgaggccaaggccgacaagauccucgccgaggccgccaagcucguccccaugggcuucaccaccgccaccgaguuccaccagcgccgcuccgagaucauccagaucaccaccggcuccaaggagcucgacaagcuccuccagggcggcaucgagaccggcuccaucaccgagauguucggcgaguuccgcaccggcaagacccagaucugccacacccucgccgucaccugccagcuccccaucgaccgcggcggcggcgagggcaaggccauguacaucgacaccgagggcaccuuccgccccgagcgccuccucgccgucgccgagcgcuacggccucuccggcuccgacguccucgacaacgucgccuacgcccgcgccuucaacaccgaccaccagacccagcuccucuaccaggccuccgccaugauggucgagucccgcuacgcccuccucaucgucgacuccgccaccgcccucuaccgcaccgacuacuccggccgcggcgagcucuccgcccgccagaugcaccucgcccgcuuccuccgcaugcuccuccgccucgccgacgagaucgucuccgaggagcgcaagcgcggcaaccagaaccuccagaaccuccgccucucccucuccuccuga

SEQ ID NO: 48489 - RNA, 1257 nt, Artificial Sequence
  derived and/or modified sequence opt2 from RAD52__Homo_sapiens__NP_001284348
auguccggcaccgaggaggccauccucggcggccgcgacucccaccccgccgccggcggcggcuccguccucugcuucggccagugccaguacaccgccgaggaguaccaggccauccagaaggcccuccgccagcgccucggccccgaguacaucuccucccgcauggccggcggcggccagaaggucugcuacaucgagggccaccgcgucaucaaccucgccaacgagauguucggcuacaacggcugggcccacuccaucacccagcagaacgucgacuucgucgaccucaacaacggcaaguucuacgucggcgucugcgccuucguccgcguccagcucaaggacggcuccuaccacgaggacgucggcuacggcgucuccgagggccucaaguccaaggcccucucccucgagaaggcccgcaaggaggccgucaccgacggccucaagcgcgcccuccgcuccuucggcaacgcccucggcaacugcauccucgacaaggacuaccuccgcucccucaacaagcucccccgccagcucccccucgaggucgaccucaccaaggccaagcgccaggaccucgagcccuccgucgaggaggcccgcuacaacuccugccgccccaacauggcccucggccacccccagcuccagcaggucaccucccccucccgccccucccacgccgucauccccgccgaccaggacugcuccucccgcucccucuccuccuccgccgucgaguccgaggccacccaccagcgcaagcuccgccagaagcagcuccagcagcaguuccgcgagcgcauggagaagcagcagguccgcgucuccacccccuccgccgagaaguccgaggccgccccccccgccccccccgucacccacuccacccccgucaccgucuccgagccccuccucgagaaggacuuccucgccggcgucacccaggagcucaucaagacccucgaggacaacuccgagaagugggccgucacccccgacgccggcgacggcgucgucaagcccuccucccgcgccgaccccgcccagaccuccgacacccucgcccucaacaaccagauggucacccagaaccgcaccccccacuccgucugccaccagaagccccaggccaaguccggcuccugggaccuccagaccuacuccgccgaccagcgcaccaccggcaacugggagucccaccgcaagucccaggacaugaagaagcgcaaguacgaccccuccuga

SEQ ID NO: 48490 - RNA, 354 nt, Artificial Sequence
  derived and/or modified sequence opt2 from RAD54B__Homo_sapiens__NP_001192191
augcgccgcuccgccgcccccucccagcuccagggcaacuccuucaagaagcccaaguucaucccccccggccgcuccaaccccggccucaacgaggagaucaccaagcucaaccccgacaucaagcucuucgagggcgucgccaucaacaacaccuuccuccccucccagaacgaccuccgcaucugcucccucaaccuccccuccgaggaguccacccgcgagaucaacaaccgcgacaacugcuccggcaaguacugcuucgaggcccccacccucgccacccucgaccccccccacaccguccagaccuggaugcgccgccaccgccucguccccguccacuaccgcuga

SEQ ID NO: 48491 - RNA, 1176 nt, Artificial Sequence
  derived and/or modified sequence opt2 from RAD9A__Homo_sapiens__NP_004575
augaagugccucgucaccggcggcaacgucaagguccucggcaaggccguccacucccucucccgcaucggcgacgagcucuaccucgagccccucgaggacggccucucccuccgcaccgucaacuccucccgcuccgccuacgccugcuuccucuucgccccccucuucuuccagcaguaccaggccgccacccccggccaggaccuccuccgcugcaagauccucaugaaguccuuccucuccgucuuccgcucccucgccaugcucgagaagaccgucgagaagugcugcaucucccucaacggccgcuccucccgccucgucguccagcuccacugcaaguucggcguccgcaagacccacaaccucuccuuccaggacugcgagucccuccaggccgucuucgaccccgccuccugcccccacaugcuccgcgcccccgcccgcguccucggcgaggccguccuccccuucucccccgcccucgccgaggucacccucggcaucggccgcggccgccgcgucauccuccgcuccuaccacgaggaggaggccgacuccaccgccaaggccauggucaccgagaugugccucggcgaggaggacuuccagcagcuccaggcccaggagggcgucgccaucaccuucugccucaaggaguuccgcggccuccucuccuucgccgaguccgccaaccucaaccucuccauccacuucgacgcccccggccgccccgccaucuucaccaucaaggacucccuccucgacggccacuucguccucgccacccucuccgacaccgacucccacucccaggaccucggcucccccgagcgccaccagcccgucccccagcuccaggcccacuccaccccccaccccgacgacuucgccaacgacgacaucgacuccuacaugaucgccauggagaccaccaucggcaacgagggcucccgcguccuccccuccaucucccucucccccggcccccagccccccaagucccccggcccccacuccgaggaggaggacgaggccgagcccuccaccguccccggcacccccccccccaagaaguuccgcucccucuucuucggcuccauccucgcccccguccgcuccccccagggccccucccccguccucgccgaggacuccgagggcgagggcuga

SEQ ID NO: 48492 - RNA, 1038 nt, Artificial Sequence
  derived and/or modified sequence opt2 from RAD9B__Homo_sapiens__NP_001273461
auguccgagaacgagcucgacaccacccuccaccucaagugcaagcucggcaugaaguccauccuccccaucuuccgcugccucaacucccucgagcgcaacaucgagaagugccgcaucuucacccgcuccgacaagugcaaggucgucauccaguucuucuaccgccacggcaucaagcgcacccacaacaucugcuuccaggagucccagccccuccaggucaucuucgacaagaacgucugcaccaacacccucaugauccagccccgccuccucgccgacgccaucguccucuucaccuccucccaggaggaggucacccucgccgucaccccccucaacuucugccucaaguccuccaacgaggaguccauggaccucuccaacgccguccacuccgagauguucgucggcuccgacgaguucgacuucuuccagaucggcauggacaccgagaucaccuucugcuucaaggagcucaagggcauccucaccuucuccgaggccacccacgcccccaucuccaucuacuucgacuuccccggcaagccccucgcccucuccaucgacgacaugcucgucgaggccaacuucauccucgccacccucgccgacgagcagucccgcgccuccuccccccagucccucugccucucccagaagcgcaagcgcuccgaccucaucgagaagaaggccggcaagaacgucaccggccaggcccucgagugcaucuccaagaaggccgccccccgccgccucuaccccaaggagacccucaccaacaucuccgcccucgagaacugcggcucccccgccaugaagcgcgucgacggcgacgucuccgaggucuccgaguccuccgucuccaacaccgaggagguccccggcucccucugccuccgcaaguucuccugcauguucuucggcgccgucuccuccgaccagcaggagcacuucaaccaccccuucgacucccucgcccgcgccuccgacuccgaggaggacaugaacaacggcuccuucuccaucuucuga

SEQ ID NO: 48493 - RNA, 1221 nt, Artificial Sequence
  derived and/or modified sequence opt2 from RAE1__Homo_sapiens__XP_005260640
auggcccccgccgaggccgagcucccccccggcuccgcccuccuccgcgacgccggcgcccgcgccggccuccucaccaagcuccgcuacugggcccucgaggcccgcuucaagaugucccucuucggcaccaccuccggcuucggcaccuccggcaccuccauguucggcuccgccaccaccgacaaccacaaccccaugaaggacaucgaggucaccuccucccccgacgacuccaucggcugccucuccuucuccccccccacccuccccggcaacuuccucaucgccggcuccugggccaacgacguccgcugcugggagguccaggacuccggccagaccauccccaaggcccagcagaugcacaccggccccguccucgacgucugcugguccgacgacggcuccaaggucuucaccgccuccugcgacaagaccgccaagaugugggaccucuccuccaaccaggccauccagaucgcccagcacgacgcccccgucaagaccauccacuggaucaaggcccccaacuacuccugcgucaugaccggcuccugggacaagacccucaaguucugggacacccgcuccuccaaccccaugaugguccuccagcuccccgagcgcugcuacugcgccgacgucaucuaccccauggccgucgucgccaccgccgagcgcggccucaucgucuaccagcucgagaaccagcccuccgaguuccgccgcaucgaguccccccucaagcaccagcaccgcugcgucgccaucuucaaggacaagcagaacaagcccaccggcuucgcccucggcuccaucgagggccgcgucgccauccacuacaucaacccccccaaccccgccaaggacaacuucaccuucaagugccaccgcuccaacggcaccaacaccuccgccccccaggacaucuacgccgucaacggcaucgccuuccaccccguccacggcacccucgccaccgucggcuccgacggccgcuucuccuucugggacaaggacgcccgcaccaagcucaagaccuccgagcagcucgaccagcccaucuccgccugcugcuucaaccacaacggcaacaucuucgccuacgccuccuccuacgacugguccaagggccacgaguucuacaacccccagaagaagaacuacaucuuccuccgcaacgccgccgaggagcucaagccccgcaacaagaaguga

SEQ ID NO: 48494 - RNA, 684 nt, Artificial Sequence
  derived and/or modified sequence opt2 from RAET1E__Homo_sapiens__NP_001230254
augcgccgcaucucccucaccuccucccccguccgccuccuccucuuccuccuccuccuccucaucgcccucgagaucauguacaacuccgacaacaacauggucaagccccucggccuccucggcaagaaggucuacgccaccuccaccuggggcgagcucacccagacccucggcgaggucggccgcgaccuccgcaugcuccucugcgacaucaagccccagaucaagaccuccgaccccuccacccuccaggucgagauguucugccagcgcgaggccgagcgcugcaccggcgccuccuggcaguucgccaccaacggcgagaagucccuccucuucgacgccaugaacaugaccuggaccgucaucaaccacgaggccuccaagaucaaggagaccuggaagaaggaccgcggccucgagaaguacuuccgcaagcucuccaagggcgacugcgaccacuggcuccgcgaguuccucggccacugggaggccaugcccgagcccaccgucucccccgucaacgccuccgacauccacugguccuccuccucccuccccgaccgcuggaucauccucggcgccuucauccuccucguccucaugggcaucguccucaucugcgucugguggcagaacggcgaguggcaggccggccucuggccccuccgcaccuccuga

SEQ ID NO: 48495 - RNA, 741 nt, Artificial Sequence
  derived and/or modified sequence opt2 from RAET1L__Homo_sapiens__NP_570970
auggccgccgccgccauccccgcccuccuccucugccucccccuccucuuccuccucuucggcuggucccgcgcccgccgcgacgacccccacucccucugcuacgacaucaccgucauccccaaguuccgccccggcccccgcuggugcgccguccagggccaggucgacgagaagaccuuccuccacuacgacugcggcaacaagaccgucacccccgucuccccccucggcaagaagcucaacgucaccauggccuggaaggcccagaaccccguccuccgcgaggucgucgacauccucaccgagcagcuccucgacauccagcucgagaacuacacccccaaggagccccucacccuccaggcccgcauguccugcgagcagaaggccgagggccacuccuccggcuccuggcaguucuccaucgacggccagaccuuccuccucuucgacuccgagaagcgcauguggaccaccguccaccccggcgcccgcaagaugaaggagaagugggagaacgacaaggacgucgccauguccuuccacuacaucuccaugggcgacugcaucggcuggcucgaggacuuccucaugggcauggacuccacccucgagcccuccgccggcgccccccucgccauguccuccggcaccacccagcuccgcgccaccgccaccacccucauccucugcugccuccucaucauccuccccugcuucauccuccccggcaucuga

SEQ ID NO: 48496 - RNA, 1947 nt, Artificial Sequence
  derived and/or modified sequence opt2 from RAF1__Homo_sapiens__NP_002871
auggagcacauccagggcgccuggaagaccaucuccaacggcuucggcuucaaggacgccgucuucgacggcuccuccugcaucucccccaccaucguccagcaguucggcuaccagcgccgcgccuccgacgacggcaagcucaccgaccccuccaagaccuccaacaccauccgcgucuuccuccccaacaagcagcgcaccgucgucaacguccgcaacggcaugucccuccacgacugccucaugaaggcccucaagguccgcggccuccagcccgagugcugcgccgucuuccgccuccuccacgagcacaagggcaagaaggcccgccucgacuggaacaccgacgccgccucccucaucggcgaggagcuccaggucgacuuccucgaccacgucccccucaccacccacaacuucgcccgcaagaccuuccucaagcucgccuucugcgacaucugccagaaguuccuccucaacggcuuccgcugccagaccugcggcuacaaguuccacgagcacugcuccaccaagguccccaccaugugcgucgacugguccaacauccgccagcuccuccucuuccccaacuccaccaucggcgacuccggcguccccgcccuccccucccucaccaugcgccgcaugcgcgaguccgucucccgcaugcccgucuccucccagcaccgcuacuccaccccccacgccuucaccuucaacaccuccucccccuccuccgagggcucccucucccagcgccagcgcuccaccuccacccccaacguccacauggucuccaccacccuccccgucgacucccgcaugaucgaggacgccauccgcucccacuccgaguccgccucccccuccgcccucuccuccucccccaacaaccucucccccaccggcuggucccagcccaagacccccguccccgcccagcgcgagcgcgcccccgucuccggcacccaggagaagaacaagauccgcccccgcggccagcgcgacuccuccuacuacugggagaucgaggccuccgaggucaugcucuccacccgcaucggcuccggcuccuucggcaccgucuacaagggcaaguggcacggcgacgucgccgucaagauccucaaggucgucgaccccacccccgagcaguuccaggccuuccgcaacgaggucgccguccuccgcaagacccgccacgucaacauccuccucuucaugggcuacaugaccaaggacaaccucgccaucgucacccaguggugcgagggcuccucccucuacaagcaccuccacguccaggagaccaaguuccagauguuccagcucaucgacaucgcccgccagaccgcccagggcauggacuaccuccacgccaagaacaucauccaccgcgacaugaaguccaacaacaucuuccuccacgagggccucaccgucaagaucggcgacuucggccucgccaccgucaagucccgcugguccggcucccagcaggucgagcagcccaccggcuccguccucuggauggcccccgaggucauccgcaugcaggacaacaaccccuucuccuuccaguccgacgucuacuccuacggcaucguccucuacgagcucaugaccggcgagcuccccuacucccacaucaacaaccgcgaccagaucaucuucauggucggccgcggcuacgccucccccgaccucuccaagcucuacaagaacugccccaaggccaugaagcgccucgucgccgacugcgucaagaaggucaaggaggagcgcccccucuucccccagauccucuccuccaucgagcuccuccagcacucccuccccaagaucaaccgcuccgccuccgagcccucccuccaccgcgccgcccacaccgaggacaucaacgccugcacccucaccaccuccccccgccuccccgucuucuga

SEQ ID NO: 48497 - RNA, 3132 nt, Artificial Sequence
  derived and/or modified sequence opt2 from RAG1__Homo_sapiens__XP_005253098
auggccgccuccuucccccccacccucggccucuccuccgcccccgacgagauccagcacccccacaucaaguucuccgaguggaaguucaagcucuuccgcguccgcuccuucgagaagacccccgaggaggcccagaaggagaagaaggacuccuucgagggcaagcccucccucgagcagucccccgccguccucgacaaggccgacggccagaagcccguccccacccagccccuccucaaggcccaccccaaguucuccaagaaguuccacgacaacgagaaggcccgcggcaaggccauccaccaggccaaccuccgccaccucugccgcaucugcggcaacuccuuccgcgccgacgagcacaaccgccgcuaccccguccacggccccgucgacggcaagacccucggccuccuccgcaagaaggagaagcgcgccaccuccuggcccgaccucaucgccaaggucuuccgcaucgacgucaaggccgacgucgacuccauccaccccaccgaguucugccacaacugcugguccaucaugcaccgcaaguucuccuccgcccccugcgaggucuacuucccccgcaacgucaccauggaguggcacccccacacccccuccugcgacaucugcaacaccgcccgccgcggccucaagcgcaagucccuccagcccaaccuccagcucuccaagaagcucaagaccguccucgaccaggcccgccaggcccgccagcacaagcgccgcgcccaggcccgcaucuccuccaaggacgucaugaagaagaucgccaacugcuccaagauccaccucuccaccaagcuccucgccgucgacuuccccgagcacuucgucaaguccaucuccugccagaucugcgagcacauccucgccgaccccgucgagaccaacugcaagcacgucuucugccgcgucugcauccuccgcugccucaaggucaugggcuccuacugccccuccugccgcuaccccugcuuccccaccgaccucgagucccccgucaaguccuuccucuccguccucaacucccucauggucaagugccccgccaaggagugcaacgaggaggucucccucgagaaguacaaccaccacaucuccucccacaaggaguccaaggagaucuucguccacaucaacaagggcggccgcccccgccagcaccuccucucccucacccgccgcgcccagaagcaccgccuccgcgagcucaagcuccaggucaaggccuucgccgacaaggaggagggcggcgacgucaaguccgucugcaugacccucuuccuccucgcccuccgcgcccgcaacgagcaccgccaggccgacgagcucgaggccaucaugcagggcaagggcuccggccuccagcccgccgucugccucgccauccgcgucaacaccuuccucuccugcucccaguaccacaagauguaccgcaccgucaaggccaucaccggccgccagaucuuccagccccuccacgcccuccgcaacgccgagaagguccuccuccccggcuaccaccacuucgaguggcagcccccccucaagaacgucuccuccuccaccgacgucggcaucaucgacggccucuccggccucuccuccuccgucgacgacuaccccgucgacaccaucgccaagcgcuuccgcuacgacuccgcccucgucuccgcccucauggacauggaggaggacauccucgagggcaugcgcucccaggaccucgacgacuaccucaacggccccuucaccgucgucgucaaggaguccugcgacggcaugggcgacgucuccgagaagcacggcuccggccccgucguccccgagaaggccguccgcuucuccuucaccaucaugaagaucaccaucgcccacuccucccagaacgucaaggucuucgaggaggccaagcccaacuccgagcucugcugcaagccccucugccucaugcucgccgacgaguccgaccacgagacccucaccgccauccucuccccccucaucgccgagcgcgaggccaugaaguccuccgagcucaugcucgagcucggcggcauccuccgcaccuucaaguucaucuuccgcggcaccggcuacgacgagaagcucguccgcgaggucgagggccucgaggccuccggcuccgucuacaucugcacccucugcgacgccacccgccucgaggccucccagaaccucgucuuccacuccaucacccgcucccacgccgagaaccucgagcgcuacgaggucuggcgcuccaaccccuaccacgaguccgucgaggagcuccgcgaccgcgucaagggcgucuccgccaagcccuucaucgagaccguccccuccaucgacgcccuccacugcgacaucggcaacgccgccgaguucuacaagaucuuccagcucgagaucggcgaggucuacaagaaccccaacgccuccaaggaggagcgcaagcgcuggcaggccacccucgacaagcaccuccgcaagaagaugaaccucaagcccaucaugcgcaugaacggcaacuucgcccgcaagcucaugaccaaggagaccgucgacgccgucugcgagcucauccccuccgaggagcgccacgaggcccuccgcgagcucauggaccucuaccucaagaugaagcccgucuggcgcuccuccugccccgccaaggagugccccgagucccucugccaguacuccuucaacucccagcgcuucgccgagcuccucuccaccaaguucaaguaccgcuacgagggcaagaucaccaacuacuuccacaagacccucgcccacguccccgagaucaucgagcgcgacggcuccaucggcgccugggccuccgagggcaacgaguccggcaacaagcucuuccgccgcuuccgcaagaugaacgcccgccaguccaagugcuacgagauggaggacguccucaagcaccacuggcucuacaccuccaaguaccuccagaaguucaugaacgcccacaacgcccucaagaccuccggcuucaccaugaacccccaggccucccucggcgacccccucggcaucgaggacucccucgagucccaggacuccauggaguucuga

SEQ ID NO: 48498 - RNA, 1584 nt, Artificial Sequence
  derived and/or modified sequence opt2 from RAG2__Homo_sapiens__NP_001230714
augucccuccagauggucaccgucuccaacaacaucgcccucauccagcccggcuucucccucaugaacuucgacggccaggucuucuucuucggccagaagggcuggcccaagcgcuccugccccaccggcgucuuccaccucgacgucaagcacaaccacgucaagcucaagcccaccaucuucuccaaggacuccugcuaccuccccccccuccgcuaccccgccaccugcaccuucaagggcucccucgaguccgagaagcaccaguacaucauccacggcggcaagacccccaacaacgaggucuccgacaagaucuacgucauguccaucgucugcaagaacaacaagaaggucaccuuccgcugcaccgagaaggaccucgucggcgacguccccgaggcccgcuacggccacuccaucaacgucgucuacucccgcggcaaguccaugggcguccucuucggcggccgcuccuacaugcccuccacccaccgcaccaccgagaaguggaacuccgucgccgacugccuccccugcgucuuccucgucgacuucgaguucggcugcgccaccuccuacauccuccccgagcuccaggacggccucuccuuccacgucuccaucgccaagaacgacaccaucuacauccucggcggccacucccucgccaacaacauccgccccgccaaccucuaccgcauccgcgucgaccucccccucggcucccccgccgucaacugcaccguccuccccggcggcaucuccgucuccuccgccauccucacccagaccaacaacgacgaguucgucaucgucggcggcuaccagcucgagaaccagaagcgcaugaucugcaacaucaucucccucgaggacaacaagaucgagauccgcgagauggagacccccgacuggacccccgacaucaagcacuccaagaucugguucggcuccaacaugggcaacggcaccgucuuccucggcauccccggcgacaacaagcaggucgucuccgagggcuucuacuucuacaugcucaagugcgccgaggacgacaccaacgaggagcagaccaccuucaccaacucccagaccuccaccgaggaccccggcgacuccacccccuucgaggacuccgaggaguucugcuucuccgccgaggccaacuccuucgacggcgacgacgaguucgacaccuacaacgaggacgacgaggaggacgaguccgagaccggcuacuggaucaccugcugccccaccugcgacgucgacaucaacaccuggguccccuucuacuccaccgagcucaacaagcccgccaugaucuacugcucccacggcgacggccacuggguccacgcccagugcauggaccucgccgagcgcacccucauccaccucuccgccggcuccaacaaguacuacugcaacgagcacgucgagaucgcccgcgcccuccacaccccccagcgcguccucccccucaagaagccccccaugaagucccuccgcaagaagggcuccggcaagauccucacccccgccaagaaguccuuccuccgccgccucuucgacuga

SEQ ID NO: 48499 - RNA, 2943 nt, Artificial Sequence
  derived and/or modified sequence opt2 from RAI14__Homo_sapiens__NP_001138992
augaagucccucaaggccaaguuccgcaaguccgacaccaacgaguggaacaagaacgacgaccgccuccuccaggccgucgagaacggcgacgccgagaaggucgccucccuccucggcaagaagggcgccuccgccaccaagcacgacuccgagggcaagaccgccuuccaccucgccgccgccaagggccacgucgagugccuccgcgucaugaucacccacggcgucgacgucaccgcccaggacaccaccggccacuccgcccuccaccucgccgccaagaacucccaccacgagugcauccgcaagcuccuccaguccaagugccccgccgaguccgucgacuccuccggcaagaccgcccuccacuacgccgccgcccagggcugccuccaggccguccagauccucugcgagcacaagucccccaucaaccucaaggaccucgacggcaacaucccccuccuccucgccguccagaacggccacuccgagaucugccacuuccuccucgaccacggcgccgacgucaacucccgcaacaaguccggccgcaccgcccucaugcucgccugcgagaucggcuccuccaacgccgucgaggcccucaucaagaagggcgccgaccucaaccucgucgacucccucggcuacaacgcccuccacuacuccaagcucuccgagaacgccggcauccagucccuccuccucuccaagaucucccaggacgccgaccucaagacccccaccaagcccaagcagcacgaccaggucuccaagaucuccuccgagcgcuccggcacccccaagaagcgcaaggccccccccccccccaucucccccacccagcucuccgacgucuccuccccccgcuccaucaccuccaccccccucuccggcaaggaguccgucuucuucgccgagccccccuucaaggccgagaucuccuccauccgcgagaacaaggaccgccucuccgacuccaccaccggcgccgacucccuccucgacaucuccuccgaggccgaccagcaggaccuccucucccuccuccaggccaaggucgccucccucacccuccacaacaaggagcuccaggacaagcuccaggccaagucccccaaggaggccgaggccgaccucuccuucgacuccuaccacuccacccagaccgaccucggccccucccucggcaagcccggcgagaccuccccccccgacuccaaguccucccccuccguccucauccacucccucggcaaguccaccaccgacaacgacguccgcauccagcagcuccaggagauccuccaggaccuccagaagcgccucgaguccuccgaggccgagcgcaagcagcuccaggucgagcuccagucccgccgcgccgagcucgucugccucaacaacaccgagaucuccgagaacuccuccgaccucucccagaagcucaaggagacccaguccaaguacgaggaggccaugaaggagguccucuccguccagaagcagaugaagcucggccucgucucccccgaguccauggacaacuacucccacuuccacgagcuccgcgucaccgaggaggagaucaacguccucaagcaggaccuccagaacgcccucgaggaguccgagcgcaacaaggagaagguccgcgagcucgaggagaagcucgucgagcgcgagaagggcaccgucaucaagccccccgucgaggaguacgaggagaugaaguccuccuacugcuccgucaucgagaacaugaacaaggagaaggccuuccucuucgagaaguaccaggaggcccaggaggagaucaugaagcucaaggacacccucaagucccagaugacccaggaggccuccgacgaggccgaggacaugaaggaggccaugaaccgcaugaucgacgagcucaacaagcaggucuccgagcucucccagcucuacaaggaggcccaggccgagcucgaggacuaccgcaagcgcaagucccucgaggacgucaccgccgaguacauccacaaggccgagcacgagaagcucaugcagcucaccaacgucucccgcgccaaggccgaggacgcccucuccgagaugaagucccaguacuccaagguccucaacgagcucacccagcucaagcagcucgucgacgcccagaaggagaacuccgucuccaucaccgagcaccuccaggucaucaccacccuccgcaccgccgccaaggagauggaggagaagaucuccaaccucaaggagcaccucgccuccaaggaggucgaggucgccaagcucgagaagcagcuccucgaggagaaggccgccaugaccgacgccauggucccccgcuccuccuacgagaagcuccaguccucccucgaguccgaggucuccguccucgccuccaagcucaaggaguccgucaaggagaaggagaagguccacuccgaggucguccagauccgcuccgaggucucccaggucaagcgcgagaaggagaacauccagacccuccucaaguccaaggagcaggaggucaacgagcuccuccagaaguuccagcaggcccaggaggagcucgccgagaugaagcgcuacgccgaguccuccuccaagcucgaggaggacaaggacaagaagaucaacgagauguccaaggaggucaccaagcucaaggaggcccucaacucccucucccagcucuccuacuccaccuccuccuccaagcgccagucccagcagcucgaggcccuccagcagcaggucaagcagcuccagaaccagcucgccgagugcaagaagcagcaccaggaggucaucuccgucuaccgcaugcaccuccucuacgccguccagggccagauggacgaggacguccagaagguccucaagcagauccucaccaugugcaagaaccagucccagaagaaguga

SEQ ID NO: 48500 - RNA, 5721 nt, Artificial Sequence
  derived and/or modified sequence opt2 from RAI1__Homo_sapiens__NP_109590
augcaguccuuccgcgagcgcugcggcuuccacggcaagcagcagaacuaccagcagaccucccaggagaccucccgccucgagaacuaccgccagcccucccaggccggccucuccugcgaccgccagcgccuccucgccaaggacuacuacaacccccagcccuaccccuccuacgagggcggcgccggcacccccuccggcaccgccgccgccgucgccgccgacaaguaccaccgcggcuccaaggcccuccccacccagcagggccuccagggccgccccgccuuccccggcuacggcguccaggacuccucccccuaccccggccgcuacgccggcgaggagucccuccaggccuggggcgccccccagcccccccccccccagccccagccccuccccgccggcgucgccaaguacgacgagaaccucaugaagaagaccgccgucccccccucccgccaguacgccgagcagggcgcccagguccccuuccgcacccacucccuccacguccagcagcccccccccccccagcagccccucgccuaccccaagcuccagcgccagaagcuccagaacgacaucgccuccccccuccccuucccccagggcacccacuucccccagcacucccaguccuuccccaccuccuccaccuacuccuccuccguccagggcggcggccagggcgcccacuccuacaaguccugcaccgcccccaccgcccagccccacgaccgcccccucaccgccuccuccucccucgcccccggccagcgcguccagaaccuccacgccuaccaguccggccgccucuccuacgaccagcagcagcagcagcagcagcagcagcagcagcagcagcaggcccuccagucccgccaccacgcccaggagacccuccacuaccagaaccucgccaaguaccagcacuacggccagcagggccagggcuacugccagcccgacgccgccguccgcacccccgagcaguacuaccagaccuucucccccuccuccucccacucccccgcccgcuccgucggccgcucccccuccuacuccuccacccccuccccccucaugcccaaccucgagaacuuccccuacucccagcagccccucuccaccggcgccuuccccgccggcaucaccgaccacucccacuucaugccccuccucaaccccucccccaccgacgccaccuccuccgucgacacccaggccggcaacugcaagccccuccagaaggacaagcuccccgagaaccuccucuccgaccucucccuccagucccucaccgcccucaccucccaggucgagaacaucuccaacaccguccagcagcuccuccucuccaaggccgccgucccccagaagaagggcgucaagaaccucgucucccgcacccccgagcagcacaagucccagcacugcucccccgagggcuccggcuacuccgccgagcccgccggcaccccccucuccgagccccccuccuccaccccccaguccacccacgccgagccccaggaggccgacuaccucuccggcuccgaggacccccucgagcgcuccuuccucuacugcaaccaggcccgcggcucccccgcccgcgucaacuccaacuccaaggccaagcccgaguccgucuccaccugcuccgucaccucccccgacgacauguccaccaaguccgacgacuccuuccagucccuccacggcucccucccccucgacuccuucuccaaguucgucgccggcgagcgcgacugcccccgccuccuccucuccgcccucgcccaggaggaccucgccuccgagauccucggccuccaggaggccaucggcgagaaggccgacaaggccugggccgaggcccccucccucgucaaggacuccuccaagccccccuucucccucgagaaccacuccgccugccucgacuccgucgccaaguccgccuggccccgccccggcgagcccgaggcccuccccgacucccuccagcucgacaagggcggcaacgccaaggacuucucccccggccucuucgaggaccccuccgucgccuucgccacccccgaccccaagaagaccaccggcccccucuccuucggcaccaagcccacccucggcguccccgcccccgaccccaccaccgccgccuucgacugcuuccccgacaccaccgccgccuccuccgccgacuccgccaaccccuucgccuggcccgaggagaaccucggcgacgccugcccccgcuggggccuccaccccggcgagcucaccaagggccucgagcagggcggcaaggccuccgacggcaucuccaagggcgacacccacgaggccuccgccugccucggcuuccaggaggaggacccccccggcgagaaggucgccucccuccccggcgacuucaagcaggaggaggucggcggcgucaaggaggaggccggcggccuccuccagugccccgaggucgccaaggccgaccgcuggcucgaggacucccgccacugcugcuccaccgccgacuucggcgaccucccccuccucccccccaccucccgcaaggaggaccucgaggccgaggaggaguacuccucccucugcgagcuccucggcucccccgagcagcgccccggcaugcaggacccccucucccccaaggccccccucaucugcaccaaggaggaggucgaggagguccucgacuccaaggccggcuggggcucccccugccaccucuccggcgaguccgucauccuccucggccccaccgucggcaccgaguccaagguccaguccugguucgaguccucccucucccacaugaagcccggcgaggagggccccgacggcgagcgcgcccccggcgacuccaccaccuccgacgccucccucgcccagaagcccaacaagcccgccguccccgaggcccccaucgccaagaaggagcccgucccccgcggcaagucccuccgcucccgccgcguccaccgcggccuccccgaggccgaggacucccccugccgcgcccccguccuccccaaggaccuccuccuccccgaguccugcaccggccccccccagggccagauggagggcgccggcgcccccggccgcggcgccuccgagggccucccccgcaugugcacccgcucccucaccgcccucuccgagccccgcacccccggcccccccggccucaccaccacccccgccccccccgacaagcucggcggcaagcagcgcgccgccuucaaguccggcaagcgcgucggcaagcccucccccaaggccgccuccucccccuccaaccccgccgcccuccccgucgccuccgacuccucccccaugggcuccaagaccaaggagaccgacucccccuccacccccggcaaggaccagcgcuccaugauccuccgcucccgcaccaagacccaggagaucuuccacuccaagcgccgccgccccuccgagggccgccuccccaacugccgcgccaccaagaagcuccucgacaacucccaccuccccgccaccuucaaggucuccuccuccccccagaaggagggccgcgucucccagcgcgcccgcguccccaagcccggcgccggcuccaagcucuccgaccgcccccuccacgcccucaagcgcaaguccgccuucauggcccccguccccaccaagaagcgcaaccucguccuccgcucccgcuccuccuccuccuccaacgccuccggcaacggcggcgacggcaaggaggagcgccccgagggcucccccacccucuucaagcgcauguccucccccaagaaggccaagcccaccaagggcaacggcgagcccgccaccaagcuccccccccccgagacccccgacgccugccucaagcucgccucccgcgccgccuuccagggcgccaugaagaccaagguccuccccccccgcaagggccgcggccucaagcucgaggccaucguccagaagaucaccucccccucccucaagaaguucgccugcaaggcccccggcgccucccccggcaacccccucucccccucccucuccgacaaggaccgcggccucaagggcgccggcggcucccccgucggcgucgaggagggccucgucaacgucggcaccggccagaagcuccccaccuccggcgccgacccccucugccgcaaccccaccaaccgcucccucaagggcaagcucaugaacuccaagaagcucuccuccaccgacugcuucaagaccgaggccuucaccucccccgaggcccuccagcccggcggcaccgcccucgcccccaagaagcgcucccgcaagggccgcgccggcgcccacggccucuccaagggcccccucgagaagcgccccuaccucggccccgcccuccuccucaccccccgcgaccgcgccuccggcacccagggcgccuccgaggacaacuccggcggcggcggcaagaagcccaagauggaggagcucggccucgccucccagccccccgagggccgccccugccagccccagacccgcgcccagaagcagcccggccacaccaacuacuccuccuacuccaagcgcaagcgccucacccgcggccgcgccaagaacaccaccuccucccccugcaagggccgcgccaagcgccgccgccagcagcagguccucccccucgaccccgccgagcccgagauccgccucaaguacaucuccuccugcaagcgccuccgcuccgacucccgcacccccgccuucucccccuucguccgcgucgagaagcgcgacgccuucaccaccaucugcaccgucgucaacucccccggcgacgcccccaagccccaccgcaagcccuccuccuccgccuccuccuccuccuccuccuccuccuucucccucgacgccgccggcgccucccucgccacccuccccggcggcuccauccuccagccccgccccucccucccccucuccuccaccaugcaccucggccccgucgucuccaaggcccucuccaccuccugccucgucugcugccucugccagaaccccgccaacuucaaggaccucggcgaccucugcggccccuacuaccccgagcacugccuccccaagaagaagcccaagcucaaggagaagguccgccccgagggcaccugcgaggaggccucccucccccucgagcgcacccucaagggccccgagugcgccgccgccgccaccgccggcaagcccccccgccccgacggccccgccgaccccgccaagcagggcccccuccgcaccuccgcccgcggccucucccgccgccuccaguccugcuacugcugcgacggccgcgaggacggcggcgaggaggccgcccccgccgacaagggccgcaagcacgagugcuccaaggaggcccccgccgagcccggcggcgaggcccaggagcacuggguccacgaggccugcgccgucuggaccggcggcgucuaccucgucgccggcaagcucuucggccuccaggaggccaugaaggucgccgucgacaugaugugcuccuccugccaggaggccggcgccaccaucggcugcugccacaagggcugccuccacaccuaccacuaccccugcgccuccgacgccggcugcaucuucaucgaggagaacuucucccucaagugccccaagcacaagcgccuccccuga

SEQ ID NO: 48501 - RNA, 1443 nt, Artificial Sequence
  derived and/or modified sequence opt2 from RAI2__Homo_sapiens__NP_001166203
auggacgaccuccagucccagaaccucuccauggacaugaccgacuccccccccgcccucgccaacaaccgccucgagaacggcauggcccagcucaucaccaccgaggccuggaacaucaacuccaccgaccucgucgagggcuccuccgcccccgagcucaaccccaacggcaacgccaccuacgucaugaccacccagggccccguccagcuccccgucguccucgagcagcacgucuuccagcaccucaacuccccccucguccucccccaggaggcccccugcuccuccuccaccauccacaacaaccucuuccagggcgccgaggaccccgaggcccagccccagcuccucgaccuccgcauccccucccagccccaggagcccacccuccccuucgaggccguccuccagaaccucuuccccucccagggcacccucggccccccccccugccagcccccccccggcuacgcccccguccccccccagcccuucuccuccccccucuccccccucgucccccccgccacccuccucguccccuaccccgucaucgucccccuccccguccccguccccauccccauccccauccccgucccccaguccuccgaguccaaguucuccuccuccuuccccaagccccccuccuccuucggccuccaccccuucaagggcacccagaccccccucgagaaggacgagcucaagcccuucgacauccuccagcccaaggaguacuuccagcucucccgccacaccgucaucaagaugggcuccgagaacgaggcccucgaccucuccaugaaguccguccccuggcucaaggccggcgaggucuccccccccaucuuccaggaggacgccgcccucgaccucuccgucgccgcccaccgcaaguccgagcccccccccgagacccucuacgacuccggcgccuccgucgacuccuccggccacaccgucauggagaagcuccccuccggcauggagaucuccuucgcccccgccaccucccacgaggcccccgccaugauggacucccacaucuccuccuccgacgccgccaccgagaugcucucccagcccaaccaccccuccggcgaggucaaggccgagaacaacaucgagauggucggcgagucccaggccgccaaggucaucgucuccgucgaggacgccguccccaccaucuucugcggcaagaucaagggccucuccggcgucuccaccaagaacuucuccuucaagcgcgaggacuccguccuccagggcuacgacaucaacucccagggcgaggaguccaugggcaacgccgagccccuccgcaagcccaucaagaaccgcuccaucaagcucaagaaggucaacucccaggagauccacaugcuccccaucaagaagcagcgccucgccaccuucuucccccgcaaguga

SEQ ID NO: 48502 - RNA, 621 nt, Artificial Sequence
  derived and/or modified sequence opt2 from RALA__Homo_sapiens__XP_006715825
auggccgccaacaagcccaagggccagaacucccucgcccuccacaaggucaucauggucggcuccggcggcgucggcaaguccgcccucacccuccaguucauguacgacgaguucgucgaggacuacgagcccaccaaggccgacuccuaccgcaagaaggucguccucgacggcgaggagguccagaucgacauccucgacaccgccggccaggaggacuacgccgccauccgcgacaacuacuuccgcuccggcgagggcuuccucugcgucuucuccaucaccgagauggaguccuucgccgccaccgccgacuuccgcgagcagauccuccgcgucaaggaggacgagaacguccccuuccuccucgucggcaacaaguccgaccucgaggacaagcgccaggucuccgucgaggaggccaagaaccgcgccgagcaguggaacgucaacuacgucgagaccuccgccaagacccgcgccaacgucgacaaggucuucuucgaccucaugcgcgagauccgcgcccgcaagauggaggacuccaaggagaagaacggcaagaagaagcgcaagucccucgccaagcgcauccgcgagcgcugcugcauccucuga

SEQ ID NO: 48503 - RNA, 621 nt, Artificial Sequence
  derived and/or modified sequence opt2 from RALB__Homo_sapiens__NP_002872
auggccgccaacaaguccaagggccaguccucccucgcccuccacaaggucaucauggucggcuccggcggcgucggcaaguccgcccucacccuccaguucauguacgacgaguucgucgaggacuacgagcccaccaaggccgacuccuaccgcaagaaggucguccucgacggcgaggagguccagaucgacauccucgacaccgccggccaggaggacuacgccgccauccgcgacaacuacuuccgcuccggcgagggcuuccuccucgucuucuccaucaccgagcacgaguccuucaccgccaccgccgaguuccgcgagcagauccuccgcgucaaggccgaggaggacaagaucccccuccucgucgucggcaacaaguccgaccucgaggagcgccgccagguccccgucgaggaggcccgcuccaaggccgaggaguggggcguccaguacgucgagaccuccgccaagacccgcgccaacgucgacaaggucuucuucgaccucaugcgcgagauccgcaccaagaagauguccgagaacaaggacaagaacggcaagaaguccuccaagaacaagaaguccuucaaggagcgcugcugccuccucuga

SEQ ID NO: 48504 - RNA, 1968 nt, Artificial Sequence
  derived and/or modified sequence opt2 from RALBP1__Homo_sapiens__NP_006779
augaccgagugcuuccucccccccaccuccucccccuccgagcaccgccgcgucgagcacggcuccggccucacccgcacccccuccuccgaggagaucucccccaccaaguuccccggccucuaccgcaccggcgagcccucccccccccacgacauccuccacgagccccccgacgucgucuccgacgacgagaaggaccacggcaagaagaagggcaaguucaagaagaaggagaagcgcaccgagggcuacgccgccuuccaggaggacuccuccggcgacgaggccgagucccccuccaagaugaagcgcuccaagggcauccacgucuucaagaagcccuccuucuccaagaagaaggagaaggacuucaagaucaaggagaagcccaaggaggagaagcacaaggaggagaagcacaaggaggagaagcacaaggagaagaaguccaaggaccucaccgccgccgacgucgucaagcaguggaaggagaagaagaagaagaagaagcccauccaggagcccgaggucccccagaucgacguccccaaccucaagcccaucuucggcaucccccucgccgacgccgucgagcgcaccaugauguacgacggcauccgccuccccgccgucuuccgcgagugcaucgacuacgucgagaaguacggcaugaagugcgagggcaucuaccgcgucuccggcaucaaguccaaggucgacgagcucaaggccgccuacgaccgcgaggaguccaccaaccucgaggacuacgagcccaacaccgucgccucccuccucaagcaguaccuccgcgaccuccccgagaaccuccucaccaaggagcucaugccccgcuucgaggaggccugcggccgcaccaccgagaccgagaagguccaggaguuccagcgccuccucaaggagcuccccgagugcaacuaccuccucaucuccuggcucaucguccacauggaccacgucaucgccaaggagcucgagaccaagaugaacauccagaacaucuccaucguccucucccccaccguccagaucuccaaccgcguccucuacgucuucuucacccacguccaggagcucuucggcaacgucguccucaagcaggucaugaagccccuccgcugguccaacauggccaccaugcccacccuccccgagacccaggccggcaucaaggaggagauccgccgccaggaguuccuccucaacugccuccaccgcgaccuccagggcggcaucaaggaccucuccaaggaggagcgccucugggagguccagcgcauccucaccgcccucaagcgcaagcuccgcgaggccaagcgccaggagugcgagaccaagaucgcccaggagaucgccucccucuccaaggaggacgucuccaaggaggagaugaacgagaacgaggaggucaucaacauccuccucgcccaggagaacgagauccucaccgagcaggaggagcuccucgccauggagcaguuccuccgccgccagaucgccuccgagaaggaggagaucgagcgccuccgcgccgagaucgccgagauccagucccgccagcagcacggccgcuccgagaccgaggaguacuccuccgaguccgaguccgaguccgaggacgaggaggagcuccagaucauccucgaggaccuccagcgccagaacgaggagcucgagaucaagaacaaccaccucaaccaggccauccacgaggagcgcgaggccaucaucgagcuccgcguccagcuccgccuccuccagaugcagcgcgccaaggccgagcagcaggcccaggaggacgaggagcccgaguggcgcggcggcgccguccagcccccccgcgacggcguccucgagcccaaggccgccaaggagcagcccaaggccggcaaggagcccgccaagcccucccccucccgcgaccgcaaggagaccuccaucuga

SEQ ID NO: 48505 - RNA, 6150 nt, Artificial Sequence
  derived and/or modified sequence opt2 from RALGAPA1__Homo_sapiens__NP_001269972
auguucuccaagaagccccacggcgacgucaagaaguccacccagaagguccucgacaccaagaaggacgcccucacccgccucaagcaccuccgcaucgucaucgagaacgccgaguccaucgaccucaagcaguucuucgaccagcacuucucccacaucuacuacgucuucuucgagaacuucgucaccaucgaggccucccucaagcagaagggccacaagucccagcgcgaggagcucgacgccauccucuucaucuucgagaagauccuccagcuccuccccgagcgcauccaccagcgcuggcaguuccacuccaucggccucauccucaagaagcuccuccacaccggcaacucccucaagauccgccgcgagggcguccgccucuuccuccucuggcuccaggcccuccagaacaacugcuccaaggagcagcucuggauguucuccugccucauccccggcuucuccgccccccaguccgagcacggcccccgcacccucgacaaccucaucaaccccccccucaaccuccaggagacccaggucaccaucgaggagaucaccccccucguccccccccaguccggcgacaagggccaggaggaccucaccuccuacuuccucgaggcccuccucaaguacaucgucauccaggucaagucccucgaguggaagaacaaggagaaccaggagcgcggcuucuccuuccucuucucccacuucaagaaguacuaccuccccuacaucuuccccaacaucugcaaggagaacucccucuaccaccccauccucgacaucccccagaugcgccccaagccccacuacgucgucaucaagaaggacgccgagaccaacgaggccaucuacugcaccaaggagcccuucaucaaggcccgcgucaucgucauccgcuggcucgucuccuucuggcucgagcccaagccccacaccggcccccacauccccggcauggagggcgagguccuccccaagaacauccagcgcgccgccgccucccucgucucccgcgaggaguccaagaacgacaacgccgacaagaccgaccgcaccaccgagcccgagcagucccacuccaacaccuccacccucaccgagcgcgagcccuccuccuccucccucugcuccaucgacgaggagcaccucaccgacaucgagaucguccgccgcgucuucuccuccaagcgcuccaacgucaacuucgucaccgagaucuuccgccaggccuuccuccuccccaucugcgaggccgccgccaugcgcaaggucgucaaggucuaccaggaguggauccagcaggaggagaagccccucuucaugcaggagcccgaggagaucgucaucaccuccuccgaccuccccugcaucgagaacgucaccgaccacgacaucuccauggaggagggcgagaagcgcgaggaggagaacggcaccaacaccgccgaccacguccgcaacuccuccugggccaagaacggcuccuaccagggcgcccuccacaacgccuccgaggaggccaccgagcagaacauccgcgccggcacccaggccguccuccaggucuucaucaucaacuccuccaacaucuuccuccucgagcccgccaacgagaucaagaaccuccucgacgagcacaccgacaugugcaagcgcauccucaacaucuaccgcuacauggucguccaggucuccauggacaagaagaccugggagcagaugcuccucguccuccuccgcgucaccgaguccguccucaagaugcccucccaggccuuccuccaguuccagggcaagaagaacaugacccucgccggccgccucgccggcccccucuuccagacccucaucgucgccuggaucaaggccaaccucaacgucuacaucucccgcgagcucugggacgaccuccucuccguccucuccucccucaccuacugggaggagcucgccaccgaguggucccucaccauggagacccucaccaagguccucgcccgcaaccucuacucccucgaccucuccgaccucccccucgacaagcucuccgagcagaagcagaagaagcacaagggcaagggcgucggccacgaguuccagaaggucuccgucgacaaguccuucucccgcggcuggucccgcgaccagcccggccaggcccccaugcgccagcgcuccgccaccaccaccggcucccccggcaccgagaaggcccgcuccaucguccgccagaagaccgucgacaucgacgacgcccagauccucccccgcuccacccgcguccgccacuucucccaguccgaggagaccggcaacgaggucuucggcgcccucaacgaggagcagccccucccccgcuccuccuccaccuccgacauccucgagcccuucaccgucgagcgcgccaaggaggccgagcagaacgccacccgcggcuccaccgagggcuccguccaguccugcaacggccucuucuggaaggaguccugcuccgacaucggcggcuccuccgccaacguccccgaccucauggacgaguucaucgccgagcgccuccgcuccggcaacgccuccaccaugacccgccgcggcuccucccccggcucccucgagauccccaaggaccuccccgacauccucaacaagcagaaccagaugcgccccaucgacgaccccggcguccccuccgaguggaccucccccgccuccgccggcuccuccgaccucaucuccuccgacucccacuccgacuccuucuccgccuuccaguacgacggccgcaaguucgacaacuucggcuucggcaccgacaccggcgucaccuccuccgccgacgucgacuccggcuccggccaccaccaguccgccgaggagcaggaggucgccucccucaccacccuccacaucgacuccgagaccuccucccucaaccagcaggccuucuccgccgaggucgccaccaucaccggcuccgaguccgccucccccguccacuccccccucggcucccgcucccagacccccucccccuccacccucaacaucgaccacauggagcagaaggaccuccagcucgacgagaagcuccaccacuccguccuccagacccccgacgaccucgagaucuccgaguuccccuccgagugcugcuccgucauggccggcggcacccucaccggcuggcacgccgacgucgccaccgucauguggcgccgcaugcucggcauccucggcgacgucaacuccaucauggaccccgagauccacgcccaggucuucgacuaccucugcgagcucuggcagaaccucgccaagauccgcgacaaccucggcaucuccaccgacaaccucaccucccccuccccccccguccucauccccccccuccgcauccucacccccuggcucuucaaggccaccaugcucaccgacaaguacaagcagggcaagcuccacgccuacaagcucaucugcaacaccaugaagcgccgccaggacgucucccccaaccgcgacuuccucacccacuucuacaacaucaugcacugcggccuccuccacaucgaccaggacaucgucaacaccaucaucaagcacugcuccccccaguucuucucccucggccuccccggcgccaccaugcucaucauggacuucaucgucgccgccggccgcgucgccuccuccgccuuccucaacgccccccgcgucgaggcccagguccuccucggcucccucgucugcuuccccaaccucuacugcgagcuccccucccuccaccccaacauccccgacgucgccgucucccaguucaccgacgucaaggagcucaucaucaagaccguccucuccuccgcccgcgacgagcccuccggccccgcccgcugcgucgcccucugcucccucggcaucuggaucugcgaggagcucguccacgagucccaccacccccagaucaaggaggcccucaacgucaucugcgucucccucaaguucaccaacaagaccgucgcccacgucgccugcaacaugcuccacaugcucguccacuacgucccccgccuccagaucuaccagcccgacuccccccucaagaucauccagauccucaucgccaccaucacccaccuccuccccuccaccgaggccuccuccuacgagauggacaagcgccucgucgucucccuccuccucugccuccucgacuggaucauggcccucccccucaagacccuccuccagcccuuccacgccaccggcgccgaguccgacaagaccgagaaguccguccucaacugcaucuacaagguccuccacggcugcgucuacggcgcccagugcuucuccaacccccgcuacuuccccaugucccucuccgaccucgccuccgucgacuacgaccccuucaugcaccucgagucccucaaggagcccgagccccuccacucccccgacuccgagcgcuccuccaagcuccagcccgucaccgaggucaagacccagaugcagcacggccucaucuccaucgccgcccgcaccgucaucacccaccucgucaaccaccucggccacuaccccauguccggcggccccgccaugcucaccucccaggucugcgagaaccacgacaaccacuacuccgaguccaccgagcucucccccgagcucuucgagucccccaacauccaguucuucguccucaacaacaccacccucgucuccugcauccagauccgcuccgaggagaacaugcccggcggcggccucuccgccggccucgccuccgccaacuccaacguccgcaucaucguccgcgaccucuccggcaaguacuccugggacuccgccauccucuacggccccccccccgucuccggccucuccgagcccaccuccuucaugcucucccucucccaccaggagaagcccgaggagccccccaccuccaacgagugccucgaggacaucaccgucaaggacggccucucccuccaguucaagcgcuuccgcgagaccguccccaccugggacaccauccgcgacgaggaggacguccucgacgagcuccuccaguaccucggcgucaccucccccgagugccuccagcgcaccggcaucucccucaacauccccgccccccagcccgucugcaucuccgagaagcaggagaacgacgucaucaacgccauccucaagcagcacaccgaggagaaggaguucgucgagaagcacuucaacgaccucaacaugaaggccgucgagcaggacgagcccaucccccagaagccccaguccgccuucuacuacugccgccuccuccucuccauccucggcaugaacuccugggacaagcgccgcuccuuccaccuccucaagaagaacgagaagcuccuccgcgagcuccgcaaccucgacucccgccagugccgcgagacccacaagaucgccgucuucuacgucgccgagggccaggaggacaagcacuccauccucaccaacaccggcggcucccaggccuacgaggacuucgucgccggccucggcugggaggucaaccucaccaaccacugcggcuucaugggcggccuccagaagaacaaguccaccggccucaccacccccuacuucgccaccuccaccgucgaggucaucuuccacgucuccacccgcaugcccuccgacuccgacgacucccucaccaagaagcuccgccaccucggcaacgacgagguccacaucgucugguccgagcacacccgcgacuaccgccgcggcaucauccccaccgaguucggcgacguccucaucgucaucuaccccaugaagaaccacauguucuccauccagaucaugaagaagcccgagguccccuucuucggcccccucuucgacggcgccaucgucaacggcaagguccuccccaucaugguccgcgccaccgccaucaacgccucccgcgcccucaagucccucaucccccucuaccagaacuucuacgaggagcgcgcccgcuaccuccagaccaucguccagcaccaccucgagcccaccaccuucgaggacuucgccgcccaggucuucucccccgcccccuaccaccaccuccccuccgacgccgaccacuga

SEQ ID NO: 48506 - RNA, 5622 nt, Artificial Sequence
  derived and/or modified sequence opt2 from RALGAPA2__Homo_sapiens__NP_065076
auguucucccgccgcucccacggcgacgucaagaaguccacccagaagguccucgaccccaagaaggacguccucacccgccucaagcaccuccgcgcccuccucgacaacgucgacgccaacgaccucaagcaguucuucgagaccaacuacucccagaucuacuucaucuucuacgagaacuucaucgcccucgagaacucccucaagcucaagggcaacaacaagucccagcgcgaggagcucgacuccauccucuuccucuucgagaagauccuccaguuccuccccgagcgcaucuucuuccgcuggcacuaccaguccaucggcuccacccucaagaagcuccuccacaccggcaacuccaucaagauccgcugcgagggcauccgccucuuccuccucuggcuccaggcccuccagaccaacugcgccgaggagcagguccucaucuucgccugccucguccccggcuuccccgccgucauguccucccgcggccccugcacccucgagacccucaucaaccccucccccuccgucgccgacgucaagaucuaccccgaggagaucaccccccuccuccccgccaucuccggcgagaagaucgccgaggaccagaccugcuucuuccuccagauccuccucaaguacauggucauccaggccgccucccucgaguggaagaacaaggagaaccaggacaccggcuucaaguuccucuucacccucuuccgcaaguacuaccucccccaccucuuccccuccuucaccaagcucaccaacaucuacaagcccguccucgacaucccccaccuccgccccaagcccgucuacaucaccaccacccgcgacaacgagaacaucuacuccaccaagauccccuacauggccgcccgcgucgucuucaucaaguggaucgucaccuucuuccucgagaagaaguaccucaccgccacccagaacaccaagaacggcgucgacguccuccccaagaucauccagaccgucggcggcggcgccguccaggagcgcgcccccgagcucgacggcggcggccccaccgagcaggacaagucccacuccaacuccuccacccucuccgaccgccgccucuccaacuccucccucugcuccaucgaggaggagcaccgcauggucuacgagaugguccagcgcauccuccucuccacccgcggcuacgucaacuucgucaacgaggucuuccaccaggccuuccuccuccccuccugcgagaucgccgucacccgcaaggucguccaggucuaccgcaaguggauccuccaggacaagcccgucuucauggaggagcccgaccgcaaggacgucgcccaggaggacgccgagaagcucggcuucuccgagaccgacuccaaggaggccuccuccgaguccuccggccacaagcgcuccuccuccuggggccgcaccuacuccuucaccuccgccaugucccgcggcugcgucaccgaggaggagaacaccaacgucaaggccggcguccaggcccuccuccaggucuuccucaccaacuccgccaacaucuuccuccucgagcccugcgccgagguccccguccuccucaaggagcaggucgacgccugcaaggccguccucaucaucuuccgccgcaugaucauggagcucaccaugaacaagaagaccugggagcagaugcuccagauccuccuccgcaucaccgaggccgucaugcagaagcccaaggacaagcagaucaaggaccucuucgcccagucccucgccggccuccucuuccgcacccucauggucgccuggauccgcgccaaccucugcgucuacaucucccgcgagcucugggacgacuuccucggcguccucuccucccucaccgagugggaggagcucaucaacgagugggccaacaucauggacucccucaccgccguccucgcccgcaccgucuacggcgucgagaugaccaaccucccccucgacaagcucuccgagcagaaggagaagaagcagcgcggcaagggcugcguccucgacccccagaagggcaccaccgucggccgcuccuucucccucuccuggcgcucccaccccgacgucaccgagcccaugcgcuuccgcuccgccaccaccuccggcgcccccggcgucgagaaggcccgcaacaucguccgccagaaggccaccgaggucgaggagugccagcaguccgagaacgcccccgccgccggcuccggccaccucaccgucggccagcagcagcagguccuccgcuccuccuccaccuccgacauccccgagccccucugcuccgacuccucccagggccagaaggccgagaacacccagaacuccuccuccuccgagccccagcccauccaggagaacaagggccacgucaagcgcgagcacgagggcaucaccauccucguccgccgcuccuccucccccgccgagcucgaccucaaggacgaccuccagcagacccagggcaagugccgcgagcgccagaaguccgaguccaccaacuccgacaccacccucggcugcaccaacgaggccgagcucuccaugggccccuggcagaccugcgaggaggaccccgagcucaacacccccaccgacgucgucgccgacgccgacgcccgccacuggcuccagcucucccccaccgacgccuccaaccucaccgacuccuccgagugccucaccgacgacugcuccaucaucgccggcggcucccucaccggcuggcaccccgacuccgccgccguccucuggcgccgcguccucggcauccucggcgacgucaacaacauccagucccccaagauccacgcccgcgucuucugcuaccucuacgagcucugguacaagcucgccaagauccgcgacaaccucgccaucucccucgacaaccaguccucccccuccccccccguccucauccccccccuccgcauguucgccuccuggcucuucaaggccgccacccuccccaacgaguacaaggagggcaagcuccaggccuaccgccucaucugcgccaugaugacccgccgccaggacguccuccccaacuccgacuuccucguccacuucuaccucgucaugcaccucggccucaccuccgaggaccaggacauccucaacaccaucauccgccacugccccccccgcuucuucucccucggcuuccccggcuucuccaugcucgucggcgacuucaucaccgccgccgcccgcguccucuccaccgacauccucaccgccccccgcuccgaggccgucaccguccucggcucccucgucugcuuccccaacaccuaccaggagaucccccuccuccaguccguccccgaggucaacgaggccaucaccggcaccgaggacgucaagcacuaccucaucaacauccuccucaagaacgccaccgaggagcccaacgaguacgcccgcugcaucgccgucugcucccucggcgucuggaucugcgaggagcucgcccagugcaccucccacccccaggucaaggaggccaucaacgucaucggcgucacccucaaguuccccaacaagaucgucgcccaggucgccugcgacguccuccagcuccucgucuccuacugggagaagcuccagauguucgagaccucccucccccgcaagauggccgagauccucgucgccaccgucgccuuccuccuccccuccgccgaguacuccuccgucgagaccgacaagaaguucaucgucucccuccuccucugccuccucgacuggugcauggcccuccccgucuccguccuccuccaccccgucuccaccgccguccucgaggagcagcacuccgcccgcgccccccuccucgacuacaucuaccgcguccuccacugcugcgucugcggcuccuccaccuacacccagcagucccacuacauccucacccucgccgaccucuccuccaccgacuacgaccccuuccucccccucgccaacgucaaguccuccgagcccguccaguaccacuccuccgccgagcucggcaaccuccucaccgucgaggaggagaagaagcgccgcucccucgagcucaucccccucaccgcccgcauggucauggcccaccucgucaaccaccucggccacuacccccucuccggcggccccgccauccuccacucccucgucuccgagaaccacgacaacgcccacgucgagggcuccgagcucuccuucgaggucuuccgcucccccaaccuccagcucuucgucuucaacgacuccacccucaucuccuaccuccagacccccaccgagggccccgucggcggcucccccgucggcucccucuccgacguccgcgucaucguccgcgacaucuccggcaaguacuccugggacggcaagguccucuacggcccccucgagggcugccucgcccccaacggccgcaaccccuccuuccucaucuccuccuggcaccgcgacaccuucggcccccagaaggacuccucccaggucgaggagggcgacgacguccucgacaagcuccucgagaacaucggccacaccucccccgagugccuccuccccucccagcucaaccucaacgagcccucccucacccccugcggcaugaacuacgaccaggagaaggagaucaucgaggucauccuccgccagaacgcccaggaggacgaguacauccagucccacaacuucgacuccgccaugaaggucaccucccagggccagcccucccccgucgagccccgcggccccuucuacuucugccgccuccuccucgacgaccucggcaugaacuccugggaccgccgcaagaacuuccaccuccucaagaagaacuccaagcuccuccgcgagcucaagaaccucgacucccgccagugccgcgagacccacaagaucgccgucuucuacaucgccgagggccaggaggacaagugcuccauccucuccaacgagcgcggcucccaggccuacgaggacuucgucgccggccucggcugggaggucgaccucuccacccacugcggcuucaugggcggccuccagcgcaacggcuccaccggccagaccgcccccuacuacgccaccuccaccgucgaggucaucuuccacgucuccacccgcaugcccuccgacuccgacgacucccucaccaagaagcuccgccaccucggcaacgacgagguccacaucgucugguccgagcacucccgcgacuaccgccgcggcaucauccccaccgccuucggcgacgucuccaucaucaucuaccccaugaagaaccacauguucuucaucgccaucaccaagaagcccgagguccccuucuucggcccccucuucgacggcgccaucgucuccggcaagcuccuccccucccucgucugcgccaccugcaucaacgccucccgcgccgucaagugccucaucccccucuaccaguccuucuacgaggagcgcgcccucuaccucgaggccaucauccagaaccaccgcgaggucaugaccuucgaggacuucgccgcccaggucuucucccccucccccuccuacucccucuccggcaccgacuga

SEQ ID NO: 48507 - RNA, 4476 nt, Artificial Sequence
  derived and/or modified sequence opt2 from RALGAPB__Homo_sapiens__NP_001269847
auguacuccgaguggcgcucccuccaccucgucauccagaacgaccagggccacaccuccguccuccacuccuaccccgaguccgucggccgcgaggucgccaacgccgucguccgcccccucggccagguccucggcacccccuccgucgccggcuccgagaaccuccucaagaccgacaaggaggucaaguggaccauggaggucaucugcuacggccucacccucccccucgacggcgagaccgucaaguacugcgucgacgucuacaccgacuggaucauggcccucguccuccccaaggacuccaucccccuccccgucaucaaggagcccaaccaguacguccagaccauccucaagcaccuccagaaccucuucgucccccgccaggagcagggcuccucccagauccgccucugccuccagguccuccgcgccauccagaagcucgcccgcgaguccucccucauggcccgcgagaccugggagguccuccuccucuuccuccuccagaucaacgacauccuccucgccccccccaccguccagggcggcaucgccgagaaccucgccgagaagcucaucggcguccucuucgaggucuggcuccucgccugcacccgcugcuuccccaccccccccuacuggaagaccgccaaggagauggucgccaacuggcgccaccaccccgccgucgucgagcagugguccaaggucaucugcgcccucaccucccgccuccuccgcuucaccuacggccccuccuuccccgccuucaagguccccgacgaggacgccucccucaucccccccgagauggacaacgagugcgucgcccagaccugguuccgcuuccuccacaugcucuccaaccccgucgaccucuccaaccccgccaucaucuccuccacccccaaguuccaggagcaguuccucaacgucuccggcaugccccaggagcucaaccaguaccccugccucaagcaccucccccagaucuucuuccgcgccaugcgcggcaucuccugccucgucgacgccuuccucggcaucucccgcccccgcuccgacuccgccccccccacccccgucaaccgccucuccaugccccaguccgccgccgucuccaccacccccccccacaaccgccgccaccgcgccgucaccgucaacaaggccaccaugaagaccuccaccgucuccaccgcccacgccuccaagguccagcaccagaccuccuccaccuccccccucuccucccccaaccagaccuccuccgagccccgcccccuccccgccccccgccgccccaaggucaacuccauccucaaccucuucggcuccuggcucuucgacgccgccuucguccacugcaagcuccacaacggcaucaaccgcgacuccuccaugaccgccaucaccacccaggccuccauggaguuccgccgcaagggcucccagauguccaccgacaccauggucuccaaccccauguucgacgccuccgaguuccccgacaacuacgaggccggccgcgccgaggccugcggcacccucugccgcaucuucugcuccaagaagaccggcgaggagauccuccccgccuaccucucccgcuucuacaugcuccucauccagggccuccagaucaacgacuacgucugccaccccguccucgccuccgucauccucaacucccccccccucuucugcugcgaccucaagggcaucgacgucgucguccccuacuucaucuccgcccucgagaccauccuccccgaccgcgagcucuccaaguucaaguccuacgucaaccccaccgagcuccgccgcuccuccaucaacauccuccucucccuccucccccucccccaccacuucggcaccgucaaguccgaggucguccucgagggcaaguucuccaacgacgacuccuccuccuacgacaagcccaucaccuuccucucccucaagcuccgccucgucaacauccucaucggcgcccuccagaccgagaccgaccccaacaacacccagaugauccucggcgccaugcucaacaucguccaggacuccgcccuccucgaggccaucggcugccagauggagaugggcggcggcgagaacaaccucaagucccacucccgcaccaacuccggcaucuccuccgccuccggcggcuccaccgagcccaccacccccgacuccgagcgccccgcccaggcccuccuccgcgacuacgacuccgccgccggccuccucauccgcuccauccaccucgucacccagcgccucaacucccaguggcgccaggacauguccaucucccucgccgcccucgagcuccucuccggccucgccaaggucaaggucauggucgacuccggcgaccgcaagcgcgccaucuccuccgucugcaccuacaucgucuaccagugcucccgccccgccccccuccacucccgcgaccuccacuccaugaucgucgccgccuuccagugccucugcgucuggcucaccgagcaccccgacaugcucgacgagaaggacugccucaaggagguccucgagaucgucgagcucggcaucuccggcuccaaguccaagaacaacgagcaggaggucaaguacaagggcgacaaggagcccaaccccgccuccaugcgcgucaaggacgccgccgaggccacccucaccugcaucaugcagcuccucggcgccuuccccucccccuccggccccgccucccccugcucccucgucaacgagaccacccucaucaaguacucccgccuccccaccaucaacaagcacuccuuccgcuacuucguccucgacaacuccgucauccucgccaugcucgagcagccccucggcaacgagcagaacgacuucuuccccuccgucaccguccucguccgcggcauguccggccgccucgccugggcccagcagcucugccuccucccccgcggcgccaaggccaaccagaagcucuucguccccgagccccgccccguccccaagaacgacgucggcuucaaguacuccgucaagcaccgccccuuccccgaggaggucgacaagauccccuucgucaaggccgaccucuccauccccgaccuccacgagaucgucaccgaggagcucgaggagcgccacgagaagcuccgcuccggcauggcccagcagaucgccuacgagauccaccucgagcagcaguccgaggaggagcuccagaagcgcuccuuccccgaccccgucaccgacugcaagccccccccccccgcccaggaguuccagaccgcccgccucuuccucucccacuucggcuuccucucccucgaggcccucaaggagcccgccaacucccgccuccccccccaccucaucgcccucgacuccaccauccccggcuucuucgacgacaucggcuaccucgaccuccuccccugccgccccuucgacaccgucuucaucuucuacaugaagcccggccagaagaccaaccaggagauccucaagaacgucgaguccucccgcaccguccagccccacuuccucgaguuccuccucucccucggcugguccgucgacgucggccgccaccccggcuggaccggccacgucuccaccuccugguccaucaacugcugcgacgacggcgagggcucccagcaggaggaggucaucuccuccgaggacaucggcgccuccaucuucaacggccagaagaagguccucuacuacgccgacgcccucaccgagaucgccuucgucguccccucccccgucgagucccucaccgacucccucgaguccaacaucuccgaccaggacuccgacuccaacauggaccucaugcccggcauccucaagcagcccucccucacccucgagcucuuccccaaccacaccgacaaccucaacuccucccagcgccucucccccuccucccgcaugcgcaagcucccccagggccgccccguccccccccucggccccgagacccgcgucuccgucgucugggucgagcgcuacgacgacaucgagaacuucccccucuccgagcucaugaccgagaucuccaccggcgucgagaccaccgccaacuccuccaccucccuccgcuccaccacccucgagaaggagguccccgucaucuucauccacccccucaacaccggccucuuccgcaucaagauccagggcgccaccggcaaguucaacauggucaucccccucgucgacggcaugaucgucucccgccgcgcccucggcuuccucguccgccagaccgucaucaacaucugccgccgcaagcgccucgaguccgacuccuacucccccccccacguccgccgcaagcagaagaucaccgacaucgucaacaaguaccgcaacaagcagcucgagcccgaguucuacaccucccucuuccaggaggucggccucaagaacugcuccuccuga

SEQ ID NO: 48508 - RNA, 2580 nt, Artificial Sequence
  derived and/or modified sequence opt2 from RALGDS__Homo_sapiens__NP_001035827
augauggucgacugccaguccuccacccaggagaucggcgaggagcucaucaacggcgucaucuacuccaucucccuccgcaagguccagcuccaccacggcggcaacaagggccagcgcuggcucggcuacgagaacgaguccgcccucaaccucuacgagaccugcaagguccgcaccgucaaggccggcacccucgagaagcucgucgagcaccucguccccgccuuccagggcuccgaccucuccuacgucaccaucuuccucugcaccuaccgcgccuucaccaccacccagcagguccucgaccuccucuucaagcgcuacggccgcugcgacgcccucaccgccuccucccgcuacggcugcauccuccccuacuccgacgaggacggcggcccccaggaccagcucaagaacgccaucuccuccauccucggcaccuggcucgaccaguacuccgaggacuucugccagccccccgacuuccccugccucaagcagcucgucgccuacguccagcucaacaugcccggcuccgaccucgagcgccgcgcccaccuccuccucgcccagcucgagcacuccgagcccaucgaggccgagcccgaggcccucucccccguccccgcccucaagcccacccccgagcucgagcucgcccucacccccgcccgcgcccccucccccguccccgcccccgcccccgagcccgagcccgcccccacccccgcccccggcuccgagcucgaggucgcccccgcccccgcccccgagcuccagcaggcccccgagcccgccgucggccucgaguccgcccccgcccccgcccucgagcucgagcccgcccccgagcaggaccccgcccccucccagacccucgagcucgagcccgcccccgcccccguccccucccuccagcccuccuggcccucccccgucgucgccgagaacggccucuccgaggagaagccccaccuccucgucuucccccccgaccucgucgccgagcaguucacccucauggacgccgagcucuucaagaaggucguccccuaccacugccucggcuccaucuggucccagcgcgacaagaagggcaaggagcaccucgcccccaccauccgcgccaccgucacccaguucaacuccgucgccaacugcgucaucaccaccugccucggcaaccgcuccaccaaggcccccgaccgcgcccgcgucgucgagcacuggaucgaggucgcccgcgagugccgcauccucaagaacuucuccucccucuacgccauccucuccgcccuccaguccaacuccauccaccgccucaagaagaccugggaggacgucucccgcgacuccuuccgcaucuuccagaagcucuccgagaucuucuccgacgagaacaacuacucccucucccgcgagcuccucaucaaggagggcaccuccaaguucgccacccucgagaugaaccccaagcgcgcccagaagcgccccaaggagaccggcaucauccagggcaccguccccuaccucggcaccuuccucaccgaccucgucaugcucgacaccgccaugaaggacuaccucuacggccgccucaucaacuucgagaagcgccgcaaggaguucgaggucaucgcccagaucaagcuccuccaguccgccugcaacaacuacuccaucgcccccgacgagcaguucggcgccugguuccgcgccgucgagcgccucuccgagaccgaguccuacaaccucuccugcgagcucgagccccccuccgaguccgccuccaacacccuccgcaccaagaagaacaccgccaucgucaagcgcugguccgaccgccaggcccccuccaccgagcucuccaccuccggcuccucccacuccaaguccugcgaccagcuccgcugcggccccuaccucuccuccggcgacaucgccgacgcccucuccguccacuccgccggcuccuccuccuccgacgucgaggagaucaacaucuccuucguccccgagucccccgacggccaggagaagaaguucugggaguccgccucccaguccucccccgagaccuccggcaucuccuccgccuccuccuccaccuccuccuccuccgccuccaccacccccgucgccgccacccgcacccacaagcgcuccgucuccggccucugcaacuccuccuccgcccucccccucuacaaccagcaggucggcgacugcugcaucauccgcgucucccucgacgucgacaacggcaacauguacaaguccauccucgucaccucccaggacaaggcccccgccgucauccgcaaggccauggacaagcacaaccucgaggaggaggagcccgaggacuacgagcuccuccagauccucuccgacgaccgcaagcucaagauccccgagaacgccaacgucuucuacgccaugaacuccaccgccaacuacgacuucguccucaagaagcgcaccuucaccaagggcgucaaggucaagcacggcgccuccuccacccucccccgcaugaagcagaagggccucaagaucgccaagggcaucuucuga

SEQ ID NO: 48509 - RNA, 1590 nt, Artificial Sequence
  derived and/or modified sequence opt2 from RALGPS1__Homo_sapiens__NP_001177657
auguacaagcgcaacggccucauggccuccguccucgucaccuccgccaccccccagggcuccuccuccuccgacucccucgagggccaguccugcgacuacgccuccaaguccuacgacgccgucgucuucgacguccucaaggucacccccgaggaguucgccucccagaucacccucauggacauccccgucuucaaggccauccagcccgaggagcucgccuccugcggcugguccaagaaggagaagcacucccucgcccccaacgucgucgccuucacccgccgcuucaaccaggucuccuucugggucguccgcgagauccucaccgcccagacccucaagauccgcgccgagauccucucccacuucgucaagaucgccaagaagcuccucgagcucaacaaccuccacucccucauguccgucgucuccgcccuccaguccgcccccaucuuccgccucaccaagaccugggcccuccucaaccgcaaggacaagaccaccuucgagaagcucgacuaccucauguccaaggaggacaacuacaagcgcacccgcgaguacauccgcucccucaagaugguccccuccauccccuaccucggcaucuaccuccucgaccucaucuacaucgacuccgccuaccccgccuccggcuccaucauggagaacgagcagcgcuccaaccagaugaacaacauccuccgcaucaucgccgaccuccaggucuccugcuccuacgaccaccucaccacccucccccacguccagaaguaccucaaguccguccgcuacaucgaggagcuccagaaguucgucgaggacgacaacuacaagcucucccuccgcaucgagcccggcuccuccuccccccgccucgucuccuccaaggaggaccucgccggccccuccgccggcuccggcuccgcccgcuucucccgccgccccaccugccccgacaccuccgucgccggcucccuccccaccccccccgucccccgccaccgcaagucccacucccucggcaacaaccgcggccgccucuacgccacccucggccccaacuggcgcguccccguccgcaacuccccccgcacccgcuccugcgucuacucccccaccggccccugcaucugcucccucggcaacuccgccgccguccccaccauggagggcccccuccgccgcaagacccuccucaaggagggccgcaagcccgcccucuccuccuggacccgcuacugggucauccucuccggcuccacccuccucuacuacggcgccaagucccuccgcggcaccgaccgcaagcacgucuccaucgucggcuggaugguccagcuccccgacgaccccgagcaccccgacaucuuccagcucaacaaccccgacaagggcaacgucuacaaguuccagaccggcucccgcuuccacgccauccucuggcacaagcaccucgacgacgccugcaaguccaaccgcccccaggaggccggcgccgcccccggccccaccggcaccgacucccacgaggucgaccaccucgagggcggcgccggcaaggaggccggccccugcgccuga

SEQ ID NO: 48510 - RNA, 873 nt, Artificial Sequence
  derived and/or modified sequence opt2 from RALY__Homo_sapiens__NP_031393
augucccucaagcuccaggccuccaacgucaccaacaagaacgaccccaaguccaucaacucccgcgucuucaucggcaaccucaacaccgcccucgucaagaaguccgacgucgagaccaucuucuccaaguacggccgcgucgccggcugcuccguccacaagggcuacgccuucguccaguacuccaacgagcgccacgcccgcgccgccguccucggcgagaacggccgcguccucgccggccagacccucgacaucaacauggccggcgagcccaagcccgaccgccccaagggccucaagcgcgccgccuccgccaucuaccgccucuucgacuaccgcggccgccucucccccguccccgucccccgcgccguccccgucaagcgcccccgcgucaccgucccccucguccgccgcgucaagaccaacguccccgucaagcucuucgcccgcuccaccgccgucaccaccuccuccgccaagaucaagcucaaguccuccgagcuccaggccaucaagaccgagcucacccagaucaaguccaacaucgacgcccuccucucccgccucgagcagaucgccgccgagcagaaggccaaccccgacggcaagaagaagggcgacggcggcggcgccggcggcggcggcggcggcggcggcuccggcggcggcggcuccggcggcggcggcggcggcggcuccucccgcccccccgccccccaggagaacaccaccuccgaggccggccucccccagggcgaggcccgcacccgcgacgacggcgacgaggagggccuccucacccacuccgaggaggagcucgagcacucccaggacaccgacgccgacgacggcgcccuccaguga

SEQ ID NO: 48511 - RNA, 915 nt, Artificial Sequence
  derived and/or modified sequence opt2 from RALYL__Homo_sapiens__NP_001093861
auguccaagcgccgccgccucaagcagggcgagcccaucaugaccggcaagacccagaccuccaacgucaccaacaagaacgaccccaaguccaucaacucccgcgucuucaucggcaaccucaacaccgccaucgucaagaaggucgacaucgaggccaucuucuccaaguacggcaagaucgucggcugcuccguccacaagggcuacgccuucguccaguacauguccgagcgccacgcccgcgccgccgucgccggcgagaacgcccgcgucaucgccggccagccccucgacaucaacauggccggcgagcccaagcccuaccgccccaagcccggcaacaagcgcccccucuccgcccucuaccgccucgaguccaaggagcccuuccucuccgucggcggcuacgucuucgacuacgacuacuaccgcgacgacuucuacaaccgccucuucgacuaccacggccgcguccccccccccccccgcgccgucaucccccucaagcgcccccgcgucgccgucaccaccacccgccgcggcaagggcgucuucuccaugaagggcggcucccgcuccaccgccuccggcuccaccggcuccaagcucaaguccgacgagcuccagaccaucaagaaggagcucacccagaucaagaccaagaucgacucccuccucggccgccucgagaagaucgagaagcagcagaaggccgaggccgaggcccagaagaagcagcucgaggagucccucguccucauccaggaggagugcgucuccgagaucgccgaccacuccaccgaggagcccgccgagggcggccccgacgccgacggcgaggagaugaccgacggcaucgaggaggacuucgacgaggacggcggccacgagcucuuccuccagaucaaguga

SEQ ID NO: 48512 - RNA, 447 nt, Artificial Sequence
  derived and/or modified sequence opt2 from RAMP1__Homo_sapiens__NP_005846
auggcccgcgcccucugccgccucccccgccgcggccucuggcuccuccucgcccaccaccucuucaugaccaccgccugccaggaggccaacuacggcgcccuccuccgcgagcucugccucacccaguuccaggucgacauggaggccgucggcgagacccucuggugcgacuggggccgcaccauccgcuccuaccgcgagcucgccgacugcaccuggcacauggccgagaagcucggcugcuucuggcccaacgccgaggucgaccgcuucuuccucgccguccacggccgcuacuuccgcuccugccccaucuccggccgcgccguccgcgacccccccggcuccauccucuaccccuucaucgucguccccaucaccgucacccuccucgucaccgcccucgucgucuggcaguccaagcgcaccgagggcaucgucuga

SEQ ID NO: 48513 - RNA, 528 nt, Artificial Sequence
  derived and/or modified sequence opt2 from RAMP2__Homo_sapiens__NP_005845
auggccucccuccgcgucgagcgcgccggcggcccccgccucccccgcacccgcgucggccgccccgccgcccuccgccuccuccuccuccucggcgccguccucaacccccacgaggcccucgcccagccccuccccaccaccggcacccccggcuccgagggcggcaccgucaagaacuacgagaccgccguccaguucugcuggaaccacuacaaggaccagauggaccccaucgagaaggacuggugcgacugggccaugaucucccgccccuacuccacccuccgcgacugccucgagcacuucgccgagcucuucgaccucggcuuccccaacccccucgccgagcgcaucaucuucgagacccaccagauccacuucgccaacugcucccucguccagcccaccuucuccgacccccccgaggacguccuccucgccaugaucaucgcccccaucugccucauccccuuccucaucacccucgucgucuggcgcuccaaggacuccgaggcccaggccuga

SEQ ID NO: 48514 - RNA, 447 nt, Artificial Sequence
  derived and/or modified sequence opt2 from RAMP3__Homo_sapiens__NP_005847
auggagaccggcgcccuccgccgcccccagcuccucccccuccuccuccuccucugcggcggcugcccccgcgccggcggcugcaacgagaccggcaugcucgagcgccucccccucugcggcaaggccuucgccgacaugaugggcaaggucgacgucuggaaguggugcaaccucuccgaguucaucgucuacuacgaguccuucaccaacugcaccgagauggaggccaacgucgucggcugcuacuggcccaacccccucgcccagggcuucaucaccggcauccaccgccaguucuucuccaacugcaccgucgaccgcguccaccucgaggacccccccgacgagguccucaucccccucaucgucauccccgucguccucaccgucgccauggccggccucgucgucuggcgcuccaagcgcaccgacacccuccucuga

SEQ ID NO: 48515 - RNA, 1863 nt, Artificial Sequence
  derived and/or modified sequence opt2 from RANBP10__Homo_sapiens__NP_065901
auggccgccgccaccgccgaccccggcgccggcaacccccagcccggcgacuccuccggcggcggcgccggcggcggccuccccucccccggcgagcaggagcucucccgccgccuccagcgccucuaccccgccgucaaccagcaggagaccccccucccccgcuccuggucccccaaggacaaguacaacuacaucggccucucccagggcaaccuccgcguccacuacaagggccacggcaagaaccacaaggacgccgccuccguccgcgccacccaccccauccccgccgccugcggcaucuacuacuucgaggucaagaucgucuccaagggccgcgacggcuacaugggcaucggccucuccgcccagggcgucaacaugaaccgccuccccggcugggacaagcacuccuacggcuaccacggcgacgacggccacuccuucugcuccuccggcaccggccagcccuacggccccaccuucaccaccggcgacgucaucggcugcugcgucaaccucaucaacggcaccugcuucuacaccaagaacggccacucccucggcaucgccuucaccgaccuccccgccaaccucuaccccaccgucggccuccagacccccggcgagaucgucgacgccaacuucggccagcagcccuuccucuucgacaucgaggacuacaugcgcgaguggcgcgccaagguccagggcaccguccacugcuuccccaucuccgcccgccucggcgaguggcaggccguccuccagaacauggucuccuccuaccucguccaccacggcuacugcgccaccgccaccgccuucgcccgcaugaccgagacccccauccaggaggagcaggccuccaucaagaaccgccagaagauccagaagcucguccucgagggccgcgucggcgaggccaucgagaccacccagcgcuucuaccccggccuccucgagcacaaccccaaccuccucuucaugcucaagugccgccaguucgucgagauggucaacggcaccgacuccgagguccgcucccucuccucccgcucccccaagucccaggacuccuaccccggcucccccucccucuccccccgccacggccccuccuccucccacaugcacaacaccggcgccgacucccccuccugcuccaacggcgucgccuccaccaaguccaagcagaaccacuccaaguaccccgcccccuccuccuccuccuccuccuccuccuccuccuccuccuccucccccuccuccgucaacuacuccgaguccaacuccaccgacuccaccaagucccagcaccacuccuccaccuccaaccaggagaccuccgacuccgagauggagauggaggccgagcacuaccccaacggcguccucggcuccauguccacccgcaucgucaacggcgccuacaagcacgaggaccuccagaccgacgaguccuccauggacgaccgccacccccgccgccagcucugcggcggcaaccaggccgccaccgagcgcaucauccucuucggccgcgagcuccaggcccucuccgagcagcucggccgcgaguacggcaagaaccucgcccacaccgagaugcuccaggacgccuucucccuccucgccuacuccgaccccugguccugccccgucggccagcagcucgaccccauccagcgcgagcccgucugcgccgcccucaacuccgccauccucgagucccagaaccuccccaagcagcccccccucaugcucgcccucggccaggccuccgagugccuccgccucauggcccgcgccggccucggcuccugcuccuucgcccgcgucgacgacuaccuccacuga

SEQ ID NO: 48516 - RNA, 3267 nt, Artificial Sequence
  derived and/or modified sequence opt2 from RANBP17__Homo_sapiens__NP_075048
auggcccuccacuuccagucccucgccgagcucgagguccucugcacccaccucuacaucggcaccgaccucacccagcgcaucgaggccgagaaggcccuccucgagcucaucgacucccccgagugccucuccaagugccagcuccuccucgagcagggcaccaccuccuacgcccagcuccucgccgccaccugccucuccaagcucgucucccgcgucuccccccuccccgucgagcagcgcauggacauccgcaacuacauccucaacuacgucgccucccagcccaagcucgcccccuucgucauccaggcccucauccaggucaucgccaagaucaccaagcucggcugguucgagguccagaaggaccaguucgucuuccgcgagaucaucgccgacgucaagaaguuccuccagggcaccgucgagcacugcaucaucggcgucaucauccucuccgagcucacccaggagaugaaccucgucgacuacucccgccccuccgccaagcaccgcaagaucgccaccuccuuccgcgacaccucccucaaggacguccucguccucgccugcucccuccucaaggaggucuucgccaagccccucaaccuccaggaccagugccagcagaaccucgucaugcagguccucaagcucguccucaacugccucaacuucgacuucaucggcuccuccgccgacgaguccgccgacgaccucugcaccguccagauccccaccaccuggcgcaccaucuuccucgagcccgagacccucgaccucuucuucaaccucuaccacucccuccccccccuccucucccagcucgcccucuccugccucguccaguucgccuccacccgccgcucccucuucaacucccccgagcgcgccaaguaccucggcaaccucaucaagggcgucaagcgcauccucgagaacccccagggccucuccgaccccggcaacuaccacgaguucugccgcuuccucgcccgccucaagaccaacuaccagcucggcgagcucgucauggucaaggaguaccccgaggucauccgccucaucgccaacuucaccaucaccucccuccagcacugggaguucgcccccaacuccguccacuaccuccucacccucuggcagcgcauggucgccuccguccccuucgucaaguccaccgagccccaccuccucgacaccuacgcccccgagaucaccaaggccuucaucaccucccgccucgacuccgucgccaucgucguccgcgaccaccucgacgacccccucgacgacaccgccaccgucuuccagcagcucgagcagcucugcaccgucucccgcugcgaguacgagaagaccugcgcccuccucguccagcucuucgaccagaacgcccagaacuaccagaagcuccuccaccccuacuccggcgucaccgucgacaucaccauccaggagggccgccucgccuggcucgucuaccucgucggcaccgucgucggcggccgccucaccuacaccuccaccgacgagcacgacgccauggacggcgagcucuccugccgcgucuuccagcucaucucccucauggacaccggccucccccgcugcugcaacgagaagaucgagcucgccauccucugguuccucgaccaguuccgcaagaccuacgucggcgaccagcuccagcgcaccuccaaggucuacgcccgcauguccgagguccucggcaucaccgacgacaaccacguccucgagaccuucaugaccaagaucgucaccaaccucaaguacuggggccgcuacgagcccgucaucucccgcacccuccaguuccucaacgaccucuccgucggcuacauccuccucaagaagcucgucaagaucgacgccgucaaguucaugcucaagaaccacaccuccgagcacuuccccuuccucggcaucuccgacaaccacucccucuccgacuuccgcugccgcaccaccuucuacaccgcccucacccgccuccucauggucgaccucggcgaggacgaggacgaguucgagaacuucaugcucccccucaccgucgccuucgagaccguccuccagaucuucaacaacaacuucaagcaggaggacgucaagcgcaugcucaucggccucgcccgcgaccuccgcggcaucgccuucgcccucaacaccaagaccuccuacaccaugcucuucgacuggauguaccccaccuaccucccccuccuccagaacgccgucgagcgcugguacggcgagcccaccugcaccacccccauccucaagcucauggccgagcucaugcagaaccgcucccagcgccucaacuucgacgucuccucccccaacggcauccuccucuuccgcgaggccuccaagauggucugcaccuacggcaaccagauccucucccucggcucccucuccaaggaccagaucuaccccaugaagcucaagggcaucuccaucugcuacuccgcccucaaguccgcccucugcggcaacuacgucuccuucggcgucuucaagcucuacggcgacaaccacuucgacaacguccuccaggccuucgucaagaugcuccucuccgucucccacuccgaccuccuccaguaccgcaagcucucccaguccuacuacccccuccucgagugccucacccaggaccacauguccuucaucaucaaccucgagccccccguccucauguacguccucaccuccaucuccgagggccucaccacccucgacaccgucgucuccuccuccugcugcaccucccucgacuacaucgucaccuaccucuucaagcacaucgccaaggagggcaagaagccccuccgcugccgcgaggccacccaggccggccagcgccuccuccacuucaugcagcagaaccccgacguccuccagcagaugauguccguccucaugaacaccaucgucuucgaggacugccgcaaccagugguccgucucccgcccccuccucggccucauccuccucaacgagaaguacuucuccgagcuccgcgccucccucaucaacucccagccccuccccaagcaggagguccucgcccagugcuuccgcaaccucauggagggcgucgagcagaaccucuccgucaagaaccgcgaccgcuucacccagaaccucuccgucuuccgccgcgacgucgccgaggcccuccgcuccgacggcaacaccgagcccugcucccucgacaugauguccuga

SEQ ID NO: 48517 - RNA, 606 nt, Artificial Sequence
  derived and/or modified sequence opt2 from RANBP1__Homo_sapiens__NP_002873
auggccgccgccaaggacacccacgaggaccacgacaccuccaccgagaacaccgacgaguccaaccacgacccccaguucgagcccaucgucucccuccccgagcaggagaucaagacccucgaggaggacgaggaggagcucuucaagaugcgcgccaagcucuuccgcuucgccuccgagaacgaccuccccgaguggaaggagcgcggcaccggcgacgucaagcuccucaagcacaaggagaagggcgccauccgccuccucaugcgccgcgacaagacccucaagaucugcgccaaccacuacaucacccccaugauggagcucaagcccaacgccggcuccgaccgcgccugggucuggaacacccacgccgacuucgccgacgagugccccaagcccgagcuccucgccauccgcuuccucaacgccgagaacgcccagaaguucaagaccaaguucgaggagugccgcaaggagaucgaggagcgcgagaagaaggccggcuccggcaagaacgaccacgccgagaaggucgccgagaagcucgaggcccucuccgucaaggaggagaccaaggaggacgccgaggagaagcaguga

SEQ ID NO: 48518 - RNA, 9675 nt, Artificial Sequence
  derived and/or modified sequence opt2 from RANBP2__Homo_sapiens__NP_006258
augcgccgcuccaaggccgacgucgagcgcuacaucgccuccguccagggcuccacccccuccccccgccagaaguccaugaagggcuucuacuucgccaagcucuacuacgaggccaaggaguacgaccucgccaagaaguacaucugcaccuacaucaacguccaggagcgcgaccccaaggcccaccgcuuccucggccuccucuacgagcucgaggagaacaccgacaaggccgucgagugcuaccgccgcuccgucgagcucaaccccacccagaaggaccucguccucaagaucgccgagcuccucugcaagaacgacgucaccgacggccgcgccaaguacuggcucgagcgcgccgccaagcucuuccccggcucccccgccaucuacaagcucaaggagcagcuccucgacugcgagggcgaggacggcuggaacaagcucuucgaccucauccaguccgagcucuacguccgccccgacgacguccacgucaacauccgccucgucgaggucuaccgcuccaccaagcgccucaaggacgccgucgcccacugccacgaggccgagcgcaacaucgcccuccgcuccucccucgaguggaacuccugcgucguccagacccucaaggaguaccucgagucccuccagugccucgaguccgacaaguccgacuggcgcgccaccaacaccgaccuccuccucgccuacgccaaccucaugcuccucacccucuccacccgcgacguccaggagucccgcgagcuccuccaguccuucgacuccgcccuccaguccgucaagucccucggcggcaacgacgagcucuccgccaccuuccucgagaugaagggccacuucuacaugcacgccggcucccuccuccucaagaugggccagcacuccuccaacguccaguggcgcgcccucuccgagcucgccgcccucugcuaccucaucgccuuccaggucccccgccccaagaucaagcucaucaagggcgaggccggccagaaccuccucgagaugauggccugcgaccgccucucccaguccggccacaugcuccucaaccucucccgcggcaagcaggacuuccucaaggagaucgucgagaccuucgccaacaaguccggccaguccgcccucuacgacgcccucuucuccucccagucccccaaggacaccuccuuccucggcuccgacgacaucggcaacaucgacguccgcgagcccgagcucgaggaccucacccgcuacgacgucggcgccauccgcgcccacaacggcucccuccagcaccucaccuggcucggccuccaguggaacucccuccccgcccuccccggcauccgcaaguggcucaagcagcucuuccaccaccucccccacgagaccucccgccucgagaccaacgcccccgaguccaucugcauccucgaccucgaggucuuccuccucggcgucgucuacaccucccaccuccagcucaaggagaagugcaacucccaccacuccuccuaccagccccucugccucccccuccccgucugcaagcagcucugcaccgagcgccagaaguccuggugggacgccgucugcacccucauccaccgcaaggccguccccggcaacgucgccaagcuccgccuccucguccagcacgagaucaacacccuccgcgcccaggagaagcacggccuccagcccgcccuccucguccacugggccgagugccuccagaagaccggcuccggccucaacuccuucuacgaccagcgcgaguacaucggccgcuccguccacuacuggaagaagguccucccccuccucaagaucaucaagaagaagaacuccauccccgagcccaucgacccccucuucaagcacuuccacuccgucgacauccaggccuccgagaucgucgaguacgaggaggacgcccacaucaccuucgccauccucgacgccgucaacggcaacaucgaggacgccgucaccgccuucgaguccaucaaguccgucgucuccuacuggaaccucgcccucaucuuccaccgcaaggccgaggacaucgagaacgacgcccucucccccgaggagcaggaggagugcaagaacuaccuccgcaagacccgcgacuaccucaucaagaucaucgacgacuccgacuccaaccucuccgucgucaagaagcuccccgucccccucgaguccgucaaggagaugcucaacuccgucaugcaggagcucgaggacuacuccgagggcggcccccucuacaagaacggcucccuccgcaacgccgacuccgagaucaagcacuccacccccucccccacccgcuacucccucucccccuccaaguccuacaaguacucccccaagacccccccccgcugggccgaggaccagaacucccuccucaagaugaucugccagcaggucgaggccaucaagaaggagaugcaggagcucaagcucaacuccuccaacuccgccuccccccaccgcuggcccaccgagaacuacggccccgacuccguccccgacggcuaccagggcucccagaccuuccacggcgccccccucaccgucgccaccaccggccccuccgucuacuacucccagucccccgccuacaacucccaguaccuccuccgccccgccgccaacgucacccccaccaagggccccgucuacggcaugaaccgccuccccccccagcagcacaucuacgccuacccccagcagaugcacaccccccccguccaguccuccuccgccugcauguucucccaggagauguacggcccccccgcccuccgcuucgagucccccgccaccggcauccucuccccccgcggcgacgacuacuucaacuacaacguccagcagaccuccaccaaccccccccuccccgagcccggcuacuucaccaagccccccaucgccgcccacgccucccgcuccgccgaguccaagaccaucgaguucggcaagaccaacuucguccagcccaugcccggcgagggccuccgccccucccuccccacccaggcccacaccacccagcccacccccuucaaguucaacuccaacuucaaguccaacgacggcgacuucaccuucuccuccccccaggucgucacccagcccccccccgccgccuacuccaacuccgagucccuccucggccuccucaccuccgacaagccccuccagggcgacggcuacuccggcgccaagcccauccccggcggccagaccaucggcccccgcaacaccuucaacuucggcuccaagaacgucuccggcaucuccuucaccgagaacaugggcuccucccagcagaagaacuccggcuuccgccgcuccgacgacauguucaccuuccacggccccggcaaguccgucuucggcacccccacccucgagaccgccaacaagaaccacgagaccgacggcggcuccgcccacggcgacgacgacgacgacggcccccacuucgagcccgucgucccccuccccgacaagaucgaggucaagaccggcgaggaggacgaggaggaguucuucugcaaccgcgccaagcucuuccgcuucgacgucgaguccaaggaguggaaggagcgcggcaucggcaacgucaagauccuccgccacaagaccuccggcaagauccgccuccucaugcgccgcgagcagguccucaagaucugcgccaaccacuacaucucccccgacaugaagcucacccccaacgccggcuccgaccgcuccuucgucuggcacgcccucgacuacgccgacgagcuccccaagcccgagcagcucgccauccgcuucaagacccccgaggaggccgcccucuucaagugcaaguucgaggaggcccaguccauccucaaggcccccggcaccaacgucgccauggccuccaaccaggccguccgcaucgucaaggagcccaccucccacgacaacaaggacaucugcaaguccgacgccggcaaccucaacuucgaguuccaggucgccaagaaggagggcuccugguggcacugcaacuccugcucccucaagaacgccuccaccgccaagaagugcgucuccugccagaaccucaaccccuccaacaaggagcucgucggccccccccucgccgagaccgucuucacccccaagaccucccccgagaacguccaggaccgcuucgcccucgucacccccaagaaggagggccacugggacugcuccaucugccucguccgcaacgagcccaccgucucccgcugcaucgccugccagaacaccaaguccgccaacaaguccggcuccuccuucguccaccaggccuccuucaaguucggccagggcgaccuccccaagcccaucaacuccgacuuccgcuccgucuucuccaccaaggagggccagugggacugcuccgccugccucguccagaacgagggcuccuccaccaagugcgccgccugccagaacccccgcaagcagucccuccccgccaccuccauccccacccccgccuccuucaaguucggcaccuccgagaccuccaagacccucaaguccggcuucgaggacauguucgccaagaaggagggccagugggacugcuccuccugccucguccgcaacgaggccaacgccacccgcugcgucgccugccagaaccccgacaagcccucccccuccaccuccguccccgcccccgccuccuucaaguucggcaccuccgagaccuccaaggcccccaaguccggcuucgagggcauguucaccaagaaggagggccagugggacugcuccgucugccucguccgcaacgaggccuccgccaccaagugcaucgccugccagaaccccggcaagcagaaccagaccaccuccgccgucuccacccccgccuccuccgagaccuccaaggcccccaaguccggcuucgagggcauguucaccaagaaggagggccagugggacugcuccgucugccucguccgcaacgaggccuccgccaccaagugcaucgccugccagaaccccggcaagcagaaccagaccaccuccgccgucuccacccccgccuccuccgagaccuccaaggcccccaaguccggcuucgagggcauguucaccaagaaggagggccagugggacugcuccgucugccucguccgcaacgaggccuccgccaccaagugcaucgccugccagugccccuccaagcagaaccagaccaccgccaucuccacccccgccuccuccgagaucuccaaggcccccaaguccggcuucgagggcauguucauccgcaagggccagugggacugcuccgucugcugcguccagaacgaguccuccucccucaagugcgucgccugcgacgccuccaagcccacccacaagcccaucgccgaggcccccuccgccuucacccucggcuccgagaugaagcuccacgacuccuccggcucccaggucggcaccggcuucaaguccaacuucuccgagaaggccuccaaguucggcaacaccgagcagggcuucaaguucggccacgucgaccaggagaacucccccuccuucauguuccagggcuccuccaacaccgaguucaaguccaccaaggagggcuucuccauccccgucuccgccgacggcuucaaguucggcaucuccgagcccggcaaccaggagaagaaguccgagaagccccucgagaacggcaccggcuuccaggcccaggacaucuccggccagaagaacggccgcggcgucaucuucggccagaccuccuccaccuucaccuucgccgaccucgccaaguccaccuccggcgagggcuuccaguucggcaagaaggaccccaacuucaagggcuucuccggcgccggcgagaagcucuucuccucccaguacggcaagauggccaacaaggccaacaccuccggcgacuucgagaaggacgacgacgccuacaagaccgaggacuccgacgacauccacuucgagcccgucguccagaugcccgagaaggucgagcucgucaccggcgaggaggacgagaagguccucuacucccagcgcgucaagcucuuccgcuucgacgccgaggucucccaguggaaggagcgcggccucggcaaccucaagauccucaagaacgaggucaacggcaagcuccgcaugcucaugcgccgcgagcagguccucaaggucugcgccaaccacuggaucaccaccaccaugaaccucaagccccucuccggcuccgaccgcgccuggauguggcucgccuccgacuucuccgacggcgacgccaagcucgagcagcucgccgccaaguucaagacccccgagcucgccgaggaguucaagcagaaguucgaggagugccagcgccuccuccucgacaucccccuccagaccccccacaagcucgucgacaccggccgcgccgccaagcucauccagcgcgccgaggagaugaaguccggccucaaggacuucaagaccuuccucaccaacgaccagaccaaggucaccgaggaggagaacaagggcuccggcaccggcgccgccggcgccuccgacaccaccaucaagcccaaccccgagaacaccggccccacccucgagugggacaacuacgaccuccgcgaggacgcccucgacgacuccgucuccuccuccuccguccacgccuccccccucgccuccucccccguccgcaagaaccucuuccgcuucggcgaguccaccaccggcuucaacuucuccuucaaguccgcccucucccccuccaagucccccgccaagcucaaccaguccggcaccuccgucggcaccgacgaggaguccgacgucacccaggaggaggagcgcgacggccaguacuucgagcccgucgucccccuccccgaccucgucgaggucuccuccggcgaggagaacgagcaggucgucuucucccaccgcgccaagcucuaccgcuacgacaaggacgucggccaguggaaggagcgcggcaucggcgacaucaagauccuccagaacuacgacaacaagcagguccgcaucgucaugcgccgcgaccagguccucaagcucugcgccaaccaccgcaucacccccgacaugacccuccagaacaugaagggcaccgagcgcgucuggcucuggaccgccugcgacuucgccgacggcgagcgcaaggucgagcaccucgccguccgcuucaagcuccaggacgucgccgacuccuucaagaagaucuucgacgaggccaagaccgcccaggagaaggacucccucaucaccccccacgucucccgcuccuccaccccccgcgagucccccugcggcaagaucgccgucgccguccucgaggagaccacccgcgagcgcaccgacgucauccagggcgacgacgucgccgacgccaccuccgaggucgaggucuccuccaccuccgagaccacccccaaggccgucgucuccccccccaaguucgucuucggcuccgaguccgucaaguccaucuucuccuccgagaaguccaagcccuucgccuucggcaacuccuccgccaccggcucccucuucggcuucuccuucaacgccccccucaaguccaacaacuccgagaccuccuccgucgcccaguccggcuccgaguccaaggucgagcccaagaagugcgagcucuccaagaacuccgacaucgagcaguccuccgacuccaaggucaagaaccucuucgccuccuuccccaccgaggaguccuccaucaacuacaccuucaagacccccgagaaggccaaggagaagaagaagcccgaggacucccccuccgacgacgacguccucaucgucuacgagcucacccccaccgccgagcagaaggcccucgccaccaagcucaagcucccccccaccuucuucugcuacaagaaccgccccgacuacgucuccgaggaggaggaggacgacgaggacuucgagaccgccgucaagaagcucaacggcaagcucuaccucgacggcuccgagaagugccgcccccucgaggagaacaccgccgacaacgagaaggagugcaucaucgucugggagaagaagcccaccgucgaggagaaggccaaggccgacacccucaagcucccccccaccuucuucugcggcgucugcuccgacaccgacgaggacaacggcaacggcgaggacuuccaguccgagcuccagaagguccaggaggcccagaagucccagaccgaggagaucaccuccaccaccgacuccgucuacaccggcggcaccgaggucaugguccccuccuucugcaaguccgaggagcccgacuccaucaccaaguccaucuccucccccuccgucuccuccgagaccauggacaagcccgucgaccucuccacccgcaaggagaucgacaccgacuccaccucccagggcgaguccaagaucgucuccuucggcuucggcuccuccaccggccucuccuucgccgaccucgccuccuccaacuccggcgacuucgccuucggcuccaaggacaagaacuuccagugggccaacaccggcgccgccgucuucggcacccaguccgucggcacccaguccgccggcaaggucggcgaggacgaggacggcuccgacgaggaggucguccacaacgaggacauccacuucgagcccaucgucucccuccccgaggucgaggucaaguccggcgaggaggacgaggagauccucuucaaggagcgcgccaagcucuaccgcugggaccgcgacgucucccaguggaaggagcgcggcgucggcgacaucaagauccucuggcacaccaugaagaacuacuaccgcauccucaugcgccgcgaccaggucuucaaggucugcgccaaccacgucaucaccaagaccauggagcucaagccccucaacgucuccaacaacgcccucgucuggaccgccuccgacuacgccgacggcgaggccaaggucgagcagcucgccguccgcuucaagaccaaggaggucgccgacugcuucaagaagaccuucgaggagugccagcagaaccucaugaagcuccagaagggccacgucucccucgccgccgagcucuccaaggagaccaaccccgucgucuucuucgacgucugcgccgacggcgagccccucggccgcaucaccauggagcucuucuccaacaucgucccccgcaccgccgagaacuuccgcgcccucugcaccggcgagaagggcuucggcuucaagaacuccaucuuccaccgcgucauccccgacuucgucugccagggcggcgacaucaccaagcacgacggcaccggcggccaguccaucuacggcgacaaguucgaggacgagaacuucgacgucaagcacaccggccccggccuccucuccauggccaaccagggccagaacaccaacaacucccaguucgucaucacccucaagaaggccgagcaccucgacuucaagcacgucgucuucggcuucgucaaggacggcauggacaccgucaagaagaucgaguccuucggcucccccaagggcuccgucugccgccgcaucaccaucaccgagugcggccagaucuga

SEQ ID NO: 48519 - RNA, 1689 nt, Artificial Sequence
  derived and/or modified sequence opt2 from RANBP3__Homo_sapiens__NP_003615
auggccgaccucgccaacgaggagaagcccgccaucgccccccccgucuucgucuuccagaaggacaagggccagaagucccccgccgagcagaagaaccucuccgacuccggcgaggagccccgcggcgaggccgaggccccccaccacggcaccggccaccccgaguccgccggcgagcacgcccucgagccccccgcccccgccggcgccuccgccuccaccccccccccccccgcccccgaggcccagcucccccccuucccccgcgagcucgccggccgcuccgccggcggcuccucccccgagggcggcgaggacuccgaccgcgaggacggcaacuacugcccccccgucaagcgcgagcgcaccuccucccucacccaguucccccccucccaguccgaggagcgcuccuccggcuuccgccucaagccccccacccucauccacggccaggcccccuccgccggccuccccucccagaagcccaaggagcagcagcgcuccguccuccgccccgccguccuccaggccccccagcccaaggcccucucccagaccguccccuccuccggcaccaacggcgucucccuccccgccgacugcaccggcgccguccccgccgccucccccgacaccgccgccuggcgcucccccuccgaggccgccgacgaggagaaggagccccagaagaacgaguccuccaacgccuccgaggaggaggccugcgagaagaaggaccccgccacccagcaggccuucgucuucggccagaaccuccgcgaccgcgucaagcucaucaacgaguccgucgacgaggccgacauggagaacgccggccaccccuccgccgacacccccaccgccaccaacuacuuccuccaguacaucuccuccucccucgagaacuccaccaacuccgccgacgccuccuccaacaaguucgucuucggccagaacauguccgagcgcguccucuccccccccaagcucaacgaggucuccuccgacgccaaccgcgagaacgccgccgccgaguccggcuccgaguccuccucccaggaggccacccccgagaaggagucccucgccgaguccgccgccgccuacaccaaggccaccgcccgcaagugccuccucgagaaggucgaggucaucaccggcgaggaggccgaguccaacguccuccagaugcagugcaagcucuucgucuucgacaagaccucccaguccugggucgagcgcggccgcggccuccuccgccucaacgacauggccuccaccgacgacggcacccuccagucccgccucgucaugcgcacccagggcucccuccgccucauccucaacaccaagcucugggcccagaugcagaucgacaaggccuccgagaaguccauccgcaucaccgccauggacaccgaggaccagggcgucaaggucuuccucaucuccgccuccuccaaggacaccggccagcucuacgccgcccuccaccaccgcauccucgcccuccgcucccgcgucgagcaggagcaggaggccaagaugcccgcccccgagcccggcgccgcccccuccaacgaggaggacgacuccgacgacgacgacguccucgcccccuccggcgccaccgccgccggcgccggcgacgagggcgacggccagaccaccggcuccaccuga

SEQ ID NO: 48520 - RNA, 1473 nt, Artificial Sequence
  derived and/or modified sequence opt2 from RANBP3L__Homo_sapiens__NP_001154901
augaccaccaucccccgcaagggcuccucccaccuccccggcucccuccacaccugcaagcucaagcuccaggaggaccgccgccagcaggagaaguccgucaucgcccagcccaucuucgucuucgagaagggcgagcagaccuucaagcgccccgccgaggacacccucuacgaggccgccgagcccgagugcaacggcuuccccaccaagcgcguccgcuccuccuccuucaccuuccacaucaccgacucccagucccagggcgucuccacccucucccagaagcagaugcgcugcuccuccgucaccaaccuccccaccuucccccacuccggccccguccgcaagaacaacgucuucaugaccuccgcccucguccaguccuccgucgacaucaaguccgccgagcagggccccgucaagcacuccaagcacgucauccgccccgccauccuccagcucccccaggcccgcuccugcgccaagguccgcaagaccuucggccacaaggcccucgaguccugcaagaccaaggagaagaccaacaacaagaucuccgagggcaacuccuaccuccucuccgagaaccucucccgcgcccgcaucuccguccagcucuccaccaaccaggacuuccucggcgccaccuccgucggcugccagcccaacgaggacaagugcuccuucaaguccugcuccuccaacuucgucuucggcgagaacauggucgagcgcguccucggcacccagaagcucacccagccccagcucgagaacgacuccuacgccaaggagaagcccuucaaguccauccccaaguuccccgucaacuuccucuccucccgcaccgacuccaucaagaacaccucccucaucgaguccgccgccgccuucuccucccagcccucccgcaagugccuccucgagaagaucgacgucaucaccggcgaggagaccgagcacaacguccucaagaucaacugcaagcucuucaucuucaacaagaccacccaguccuggaucgagcgcggccgcggcacccuccgccucaacgacaccgccuccaccgacugcggcacccuccagucccgccucaucaugcgcaaccagggcucccuccgccucauccucaacuccaagcucugggcccagaugaagauccagcgcgccaaccacaagaacguccgcaucaccgccaccgaccucgaggacuacuccaucaagaucuuccucauccaggccuccgcccaggacaccgccuaccucuacgccgccauccaccaccgccucgucgcccuccaguccuucaacaagcagcgcgacgucaaccaggccgagucccucuccgagaccgcccagcagcucaacugcgaguccugcgacgagaacgaggacgacuucauccaggucaccaagaacggcuccgaccccuccuccuggacccaccgccaguccgucgccugcuccuga

SEQ ID NO: 48521 - RNA, 3318 nt, Artificial Sequence
  derived and/or modified sequence opt2 from RANBP6__Homo_sapiens__NP_036548
auggccgccaccgccuccgccggcguccccgccaccgucuccgagaagcaggaguucuaccagcuccucaagaaccucaucaaccccuccugcaugguccgccgccaggccgaggagaucuacgagaacauccccggccucugcaagaccaccuuccuccucgacgccguccgcaaccgccgcgccggcuacgagguccgccagauggccgccgcccuccuccgccgccuccucuccuccggcuucgaggaggucuaccccaaccuccccgccgacguccagcgcgacgucaagaucgagcucauccucgccgucaagcucgagacccacgccuccaugcgcaagaagcucugcgacaucuucgccguccucgcccgcaaccucaucgacgaggacggcaccaaccacuggcccgagggccucaaguuccucaucgacuccaucuacuccaagaacgucguccucugggaggucgcccuccacgucuucuggcacuuccccggcaucuucggcacccaggagcgccacgaccucgacaucaucaagcgccuccucgaccagugcauccaggaccaggagcaccccgccauccgcacccucuccgcccgcgccgccgccgccuucguccucgccaacgagaacaacaucgcccucuucaaggacuucgccgaccuccuccccggcauccuccaggccgucaacgacuccugcuaccaggacgacgacuccguccucgagucccucgucgagaucgccgacaccguccccaaguaccucggccccuaccucgaggacacccuccagcucucccucaagcucugcggcgacucccgccucuccaaccuccagcgccagcucgcccucgaggucaucgucacccucuccgagaccgccacccccaugcucaagaagcacaccaacaucaucgcccaggccgucccccacauccucgccaugauggucgaccuccaggacgacgaggacugggucaacgccgacgagauggaggaggacgacuucgacuccaacgccgucgccgccgaguccgcccucgaccgccucgccugcggccucggcggcaaggucguccuccccaugaccaaggagcacaucaugcagaugcuccagucccccgacuggaaguaccgccacgccggccucauggcccucuccgccaucggcgagggcugccaccagcagauggaguccauccucgacgagaccgucaacuccguccuccucuuccuccaggacccccacccccgcguccgcgccgccgccugcaccacccucggccagauggccaccgacuucgcccccaacuuccagaagaaguuccacgagaccgucaucgccgcccuccuccgcaccauggagaaccagggcaaccagcgcguccagucccacgccgccuccgcccucaucaucuucaucgaggacugccccaagucccuccucguccucuacgucgacuccauggucaagaaccuccacuccguccucgucaucaagcuccaggagcucauccgcaacggcaccaagcucgcccucgagcagcucgucaccaccaucgccuccgucgccgacaccaucgaggagaaguucguccccuacuacgacaucuucaugcccucccucaagcacaucgucgagcucgccguccagaaggagcucaagcuccuccgcggcaagaccaucgagugcaucucccacaucggccucgccgucggcaaggagaaguucaugcaggacgccuccaacgucaugcagcuccuccucaagacccaguccgaccucaacaacauggaggacgacgacccccagaccuccuacauggucuccgccugggcccgcaugugcaagauccucggcaaggacuuccagcaguaccucccccucgucaucgagccccucaucaagaccgccuccgccaagcccgacgucgcccuccucgacacccaggacgucgagaacauguccgacgacgacggcuggcaguucgucaaccucggcgaccagcaguccuucggcaucaagaccuccggccucgaggccaaggccaccgccugccagaugcucgucuacuacgccaaggagcuccgcgagggcuucgucgaguacaccgagcaggucgucaagcucauggucccccuccucaaguucuacuuccacgacaacguccgcgucgccgccgccgaguccaugcccuuccuccucgagugcgcccgcauccgcggccccgaguaccucgcccagauguggcaguucaucugcgacccccucaucaaggccaucggcaccgagcccgacaccgacguccucuccgagaucaugaacuccuucgccaaguccaucgaggucaugggcgacggcugccucaacgacgagcaccucgaggagcucggcggcauccucaaggccaagcucgagggccacuucaagaaccaggagcuccgccaggucaagcgccaggaggagaacuacgaccagcaggucgagaugucccuccaggacgaggacgagugcgacgucuacauccucaccaaggucuccgacauccuccacucccucuucuccaccuacaaggagaagauccuccccugguucgagcagcuccucccccucaucgucaaccucaucugcuccucccgccccuggcccgaccgccaguggggccucugcaucuucgacgacaucaucgagcacugcucccccaccuccuucaaguacgucgaguacuuccgcuggcccaugcuccucaacaugcgcgacaacaaccccgagguccgccaggccgccgccuacggccucggcgucauggcccaguucggcggcgacgacuaccgcucccucugcuccgaggccgucccccuccucgucaaggucaucaagugcgccaacuccaagaccaagaagaacgucaucgccaccgagaacugcaucuccgccaucggcaagauccucaaguucaagcccaacugcgucaacgucgacgagguccucccccacuggcucuccuggcucccccuccacgaggacaaggaggaggccauccagacccucuccuuccucugcgaccucaucgaguccaaccaccccgucgucaucggccccaacaacuccaaccuccccaagaucaucuccaucaucgccgagggcaagaucaacgagaccaucaacuacgaggaccccugcgccaagcgccucgccaacgucguccgccagguccagaccuccgaggaccucuggcucgagugcgucucccagcucgacgacgagcagcaggaggcccuccaggagcuccucaacuucgccuga

SEQ ID NO: 48522 - RNA, 2190 nt, Artificial Sequence
  derived and/or modified sequence opt2 from RANBP9__Homo_sapiens__NP_005484
auguccggccagcccccccccccccccccccagcagcagcagcagcagcagcagcucuccccccccccccccgccgcccucgcccccgucuccggcgucguccuccccgccccccccgccgucuccgccggcuccucccccgccggcucccccggcggcggcgccggcggcgagggccucggcgccgccgccgccgcccuccuccuccaccccccccccccccccccccccgccaccgccgcccccccccccccccccccccccccccccccccccgccuccgccgccgcccccgccuccggcccccccgccccccccggccucgccgccggccccggccccgccggcggcgcccccacccccgcccucgucgccggcuccuccgccgccgcccccuucccccacggcgacuccgcccucaacgagcaggagaaggagcuccagcgccgccucaagcgccucuaccccgccgucgacgagcaggagaccccccucccccgcuccuggucccccaaggacaaguucuccuacaucggccucucccagaacaaccuccgcguccacuacaagggccacggcaagacccccaaggacgccgccuccguccgcgccacccaccccauccccgccgccugcggcaucuacuacuucgaggucaagaucgucuccaagggccgcgacggcuacaugggcaucggccucuccgcccagggcgucaacaugaaccgccuccccggcugggacaagcacuccuacggcuaccacggcgacgacggccacuccuucugcuccuccggcaccggccagcccuacggccccaccuucaccaccggcgacgucaucggcugcugcgucaaccucaucaacaacaccugcuucuacaccaagaacggccacucccucggcaucgccuucaccgaccucccccccaaccucuaccccaccgucggccuccagacccccggcgaggucgucgacgccaacuucggccagcaccccuucgucuucgacaucgaggacuacaugcgcgaguggcgcaccaagauccaggcccagaucgaccgcuuccccaucggcgaccgcgagggcgaguggcagaccaugauccagaagauggucuccuccuaccucguccaccacggcuacugcgccaccgccgaggccuucgcccgcuccaccgaccagaccguccucgaggagcucgccuccaucaagaaccgccagcgcauccagaagcucguccucgccggccgcaugggcgaggccaucgagaccacccagcagcucuaccccucccuccucgagcgcaaccccaaccuccucuucacccucaagguccgccaguucaucgagauggucaacggcaccgacuccgagguccgcugccucggcggccgcucccccaagucccaggacuccuaccccgucuccccccgccccuucuccucccccuccaugucccccucccacggcaugaacauccacaaccucgccuccggcaagggcuccaccgcccacuucuccggcuucgaguccugcuccaacggcgucaucuccaacaaggcccaccaguccuacugccacuccaacaagcaccaguccuccaaccucaacguccccgagcucaacuccaucaacaugucccgcucccagcaggucaacaacuucaccuccaacgacgucgacauggagaccgaccacuacuccaacggcgucggcgagaccuccuccaacggcuuccucaacggcuccuccaagcacgaccacgagauggaggacugcgacaccgagauggaggucgacuccucccagcuccgccgccagcucugcggcggcucccaggccgccaucgagcgcaugauccacuucggccgcgagcuccaggccauguccgagcagcuccgccgcgacugcggcaagaacaccgccaacaagaagaugcucaaggacgccuucucccuccucgccuacuccgaccccuggaacucccccgucggcaaccagcucgaccccauccagcgcgagcccgucugcuccgcccucaacuccgccauccucgagacccacaaccuccccaagcagcccccccucgcccucgccaugggccaggccacccagugccucggccucauggcccgcuccggcaucggcuccugcgccuucgccaccgucgaggacuaccuccacuga

SEQ ID NO: 48523 - RNA, 1764 nt, Artificial Sequence
  derived and/or modified sequence opt2 from RANGAP1__Homo_sapiens__NP_001265580
auggccuccgaggacaucgccaagcucgccgagacccucgccaagacccaggucgccggcggccagcucuccuucaagggcaagucccucaagcucaacaccgccgaggacgccaaggacgucaucaaggagaucgaggacuucgacucccucgaggcccuccgccucgagggcaacaccgucggcgucgaggccgcccgcgucaucgccaaggcccucgagaagaaguccgagcucaagcgcugccacugguccgacauguucaccggccgccuccgcaccgagaucccccccgcccucaucucccucggcgagggccucaucaccgccggcgcccagcucgucgagcucgaccucuccgacaacgccuucggccccgacggcguccagggcuucgaggcccuccucaaguccuccgccugcuucacccuccaggagcucaagcucaacaacugcggcaugggcaucggcggcggcaagauccucgccgccgcccucaccgagugccaccgcaaguccuccgcccagggcaagccccucgcccucaaggucuucgucgccggccgcaaccgccucgagaacgacggcgccaccgcccucgccgaggccuuccgcgucaucggcacccucgaggagguccacaugccccagaacggcaucaaccaccccggcaucaccgcccucgcccaggccuucgccgucaacccccuccuccgcgucaucaaccucaacgacaacaccuucaccgagaagggcgccgucgccauggccgagacccucaagacccuccgccaggucgaggucaucaacuucggcgacugccucguccgcuccaagggcgccgucgccaucgccgacgccauccgcggcggccuccccaagcucaaggagcucaaccucuccuucugcgagaucaagcgcgacgccgcccucgccgucgccgaggccauggccgacaaggccgagcucgagaagcucgaccucaacggcaacacccucggcgaggagggcugcgagcagcuccaggagguccucgagggcuucaacauggccaagguccucgccucccucuccgacgacgaggacgaggaggaggaggaggagggcgaggaggaggaggaggaggccgaggaggaggaggaggaggacgaggaggaggaggaggaggaggaggaggaggaggaggaggagccccagcagcgcggccagggcgagaaguccgccacccccucccgcaagauccucgaccccaacaccggcgagcccgcccccguccucuccucccccccccccgccgacgucuccaccuuccucgccuuccccucccccgagaagcuccuccgccucggccccaaguccuccguccucaucgcccagcagaccgacaccuccgaccccgagaaggucgucuccgccuuccucaaggucuccuccgucuucaaggacgaggccaccguccgcauggccguccaggacgccgucgacgcccucaugcagaaggccuucaacuccuccuccuucaacuccaacaccuuccucacccgccuccucguccacaugggccuccucaaguccgaggacaaggucaaggccaucgccaaccucuacggcccccucauggcccucaaccacaugguccagcaggacuacuuccccaaggcccucgccccccuccuccucgccuucgucaccaagcccaacuccgcccucgaguccugcuccuucgcccgccacucccuccuccagacccucuacaaggucuga

SEQ ID NO: 48524 - RNA, 441 nt, Artificial Sequence
  derived and/or modified sequence opt2 from RANGRF__Homo_sapiens__NP_001171272
auggagcccacccgcgacugcccccucuucggcggcgccuucuccgccauccuccccaugggcgccaucgacgucuccgaccuccgccccguccccgacaaccaggaggucuucugccaccccgucaccgaccagucccucaucgucgagcuccucgagcuccaggcccacguccgcggcgaggccgccgcccgcuaccacuucgaggacgucggcggcguccagggcgcccgcgccguccacgucgaguccguccagccccucucccucgagaaccucgcccuccgcggccgcugccaggaggccuggguccucuccggcaagcagcagaucgccaaggagaaccagcaggucgccaaggacgucacccuccaccaggcccuccuccgccucccccaguaccagaccgaccuccuccucaccuucaaccagccccccuga

SEQ ID NO: 48525 - RNA, 387 nt, Artificial Sequence
  derived and/or modified sequence opt2 from RAN__Homo_sapiens__NP_001287725
auguucgacgucaccucccgcgucaccuacaagaacguccccaacuggcaccgcgaccucguccgcgucugcgagaacauccccaucguccucugcggcaacaaggucgacaucaaggaccgcaaggucaaggccaaguccaucgucuuccaccgcaagaagaaccuccaguacuacgacaucuccgccaaguccaacuacaacuucgagaagcccuuccucuggcucgcccgcaagcucaucggcgaccccaaccucgaguucgucgccaugcccgcccucgccccccccgaggucgucauggaccccgcccucgccgcccaguacgagcacgaccucgaggucgcccagaccaccgcccuccccgacgaggacgacgaccucuga

SEQ ID NO: 48526 - RNA, 555 nt, Artificial Sequence
  derived and/or modified sequence opt2 from RAP1B__Homo_sapiens__NP_001010942
augcgcgaguacaagcucgucguccucggcuccggcggcgucggcaaguccgcccucaccguccaguucguccagggcaucuucgucgagaaguacgaccccaccaucgaggacuccuaccgcaagcaggucgaggucgacgcccagcagugcaugcucgagauccucgacaccgccggcaccgagcaguucaccgccaugcgcgaccucuacaugaagaacggccagggcuucgcccucgucuacuccaucaccgcccaguccaccuucaacgaccuccaggaccuccgcgagcagauccuccgcgucaaggacaccgacgacguccccaugauccucgucggcaacaagugcgaccucgaggacgagcgcgucgucggcaaggagcagggccagaaccucgcccgccaguggaacaacugcgccuuccucgaguccuccgccaaguccaagaucaacgucaacgagaucuucuacgaccucguccgccagaucaaccgcaagacccccguccccggcaaggcccgcaagaaguccuccugccagcuccucuga

SEQ ID NO: 48527 - RNA, 2148 nt, Artificial Sequence
  derived and/or modified sequence opt2 from RAP1GAP2__Homo_sapiens__NP_001093868
auguucggccgcaagcgcuccgucuccuucggcggcuucggcuggaucgacaagaccaugcucgccucccucaaggucaagaagcaggagcucgccaacuccuccgacgccacccuccccgaccgcccccucucccccccccucaccgccccccccaccaugaaguccuccgaguucuucgagaugcucgagaagaugcaggacgacuacauccccuaccccuccaucgacgaggucgucgagaagggcggccccuacccccaggucauccucccccaguucggcggcuacuggaucgaggaccccgagaacgucggcacccccaccucccucggcuccuccaucugcgaggaggaggaggaggacaaccucucccccaacaccuucggcuacaagcucgagugcaagggcgaggcccgcgccuaccgccgccacuuccucggcaaggaccaccucaacuucuacugcaccggcuccucccucggcaaccucauccucuccgucaagugcgaggaggccgagggcaucgaguaccuccgcgucauccuccgcuccaagcucaagaccguccacgagcgcaucccccucgccggccucuccaagcuccccuccgucccccagaucgccaaggccuucugcgacgacgccgucggccuccgcuucaaccccguccucuaccccaaggccucccagaugaucgucuccuacgacgagcacgaggucaacaacaccuucaaguucggcgucaucuaccagaaggcccgccagacccucgaggaggagcucuucggcaacaacgaggagucccccgccuucaaggaguuccucgaccuccucggcgacaccaucacccuccaggacuucaagggcuuccgcggcggccucgacgucacccacggccagaccggcgucgaguccgucuacaccaccuuccgcgaccgcgagaucauguuccacgucuccaccaagcuccccuucaccgacggcgacgcccagcagcuccagcgcaagcgccacaucggcaacgacaucgucgccaucaucuuccaggaggagaacacccccuucguccccgacaugaucgccuccaacuuccuccacgccuacaucgucguccaggucgagacccccggcaccgagacccccuccuacaaggucuccgucaccgcccgcgaggacguccccaccuucggccccccccuccccuccccccccgucuuccagaagggccccgaguuccgcgaguuccuccucaccaagcucaccaacgccgagaacgccugcugcaaguccgacaaguucgccaagcucgaggaccgcacccgcgccgcccuccucgacaaccuccacgacgagcuccacgcccacacccaggccaugcucggccucggccccgaggaggacaaguucgagaacggcggccacggcggcuuccucgaguccuucaagcgcgccauccgcguccgcucccacuccauggagaccauggucggcggccagaagaagucccacuccggcggcauccccggcucccucuccggcggcaucucccacaacuccauggaggucaccaagaccaccuucuccccccccgucgucgccgccaccgucaagaaccagucccgcucccccaucaagcgccgcuccggccucuucccccgccuccacaccggcuccgagggccagggcgacucccgcgcccgcugcgacuccaccuccuccacccccaagacccccgacggcggccacuccucccaggagaucaaguccgagaccuccuccaaccccuccucccccgagaucugccccaacaaggagaagcccuucaugaagcucaaggagaacggccgcgccaucucccgcuccuccuccuccaccuccuccgucuccuccaccgccggcgagggcgaggccauggaggagggcgacuccggcggcucccagcccuccaccaccucccccuucaagcaggaggucuucgucuacucccccucccccuccuccgagucccccucccucggcgccgccgccacccccaucaucaugucccgcucccccaccgacgccaagucccgcaacuccccccgcuccaaccucaaguuccgcuucgacaagcucucccacgccuccuccggcgccggccacuga

SEQ ID NO: 48528 - RNA, 1827 nt, Artificial Sequence
  derived and/or modified sequence opt2 from RAP1GDS1__Homo_sapiens__NP_001093896
auggccgacaaccucuccgacacccucaagaagcucaagaucaccgccgucgacaagaccgaggacucccucgagggcugccucgacugccuccuccaggcccucgcccagaacaacaccgagaccuccgagaagauccaggccuccggcauccuccagcucuucgccucccuccucaccccccaguccuccugcaaggccaaggucgccaacaucaucgccgaggucgccaagaacgaguucaugcgcauccccugcgucgacgccggccucaucuccccccucguccagcuccucaacuccaaggaccaggagguccuccuccagaccggccgcgcccucggcaacaucugcuacgacucccacgagggccgcuccgccgucgaccaggccggcggcgcccagaucgucaucgaccaccuccgcucccucugcuccaucaccgaccccgccaacgagaagcuccucaccgucuucugcggcaugcucaugaacuacuccaacgagaacgacucccuccaggcccagcucaucaacaugggcgucauccccacccucgucaagcuccucggcauccacugccagaacgccgcccucaccgagaugugccucgucgccuucggcaaccucgccgagcucgaguccuccaaggagcaguucgccuccaccaacaucgccgaggagcucgucaagcucuucaagaagcagaucgagcacgacaagcgcgagaugaucuucgagguccucgccccccucgccgagaacgacgccaucaagcuccagcucgucgaggccggccucgucgagugccuccucgagaucguccagcagaaggucgacuccgacaaggaggacgacaucaccgagcucaagaccggcuccgaccucaugguccuccuccuccucggcgacgaguccaugcagaagcucuucgagggcggcaagggcuccgucuuccagcgcguccucuccuggauccccuccaacaaccaccagcuccagcucgccggcgcccucgccaucgccaacuucgcccgcaacgacgccaacugcauccacauggucgacaacggcaucgucgagaagcucauggaccuccucgaccgccacgucgaggacggcaacgucaccguccagcacgccgcccucuccgcccuccgcaaccucgccauccccgucaucaacaaggccaagaugcucuccgccggcgucaccgaggccguccucaaguuccucaaguccgagaugccccccguccaguucaagcuccucggcacccuccgcaugcucaucgacgcccaggccgaggccgccgagcagcucggcaagaacgucaagcucgucgagcgccucgucgaguggugcgaggccaaggaccacgccggcgucaugggcgaguccaaccgccuccucuccgcccucauccgccacuccaaguccaaggacgucaucaagaccaucguccaguccggcggcaucaagcaccucgucaccauggccaccuccgagcacgucaucaugcagaacgaggcccucgucgcccucgcccucaucgccgcccucgagcucggcaccgccgagaaggaccucgaguccgccaagcucguccagauccuccaccgccuccucgccgacgagcgcuccgcccccgagaucaaguacaacuccaugguccucaucugcgcccucaugggcuccgagugccuccacaaggagguccaggaccucgccuuccucgacgucgucuccaagcuccgcucccacgagaacaaguccgucgcccagcaggccucccucaccgagcagcgccucaccgucgaguccuga

SEQ ID NO: 48529 - RNA, 552 nt, Artificial Sequence
  derived and/or modified sequence opt2 from RAP2A__Homo_sapiens__NP_066361
augcgcgaguacaaggucgucguccucggcuccggcggcgucggcaaguccgcccucaccguccaguucgucaccggcaccuucaucgagaaguacgaccccaccaucgaggacuucuaccgcaaggagaucgaggucgacuccucccccuccguccucgagauccucgacaccgccggcaccgagcaguucgccuccaugcgcgaccucuacaucaagaacggccagggcuucauccucgucuacucccucgucaaccagcaguccuuccaggacaucaagcccaugcgcgaccagaucauccgcgucaagcgcuacgagaagguccccgucauccucgucggcaacaaggucgaccucgaguccgagcgcgaggucuccuccuccgagggccgcgcccucgccgaggaguggggcugccccuucauggagaccuccgccaaguccaagaccauggucgacgagcucuucgccgagaucguccgccagaugaacuacgccgcccagcccgacaaggacgaccccugcugcuccgccugcaacauccaguga

SEQ ID NO: 48530 - RNA, 552 nt, Artificial Sequence
  derived and/or modified sequence opt2 from RAP2B__Homo_sapiens__NP_002877
augcgcgaguacaaggucgucguccucggcuccggcggcgucggcaaguccgcccucaccguccaguucgucaccggcuccuucaucgagaaguacgaccccaccaucgaggacuucuaccgcaaggagaucgaggucgacuccucccccuccguccucgagauccucgacaccgccggcaccgagcaguucgccuccaugcgcgaccucuacaucaagaacggccagggcuucauccucgucuacucccucgucaaccagcaguccuuccaggacaucaagcccaugcgcgaccagaucauccgcgucaagcgcuacgagcgcguccccaugauccucgucggcaacaaggucgaccucgagggcgagcgcgaggucuccuacggcgagggcaaggcccucgccgaggagugguccugccccuucauggagaccuccgccaagaacaaggccuccgucgacgagcucuucgccgagaucguccgccagaugaacuacgccgcccagcccaacggcgacgagggcugcugcuccgccugcgucauccucuga

SEQ ID NO: 48531 - RNA, 3285 nt, Artificial Sequence
  derived and/or modified sequence opt2 from RAPGEF1__Homo_sapiens__NP_001291204
auguccggcggccucggccuccgccgcucccccgagauguccggcaagaucgagaaggccgacucccagcgcucccaccucuccuccuucaccaugaagcucauggacaaguuccacucccccaagaucaagcgcacccccuccaagaagggcaagcccgccgaggucuccgucaagauccccgagaagcccgucaacaaggaggccaccgaccgcuuccuccccgagggcuacccccucccccucgaccucgagcagcaggccgucgaguucauguccaccuccgccgucgccucccgcucccagcgccagaagaaccucuccuggcucgaggagaaggagaaggaggucgucuccgcccuccgcuacuucaagaccaucgucgacaagauggccaucgacaagaagguccucgagaugcuccccggcuccgccuccaagguccucgaggccauccucccccucguccagaacgacccccgcauccagcacuccuccgcccucuccuccugcuacucccgcgucuaccagucccucgccaaccucauccgcugguccgaccaggucaugcucgagggcgucaacuccgaggacaaggagauggucaccaccgucaagggcgucaucaaggccguccucgacggcgucaaggagcucguccgccucaccaucgagaagcagggccgccccucccccaccucccccgucaagcccuccucccccgccuccaagcccgacggccccgccgagcucccccucaccgaccgcgaggucgagauccucaacaagaccaccggcaugucccaguccaccgagcuccuccccgacgccaccgacgaggaggucgccccccccaagcccccccuccccggcauccgcgucgucgacaacucccccccccccgcccucccccccaagaagcgccaguccgcccccucccccacccgcgucgccgucgucgcccccaugucccgcgccaccuccggcuccucccuccccgucggcaucaaccgccaggacuucgacgucgacugcuacgcccagcgccgccucuccggcggcucccacuccuacggcggcgaguccccccgccucucccccugcuccuccaucggcaagcucuccaaguccgacgagcagcucuccucccucgaccgcgacuccggccagugcucccgcaacaccuccugcgagacccucgaccacuacgaccccgacuacgaguuccuccagcaggaccucuccaacgccgaccagaucccccagcagaccgccuggaaccucuccccccuccccgagucccucggcgaguccggcucccccuuccucggcccccccuuccagcucccccucggcggccacccccagcccgacggcccccucgcccccggccagcagaccgacaccccccccgcccuccccgagaagaagcgccgcuccgccgccucccagaccgccgacggcuccggcugccgcgucuccuacgagcgccaccccucccaguacgacaacaucuccggcgaggaccuccaguccaccgcccccauccccuccguccccuacgcccccuucgccgccauccuccccuuccagcacggcggcuccuccgcccccgucgaguucgucggcgacuucaccgcccccgaguccaccggcgaccccgagaagccccccccccuccccgagaagaagaacaagcacaugcucgccuacaugcagcuccucgaggacuacuccgagccccagcccuccauguucuaccagaccccccagaacgagcacaucuaccagcagaagaacaagcuccucauggaggucuacggcuucuccgacuccuucuccggcgucgacuccguccaggagcucgcccccccccccgcccucccccccaagcagcgccagcucgagccccccgccggcaaggacggccacccccgcgaccccuccgccgucuccggcguccccggcaaggacucccgcgacggcuccgagcgcgcccccaagucccccgacgcccucgaguccgcccaguccgaggaggaggucgacgagcucucccucaucgaccacaacgagaucaugucccgccucacccucaagcaggagggcgacgacggccccgacguccgcggcggcuccggcgacauccuccucguccacgccaccgagaccgaccgcaaggaccucguccucuacugcgaggccuuccucaccaccuaccgcaccuucaucucccccgaggagcucaucaagaagcuccaguaccgcuacgagaaguucucccccuucgccgacaccuucaagaagcgcgucuccaagaacaccuucuucguccucguccgcgucgucgacgagcucugccucgucgagcucaccgaggagauccucaagcuccucauggagcucgucuuccgccucgucugcaacggcgagcucucccucgcccgcguccuccgcaagaacauccucgacaaggucgaccagaagaagcuccuccgcugcgccaccuccucccagccccucgccgcccgcggcgucgccgcccgccccggcacccuccacgacuuccacucccacgagaucgccgagcagcucacccuccucgacgccgagcucuucuacaagaucgagauccccgagguccuccucugggccaaggagcagaacgaggagaagucccccaaccucacccaguucaccgagcacuucaacaacauguccuacuggguccgcuccaucaucaugcuccaggagaaggcccaggaccgcgagcgccuccuccucaaguucaucaagaucaugaagcaccuccgcaagcucaacaacuucaacuccuaccucgccauccucuccgcccucgacuccgcccccauccgccgccucgaguggcagaagcagaccuccgagggccucgccgaguacugcacccucaucgacuccuccuccuccuuccgcgccuaccgcgccgcccucuccgaggucgagccccccugcauccccuaccucggccucauccuccaggaccucaccuucguccaccucggcaaccccgacuacaucgacggcaaggucaacuucuccaagcgcuggcagcaguucaacauccucgacuccaugcgcugcuuccagcaggcccacuacgacaugcgccgcaacgacgacaucaucaacuucuucaacgacuucuccgaccaccucgccgaggaggcccucugggagcucucccucaagaucaagccccgcaacaucacccgccgcaagaccgaccgcgaggagaagaccuga

SEQ ID NO: 48532 - RNA, 4500 nt, Artificial Sequence
  derived and/or modified sequence opt2 from RAPGEF2__Homo_sapiens__NP_055062
augaagccccucgccauccccgccaaccacggcgucaugggccagcaggagaagcacucccuccccgccgacuucaccaagcuccaccucaccgacucccuccacccccaggucacccacgucuccuccucccacuccggcugcuccaucaccuccgacuccggcuccuccucccucuccgacaucuaccaggccaccgaguccgaggccggcgacauggaccucuccggccuccccgagaccgccgucgacuccgaggacgacgacgacgaggaggacaucgagcgcgccuccgacccccucaugucccgcgacaucguccgcgacugccucgagaaggaccccaucgaccgcaccgacgacgacaucgagcagcuccucgaguucaugcaccagcuccccgccuucgccaacaugaccauguccguccgccgcgagcucugcgccgucauggucuucgccgucgucgagcgcgccggcaccaucguccucaacgacggcgaggagcucgacuccugguccgucauccucaacggcuccgucgaggucaccuaccccgacggcaaggccgagauccucugcaugggcaacuccuucggcgucucccccaccauggacaaggaguacaugaagggcgucaugcgcaccaaggucgacgacugccaguucgucugcaucgcccagcaggacuacugccgcauccucaaccaggucgagaagaacaugcagaaggucgaggaggagggcgagaucgucauggucaaggagcaccgcgagcucgaccgcaccggcacccgcaagggccacaucgucaucaagggcaccuccgagcgccucaccaugcaccucgucgaggagcacuccgucgucgaccccaccuucaucgaggacuuccuccucaccuaccgcaccuuccucuccucccccauggaggucggcaagaagcuccucgagugguucaacgaccccucccuccgcgacaaggucacccgcgucguccuccucugggucaacaaccacuucaacgacuucgagggcgaccccgccaugacccgcuuccucgaggaguucgagaacaaccucgagcgcgagaagaugggcggccaccuccgccuccucaacaucgccugcgccgccaaggccaagcgccgccucaugacccucaccaagcccucccgcgaggccccccuccccuucauccuccucggcggcuccgagaagggcuucggcaucuucgucgacuccgucgacuccggcuccaaggccaccgaggccggccucaagcgcggcgaccagauccucgaggucaacggccagaacuucgagaacauccagcucuccaaggccauggagauccuccgcaacaacacccaccucuccaucaccgucaagaccaaccucuucgucuucaaggagcuccucacccgccucuccgaggagaagcgcaacggcgccccccaccuccccaagaucggcgacaucaagaaggccucccgcuacuccauccccgaccucgccgucgacgucgagcaggucaucggccucgagaaggucaacaagaaguccaaggccaacaccgucggcggccgcaacaagcucaagaagauccucgacaagacccgcaucuccauccucccccagaagcccuacaacgacaucggcaucggccagucccaggacgacuccaucgucggccuccgccagaccaagcacauccccaccgcccuccccgucuccggcacccucuccuccuccaaccccgaccuccuccagucccaccaccgcauccucgacuucuccgccacccccgaccuccccgaccagguccuccgcgucuucaaggccgaccagcagucccgcuacaucaugaucuccaaggacaccaccgccaaggaggucgucauccaggccauccgcgaguucgccgucaccgccacccccgaccaguacucccucugcgaggucuccgucacccccgagggcgucaucaagcagcgccgccuccccgaccagcucuccaagcucgccgaccgcauccagcucuccggccgcuacuaccucaagaacaacauggagaccgagacccucugcuccgacgaggacgcccaggagcuccuccgcgagucccagaucucccuccuccagcucuccaccgucgaggucgccacccagcucuccaugcgcaacuucgagcucuuccgcaacaucgagcccaccgaguacaucgacgaccucuucaagcuccgcuccaagaccuccugcgccaaccucaagcgcuucgaggaggucaucaaccaggagaccuucugggucgccuccgagauccuccgcgagaccaaccagcucaagcgcaugaagaucaucaagcacuucaucaagaucgcccuccacugccgcgagugcaagaacuucaacuccauguucgccaucaucuccggccucaaccucgcccccgucgcccgccuccgcaccaccugggagaagcuccccaacaaguacgagaagcucuuccaggaccuccaggaccucuucgaccccucccgcaacauggccaaguaccgcaacguccucaacucccagaaccuccagccccccaucaucccccucuuccccgucaucaagaaggaccucaccuuccuccacgagggcaacgacuccaaggucgacggccucgucaacuucgagaagcuccgcaugaucgccaaggagauccgccacgucggccgcauggccuccgucaacauggaccccgcccucauguuccgcacccgcaagaagaaguggcgcucccucggcucccucucccagggcuccaccaacgccaccguccucgacgucgcccagaccggcggccacaagaagcgcguccgccgcuccuccuuccucaacgccaagaagcucuacgaggacgcccagauggcccgcaaggucaagcaguaccucuccaaccucgagcucgagauggacgaggagucccuccagacccucucccuccagugcgagcccgccaccaacacccuccccaagaaccccggcgacaagaagcccgucaaguccgagaccucccccgucgccccccgcgccggcucccagcagaaggcccagucccucccccagccccagcagcagcccccccccgcccacaagaucaaccagggccuccagguccccgccgucucccucuaccccucccgcaagaagguccccgucaaggaccucccccccuucggcaucaacuccccccaggcccucaagaagauccucucccucuccgaggagggcucccucgagcgccacaagaagcaggccgaggacaccaucuccaacgccuccucccagcucuccuccccccccaccuccccccaguccuccccccgcaagggcuacacccucgcccccuccggcaccgucgacaacuucuccgacuccggccacuccgagaucuccucccgcuccuccaucgucuccaacuccuccuucgacuccguccccgucucccuccacgacgagcgccgccagcgccacuccgucuccaucgucgagaccaaccucggcaugggccgcauggagcgccgcaccaugaucgagcccgaccaguacucccucggcuccuacgcccccauguccgagggccgcggccucuacgccaccgccaccgucaucuccucccccuccaccgaggagcucucccaggaccagggcgaccgcgccucccucgacgccgccgacuccggccgcggcuccuggaccuccugcuccuccggcucccacgacaacauccagaccauccagcaccagcgcuccugggagacccuccccuucggccacacccacuucgacuacuccggcgaccccgccggccucugggccuccuccucccacauggaccagaucauguucuccgaccacuccaccaaguacaaccgccagaaccagucccgcgagucccucgagcaggcccagucccgcgccuccugggccuccuccaccggcuacuggggcgaggacuccgagggcgacaccggcaccaucaagcgccgcggcggcaaggacgucuccaucgaggccgaguccuccucccucaccuccgucaccaccgaggagaccaagcccguccccaugcccgcccacaucgccgucgccuccuccaccaccaagggccucaucgcccgcaaggagggccgcuaccgcgagcccccccccaccccccccggcuacaucggcauccccaucaccgacuuccccgagggccacucccaccccgcccgcaagccccccgacuacaacgucgcccuccagcgcucccgcauggucgcccgcuccuccgacaccgccggccccuccuccguccagcagccccacggccaccccaccuccucccgccccgucaacaagccccaguggcacaagcccaacgaguccgacccccgccucgcccccuaccagucccagggcuucuccaccgaggaggacgaggacgagcaggucuccgccgucuga

SEQ ID NO: 48533 - RNA, 2772 nt, Artificial Sequence
  derived and/or modified sequence opt2 from RAPGEF3__Homo_sapiens__NP_001092001
augaaggucggcuggcccggcgaguccugcuggcaggucggccucgccgucgaggacucccccgcccucggcgccccccgcgucggcgcccuccccgacgucguccccgagggcacccuccucaacaugguccuccgccgcaugcaccgcccccgcuccugcuccuaccagcuccuccucgagcaccagcgccccuccugcauccagggccuccgcuggaccccccucaccaacuccgaggagucccucgacuucuccgagucccucgagcaggccuccaccgagcgcguccuccgcgccggccgccagcuccaccgccaccuccucgccaccugccccaaccucauccgcgaccgcaaguaccaccuccgccucuaccgccagugcugcuccggccgcgagcucgucgacggcauccucgcccucggccucggcguccacucccgcucccaggucgucggcaucugccagguccuccucgacgagggcgcccucugccacgucaagcacgacugggccuuccaggaccgcgacgcccaguucuaccgcuuccccggccccgagcccgagcccgucggcacccacgagauggaggaggagcucgccgaggccgucgcccuccucucccagcgcggccccgacgcccuccucaccgucgcccuccgcaagccccccggccagcgcaccgacgaggagcucgaccucaucuucgaggagcuccuccacaucaaggccgucgcccaccucuccaacuccgucaagcgcgagcucgccgccguccuccucuucgagccccacuccaaggccggcaccguccucuucucccagggcgacaagggcaccuccugguacaucaucuggaagggcuccgucaacgucgucacccacggcaagggccucgucaccacccuccacgagggcgacgacuucggccagcucgcccucgucaacgacgccccccgcgccgccaccaucauccuccgcgaggacaacugccacuuccuccgcgucgacaagcaggacuucaaccgcaucaucaaggacgucgaggccaagaccaugcgccucgaggagcacggcaaggucguccucguccucgagcgcgccucccagggcgccggccccucccgcccccccacccccggccgcaaccgcuacaccgucauguccggcacccccgagaagauccucgagcuccuccucgaggccaugggccccgacuccuccgcccacgaccccaccgagaccuuccucuccgacuuccuccucacccaccgcgucuucaugcccuccgcccagcucugcgccgcccuccuccaccacuuccacgucgagcccgccggcggcuccgagcaggagcgcuccaccuacgucugcaacaagcgccagcagauccuccgccucgucucccagugggucgcccucuacggcuccaugcuccacaccgaccccgucgccaccuccuuccuccagaagcucuccgaccucgucggccgcgacacccgccucuccaaccuccuccgcgagcaguggcccgagcgccgccgcugccaccgccucgagaacggcugcggcaacgccuccccccagaugaaggcccgcaaccuccccgucuggcuccccaaccaggacgagccccuccccggcuccuccugcgccauccaggucggcgacaagguccccuacgacaucugccgccccgaccacuccguccucacccuccagcuccccgucaccgccuccguccgcgaggucauggccgcccucgcccaggaggacggcuggaccaagggccagguccucgucaaggucaacuccgccggcgacgccaucggccuccagcccgacgcccgcggcgucgccaccucccucggccucaacgagcgccucuucgucgucaacccccaggagguccacgagcucaucccccaccccgaccagcucggccccaccgucggcuccgccgagggccucgaccucgucuccgccaaggaccucgccggccagcucaccgaccacgacuggucccucuucaacuccauccaccaggucgagcucauccacuacguccucggcccccagcaccuccgcgacgucaccaccgccaaccucgagcgcuucaugcgccgcuucaacgagcuccaguacugggucgccaccgagcucugccucugccccguccccggcccccgcgcccagcuccuccgcaaguucaucaagcucgccgcccaccucaaggagcagaagaaccucaacuccuucuucgccgucauguucggccucuccaacuccgccaucucccgccucgcccacaccugggagcgccucccccacaagguccgcaagcucuacuccgcccucgagcgccuccucgaccccuccuggaaccaccgcgucuaccgccucgcccucgccaagcucuccccccccgucauccccuucaugccccuccuccucaaggacaugaccuucauccacgagggcaaccacacccucgucgagaaccucaucaacuucgagaagaugcgcaugauggcccgcgccgcccgcaugcuccaccacugccgcucccacaaccccgucccccucuccccccuccgcucccgcgucucccaccuccacgaggacucccaggucgcccgcaucuccaccugcuccgagcagucccucuccacccgcucccccgccuccaccugggccuacguccagcagcucaaggucaucgacaaccagcgcgagcucucccgccucucccgcgagcucgagcccuga

SEQ ID NO: 48534 - RNA, 2604 nt, Artificial Sequence
  derived and/or modified sequence opt2 from RAPGEF4__Homo_sapiens__NP_001093867
augcucuacaagaaguaccgccaguacauggccggccuccucgccccccccuacggcgucauggagaccggcuccaacaacgaccgcauccccgacaaggagaacaccccccucaucgagccccacgucccccuccgccccgccaacaccaucaccaagguccccuccgagaagauccuccgcgccggcaagauccuccgcaacgccauccucucccgcgccccccacaugauccgcgaccgcaaguaccaccucaagaccuaccgccagugcugcgucggcaccgagcucgucgacuggaugaugcagcagacccccugcguccacucccgcacccaggccgucggcauguggcagguccuccucgaggacggcguccucaaccacgucgaccaggagcaccacuuccaggacaaguaccucuucuaccgcuuccucgacgacgagcacgaggacgccccccuccccaccgaggaggagaagaaggagugcgacgaggagcuccaggacaccaugcuccuccucucccagaugggccccgacgcccacaugcgcaugauccuccgcaagccccccggccagcgcaccgucgacgaccucgagaucaucuacgaggagcuccuccacaucaaggcccucucccaccucuccaccaccgucaagcgcgagcucgccggcguccucaucuucgagucccacgccaagggcggcaccguccucuucaaccagggcgaggagggcaccuccugguacaucauccucaagggcuccgucaacgucgucaucuacggcaagggcgucgucugcacccuccacgagggcgacgacuucggcaagcucgcccucgucaacgacgccccccgcgccgccuccaucguccuccgcgaggacaacugccacuuccuccgcgucgacaaggaggacuucaaccgcauccuccgcgacgucgaggccaacaccguccgccucaaggagcacgaccaggacguccucguccucgagaagguccccgccggcaaccgcgccuccaaccagggcaacucccagccccagcagaaguacaccgucauguccggcacccccgagaagauccucgagcacuuccucgagaccauccgccucgaggccacccucaacgaggccaccgacuccguccucaacgacuucaucaugaugcacugcgucuucaugcccaacacccagcucugccccgcccucgucgcccacuaccacgcccagcccucccagggcaccgagcaggagaagauggacuacgcccucaacaacaagcgccgcgucauccgccucguccuccagugggccgccauguacggcgaccuccuccaggaggacgacgucuccauggccuuccucgaggaguucuacgucuccgucuccgacgacgcccgcaugaucgccgcccucaaggagcagcuccccgagcucgagaagaucgucaagcagaucuccgaggacgccaaggccccccagaagaagcacaagguccuccuccagcaguucaacaccggcgacgagcgcgcccagaagcgccagcccauccgcggcuccgacgagguccucuucaaggucuacugcauggaccacaccuacaccaccauccgcguccccgucgccaccuccgucaaggaggucaucuccgccgucgccgacaagcucggcuccggcgagggccucaucaucgucaagauguccuccggcggcgagaaggucguccucaagcccaacgacgucuccgucuucaccacccucaccaucaacggccgccucuucgccugcccccgcgagcaguucgacucccucaccccccuccccgagcaggagggccccaccgucggcaccgucggcaccuucgagcucauguccuccaaggaccucgccuaccagaugaccaucuacgacugggagcucuucaacugcguccacgagcucgagcucaucuaccacaccuucggccgccacaacuucaagaagaccaccgccaaccucgaccucuuccuccgccgcuucaacgagauccaguucugggucgucaccgagaucugccucugcucccagcucuccaagcgcguccagcuccucaagaaguucaucaagaucgccgcccacugcaaggaguacaagaaccucaacuccuucuucgccaucgucaugggccucuccaacgucgccgucucccgccucgcccucaccugggagaagcuccccuccaaguucaagaaguucuacgccgaguucgagucccucauggaccccucccgcaaccaccgcgccuaccgccucaccgucgccaagcucgagcccccccucauccccuucaugccccuccucaucaaggacaugaccuucacccacgagggcaacaagaccuucaucgacaaccucgucaacuucgagaagaugcgcaugaucgccaacaccgcccgcaccguccgcuacuaccgcucccagcccuucaaccccgacgccgcccaggccaacaagaaccaccaggacguccgcuccuacguccgccagcucaacgucaucgacaaccagcgcacccucucccagaugucccaccgccucgagccccgccgccccuga

SEQ ID NO: 48535 - RNA, 2193 nt, Artificial Sequence
  derived and/or modified sequence opt2 from RAPGEF5__Homo_sapiens__NP_036426
auggccaucggcgucuggcagcuccuccucgacaugggcaucaugcucuccgucgaccagcaccucuacuuccaggacaccuacgucuucuaccaguucuccuccgacgagugcuccuaccucuacugcgaguucgagcgcgaggaggaguggcagaacggcgucaagcuccuccuccagcucgucccccucauccccgcccgcggcggcaucugcgagcucucccaccagaagaucgaggacuccgaggaguccuccgacgagauccucguccgccucaccuccgccguccagcgcgagcucgccgccgucaucgcccucaaggcccgcaaguccgccaucgagcaggacgaggagaacaacgacaagcacgucgccgucaccgaggccgaguccguccccgacucccaggccggcgucaugugcaagcuccaggagcgcgacgagaucggccgcaucgagcucguccagaagcucgccaaggagaacuaccaguuccuccagaccgacaagaaggagcaggagaaguccgagcaccaggacgacgaggucaccaccguccaggucaaggagcaggaccaguccguccucguccucaagaagguccagugcugcggccccgcccccaccgccggcuccgccgagucccacuggcgcuacgucgucgucuccggcacccccgagaagauccucgagcaccuccucaacgaccuccaccucgaggagguccaggacaaggagaccgagacccuccucgacgacuuccuccucaccuacaccgucuucaugaccaccgacgaccucugccaggcccuccuccgccacuacuccgccaagaaguaccagggcaaggaggagaacuccgacgucccccgccgcaagcgcaagguccuccaccucgucucccaguggaucgcccucuacaaggacuggcuccccgaggacgagcacuccaagauguuccucaagaccaucuaccgcaacguccucgacgacgucuacgaguaccccauccucgagaaggagcucaaggaguuccagaagauccucggcaugcaccgccgccacaccgucgacgaguacuccccccagaagaagaacaaggcccucuuccaccaguucucccucaaggagaacuggcuccagcaccgcggcaccgucaccgagaccgaggagaucuucugccacgucuacaucaccgagcacuccuacgucuccgucaaggccaaggucuccuccaucgcccaggagauccucaaggucgucgccgagaagauccaguacgccgaggaggaccucgcccucgucgccaucaccuucuccggcgagaagcacgagcuccagcccaacgaccucgucaucuccaagucccucgaggccuccggccgcaucuacgucuaccgcaaggaccucgccgacacccucaaccccuucgccgagaacgaggagucccagcagcgcuccaugcgcauccucggcaugaacaccugggaccucgcccucgagcucaugaacuucgacuggucccucuucaacuccauccacgagcaggagcucaucuacuucaccuucucccgccagggcuccggcgagcacaccgccaaccucucccuccuccuccagcgcugcaacgagguccagcucugggucgccaccgagauccuccucugcucccagcucggcaagcgcguccagcucgucaagaaguucaucaagaucgccgcccacugcaaggcccagcgcaaccucaacuccuucuucgccaucgucaugggccucaacaccgccuccgucucccgccucucccagaccugggagaagauccccggcaaguucaagaagcucuucuccgagcucgagucccucaccgaccccucccucaaccacaaggccuaccgcgacgccuucaagaagaugaagccccccaagauccccuucaugccccuccuccucaaggacgucaccuucauccacgagggcaacaagaccuuccucgacaaccucgucaacuucgagaagcuccacaugaucgccgacaccguccgcacccuccgccacugccgcaccaaccaguucggcgaccucucccccaaggagcaccaggagcucaaguccuacgucaaccaccucuacgucaucgacucccagcaggcccucuucgagcucucccaccgcaucgagccccgcgucuga

SEQ ID NO: 48536 - RNA, 1935 nt, Artificial Sequence
  derived and/or modified sequence opt2 from RAPH1__Homo_sapiens__NP_976241
auggagcagcucuccgacgaggagaucgaccacggcgccgaggaggacuccgacaaggaggaccaggaccucgacaagauguucggcgccuggcucggcgagcucgacaagcucacccagucccucgacuccgacaagcccauggagcccgucaagcgcuccccccuccgccaggagaccaacauggccaacuucuccuaccgcuucuccaucuacaaccucaacgaggcccucaaccagggcgagaccgucgaccucgacgcccucauggccgaccucugcuccaucgagcaggagcucuccuccaucggcuccggcaacuccaagcgccagaucaccgagaccaaggccacccagaagcuccccgucucccgccacacccucaagcacggcacccucaagggccucuccuccuccuccaaccgcaucgccaagcccucccacgccuccuacucccucgacgacgucaccgcccagcucgagcaggccucccucuccauggacgaggccgcccagcaguccguccucgaggacaccaagccccucgucaccaaccagcaccgccgcaccgccuccgccggcaccgucuccgacgccgagguccacuccaucuccaacuccucccacuccuccaucaccuccgccgccuccuccauggacucccucgacaucgacaaggucacccgcccccaggagcucgaccucacccaccagggccagcccaucaccgagcacgccaucucccuccgcugcuccuccaagcaggccaagcgccacaucgacuucaccgaggagcaggccgagcucaccccccacuccuaccucgaccgcgagaccucccuccuccuccgcaacaucgccggcaagcccucccaccuccucaccaaggaggagcaggccgccaagcucaaggccgagaagauccgcgucgcccucgagaagaucaaggaggcccaggucaagaagcucgucauccgcguccacauguccgacgacuccuccaagaccaugauggucgacgagcgccagaccguccgccagguccucgacaaccucauggacaagucccacugcggcuacucccucgacuggucccucgucgagaccgucuccgagcuccagauggagcgcaucuucgaggaccacgagaaccucgucgagaaccuccucaacuggacccgcgacucccagaacaagcucaucuucauggagcgcaucgagaaguacgcccucuucaagaacccccagaacuaccuccucggcaagaaggagaccgccgagauggccgaccgcaacaaggagguccuccucgaggagugcuucugcggcuccuccgucaccguccccgagaucgagggcguccucuggcucaaggacgacggcaagaaguccuggaagaagcgcuacuuccuccuccgcgccuccggcaucuacuacguccccaagggcaaggccaaggucucccgcgaccucgucugcuuccuccagcucgaccacgucaacgucuacuacggccaggacuaccgcaacaaguacaaggcccccaccgacuacugccucguccucaagcacccccagauccagaagaagucccaguacaucaaguaccucugcugcgacgacguccgcacccuccaccagugggucaacggcauccgcaucgccaaguacggcaagcagcucuacaugaacuaccaggaggcccucaagcgcaccgaguccgccuacgacuggaccucccucuccuccuccuccaucaaguccggcuccuccuccuccuccauccccgagucccaguccaaccacuccaaccaguccgacuccggcgucuccgacacccagcccgccggccacguccgcucccaguccaucgucuccuccgucuucuccgaggccuggaagcgcggcacccagcucgaggaguccuccaaguga

SEQ ID NO: 48537 - RNA, 1239 nt, Artificial Sequence
  derived and/or modified sequence opt2 from RAPSN__Homo_sapiens__NP_005046
augggccaggaccagaccaagcagcagaucgagaagggccuccagcucuaccaguccaaccagaccgagaaggcccuccaggucuggaccaagguccucgagaaguccuccgaccucaugggccgcuuccgcguccucggcugccucgucaccgcccacuccgagaugggccgcuacaaggagaugcucaaguucgccgucguccagaucgacaccgcccgcgagcucgaggacgccgacuuccuccucgaguccuaccucaaccucgcccgcuccaacgagaagcucugcgaguuccacaagaccaucuccuacugcaagaccugccucggccuccccggcacccgcgccggcgcccagcucggcggccaggucucccucuccaugggcaacgccuuccucggccucuccgucuuccagaaggcccucgaguccuucgagaaggcccuccgcuacgcccacaacaacgacgacgccaugcucgagugccgcgucugcugcucccucggcuccuucuacgcccaggucaaggacuacgagaaggcccucuucuuccccugcaaggccgccgagcucgucaacaacuacggcaagggcuggucccucaaguaccgcgccaugucccaguaccacauggccgucgccuaccgccuccucggccgccucggcuccgccauggagugcugcgaggaguccaugaagaucgcccuccagcacggcgaccgcccccuccaggcccucugccuccucugcuucgccgacauccaccgcucccgcggcgaccucgagaccgccuucccccgcuacgacuccgccauguccaucaugaccgagaucggcaaccgccucggccagguccaggcccuccucggcgucgccaagugcugggucgcccgcaaggcccucgacaaggcccucgacgccaucgagcgcgcccaggaccucgccgaggaggucggcaacaagcucucccagcucaagcuccacugccucuccgaguccaucuaccgcuccaagggccuccagcgcgagcuccgcgcccacgucguccgcuuccacgagugcgucgaggagaccgagcucuacugcggccucugcggcgaguccaucggcgagaagaacucccgccuccaggcccuccccugcucccacaucuuccaccuccgcugccuccagaacaacggcacccgcuccugccccaacugccgccgcuccuccaugaagcccggcuucgucuga

SEQ ID NO: 48538 - RNA, 1374 nt, Artificial Sequence
  derived and/or modified sequence opt2 from RARA__Homo_sapiens__NP_001019980
auguacgaguccgucgaggucggcggccccacccccaaccccuuccucgucgucgacuucuacaaccagaaccgcgccugccuccuccccgagaagggccuccccgcccccggccccuacuccaccccccuccgcaccccccucuggaacggcuccaaccacuccaucgagacccaguccuccuccuccgaggagaucguccccuccccccccuccccccccccccucccccgcaucuacaagcccugcuucgucugccaggacaaguccuccggcuaccacuacggcgucuccgccugcgagggcugcaagggcuucuuccgccgcuccauccagaagaacauggucuacaccugccaccgcgacaagaacugcaucaucaacaaggucacccgcaaccgcugccaguacugccgccuccagaagugcuucgaggucggcauguccaaggaguccguccgcaacgaccgcaacaagaagaagaaggagguccccaagcccgagugcuccgaguccuacacccucacccccgaggucggcgagcucaucgagaagguccgcaaggcccaccaggagaccuuccccgcccucugccagcucggcaaguacaccaccaacaacuccuccgagcagcgcgucucccucgacaucgaccucugggacaaguucuccgagcucuccaccaagugcaucaucaagaccgucgaguucgccaagcagcuccccggcuucaccacccucaccaucgccgaccagaucacccuccucaaggccgccugccucgacauccucauccuccgcaucugcacccgcuacacccccgagcaggacaccaugaccuucuccgacggccucacccucaaccgcacccagaugcacaacgccggcuucggcccccucaccgaccucgucuucgccuucgccaaccagcuccucccccucgagauggacgacgccgagaccggccuccucuccgccaucugccucaucugcggcgaccgccaggaccucgagcagcccgaccgcgucgacaugcuccaggagccccuccucgaggcccucaaggucuacguccgcaagcgccgccccucccgcccccacauguuccccaagaugcucaugaagaucaccgaccuccgcuccaucuccgccaagggcgccgagcgcgucaucacccucaagauggagauccccggcuccaugcccccccucauccaggagaugcucgagaacuccgagggccucgacacccucuccggccagcccggcggcggcggccgcgacggcggcggccucgcccccccccccggcuccugcucccccucccucucccccuccuccaaccgcuccucccccgccacccacucccccuga

SEQ ID NO: 48539 - RNA, 1347 nt, Artificial Sequence
  derived and/or modified sequence opt2 from RARB__Homo_sapiens__NP_000956
auguucgacugcauggacguccucuccgucucccccggccagauccucgacuucuacaccgccucccccuccuccugcaugcuccaggagaaggcccucaaggccugcuucuccggccucacccagaccgaguggcagcaccgccacaccgcccaguccaucgagacccaguccaccuccuccgaggagcucguccccuccccccccuccccccucccccccccccgcgucuacaagcccugcuucgucugccaggacaaguccuccggcuaccacuacggcgucuccgccugcgagggcugcaagggcuucuuccgccgcuccauccagaagaacaugaucuacaccugccaccgcgacaagaacugcgucaucaacaaggucacccgcaaccgcugccaguacugccgccuccagaagugcuucgaggucggcauguccaaggaguccguccgcaacgaccgcaacaagaagaagaaggagaccuccaagcaggagugcaccgaguccuacgagaugaccgccgagcucgacgaccucaccgagaagauccgcaaggcccaccaggagaccuuccccucccucugccagcucggcaaguacaccaccaacuccuccgccgaccaccgcguccgccucgaccucggccucugggacaaguucuccgagcucgccaccaagugcaucaucaagaucgucgaguucgccaagcgccuccccggcuucaccggccucaccaucgccgaccagaucacccuccucaaggccgccugccucgacauccucauccuccgcaucugcacccgcuacacccccgagcaggacaccaugaccuucuccgacggccucacccucaaccgcacccagaugcacaacgccggcuucggcccccucaccgaccucgucuucaccuucgccaaccagcuccucccccucgagauggacgacaccgagaccggccuccucuccgccaucugccucaucugcggcgaccgccaggaccucgaggagcccaccaaggucgacaagcuccaggagccccuccucgaggcccucaagaucuacauccgcaagcgccgccccuccaagccccacauguuccccaagauccucaugaagaucaccgaccuccgcuccaucuccgccaagggcgccgagcgcgucaucacccucaagauggagauccccggcuccaugcccccccucauccaggagaugcucgagaacuccgagggccacgagccccucacccccuccuccuccggcaacaccgccgagcacucccccuccaucucccccuccuccgucgagaacuccggcgucucccaguccccccucguccaguga

SEQ ID NO: 48540 - RNA, 1332 nt, Artificial Sequence
  derived and/or modified sequence opt2 from RARG__Homo_sapiens__NP_001036193
auguacgacugcauggagaccuucgcccccggcccccgccgccucuacggcgccgccggccccggcgccggccuccuccgccgcgccaccggcggcuccugcuucgccggccucgaguccuucgccuggccccagcccgccucccuccaguccgucgagacccaguccaccuccuccgaggagaugguccccuccucccccuccccccccccccccccccgcgucuacaagcccugcuucgucugcaacgacaaguccuccggcuaccacuacggcgucuccuccugcgagggcugcaagggcuucuuccgccgcuccauccagaagaacauggucuacaccugccaccgcgacaagaacugcaucaucaacaaggucacccgcaaccgcugccaguacugccgccuccagaagugcuucgaggucggcauguccaaggaggccguccgcaacgaccgcaacaagaagaagaaggaggucaaggaggagggcucccccgacuccuacgagcucuccccccagcucgaggagcucaucaccaaggucuccaaggcccaccaggagaccuuccccucccucugccagcucggcaaguacaccaccaacuccuccgccgaccaccgcguccagcucgaccucggccucugggacaaguucuccgagcucgccaccaagugcaucaucaagaucgucgaguucgccaagcgccuccccggcuucaccggccucuccaucgccgaccagaucacccuccucaaggccgccugccucgacauccucaugcuccgcaucugcacccgcuacacccccgagcaggacaccaugaccuucuccgacggccucacccucaaccgcacccagaugcacaacgccggcuucggcccccucaccgaccucgucuucgccuucgccggccagcuccucccccucgagauggacgacaccgagaccggccuccucuccgccaucugccucaucugcggcgaccgcauggaccucgaggagcccgagaaggucgacaagcuccaggagccccuccucgaggcccuccgccucuacgcccgccgccgccgccccucccagcccuacauguucccccgcaugcucaugaagaucaccgaccuccgcggcaucuccaccaagggcgccgagcgcgccaucacccucaagauggagauccccggccccaugcccccccucauccgcgagaugcucgagaaccccgagauguucgaggacgacuccucccagcccggcccccaccccaacgccuccuccgaggacgagguccccggcggccagggcaagggcggccucaagucccccgccuga

SEQ ID NO: 48541 - RNA, 687 nt, Artificial Sequence
  derived and/or modified sequence opt2 from RARRES1__Homo_sapiens__NP_002879
augcagccccgccgccagcgccuccccgcccccugguccggcccccgcggcccccgccccaccgccccccuccucgcccuccuccuccuccucgcccccgucgccgcccccgccggcuccggcgaccccgacgaccccggccagccccaggacgccggcgucccccgccgccuccuccagcaggccgcccgcgccgcccuccacuucuucaacuuccgcuccggcucccccuccgcccuccgcguccucgccgagguccaggagggccgcgccuggaucaaccccaaggagggcugcaagguccacgucgucuucuccaccgagcgcuacaaccccgagucccuccuccaggagggcgagggccgccucggcaagugcuccgcccgcgucuucuucaagaaccagaagccccgccccaccaucaacgucaccugcacccgccucaucgagaagaagaagcgccagcaggaggacuaccuccucuacaagcagaugaagcagcucaagaacccccucgagaucgucuccauccccgacaaccacggccacaucgaccccucccuccgccucaucugggaccucgccuuccucggcuccuccuacgucaugugggagaugaccacccaggucucccacuacuaccucgcccagcucaccuccguccgccaguggguccgcaagaccuga

SEQ ID NO: 48542 - RNA, 492 nt, Artificial Sequence
  derived and/or modified sequence opt2 from RARRES2__Homo_sapiens__NP_002880
augcgccgccuccucaucccccucgcccucuggcucggcgccgucggcgucggcgucgccgagcucaccgaggcccagcgccgcggccuccaggucgcccucgaggaguuccacaagcacccccccguccagugggccuuccaggagaccuccgucgaguccgccgucgacacccccuuccccgccggcaucuucguccgccucgaguucaagcuccagcagaccuccugccgcaagcgcgacuggaagaagcccgagugcaagguccgccccaacggccgcaagcgcaagugccucgccugcaucaagcucggcuccgaggacaagguccucggccgccucguccacugccccaucgagacccagguccuccgcgaggccgaggagcaccaggagacccagugccuccgcguccagcgcgccggcgaggacccccacuccuucuacuuccccggccaguucgccuucuccaaggcccucccccgcuccuga

SEQ ID NO: 48543 - RNA, 495 nt, Artificial Sequence
  derived and/or modified sequence opt2 from RARRES3__Homo_sapiens__NP_004576
auggccuccccccaccaggagcccaagcccggcgaccucaucgagaucuuccgccucggcuacgagcacugggcccucuacaucggcgacggcuacgucauccaccucgccccccccuccgaguaccccggcgccggcuccuccuccgucuucuccguccucuccaacuccgccgaggucaagcgcgagcgccucgaggacgucgucggcggcugcugcuaccgcgucaacaacucccucgaccacgaguaccagccccgccccgucgaggucaucaucuccuccgccaaggagauggucggccagaagaugaaguacuccaucgucucccgcaacugcgagcacuucgucacccagcuccgcuacggcaagucccgcugcaagcaggucgagaaggccaaggucgaggucggcgucgccaccgcccucggcauccucgucgucgccggcugcuccuucgccauccgccgcuaccagaagaaggccaccgccuga

SEQ ID NO: 48544 - RNA, 1737 nt, Artificial Sequence
  derived and/or modified sequence opt2 from RARS2__Homo_sapiens__NP_064716
auggccugcggcuuccgccgcgccaucgccugccagcucucccgcguccucaaccucccccccgagaaccucaucaccuccaucuccgccguccccaucucccagaaggaggaggucgccgacuuccagcucuccgucgacucccuccucgagaaggacaacgaccacucccgccccgacauccagguccaggccaagcgccucgccgagaagcuccgcugcgacaccgucgucuccgagaucuccaccggccagcgcaccgucaacuucaagaucaaccgcgagcuccucaccaagaccguccuccagcaggucaucgaggacggcuccaaguacggccucaaguccgagcucuucuccggccucccccagaagaagaucgucgucgaguucuccucccccaacgucgccaagaaguuccacgucggccaccuccgcuccaccaucaucggcaacuucaucgccaaccucaaggaggcccucggccaccaggucauccgcaucaacuaccucggcgacuggggcaugcaguucggccuccucggcaccggcuuccagcucuucggcuacgaggagaagcuccaguccaacccccuccagcaccucuucgaggucuacguccaggucaacaaggaggccgccgacgacaaguccgucgccaaggccgcccaggaguucuuccagcgccucgagcucggcgacguccaggcccucucccucuggcagaaguuccgcgaccucuccaucgaggaguacauccgcgucuacaagcgccucggcgucuacuucgacgaguacuccggcgaguccuucuaccgcgagaagucccaggagguccucaagcuccucgaguccaagggccuccuccucaagaccaucaagggcaccgccgucgucgaccucuccggcaacggcgaccccuccuccaucugcaccgucaugcgcuccgacggcaccucccucuacgccacccgcgaccucgccgccgccaucgaccgcauggacaaguacaacuucgacaccaugaucuacgucaccgacaagggccagaagaagcacuuccagcaggucuuccagaugcucaagaucaugggcuacgacugggccgagcgcugccagcacguccccuucggcgucguccagggcaugaagacccgccgcggcgacgucaccuuccucgaggacguccucaacgagauccagcuccgcaugcuccagaacauggccuccaucaagaccaccaaggagcucaagaacccccaggagaccgccgagcgcgucggccucgccgcccucaucauccaggacuucaagggccuccuccucuccgacuacaaguucuccugggaccgcgucuuccagucccgcggcgacaccggcgucuuccuccaguacacccacgcccgccuccacucccucgaggagaccuucggcugcggcuaccucaacgacuucaacaccgccugccuccaggagccccaguccgucuccauccuccagcaccuccuccgcuucgacgagguccucuacaaguccucccaggacuuccagccccgccacaucgucuccuaccuccucacccucucccaccucgccgccgucgcccacaagacccuccagaucaaggacuccccccccgaggucgccggcgcccgccuccaccucuucaaggccguccgcuccguccucgccaacggcaugaagcuccucggcaucacccccgucugccgcauguga

SEQ ID NO: 48545 - RNA, 1983 nt, Artificial Sequence
  derived and/or modified sequence opt2 from RARS__Homo_sapiens__NP_002878
auggacguccucgucuccgagugcuccgcccgccuccuccagcaggaggaggagaucaagucccucaccgccgagaucgaccgccucaagaacugcggcugccucggcgccucccccaaccucgagcagcuccaggaggagaaccucaagcucaaguaccgccucaacauccuccgcaagucccuccaggccgagcgcaacaagcccaccaagaacaugaucaacaucaucucccgccuccaggaggucuucggccacgccaucaaggccgccuaccccgaccucgagaaccccccccuccucgucacccccucccagcaggccaaguucggcgacuaccagugcaacuccgccaugggcaucucccagaugcucaagaccaaggagcagaaggucaacccccgcgagaucgccgagaacaucaccaagcaccuccccgacaacgagugcaucgagaaggucgagaucgccggccccggcuucaucaacguccaccuccgcaaggacuucgucuccgagcagcucaccucccuccucgucaacggcguccagcuccccgcccucggcgagaacaagaaggucaucgucgacuucuccucccccaacaucgccaaggagaugcacgucggccaccuccgcuccaccaucaucggcgaguccaucucccgccucuucgaguucgccggcuacgacguccuccgccucaaccacgucggcgacuggggcacccaguucggcaugcucaucgcccaccuccaggacaaguuccccgacuaccucaccgucuccccccccaucggcgaccuccaggucuucuacaaggaguccaagaagcgcuucgacaccgaggaggaguucaagaagcgcgccuaccagugcgucguccuccuccagggcaagaaccccgacaucaccaaggccuggaagcucaucugcgacgucucccgccaggagcucaacaagaucuacgacgcccucgacgucucccucaucgagcgcggcgaguccuucuaccaggaccgcaugaacgacaucgucaaggaguucgaggaccgcggcuucguccaggucgacgacggccgcaagaucgucuucguccccggcugcuccaucccccucaccaucgucaaguccgacggcggcuacaccuacgacaccuccgaccucgccgccaucaagcagcgccucuucgaggagaaggccgacaugaucaucuacgucgucgacaacggccaguccguccacuuccagaccaucuucgccgccgcccagaugaucggcugguacgaccccaaggucacccgcgucuuccacgccggcuucggcgucguccucggcgaggacaagaagaaguucaagacccgcuccggcgagaccguccgccucauggaccuccucggcgagggccucaagcgcuccauggacaagcucaaggagaaggagcgcgacaagguccucaccgccgaggagcucaacgccgcccagaccuccgucgccuacggcugcaucaaguacgccgaccucucccacaaccgccucaacgacuacaucuucuccuucgacaagaugcucgacgaccgcggcaacaccgccgccuaccuccucuacgccuucacccgcauccgcuccaucgcccgccucgccaacaucgacgaggagaugcuccagaaggccgcccgcgagaccaagauccuccucgaccacgagaaggaguggaagcucggccgcugcauccuccgcuuccccgagauccuccagaagauccucgacgaccucuuccuccacacccucugcgacuacaucuacgagcucgccaccgccuucaccgaguucuacgacuccugcuacugcgucgagaaggaccgccagaccggcaagauccucaaggucaacauguggcgcaugcuccucugcgaggccgucgccgccgucauggccaagggcuucgacauccucggcaucaagcccguccagcgcauguga

SEQ ID NO: 48546 - RNA, 3144 nt, Artificial Sequence
  derived and/or modified sequence opt2 from RASA1__Homo_sapiens__NP_002881
augauggccgccgaggccggcuccgaggagggcggccccgucaccgccggcgccggcggcggcggcgccgccgccggcuccuccgccuaccccgccgucugccgcgucaagauccccgccgcccuccccgucgccgccgcccccuaccccggccucgucgagaccggcgucgccggcacccucggcggcggcgccgcccucggcuccgaguuccucggcgccggcuccgucgccggcgcccucggcggcgccggccucaccggcggcggcaccgccgccggcgucgccggcgccgccgccggcgucgccggcgccgccgucgccggccccuccggcgacauggcccucaccaagcuccccaccucccuccucgccgagacccucggccccggcggcggcuuccccccccucccccccccccccuaccuccccccccucggcgccggccucggcaccgucgacgagggcgacucccucgacggccccgaguacgaggaggaggaggucgccaucccccucaccgccccccccaccaaccagugguaccacggcaagcucgaccgcaccaucgccgaggagcgccuccgccaggccggcaaguccggcuccuaccucauccgcgaguccgaccgccgccccggcuccuucguccucuccuuccucucccagaugaacgucgucaaccacuuccgcaucaucgccaugugcggcgacuacuacaucggcggccgccgcuucuccucccucuccgaccucaucggcuacuacucccacgucuccugccuccucaagggcgagaagcuccucuaccccgucgccccccccgagcccgucgaggaccgccgccgcguccgcgccauccuccccuacaccaagguccccgacaccgacgagaucuccuuccucaagggcgacauguucaucguccacaacgagcucgaggacggcuggaugugggucaccaaccuccgcaccgacgagcagggccucaucgucgaggaccucgucgaggaggucggccgcgaggaggacccccacgagggcaagaucugguuccacggcaagaucuccaagcaggaggccuacaaccuccucaugaccgucggccaggucugcuccuuccucguccgccccuccgacaacacccccggcgacuacucccucuacuuccgcaccaacgagaacauccagcgcuucaagaucugccccacccccaacaaccaguucaugaugggcggccgcuacuacaacuccaucggcgacaucaucgaccacuaccgcaaggagcagaucgucgagggcuacuaccucaaggagcccguccccaugcaggaccaggagcagguccucaacgacaccgucgacggcaaggagaucuacaacaccauccgccgcaagaccaaggacgccuucuacaagaacaucgucaagaagggcuaccuccucaagaagggcaagggcaagcgcuggaagaaccucuacuucauccucgagggcuccgacgcccagcucaucuacuucgaguccgagaagcgcgccaccaagcccaagggccucaucgaccucuccgucugcuccgucuacgucguccacgacucccucuucggccgccccaacugcuuccagaucgucguccagcacuucuccgaggagcacuacaucuucuacuucgccggcgagacccccgagcaggccgaggacuggaugaagggccuccaggccuucugcaaccuccgcaaguccucccccggcaccuccaacaagcgccuccgccaggucuccucccucguccuccacaucgaggaggcccacaagcuccccgucaagcacuucaccaaccccuacugcaacaucuaccucaacuccguccaggucgccaagacccacgcccgcgagggccagaaccccgucugguccgaggaguucgucuucgacgaccucccccccgacaucaaccgcuucgagaucacccucuccaacaagaccaagaaguccaaggaccccgacauccucuucaugcgcugccagcucucccgccuccagaagggccacgccaccgacgagugguuccuccucuccucccacaucccccucaagggcaucgagcccggcucccuccgcguccgcgcccgcuacuccauggagaagaucaugcccgaggaggaguacuccgaguucaaggagcucauccuccagaaggagcuccacgucgucuacgcccucucccacgucugcggccaggaccgcacccuccucgccuccauccuccuccgcaucuuccuccacgagaagcucgagucccuccuccucugcacccucaacgaccgcgagaucuccauggaggacgaggccaccacccucuuccgcgccaccacccucgccuccacccucauggagcaguacaugaaggccaccgccacccaguucguccaccacgcccucaaggacuccauccucaagaucauggaguccaagcaguccugcgagcucucccccuccaagcucgagaagaacgaggacgucaacaccaaccucacccaccuccucaacauccucuccgagcucgucgagaagaucuucauggccuccgagauccucccccccacccuccgcuacaucuacggcugccuccagaaguccguccagcacaaguggcccaccaacaccaccaugcgcacccgcgucgucuccggcuucgucuuccuccgccucaucugccccgccauccucaacccccgcauguucaacaucaucuccgacucccccucccccaucgccgcccgcacccucauccucgucgccaaguccguccagaaccucgccaaccucgucgaguucggcgccaaggagcccuacauggagggcgucaaccccuucaucaaguccaacaagcaccgcaugaucauguuccucgacgagcucggcaacguccccgagcuccccgacaccaccgagcacucccgcaccgaccucucccgcgaccucgccgcccuccacgagaucugcgucgcccacuccgacgagcuccgcacccucuccaacgagcgcggcgcccagcagcacguccucaagaagcuccucgccaucaccgagcuccuccagcagaagcagaaccaguacaccaagaccaacgacguccgcuga

SEQ ID NO: 48547 - RNA, 2553 nt, Artificial Sequence
  derived and/or modified sequence opt2 from RASA2__Homo_sapiens__NP_001290174
auggccgccgccgcccccgccgccgccgccgccuccuccgaggcccccgccgccuccgccaccgccgagcccgaggccggcgaccaggacucccgcgagguccgcguccuccagucccuccgcggcaagaucugcgaggccaagaaccuccuccccuaccucggcccccacaagaugcgcgacugcuucugcaccaucaaccucgaccaggaggaggucuaccgcacccaggucgucgagaagucccucucccccuucuucuccgaggaguucuacuucgagaucccccgcaccuuccaguaccucuccuucuacgucuacgacaagaacguccuccagcgcgaccuccgcaucggcaaggucgccaucaagaaggaggaccucugcaaccacuccggcaaggagaccugguucucccuccagcccgucgacuccaacuccgagguccagggcaagguccaccucgagcucaagcucaacgagcucaucaccgagaacggcaccgucugccagcagcucgucguccacaucaaggccugccacggccucccccucaucaacggccaguccugcgaccccuacgccaccgucucccucgucggccccucccgcaacgaccagaagaagaccaaggucaagaagaagaccuccaacccccaguucaacgagaucuucuacuucgaggucacccgcuccuccuccuacacccgcaagucccaguuccaggucgaggaggaggacaucgagaagcucgagauccgcaucgaccucuggaacaacggcaaccucguccaggacgucuuccucggcgagaucaagguccccgucaacguccuccgcaccgacuccucccaccaggccugguaccuccuccagccccgcgacaacggcaacaaguccuccaagaccgacgaccucggcucccuccgccucaacaucugcuacaccgaggacuacguccuccccuccgaguacuacggcccccucaagacccuccuccucaagucccccgacguccagcccaucuccgccuccgccgccuacauccucuccgagaucugccgcgacaagaacgacgccguccucccccucguccgccuccuccuccaccacgacaagcucguccccuucgccaccgccgucgccgagcucgaccucaaggacacccaggacgccaacaccaucuuccgcggcaacucccucgccacccgcugccucgacgagaugaugaagaucgucggcggccacuaccucaaggucacccucaagcccauccucgacgagaucugcgacuccuccaaguccugcgagaucgaccccaucaagcucaaggagggcgacaacgucgagaacaacaaggagaaccuccgcuacuacgucgacaagcucuucaacaccaucgucaaguccuccauguccugccccaccgucaugugcgacaucuucuacucccuccgccagauggccacccagcgcuuccccaacgacccccacguccaguacuccgccgucuccuccuucgucuuccuccgcuucuucgccgucgccgucgucuccccccacaccuuccaccuccgcccccaccaccccgacgcccagaccauccgcacccucacccucaucuccaagaccauccagacccucggcuccuggggcucccucuccaaguccaaguccuccuucaaggagaccuucaugugcgaguucuucaagauguuccaggaggagggcuacaucaucgccgucaagaaguuccucgacgagaucuccuccaccgagaccaaggaguccuccggcaccuccgagcccguccaccucaaggagggcgagauguacaagcgcgcccagggccgcacccgcaucggcaagaagaacuucaagaagcgcugguucugccucaccucccgcgagcucaccuaccacaagcagcccggcuccaaggacgccaucuacaccauccccgucaagaacauccucgccgucgagaagcucgaggaguccuccuucaacaagaagaacauguuccaggucauccacaccgagaagccccucuacguccaggccaacaacugcgucgaggccaacgaguggaucgacguccucugccgcgucucccgcugcaaccagaaccgccucuccuucuaccaccccuccgucuaccucaacggcaacuggcucugcugccaggagaccggcgagaacacccucggcugcaagcccugcaccgccggcguccccgccgacauccagaucgacaucgacgaggaccgcgagaccgagcgcaucuacucccucuucacccucucccuccucaagcuccagaagauggaggaggccugcggcaccaucgccgucuaccagggcccccagaaggagcccgacgacuacuccaacuucgucaucgaggacuccgucaccaccuucaagaccauccagcagaucaaguccaucaucgagaagcucgacgagccccacgagaaguaccgcaagaagcgcuccuccuccgccaaguacggcuccaaggagaaccccaucgucggcaaggccuccuga

SEQ ID NO: 48548 - RNA, 2421 nt, Artificial Sequence
  derived and/or modified sequence opt2 from RASAL1__Homo_sapiens__NP_001180449
auggccaaguccuccucccucaacguccgcgucgucgagggccgcgcccuccccgccaaggacgucuccggcuccuccgaccccuacugccucgucaaggucgacgacgaggucgucgcccgcaccgccaccgucuggcgcucccucggccccuucuggggcgaggaguacaccguccaccucccccucgacuuccaccagcucgccuucuacguccucgacgaggacaccgucggccacgacgacaucaucggcaagaucucccucucccgcgaggccaucaccgccgacccccgcggcaucgacuccuggaucaaccucucccgcgucgaccccgacgccgagguccagggcgagaucugccucuccguccagaugcucgaggacggccagggccgcugccuccgcugccacguccuccaggcccgcgaccucgccccccgcgacaucuccggcaccuccgaccccuucgcccgcgucuucuggggcucccagucccucgagaccuccaccaucaagaagacccgcuucccccacugggacgagguccucgagcuccgcgagaugcccggcgcccccuccccccuccgcgucgagcucugggacugggacauggucggcaagaacgacuuccucggcauggucgaguucucccccaagacccuccagcagaagccccccaagggcugguuccgccuccuccccuucccccgcgccgaggaggacuccggcggcaaccucggcgcccuccgcgucaagguccgccucaucgaggaccgcguccuccccucccagugcuaccagccccucauggagcuccucauggaguccguccagggccccgccgaggaggacaccgccuccccccucgcccuccucgaggagcucacccucggcgacugccgccaggaccucgccaccaagcucgucaagcucuuccucggccgcggccucgccggccgcuuccucgacuaccucacccgccgcgaggucgcccgcaccauggaccccaacacccucuuccgcuccaacucccucgccuccaaguccauggagcaguucaugaagcucgucggcaugcccuaccuccacgagguccucaagcccgucaucucccgcgucuucgaggagaagaaguacauggagcucgaccccugcaagauggaccucggccgcacccgccgcaucuccuucaagggcgcccucuccgaggagcagaugcgcgagaccucccucggccuccucaccggcuaccucggccccaucgucgacgccaucgucggcuccgucggccgcugcccccccgccaugcgccucgccuucaagcagcuccaccgccgcgucgaggagcgcuucccccaggccgagcaccagcaggacgucaaguaccucgccaucuccggcuuccucuuccuccgcuucuucgcccccgccauccucacccccaagcucuucgaccuccgcgaccagcacgccgacccccagaccucccgcucccuccuccuccucgccaaggccguccaguccaucggcaaccucggccagcagcucggccagggcaaggagcucuggauggccccccuccaccccuuccuccuccagugcgucucccgcguccgcgacuuccucgaccgccucgucgacgucgacggcgacgaggaggccggcguccccgcccgcgcccucuucccccccuccgccaucguccgcgagggcuaccuccucaagcgcaaggaggagcccgccggccucgccacccgcuucgccuucaagaagcgcuacgucuggcucuccggcgagacccucuccuucuccaagucccccgaguggcagaugugccacuccauccccgucucccacauccgcgccgucgagcgcgucgacgagggcgccuuccagcucccccacgucaugcaggucgucacccaggacggcaccggcgcccuccacaccaccuaccuccagugcaagaacgucaacgagcucaaccaguggcucuccgcccuccgcaaggccuccgcccccaaccccaacaagcucgccgccugccaccccggcgccuuccgcuccgcccgcuggaccugcugccuccaggccgagcgcuccgccgccggcugcucccgcacccacuccgccgucacccucggcgacugguccgacccccucgaccccgacgccgaggcccagaccgucuaccgccagcuccuccucggccgcgaccagcuccgccucaagcuccucgaggacuccaacauggacaccacccucgaggccgacaccggcgccugccccgagguccucgcccgccagcgcgccgccaccgcccgccuccucgagguccucgccgaccucgaccgcgcccacgaggaguuccagcagcaggagcgcggcaaggccgcccucggcccccucggccccuga

SEQ ID NO: 48549 - RNA, 3420 nt, Artificial Sequence
  derived and/or modified sequence opt2 from RASAL2__Homo_sapiens__NP_004832
augcagacccccgagguccccgccgagcgcuccccccgccgccgcuccaucuccggcaccuccaccuccgagaagcccaacuccauggacaccgccaacaccucccccuucaagguccccggcuucuucuccaagcgccucaagggcuccaucaagcgcaccaagucccaguccaagcucgaccgcaacaccuccuuccgccuccccucccuccgcuccaccgacgaccgcucccgcggccuccccaagcucaaggagucccgcucccacgagucccuccucucccccugcuccaccgucgagugccucgaccucggccgcggcgagcccgucuccgucaagccccuccacuccuccauccucggccaggacuucugcuucgaggucaccuaccucuccggcuccaagugcuucuccugcaacuccgccuccgagcgcgacaaguggauggagaaccuccgccgcaccguccagcccaacaaggacaacugccgccgcgccgagaacguccuccgccucuggaucaucgaggccaaggaccucgcccccaagaagaaguacuucugcgagcucugccucgacgacacccucuucgcccgcaccaccuccaagaccaaggccgacaacaucuucuggggcgagcacuucgaguucuucucccuccccccccuccacuccaucaccguccacaucuacaaggacgucgagaagaagaagaagaaggacaagaacaacuacgucggccucgucaacauccccaccgccuccgucaccggccgccaguucgucgagaagugguaccccgucuccacccccacccccaacaagggcaagaccggcggccccuccauccgcaucaagucccgcuuccagaccaucaccauccuccccauggagcaguacaaggaguucgccgaguucgucaccuccaacuacaccaugcucugcuccguccucgagcccgucaucuccguccgcaacaaggaggagcucgccugcgcccucguccacauccuccaguccaccggccgcgccaaggacuuccucaccgaccucgucauguccgaggucgaccgcugcggcgagcacgacguccucaucuuccgcgagaacaccaucgccaccaaguccaucgaggaguaccucaagcucgucggccagcaguaccuccacgacgcccucggcgaguucaucaaggcccucuacgaguccgacgagaacugcgaggucgaccccuccaagugcuccuccuccgagcucaucgaccaccaguccaaccucaagaugugcugcgagcucgccuucugcaagaucaucaacuccuacugcgucuucccccgcgagcucaaggaggucuucgccuccuggaagcagcagugccucaaccgcggcaagcaggacaucuccgagcgccucaucuccgccucccucuuccuccgcuuccucugccccgccaucaugucccccucccucuucaaccucaugcaggaguaccccgacgaccgcaccucccgcacccucacccucaucgccaaggucauccagaaccucgccaacuucgccaaguucggcaacaaggaggaguacauggccuucaugaacgacuuccucgagcacgaguggggcggcaugaagcgcuuccuccucgagaucuccaaccccgacaccaucuccaacacccccggcuucgacggcuacaucgaccucggccgcgagcucuccguccuccacucccuccucugggaggucgucucccagcucgacaagggcgagaacuccuuccuccaggccaccgucgccaagcucggcccccucccccgcguccucgccgacaucaccaagucccucaccaaccccacccccauccagcagcagcuccgccgcuucaccgagcacaacuccucccccaacgucuccggcucccucuccuccggccuccagaagaucuucgaggaccccaccgacuccgaccuccacaagcucaagucccccucccaggacaacaccgacuccuacuuccgcggcaagacccuccuccucguccagcaggccuccucccaguccaugaccuacuccgagaaggacgagcgcgaguccucccuccccaacggccgcuccgucucccucauggaccuccaggacacccacgccgcccaggucgagcacgccuccgucaugcucgacguccccauccgccucaccggcucccagcucuccaucacccaggucgccuccaucaagcagcuccgcgagacccaguccaccccccaguccgccccccagguccgccgcccccuccaccccgcccucaaccagcccggcggccuccagccccucuccuuccagaaccccgucuaccaccucaacaaccccauccccgccaugcccaaggccuccaucgacuccucccucgagaaccucuccaccgccuccucccgcucccaguccaacuccgaggacuucaagcucuccggccccuccaacuccuccauggaggacuucaccaagcgcuccacccaguccgaggacuucucccgccgccacaccguccccgaccgccacaucccccucgcccucccccgccagaacuccaccggccaggcccagauccgcaaggucgaccagggcggccucggcgcccgcgccaaggccccccccucccucccccacuccgccucccuccgcuccaccggcuccauguccgucgucuccgccgcccucgucgccgagcccguccagaacggcucccgcucccgccagcaguccuccuccucccgcgagucccccguccccaagguccgcgccauccagcgccagcagacccagcagguccagucccccgucgacuccgccaccaugucccccgucgagcgcaccgccgccuggguccucaacaacggccaguacgaggaggacgucgaggagaccgagcagaaccucgacgaggccaagcacgccgagaaguacgagcaggagaucaccaagcucaaggagcgccuccgcgucuccucccgccgccucgaggaguacgagcgccgccuccucguccaggagcagcagaugcagaagcuccuccucgaguacaaggcccgccucgaggacuccgaggagcgccuccgccgccagcaggaggagaaggacucccagaugaaguccaucaucucccgccucauggccgucgaggaggagcucaagaaggaccacgccgagaugcaggccgucaucgacgccaagcagaagaucaucgacgcccaggagaagcgcaucgucucccucgacuccgccaacacccgccucauguccgcccucacccaggucaaggagcgcuacuccaugcagguccgcaacggcaucucccccaccaaccccaccaagcucuccaucaccgagaacggcgaguucaagaacuccuccugcuga

SEQ ID NO: 48550 - RNA, 369 nt, Artificial Sequence
  derived and/or modified sequence opt2 from RASD1__Homo_sapiens__NP_001186918
augaagcucgccgccaugaucaagaagaugugccccuccgacuccgagcucuccauccccgccaagaacugcuaccgcauggucauccucggcuccuccaaggucggcaagaccgccaucgucucccgcuuccucaccggccgcuucgaggacgccuacacccccaccaucgaggacuuccaccgcaaguucuacuccauccgcggcgaggucuaccagcucgacauccucgacaccuccggcaaccaccccuuccccgccaugcgccgccucuccauccucaccgacccccgccaccagguccucccccaggagcagaaccagggcgagcgcggccgcgcccccggccaccuccgccagcagggcuga

SEQ ID NO: 48551 - RNA, 801 nt, Artificial Sequence
  derived and/or modified sequence opt2 from RASD2__Homo_sapiens__NP_055125
augaugaagacccucuccuccggcaacugcacccucuccguccccgccaagaacuccuaccgcauggucguccucggcgccucccgcgucggcaaguccuccaucgucucccgcuuccucaacggccgcuucgaggaccaguacacccccaccaucgaggacuuccaccgcaaggucuacaacauccgcggcgacauguaccagcucgacauccucgacaccuccggcaaccaccccuuccccgccaugcgccgccucuccauccucaccggcgacgucuucauccucgucuucucccucgacaaccgcgaguccuucgacgaggucaagcgccuccagaagcagauccucgaggucaaguccugccucaagaacaagaccaaggaggccgccgagcuccccauggucaucugcggcaacaagaacgaccacggcgagcucugccgccagguccccaccaccgaggccgagcuccucgucuccggcgacgagaacugcgccuacuucgaggucuccgccaagaagaacaccaacgucgacgagauguucuacguccucuucuccauggccaagcucccccacgagaugucccccgcccuccaccgcaagaucuccguccaguacggcgacgccuuccacccccgccccuucugcaugcgccgcgucaaggagauggacgccuacggcauggucucccccuucgcccgccgccccuccgucaacuccgaccucaaguacaucaaggccaagguccuccgcgagggccaggcccgcgagcgcgacaagugcaccauccaguga

SEQ ID NO: 48552 - RNA, 2223 nt, Artificial Sequence
  derived and/or modified sequence opt2 from RASEF__Homo_sapiens__NP_689786
auggaggccgacggcgacggcgaggagcucgcccgccuccgcuccgucuucgccgccugcgacgccaaccgcuccggccgccucgagcgcgaggaguuccgcgcccucugcaccgagcuccgcguccgccccgccgacgccgaggccgucuuccagcgccucgacgccgaccgcgacggcgccaucaccuuccaggaguucgcccgcggcuuccucggcucccuccgcggcggccgccgccgcgacuggggcccccucgaccccgcccccgccgucuccgaggccggccccgagacccacgacuccgaggaggacgagggcgacgaggacgccgccgccgcccucgccaccuccugcggccccgccucccccggccgcgccuggcaggacuuccaggcccgccucggcgacgaggccaaguucaucccccgcgaggagcaggucuccacccucuaccagaacaucaaccucgucgagccccgccucauccagcccuacgagcacgucaucaagaacuucauccgcgagauccgccuccaguccaccgagauggagaaccucgccaucgccgucaagcgcgcccaggacaaggccgccaugcagcucuccgagcucgaggaggagauggaccagcgcauccaggccgccgagcacaagacccgcaaggacgagaagcgcaaggccgaggaggcccucuccgaccuccgccgccaguacgagaccgaggucggcgaccuccaggucaccaucaagaagcuccgcaagcucgaggagcaguccaagcgcgucucccagaaggaggacgucgccgcccucaagaagcagaucuacgaccucuccauggagaaccagaaggucaagaaggaccuccucgaggcccagaccaacaucgccuuccuccaguccgagcucgacgcccucaaguccgacuacgccgaccagucccucaacaccgagcgcgaccucgagaucauccgcgccuacaccgaggaccgcaacucccucgagcgccagaucgagauccuccagaccgccaaccgcaagcuccacgacuccaacgacggccuccgcuccgcccucgagaacuccuacuccaaguucaaccgcucccuccacaucaacaacaucucccccggcaacaccaucucccgcuccucccccaaguucaucggccacuccccccagccccucggcuacgaccgcuccucccgcuccuccuacgucgacgaggacugcgacucccucgcccucugcgacccccuccagcgcaccaacugcgaggucgacucccuccccgaguccugcuucgacuccggccucuccacccuccgcgaccccaacgaguacgacuccgaggucgaguacaagcaccagcgcggcuuccagcgcucccacggcguccaggaguccuucggcggcgacgccuccgacaccgacguccccgacauccgcgacgaggagaccuucggccucgaggacgucgccuccguccucgacuggaagccccagggcuccgucuccgagggcuccaucgucuccuccucccgcaagcccaucuccgcccucuccccccagaccgaccucgucgacgacaacgccaaguccuucuccucccagaaggccuacaagaucguccucgccggcgacgccgccgucggcaaguccuccuuccucaugcgccucugcaagaacgaguuccgcgagaacaucuccgccacccucggcgucgacuuccagaugaagacccucaucgucgacggcgagcgcaccguccuccagcucugggacaccgccggccaggagcgcuuccgcuccaucgccaaguccuacuuccgcaaggccgacggcguccuccuccucuacgacgucaccugcgagaaguccuuccucaacauccgcgagugggucgacaugaucgaggacgccgcccacgagaccguccccaucaugcucgucggcaacaaggccgacauccgcgacaccgccgccaccgagggccagaagugcguccccggccacuucggcgagaagcucgccaugaccuacggcgcccucuucugcgagaccuccgccaaggacggcuccaacaucgucgaggccguccuccaccucgcccgcgaggucaagaagcgcaccgacaaggacgacucccgcuccaucaccaaccucaccggcaccaacuccaagaaguccccccagaugaagaacugcugcaacggcuga

SEQ ID NO: 48553 - RNA, 1470 nt, Artificial Sequence
  derived and/or modified sequence opt2 from RASGEF1A__Homo_sapiens__NP_001269791
auguuccucgagccccaggagaccaugccccagaccuccgucgucuucuccuccauccucggccccuccugcuccggccagguccagcccggcaugggcgagcgcggcggcggcgccggcggcggcuccggcgaccucaucuuccaggacggccaccucaucuccggcucccucgaggcccucauggagcaccucguccccaccgucgacuacuaccccgaccgcaccuacaucuucaccuuccuccucuccucccgcgucuucaugcccccccacgaccuccucgcccgcgucggccagaucugcgucgagcagaagcagcagcucgaggccggccccgagaaggccaagcucaaguccuucuccgccaagaucguccagcuccucaaggaguggaccgaggccuuccccuacgacuuccaggacgagaaggccauggccgagcucaaggccaucacccaccgcgucacccagugcgacgaggagaacggcaccgucaagaaggccaucgcccagaugacccagucccuccuccucucccucgccgcccgcucccagcuccaggagcuccgcgagaagcuccgcccccccgccgucgacaagggccccauccucaagaccaagccccccgccgcccagaaggacauccucggcgucugcugcgacccccucguccucgcccagcagcucacccacaucgagcucgaccgcgucuccuccaucuaccccgaggaccucaugcagaucgucucccacauggacucccucgacaaccaccgcugccgcggcgaccucaccaagaccuacucccucgaggccuacgacaacugguucaacugccucuccaugcucgucgccaccgaggucugccgcgucgucaagaagaagcaccgcacccgcaugcucgaguucuucaucgacgucgcccgcgagugcuucaacaucggcaacuucaacuccaugauggccaucaucuccggcaugaaccucucccccgucgcccgccucaagaagaccugguccaaggucaagaccgccaaguucgacguccucgagcaccacauggaccccuccuccaacuucugcaacuaccgcaccgcccuccagggcgccacccagcgcucccagauggccaacuccucccgcgagaagaucgucauccccgucuucaaccucuucgucaaggacaucuacuuccuccacaagauccacaccaaccaccuccccaacggccacaucaacuucaagaaguucugggagaucucccgccagauccacgaguucaugaccuggacccaggucgagugccccuucgagaaggacaagaagauccaguccuaccuccucaccgcccccaucuacuccgaggaggcccucuucgucgccuccuucgaguccgagggccccgagaaccacauggagaaggacuccuggaagacccuccgcaccacccuccucaaccgcgccuga

SEQ ID NO: 48554 - RNA, 1401 nt, Artificial Sequence
  derived and/or modified sequence opt2 from RASGEF1C__Homo_sapiens__NP_778232
augccccagacccucuccgccuccgacauggucacccccggcucccucucccccccccccaccgagcccaccgacggcgagcaggccggccagccccuccucgacggcgcccccuccuccgccucccucgagacccucauccagcaccucguccccaccgccgacuacuaccccgagaaggccuacaucuucaccuuccuccucuccucccgccucuucaucgagccccgcgagcuccucgcccgcgucugccaccucugcaucgagcagcagcagcucgacaagcccguccucgacaaggcccgcguccgcaaguucggccccaagcuccuccagcuccucgccgaguggaccgagaccuucccccgcgacuuccaggaggaguccaccaucggccaccucaaggacgucgucggccgcaucgcccccugcgacgaggccuaccgcaagcgcaugcaccagcuccuccaggcccuccaccagaagcucgccgcccuccgccagggccccgagggccucgucggcgccgacaagcccaucuccuaccgcaccaagccccccgccuccauccaccgcgagcuccucggcgucugcuccgaccccuacacccucgcccagcagcucacccacgucgagcucgagcgccuccgccacaucggccccgaggaguucguccaggccuucgucaacaaggacccccucgccuccaccaagcccugcuucuccgacaagaccuccaaccucgaggccuacgucaagugguucaaccgccucugcuaccucgucgccaccgagaucugcaugcccgccaagaagaagcagcgcgcccaggucaucgaguucuucaucgacgucgcccgcgagugcuucaacaucggcaacuucaacucccucauggccaucaucuccggcaugaacaugucccccgucucccgccucaagaagaccugggccaagguccgcaccgccaaguucuucauccucgagcaccagauggaccccaccggcaacuucugcaacuaccgcaccgcccuccgcggcgccgcccaccgcucccucaccgcccacuccucccgcgagaagaucgucauccccuucuucucccuccucaucaaggacaucuacuuccucaacgagggcugcgccaaccgccuccccaacggccacgucaacuucgagaaguuccucgagcucgccaagcaggucggcgaguucaucaccuggaagcaggucgagugccccuucgagcaggacgccuccaucacccacuaccucuacaccgcccccaucuucuccgaggacggccucuaccucgccuccuacgaguccgagucccccgagaaccagaccgagaaggagcgcuggaaggcccuccgcuccuccauccucggcaagaccuga

SEQ ID NO: 48555 - RNA, 3774 nt, Artificial Sequence
  derived and/or modified sequence opt2 from RASGRF1__Homo_sapiens__NP_001139120
augcagaagggcauccgccucaacgacggccacgucgccucccucggccuccucgcccgcaaggacggcacccgcaagggcuaccucuccaagcgcuccuccgacaacaccaaguggcagaccaagugguucgcccuccuccagaaccuccucuucuacuucgaguccgacuccuccucccgccccuccggccucuaccuccucgagggcugcgucugcgaccgcgcccccucccccaagcccgcccucuccgccaaggagccccucgagaagcagcacuacuucaccgucaacuucucccacgagaaccagaaggcccucgagcuccgcaccgaggacgccaaggacugcgacgagugggucgccgccaucgcccacgccuccuaccgcacccucgccaccgagcacgaggcccucaugcagaaguaccuccaccuccuccagaucgucgagaccgagaagaccgucgccaagcagcuccgccagcagaucgaggacggcgagaucgagaucgagcgccucaaggccgagaucaccucccuccucaaggacaacgagcgcauccaguccacccagaccgucgcccccaacgacgaggacuccgacaucaagaagaucaagaagguccaguccuuccuccgcggcuggcucugccgccgcaaguggaagaccaucauccaggacuacauccgcuccccccacgccgacuccaugcgcaagcgcaaccaggucgucuucuccaugcucgaggccgaggccgaguacguccagcagcuccacauccucgucaacaacuuccuccgcccccuccgcauggccgccuccuccaagaagccccccaucacccacgacgacgucuccuccaucuuccucaacuccgagaccaucauguuccuccaccagaucuucuaccagggccucaaggcccgcaucuccuccuggcccacccucguccucgccgaccucuucgacauccuccuccccaugcucaacaucuaccaggaguucguccgcaaccaccaguacucccuccagauccucgcccacugcaagcagaaccgcgacuucgacaagcuccucaagcacuacgaggccaagcccgacugcgaggagcgcacccucgagaccuuccucaccuaccccauguuccagaucccccgcuacauccucacccuccacgagcuccucgcccacaccccccacgagcacgucgagcgcaacucccucgacuacgccaaguccaagcucgaggagcucucccgcaucaugcacgacgaggucuccgagaccgagaacauccgcaagaaccucgccaucgagcgcaugaucaucgagggcugcgagauccuccucgacaccucccagaccuucguccgccagggcucccucauccagguccccauguccgagaagggcaagaucacccgcggccgccucggcucccucucccucaagaaggagggcgagcgccagugcuuccucuucuccaagcaccucaucaucugcacccgcggcuccggcggcaagcuccaccucaccaagaacggcgucaucucccucaucgacugcacccuccucgaggagcccgaguccaccgaggaggaggccaagggcuccggccaggacaucgaccaccucgacuucaagaucggcgucgagcccaaggacuccccccccuucaccgucauccucgucgccuccucccgccaggagaaggccgccuggaccuccgacaucucccagugcgucgacaacauccgcugcaacggccucaugaugaacgccuucgaggagaacuccaaggucaccgucccccagaugaucaaguccgacgccucccucuacugcgacgacgucgacauccgcuucuccaagaccaugaacuccugcaagguccuccagauccgcuacgccuccgucgagcgccuccucgagcgccucaccgaccuccgcuuccucuccaucgacuuccucaacaccuuccuccacuccuaccgcgucuucaccaccgccaucgucguccucgacaagcucaucaccaucuacaagaagcccaucuccgccauccccgcccgcucccucgagcuccucuucgccuccggccagaacaacaagcuccucuacggcgagccccccaaguccccccgcgccacccgcaaguucuccuccccccccccccucuccaucaccaagaccuccucccccucccgccgccgcaagcucucccucaacauccccaucaucaccggcggcaaggcccucgaccucgccgcccucuccugcaacuccaacggcuacaccuccauguacuccgccaugucccccuucuccaaggccacccucgacaccuccaagcucuacgucuccuccuccuucaccaacaagauccccgacgagggcgacaccacccccgagaagcccgaggaccccuccgcccucuccaagcaguccuccgaggucuccaugcgcgaggaguccgacaucgaccagaaccaguccgacgacggcgacaccgagaccucccccaccaagucccccaccacccccaaguccgucaagaacaagaacuccuccgaguucccccucuucuccuacaacaacggcgucgucaugaccuccugccgcgagcucgacaacaaccgcuccgcccucuccgccgccuccgccuucgccaucgccaccgccggcgccaacgagggcacccccaacaaggagaaguaccgccgcaugucccucgccuccgccggcuucccccccgaccagcgcaacggcgacaaggaguucgucauccgccgcgccgccaccaaccgcguccucaacguccuccgccacugggucuccaagcacucccaggacuucgagaccaacgacgagcucaagugcaaggucaucggcuuccucgaggaggucaugcacgaccccgagcuccucacccaggagcgcaaggccgccgccaacaucauccgcacccucacccaggaggaccccggcgacaaccagaucacccucgaggagaucacccagauggccgagggcgucaaggccgagcccuucgagaaccacuccgcccucgagaucgccgagcagcucacccuccucgaccaccucgucuucaagaagauccccuacgaggaguucuucggccagggcuggaugaagcucgagaagaacgagcgcacccccuacaucaugaagaccaccaagcacuucaacgacaucuccaaccucaucgccuccgagaucauccgcaacgaggacaucaacgcccgcgucuccgccaucgagaagugggucgccgucgccgacaucugccgcugccuccacaacuacaacgccguccucgagaucaccuccuccaugaaccgcuccgccaucuuccgccucaagaagaccuggcucaaggucuccaagcagaccaaggcccucaucgacaagcuccagaagcucgucuccuccgagggccgcuucaagaaccuccgcgaggcccucaagaacugcgacccccccugcguccccuaccucggcauguaccucaccgaccucgccuucaucgaggagggcacccccaacuacaccgaggacggccucgucaacuucuccaagaugcgcaugaucucccacaucauccgcgagauccgccaguuccagcagaccgccuacaagaucgagcaccaggccaaggucacccaguaccuccucgaccaguccuucgucauggacgaggagucccucuacgaguccucccuccgcaucgagcccaagcuccccaccuga

SEQ ID NO: 48556 - RNA, 3714 nt, Artificial Sequence
  derived and/or modified sequence opt2 from RASGRF2__Homo_sapiens__NP_008840
augcagaaguccguccgcuacaacgagggccacgcccucuaccucgccuuccucgcccgcaaggagggcaccaagcgcggcuuccucuccaagaagaccgccgaggccucccgcuggcacgagaagugguucgcccucuaccagaacguccucuucuacuucgagggcgagcaguccugccgccccgccggcauguaccuccucgagggcugcuccugcgagcgcacccccgcccccccccgcgccggcgccggccagggcggcguccgcgacgcccucgacaagcaguacuacuucaccguccucuucggccacgagggccagaagccccucgagcuccgcugcgaggaggagcaggacggcaaggaguggauggaggccauccaccaggccuccuacgccgacauccucaucgagcgcgagguccucaugcagaaguacauccaccucguccagaucgucgagaccgagaagaucgccgccaaccagcuccgccaccagcucgaggaccaggacaccgagaucgagcgccucaaguccgagaucaucgcccucaacaagaccaaggagcgcaugcgccccuaccaguccaaccaggaggacgaggaccccgacaucaagaagaucaagaagguccaguccuucaugcgcggcuggcucugccgccgcaaguggaagaccaucguccaggacuacaucugcuccccccacgccgaguccaugcgcaagcgcaaccagaucgucuucaccauggucgaggccgaguccgaguacguccaccagcucuacauccucgucaacggcuuccuccgcccccuccgcauggccgccuccuccaagaagccccccaucucccacgacgacgucuccuccaucuuccucaacuccgagaccaucauguuccuccacgagaucuuccaccagggccucaaggcccgcaucgccaacuggcccacccucauccucgccgaccucuucgacauccuccuccccaugcucaacaucuaccaggaguucguccgcaaccaccaguacucccuccagguccucgccaacugcaagcagaaccgcgacuucgacaagcuccucaagcaguacgaggccaaccccgccugcgagggccgcaugcucgagaccuuccucaccuaccccauguuccagaucccccgcuacaucaucacccuccacgagcuccucgcccacaccccccacgagcacgucgagcgcaagucccucgaguucgccaaguccaagcucgaggagcucucccgcgucaugcacgacgaggucuccgacaccgagaacauccgcaagaaccucgccaucgagcgcaugaucgucgagggcugcgacauccuccucgacaccucccagaccuucauccgccagggcucccucauccagguccccuccgucgagcgcggcaagcucuccaagguccgccucggcucccucucccucaagaaggagggcgagcgccagugcuuccucuucaccaagcacuuccucaucugcacccgcuccuccggcggcaagcuccaccuccucaagaccggcggcguccucucccucaucgacugcacccucaucgaggagcccgacgccuccgacgacgacuccaagggcuccggccaggucuucggccaccucgacuucaagaucgucgucgagccccccgacgccgccgccuucaccgucguccuccucgcccccucccgccaggagaaggccgccuggauguccgacaucucccagugcgucgacaacauccgcugcaacggccucaugaccaucgucuucgaggagaacuccaaggucaccgucccccacaugaucaaguccgacgcccgccuccacaaggacgacaccgacaucugcuucuccaagacccucaacuccugcaaggucccccagauccgcuacgccuccgucgagcgccuccucgagcgccucaccgaccuccgcuuccucuccaucgacuuccucaacaccuuccuccacaccuaccgcaucuucaccaccgccgccgucguccucggcaagcucuccgacaucuacaagcgccccuucaccuccauccccguccgcucccucgagcucuucuucgccaccucccagaacaaccgcggcgagcaccucgucgacggcaaguccccccgccucugccgcaaguucuccuccccccccccccucgccgucucccgcaccuccucccccguccgcgcccgcaagcucucccucaccuccccccucaacuccaagaucggcgcccucgaccucaccaccuccuccucccccaccaccaccacccagucccccgccgccuccccccccccccacaccggccagaucccccucgaccucucccgcggccucuccucccccgagcagucccccggcaccgucgaggagaacgucgacaacccccgcgucgaccucugcaacaagcucaagcgcuccauccagaaggccguccucgaguccgcccccgccgaccgcgccggcgucgaguccucccccgccgccgacaccaccgagcucucccccugccgcucccccuccaccccccgccaccuccgcuaccgccagcccggcggccagaccgccgacaacgcccacugcuccgucucccccgccuccgccuucgccaucgccaccgccgccgccggccacggcuccccccccggcuucaacaacaccgagcgcaccugcgacaaggaguucaucauccgccgcaccgccaccaaccgcguccucaacguccuccgccacugggucuccaagcacgcccaggacuucgagcucaacaacgagcucaagaugaacguccucaaccuccucgaggagguccuccgcgaccccgaccuccucccccaggagcgcaaggccgccgccaacauccuccgcgcccucucccaggacgaccaggacgacauccaccucaagcucgaggacaucauccagaugaccgacugcaugaaggccgagugcuucgagucccucuccgccauggagcucgccgagcagaucacccuccucgaccacgucaucuuccgcuccauccccuacgaggaguuccucggccagggcuggaugaagcucgacaagaacgagcgcacccccuacaucaugaagaccucccagcacuucaacgacauguccaaccucgucgccucccagaucaugaacuacgccgacgucuccucccgcgccaacgccaucgagaagugggucgccgucgccgacaucugccgcugccuccacaacuacaacggcguccucgagaucaccuccgcccucaaccgcuccgccaucuaccgccucaagaagaccugggccaaggucuccaagcagaccaaggcccucauggacaagcuccagaagaccgucuccuccgagggccgcuucaagaaccuccgcgagacccucaagaacugcaacccccccgccguccccuaccucggcauguaccucaccgaccucgccuucaucgaggagggcacccccaacuucaccgaggagggccucgucaacuucuccaagaugcgcaugaucucccacaucauccgcgagauccgccaguuccagcagaccuccuaccgcaucgaccaccagcccaaggucgcccaguaccuccucgacaaggaccucaucaucgacgaggacacccucuacgagcucucccucaagaucgagccccgccuccccgccuga

SEQ ID NO: 48557 - RNA, 2289 nt, Artificial Sequence
  derived and/or modified sequence opt2 from RASGRP1__Homo_sapiens__NP_001122074
augggcacccucggcaaggcccgcgaggccccccgcaagcccucccacggcugccgcgccgccuccaaggcccgccucgaggccaagcccgccaacucccccuuccccucccaccccucccucgcccacaucacccaguuccgcaugauggucucccucggccaccucgccaagggcgccucccucgacgaccucaucgacuccugcauccaguccuucgacgccgacggcaaccucugccgcuccaaccagcuccuccaggucaugcucaccaugcaccgcaucgucaucuccuccgccgagcuccuccagaaggucaucacccucuacaaggacgcccucgccaagaacucccccggccucugccucaagaucugcuacuucguccgcuacuggaucaccgaguucugggucauguucaagauggacgccucccucaccgacaccauggaggaguuccaggagcucgucaaggccaagggcgaggagcuccacugccgccucaucgacaccacccagaucaacgcccgcgacuggucccgcaagcucacccagcgcaucaaguccaacaccuccaagaagcgcaaggucucccuccucuucgaccaccucgagcccgaggagcucuccgagcaccucaccuaccucgaguucaaguccuuccgccgcaucuccuucuccgacuaccagaacuaccucgucaacuccugcgucaaggagaaccccaccauggagcgcuccaucgcccucugcaacggcaucucccaguggguccagcucaugguccucucccgccccaccccccagcuccgcgccgaggucuucaucaaguucauccaggucgcccagaagcuccaccagcuccagaacuucaacacccucauggccgucaucggcggccucugccacuccuccaucucccgccucaaggagaccuccucccacgucccccacgagaucaacaagguccucggcgagaugaccgagcuccucuccuccucccgcaacuacgacaacuaccgccgcgccuacggcgagugcaccgacuucaagauccccauccucggcguccaccucaaggaccucaucucccucuacgaggccaugcccgacuaccucgaggacggcaaggucaacguccacaagcuccucgcccucuacaaccacaucuccgagcucguccagcuccaggaggucgcccccccccucgaggccaacaaggaccucguccaccuccucacccucucccucgaccucuacuacaccgaggacgagaucuacgagcucuccuacgcccgcgagccccgcaaccaccgcgcccccuccgucuucaagaacuacgaccacgaccaggacggcuacaucucccaggaggaguucgagaagaucgccgccuccuuccccuucuccuucugcgucauggacaaggaccgcgagggccucaucucccgcgacgagaucaccgccuacuucaugcgcgccuccuccaucuacuccaagcucggccucggcuucccccacaacuuccaggagaccaccuaccucaagcccaccuucugcgacaacugcgccggcuuccucuggggcgucaucaagcagggcuaccgcugcaaggacugcggcaugaacugccacaagcagugcaaggaccucgucgucuucgagugcaagaagcgcgccaagaaccccgucgcccccaccgagaacaacaccuccgucggccccgucuccaaccucugcucccucggcgccaaggaccuccuccacgcccccgaggagggccccuucaccuuccccaacggcgaggccgucgagcacggcgaggaguccaaggaccgcaccaucaugcucaugggcgucuccucccagaagaucucccuccgccucaagcgcgccgucgcccacaaggccacccagaccgagucccagcccuggaucggcuccgagggccccuccggccccuucguccucuccuccccccgcaagaccgcccaggacacccucuacguccuccccucccccaccucccccugccccucccccguccucguccgcaagcgcgccuucgucaagugggagaacaaggacucccucaucaaguccaaggaggagcuccgccaccuccgccuccccaccuaccaggagcucgagcaggagaucaacacccucaaggccgacaacgacgcccucaagauccagcucaaguacgcccagaagaagaucgagucccuccagcucgagaaguccaaccacguccucgcccagauggagcagggcgacugcuccuga

SEQ ID NO: 48558 - RNA, 1830 nt, Artificial Sequence
  derived and/or modified sequence opt2 from RASGRP2__Homo_sapiens__NP_001092141
auggccggcacccucgaccucgacaagggcugcaccgucgaggagcuccuccgcggcugcaucgaggccuucgacgacuccggcaagguccgcgacccccagcucguccgcauguuccucaugaugcaccccugguacauccccuccucccagcucgccgccaagcuccuccacaucuaccagcagucccgcaaggacaacuccaacucccuccaggucaagaccugccaccucguccgcuacuggaucuccgccuuccccgccgaguucgaccucaaccccgagcucgccgagcagaucaaggagcucaaggcccuccucgaccaggagggcaaccgccgccacuccucccucaucgacaucgacuccguccccaccuacaaguggaagcgccaggucacccagcgcaaccccgucggccagaagaagcgcaagaugucccuccucuucgaccaccucgagcccauggagcucgccgagcaccucaccuaccucgaguaccgcuccuucugcaagauccucuuccaggacuaccacuccuucgucacccacggcugcaccgucgacaaccccguccucgagcgcuucaucucccucuucaacuccgucucccaguggguccagcucaugauccucuccaagcccaccgccccccagcgcgcccucgucaucacccacuucguccacgucgccgagaagcuccuccagcuccagaacuucaacacccucauggccgucgucggcggccucucccacuccuccaucucccgccucaaggagacccacucccacgucucccccgagaccaucaagcucugggagggccucaccgagcucgucaccgccaccggcaacuacggcaacuaccgccgccgccucgccgccugcgucggcuuccgcuuccccauccucggcguccaccucaaggaccucgucgcccuccagcucgcccuccccgacuggcucgaccccgcccgcacccgccucaacggcgccaagaugaagcagcucuucuccauccucgaggagcucgccauggucaccucccuccgcccccccguccaggccaaccccgaccuccucucccuccucaccgucucccucgaccaguaccagaccgaggacgagcucuaccagcucucccuccagcgcgagccccgcuccaaguccucccccaccucccccaccuccugcaccccccccccccgcccccccguccucgaggaguggaccuccgccgccaagcccaagcucgaccaggcccucgucgucgagcacaucgagaagauggucgaguccgucuuccgcaacuucgacgucgacggcgacggccacaucucccaggaggaguuccagaucauccgcggcaacuuccccuaccucuccgccuucggcgaccucgaccagaaccaggacggcugcaucucccgcgaggagauggucuccuacuuccuccgcuccuccuccguccucggcggccgcaugggcuucguccacaacuuccaggaguccaacucccuccgccccgucgccugccgccacugcaaggcccucauccucggcaucuacaagcagggccucaagugccgcgccugcggcgucaacugccacaagcagugcaaggaccgccucuccgucgagugccgccgccgcgcccaguccgucucccucgagggcuccgcccccucccccucccccaugcacucccaccaccaccgcgccuucuccuucucccucccccgccccggccgccgcggcucccgcccccccgagauccgcgaggaggagguccagaccgucgaggacggcgucuucgacauccaccucuga

SEQ ID NO: 48559 - RNA, 2070 nt, Artificial Sequence
  derived and/or modified sequence opt2 from RASGRP3__Homo_sapiens__NP_056191
augggcuccuccggccucggcaaggccgccacccucgacgagcuccucugcaccugcaucgagauguucgacgacaacggcgagcucgacaacuccuaccucccccgcaucguccuccucaugcaccgcugguaccucuccuccaccgagcucgccgagaagcuccucugcauguaccgcaacgccaccggcgaguccugcaacgaguuccgccucaagaucugcuacuucaugcgcuacuggauccucaaguuccccgccgaguucaaccucgaccucggccucauccgcaugaccgaggaguuccgcgaggucgccucccagcucggcuacgagaagcacgucucccucaucgacaucuccuccauccccuccuacgacuggaugcgccgcgucacccagcgcaagaaggucuccaagaagggcaaggccugccuccucuucgaccaccucgagcccaucgagcucgccgagcaccucaccuuccucgagcacaaguccuuccgccgcaucuccuucaccgacuaccaguccuacgucauccacggcugccucgagaacaaccccacccucgagcgcuccaucgcccucuucaacggcaucuccaaguggguccagcucaugguccucuccaagcccaccccccagcagcgcgccgaggucaucaccaaguucaucaacgucgccaagaagcuccuccagcucaagaacuucaacacccucauggccgucgucggcggccucucccacuccuccaucucccgccucaaggagacccacucccaccucuccuccgaggucaccaagaacuggaacgagaugaccgagcucgucuccuccaacggcaacuacugcaacuaccgcaaggccuucgccgacugcgacggcuucaagauccccauccucggcguccaccucaaggaccucaucgccguccacgucaucuuccccgacuggaccgaggagaacaaggucaacaucgucaagaugcaccagcucuccgucacccucuccgagcucgucucccuccagaacgccucccaccaccucgagcccaacauggaccucaucaaccuccucacccucucccucgaccucuaccacaccgaggacgacaucuacaagcucucccucguccucgagccccgcaacuccaagucccccaccucccccaccacccccaacaagcccgucgucccccucgagugggcccucggcgucaugcccaagcccgaccccaccgucaucaacaagcacauccgcaagcucgucgaguccgucuuccgcaacuacgaccacgaccacgacggcuacaucucccaggaggacuucgaguccaucgccgccaacuuccccuuccucgacuccuucugcguccucgacaaggaccaggacggccucaucuccaaggacgagaugauggccuacuuccuccgcgccaagucccagcuccacugcaagaugggccccggcuucauccacaacuuccaggagaugaccuaccucaagcccaccuucugcgagcacugcgccggcuuccucuggggcaucaucaagcagggcuacaagugcaaggacugcggcgccaacugccacaagcagugcaaggaccuccucguccucgccugccgccgcuucgcccgcgcccccucccucuccuccggccacggcucccuccccggcucccccucccucccccccgcccaggacgaggucuucgaguuccccggcgucaccgccggccaccgcgaccucgacucccgcgccaucacccucgucaccggcuccucccgcaagaucuccguccgccuccagcgcgccaccaccucccaggccacccagaccgagcccgucugguccgaggccggcuggggcgacuccggcucccacaccuuccccaagaugaaguccaaguuccacgacaaggccgccaaggacaagggcuucgccaagugggagaacgagaagccccgcguccacgccggcgucgacgucgucgaccgcggcaccgaguucgagcucgaccaggacgagggcgaggagacccgccaggacggcgaggacggcuga

SEQ ID NO: 48560 - RNA, 1980 nt, Artificial Sequence
  derived and/or modified sequence opt2 from RASGRP4__Homo_sapiens__NP_001139674
augaaccgcaaggacuccaagcgcaagucccaccaggagugcaccggcaagaucggcggccgcggccgcccccgccagguccgccgccacaagaccugccccuccccccgcgagaucuccaaggucauggccuccaugaaccucggccuccucuccgagggcggcugcuccgaggacgagcuccucgagaagugcauccaguccuucgacuccgccggcucccucugccacgaggaccacaugcucaacaugguccucgccaugcacuccuggguccuccccuccgccgaccucgccgcccgccuccucaccuccuaccagaaggccaccggcgacacccaggagcuccgccgccuccagaucugccaccucguccgcuacuggcucaugcgccaccccgaggucaugcaccaggacccccagcucgaggaggucaucggccgcuucugggccaccgucgcccgcgagggcaacuccgcccagcgccgccucggcgacuccuccgaccuccccggccucggcaagaagcgcaaggucucccuccucuucgaccaccucgagaccggcgagcucgcccagcaccucaccuaccucgaguuccgcuccuuccaggccaucaccccccaggaccuccgcuccuacguccuccagggcuccguccgcggcugccccgcccucgagggcuccgucggccucuccaacuccgucucccgcuggguccaggucaugguccucucccgccccggcccccuccagcgcgcccagguccucgacaaguucauccacgucgcccagcgccuccaccagcuccagaacuucaacacccucauggccgucaccggcggccucugccacuccgccaucucccgccucaaggacucccacgcccaccucucccccgacuccaccaaggcccuccucgagcucaccgagcuccucgccucccacaacaacuacgcccgcuaccgccgcaccugggccggcugcgccggcuuccgccuccccguccucggcguccaccucaaggaccucgucucccuccacgaggcccagcccgaccgccuccccgacggccgccuccaccuccccaagcucaacaaccucuaccuccgccuccaggagcucgucgcccuccagggccagcacccccccugcuccgccaacgaggaccuccuccaccuccucacccucucccucgaccucuucuacaccgaggacgagaucuacgagcucuccuacgcccgcgagccccgcugccccaagucccucccccccucccccuucaacgccccccucgucgucgagugggcccccggcgucacccccaagcccgaccgcgucacccucggccgccacgucgagcagcucgucgaguccgucuucaagaacuacgaccccgagggccgcggcaccaucucccaggaggacuucgagcgccucuccggcaacuuccccuucgccugccacggccuccacccccccccccgccagggccgcggcuccuucucccgcgaggagcucaccggcuaccuccuccgcgccuccgccaucugcuccaagcucggccucgccuuccuccacaccuuccacgaggucaccuuccgcaagcccaccuucugcgacuccugcuccggcuuccucuggggcgucaccaagcagggcuaccgcugccgcgagugcggccucugcugccacaagcacugccgcgaccaggucaaggucgagugcaagaagcgccccggcgccaagggcgacgccggcccccccggcgcccccguccccuccacccccgccccccacgccuccugcggcuccgaggagaaccacuccuacacccucucccucgagcccgagaccggcugccagcuccgccacgccuggacccagaccgaguccccccaccccuccugggagaccgacaccguccccugccccgucauggacccccccuccaccgccuccuccaagcucgacuccuga

SEQ ID NO: 48561 - RNA, 2892 nt, Artificial Sequence
  derived and/or modified sequence opt2 from RASIP1__Homo_sapiens__NP_060275
augcucuccggcgagcgcaaggagggcggcuccccccgcuucggcaagcuccaccuccccgucggccucuggaucaacuccccccgcaagcagcucgccaagcucggccgccgcuggcccuccgccgccuccgucaaguccuccuccuccgacaccggcucccgcuccuccgagccccucccccccccccccccccacgucgagcuccgccgcgucggcgccgucaaggccgccggcggcgccuccggcucccgcgccaagcgcaucucccagcucuuccgcggcuccggcaccggcaccaccggcuccuccggcgccggcggccccggcacccccggcggcgcccagcgcugggccuccgagaagaagcuccccgagcucgccgccggcgucgcccccgagcccccccucgccacccgcgccaccgccccccccggcguccucaagaucuucggcgccggccucgccuccggcgccaacuacaaguccguccucgccaccgcccgcuccaccgcccgcgagcucgucgccgaggcccucgagcgcuacggccucgccggcucccccggcggcggccccggcgaguccuccugcgucgacgccuucgcccucugcgacgcccucggccgccccgccgccgccggcgucggcuccggcgaguggcgcgccgagcaccuccgcguccucggcgacuccgagcgcccccuccucguccaggagcucuggcgcgcccgccccggcugggcccgccgcuucgagcuccgcggccgcgaggaggcccgccgccucgagcaggaggccuucggcgccgccgacuccgagggcaccggcgcccccuccuggcgcccccagaagaaccgcucccgcgccgccuccggcggcgccgcccucgccucccccggccccggcaccggcuccggcgcccccgccggcuccggcggcaaggagcgcuccgagaaccucucccuccgccgcuccgucuccgagcucucccuccagggccgccgccgccgccagcaggagcgccgccagcaggcccucuccauggcccccggcgccgccgacgcccagaucggcaccgccgaccccggcgacuucgaccagcucacccagugccucauccaggcccccuccaaccgccccuacuuccuccuccuccagggcuaccaggacgcccaggacuucgucgucuacgucaugacccgcgagcagcacgucuucggccgcggcggcaacuccuccggccgcggcggcucccccgcccccuacgucgacaccuuccucaacgcccccgacauccucccccgccacugcaccguccgcgccggccccgagcaccccgccaugguccgccccucccgcggcgcccccgucacccacaacggcugccuccuccuccgcgaggccgagcuccaccccggcgaccuccucggccucggcgagcacuuccucuucauguacaaggacccccgcaccggcggcuccggccccgcccgcccccccuggcuccccgcccgccccggcgccaccccccccggccccggcugggccuucuccugccgccucugcggccgcggccuccaggagcgcggcgaggcccucgccgccuaccucgacggccgcgagcccguccuccgcuuccgcccccgcgaggaggaggcccuccucggcgagaucguccgcgccgccgccgccggcuccggcgaccuccccccccucggccccgccacccuccucgcccucugcguccagcacuccgcccgcgagcucgagcucggccaccucccccgccuccucggccgccucgcccgccucaucaaggaggccgucugggagaagaucaaggagaucggcgaccgccagcccgagaaccaccccgagggcguccccgaggucccccucacccccgaggccgucuccgucgagcuccgcccccucaugcucuggauggccaacaccaccgagcuccucuccuucguccaggagaagguccucgagauggagaaggaggccgaccaggaggacccccagcucugcaacgaccucgagcucugcgacgaggccauggcccuccucgacgaggucaucaugugcaccuuccagcaguccgucuacuaccucaccaagacccucuacuccacccuccccgcccuccucgacuccaaccccuucaccgccggcgccgagcuccccggccccggcgccgagcucggcgccaugccccccggccuccgccccacccucggcgucuuccaggccgcccucgagcucaccucccagugcgagcuccaccccgaccucgucucccagaccuucggcuaccucuucuucuucuccaacgccucccuccucaacucccucauggagcgcggccagggccgccccuucuaccaguggucccgcgccguccagauccgcaccaaccucgaccucguccucgacuggcuccagggcgccggccucggcgacaucgccaccgaguucuuccgcaagcucuccauggccgucaaccuccucugcgucccccgcaccucccuccucaaggccuccugguccucccuccgcaccgaccaccccacccucacccccgcccagcuccaccaccuccucucccacuaccagcucggccccggccgcggcccccccgccgccugggaccccccccccgccgagcgcgaggccgucgacaccggcgacaucuucgaguccuucuccucccaccccccccucauccucccccucggcuccucccgccuccgccucaccggccccgucaccgacgacgcccuccaccgcgagcuccgccgccuccgccgccuccucugggaccucgagcagcaggagcuccccgccaacuaccgccacggcccccccgucgccaccucccccuga

SEQ ID NO: 48562 - RNA, 612 nt, Artificial Sequence
  derived and/or modified sequence opt2 from RASL10A__Homo_sapiens__NP_006468
augggcggcucccuccgcgucgccguccucggcgcccccggcgucggcaagaccgccaucauccgccaguuccucuucggcgacuaccccgagcgccaccgccccaccgacggcccccgccucuaccgccccgccguccuccucgacggcgccgucuacgaccucuccauccgcgacggcgacgucgccggccccggcuccucccccggcggccccgaggaguggcccgacgccaaggacuggucccuccaggacaccgacgccuucguccucgucuacgacaucugcucccccgacuccuucgacuacgucaaggcccuccgccagcgcaucgccgagacccgccccgccggcgcccccgaggcccccauccucgucgucggcaacaagcgcgaccgccagcgccuccgcuucggcccccgccgcgcccucgccgcccucguccgccgcggcuggcgcugcggcuaccucgagugcuccgccaaguacaacuggcacguccuccgccucuuccgcgagcuccuccgcugcgcccucguccgcgcccgccccgcccaccccgcccuccgccuccagggcgcccuccaccccgcccgcugcucccucauguga

SEQ ID NO: 48563 - RNA, 612 nt, Artificial Sequence
  derived and/or modified sequence opt2 from RASL10B__Homo_sapiens__NP_201572
auggucuccaccuaccgcgucgccguccucggcgcccgcggcgucggcaaguccgccaucguccgccaguuccucuacaacgaguucuccgaggucugcguccccaccaccgcccgccgccucuaccuccccgccgucgucaugaacggccacguccacgaccuccagauccucgacuucccccccaucuccgccuuccccgucaacacccuccaggagugggccgacaccugcugccgcggccuccgcuccguccacgccuacauccucgucuacgacaucugcugcuucgacuccuucgaguacgucaagaccauccgccagcagauccucgagacccgcgucaucggcaccuccgagacccccaucaucaucgucggcaacaagcgcgaccuccagcgcggccgcgucaucccccgcuggaacgucucccaccucguccgcaagaccuggaagugcggcuacgucgagugcuccgccaaguacaacuggcacauccuccuccucuucuccgagcuccucaaguccgucggcugcgcccgcugcaagcacguccacgccgcccuccgcuuccagggcgcccuccgccgcaaccgcugcgccaucauguga

SEQ ID NO: 48564 - RNA, 729 nt, Artificial Sequence
  derived and/or modified sequence opt2 from RASL11A__Homo_sapiens__NP_996563
augcgcccccucuccauguccggccacuuccuccucgcccccauccccgaguccuccuccgacuaccuccuccccaaggacaucaagcucgccguccucggcgccggccgcgucggcaaguccgccaugaucguccgcuuccucaccaagcgcuucaucggcgacuacgagcccaacaccggcaagcucuacucccgccucgucuacgucgagggcgaccagcucucccuccagauccaggacacccccggcggcguccagauccaggacucccucccccaggucgucgacucccucuccaagugcguccagugggccgagggcuuccuccucgucuacuccaucaccgacuacgacuccuaccucuccauccgcccccucuaccagcacauccgcaagguccaccccgacuccaaggcccccgucaucaucgucggcaacaagggcgaccuccuccacgcccgccagguccagacccaggacggcauccagcucgccaacgagcucggcucccucuuccucgagaucuccaccuccgagaacuacgaggacgucugcgacgucuuccagcaccucugcaaggaggucuccaagaugcacggccucuccggcgagcgccgccgcgccuccaucaucccccgcccccgcucccccaacaugcaggaccucaagcgccgcuucaagcaggcccucucccccaaggucaaggcccccuccgcccucggcuga

SEQ ID NO: 48565 - RNA, 747 nt, Artificial Sequence
  derived and/or modified sequence opt2 from RASL11B__Homo_sapiens__NP_076429
augcgccucauccagaacaugugcaccaucgccgaguaccccgcccccggcaacgccgccgccuccgacugcugcgucggcgccgccggccgccgccucgucaagaucgccgucgucggcgccuccggcgucggcaagaccgcccucgucguccgcuuccucaccaagcgcuucaucggcgacuacgagcgcaacgccggcaaccucuacacccgccagguccagaucgagggcgagacccucgcccuccagguccaggacacccccggcauccagguccacgagaacucccucuccugcuccgagcagcucaaccgcugcauccgcugggccgacgccgucgucaucgucuucuccaucaccgacuacaaguccuacgagcucaucucccagcuccaccagcacguccagcagcuccaccucggcacccgccuccccgucgucgucgucgccaacaaggccgaccuccuccacaucaagcaggucgacccccagcucggccuccagcucgccuccaugcucggcugcuccuucuacgaggucuccgucuccgagaacuacaacgacgucuacuccgccuuccacguccucugcaaggaggucucccacaagcagcagcccuccuccacccccgagaagcgccgcaccucccucaucccccgccccaagucccccaacaugcaggaccucaagcgccgcuucaagcaggcccucuccgccaagguccgcaccgucaccuccgucuga

SEQ ID NO: 48566 - RNA, 801 nt, Artificial Sequence
  derived and/or modified sequence opt2 from RASL12__Homo_sapiens__NP_057647
auguccuccgucuucggcaagccccgcgccggcuccggcccccaguccgccccccucgaggucaaccucgccauccucggccgccgcggcgccggcaaguccgcccucaccgucaaguuccucaccaagcgcuucaucuccgaguacgaccccaaccucgaggacaccuacuccuccgaggagaccgucgaccaccagcccguccaccuccgcgucauggacaccgccgaccucgacaccccccgcaacugcgagcgcuaccucaacugggcccacgccuuccucgucgucuacuccgucgacucccgccaguccuucgacuccuccuccuccuaccucgagcuccucgcccuccacgccaaggagacccagcgcuccauccccgcccuccuccucggcaacaagcucgacauggcccaguaccgccaggucaccaaggccgagggcgucgcccucgccggccgcuucggcugccucuucuucgaggucuccgccugccucgacuucgagcacguccagcacgucuuccacgaggccguccgcgaggcccgccgcgagcucgagaaguccccccucacccgcccccucuucaucuccgaggagcgcgcccucccccaccaggccccccucaccgcccgccacggccucgccuccugcaccuucaacacccucuccaccaucaaccucaaggagaugcccaccgucgcccaggccaagcucgucaccgucaaguccucccgcgcccaguccaagcgcaaggcccccacccucacccuccucaagggcuucaagaucuucuga

SEQ ID NO: 48567 - RNA, 570 nt, Artificial Sequence
  derived and/or modified sequence opt2 from RASSF1__Homo_sapiens__NP_001193886
augucccucaacaaggacggcuccuacaccggcuucaucaagguccagcucaagcucguccgccccgucuccguccccuccuccaagaagccccccucccuccaggacgcccgccgcggccccggccgcggcaccuccguccgccgccgcaccuccuucuaccuccccaaggacgccgucaagcaccuccacguccucucccgcacccgcgcccgcgaggucaucgaggcccuccuccgcaaguuccucgucgucgacgacccccgcaaguucgcccucuucgagcgcgccgagcgccacggccaggucuaccuccgcaagcuccucgacgacgagcagccccuccgccuccgccuccucgccggccccuccgacaaggcccucuccuucguccucaaggagaacgacuccggcgaggucaacugggacgccuucuccaugcccgagcuccacaacuuccuccgcauccuccagcgcgaggaggaggagcaccuccgccagauccuccagaaguacuccuacugccgccagaagauccaggaggcccuccacgccugcccccucggcuga

SEQ ID NO: 48568 - RNA, 981 nt, Artificial Sequence
  derived and/or modified sequence opt2 from RASSF2__Homo_sapiens__NP_055552
auggacuacucccaccagaccucccucguccccugcggccaggacaaguacaucuccaagaacgagcuccuccuccaccucaagaccuacaaccucuacuacgagggccagaaccuccagcuccgccaccgcgaggaggaggacgaguucaucgucgagggccuccucaacaucuccuggggccuccgccgccccauccgccuccagaugcaggacgacaacgagcgcauccgccccccccccuccuccuccuccuggcacuccggcugcaaccucggcgcccagggcaccacccucaagccccucaccguccccaagguccagaucuccgaggucgacgccccccccgagggcgaccagaugcccuccuccaccgacucccgcggccucaagccccuccaggaggacaccccccagcucaugcgcacccgcuccgacgucggcguccgccgccgcggcaacguccgcacccccuccgaccagcgccgcauccgccgccaccgcuucuccaucaacggccacuucuacaaccacaagaccuccgucuucacccccgccuacggcuccgucaccaacguccgcaucaacuccaccaugaccaccccccagguccucaagcuccuccucaacaaguucaagaucgagaacuccgccgaggaguucgcccucuacgucguccacaccuccggcgagaagcagaagcucaaggccaccgacuacccccucaucgcccgcauccuccagggccccugcgagcagaucuccaaggucuuccucauggagaaggaccaggucgaggaggucaccuacgacgucgcccaguacaucaaguucgagaugcccguccucaaguccuucauccagaagcuccaggaggaggaggaccgcgaggucaagaagcucaugcgcaaguacaccguccuccgccucaugauccgccagcgccucgaggagaucgccgagacccccgccaccaucuga

SEQ ID NO: 48569 - RNA, 717 nt, Artificial Sequence
  derived and/or modified sequence opt2 from RASSF3__Homo_sapiens__NP_835463
auguccuccggcuacuccucccucgaggaggacgccgaggacuucuucuucaccgcccgcaccuccuucuuccgccgcgccccccagggcaagccccgcuccggccagcaggacgucgagaaggagaaggagacccacuccuaccucuccaaggaggagaucaaggagaagguccacaaguacaaccucgccgucaccgacaagcucaagaugacccucaacuccaacggcaucuacaccggcuucaucaagguccagauggagcucugcaagcccccccagaccucccccaacuccggcaagcucucccccuccuccaacggcugcaugaacacccuccacaucuccuccaccaacaccgucggcgaggucaucgaggcccuccucaagaaguuccucgucaccgagucccccgccaaguucgcccucuacaagcgcugccaccgcgaggaccaggucuacgccugcaagcucuccgaccgcgagcacccccucuaccuccgccucgucgccggcccccgcaccgacacccucuccuucguccuccgcgagcacgagaucggcgagugggaggccuucucccuccccgagcuccagaacuuccuccgcauccucgacaaggaggaggacgagcagcuccagaaccucaagcgccgcuacaccgccuaccgccagaagcucgaggaggcccuccgcgaggucuggaagcccgacuga

SEQ ID NO: 48570 - RNA, 966 nt, Artificial Sequence
  derived and/or modified sequence opt2 from RASSF4__Homo_sapiens__NP_114412
augaaggaggacugccuccccuccucccacguccccaucuccgacuccaaguccauccagaaguccgagcuccucggccuccucaagaccuacaacugcuaccacgagggcaaguccuuccagcuccgccaccgcgaggaggagggcacccucaucaucgagggccuccucaacaucgccuggggccuccgccgccccauccgccuccagaugcaggacgaccgcgagcagguccaccuccccuccaccuccuggaugccccgccgccccuccugcccccucaaggagcccuccccccagaacggcaacaucaccgcccagggccccuccauccagcccguccacaaggccgaguccuccaccgacuccuccggcccccucgaggaggccgaggaggccccccagcucaugcgcaccaaguccgacgccuccugcaugucccagcgccgccccaagugccgcgcccccggcgaggcccagcgcauccgccgccaccgcuucuccaucaacggccacuucuacaaccacaagaccuccgucuucacccccgccuacggcuccgucaccaacguccgcgucaacuccaccaugaccacccuccagguccucacccuccuccucaacaaguuccgcgucgaggacggccccuccgaguucgcccucuacaucguccacgaguccggcgagcgcaccaagcucaaggacugcgaguacccccucaucucccgcauccuccacggccccugcgagaagaucgcccgcaucuuccucauggaggccgaccucggcgucgaggucccccacgaggucgcccaguacaucaaguucgagaugcccguccucgacuccuucgucgagaagcucaaggaggaggaggagcgcgagaucaucaagcucaccaugaaguuccaggcccuccgccucaccaugcuccagcgccucgagcagcucgucgaggccaaguga

SEQ ID NO: 48571 - RNA, 1257 nt, Artificial Sequence
  derived and/or modified sequence opt2 from RASSF5__Homo_sapiens__NP_872604
auggccauggccucccccgccaucggccagcgccccuacccccuccuccucgaccccgagcccccccgcuaccuccagucccucuccggccccgagcuccccccccccccccccgaccgcuccucccgccucugcguccccgccccccucuccaccgcccccggcgcccgcgagggccgcuccgcccgccgcgccgcccgcggcaaccucgagccccccccccgcgccucccgccccgcccgcccccuccgccccggccuccagcagcgccuccgccgccgccccggcgccccccgcccccgcgacguccgcuccaucuucgagcagccccaggacccccgcguccccgccgagcgcggcgagggccacugcuucgccgagcucguccuccccggcggccccggcuggugcgaccucugcggccgcgagguccuccgccaggcccuccgcugcaccaacugcaaguucaccugccaccccgagugccgcucccucauccagcucgacugcucccagcaggagggccucucccgcgaccgccccucccccgaguccacccucaccgucaccuucucccagaacgucugcaagcccgucgaggagacccagcgcccccccacccuccaggagaucaagcagaagaucgacuccuacaacacccgcgagaagaacugccucggcaugaagcucuccgaggacggcaccuacaccggcuucaucaagguccaccucaagcuccgccgccccgucaccguccccgccggcauccgcccccaguccaucuacgacgccaucaaggaggucaaccucgccgccaccaccgacaagcgcaccuccuucuaccucccccucgacgccaucaagcagcuccacaucuccuccaccaccaccgucuccgaggucauccagggccuccucaagaaguucauggucgucgacaacccccagaaguucgcccucuucaagcgcauccacaaggacggccagguccucuuccagaagcucuccaucgccgaccgcccccucuaccuccgccuccucgccggccccgacaccgagguccucuccuucguccucaaggagaacgagaccggcgaggucgagugggacgccuucuccauccccgagcuccagaacuuccucaccauccucgagaaggaggagcaggacaagauccagcagguccagaagaaguacgacaaguuccgccagaagcucgaggaggcccuccgcgagucccagggcaagcccggcuga

SEQ ID NO: 48572 - RNA, 912 nt, Artificial Sequence
  derived and/or modified sequence opt2 from RASSF6__Homo_sapiens__NP_001257320
augaccaugauggcccaccaguaccccuccuggaucuucaucaacgagaagaccuucaucacccgcgagcagcucaacucccuccucaagaccuacaacaucuucuacgagaaccagaagaaccuccacauccucuacggcgagaccgaggacggcaagcucaucgucgagggcaugcucgacaucuucuggggcgucaagcgccccauccagcucaagauccaggacgagaagcccuucuccuccuucaccuccaugaaguccuccgacgucuucuccuccaagggcaugacccgcuggggcgaguucgacgaccucuaccgcaucuccgagcucgaccgcacccagauccccauguccgagaagcgcaacucccaggaggacuaccucuccuaccacuccaacacccucaagccccacgccaaggacgagcccgacucccccguccucuaccgcaccauguccgaggccgcccucguccgcaagcgcaugaagccccucaugauggaccgcaaggagcgccagaagaaccgcgccuccaucaacggccacuucuacaaccacgagaucgagaacuccccccaggacuucgcccuccacaucaucuucgccaccggcgagcagcgccgccucaagaagaccgacaucccccuccuccagcgccuccuccagggccccuccgagaagaacgcccgcaucuuccucauggacaaggacgccgaggagaucuccuccgacgucgcccaguacaucaacuuccacuucucccuccucgaguccauccuccagcgccucaacgaggaggagaagcgcgagauccagcgcaucgucaccaaguucaacaaggagaaggccaucauccucaagugccuccagaacaagcucgucaucaagaccgagaccaccgucuga

SEQ ID NO: 48573 - RNA, 1014 nt, Artificial Sequence
  derived and/or modified sequence opt2 from RASSF7__Homo_sapiens__NP_001137465
augcuccucggccucgccgccauggagcucaaggucugggucgacggcauccagcgcgucgucugcggcgucuccgagcagaccaccugccaggaggucgucaucgcccucgcccaggccaucggccagaccggccgcuucguccucguccagcgccuccgcgagaaggagcgccagcuccucccccaggagugccccgucggcgcccaggccaccugcggccaguucgccuccgacguccaguucguccuccgccgcaccggccccucccucgccggccgccccuccuccgacuccugccccccccccgagcgcugccucauccgcgccucccuccccgucaagccccgcgccgcccucggcugcgagccccgcaagacccucacccccgagcccgcccccucccucucccgccccggccccgccgcccccgucacccccacccccggcugcugcaccgaccuccgcggccucgagcuccgcguccagcgcaacgccgaggagcucggccacgaggccuucugggagcaggagcuccgccgcgagcaggcccgcgagcgcgagggccaggcccgccuccaggcccucuccgccgccaccgccgagcacgccgcccgccuccaggcccucgacgcccaggcccgcgcccucgaggccgagcuccagcucgccgccgaggcccccggcccccccucccccauggccuccgccaccgagcgccuccaccaggaccucgccguccaggagcgccaguccgccgagguccagggcucccucgcccucgucucccgcgcccucgaggccgccgagcgcgcccuccaggcccaggcccaggagcucgaggagcucaaccgcgagcuccgccagugcaaccuccagcaguucauccagcagaccggcgccgcccuccccccccccccccgccccgaccgcggcccccccggcacccaggucggcgucguccucggcggcggcugggagguccgcaccuggcccucccccacccccuccuga

SEQ ID NO: 48574 - RNA, 1260 nt, Artificial Sequence
  derived and/or modified sequence opt2 from RASSF8__Homo_sapiens__NP_001158219
auggagcucaaggucugggucgacggcguccagcgcaucgucugcggcgucaccgaggucaccaccugccaggaggucgucaucgcccucgcccaggccaucggccgcaccggccgcuacacccucaucgagaaguggcgcgacaccgagcgccaccucgccccccacgagaaccccaucaucucccucaacaaguggggccaguacgccuccgacguccagcucauccuccgccgcaccggccccucccucuccgagcgccccaccuccgacuccgucgcccgcauccccgagcgcacccucuaccgccagucccuccccccccucgccaagcuccgcccccagaucgacaaguccaucaagcgccgcgagcccaagcgcaagucccucaccuucaccggcggcgccaagggccucauggacaucuucggcaagggcaaggagaccgaguucaagcagaagguccucaacaacugcaagaccaccgccgacgagcucaagaagcucauccgccuccagaccgagaagcuccaguccaucgagaagcagcucgaguccaacgagaucgagauccgcuucugggagcagaaguacaacuccaaccucgaggaggagaucguccgccucgagcagaagaucaagcgcaacgacgucgagaucgaggaggaggaguucugggagaacgagcuccagaucgagcaggagaacgagaagcagcucaaggaccagcuccaggagauccgccagaagaucaccgagugcgagaacaagcucaaggacuaccucgcccagauccgcaccauggaguccggccucgaggccgagaagcuccagcgcgagguccaggaggcccaggucaacgaggaggaggucaagggcaagaucggcaaggucaagggcgagaucgacauccagggccagcagucccuccgccucgagaacggcaucaaggccgucgagcgcucccucggccaggccaccaagcgccuccaggacaaggagcaggagcucgagcagcucaccaaggagcuccgccaggucaaccuccagcaguucauccagcagaccggcaccaaggucaccguccuccccgccgagcccaucgagaucgaggccucccacgccgacaucgagcgcgaggcccccuuccaguccggcucccucaagcgccccggcuccucccgccagcuccccuccaaccuccgcauccuccagaaccccaucuccuccggcuucaaccccgagggcaucuacgucuga

SEQ ID NO: 48575 - RNA, 555 nt, Artificial Sequence
  derived and/or modified sequence opt2 from RAX2__Homo_sapiens__NP_116142
auguuccucucccccggcgagggccccgccaccgagggcggcggccucggccccggcgaggaggcccccaagaagaagcaccgccgcaaccgcaccaccuucaccaccuaccagcuccaccagcucgagcgcgccuucgaggccucccacuaccccgacgucuacucccgcgaggagcucgccgccaagguccaccuccccgagguccgcguccaggucugguuccagaaccgccgcgccaaguggcgccgccaggagcgccucgaguccggcuccggcgccgucgccgccccccgccuccccgaggcccccgcccuccccuucgcccgcccccccgccaugucccucccccucgagcccuggcucggccccggcccccccgccguccccggccucccccgccuccucggccccggccccggccuccaggccuccuucggcccccacgccuucgcccccaccuucgccgacggcuucgcccucgaggaggccucccuccgccuccucgccaaggagcacgcccaggcccucgaccgcgccuggccccccgccuga

SEQ ID NO: 48576 - RNA, 1041 nt, Artificial Sequence
  derived and/or modified sequence opt2 from RAX__Homo_sapiens__NP_038463
augcaccuccccggcugcgcccccgccauggccgacggcuccuucucccucgccggccaccuccuccgcucccccggcggcuccaccucccgccuccacuccaucgaggccauccucggcuucaccaaggacgacggcauccucggcaccuuccccgccgagcgcggcgcccgcggcgccaaggagcgcgaccgccgccucggcgcccgccccgccugccccaaggcccccgaggagggcuccgagcccucccccccccccgcccccgcccccgcccccgaguacgaggccccccgccccuacugccccaaggagcccggcgaggcccgccccucccccggccuccccgucggccccgccaccggcgaggccaagcucuccgaggaggagcagcccaagaagaagcaccgccgcaaccgcaccaccuucaccaccuaccagcuccacgagcucgagcgcgccuucgagaagucccacuaccccgacgucuacucccgcgaggagcucgccggcaaggucaaccuccccgagguccgcguccaggucugguuccagaaccgccgcgccaaguggcgccgccaggagaagcucgaggucuccuccaugaagcuccaggacuccccccuccucuccuucucccgcuccccccccuccgccacccucuccccccucggcgccggccccggcuccggcggcggccccgccggcggcgcccucccccucgaguccuggcucggccccccccuccccggcggcggcgccaccgcccuccagucccuccccggcuucggcccccccgcccagucccuccccgccuccuacacccccccccccccccccccccccuuccucaacucccccccccucggccccggccuccagccccucgccccccccccccccuccuaccccugcggccccggcuucggcgacaaguucccccucgacgaggccgacccccgcaacuccuccaucgccgcccuccgccucaaggccaaggagcacauccaggccaucggcaagcccuggcaggcccucuga

SEQ ID NO: 48577 - RNA, 4776 nt, Artificial Sequence
  derived and/or modified sequence opt2 from RB1CC1__Homo_sapiens__NP_001077086
augaagcucuacgucuuccucgucaacaccggcaccacccucaccuucgacaccgagcucaccguccagaccgucgccgaccucaagcacgccauccaguccaaguacaagaucgccauccagcaccagguccucgucgucaacggcggcgagugcauggccgccgaccgccgcgucugcaccuacuccgccggcaccgacaccaaccccaucuuccucuucaacaaggagaugauccucugcgaccgcccccccgccauccccaagaccaccuucuccaccgagaacgacauggagaucaaggucgaggagucccucaugaugcccgccgucuuccacaccgucgccucccgcacccagcucgcccucgagauguacgaggucgccaagaagcucugcuccuucugcgagggccucguccacgacgagcaccuccagcaccagggcugggccgccaucauggccaaccucgaggacugcuccaacuccuaccagaagcuccucuucaaguucgaguccaucuacuccaacuaccuccaguccaucgaggacaucaagcucaagcucacccaccucggcaccgccgucuccgucauggccaagaucccccuccucgagugccucacccgccacuccuaccgcgagugccucggccgccucgacucccuccccgagcacgaggacuccgagaaggccgagaugaagcgcuccaccgagcucguccucucccccgacaugccccgcaccaccaacgagucccuccucaccuccuuccccaaguccgucgagcacgucucccccgacaccgccgacgccgaguccggcaaggagauccgcgaguccugccaguccaccguccaccagcaggacgagaccaccaucgacaccaaggacggcgaccuccccuucuucaacgucucccuccucgacuggaucaacguccaggaccgccccaacgacgucgagucccucguccgcaagugcuucgacuccaugucccgccucgacccccgcaucauccgccccuucaucgccgagugccgccagaccaucgccaagcucgacaaccagaacaugaaggccaucaagggccucgaggaccgccucuacgcccucgaccagaugaucgccuccugcggccgccucgucaacgagcagaaggagcucgcccagggcuuccucgccaaccagaagcgcgccgagaaccucaaggacgccuccguccuccccgaccucugccucucccacgccaaccagcucaugaucaugcuccagaaccaccgcaagcuccucgacaucaagcagaagugcaccaccgccaagcaggagcucgccaacaaccuccacguccgccucaaguggugcugcuucgucaugcuccacgccgaccaggacggcgagaagcuccaggcccuccuccgccucgucaucgagcuccucgagcgcgucaagaucgucgaggcccucuccaccgucccccagauguacugccucgccgucgucgaggucguccgccgcaagauguucaucaagcacuaccgcgagugggccggcgcccucgucaaggacggcaagcgccucuacgaggccgagaaguccaagcgcgaguccuucggcaagcucuuccgcaaguccuuccuccgcaaccgccucuuccgcggccucgacuccuggccccccuccuucugcacccagaagccccgcaaguucgacugcgagcuccccgacaucucccucaaggaccuccaguuccuccaguccuucugccccuccgagguccagcccuuccuccgcgucccccuccucugcgacuucgagccccuccaccagcacguccucgcccuccacaaccucgucaaggccgcccagucccucgacgagaugucccagaccaucaccgaccuccucuccgagcagaaggccuccgucucccagaccuccccccaguccgccuccuccccccgcauggaguccaccgccggcaucaccaccaccaccuccccccgcaccccccccccccucaccguccaggacccccucugccccgccgucugcccccucgaggagcucucccccgacuccaucgacgcccacaccuucgacuucgagaccaucccccaccccaacaucgagcagaccauccaccaggucucccucgaccucgacucccucgccgagucccccgaguccgacuucauguccgccgucaacgaguucgucaucgaggagaaccucuccucccccaaccccaucuccgacccccagucccccgagaugauggucgagucccucuacuccuccgucaucaacgccaucgacucccgccgcaugcaggacaccaacgucugcggcaaggaggacuucggcgaccacaccucccucaacguccagcucgagcgcugccgcgucgucgcccaggacucccacuucuccauccagaccaucaaggaggaccucugccacuuccgcaccuucguccagaaggagcagugcgacuucuccaacucccucaagugcaccgccgucgagauccgcaacaucaucgagaaggucaagugcucccucgagaucacccucaaggagaagcaccagaaggagcuccucucccucaagaacgaguacgagggcaagcucgacggccucaucaaggagaccgaggagaacgagaacaagaucaagaagcucaagggcgagcucgucugccucgaggagguccuccagaacaaggacaacgaguucgcccucgucaagcacgagaaggaggccgucaucugccuccagaacgagaaggaccagaagcuccucgagauggagaacaucaugcacucccagaacugcgagaucaaggagcucaagcagucccgcgagaucguccucgaggaccucaagaagcuccacgucgagaacgacgagaagcuccagcuccuccgcgccgagcuccagucccucgagcagucccaccucaaggagcucgaggacacccuccagguccgccacauccaggaguucgagaaggucaugaccgaccaccgcgucucccucgaggagcucaagaaggagaaccagcagaucaucaaccagauccaggagucccacgccgagaucauccaggagaaggagaagcagcuccaggagcucaagcucaaggucuccgaccucuccgacacccgcugcaagcucgaggucgagcucgcccucaaggaggccgagaccgacgagaucaagauccuccucgaggagucccgcgcccagcagaaggagacccucaagucccuccucgagcaggagaccgagaaccuccgcaccgagaucuccaagcucaaccagaagauccaggacaacaacgagaacuaccaggucggccucgccgagcuccgcacccucaugaccaucgagaaggaccagugcaucuccgagcucaucucccgccacgaggaggaguccaacauccucaaggccgagcucaacaaggucaccucccuccacaaccaggccuucgagaucgagaagaaccucaaggagcagaucaucgagcuccaguccaagcucgacuccgagcucuccgcccucgagcgccagaaggacgagaagaucacccagcaggaggagaaguacgaggccaucauccagaaccucgagaaggaccgccagaagcucgucuccucccaggagcaggaccgcgagcagcucauccagaagcucaacugcgagaaggacgaggccauccagaccgcccucaaggaguucaagcucgagcgcgaggucgucgagaaggagcuccucgagaaggucaagcaccucgagaaccagaucgccaagucccccgccaucgacuccacccgcggcgacuccuccucccucgucgccgagcuccaggagaagcuccaggaggagaaggccaaguuccucgagcagcucgaggagcaggagaagcgcaagaacgaggagaugcagaacguccgcaccucccucaucgccgagcagcagaccaacuucaacaccguccucacccgcgagaagaugcgcaaggagaacaucaucaacgaccucuccgacaagcucaaguccaccaugcagcagcaggagcgcgacaaggaccucaucgagucccucuccgaggaccgcgcccgccuccucgaggagaagaagaagcucgaggaggaggucuccaagcuccgcuccuccuccuucguccccucccccuacgucgccaccgcccccgagcucuacggcgccugcgcccccgagcuccccggcgaguccgaccgcuccgccgucgagaccgccgacgagggccgcgucgacuccgccauggagaccuccaugauguccguccaggagaacauccacaugcucuccgaggagaagcagcgcaucaugcuccucgagcgcacccuccagcucaaggaggaggagaacaagcgccucaaccagcgccucaugucccaguccauguccuccgucuccucccgccacuccgagaagaucgccauccgcgacuuccaggucggcgaccucguccucaucauccucgacgagcgccacgacaacuacguccucuucaccgucucccccacccucuacuuccuccacuccgagucccuccccgcccucgaccucaagcccgccuccggcgccucccgccgccccuggguccucggcaaggucauggagaaggaguacugccaggccaagaaggcccagaaccgcuucaaggucccccucggcaccaaguucuaccgcgucaaggccgucuccuggaacaagaaggucuga

SEQ ID NO: 48578 - RNA, 2787 nt, Artificial Sequence
  derived and/or modified sequence opt2 from RB1__Homo_sapiens__NP_000312
augccccccaagaccccccgcaagaccgccgccaccgccgccgccgccgccgccgagccccccgcccccccccccccccccccccccgaggaggaccccgagcaggacuccggccccgaggaccucccccucguccgccucgaguucgaggagaccgaggagcccgacuucaccgcccucugccagaagcucaagauccccgaccacguccgcgagcgcgccuggcucaccugggagaaggucuccuccgucgacggcguccucggcggcuacauccagaagaagaaggagcucuggggcaucugcaucuucaucgccgccgucgaccucgacgagauguccuucaccuucaccgagcuccagaagaacaucgagaucuccguccacaaguucuucaaccuccucaaggagaucgacaccuccaccaaggucgacaacgccaugucccgccuccucaagaaguacgacguccucuucgcccucuucuccaagcucgagcgcaccugcgagcucaucuaccucacccagcccuccuccuccaucuccaccgagaucaacuccgcccucguccucaaggucuccuggaucaccuuccuccucgccaagggcgagguccuccagauggaggacgaccucgucaucuccuuccagcucaugcucugcguccucgacuacuucaucaagcucuccccccccaugcuccucaaggagcccuacaagaccgccgucauccccaucaacggcuccccccgcaccccccgccgcggccagaaccgcuccgcccgcaucgccaagcagcucgagaacgacacccgcaucaucgagguccucugcaaggagcacgagugcaacaucgacgaggucaagaacgucuacuucaagaacuucauccccuucaugaacucccucggccucgucaccuccaacggccuccccgaggucgagaaccucuccaagcgcuacgaggagaucuaccucaagaacaaggaccucgacgcccgccucuuccucgaccacgacaagacccuccagaccgacuccaucgacuccuucgagacccagcgcaccccccgcaaguccaaccucgacgaggaggucaacgucauccccccccacacccccguccgcaccgucaugaacaccauccagcagcucaugaugauccucaacuccgccuccgaccagcccuccgagaaccucaucuccuacuucaacaacugcaccgucaaccccaaggaguccauccucaagcgcgucaaggacaucggcuacaucuucaaggagaaguucgccaaggccgucggccagggcugcgucgagaucggcucccagcgcuacaagcucggcguccgccucuacuaccgcgucauggaguccaugcucaaguccgaggaggagcgccucuccauccagaacuucuccaagcuccucaacgacaacaucuuccacaugucccuccucgccugcgcccucgaggucgucauggccaccuacucccgcuccaccucccagaaccucgacuccggcaccgaccucuccuuccccuggauccucaacguccucaaccucaaggccuucgacuucuacaaggucaucgaguccuucaucaaggccgagggcaaccucacccgcgagaugaucaagcaccucgagcgcugcgagcaccgcaucauggagucccucgccuggcucuccgacuccccccucuucgaccucaucaagcaguccaaggaccgcgagggccccaccgaccaccucgaguccgccugcccccucaaccucccccuccagaacaaccacaccgccgccgacauguaccucucccccguccgcucccccaagaagaagggcuccaccacccgcgucaacuccaccgccaacgccgagacccaggccaccuccgccuuccagacccagaagccccucaaguccaccucccucucccucuucuacaagaaggucuaccgccucgccuaccuccgccucaacacccucugcgagcgccuccucuccgagcaccccgagcucgagcacaucaucuggacccucuuccagcacacccuccagaacgaguacgagcucaugcgcgaccgccaccucgaccagaucaugaugugcuccauguacggcaucugcaaggucaagaacaucgaccucaaguucaagaucaucgucaccgccuacaaggaccucccccacgccguccaggagaccuucaagcgcguccucaucaaggaggaggaguacgacuccaucaucgucuucuacaacuccgucuucaugcagcgccucaagaccaacauccuccaguacgccuccacccgcccccccacccucucccccaucccccacaucccccgcucccccuacaaguuccccuccuccccccuccgcauccccggcggcaacaucuacaucuccccccucaagucccccuacaagaucuccgagggccuccccacccccaccaagaugaccccccgcucccgcauccucgucuccaucggcgaguccuucggcaccuccgagaaguuccagaagaucaaccagauggucugcaacuccgaccgcguccucaagcgcuccgccgagggcuccaacccccccaagccccucaagaagcuccgcuucgacaucgagggcuccgacgaggccgacggcuccaagcaccuccccggcgaguccaaguuccagcagaagcucgccgagaugaccuccacccgcacccgcaugcagaagcagaagaugaacgacuccauggacaccuccaacaaggaggagaaguga

SEQ ID NO: 48579 - RNA, 2145 nt, Artificial Sequence
  derived and/or modified sequence opt2 from RBAK__Homo_sapiens__NP_066986
augaacacccuccagggccccgucuccuucaaggacgucgccgucgacuucacccaggaggaguggcagcagcucgaccccgacgagaagaucaccuaccgcgacgucaugcucgagaacuacucccaccucgucuccgucggcuacgacaccaccaagcccaacgucaucaucaagcucgagcagggcgaggagcccuggaucaugggcggcgaguuccccugccagcacucccccgaggccuggcgcgucgacgaccucaucgagcgcauccaggagaacgaggacaagcacucccgccaggccgccugcaucaacuccaagacccucaccgaggagaaggagaacaccuucucccagaucuacauggagaccucccucguccccuccuccaucaucgcccacaacugcgucuccugcggcaagaaccucgaguccaucucccagcucaucuccuccgacggcuccuacgcccgcaccaagcccgacgagugcaacgagugcggcaagaccuaccacggcgagaagaugugcgaguucaaccagaacggcgacaccuacucccacaacgaggagaacauccuccagaagaucuccauccucgagaagcccuucgaguacaacgagugcauggaggcccucgacaacgaggccgucuucaucgcccacaagcgcgccuacaucggcgagaagcccuacgaguggaacgacuccggccccgacuucauccagauguccaacuucaacgccuaccagcgcucccagauggagaugaagcccuucgagugcuccgagugcggcaaguccuucugcaagaaguccaaguucaucauccaccagcgcgcccacaccggcgagaagcccuacgagugcaacgucugcggcaaguccuucucccagaagggcacccucaccguccaccgccgcucccaccucgaggagaagcccuacaagugcaacgagugcggcaagaccuucugccagaagcuccaccucacccagcaccuccgcacccacuccggcgagaagcccuacgagugcuccgagugcggcaagaccuucugccagaagacccaccucacccuccaccagcgcaaccacuccggcgagcgccccuaccccugcaacgagugcggcaaguccuucucccgcaaguccgcccucuccgaccaccagcgcacccacaccggcgagaagcucuacaagugcaacgagugcggcaaguccuacuaccgcaaguccacccucaucacccaccagcgcacccacaccggcgagaagcccuaccagugcuccgagugcggcaaguucuucucccgcgucuccuaccucaccauccacuaccgcucccaccucgaggagaagcccuacgagugcaacgagugcggcaagaccuucaaccucaacuccgccuucauccgccaccgcaagguccacaccgaggagaagucccacgagugcuccgagugcggcaaguucucccagcucuaccucaccgaccaccacaccgcccaccucgaggagaagcccuacgagugcaacgagugcggcaagaccuuccucgucaacuccgccuucgacggccaccagccccuccccaagggcgagaaguccuacgagugcaacgucugcggcaagcucuucaacgagcucuccuacuacaccgagcacuaccgcucccacuccgaggagaagcccuacggcugcuccgagugcggcaagaccuucucccacaacuccucccucuuccgccaccagcgcguccacaccggcgagaagcccuacgagugcuacgagugcggcaaguucuucucccagaaguccuaccucaccauccaccaccgcauccacuccggcgagaagcccuacgagugcuccaagugcggcaaggucuucucccgcauguccaaccucaccguccacuaccgcucccacuccggcgagaagcccuacgagugcaacgagugcggcaaggucuucucccagaaguccuaccucaccguccacuaccgcacccacuccggcgagaagcccuacgagugcaacgagugcggcaagaaguuccaccaccgcuccgccuucaacucccaccagcgcauccaccgccgcggcaacaugaacguccucgacgucgagaaccucuga

SEQ ID NO: 48580 - RNA, 1503 nt, Artificial Sequence
  derived and/or modified sequence opt2 from RBBP5__Homo_sapiens__NP_001180201
augaaccucgagcuccucgaguccuucggccagaacuaccccgaggaggccgacggcacccucgacugcaucuccauggcccucaccugcaccuucaaccgcuggggcacccuccucgccgucggcugcaacgacggccgcaucgucaucugggacuuccucacccgcggcaucgccaagaucaucuccgcccacauccaccccgucugcucccucugcuggucccgcgacggccacaagcucgucuccgccuccaccgacaacaucgucucccagugggacguccucuccggcgacugcgaccagcgcuuccgcuuccccucccccauccucaagguccaguaccacccccgcgaccagaacaagguccucgucugccccaugaaguccgcccccgucaugcucacccucuccgacuccaagcacgucguccuccccgucgacgacgacuccgaccucaacgucgucgccuccuucgaccgccgcggcgaguacaucuacaccggcaacgccaagggcaagauccucguccucaagaccgacucccaggaccucgucgccuccuuccgcgucaccaccggcaccuccaacaccaccgccaucaaguccaucgaguucgcccgcaagggcuccugcuuccucaucaacaccgccgaccgcaucauccgcgucuacgacggccgcgagauccucaccugcggccgcgacggcgagcccgagcccaugcagaagcuccaggaccucgucaaccgcacccccuggaagaagugcugcuucuccggcgacggcgaguacaucgucgccggcuccgcccgccagcacgcccucuacaucugggagaaguccaucggcaaccucgucaagauccuccacggcacccgcggcgagcuccuccucgacgucgccuggcaccccguccgccccaucaucgccuccaucuccuccggcgucgucuccaucugggcccagaaccaggucgagaacugguccgccuucgcccccgacuucaaggagcucgacgagaacgucgaguacgaggagcgcgaguccgaguucgacaucgaggacgaggacaaguccgagcccgagcagaccggcgccgacgccgccgaggacgaggaggucgacgucaccuccgucgaccccaucgccgccuucugcuccuccgacgaggagcucgaggacuccaaggcccuccucuaccuccccaucgcccccgaggucgaggaccccgaggagaaccccuacggccccccccccgacgccguccagaccucccucauggacgagggcgccuccuccgagaagaagcgccaguccuccgccgacggcucccagccccccaagaagaagcccaagaccaccaacaucgagcuccagggcguccccaacgacgagguccacccccuccucggcgucaagggcgacggcaaguccaagaagaagcaggccggccgccccaagggcuccaaggccggcggcgccaucuccgagcuccucuga

SEQ ID NO: 48581 - RNA, 5379 nt, Artificial Sequence
  derived and/or modified sequence opt2 from RBBP6__Homo_sapiens__NP_008841
auguccugcguccacuacaaguucuccuccaagcucaacuacgacaccgucaccuucgacggccuccacaucucccucugcgaccucaagaagcagaucaugggccgcgagaagcucaaggccgccgacugcgaccuccagaucaccaacgcccagaccaaggaggaguacaccgacgacaacgcccucauccccaagaacuccuccgucaucguccgccgcauccccaucggcggcgucaaguccaccuccaagaccuacgucaucucccgcaccgagcccgccauggccaccaccaaggccaucgacgacuccuccgccuccaucucccucgcccagcucaccaagaccgccaaccucgccgaggccaacgccuccgaggaggacaagaucaaggccaugaugucccaguccggccacgaguacgaccccaucaacuacaugaagaagccccucggcccccccccccccuccuacaccugcuuccgcugcggcaagcccggccacuacaucaagaacugccccaccaacggcgacaagaacuucgaguccggcccccgcaucaagaaguccaccggcaucccccgcuccuucaugauggaggucaaggaccccaacaugaagggcgccaugcucaccaacaccggcaaguacgccauccccaccaucgacgccgaggccuacgccaucggcaagaaggagaagccccccuuccuccccgaggagcccuccuccuccuccgaggaggacgaccccauccccgacgagcuccucugccucaucugcaaggacaucaugaccgacgccgucgucauccccugcugcggcaacuccuacugcgacgagugcauccgcaccgcccuccucgaguccgacgagcacaccugccccaccugccaccagaacgacgucucccccgacgcccucaucgccaacaaguuccuccgccaggccgucaacaacuucaagaacgagaccggcuacaccaagcgccuccgcaagcagcucccccccccccccccccccaucccccccccccgcccccucauccagcgcaaccuccagccccucaugcgcucccccaucucccgccagcaggacccccucaugauccccgucaccuccuccuccacccaccccgcccccuccaucuccucccucaccuccaaccaguccucccucgccccccccgucuccggcaaccccuccuccgcccccgcccccguccccgacaucaccgccaccgucuccaucuccguccacuccgagaaguccgacggccccuuccgcgacuccgacaacaagauccuccccgccgccgcccucgccuccgagcacuccaagggcaccuccuccaucgccaucaccgcccucauggaggagaagggcuaccagguccccguccucggcacccccucccuccucggccagucccuccuccacggccagcucauccccaccaccggccccguccgcaucaacaccgcccgccccggcggcggccgccccggcugggagcacuccaacaagcucggcuaccucgucucccccccccagcagauccgccgcggcgagcgcuccugcuaccgcuccaucaaccgcggccgccaccacuccgagcgcucccagcgcacccagggccccucccuccccgccacccccgucuucguccccguccccccccccccccucuaccccccccccccccacacccucccccucccccccggcgucccccccccccaguucuccccccaguucccccccggccagcccccccccgccggcuacuccguccccccccccggcuucccccccgcccccgccaaccucuccacccccugggucuccuccggcguccagaccgcccacuccaacaccauccccaccacccaggcccccccccucucccgcgaggaguucuaccgcgagcagcgccgccucaaggaggaggagaagaagaaguccaagcucgacgaguucaccaacgacuucgccaaggagcucauggaguacaagaagauccagaaggagcgccgccgcuccuucucccgcuccaagucccccuacuccggcuccuccuacucccgcuccuccuacaccuacuccaagucccgcuccggcuccacccgcucccgcuccuacucccgcuccuucucccgcucccacucccgcuccuacucccgcuccccccccuacccccgccgcggccgcggcaagucccgcaacuaccgcucccgcucccgcucccacggcuaccaccgcucccgcucccgcuccccccccuaccgccgcuaccacucccgcucccgcuccccccaggccuuccgcggccagucccccaacaagcgcaacgucccccagggcgagaccgagcgcgaguacuucaaccgcuaccgcgagguccccccccccuacgacaugaaggccuacuacggccgcuccgucgacuuccgcgaccccuucgagaaggagcgcuaccgcgagugggagcgcaaguaccgcgagugguacgagaaguacuacaagggcuacgccgccggcgcccagccccgccccuccgccaaccgcgagaacuucucccccgagcgcuuccucccccucaacauccgcaacucccccuucacccgcggccgccgcgaggacuacgucggcggccagucccaccgcucccgcaacaucggcuccaacuaccccgagaagcucuccgcccgcgacggccacaaccagaaggacaacaccaaguccaaggagaaggaguccgagaacgcccccggcgacggcaagggcaacaagcacaagaagcaccgcaagcgccgcaagggcgaggaguccgagggcuuccucaaccccgagcuccucgagaccucccgcaagucccgcgagcccaccggcgucgaggagaacaagaccgacucccucuucguccuccccucccgcgacgacgccacccccguccgcgacgagcccauggacgccgaguccaucaccuucaaguccgucuccgagaaggacaagcgcgagcgcgacaagcccaaggccaagggcgacaagaccaagcgcaagaacgacggcuccgccgucuccaagaaggagaacaucgucaagcccgccaagggcccccaggagaaggucgacggcgagcgcgagcgcuccccccgcuccgagccccccaucaagaaggccaaggaggagacccccaagaccgacaacaccaaguccuccuccuccucccagaaggacgagaagaucaccggcaccccccgcaaggcccacuccaaguccgccaaggagcaccaggagaccaagcccgucaaggaggagaaggucaagaaggacuacuccaaggacgucaaguccgagaagcucaccaccaaggaggagaaggccaagaagcccaacgagaagaacaagccccucgacaacaagggcgagaagcgcaagcgcaagaccgaggagaagggcgucgacaaggacuucgaguccuccuccaugaagaucuccaagcucgaggucaccgagaucgucaagcccucccccaagcgcaagauggagcccgacaccgagaagauggaccgcacccccgagaaggacaagaucucccucuccgcccccgccaagaagaucaagcucaaccgcgagaccggcaagaagaucggcuccaccgagaacaucuccaacaccaaggagcccuccgagaagcucgaguccaccuccuccaaggucaagcaggagaaggucaagggcaagguccgccgcaaggucaccggcaccgagggcuccuccuccacccucgucgacuacaccuccaccuccuccaccggcggcucccccguccgcaaguccgaggagaagaccgacaccaagcgcaccgucaucaagaccauggaggaguacaacaacgacaacaccgcccccgccgaggacgucaucaucaugauccaggucccccaguccaagugggacaaggacgacuucgaguccgaggaggaggacgucaaguccacccagcccaucuccuccgucggcaagcccgccuccgucaucaagaacgucuccaccaagcccuccaacaucgucaaguaccccgagaaggaguccgagcccuccgagaagauccagaaguucaccaaggacgucucccacgagaucauccagcacgaggucaaguccuccaagaacuccgccuccuccgagaagggcaagaccaaggaccgcgacuacuccguccucgagaaggagaaccccgagaagcgcaagaacuccacccagcccgagaaggaguccaaccucgaccgccucaacgagcagggcaacuucaagucccucucccaguccuccaaggaggcccgcaccuccgacaagcacgacuccacccgcgccuccuccaacaaggacuucacccccaaccgcgacaagaagaccgacuacgacacccgcgaguacuccuccuccaagcgccgcgacgagaagaacgagcucacccgccgcaaggacucccccucccgcaacaaggacuccgccuccggccagaagaacaagccccgcgaggagcgcgaccuccccaagaagggcaccggcgacuccaagaaguccaacuccucccccucccgcgaccgcaagccccacgaccacaaggccaccuacgacaccaagcgccccaacgaggagaccaaguccgucgacaagaaccccugcaaggaccgcgagaagcacguccucgaggcccgcaacaacaaggaguccuccggcaacaagcuccucuacauccucaacccccccgagacccaggucgagaaggagcagaucaccggccagaucgacaaguccaccgucaagcccaagccccagcucucccacuccucccgccucuccuccgaccucacccgcgagaccgacgaggccgccuucgagcccgacuacaacgaguccgacuccgaguccaacgucuccgucaaggaggaggaguccuccggcaacaucuccaaggaccucaaggacaagaucgucgagaaggccaaggagucccucgacaccgccgccgucguccaggucggcaucucccgcaaccagucccacuccucccccuccgucucccccucccgcucccacucccccuccggcucccagacccgcucccacuccuccuccgccuccuccgccgagucccaggacuccaagaagaagaagaagaagaaggagaagaagaagcacaagaagcacaagaagcacaagaagcacaagaagcacgccggcaccgaggucgagcucgagaagucccagaagcacaagcacaagaagaagaaguccaagaagaacaaggacaaggagaaggagaaggagaaggacgaccagaaggucaaguccgucaccgucuga

SEQ ID NO: 48582 - RNA, 1410 nt, Artificial Sequence
  derived and/or modified sequence opt2 from RBBP7__Homo_sapiens__NP_001185648
auggccgccgaggccggcgucgucggcgccggcgccucccccgacggcgacuggcgcgaccaggccugcggccuccuccuccacguccaccucuccucccgccucggccgcgccgcccccguccgcaccggccgccaccuccgcaccgucuucgaggacaccgucgaggagcgcgucaucaacgaggaguacaagaucuggaagaagaacacccccuuccucuacgaccucgucaugacccacgcccuccaguggcccucccucaccguccaguggcuccccgaggucaccaagcccgagggcaaggacuacgcccuccacuggcucguccucggcacccacaccuccgacgagcagaaccaccucgucgucgcccgcguccacauccccaacgacgacgcccaguucgacgccucccacugcgacuccgacaagggcgaguucggcggcuucggcuccgucaccggcaagaucgagugcgagaucaagaucaaccacgagggcgaggucaaccgcgcccgcuacaugccccagaacccccacaucaucgccaccaagacccccuccuccgacguccucgucuucgacuacaccaagcaccccgccaagcccgaccccuccggcgagugcaaccccgaccuccgccuccgcggccaccagaaggagggcuacggccucuccuggaacuccaaccucuccggccaccuccucuccgccuccgacgaccacaccgucugccucugggacaucaacgccggccccaaggagggcaagaucgucgacgccaaggccaucuucaccggccacuccgccgucgucgaggacgucgccuggcaccuccuccacgagucccucuucggcuccgucgccgacgaccagaagcucaugaucugggacacccgcuccaacaccaccuccaagcccucccaccucgucgacgcccacaccgccgaggucaacugccucuccuucaaccccuacuccgaguucauccucgccaccggcuccgccgacaagaccgucgcccucugggaccuccgcaaccucaagcucaagcuccacaccuucgagucccacaaggacgagaucuuccagguccacugguccccccacaacgagaccauccucgccuccuccggcaccgaccgccgccucaacgucugggaccucuccaagaucggcgaggagcaguccgccgaggacgccgaggacggcccccccgagcuccucuucauccacggcggccacaccgccaagaucuccgacuucuccuggaaccccaacgagcccugggucaucugcuccgucuccgaggacaacaucaugcagaucuggcagauggccgagaacaucuacaacgacgaggaguccgacgucaccaccuccgagcucgagggccagggcuccuga

SEQ ID NO: 48583 - RNA, 2604 nt, Artificial Sequence
  derived and/or modified sequence opt2 from RBBP8__Homo_sapiens__NP_976037
augaacaucuccggcuccuccugcggcucccccaacuccgccgacaccuccuccgacuucaaggaccucuggaccaagcucaaggagugccacgaccgcgagguccagggccuccaggucaaggucaccaagcucaagcaggagcgcauccucgacgcccagcgccucgaggaguucuucaccaagaaccagcagcuccgcgagcagcagaagguccuccacgagaccaucaagguccucgaggaccgccuccgcgccggccucugcgaccgcugcgccgucaccgaggagcacaugcgcaagaagcagcaggaguucgagaacauccgccagcagaaccucaagcucaucaccgagcucaugaacgagcgcaacacccuccaggaggagaacaagaagcucuccgagcagcuccagcagaagaucgagaacgaccagcagcaccaggccgccgagcucgagugcgaggaggacgucauccccgacucccccaucaccgccuucuccuucuccggcgucaaccgccuccgccgcaaggagaacccccacguccgcuacaucgagcagacccacaccaagcucgagcacuccgucugcgccaacgagaugcgcaaggucuccaaguccuccacccacccccagcacaaccccaacgagaacgagauccucgucgccgacaccuacgaccagucccagucccccauggccaaggcccacggcaccuccuccuacacccccgacaaguccuccuucaaccucgccaccgucgucgccgagacccucggccucggcguccaggaggaguccgagacccagggccccauguccccccucggcgacgagcucuaccacugccucgagggcaaccacaagaagcagcccuucgaggaguccacccgcaacaccgaggacucccuccgcuucuccgacuccaccuccaagacccccccccaggaggagcuccccacccgcgucuccucccccgucuucggcgccaccuccuccaucaaguccggccucgaccucaacaccucccucucccccucccuccuccagcccggcaagaagaagcaccucaagacccuccccuucuccaacaccugcaucucccgccucgagaagacccgcuccaaguccgaggacuccgcccucuucacccaccacucccucggcuccgaggucaacaagaucaucauccaguccuccaacaagcagauccucaucaacaagaacaucuccgagucccucggcgagcagaaccgcaccgaguacggcaaggacuccaacaccgacaagcaccucgagccccucaagucccucggcggccgcaccuccaagcgcaagaagaccgaggaggaguccgagcacgaggucuccugcccccaggccuccuucgacaaggagaacgccuuccccuuccccauggacaaccaguucuccaugaacggcgacugcgucauggacaagccccucgaccucuccgaccgcuucuccgccauccagcgccaggagaagucccagggcuccgagaccuccaagaacaaguuccgccaggucacccucuacgaggcccucaagaccauccccaagggcuucuccuccucccgcaaggccuccgacggcaacugcacccuccccaaggacucccccggcgagcccugcucccaggagugcaucauccuccagccccucaacaagugcucccccgacaacaagcccucccuccagaucaaggaggagaacgccgucuucaagaucccccuccgcccccgcgagucccucgagaccgagaacguccucgacgacaucaaguccgccggcucccacgagcccaucaagauccagacccgcuccgaccacggcggcugcgagcucgccuccguccuccagcucaaccccugccgcaccggcaagaucaagucccuccagaacaaccaggacgucuccuucgagaacauccagugguccaucgaccccggcgccgaccucucccaguacaagauggacgucaccgucaucgacaccaaggacggcucccaguccaagcucggcggcgagaccgucgacauggacugcacccucgucuccgagaccguccuccucaagaugaagaagcaggagcagaagggcgagaaguccuccaacgaggagcgcaagaugaacgacucccucgaggacauguucgaccgcaccacccacgaggaguacgaguccugccucgccgacuccuucucccaggccgccgacgaggaggaggagcucuccaccgccaccaagaagcuccacacccacggcgacaagcaggacaaggucaagcagaaggccuucgucgagcccuacuucaagggcgacgaguccaucaugcagaucugccagcagaagaaggagaagcgcaacuggcuccccgcccaggacaccgacuccgccaccuuccaccccacccaccagcgcaucuucggcaagcucgucuuccucccccuccgccucgucuggaaggaggucauccuccgcaagauccucauccucguccucguccagaaggacgucucccucaccacccaguacuuccuccagaaggcccgcucccgccgccaccgccgcuga

SEQ ID NO: 48584 - RNA, 561 nt, Artificial Sequence
  derived and/or modified sequence opt2 from RBBP9__Homo_sapiens__NP_006597
auggccucccccuccaaggccgucaucguccccggcaacggcggcggcgacgucaccacccacggcugguacggcugggucaagaaggagcucgagaagauccccggcuuccagugccucgccaagaacaugcccgaccccaucaccgcccgcgaguccaucuggcuccccuucauggagaccgagcuccacugcgacgagaagaccaucaucaucggccacuccuccggcgccaucgccgccaugcgcuacgccgagacccaccgcgucuacgccaucguccucgucuccgccuacaccuccgaccucggcgacgagaacgagcgcgccuccggcuacuucacccgccccuggcagugggagaagaucaaggccaacugccccuacaucguccaguucggcuccaccgacgaccccuuccuccccuggaaggagcagcaggaggucgccgaccgccucgagaccaagcuccacaaguucaccgacugcggccacuuccagaacaccgaguuccacgagcucaucaccgucgucaagucccuccucaagguccccgccuga

SEQ ID NO: 48585 - RNA, 1407 nt, Artificial Sequence
  derived and/or modified sequence opt2 from RBCK1__Homo_sapiens__NP_006453
augggcaccgccacccccgacggccgcgaggaccaggagcgccucugggucuccgucgaggacgcccagaugcacaccgucaccaucuggcucaccguccgccccgacaugaccgucgccucccucaaggacauggucuuccucgacuacggcuucccccccguccuccagcagugggucaucggccagcgccucgcccgcgaccaggagacccuccacucccacggcguccgccagaacggcgacuccgccuaccucuaccuccucuccgcccgcaacaccucccucaacccccaggagcuccagcgcgagcgccagcuccgcaugcucgaggaccucggcuucaaggaccucacccuccagccccgcggcccccucgagcccggcccccccaagcccggcgucccccaggagcccggccgcggccagcccgacgccguccccgagcccccccccgucggcuggcagugccccggcugcaccuucaucaacaagcccacccgccccggcugcgagaugugcugccgcgcccgccccgaggccuaccagguccccgccuccuaccagcccgacgaggaggagcgcgcccgccucgccggcgaggaggaggcccuccgccaguaccagcagcgcaagcagcagcagcaggagggcaacuaccuccagcacguccagcucgaccagcgcucccucguccucaacaccgagcccgccgagugccccgucugcuacuccguccucgcccccggcgaggccgucguccuccgcgagugccuccacaccuucugccgcgagugccuccagggcaccauccgcaacucccaggaggccgaggucuccugccccuucaucgacaacaccuacuccugcuccggcaagcuccucgagcgcgagaucaaggcccuccucacccccgaggacuaccagcgcuuccucgaccucggcaucuccaucgccgagaaccgcuccgccuucuccuaccacugcaagacccccgacugcaagggcuggugcuucuucgaggacgacgucaacgaguucaccugccccgucugcuuccacgucaacugccuccucugcaaggccauccacgagcagaugaacugcaaggaguaccaggaggaccucgcccuccgcgcccagaacgacgucgccgcccgccagaccaccgagaugcucaaggucaugcuccagcagggcgaggccaugcgcugcccccagugccagaucgucguccagaagaaggacggcugcgacuggauccgcugcaccgucugccacaccgagaucugcugggucaccaagggcccccgcuggggccccggcggccccggcgacaccuccggcggcugccgcugccgcgucaacggcauccccugccaccccuccugccagaacugccacuga

SEQ ID NO: 48586 - RNA, 1113 nt, Artificial Sequence
  derived and/or modified sequence opt2 from RBFOX1__Homo_sapiens__NP_001135805
augaacugcgagcgcgagcagcuccgcggcaaccaggaggccgccgccgcccccgacaccauggcccagcccuacgccuccgcccaguucgcccccccccagaacggcauccccgccgaguacaccgccccccacccccaccccgcccccgaguacaccggccagaccaccguccccgagcacacccucaaccucuacccccccgcccagacccacuccgagcagucccccgccgacaccuccgcccagaccgucuccggcaccgccacccagaccgacgacgccgcccccaccgacggccagccccagacccagcccuccgagaacaccgagaacaagucccagcccaagcgccuccacgucuccaacauccccuuccgcuuccgcgaccccgaccuccgccagauguucggccaguucggcaagauccucgacgucgagaucaucuucaacgagcgcggcuccaagggcuucggcuucgucaccuucgagaacuccgccgacgccgaccgcgcccgcgagaagcuccacggcaccgucgucgagggccgcaagaucgaggucaacaacgccaccgcccgcgucaugaccaacaagaagaccgucaaccccuacaccaacggcuggaagcucaaccccgucgucggcgccgucuacucccccgaguucuacgccguccccggcuuccccuaccccgccgccaccgccgccgccgccuaccgcggcgcccaccuccgcggccgcggccgcaccgucuacaacaccuuccgcgccgccgccccccccccccccauccccgccuacggcggcgucgucuaccaggacggcuucuacggcgccgacaucuacggcggcuacgccgccuaccgcuacgcccagcccacccccgccaccgccgccgccuacuccgacuccuacggccgcgucuacgccgccgaccccuaccaccacgcccucgcccccgcccccaccuacggcgucggcgccaugaacgccuucgccccccucaccgacgccaagacccgcucccacgccgacgacgucggccucguccucuccucccuccaggccuccaucuaccgcggcggcuacaaccgcuucgcccccuacuga

SEQ ID NO: 48587 - RNA, 1143 nt, Artificial Sequence
  derived and/or modified sequence opt2 from RBFOX2__Homo_sapiens__NP_001026865
auggagaagaagaagauggucacccagggcaaccaggagcccaccaccacccccgacgccaugguccagcccuucaccaccauccccuuccccccccccccccagaacggcauccccaccgaguacggcgucccccacacccaggacuacgccggccagaccggcgagcacaaccucacccucuacggcuccacccaggcccacggcgagcaguccuccaacucccccuccacccagaacggcucccucaccaccgagggcggcgcccagaccgacggccagcagucccagacccaguccuccgagaacuccgaguccaaguccacccccaagcgccuccacgucuccaacauccccuuccgcuuccgcgaccccgaccuccgccagauguucggccaguucggcaagauccucgacgucgagaucaucuucaacgagcgcggcuccaagggcuucggcuucgucaccuucgagaacuccgccgacgccgaccgcgcccgcgagaagcuccacggcaccgucgucgagggccgcaagaucgaggucaacaacgccaccgcccgcgucaugaccaacaagaagauggucacccccuacgccaacggcuggaagcucucccccgucgucggcgccgucuacggccccgagcucuacgccgccuccuccuuccaggccgacgucucccucggcaacgacgccgccgucccccucuccggccgcggcggcaucaacaccuacaucccccucaucucccucccccucguccccggcuuccccuaccccaccgccgccaccaccgccgccgccuuccgcggcgcccaccuccgcggccgcggccgcaccgucuacggcgccguccgcgccgucccccccaccgccauccccgccuaccccggcgucgucuaccaggacggcuucuacggcgccgaccucuacggcggcuacgccgccuaccgcuacgcccagcccgccaccgccaccgccgccaccgccgccgccgccgccgccgccgccuacuccgacggcuacggccgcgucuacaccgccgaccccuaccacgcccucgcccccgccgccuccuacggcgucggcgccgucgccucccucuaccgcggcggcuacucccgcuucgcccccuacuga

SEQ ID NO: 48588 - RNA, 939 nt, Artificial Sequence
  derived and/or modified sequence opt2 from RBFOX3__Homo_sapiens__NP_001076044
auggcccagcccuacccccccgcccaguaccccccccccccccagaacggcauccccgccgaguacgcccccccccccccccaccccacccaggacuacuccggccagacccccguccccaccgagcacggcaugacccucuacacccccgcccagacccaccccgagcagcccggcuccgaggccuccacccagcccaucgccggcacccagaccgucccccagaccgacgaggccgcccagaccgacucccagccccuccaccccuccgaccccaccgagaagcagcagcccaagcgccuccacgucuccaacauccccuuccgcuuccgcgaccccgaccuccgccagauguucggccaguucggcaagauccucgacgucgagaucaucuucaacgagcgcggcuccaagggcuucggcuucgucaccuucgagaccuccuccgacgccgaccgcgcccgcgagaagcucaacggcaccaucgucgagggccgcaagaucgaggucaacaacgccaccgcccgcgucaugaccaacaagaagaccggcaaccccuacaccaacggcuggaagcucaaccccgucgucggcgccgucuacggccccgaguucuacgccgucaccggcuuccccuaccccaccaccggcaccgccgucgccuaccgcggcgcccaccuccgcggccgcggccgcgccgucuacaacaccuuccgcgccgcccccccccccccccccauccccaccuacggcgccgucgucuaccaggacggcuucuacggcgccgagaucuacggcggcuacgccgccuaccgcuacgcccagcccgccgccgccgccgccgccuacuccgacuccuacggccgcgucuacgccgccgccgaccccuaccaccacaccaucggccccgccgccaccuacuccaucggcaccauguga

SEQ ID NO: 48589 - RNA, 3207 nt, Artificial Sequence
  derived and/or modified sequence opt2 from RBL1__Homo_sapiens__NP_002886
auguucgaggacaagccccacgccgagggcgccgccgucgucgccgccgccggcgaggcccuccaggcccucugccaggagcucaaccucgacgagggcuccgccgccgaggcccucgacgacuucaccgccauccgcggcaacuacucccucgagggcgaggucacccacuggcucgccugcucccucuacgucgccugccgcaaguccaucauccccaccgucggcaagggcaucauggagggcaacugcgucucccucacccgcauccuccgcuccgccaagcucucccucauccaguucuucuccaagaugaagaaguggauggacauguccaaccucccccaggaguuccgcgagcgcaucgagcgccucgagcgcaacuucgaggucuccaccgucaucuucaagaaguacgagcccaucuuccucgacaucuuccagaaccccuacgaggagccccccaagcucccccgcucccgcaagcagcgccgcauccccugcuccgucaaggaccucuucaacuucugcuggacccucuucgucuacaccaagggcaacuuccgcaugaucggcgacgaccucgucaacuccuaccaccuccuccucugcugccucgaccucaucuucgccaacgccaucaugugccccaaccgccaggaccuccucaaccccuccuucaagggccuccccuccgacuuccacaccgccgacuucaccgccuccgaggagccccccugcaucaucgccguccucugcgagcuccacgacggccuccucgucgaggccaagggcaucaaggagcacuacuucaagcccuacaucuccaagcucuucgaccgcaagauccucaagggcgagugccuccucgaccucuccuccuucaccgacaacuccaaggccgucaacaaggaguacgaggaguacguccucaccgucggcgacuucgacgagcgcaucuuccucggcgccgacgccgaggaggagaucggcaccccccgcaaguucacccgcgacaccccccucggcaagcucaccgcccaggccaacgucgaguacaaccuccagcagcacuucgagaagaagcgcuccuucgcccccuccaccccccucaccggccgccgcuaccuccgcgagaaggaggccgucaucacccccgucgccuccgccacccaguccgucucccgccuccaguccaucgucgccggccucaagaacgcccccuccgaccagcucaucaacaucuucgaguccugcguccgcaaccccgucgagaacaucaugaagauccucaagggcaucggcgagaccuucugccagcacuacacccaguccaccgacgagcagcccggcucccacaucgacuucgccgucaaccgccucaagcucgccgagauccucuacuacaagauccucgagaccgucaugguccaggagacccgccgccuccacggcauggacauguccguccuccucgagcaggacaucuuccaccgcucccucauggccugcugccucgagaucguccucuucgccuacuccuccccccgcaccuuccccuggaucaucgagguccucaaccuccagcccuucuacuucuacaaggucaucgaggucgucauccgcuccgaggagggccucucccgcgacauggucaagcaccucaacuccaucgaggagcagauccucgagucccucgccuggucccacgacuccgcccucugggaggcccuccaggucuccgccaacaagguccccaccugcgaggaggucaucuuccccaacaacuucgagaccggcaacggcggcaacguccagggccaccucccccucaugcccauguccccccucaugcacccccgcgucaaggagguccgcaccgacuccggcucccuccgccgcgacaugcagccccucucccccaucuccguccacgagcgcuacuccucccccaccgccggcuccgccaagcgccgccucuucggcgaggacccccccaaggagaugcucauggacaagaucaucaccgagggcaccaagcucaagaucgcccccuccuccuccaucaccgccgagaacgucuccauccuccccggccagacccuccucaccauggccaccgcccccgucaccggcaccaccggccacaaggucaccaucccccuccacggcgucgccaacgacgccggcgagaucacccucaucccccucuccaugaacaccaaccaggaguccaaggucaagucccccgucucccucaccgcccacucccucaucggcgccucccccaagcagaccaaccucaccaaggcccaggagguccacuccaccggcaucaaccgccccaagcgcaccggcucccucgcccucuucuaccgcaaggucuaccaccucgccuccguccgccuccgcgaccucugccucaagcucgacgucuccaacgagcuccgccgcaagaucuggaccugcuucgaguucacccucguccacugccccgaccucaugaaggaccgccaccucgaccagcuccuccucugcgccuucuacaucauggccaaggucaccaaggaggagcgcaccuuccaggagaucaugaaguccuaccgcaaccagccccaggccaacucccacgucuaccgcuccguccuccucaaguccaucccccgcgaggucgucgccuacaacaagaacaucaacgacgacuucgagaugaucgacugcgaccucgaggacgccaccaagacccccgacugcuccuccggccccgucaaggaggagcgcggcgaccucaucaaguucuacaacaccaucuacgucggccgcgucaaguccuucgcccucaaguacgaccucgccaaccaggaccacaugauggacgcccccccccucucccccuucccccacaucaagcagcagcccggcuccccccgccgcaucucccagcagcacuccaucuacaucuccccccacaagaacggcuccggccucaccccccgcuccgcccuccucuacaaguucaacggcucccccuccaagucccucaaggacaucaacaacaugauccgccagggcgagcagcgcaccaagaagcgcgucaucgccaucgacuccgacgccgagucccccgccaagcgcgucugccaggagaacgacgacguccuccucaagcgccuccaggacgucgucuccgagcgcgccaaccacuga

SEQ ID NO: 48590 - RNA, 3198 nt, Artificial Sequence
  derived and/or modified sequence opt2 from RBL2__Homo_sapiens__XP_005256140
augcagucccucaccaagggcaacgaccuccacuggcucgccugcgcccucuacgucgccugccgcaaguccguccccaccgucuccaagggcaccgucgagggcaacuacgucucccucacccgcauccucaagugcuccgagcagucccucaucgaguucuucaacaagaugaagaagugggaggacauggccaaccuccccccccacuuccgcgagcgcaccgagcgccucgagcgcaacuucaccgucuccgccgucaucuucaagaaguacgagcccaucuuccaggacaucuucaaguacccccaggaggagcagccccgccagcagcgcggccgcaagcagcgccgccagcccugcaccgucuccgagaucuuccacuucugcuggguccucuucaucuacgccaagggcaacuuccccaugaucuccgacgaccucgucaacuccuaccaccuccuccucugcgcccucgaccucgucuacggcaacgcccuccagugcuccaaccgcaaggagcucgucaaccccaacuucaagggccucuccgaggacuuccacgccaaggacuccaagcccuccuccgacccccccugcaucaucgagaagcucugcucccuccacgacggccucguccucgaggccaagggcaucaaggagcacuucuggaagcccuacauccgcaagcucuacgagaagaagcuccucaagggcaaggaggagaaccucaccggcuuccucgagcccggcaacuucggcgaguccuucaaggccaucaacaaggccuacgaggaguacguccucuccgucggcaaccucgacgagcgcaucuuccucggcgaggacgccgaggaggagaucggcacccucucccgcugccucaacgccggcuccggcaccgagaccgccgagcgcguccagaugaagaacauccuccagcagcacuucgacaaguccaaggcccuccgcaucuccaccccccucaccggcguccgcuacaucaaggagaacucccccugcgucacccccgucuccaccgccacccacucccucucccgccuccacaccaugcucaccggccuccgcaacgcccccuccgagaagcucgagcagauccuccgcaccugcucccgcgaccccacccaggccaucgccaaccgccucaaggagauguucgagaucuacucccagcacuuccagcccgacgaggacuucuccaacugcgccaaggagaucgccuccaagcacuuccgcuucgccgagaugcucuacuacaagguccucgaguccgucaucgagcaggagcagaagcgccucggcgacauggaccucuccggcauccucgagcaggacgccuuccaccgcucccuccucgccugcugccucgaggucgucaccuucuccuacaagccccccggcaacuuccccuucaucaccgagaucuucgacgucccccucuaccacuucuacaaggucaucgaggucuucauccgcgccgaggacggccucugccgcgaggucgucaagcaccucaaccagaucgaggagcagauccucgaccaccucgccuggaagcccgaguccccccucugggagaagauccgcgacaacgagaaccgcguccccaccugcgaggaggucaugcccccccagaaccucgagcgcgccgacgagaucugcaucgccggcuccccccucaccccccgccgcgucaccgagguccgcgccgacaccggcggccucggccgcuccaucaccucccccaccacccucuacgaccgcuacuccuccccccccgccuccaccacccgccgccgccucuucgucgagaacgacucccccuccgacggcggcacccccggccgcaugcccccccagccccucgucaacgccguccccguccagaacgucuccggcgagaccgucuccgucacccccguccccggccagacccucgucaccauggccaccgccaccgucaccgccaacaacggccagaccgucaccauccccguccagggcaucgccaacgagaacggcggcaucaccuucuuccccguccaggucaacgucggcggccaggcccaggccgucaccggcuccauccagccccucuccgcccaggcccucgccggcucccucuccucccagcaggucaccggcaccacccuccagguccccggccaggucgccauccagcagaucucccccggcggccagcagcagaagcagggccaguccgucaccuccuccuccaaccgcccccgcaagaccuccucccucucccucuucuuccgcaaggucuaccaccucgccgccguccgccuccgcgaccucugcgccaagcucgacaucuccgacgagcuccgcaagaagaucuggaccugcuucgaguucuccaucauccagugccccgagcucaugauggaccgccaccucgaccagcuccucaugugcgccaucuacgucauggccaaggucaccaaggaggacaaguccuuccagaacaucaugcgcugcuaccgcacccagccccaggcccgcucccaggucuaccgcuccguccucaucaagggcaagcgcaagcgccgcaacuccggcuccuccgacucccgcucccaccagaacucccccaccgagcucaacaaggaccgcaccucccgcgacuccucccccgucaugcgcuccuccuccacccuccccgucccccagcccuccuccgccccccccacccccacccgccucaccggcgccaacuccgacauggaggaggaggagcgcggcgaccucauccaguucuacaacaacaucuacaucaagcagaucaagaccuucgccaugaaguacucccaggccaacauggacgcccccccccucucccccuaccccuucguccgcaccggcuccccccgccgcauccagcucucccagaaccaccccgucuacaucuccccccacaagaacgagaccaugcucuccccccgcgagaagaucuucuacuacuucuccaacucccccuccaagcgccuccgcgagaucaacuccaugauccgcaccggcgagacccccaccaagaagcgcggcauccuccucgaggacggcuccgagucccccgccaagcgcaucugccccgagaaccacuccgcccuccuccgccgccuccaggacgucgccaacgaccgcggcucccacuga

SEQ ID NO: 48591 - RNA, 2988 nt, Artificial Sequence
  derived and/or modified sequence opt2 from RBM10__Homo_sapiens__NP_001191397
auguccggcucccccucccucaccgcccgcgccgagaaggucuccgucgacgccggccgcggcggcggcgagucccuccaggaggccuccccccgccucgccgaccacggcuccuccuccggcggcggcugggaggucaagcgcucccagcgccuccgccgcggccccuccuccccccgccgccccuaccaggacauggaguacgagcgccgcggcggccgcggcgaccgcaccggccgcuacggcgccaccgaccgcucccaggacgacggcggcgagaaccgcucccgcgaccacgacuaccgcgacauggacuaccgcuccuacccccgcgaguacggcucccaggagggcaagcacgacuacgacgacuccuccgaggagcaguccgccgaggacuccuacgaggccucccccggcuccgagacccagcgccgccgccgccgccgccaccgccacucccccaccggcccccccggcuucccccgcgacggcgacuaccgcgaccaggacuaccgcaccgagcagggcgaggaggaggaggaggaggaggacgaggaggaggaggagaaggccuccaacaucgucaugcuccgcaugcucccccaggccgccaccgaggacgacauccgcggccagcuccagucccacggcguccaggcccgcgagguccgccucaugcgcaacaaguccuccggccagucccgcggcuucgccuucgucgaguucucccaccuccaggacgccacccgcuggauggaggccaaccagcacucccucaacauccucggccagaaggucuccaugcacuacuccgaccccaagcccaagaucaacgaggacuggcucugcaacaagugcggcguccagaacuucaagcgccgcgagaagugcuucaagugcggcguccccaaguccgaggccgagcagaagcucccccucggcacccgccucgaccagcagacccucccccucggcggccgcgagcucucccagggccuccucccccucccccagcccuaccaggcccagggcguccucgccucccaggcccucucccagggcuccgagcccuccuccgagaacgccaacgacaccaucauccuccgcaaccucaacccccacuccaccauggacuccauccucggcgcccucgcccccuacgccguccucuccuccuccaacguccgcgucaucaaggacaagcagacccagcucaaccgcggcuucgccuucauccagcucuccaccaucgucgaggccgcccagcuccuccagauccuccaggcccuccaccccccccucaccaucgacggcaagaccaucaacgucgaguucgccaagggcuccaagcgcgacauggccuccaacgagggcucccgcaucuccgccgccuccgucgccuccaccgccaucgccgccgcccagugggccaucucccaggccucccagggcggcgagggcaccugggccaccuccgaggagccccccgucgacuacuccuacuaccagcaggacgagggcuacggcaacucccagggcaccgaguccucccucuacgcccacggcuaccucaagggcaccaagggccccggcaucaccggcaccaagggcgaccccaccggcgccggccccgaggccucccucgagcccggcgccgacuccgucuccaugcaggccuucucccgcgcccagcccggcgccgcccccggcaucuaccagcaguccgccgaggccuccuccucccagggcaccgccgccaacucccaguccuacaccaucaugucccccgccguccucaaguccgagcuccagucccccacccaccccuccuccgcccucccccccgccaccucccccaccgcccaggaguccuacucccaguaccccguccccgacgucuccaccuaccaguacgacgagaccuccggcuacuacuacgacccccagaccggccucuacuacgaccccaacucccaguacuacuacaacgcccagucccagcaguaccucuacugggacggcgagcgccgcaccuacguccccgcccucgagcaguccgccgacggccacaaggagaccggcgcccccuccaaggagggcaaggagaagaaggagaagcacaagaccaagaccgcccagcagaucgccaaggacauggagcgcugggcccgcucccucaacaagcagaaggagaacuucaagaacuccuuccagcccaucuccucccuccgcgacgacgagcgccgcgaguccgccaccgccgacgccggcuacgccauccucgagaagaagggcgcccucgccgagcgccagcacaccuccauggaccuccccaagcucgccuccgacgaccgccccucccccccccgcggccucgucgccgccuacuccggcgaguccgacuccgaggaggagcaggagcgcggcggccccgagcgcgaggagaagcucaccgacuggcagaagcucgccugccuccucugccgccgccaguuccccuccaaggaggcccucauccgccaccagcagcucuccggccuccacaagcagaaccucgagauccaccgccgcgcccaccucuccgagaacgagcucgaggcccucgagaagaacgacauggagcagaugaaguaccgcgaccgcgccgccgagcgccgcgagaaguacggcauccccgagccccccgagcccaagcgccgcaaguacggcggcaucuccaccgccuccgucgacuucgagcagcccacccgcgacggccucggcuccgacaacaucggcucccgcaugcuccaggccaugggcuggaaggagggcuccggccucggccgcaagaagcagggcaucgucacccccaucgaggcccagacccgcguccgcggcuccggccucggcgcccgcggcuccuccuacggcgucaccuccaccgaguccuacaaggagacccuccacaagaccauggucacccgcuucaacgaggcccaguga

SEQ ID NO: 48592 - RNA, 2799 nt, Artificial Sequence
  derived and/or modified sequence opt2 from RBM12__Homo_sapiens__NP_001185769
auggccgucgucauccgccuccagggccuccccaucgucgccggcaccauggacauccgccacuucuucuccggccucaccauccccgacggcggcguccacaucgucggcggcgagcucggcgaggccuucaucgucuucgccaccgacgaggacgcccgccucggcaugaugcgcaccggcggcaccaucaagggcuccaaggucacccuccuccucuccuccaagaccgagaugcagaacaugaucgagcucucccgccgccgcuucgagaccgccaaccucgacaucccccccgccaacgccucccgcuccggccccccccccuccuccggcauguccucccgcgucaaccuccccaccaccgucuccaacuucaacaaccccucccccuccgucgucaccgccaccaccuccguccacgaguccaacaagaacauccagaccuucuccaccgccuccgucggcaccgccccccccaacaugggcgccuccuucggcucccccaccuucuccuccaccguccccuccaccgccucccccaugaacaccgucccccccccccccaucccccccauccccgccaugcccucccucccccccaugcccuccaucccccccauccccguccccccccccguccccacccucccccccgucccccccgucccccccaucccccccguccccuccgucccccccaugaccccccucccccccauguccggcaugcccccccucaaccccccccccgucgccccccuccccgccggcaugaacggcuccggcgcccccaugaaccucaacaacaaccucaaccccauguuccucggcccccucaaccccgucaaccccauccagaugaacucccaguccuccgucaagccccuccccaucaaccccgacgaccucuacgucuccguccacggcaugcccuucuccgccauggagaacgacguccgcgacuucuuccacggccuccgcgucgacgccguccaccuccucaaggaccacgucggccgcaacaacggcaacggccucgucaaguuccucuccccccaggacaccuucgaggcccucaagcgcaaccgcaugcucaugauccagcgcuacgucgaggucucccccgccaccgagcgccagugggucgccgccggcggccacaucaccuucaagcagaacaugggccccuccggccagacccacccccccccccagacccucccccgcuccaagucccccuccggccagaagcgcucccgcucccgcuccccccacgaggccggcuucugcgucuaccucaagggccuccccuucgaggccgagaacaagcacgucaucgacuucuucaagaagcucgacaucgucgaggacuccaucuacaucgccuacggccccaacggcaaggccaccggcgagggcuucgucgaguuccgcaacgaggccgacuacaaggccgcccucugccgccacaagcaguacaugggcaaccgcuucauccagguccaccccaucaccaagaagggcaugcucgagaagaucgacaugauccgcaagcgccuccagaacuucuccuacgaccagcgcgagaugauccucaaccccgagggcgacgucaacuccgccaaggucugcgcccacaucaccaacauccccuucuccaucaccaagauggacguccuccaguuccucgagggcauccccgucgacgagaacgccguccacguccucgucgacaacaacggccagggccucggccaggcccucguccaguucaagaacgaggacgacgcccgcaaguccgagcgccuccaccgcaagaagcucaacggccgcgaggccuucguccacgucgucacccucgaggacaugcgcgagaucgagaagaacccccccgcccagggcaagaagggccucaagaugcccguccccggcaaccccgccguccccggcaugcccaacgccggccuccccggcgucggccuccccuccgccggccuccccggcgccggccuccccuccaccggccuccccggcuccgccaucaccuccgccggccuccccggcgccggcaugcccuccgccggcauccccuccgccggcggcgaggagcacgccuuccucaccgucggcuccaaggaggccaacaacggcccccccuucaacuuccccggcaacuucggcggcuccaacgccuucggcccccccauccccccccccggccucggcggcggcgccuucggcgacgcccgccccggcaugcccuccgucggcaacuccggccuccccggccucggccucgacguccccggcuucggcggcggccccaacaaccucuccggccccuccggcuucggcggcggcccccagaacuucggcaacggccccggcucccucggcggcccccccggcuucggcuccggcccccccggccucggcuccgcccccggccaccucggcggcccccccgccuucggccccggccccggccccggccccggccccggccccauccacaucggcggcccccccggcuucgccuccuccuccggcaagcccggccccaccgucaucaagguccagaacaugcccuucaccgucuccaucgacgagauccucgacuucuucuacggcuaccaggucauccccggcuccgucugccucaaguacaacgagaagggcaugcccaccggcgaggccauggucgccuucgagucccgcgacgaggccaccgccgccgucaucgaccucaacgaccgccccaucggcucccgcaaggucaagcucguccucggcuga

SEQ ID NO: 48593 - RNA, 471 nt, Artificial Sequence
  derived and/or modified sequence opt2 from RBM14__Homo_sapiens__NP_001185765
augaagaucuucgucggcaacgucgacggcgccgacaccacccccgaggagcucgccgcccucuucgcccccuacggcaccgucauguccugcgccgucaugaagcaguucgccuucguccacaugcgcgagaacgccggcgcccuccgcgccaucgaggcccuccacggccacgagcuccgccccggccgcgcccucgucgucgagaugucccgcccccgcccccucaacaccuggaagaucuucgucggcaacgucuccgccgccugcaccucccaggagcuccgcucccucuucgagcgccgcggccgcgucaucgagugcgacgucgucaaggacuacgccuucguccacauggagaaggaggccgacgccaaggccgccaucgcccagcucaacggcaaggaggucaagggcaagcgcaucaacgucgagcucuccaccaagggcaugguccccaccggcgucuga

SEQ ID NO: 48594 - RNA, 1020 nt, Artificial Sequence
  derived and/or modified sequence opt2 from RBM14-RBM4__Homo_sapiens__NP_001185774
augaagaucuucgucggcaacgucgacggcgccgacaccacccccgaggagcucgccgcccucuucgcccccuacggcaccgucauguccugcgccgucaugaagcaguucgccuucguccacaugcgcgagaacgccggcgcccuccgcgccaucgaggcccuccacggccacgagcuccgccccggccgcgcccucgucgucgagaugucccgcccccgcccccucaacaccuggaagaucuucgucggcaacgucuccgccgccugcaccucccaggagcuccgcucccucuucgagcgccgcggccgcgucaucgagugcgacgucgucaagggcaagcgcaugcacguccagcucuccaccucccgccuccgcaccgcccccggcaugggcgaccaguccggcugcuaccgcugcggcaaggagggccacugguccaaggagugccccaucgaccgcuccggccgcgucgccgaccucaccgagcaguacaacgagcaguacggcgccguccgcacccccuacaccauguccuacggcgacucccucuacuacaacaacgccuacggcgcccucgacgccuacuacaagcgcugccgcgccgcccgcuccuacgaggccgucgccgccgccgccgccuccgucuacaacuacgccgagcagacccucucccagcucccccagguccagaacaccgccauggccucccaccucaccuccaccucccucgaccccuacgaccgccaccuccuccccaccuccggcgccgccgccaccgccgccgccgccgccgccgccgccgccgccgucaccgccgccuccaccuccuacuacggccgcgaccgcuccccccuccgccgcgccaccgcccccguccccaccgucggcgagggcuacggcuacggccacgaguccgagcucucccaggccuccgccgccgcccgcaacucccucuacgacauggcccgcuacgagcgcgagcaguacgccgaccgcgcccgcuacuccgccuucuga

SEQ ID NO: 48595 - RNA, 2934 nt, Artificial Sequence
  derived and/or modified sequence opt2 from RBM15__Homo_sapiens__XP_011540270
augcgcaccgccggccgcgaccccgucccccgccgcuccccccgcuggcgccgcgccgucccccucugcgagaccuccgccggccgccgcgucacccagcuccgcggcgacgaccuccgccgccccgccaccaugaagggcaaggagcgcucccccgucaaggccaagcgcucccgcggcggcgaggacuccaccucccgcggcgagcgcuccaagaagcucggcggcuccggcggcuccaacggcuccuccuccggcaagaccgacuccggcggcggcucccgccgcucccuccaccucgacaaguccuccucccgcggcggcucccgcgaguacgacaccggcggcggcuccuccuccucccgccuccacuccuacuccucccccuccaccaagaacuccuccggcggcggcgagucccgcuccuccucccgcggcggcggcggcgagucccgcuccuccggcgccgccuccuccgcccccggcggcggcgacggcgccgaguacaagacccucaagaucuccgagcucggcucccagcucuccgacgaggccgucgaggacggccucuuccacgaguucaagcgcuucggcgacgucuccgucaagaucucccaccucuccggcuccggcuccggcgacgagcgcgucgccuucgucaacuuccgccgccccgaggacgcccgcgccgccaagcacgcccgcggccgccucguccucuacgaccgcccccucaagaucgaggccgucuacgucucccgccgccgcucccgcuccccccucgacaaggacaccuacccccccuccgccuccgucgucggcgccuccgucggcggccaccgccacccccccggcggcggcggcggccagcgcucccucucccccggcggcgccgcccucggcuaccgcgacuaccgccuccagcagcucgcccucggccgccucccccccccccccccccccccccucccccgcgaccucgagcgcgagcgcgacuaccccuucuacgagcgcguccgccccgccuacucccucgagccccgcgucggcgccggcgccggcgccgcccccuuccgcgaggucgacgagaucucccccgaggacgaccagcgcgccaaccgcacccucuuccucggcaaccucgacaucaccgucaccgaguccgaccuccgccgcgccuucgaccgcuucggcgucaucaccgaggucgacaucaagcgccccucccgcggccagaccuccaccuacggcuuccucaaguucgagaaccucgacaugucccaccgcgccaagcucgccauguccggcaagaucaucauccgcaaccccaucaagaucggcuacggcaaggccacccccaccacccgccucugggucggcggccucggccccugggucccccucgccgcccucgcccgcgaguucgaccgcuucggcaccauccgcaccaucgacuaccgcaagggcgacuccugggccuacauccaguacgagucccucgacgccgcccacgccgccuggacccacaugcgcggcuucccccucggcggccccgaccgccgccuccgcgucgacuucgccgacaccgagcaccgcuaccagcagcaguaccuccagccccucccccucacccacuacgagcucgucaccgacgccuucggccaccgcgcccccgacccccuccgcggcgcccgcgaccgcacccccccccuccucuaccgcgaccgcgaccgcgaccucuaccccgacuccgacuggguccccccccccccccccguccgcgagcgcuccacccgcaccgccgccaccuccguccccgccuacgagccccucgacucccucgaccgccgccgcgacggcuggucccucgaccgcgaccgcggcgaccgcgaccuccccuccucccgcgaccagccccgcaagcgccgccuccccgaggaguccggcggccgccaccucgaccgcucccccgaguccgaccgcccccgcaagcgccacugcgcccccucccccgaccgcucccccgagcucuccuccucccgcgaccgcuacaacuccgacaacgaccgcuccucccgccuccuccucgagcgccccucccccauccgcgaccgccgcggcucccucgagaagucccagggcgacaagcgcgaccgcaagaacuccgccuccgccgagcgcgaccgcaagcaccgcaccaccgcccccaccgagggcaaguccccccucaagaaggaggaccgcuccgacggcuccgcccccuccaccuccaccgccuccuccaagcucaagucccccucccagaagcaggacggcggcaccgcccccgucgccuccgccucccccaagcucugccucgccuggcagggcaugcuccuccucaagaacuccaacuuccccuccaacaugcaccuccuccagggcgaccuccaggucgccuccucccuccucgucgagggcuccaccggcggcaaggucgcccagcucaagaucacccagcgccuccgccucgaccagcccaagcucgacgaggucacccgccgcaucaaggucgccggccccaacggcuacgccauccuccucgccguccccggcuccuccgacucccgcuccuccuccuccuccgccgccuccgacaccgccaccuccacccagcgcccccuccgcaaccucgucuccuaccucaagcagaagcaggccgccggcgucaucucccuccccgucggcggcaacaaggacaaggagaacaccggcguccuccacgccuucccccccugcgaguucucccagcaguuccucgacucccccgccaaggcccucgccaaguccgaggaggacuaccucgucaugaucaucguccgcggcuucggcuuccagaucggcguccgcuacgagaacaagaagcgcgagaaccucgcccucacccuccucuga

SEQ ID NO: 48596 - RNA, 1206 nt, Artificial Sequence
  derived and/or modified sequence opt2 from RBM17__Homo_sapiens__NP_001139019
augucccucuacgacgaccucggcgucgagaccuccgacuccaagaccgagggcugguccaagaacuucaagcuccuccagucccagcuccaggucaagaaggccgcccucacccaggccaagucccagcgcaccaagcaguccaccguccucgcccccgucaucgaccucaagcgcggcggcuccuccgacgaccgccagaucgucgacacccccccccacgucgccgccggccucaaggaccccguccccuccggcuucuccgccggcgagguccucaucccccucgccgacgaguacgaccccauguuccccaacgacuacgagaaggucgucaagcgccagcgcgaggagcgccagcgccagcgcgagcucgagcgccagaaggagaucgaggagcgcgagaagcgccgcaaggaccgccacgaggccuccggcuucgcccgccgccccgaccccgacuccgacgaggacgaggacuacgagcgcgagcgccgcaagcgcuccaugggcggcgccgccaucgccccccccaccucccucgucgagaaggacaaggagcucccccgcgacuuccccuacgaggaggacucccgcccccgcucccaguccuccaaggccgccauccccccccccgucuacgaggagcaggaccgcccccgcucccccaccggccccuccaacuccuuccucgccaacaugggcggcaccgucgcccacaagaucaugcagaaguacggcuuccgcgagggccagggccucggcaagcacgagcagggccucuccaccgcccucuccgucgagaagaccuccaagcgcggcggcaagaucaucgucggcgacgccaccgagaaggacgccuccaagaaguccgacuccaacccccucaccgagauccucaagugccccaccaaggucguccuccuccgcaacauggucggcgccggcgaggucgacgaggaccucgaggucgagaccaaggaggagugcgagaaguacggcaaggucggcaagugcgucaucuucgagauccccggcgcccccgacgacgaggccguccgcaucuuccucgaguucgagcgcgucgaguccgccaucaaggccgucgucgaccucaacggccgcuacuucggcggccgcgucgucaaggccugcuucuacaaccucgacaaguuccgcguccucgaccucgccgagcaggucuga

SEQ ID NO: 48597 - RNA, 3684 nt, Artificial Sequence
  derived and/or modified sequence opt2 from RBM20__Homo_sapiens__NP_001127835
augguccucgccgccgccaugucccaggacgccgaccccuccggccccgagcagcccgaccgcgucgccugcuccguccccggcgcccgcgccucccccgcccccuccggcccccgcggcaugcagcagccccccccccccccccagccccccccccccccccaggccggccucccccagaucauccagaacgccgccaagcuccucgacaagaaccccuucuccgucuccaaccccaacccccuccuccccucccccgccucccuccagcucgcccagcuccaggcccagcucacccuccaccgccucaagcucgcccagaccgccgucaccaacaacaccgccgccgccaccguccucaaccagguccucuccaaggucgccaugucccagccccucuucaaccagcuccgccaccccuccgucaucaccggcccccacggccacgccggcgucccccagcacgccgccgccauccccuccacccgcuuccccuccaacgccaucgccuucuccccccccucccagacccgcggccccggccccuccaugaaccuccccaaccagccccccuccgccauggucaugcaccccuucaccggcgucaugccccagacccccggccagcccgccgucauccucggcaucggcaagaccggccccgcccccgccaccgccggcuucuacgaguacggcaaggccuccuccggccagaccuacggccccgagaccgacggccagcccggcuuccuccccuccuccgccuccaccuccggcuccgucaccuacgagggccacuacucccacaccggccaggacggccaggccgccuucuccaaggacuucuacggccccaacucccagggcucccacgucgccuccggcuuccccgccgagcaggccggcggccucaaguccgaggucggcccccuccuccagggcaccaacucccagugggaguccccccacggcuucuccggccaguccaagcccgaccucaccgccggccccauguggccccccccccacaaccagcccuacgagcucuacgaccccgaggagcccaccuccgaccgcaccccccccuccuucggcggccgccucaacaacuccaagcagggcuucaucggcgccggccgccgcgccaaggaggaccaggcccuccucuccguccgcccccuccaggcccacgagcucaacgacuuccacggcgucgccccccuccaccucccccacaucugcuccaucugcgacaagaaggucuucgaccucaaggacugggagcuccacgucaagggcaagcuccacgcccagaagugccucgucuucuccgagaacgccggcauccgcugcauccucggcuccgccgagggcacccucugcgccucccccaacuccaccgccgucuacaaccccgccggcaacgaggacuacgccuccaaccucggcaccuccuacguccccauccccgcccgcuccuucacccaguccucccccaccuucccccucgccuccgucggcaccaccuucgcccagcgcaagggcgccggccgcgucguccacaucugcaaccuccccgagggcuccugcaccgagaacgacgucaucaaccucggccuccccuucggcaaggucaccaacuacauccucaugaaguccaccaaccaggccuuccucgagauggccuacaccgaggccgcccaggccaugguccaguacuaccaggagaaguccgccgucaucaacggcgagaagcuccucauccgcauguccaagcgcuacaaggagcuccagcucaagaagcccggcaaggccgucgccgccaucauccaggacauccacucccagcgcgagcgcgacauguuccgcgaggccgaccgcuacggccccgagcgcccccgcucccgcucccccgucucccgcucccucuccccccgcucccacacccccuccuucaccuccugcuccuccucccacuccccccccggccccucccgcgccgacuggggcaacggccgcgacuccugggagcacucccccuacgcccgccgcgaggaggagcgcgaccccgcccccuggcgcgacaacggcgacgacaagcgcgaccgcauggaccccugggcccacgaccgcaagcaccacccccgccagcucgacaaggccgagcucgacgagcgccccgagggcggccgcccccaccgcgagaaguacccccgcuccggcucccccaaccucccccacuccgucuccuccuacaagucccgcgaggacggcuacuaccgcaaggagcccaaggccaaguccgacaaguaccucaagcagcagcaggacgcccccggccgcucccgccgcaaggacgaggcccgccuccgcgagucccgccacccccaccccgacgacuccggcaaggaggacggccucggccccaaggucacccgcgcccccgagggcgccaaggccaagcagaacgagaagaacaagaccaagcgcaccgaccgcgaccaggagggcgccgacgaccgcaaggagaacaccauggccgagaacgaggccggcaaggaggagcaggagggcauggaggaguccccccaguccgucggccgccaggagaaggaggccgaguucuccgaccccgagaacacccgcaccaagaaggagcaggacugggaguccgaguccgaggccgagggcgaguccugguaccccaccaacauggaggagcucgucaccgucgacgaggucggcgaggaggaggacuucaucgucgagcccgacauccccgagcucgaggagaucguccccaucgaccagaaggacaagaucugccccgagaccugccucugcgucaccaccacccucgaccucgaccucgcccaggacuuccccaaggagggcgucaaggccgucggcaacggcgccgccgagaucucccucaaguccccccgcgagcuccccuccgccuccaccuccugccccuccgacauggacgucgagaugcccggccucaaccucgacgccgagcgcaagcccgccgaguccgagaccggccucucccucgaggacuccgacugcuacgagaaggaggccaagggcgucgaguccuccgacguccaccccgcccccaccguccagcagauguccucccccaagcccgccgaggagcgcgcccgccagcccucccccuucgucgacgacugcaagacccgcggcacccccgaggacggcgccugcgagggcuccccccucgaggagaaggccuccccccccaucgagaccgaccuccagaaccaggccugccaggagguccucacccccgagaacucccgcuacgucgagaugaagucccucgagguccgcucccccgaguacaccgaggucgagcucaagcagccccucucccuccccuccugggagcccgaggacgucuucuccgagcucuccaucccccucggcgucgaguucgucgucccccgcaccggcuucuacugcaagcucugcggccucuucuacaccuccgaggagaccgccaagaugucccacugccgcuccgccguccacuaccgcaaccuccagaaguaccucucccagcucgccgaggagggccucaaggagaccgagggcgccgacuccccccgccccgaggacuccggcaucgucccccgcuucgagcgcaagaagcucuga

SEQ ID NO: 48598 - RNA, 2532 nt, Artificial Sequence
  derived and/or modified sequence opt2 from RBM25__Homo_sapiens__XP_011535346
auguccuuccccccccaccucaaccgcccccccaugggcauccccgcccucccccccggcaucccccccccccaguuccccggcuuccccccccccgucccccccggcacccccaugauccccguccccauguccaucauggcccccgcccccaccguccucguccccaccgucuccauggucggcaagcaccucggcgcccgcaaggaccaccccggccucaaggccaaggagaacgacgagaacugcggccccaccaccaccgucuucgucggcaacaucuccgagaaggccuccgacaugcucauccgccagcuccucgccaagugcggccucguccucuccuggaagcgcguccagggcgccuccggcaagcuccaggccuucggcuucugcgaguacaaggagcccgaguccacccuccgcgcccuccgccuccuccacgaccuccagaucggcgagaagaagcuccucgucaaggucgacgccaagaccaaggcccagcucgacgaguggaaggccaagaagaaggccuccaacggcaacgcccgccccgagaccgucaccaacgacgacgaggaggcccucgacgaggagaccaagcgccgcgaccagaugaucaagggcgccaucgagguccucauccgcgaguacuccuccgagcucaacgcccccucccaggaguccgacucccacccccgcaagaagaagaaggagaagaaggaggacaucuuccgccgcuuccccgucgccccccucauccccuacccccucaucaccaaggaggacaucaacgccaucgagauggaggaggacaagcgcgaccucaucucccgcgagaucuccaaguuccgcgacacccacaagaagcucgaggaggagaagggcaagaaggagaaggagcgccaggagaucgagaaggagcgccgcgagcgcgagcgcgagcgcgagcgcgagcgcgagcgccgcgagcgcgagcgcgagcgcgagcgcgagcgcgagcgcgagaaggagaaggagcgcgagcgcgagcgcgagcgcgaccgcgaccgcgaccgcaccaaggagcgcgaccgcgaccgcgaccgcgagcgcgaccgcgaccgcgaccgcgagcgcuccuccgaccgcaacaaggaccgcucccgcucccgcgagaagucccgcgaccgcgagcgcgagcgcgagcgcgagcgcgagcgcgagcgcgagcgcgagcgcgagcgcgagcgcgagcgcgagcgcgagcgcgagcgcgagcgcgagcgcgagcgcgagaaggacaagaagcgcgaccgcgaggaggacgaggaggacgccuacgagcgccgcaagcucgagcgcaagcuccgcgagaaggaggccgccuaccaggagcgccucaagaacugggagauccgcgagcgcaagaagacccgcgaguacgagaaggaggccgagcgcgaggaggagcgccgccgcgagauggccaaggaggccaagcgccucaaggaguuccucgaggacuacgacgacgaccgcgacgaccccaaguacuaccgcggcuccgcccuccagaagcgccuccgcgaccgcgagaaggagauggaggccgacgagcgcgaccgcaagcgcgagaaggaggagcucgaggagauccgccagcgccuccucgccgagggccaccccgaccccgacgccgagcuccagcgcauggagcaggaggccgagcgccgccgccagccccagaucaagcaggagcccgaguccgaggaggaggaggaggagaagcaggagaaggaggagaagcgcgaggagcccauggaggaggaggaggagcccgagcagaagcccugccucaagcccacccuccgccccaucuccuccgcccccuccgucuccuccgccuccggcaacgccacccccaacacccccggcgacgagucccccugcggcaucaucaucccccacgagaacucccccgaccagcagcagcccgaggagcaccgccccaagaucggccucucccucaagcucggcgccuccaacucccccggccagcccaacuccgucaagcgcaagaagcuccccgucgacuccgucuucaacaaguucgaggacgaggacuccgacgacgucccccgcaagcgcaagcucgucccccucgacuacggcgaggacgacaagaacgccaccaagggcaccgucaacaccgaggagaagcgcaagcacaucaagucccucaucgagaagauccccaccgccaagcccgagcucuucgccuacccccucgacugguccaucgucgacuccauccucauggagcgccgcauccgccccuggaucaacaagaagaucaucgaguacaucggcgaggaggaggccacccucgucgacuucgucugcuccaaggucauggcccacuccuccccccaguccauccucgacgacgucgccaugguccucgacgaggaggccgaggucuucaucgucaagauguggcgccuccucaucuacgagaccgaggccaagaagaucggccucgucaaguga

SEQ ID NO: 48599 - RNA, 2952 nt, Artificial Sequence
  derived and/or modified sequence opt2 from RBM26__Homo_sapiens__NP_001273561
auggucuccaagaugaucaucgagaacuucgaggcccucaaguccuggcucuccaagacccucgagcccaucugcgacgccgaccccuccgcccucgccaaguacguccucgcccucgucaagaaggacaaguccgagaaggagcucaaggcccucugcaucgaccagcucgacgucuuccuccagaaggagacccagaucuucgucgagaagcucuucgacgccgucaacaccaaguccuaccuccccccccccgagcagcccuccuccggcucccucaaggucgaguucuucccccaccaggagaaggacaucaagaaggaggagaucaccaaggaggaggagcgcgagaagaaguucucccgccgccucaaccacucccccccccaguccuccucccgcuaccgcgagaaccgcucccgcgacgagcgcaagaaggacgaccgcucccgcaagcgcgacuacgaccgcaaccccccccgccgcgacuccuaccgcgaccgcuacaaccgccgccgcggccgcucccgcuccuacucccgcucccgcucccgcuccugguccaaggagcgccuccgcgagcgcgaccgcgaccgcucccgcacccgcucccgcucccgcacccgcucccgcgagcgcgaccucgucaagcccaaguacgaccucgaccgcaccgacccccucgagaacaacuacacccccgucuccuccguccccuccaucuccuccggccacuaccccguccccacccucuccuccaccaucaccgucaucgcccccacccaccacggcaacaacaccaccgaguccugguccgaguuccacgaggaccaggucgaccacaacuccuacguccgcccccccaugcccaagaagcgcugccgcgacuacgacgagaagggcuucugcaugcgcggcgacaugugccccuucgaccacggcuccgaccccgucgucgucgaggacgucaaccuccccggcaugcuccccuuccccgcccagccccccgucgucgagggcccccccccccccggccuccccccccccccccccauccucacccccccccccgucaaccuccgcccccccguccccccccccggcccccucccccccucccucccccccgucaccggccccccccccccccuccccccccuccagcccuccggcauggacgccccccccaacuccgccaccuccuccguccccaccgucgucaccaccggcauccaccaccagcccccccccgccccccccucccucuucaccgccgacaccuacgacaccgacggcuacaaccccgaggcccccuccaucaccaacaccucccgccccauguaccgccaccgcguccacgcccagcgccccaaccucaucggccucaccuccggcgacauggaccuccccccccgcgagaagccccccaacaaguccuccaugcgcaucgucgucgacuccgagucccgcaagcgcaccaucggcuccggcgagcccggcguccccaccaagaagaccugguucgacaagcccaacuucaaccgcaccaacucccccggcuuccagaagaagguccaguucggcaacgagaacaccaagcucgagcuccgcaaggucccccccgagcucaacaacaucuccaagcucaacgagcacuucucccgcuucggcacccucgucaaccuccaggucgccuacaacggcgaccccgagggcgcccucauccaguucgccaccuacgaggaggccaagaaggccaucuccuccaccgaggccguccucaacaaccgcuucaucaaggucuacuggcaccgcgagggcuccacccagcagcuccagaccaccucccccaaggucaugcagccccucguccagcagcccauccuccccgucgucaagcaguccgucaaggagcgccucggccccguccccuccuccaccaucgagcccgccgaggcccaguccgccuccuccgaccucccccagguccucuccaccuccaccggccucaccaagaccgucuacaaccccgccgcccucaaggccgcccagaagacccuccucgucuccaccuccgccgucgacaacaacgaggcccagaagaagaagcaggaggcccucaagcuccagcaggacguccgcaagcgcaagcaggagauccucgagaagcacaucgagacccagaagaugcucaucuccaagcucgagaagaacaagaccaugaaguccgaggacaaggccgagaucaugaagacccucgagguccucaccaagaacaucaccaagcucaaggacgaggucaaggccgccucccccggccgcugccuccccaaguccaucaagaccaagacccagaugcagaaggagcuccucgacaccgagcucgaccucuacaagaagaugcaggccggcgaggaggucaccgagcuccgccgcaaguacaccgagcuccagcucgaggccgccaagcgcggcauccucuccuccggccgcggccgcggcauccacucccgcggccgcggcgccguccacggccgcggccgcggccgcggccgcggccgcggcguccccggccacgccgucgucgaccaccgcccccgcgcccucgagaucuccgccuucaccgaguccgaccgcgaggaccuccucccccacuucgcccaguacggcgagaucgaggacugccagaucgacgacuccucccuccacgccgucaucaccuucaagacccgcgccgaggccgaggccgccgccguccacggcgcccgcuucaagggccaggaccucaagcucgccuggaacaagcccgucaccaacaucuccgccgucgagaccgaggaggucgagcccgacgaggaggaguuccaggaggagucccucgucgacgacucccuccuccaggacgacgacgaggaggaggaggacaacgagucccgcuccuggcgccgcuga

SEQ ID NO: 48600 - RNA, 3183 nt, Artificial Sequence
  derived and/or modified sequence opt2 from RBM27__Homo_sapiens__NP_061862
augcucaucgaggacgucgacgcccucaaguccuggcucgccaagcuccucgagcccaucugcgacgccgaccccuccgcccucgccaacuacgucgucgcccucgucaagaaggacaagcccgagaaggagcucaaggccuucugcgccgaccagcucgacgucuuccuccagaaggagaccuccggcuucgucgacaagcucuucgagucccucuacaccaagaacuaccucccccuccucgagcccgucaagcccgagcccaagccccucguccaggagaaggaggagaucaaggaggaggucuuccaggagcccgccgaggaggagcgcgacggccgcaagaagaaguaccccuccccccagaagacccgcuccgaguccuccgagcgccgcacccgcgagaagaagcgcgaggacggcaaguggcgcgacuacgaccgcuacuacgagcgcaacgagcucuaccgcgagaaguacgacuggcgccgcggccgcuccaagucccgcuccaagucccgcggccucucccgcucccgcucccgcucccgcggccgcuccaaggaccgcgaccccaaccgcaacgucgagcaccgcgagcgcuccaaguucaaguccgagcgcaacgaccucgaguccuccuacguccccgucuccgcccccccccccaacuccuccgagcaguacuccuccggcgcccaguccauccccuccaccgucaccgucaucgcccccgcccaccacuccgagaacaccaccgaguccugguccaacuacuacaacaaccacuccuccuccaacuccuucggccgcaaccucccccccaagcgccgcugccgcgacuacgacgagcgcggcuucugcguccucggcgaccucugccaguucgaccacggcaacgacccccucgucgucgacgaggucgcccuccccuccaugauccccuuccccccccccccccccggccucccccccccccccccccccggcaugcucaugccccccaugcccggccccggccccggccccggccccggccccggccccggccccggccccggccccggccccggccacuccaugcgccuccccgucccccagggccacggccagcccccccccuccgucguccuccccaucccccgcccccccaucacccaguccucccucaucaacucccgcgaccagcccggcaccuccgccguccccaaccucgccuccgucggcacccgccucccccccccccucccccagaaccuccucuacaccgucuccgagcgccagcccauguacucccgcgagcacggcgccgccgccuccgagcgccuccagcucggcaccccccccccccuccucgccgcccgccucguccccccccgcaaccucaugggcuccuccaucggcuaccacaccuccgucuccucccccaccccccucguccccgacaccuacgagcccgacggcuacaaccccgaggcccccuccaucaccuccuccggccgcucccaguaccgccaguucuucucccgcacccagacccagcgccccaaccucaucggccucaccuccggcgacauggacgucaacccccgcgccgccaacaucgucauccagaccgagccccccguccccgucuccaucaacuccaacaucacccgcgucguccucgagcccgacucccgcaagcgcgccauguccggccucgagggcccccucaccaagaagcccuggcucggcaagcagggcaacaacaaccagaacaagcccggcuuccuccgcaagaaccaguacaccaacaccaagcucgaggucaagaagaucccccaggagcucaacaacaucaccaagcucaacgagcacuucuccaaguucggcaccaucgucaacauccaggucgccuucaagggcgaccccgaggccgcccucauccaguaccucaccaacgaggaggcccgcaaggccaucuccuccaccgaggccguccucaacaaccgcuucauccgcguccucuggcaccgcgagaacaacgagcagcccacccuccaguccuccgcccagcuccuccuccagcagcagcagacccucucccaccucucccagcagcaccaccaccucccccagcaccuccaccagcagcagguccucgucgcccaguccgcccccuccaccguccacggcggcauccagaagaugauguccaagccccagaccuccggcgccuacguccucaacaagguccccgucaagcaccgccucggccacgccggcggcaaccaguccgacgccucccaccuccucaaccaguccggcggcgccggcgaggacugccagaucuucuccacccccggccaccccaagaugaucuacuccuccuccaaccucaagacccccuccaagcucugcuccggcuccaagucccacgacguccaggagguccucaagaagaagcaggaggccaugaagcuccagcaggacaugcgcaagaagcgccaggagguccucgagaagcagaucgagugccagaagaugcucaucuccaagcucgagaagaacaagaacaugaagcccgaggagcgcgccaacaucaugaagacccucaaggagcucggcgagaagaucucccagcucaaggacgagcucaagaccuccuccgccgucuccacccccuccaaggucaagaccaagaccgaggcccagaaggagcuccucgacaccgagcucgaccuccacaagcgccucuccuccggcgaggacaccaccgagcuccgcaagaagcucucccagcuccaggucgaggccgcccgccucggcauccuccccgucggccgcggcaagaccauguccucccagggccgcggccgcggccgcggccgcggcggccgcggccgcggcucccucaaccacauggucgucgaccaccgccccaaggcccucaccgucggcggcuucaucgaggaggagaaggaggaccuccuccagcacuucuccaccgccaaccagggccccaaguucaaggaccgccgccuccagaucuccuggcacaagcccaagguccccuccaucuccaccgagaccgaggaggaggaggucaaggaggaggagaccgagaccuccgaccucuuccuccccgacgacgacgacgaggacgaggacgaguacgagucccgcuccuggcgccgcuga

SEQ ID NO: 48601 - RNA, 1857 nt, Artificial Sequence
  derived and/or modified sequence opt2 from RBM28__Homo_sapiens__NP_001159607
auggccggccucacccucuucgucggccgccucccccccuccgcccgcuccgagcagcucgaggagcucuucucccaggucggccccgucaagcagugcuucgucgucaccgagaagggccgcaccgucgccgucgacugggccgucgccaaggacaaguacaaggacacccaguccgucuccgccaucggcgaggagaagucccacgaguccaagcaccaggaguccgucaagaagaagggccgcgaggaggaggacauggaggaggaggagaacgacgacgacgacgacgacgacgacgaggaggacggcgucuucgacgacgaggacgaggaggaggagaacaucgaguccaaggucaccaagcccguccagauccagaagcgcgccgucaagcgccccgcccccgccaaguccuccgaccacuccgaggaggacuccgaccucgaggaguccgacuccaucgacgacggcgaggagcucgcccaguccgacaccuccaccgaggagcaggaggacaaggccguccaggucuccaacaagaagaagcgcaagcuccccuccgacgucaacgagggcaagaccgucuucauccgcaaccucuccuucgacuccgaggaggaggagcucggcgagcuccuccagcaguucggcgagcucaaguacguccgcaucguccuccaccccgacaccgagcacuccaagggcugcgccuucgcccaguucaugacccaggaggccgcccagaagugccuccucgccgccucccccgagaacgaggccggcggccucaagcucgacggccgccagcucaaggucgaccucgccgucacccgcgacgaggccgccaagcuccagaccaccaaggucaagaagcccaccggcacccgcaaccucuaccucgcccgcgagggccucauccgcgccggcaccaaggccgccgagggcgucuccgccgccgacauggccaagcgcgagcgcuucgagcuccucaagcaccagaagcucaaggaccagaacaucuucgucucccgcacccgccucugccuccacaaccuccccaaggccgucgacgacaagcagcuccgcaagcuccuccucuccgccaccuccggcgagaagggcguccgcaucaaggagugccgcgucaugcgcgaccucaagggcguccacggcaacaugaagggccagucccucggcuacgccuucgccgaguuccaggagcacgagcacgcccucaaggcccuccgccucaucaacaacaaccccgagaucuucggcccccucaagcgccccaucgucgaguucucccucgaggaccgccgcaagcucaagaugaaggagcuccgcauccagcgcucccuccagaagaugcgcuccaagcccgccaccggcgagccccagaagggccagcccgagcccgccaaggaccagcagcagaaggccgcccagcaccacaccgaggagcaguccaaggucccccccgagcagaagcgcaaggccggcuccaccuccuggaccggcuuccagaccaaggccgaggucgagcaggucgagcuccccgacggcaagaagcgccgcaagguccucgcccuccccucccaccgcggccccaagauccgccuccgcgacaagggcaaggucaagcccguccaccccaagaagcccaagccccagaucaaccaguggaagcaggagaagcagcagcucuccuccgagcaggucucccgcaagaaggccaagggcaacaagaccgagacccgcuucaaccagcucgucgagcaguacaagcagaagcuccucggccccuccaagggcgccccccucgccaagcgcuccaagugguucgacuccuga

SEQ ID NO: 48602 - RNA, 816 nt, Artificial Sequence
  derived and/or modified sequence opt2 from RBM38__Homo_sapiens__NP_001278709
augcuccuccagcccgcccccugcgcccccuccgccggcuucccccgcccccucgccgcccccggcgccaugcacggcucccagaaggacaccaccuucaccaagaucuucgucggcggccuccccuaccacaccaccgacgccucccuccgcaaguacuucgagggcuucggcgacaucgaggaggccgucgucaucaccgaccgccagaccggcaagucccgcggcuacggcuucggcaucaucuucguccucgagggccacaucucccaggcccucaacuucgacggccgcuccuggaaccccggcggcaucuucgucggcgagccccaggucaccauggccgaccgcgccgccgccgagcgcgccugcaaggaccccaaccccaucaucgacggccgcaaggccaacgucaaccucgccuaccucggcgccaagccccgcucccuccagaccggcuucgccaucggcguccagcagcuccaccccacccucauccagcgcaccuacggccucaccccccacuacaucuacccccccgccaucguccagcccuccgucgucauccccgccgcccccguccccucccucuccucccccuacaucgaguacacccccgccucccccgccuacgcccaguacccccccgccaccuacgaccaguaccccuacgccgccucccccgccaccgccgccuccuucgucggcuacuccuaccccgccgccgucccccaggcccucuccgccgccgcccccgccggcaccaccuucguccaguaccaggccccccagcuccagcccgaccgcaugcaguga

SEQ ID NO: 48603 - RNA, 1527 nt, Artificial Sequence
  derived and/or modified sequence opt2 from RBM39__Homo_sapiens__NP_001229528
auggccgacgacaucgacaucgaggccaugcucgaggcccccuacaagaaggacgagaacaagcucuccuccgccaacggccacgaggagcgcuccaagaagcgcaagaaguccaagucccgcucccgcucccacgagcgcaagcgcuccaaguccaaggagcgcaagcgcucccgcgaccgcgagcgcaagaaguccaagucccgcgagcgcaagcgcucccgcuccaaggagcgccgccgcucccgcucccgcucccgcgaccgccgcuuccgcggccgcuaccgcucccccuaccgccgccgcucccgcuccaagucccccuuccgcaaggacaagucccccguccgcgagcccaucgacaaccucacccccgaggagcgcgacgcccgcaccgucuucugcaugcagcucgccgcccgcauccgcccccgcgaccucgaggaguucuucuccaccgucggcaagguccgcgacguccgcaugaucuccgaccgcaacucccgccgcuccaagggcaucgccuacgucgaguucgucgacgucuccuccgucccccucgccaucggccucaccggccagcgcguccucggcguccccaucaucguccaggccucccaggccgagaagaaccgcgccgccgccauggccaacaaccuccagaagggcuccgccggccccaugcgccucuacgucggcucccuccacuucaacaucaccgaggacaugcuccgcggcaucuucgagcccuucggccgcaucgaguccauccagcucaugauggacuccgagaccggccgcuccaagggcuacggcuucaucaccuucuccgacuccgagugcgccaagaaggcccucgagcagcucaacggcuucgagcucgccggccgccccaugaaggucggccacgucaccgagcgcaccgacgccuccuccgccuccuccuuccucgacuccgacgagcucgagcgcaccggcaucgaccucggcaccaccggccgccuccagcucauggcccgccucgccgagggcaccggccuccagaucccccccgccgcccagcaggcccuccagauguccggcucccucgccuucggcgccgucgccgaguucuccuucgucaucgaccuccagacccgccucucccagcagaccgaggccuccgcccucgccgccgccgccuccguccagccccucgccacccagugcuuccagcucuccaacauguucaacccccagaccgaggaggaggucggcugggacaccgagaucaaggacgacgucaucgaggagugcaacaagcacggcggcgucauccacaucuacgucgacaagaacuccgcccagggcaacgucuacgucaagugccccuccaucgccgccgccaucgccgccgucaacgcccuccacggccgcugguucgccggcaagaugaucaccgccgccuacgucccccuccccaccuaccacaaccucuuccccgacuccaugaccgccacccagcuccucguccccucccgccgcuga

SEQ ID NO: 48604 - RNA, 474 nt, Artificial Sequence
  derived and/or modified sequence opt2 from RBM3__Homo_sapiens__NP_006734
auguccuccgaggagggcaagcucuucgucggcggccucaacuucaacaccgacgagcaggcccucgaggaccacuucuccuccuucggccccaucuccgaggucgucgucgucaaggaccgcgagacccagcgcucccgcggcuucggcuucaucaccuucaccaaccccgagcacgccuccgucgccaugcgcgccaugaacggcgagucccucgacggccgccagauccgcgucgaccacgccggcaaguccgcccgcggcacccgcggcggcggcuucggcgcccacggccgcggccgcuccuacucccgcggcggcggcgaccagggcuacggcuccggccgcuacuacgacucccgccccggcggcuacggcuacggcuacggccgcucccgcgacuacaacggccgcaaccagggcggcuacgaccgcuacuccggcggcaacuaccgcgacaacuacgacaacuga

SEQ ID NO: 48605 - RNA, 1425 nt, Artificial Sequence
  derived and/or modified sequence opt2 from RBM45__Homo_sapiens__NP_694453
auggacgaggccggcuccuccgccuccggcggcggcuuccgccccggcgucgacucccucgacgagccccccaacucccgcaucuuccucgucaucuccaaguacacccccgaguccguccuccgcgagcgcuucucccccuucggcgacauccaggacaucugggucguccgcgacaagcacaccaaggaguccaagggcaucgccuucgucaaguucgcccgcuccucccaggccugccgcgccauggaggagaugcacggccagugccucggccccaacgacaccaagcccaucaaggucuucaucgcccagucccgcuccuccggcucccaccgcgacgucgaggacgaggagcucacccgcaucuucgucaugauccccaaguccuacaccgaggaggaccuccgcgagaaguucaaggucuacggcgacaucgaguacugcuccaucaucaagaacaaggucaccggcgaguccaagggccucggcuacguccgcuaccucaagcccucccaggccgcccaggccaucgagaacugcgaccgcuccuuccgcgccauccucgccgagcccaagaacaaggccuccgaguccuccgagcaggacuacuacuccaacaugcgccaggaggcccucggccacgagccccgcgucaacauguuccccuucgagcagcaguccgaguucuccuccuucgacaagaacgacucccgcggccaggaggccaucuccaagcgccucuccgucgucucccgcguccccuucaccgaggagcagcucuucuccaucuucgacaucguccccggccucgaguacugcgagguccagcgcgaccccuacuccaacuacggccacggcgucguccaguacuucaacgucgccuccgccaucuacgccaaguacaagcuccacggcuuccaguacccccccggcaaccgcaucggcgucuccuucaucgacgacggcuccaacgccaccgaccuccuccgcaagauggccacccagauggucgccgcccagcucgccuccauggucuggaacaaccccucccagcagcaguucaugcaguucggcggcuccuccggcucccagcucccccagauccagaccgacgucguccuccccuccugcaagaagaaggcccccgccgagacccccgucaaggagcgccucuucaucgucuucaacccccacccccucccccucgacguccucgaggacaucuucugccgcuucggcaaccucaucgaggucuaccucgucuccggcaagaacgucggcuacgccaaguacgccgaccgcaucuccgccaacgacgccaucgccacccuccacggcaagauccucaacggcguccgccucaaggucaugcucgccgacuccccccgcgaggaguccaacaagcgccagcgcaccuacuga

SEQ ID NO: 48606 - RNA, 1602 nt, Artificial Sequence
  derived and/or modified sequence opt2 from RBM46__Homo_sapiens__NP_659416
augaacgaggagaacaucgacggcaccaacggcugcuccaagguccgcaccggcauccagaacgaggccgcccuccucgcccucauggagaagaccggcuacaacaugguccaggagaacggccagcgcaaguucggcggccccccccccggcugggagggccccccccccccccgcggcugcgaggucuucgucggcaagaucccccgcgacauguacgaggacgagcucguccccgucuucgagcgcgccggcaagaucuacgaguuccgccucaugauggaguucuccggcgagaaccgcggcuacgccuucgucauguacaccaccaaggaggaggcccagcucgccauccgcauccucaacaacuacgagauccgccccggcaaguucaucggcgucugcgucucccucgacaacugccgccucuucaucggcgccauccccaaggagaagaagaaggaggagauccucgacgagaugaagaaggucaccgagggcgucgucgacgucaucgucuaccccuccgccaccgacaagaccaagaaccgcggcuucgccuucgucgaguacgagucccaccgcgccgccgccauggcccgccgcaagcucauccccggcaccuuccagcucuggggccacaccauccaggucgacugggccgaccccgagaaggaggucgacgaggagaccaugcagcgcgucaagguccucuacguccgcaaccucaugaucuccaccaccgaggagaccaucaaggccgaguucaacaaguucaagcccggcgccgucgagcgcgucaagaagcuccgcgacuacgccuucguccacuucuucaaccgcgaggacgccgucgccgccauguccgucaugaacggcaagugcaucgacggcgccuccaucgaggucacccucgccaagcccgucaacaaggagaacaccuggcgccagcaccucaacggccagaucucccccaacuccgagaaccucaucgucuucgccaacaaggaggagucccaccccaagacccucggcaagcuccccacccuccccgcccgccucaacggccagcacucccccuccccccccgaggucgagcgcugcaccuaccccuucuaccccggcaccaagcucacccccaucuccauguacucccucaaguccaaccacuucaacuccgccgucaugcaccucgacuacuacugcaacaagaacaacugggccccccccgaguacuaccucuacuccaccaccucccaggacggcaagguccuccucgucuacaagaucgucauccccgccaucgccaacggcucccaguccuacuucaugcccgacaagcucugcaccacccucgaggacgccaaggagcucgccgcccaguucacccuccuccaccucgacuacaacuuccaccgcuccuccaucaacucccucucccccgucuccgccacccucuccuccggcacccccuccguccuccccuacaccucccgccccuacuccuaccccggcuacccccucucccccaccaucucccucgccaacggcucccacgucggccagcgccucugcaucuccaaccaggccuccuucuucuga

SEQ ID NO: 48607 - RNA, 1782 nt, Artificial Sequence
  derived and/or modified sequence opt2 from RBM47__Homo_sapiens__NP_001092104
augaccgccgaggacuccaccgccgccauguccuccgacuccgccgccggcuccuccgccaagguccccgagggcgucgccggcgcccccaacgaggccgcccuccucgcccucauggagcgcaccggcuacuccaugguccaggagaacggccagcgcaaguacggcggccccccccccggcugggagggcccccacccccagcgcggcugcgaggucuucgucggcaagaucccccgcgacgucuacgaggacgagcucguccccgucuucgaggccgucggccgcaucuacgagcuccgccucaugauggacuucgacggcaagaaccgcggcuacgccuucgucauguacugccacaagcacgaggccaagcgcgccguccgcgagcucaacaacuacgagauccgccccggccgccuccucggcgucugcugcuccgucgacaacugccgccucuucaucggcggcauccccaagaugaagaagcgcgaggagauccucgaggagaucgccaaggucaccgagggcguccucgacgucaucgucuacgccuccgccgccgacaagaugaagaaccgcggcuucgccuucgucgaguacgagucccaccgcgccgccgccauggcccgccgcaagcucaugcccggccgcauccagcucuggggccaccagaucgccgucgacugggccgagcccgagaucgacgucgacgaggacgucauggagaccgucaagauccucuacguccgcaaccucaugaucgagaccaccgaggacaccaucaagaaguccuucggccaguucaaccccggcugcgucgagcgcgucaagaagauccgcgacuacgccuucguccacuucaccucccgcgaggacgccguccacgccaugaacaaccucaacggcaccgagcucgagggcuccugccucgaggucacccucgccaagcccgucgacaaggagcaguacucccgcuaccagaaggccgcccgcggcggcggcgccgccgaggccgcccagcagcccuccuacgucuacuccugcgaccccuacacccucgccuacuacggcuaccccuacaacgcccucaucggccccaaccgcgacuacuucgucaaggccggcuccauccgcggccgcggccgcggcgccgccggcaaccgcgcccccggcccccgcggcuccuaccucggcggcuacuccgccggccgcggcaucuacucccgcuaccacgagggcaagggcaagcagcaggagaagggcuacgagcucguccccaaccucgagauccccaccgucaaccccgucgccaucaagcccggcaccgucgccauccccgccaucggcgcccaguacuccauguuccccgccgcccccgcccccaagaugaucgaggacggcaagauccacaccgucgagcacaugaucucccccaucgccguccagcccgaccccgccuccgccgccgccgccgccgccgccgccgccgccgccgccgccgccgucauccccaccgucuccacccccccccccuuccagggccgccccaucacccccgucuacaccgucgcccccaacguccagcgcauccccaccgccggcaucuacggcgccuccuacguccccuucgccgcccccgccaccgccaccaucgccacccuccagaagaacgccgccgccgccgccgccauguacggcggcuacgccggcuacaucccccaggccuuccccgccgccgccauccagguccccauccccgacgucuaccagaccuacuga

SEQ ID NO: 48608 - RNA, 432 nt, Artificial Sequence
  derived and/or modified sequence opt2 from RBM4__Homo_sapiens__NP_001185772
auggucaagcucuucaucggcaaccucccccgcgaggccaccgagcaggagauccgcucccucuucgagcaguacggcaagguccucgagugcgacaucaucaagaacuacggcuucguccacaucgaggacaagaccgccgccgaggacgccauccgcaaccuccaccacuacaagcuccacggcgucaacaucaacgucgaggccuccaagaacaaguccaagaccuccaccaagcuccacgucggcaacaucucccccaccugcaccaacaaggagcuccgcgccaaguucgaggaguacggccccgucaucgagugcgacaucgucaaggacuacgccuucguccacauggagcgcgccgaggacgccgucgaggccauccgcggccucgacaacaccgaguuccagggcggcaugugcgucggcuga

SEQ ID NO: 48609 - RNA, 2448 nt, Artificial Sequence
  derived and/or modified sequence opt2 from RBM5__Homo_sapiens__NP_005769
augggcuccgacaagcgcgucucccgcaccgagcgcuccggccgcuacggcuccaucaucgaccgcgacgaccgcgacgagcgcgagucccgcucccgccgccgcgacuccgacuacaagcgcuccuccgacgaccgccgcggcgaccgcuacgacgacuaccgcgacuacgacucccccgagcgcgagcgcgagcgccgcaacuccgaccgcuccgaggacggcuaccacuccgacggcgacuacggcgagcacgacuaccgccacgacaucuccgacgagcgcgaguccaagaccaucaugcuccgcggccuccccaucaccaucaccgaguccgacauccgcgagaugauggaguccuucgagggcccccagcccgccgacguccgccucaugaagcgcaagaccggcgucucccgcggcuucgccuucgucgaguucuaccaccuccaggacgccaccuccuggauggaggccaaccagaagaagcucgucauccagggcaagcacaucgccaugcacuacuccaacccccgccccaaguucgaggacuggcucugcaacaagugcugccucaacaacuuccgcaagcgccucaagugcuuccgcugcggcgccgacaaguucgacuccgagcaggaggucccccccggcaccaccgaguccguccaguccgucgacuacuacugcgacaccaucauccuccgcaacaucgccccccacaccgucgucgacuccaucaugaccgcccucucccccuacgccucccucgccgucaacaacauccgccucaucaaggacaagcagacccagcagaaccgcggcuucgccuucguccagcucuccuccgccauggacgccucccagcuccuccagauccuccagucccuccaccccccccucaagaucgacggcaagaccaucggcgucgacuucgccaaguccgcccgcaaggaccucguccucuccgacggcaaccgcgucuccgccuucuccgucgccuccaccgccaucgccgccgcccagugguccuccacccagucccaguccggcgagggcggcuccgucgacuacuccuaccuccagcccggccaggacggcuacgcccaguacgcccaguacucccaggacuaccagcaguucuaccagcagcaggccggcggccucgaguccgacgccuccuccgccuccggcaccgccgucaccaccaccuccgccgccgucgucucccaguccccccagcucuacaaccagaccuccaacccccccggcucccccaccgaggaggcccagcccuccaccuccaccuccacccaggcccccgccgccucccccaccggcgucguccccggcaccaaguacgccguccccgacaccuccaccuaccaguacgacgaguccuccggcuacuacuacgaccccaccaccggccucuacuacgaccccaacucccaguacuacuacaacucccucacccagcaguaccucuacugggacggcgagaaggagaccuacguccccgccgccgaguccuccucccaccagcaguccggccucccccccgccaaggagggcaaggagaagaaggagaagcccaaguccaagaccgcccagcagaucgccaaggacauggagcgcugggccaagucccucaacaagcagaaggagaacuucaagaacuccuuccagcccgucaacucccuccgcgaggaggagcgccgcgaguccgccgccgccgacgccggcuucgcccucuucgagaagaagggcgcccucgccgagcgccagcagcucauccccgagcucguccgcaacggcgacgaggagaacccccucaagcgcggccucgucgccgccuacuccggcgacuccgacaacgaggaggagcucgucgagcgccucgaguccgaggaggagaagcucgccgacuggaagaagauggccugccuccucugccgccgccaguuccccaacaaggacgcccucguccgccaccagcagcucuccgaccuccacaagcagaacauggacaucuaccgccgcucccgccucuccgagcaggagcucgaggcccucgagcuccgcgagcgcgagaugaaguaccgcgaccgcgccgccgagcgccgcgagaaguacggcauccccgagccccccgagcccaagcgcaagaagcaguucgacgccggcaccgucaacuacgagcagcccaccaaggacggcaucgaccacuccaacaucggcaacaagaugcuccaggccaugggcuggcgcgagggcuccggccucggccgcaagugccagggcaucaccgcccccaucgaggcccagguccgccucaagggcgccggccucggcgccaagggcuccgccuacggccucuccggcgccgacuccuacaaggacgccguccgcaaggccauguucgcccgcuucaccgagauggaguga

SEQ ID NO: 48610 - RNA, 3372 nt, Artificial Sequence
  derived and/or modified sequence opt2 from RBM6__Homo_sapiens__NP_005768
auguggggcgacucccgccccgccaaccgcaccggccccuuccgcggcucccaggaggagcgcuucgcccccggcuggaaccgcgacuaccccccccccccccucaagucccacgcccaggagcgccacuccggcaacuuccccggccgcgacucccuccccuucgacuuccagggccacuccggcccccccuucgccaacgucgaggagcacuccuucuccuacggcgcccgcgacggcccccacggcgacuaccgcggcggcgagggccccggccacgacuuccgcggcggcgacuucuccuccuccgacuuccagucccgcgacuccucccagcucgacuuccgcggccgcgacauccacuccggcgacuuccgcgaccgcgagggcccccccauggacuaccgcggcggcgacggcaccuccauggacuaccgcggccgcgaggccccccacaugaacuaccgcgaccgcgacgcccacgccgucgacuuccgcggccgcgacgccccccccuccgacuuccgcggccgcggcaccuacgaccucgacuuccgcggccgcgacggcucccacgccgacuuccgcggccgcgaccucuccgaccucgacuuccgcgcccgcgagcagucccgcuccgacuuccgcaaccgcgacgucuccgaccucgacuuccgcgacaaggacggcacccaggucgacuuccgcggccgcggcuccggcaccaccgaccucgacuuccgcgaccgcgacaccccccacuccgacuuccgcggccgccaccgcucccgcaccgaccaggacuuccgcggccgcgagaugggcuccugcauggaguucaaggaccgcgagaugccccccgucgaccccaacauccucgacuacauccagcccuccacccaggaccgcgagcacuccggcaugaacgucaaccgccgcgaggaguccacccacgaccacaccaucgagcgccccgccuucggcauccagaagggcgaguucgagcacuccgagacccgcgagggcgagacccagggcgucgccuucgagcacgagucccccgccgacuuccagaacucccagucccccguccaggaccaggacaagucccagcucuccggccgcgaggagcaguccuccgacgccggccucuucaaggaggagggcggccucgacuuccucggccgccaggacaccgacuaccgcuccauggaguaccgcgacgucgaccaccgccuccccggcucccagauguucggcuacggccaguccaaguccuuccccgagggcaagaccgcccgcgacgcccagcgcgaccuccaggaccaggacuaccgcaccggccccuccgaggagaagcccucccgccucauccgccucuccggcguccccgaggacgccaccaaggaggagauccucaacgccuuccgcacccccgacggcaugcccgucaagaaccuccagcucaaggaguacaacaccggcuacgacuacggcuacgucugcgucgaguucucccuccucgaggacgccaucggcugcauggaggccaaccagggcacccucaugauccaggacaaggaggucacccucgaguacgucuccucccucgacuucugguacugcaagcgcugcaaggccaacaucggcggccaccgcuccuccugcuccuucugcaagaacccccgcgaggucaccgaggccaagcaggagcucaucaccuacccccagccccagaagaccuccauccccgccccccucgagaagcagcccaaccagccccuccgccccgccgacaaggagcccgagccccgcaagcgcgaggagggccaggagucccgccucggccaccagaagcgcgaggccgagcgcuaccucccccccucccgccgcgagggccccaccuuccgccgcgaccgcgagcgcgaguccugguccggcgagacccgccaggacggcgaguccaagaccaucaugcucaagcgcaucuaccgcuccaccccccccgaggucaucgucgagguccucgagcccuacguccgccucaccaccgccaacguccgcaucaucaagaaccgcaccggccccaugggccacaccuacggcuucaucgaccucgacucccacgccgaggcccuccgcgucgucaagauccuccagaaccucgacccccccuucuccaucgacggcaagauggucgccgucaaccucgccaccggcaagcgccgcaacgacuccggcgaccacuccgaccacaugcacuacuaccagggcaagaaguacuuccgcgaccgccgcggcggcggccgcaacuccgacugguccuccgacaccaaccgccagggccagcaguccuccuccgacugcuacaucuacgacuccgccaccggcuacuacuacgacccccucgccggcaccuacuacgaccccaacacccagcaggaggucuacgucccccaggaccccggccuccccgaggaggaggagaucaaggagaagaagcccaccucccagggcaaguccuccuccaagaaggagauguccaagcgcgacggcaaggagaagaaggaccgcggcgucacccgcuuccaggagaacgccuccgagggcaaggcccccgccgaggacgucuucaagaagccccucccccccaccgucaagaaggaggaguccccccccccccccaaggucgucaacccccucaucggccuccucggcgaguacggcggcgacuccgacuacgaggaggaggaggaggaggagcagaccccccccccccagccccgcaccgcccagccccagaagcgcgaggagcagaccaagaaggagaacgaggaggacaagcucaccgacuggaacaagcucgccugccuccucugccgccgccaguuccccaacaaggagguccucaucaagcaccagcagcucuccgaccuccacaagcagaaccucgagauccaccgcaagaucaagcaguccgagcaggagcucgccuaccucgagcgccgcgagcgcgagggcaaguucaagggccgcggcaacgaccgccgcgagaagcuccaguccuucgacucccccgagcgcaagcgcaucaaguacucccgcgagaccgacuccgaccgcaagcucgucgacaaggaggacaucgacaccuccuccaagggcggcugcguccagcaggccaccggcuggcgcaagggcaccggccucggcuacggccaccccggccucgccuccuccgaggaggccgagggccgcaugcgcggccccuccgucggcgccuccggccgcaccuccaagcgccaguccaacgagaccuaccgcgacgccguccgccgcgucauguucgcccgcuacaaggagcucgacuga

SEQ ID NO: 48611 - RNA, 801 nt, Artificial Sequence
  derived and/or modified sequence opt2 from RBM7__Homo_sapiens__NP_057174
augggcgccgccgccgccgaggccgaccgcacccucuucgucggcaaccucgagaccaaggucaccgaggagcuccucuucgagcucuuccaccaggccggccccgucaucaaggucaagauccccaaggacaaggacggcaagcccaagcaguucgccuucgucaacuucaagcacgaggucuccguccccuacgccaugaaccuccucaacggcaucaagcucuacggccgccccaucaagauccaguuccgcuccggcuccucccacgccccccaggacgucucccucuccuacccccagcaccacgucggcaacuccucccccaccuccaccucccccucccgcuacgagcgcaccauggacaacaugaccuccuccgcccagaucauccagcgcuccuucuccucccccgagaacuuccagcgccaggccgucaugaacuccgcccuccgccagauguccuacggcggcaaguucggcuccuccccccucgaccaguccggcuucucccccuccguccagucccacucccacuccuucaaccaguccuccuccucccaguggcgccagggcacccccuccucccagcgcaagguccgcaugaacuccuaccccuaccucgccgaccgccacuacucccgcgagcagcgcuacaccgaccacggcuccgaccaccacuaccgcggcaagcgcgacgacuucuucuacgaggaccgcaaccacgacgacuggucccacgacuacgacaaccgccgcgacuccucccgcgacggcaaguggcgcuccucccgccacuga

SEQ ID NO: 48612 - RNA, 1212 nt, Artificial Sequence
  derived and/or modified sequence opt2 from RBMS1__Homo_sapiens__NP_002888
augggcaaggucuggaagcagcagauguacccccaguacgccaccuacuacuacccccaguaccuccaggccaagcagucccucguccccgcccaccccauggccccccccucccccuccaccaccuccuccaacaacaacuccuccuccuccuccaacuccggcugggaccagcucuccaagaccaaccucuacauccgcggccuccccccccacaccaccgaccaggaccucgucaagcucugccagcccuacggcaagaucgucuccaccaaggccauccucgacaagaccaccaacaagugcaagggcuacggcuucgucgacuucgacucccccgccgccgcccagaaggccgucuccgcccucaaggccuccggcguccaggcccagauggccaagcagcaggagcaggaccccaccaaccucuacaucuccaaccucccccucuccauggacgagcaggagcucgagaacaugcucaagcccuucggccaggucaucuccacccgcauccuccgcgacuccuccggcaccucccgcggcgucggcuucgcccgcauggaguccaccgagaagugcgaggccgucaucggccacuucaacggcaaguucaucaagaccccccccggcgucuccgcccccaccgagccccuccucugcaaguucgccgacggcggccagaagaagcgccagaaccccaacaaguacauccccaacggccgccccuggcaccgcgagggcgaggccggcaugacccucaccuacgaccccaccaccgccgccauccagaacggcuucuaccccucccccuacuccaucgccaccaaccgcaugaucacccagaccuccaucacccccuacaucgccucccccgucuccgccuaccagguccagucccccuccuggaugcagccccagcccuacauccuccagcaccccggcgccguccucacccccuccauggagcacaccaugucccuccagcccgccuccaugaucuccccccucgcccagcagaugucccaccucucccucggcuccaccggcaccuacaugcccgccaccuccgccaugcagggcgccuaccucccccaguacgcccacaugcagaccaccgccguccccgucgaggaggccuccggccagcagcaggucgccgucgagaccuccaacgaccacucccccuacaccuuccagcccaacaaguga

SEQ ID NO: 48613 - RNA, 1224 nt, Artificial Sequence
  derived and/or modified sequence opt2 from RBMS2__Homo_sapiens__NP_002889
augcuccucuccgucaccucccgccccggcaucuccaccuucggcuacaaccgcaacaacaagaagcccuacgucucccucgcccagcagauggccccccccucccccuccaacuccacccccaacuccuccuccggcuccaacggcaacgaccagcucuccaagaccaaccucuacauccgcggccuccagcccggcaccaccgaccaggaccucgucaagcucugccagcccuacggcaagaucgucuccaccaaggccauccucgacaagaccaccaacaagugcaagggcuacggcuucgucgacuucgacucccccuccgccgcccagaaggccgucaccgcccucaaggccuccggcguccaggcccagauggccaagcagcaggagcaggaccccaccaaccucuacaucuccaaccucccccucuccauggacgagcaggagcucgagggcaugcucaagcccuucggccaggucaucuccacccgcauccuccgcgacaccuccggcaccucccgcggcgucggcuucgcccgcauggaguccaccgagaagugcgaggccaucaucacccacuucaacggcaaguacaucaagaccccccccggcguccccgcccccuccgacccccuccucugcaaguucgccgacggcggccccaagaagcgccagaaccagggcaaguucguccagaacggccgcgccuggccccgcaacgccgacaugggcgucauggcccucaccuacgaccccaccaccgcccuccagaacggcuucuaccccgcccccuacaacaucacccccaaccgcaugcucgcccaguccgcccucucccccuaccucuccucccccgucuccuccuaccagcgcgucacccagaccuccccccuccagguccccaaccccuccuggaugcaccaccacuccuaccucaugcagcccuccggcuccguccucacccccggcauggaccaccccaucucccuccagcccgccuccaugaugggcccccucacccagcagcucggccaccucucccucuccuccaccggcaccuacaugcccaccgccgccgccaugcagggcgccuacaucucccaguacacccccguccccuccuccuccgucuccgucgaggaguccuccggccagcagaaccaggucgccgucgacgcccccuccgagcacggcgucuacuccuuccaguucaacaaguga

SEQ ID NO: 48614 - RNA, 1260 nt, Artificial Sequence
  derived and/or modified sequence opt2 from RBMS3__Homo_sapiens__NP_001003792
augggcaagcgccucgaccagccccagauguacccccaguacaccuacuacuacccccacuaccuccagaccaaguccuacgcccccgccccccaccccauggccccccccucccccuccaccaacuccuccuccaacaacuccuccaacaacuccuccggcgagcagcucuccaagaccaaccucuacauccgcggccucccccccggcaccaccgaccaggaccucaucaagcucugccagcccuacggcaagaucgucuccaccaaggccauccucgacaagaacaccaaccagugcaagggcuacggcuucgucgacuucgacucccccgccgccgcccagaaggccgucgccucccucaaggccaacggcguccaggcccagauggccaagcagcaggagcaggaccccaccaaccucuacaucuccaaccuccccaucuccauggacgagcaggagcucgagaacaugcucaagcccuucggccacgucaucuccacccgcauccuccgcgacgccaacggcgucucccgcggcgucggcuucgcccgcauggaguccaccgagaagugcgaggucgucauccagcacuucaacggcaaguaccucaagaccccccccggcauccccgcccccuccgagccccuccucugcaaguucgccgacggcggccagaagaagcgccagaaccaguccaaguacacccagaacggccgccccuggccccgcgagggcgaggccggcauggcccucaccuacgaccccaccgccgccauccagaacggcuucuacuccucccccuacuccaucgccaccaaccgcaugaucccccagaccuccaucacccccuucaucgccgccucccccgucuccaccuaccagggcgccgucaucacccccaccauggaccaccccauguccaugcagcccgccaacaugaugggcccccucacccagcagaugaaccaccucucccucggcaccaccggcaccauccagucccaggaccgcaucaugauccuccaccagcuccucugccaguacaugaccgccgccgcccccaugcagggcaccuacaucccccaguacacccccgucccccccaccgccgucuccaucgagggcgucgucgccgacaccuccccccagaccgucgcccccuccucccaggacaccuccggccagcagcagcagaucgccgucgacaccuccaacgagcacgcccccgccuacuccuaccagcaguccaagcccuga

SEQ ID NO: 48615 - RNA, 969 nt, Artificial Sequence
  derived and/or modified sequence opt2 from RBMX2__Homo_sapiens__NP_057108
augaacccccucaccaaggucaagcucaucaacgagcucaacgagcgcgagguccagcucggcgucgccgacaaggucuccuggcacuccgaguacaaggacuccgccuggaucuuccucggcggccuccccuacgagcucaccgagggcgacaucaucugcgucuucucccaguacggcgagaucgucaacaucaaccucguccgcgacaagaagaccggcaaguccaagggcuucugcuuccucugcuacgaggaccagcgcuccaccauccucgccgucgacaacuucaacggcaucaagaucaagggccgcaccauccgcgucgaccacgucuccaacuaccgcgcccccaaggacuccgaggagaucgacgacgucacccgccagcuccaggagaagggcugcggcgcccgcacccccucccccucccucuccgaguccuccgaggacgagaagcccaccaagaagcacaagaaggacaagaaggagaagaagaagaagaagaaggagaaggagaaggccgaccgcgagguccaggccgagcagcccuccuccuccuccccccgccgcaagaccgucaaggagaaggacgacaccggccccaagaagcacuccuccaagaacuccgagcgcgcccagaaguccgagccccgcgagggccagaagcuccccaagucccgcaccgccuacuccggcggcgccgaggaccucgagcgcgagcucaagaaggagaagcccaagcacgagcacaaguccuccucccgccgcgaggcccgcgaggagaagacccgcauccgcgaccgcggccgcuccuccgacgcccacuccuccugguacaacggccgcuccgagggccgcuccuaccgcucccgcucccgcucccgcgacaagucccaccgccacaagcgcgcccgccgcucccgcgagcgcgaguccuccaaccccuccgaccgcuggcgccacuga

SEQ ID NO: 48616 - RNA, 591 nt, Artificial Sequence
  derived and/or modified sequence opt2 from RBMX__Homo_sapiens__NP_001158275
auggucgaggccgaccgccccggcaagcucuucaucggcggccucaacaccgagaccaacgagaaggcccucgaggccgucuucggcaaguacggccgcaucgucgagguccuccucaugaaggaccgcgagaccaacaagucccgcggcuucgccuucgucaccuucgagucccccgccgacgccaaggacgccgcccgcgacaugaacggcaagcuccucuaccacgucgaggagaucgucauggagguccaccucgagggcaaccgcugcccccucgucgagauguucaucugcccccaggagaugaugggcauccuccucaagaccgccauccaggccgagaucacccagguccucgucauccucgagaucaugcaccaccaccacgagaucauccucaccgucaucauggucauccccguccacgucaugaccauccaccaggaggacaucgccaucgagauggacauggucgucaucgucaccauccagaucauccaggucgagguccccaccgagauccacaugcgcgucauggucggcgacuucgcccacuacggccgcggcguccucaucgacucccaguga

SEQ ID NO: 48617 - RNA, 1179 nt, Artificial Sequence
  derived and/or modified sequence opt2 from RBMXL2__Homo_sapiens__NP_055284
auggucgaggccgaccgccccggcaagcucuucaucggcggccucaaccucgagaccgacgagaaggcccucgaggccgaguucggcaaguacggccgcaucgucgagguccuccucaugaaggaccgcgagaccaacaagucccgcggcuucgccuucgucaccuucgagucccccgccgacgccaaggccgccgcccgcgacaugaacggcaagucccucgacggcaaggccaucaaggucgcccaggccaccaagcccgccuucgaguccucccgccgcggccccccccccccccgcucccgcggccgcccccgcuuccuccgcggcacccgcggcggcggcggcggcccccgccgcucccccucccgcggcggccccgacgacgacggcggcuacaccgccgacuucgaccuccgccccucccgcgcccccaugcccaugaagcgcggcccccccccccgccgcgucggccccccccccaagcgcgccgcccccuccggccccgcccgcuccuccggcggcggcaugcgcggccgcgcccucgccguccgcggccgcgacggcuacuccggccccccccgccgcgagccccuccccccccgccgcgaccccuaccucggcccccgcgacgagggcuacuccucccgcgacggcuacuccucccgcgacuaccgcgagccccgcggcuucgcccccucccccggcgaguacacccaccgcgacuacggccacuccuccguccgcgacgacugcccccuccgcggcuacuccgaccgcgacggcuacggcggccgcgaccgcgacuacggcgaccaccucucccgcggcucccaccgcgagcccuucgaguccuacggcgagcuccgcggcgccgcccccggccgcggcaccccccccuccuacggcggcggcggccgcuacgaggaguaccgcggcuacucccccgacgccuacuccggcggccgcgacuccuacuccuccuccuacggccgcuccgaccgcuacucccgcggccgccaccgcgucggccgccccgaccgcggccucucccucuccauggagcgcggcugccccccccagcgcgacuccuacucccgcuccggcugccgcgucccccgcggcggcggccgccucggcggccgccucgagcgcggcggcggccgcucccgcuacuga

SEQ ID NO: 48618 - RNA, 1491 nt, Artificial Sequence
  derived and/or modified sequence opt2 from RBMY1A1__Homo_sapiens__XP_011529738
auggucgaggccgaccaccccggcaagcucuucaucggcggccucaaccgcgagaccaacgagaagaugcucaaggccgucuucggcaagcacggccccaucuccgagguccuccucaucaaggaccgcaccuccaagucccgcggcuucgccuucaucaccuucgagaaccccgccgacgccaagaacgccgccaaggacaugaacggcaagucccuccacggcaaggccaucaaggucgagcaggccaagaagcccuccuuccaguccggcggccgccgccgcccccccgccuccucccgcaaccgcucccccuccggcucccuccgcuccgcccgcggcucccgcggcggcacccgcggcuggcuccccucccacgagggccaccucgacgacggcggcuacacccccgaccucaagauguccuacucccgcggccucauccccgucaagcgcggccccuccucccgcuccggcggccccccccccaagaaguccgcccccuccgccgucgcccgcuccaacuccuggaugggcucccagggccccaugucccagcgccgcgagaacuacggcguccccccccgccgcgccaccaucuccuccuggcgcaacgaccgcauguccacccgccacgacggcuacgccaccaacgacggcaaccaccccuccugccaggagacccgcgacuacgccccccccucccgcggcuacgccuaccgcgacaacggccacuccaaccgcgacgagcacuccucccgcggcuaccgcaaccaccgcuccucccgcgagacccgcgacuacgccccccccucccgcggccacgccuaccgcgacuacggccacucccgccgcgacgaguccuacucccgcggcuaccgcaaccgccgcuccucccgcgagacccgcgaguacgccccccccucccgcggccacggcuaccgcgacuacggccacucccgccgccacgaguccuacucccgcggcuaccgcaaccaccccuccucccgcgagacccgcgacuacgcccccccccaccgcgacuacgccuaccgcgacuacggccacuccuccugggacgagcacuccucccgcggcuacuccuaccacgacggcuacggcgaggcccucggccgcgaccacuccgagcaccucuccggcuccuccuaccgcgacgcccuccagcgcuacggcaccucccacggcgccccccccgcccgcggcccccgcauguccuacggcggcuccaccugccacgccuacuccaacacccgcgaccgcuacggccgcuccugggaguccuacuccuccugcggcgacuuccacuacugcgaccgcgagcacgucugccgcaaggaccagcgcaacccccccucccucggccgcguccuccccgacccccgcgaggccugcggcuccuccuccuacgucgccuccaucgucgacggcggcgagucccgcuccgagaagggcgacuccucccgcuacuga

SEQ ID NO: 48619 - RNA, 474 nt, Artificial Sequence
  derived and/or modified sequence opt2 from RBP1__Homo_sapiens__NP_001124464
auggacccccccgccggcuucguccgcgccggcaaccccgccgucgccgccccccaguccccccucucccccgagggcgcccacuuccgcgccgcccaccacccccgcuccaccggcucccgcugccccggcucccuccagcccucccgcccccucgucgccaacuggcuccagucccuccccgagaugcccgucgacuucaccggcuacuggaagaugcucgucaacgagaacuucgaggaguaccuccgcgcccucgacgucaacgucgcccuccgcaagaucgccaaccuccucaagcccgacaaggagaucguccaggacggcgaccacaugaucauccgcacccucuccaccuuccgcaacuacaucauggacuuccaggucggcaaggaguucgaggaggaccucaccggcaucgacgaccgcaagugcauggccggcguccagucccgcgaccucuccucccucuga

SEQ ID NO: 48620 - RNA, 405 nt, Artificial Sequence
  derived and/or modified sequence opt2 from RBP2__Homo_sapiens__NP_004155
augacccgcgaccagaacggcaccugggagauggaguccaacgagaacuucgagggcuacaugaaggcccucgacaucgacuucgccacccgcaagaucgccguccgccucacccagaccaaggucaucgaccaggacggcgacaacuucaagaccaagaccaccuccaccuuccgcaacuacgacgucgacuucaccgucggcgucgaguucgacgaguacaccaagucccucgacaaccgccacgucaaggcccucgucaccugggagggcgacguccucgucugcguccagaagggcgagaaggagaaccgcggcuggaagcaguggaucgagggcgacaagcucuaccucgagcucaccugcggcgaccaggucugccgccaggucuucaagaagaaguga

SEQ ID NO: 48621 - RNA, 3744 nt, Artificial Sequence
  derived and/or modified sequence opt2 from RBP3__Homo_sapiens__NP_002891
augaugcgcgaguggguccuccucauguccguccuccucugcggccucgccggccccacccaccucuuccagcccucccucguccucgacauggccaagguccuccucgacaacuacugcuuccccgagaaccuccucggcaugcaggaggccauccagcaggccaucaagucccacgagauccucuccaucuccgacccccagacccucgccuccguccucaccgccggcguccaguccucccucaacgacccccgccucgucaucuccuacgagcccuccacccccgagccccccccccagguccccgcccucaccucccucuccgaggaggagcuccucgccuggcuccagcgcggccuccgccacgagguccucgagggcaacgucggcuaccuccgcgucgacuccguccccggccaggagguccucuccaugaugggcgaguuccucgucgcccacgucuggggcaaccucaugggcaccuccgcccucguccucgaccuccgccacugcaccggcggccaggucuccggcauccccuacaucaucuccuaccuccaccccggcaacaccauccuccacgucgacaccaucuacaaccgccccuccaacaccaccaccgagaucuggacccucccccagguccucggcgagcgcuacggcgccgacaaggacgucgucguccucaccuccucccagacccgcggcgucgccgaggacaucgcccacauccucaagcagaugcgccgcgccaucgucgucggcgagcgcaccggcggcggcgcccucgaccuccgcaagcuccgcaucggcgaguccgacuucuucuucaccguccccgucucccgcucccucggcccccucggcggcggcucccagaccugggagggcuccggcguccuccccugcgucggcacccccgccgagcaggcccucgagaaggcccucgccauccucacccuccgcuccgcccuccccggcgucguccacugccuccaggagguccucaaggacuacuacacccucgucgaccgcguccccacccuccuccagcaccucgccuccauggacuucuccaccgucgucuccgaggaggaccucgucaccaagcucaacgccggccuccaggccgccuccgaggacccccgccuccucguccgcgccaucggccccaccgagacccccuccuggcccgcccccgacgccgccgccgaggacucccccggcgucgcccccgagcuccccgaggacgaggccauccgccaggcccucgucgacuccgucuuccaggucuccguccuccccggcaacgucggcuaccuccgcuucgacuccuucgccgacgccuccguccucggcguccucgcccccuacguccuccgccaggucugggagccccuccaggacaccgagcaccucaucauggaccuccgccacaaccccggcggccccuccuccgccgucccccuccuccucuccuacuuccagggccccgaggccggccccguccaccucuucaccaccuacgaccgccgcaccaacaucacccaggagcacuucucccacauggagcuccccggcccccgcuacuccacccagcgcggcgucuaccuccucaccucccaccgcaccgccaccgccgccgaggaguucgccuuccucaugcagucccucggcugggccacccucgucggcgagaucaccgccggcaaccuccuccacacccgcaccgucccccuccucgacacccccgagggcucccucgcccucaccguccccguccucaccuucaucgacaaccacggcgaggccuggcucggcggcggcgucguccccgacgccaucguccucgccgaggaggcccucgacaaggcccaggagguccucgaguuccaccagucccucggcgcccucgucgagggcaccggccaccuccucgaggcccacuacgcccgccccgaggucgucggccagaccuccgcccuccuccgcgccaagcucgcccagggcgccuaccgcaccgccgucgaccucgagucccucgccucccagcucaccgccgaccuccaggaggucuccggcgaccaccgccuccucgucuuccacucccccggcgagcucgucgucgaggaggcccccccccccccccccgccguccccucccccgaggagcucaccuaccucaucgaggcccucuucaagaccgagguccuccccggccagcucggcuaccuccgcuucgacgccauggccgagcucgagaccgucaaggccgucggcccccagcucguccgccucgucuggcagcagcucgucgacaccgccgcccucgucaucgaccuccgcuacaaccccggcuccuacuccaccgccaucccccuccucugcuccuacuucuucgaggccgagccccgccagcaccucuacuccgucuucgaccgcgccaccuccaaggucaccgaggucuggacccucccccaggucgccggccagcgcuacggcucccacaaggaccucuacauccucaugucccacaccuccggcuccgccgccgaggccuucgcccacaccaugcaggaccuccagcgcgccaccgucaucggcgagcccaccgccggcggcgcccucuccgucggcaucuaccaggucggcuccuccccccucuacgccuccaugcccacccagauggccauguccgccaccaccggcaaggccugggaccucgccggcgucgagcccgacaucaccguccccauguccgaggcccucuccaucgcccaggacaucgucgcccuccgcgccaagguccccaccguccuccagaccgccggcaagcucgucgccgacaacuacgccuccgccgagcucggcgccaagauggccaccaagcucuccggccuccagucccgcuacucccgcgucaccuccgaggucgcccucgccgagauccucggcgccgaccuccagaugcucuccggcgacccccaccucaaggccgcccacauccccgagaacgccaaggaccgcauccccggcaucguccccaugcagauccccucccccgaggucuucgaggagcucaucaaguucuccuuccacaccaacguccucgaggacaacaucggcuaccuccgcuucgacauguucggcgacggcgagcuccucacccaggucucccgccuccucgucgagcacaucuggaagaagaucaugcacaccgacgccaugaucaucgacaugcgcuucaacaucggcggccccaccuccuccauccccauccucugcuccuacuucuucgacgagggcccccccguccuccucgacaagaucuacucccgccccgacgacuccgucuccgagcucuggacccacgcccaggucgucggcgagcgcuacggcuccaagaaguccauggucauccucaccuccuccgucaccgccggcaccgccgaggaguucaccuacaucaugaagcgccucggccgcgcccucgucaucggcgaggucaccuccggcggcugccagcccccccagaccuaccacgucgacgacaccaaccucuaccucaccauccccaccgcccgcuccgucggcgccuccgacggcuccuccugggagggcgucggcgucaccccccacgucgucguccccgccgaggaggcccucgcccgcgccaaggagaugcuccagcacaaccagcuccgcgucaagcgcucccccggccuccaggaccaccucuga

SEQ ID NO: 48622 - RNA, 606 nt, Artificial Sequence
  derived and/or modified sequence opt2 from RBP4__Homo_sapiens__NP_006735
augaagugggucugggcccuccuccuccucgccgcccucggcuccggccgcgccgagcgcgacugccgcgucuccuccuuccgcgucaaggagaacuucgacaaggcccgcuucuccggcaccugguacgccauggccaagaaggaccccgagggccucuuccuccaggacaacaucgucgccgaguucuccgucgacgagaccggccagauguccgccaccgccaagggccgcguccgccuccucaacaacugggacgucugcgccgacauggucggcaccuucaccgacaccgaggaccccgccaaguucaagaugaaguacuggggcgucgccuccuuccuccagaagggcaacgacgaccacuggaucgucgacaccgacuacgacaccuacgccguccaguacuccugccgccuccucaaccucgacggcaccugcgccgacuccuacuccuucgucuucucccgcgaccccaacggccucccccccgaggcccagaagaucguccgccagcgccaggaggagcucugccucgcccgccaguaccgccucaucguccacaacggcuacugcgacggccgcuccgagcgcaaccuccucuga

SEQ ID NO: 48623 - RNA, 1503 nt, Artificial Sequence
  derived and/or modified sequence opt2 from RBPJ__Homo_sapiens__NP_005340
auggaccacaccgagggcucccccgccgaggagccccccgcccacgcccccucccccggcaaguucggcgagcgccccccccccaagcgccucacccgcgaggccaugcgcaacuaccucaaggagcgcggcgaccagaccguccucauccuccacgccaaggucgcccagaaguccuacggcaacgagaagcgcuucuucugccccccccccugcgucuaccucaugggcuccggcuggaagaagaagaaggagcagauggagcgcgacggcugcuccgagcaggagucccagcccugcgccuucaucggcaucggcaacuccgaccaggagaugcagcagcucaaccucgagggcaagaacuacugcaccgccaagacccucuacaucuccgacuccgacaagcgcaagcacuucaugcucuccgucaagauguucuacggcaacuccgacgacaucggcgucuuccucuccaagcgcaucaaggucaucuccaagcccuccaagaagaagcagucccucaagaacgccgaccucugcaucgccuccggcaccaaggucgcccucuucaaccgccuccgcucccagaccgucuccacccgcuaccuccacgucgagggcggcaacuuccacgccuccucccagcaguggggcgccuucuucauccaccuccucgacgacgacgaguccgagggcgaggaguucaccguccgcgacggcuacauccacuacggccagaccgucaagcucgucugcuccgucaccggcauggcccucccccgccucaucauccgcaaggucgacaagcagaccgcccuccucgacgccgacgaccccgucucccagcuccacaagugcgccuucuaccucaaggacaccgagcgcauguaccucugccucucccaggagcgcaucauccaguuccaggccacccccugccccaaggagcccaacaaggagaugaucaacgacggcgccuccuggaccaucaucuccaccgacaaggccgaguacaccuucuacgagggcaugggccccguccucgcccccgucacccccguccccgucgucgagucccuccagcucaacggcggcggcgacgucgccaugcucgagcucaccggccagaacuucacccccaaccuccgcgucugguucggcgacgucgaggccgagaccauguaccgcugcggcgaguccaugcucugcgucguccccgacaucuccgccuuccgcgagggcuggcgcuggguccgccagcccguccagguccccgucacccucguccgcaacgacggcaucaucuacuccaccucccucaccuucaccuacacccccgagcccggcccccgcccccacugcuccgccgccggcgccauccuccgcgccaacuccucccaggucccccccaacgaguccaacaccaacuccgagggcuccuacaccaacgccuccaccaacuccaccuccgucaccuccuccaccgccaccgucgucuccuga

SEQ ID NO: 48624 - RNA, 630 nt, Artificial Sequence
  derived and/or modified sequence opt2 from RBPMS2__Homo_sapiens__NP_919248
auguccaaccucaagcccgacggcgagcacggcggcuccaccggcaccggcuccggcgccggcuccggcggcgcccucgaggaggagguccgcacccucuucgucuccggccuccccgucgacaucaagccccgcgagcucuaccuccucuuccgccccuucaagggcuacgagggcucccucaucaagcucaccgcccgccagcccgucggcuucgucaucuucgacucccgcgccggcgccgaggccgccaagaacgcccucaacggcauccgcuucgaccccgagaacccccagacccuccgccucgaguucgccaaggccaacaccaagauggccaaguccaagcucauggccacccccaaccccuccaacguccaccccgcccucggcgcccacuucaucgcccgcgaccccuacgaccucaugggcgccgcccucauccccgccucccccgaggccugggcccccuacccccucuacaccaccgagcucacccccgccaucucccacgccgccuucaccuaccccaccgccaccgccgccgccgccgcccuccacgcccagguccgcugguaccccuccuccgacaccacccagcagggcuggaaguaccgccaguucugcuga

SEQ ID NO: 48625 - RNA, 2355 nt, Artificial Sequence
  derived and/or modified sequence opt2 from RBSN__Homo_sapiens__NP_001289307
auggccucccucgacgaccccggcgagguccgcgagggcuuccucugcccccucugccucaaggaccuccaguccuucuaccagcuccacucccacuacgaggaggagcacuccggcgaggaccgcgacgucaagggccagaucaagucccucguccagaaggccaagaaggccaaggaccgccuccucaagcgcgagggcgacgaccgcgccgaguccggcacccagggcuacgaguccuucuccuacggcggcgucgaccccuacaugugggagccccaggagcucggcgccguccgcucccaccucuccgacuucaagaagcaccgcgccgcccgcaucgaccacuacgucgucgaggucaacaagcucaucauccgccucgagaagcucaccgccuucgaccgcaccaacaccgaguccgccaagauccgcgccaucgagaaguccgucguccccugggucaacgaccaggacguccccuucugccccgacugcggcaacaaguucuccauccgcaaccgccgccaccacugccgccucugcggcuccaucaugugcaagaagugcauggagcucaucucccucccccucgccaacaagcucaccuccgccuccaaggagucccucuccacccacaccucccccucccagucccccaacuccguccacggcucccgccgcggcuccaucuccuccauguccuccgucuccuccguccucgacgagaaggacgacgaccgcauccgcugcugcacccacugcaaggacacccuccucaagcgcgagcagcagaucgacgagaaggagcacacccccgacaucgucaagcucuacgagaagcuccgccucugcauggagaaggucgaccagaaggcccccgaguacauccgcauggccgccucccucaacgccggcgagaccaccuacucccucgagcacgccuccgaccuccgcgucgagguccagaaggucuacgagcucaucgacgcccucuccaagaagauccucacccucggccucaaccaggacccccccccccaccccuccaaccuccgccuccagcgcaugauccgcuacuccgccacccucuucguccaggagaagcuccucggccucaugucccuccccaccaaggagcaguucgaggagcucaagaagaagcgcaaggaggagauggagcgcaagcgcgccgucgagcgccaggccgcccucgagucccagcgccgccucgaggagcgccaguccggccucgccucccgcgccgccaacggcgaggucgccucccuccgccgcggccccgccccccuccgcaaggccgagggcuggcucccccucuccggcggccagggccaguccgaggacuccgacccccuccuccagcagauccacaacaucaccuccuucauccgccaggccaaggccgccggccgcauggacgagguccgcacccuccaggagaaccuccgccagcuccaggacgaguacgaccagcagcagaccgagaaggccaucgagcucucccgccgccaggccgaggaggaggaccuccagcgcgagcagcuccagaugcuccgcgagcgcgagcucgagcgcgagcgcgagcaguuccgcgucgccucccuccacacccgcacccgcucccucgacuuccgcgagaucggccccuuccagcucgagcccucccgcgagccccgcacccaccucgccuacgcccucgaccucggcuccucccccguccccuccuccaccgcccccaagacccccucccucuccuccacccagcccacccgcgucugguccggcccccccgccgucggccaggagcgccucccccaguccuccaugccccagcagcacgagggccccucccucaaccccuucgacgaggaggaccucuccucccccauggaggaggccaccaccggcccccccgccgccggcgucucccucgaccccuccgcccgcauccucaaggaguacaaccccuucgaggaggaggacgaggaggaggaggccgucgccggcaaccccuucauccagcccgacucccccgcccccaaccccuucuccgaggaggacgagcacccccagcagcgccucuccuccccccucguccccggcaaccccuucgaggagcccaccugcaucaaccccuucgagauggacuccgacuccggccccgaggccgaggagcccaucgaggaggagcuccuccuccagcagaucgacaacaucaaggccuacaucuucgacgccaagcagugcggccgccucgacgaggucgagguccucaccgagaaccuccgcgagcucaagcacacccucgccaagcagaagggcggcaccgacuga

SEQ ID NO: 48626 - RNA, 327 nt, Artificial Sequence
  derived and/or modified sequence opt2 from RBX1__Homo_sapiens__NP_055063
auggccgccgccauggacgucgacacccccuccggcaccaacuccggcgccggcaagaagcgcuucgaggucaagaaguggaacgccgucgcccucugggccugggacaucgucgucgacaacugcgccaucugccgcaaccacaucauggaccucugcaucgagugccaggccaaccaggccuccgccaccuccgaggagugcaccgucgccuggggcgucugcaaccacgccuuccacuuccacugcaucucccgcuggcucaagacccgccaggucugcccccucgacaaccgcgagugggaguuccagaaguacggccacuga

SEQ ID NO: 48627 - RNA, 3378 nt, Artificial Sequence
  derived and/or modified sequence opt2 from RC3H1__Homo_sapiens__NP_001287780
augcccguccaggccccccaguggaccgacuuccucuccugccccaucugcacccagaccuucgacgagaccauccgcaagcccaucucccucggcugcggccacaccgucugcaagaugugccucaacaagcuccaccgcaaggccugccccuucgaccagaccaccaucaacaccgacaucgagcuccuccccgucaacuccgcccuccuccagcucgucggcgcccagguccccgagcagcagcccaucacccucugcuccggcgucgaggacaccaagcacuacgaggaggccaagaagugcgucgaggagcucgcccucuaccucaagccccucuccuccgcccgcggcgucggccucaacuccaccacccaguccguccucucccgccccaugcagcgcaagcucgucacccucguccacugccagcucgucgaggaggagggccgcauccgcgccaugcgcgccgcccgcucccucggcgagcgcaccgucaccgagcucauccuccagcaccagaacccccagcagcucuccuccaaccucugggccgccguccgcgcccgcggcugccaguuccucggccccgccaugcaggaggaggcccucaagcucguccuccucgcccucgaggacggcuccgcccucucccgcaagguccucguccucuucgucguccagcgccucgagccccgcuucccccaggccuccaagaccuccaucggccacgucguccagcuccucuaccgcgccuccugcuucaaggucaccaagcgcgacgaggacuccucccucaugcagcucaaggaggaguuccgcaccuacgaggcccuccgccgcgagcacgacucccagaucguccagaucgccauggaggccggccuccgcaucgcccccgaccagugguccucccuccucuacggcgaccagucccacaagucccacaugcaguccaucaucgacaagcuccagacccccgccuccuucgcccaguccguccaggagcucaccaucgcccuccagcgcaccggcgaccccgccaaccucaaccgccuccgcccccaccucgagcuccucgccaacaucgaccccucccccgacgcccccccccccaccugggagcagcucgagaacggccucgucgccguccgcaccgucguccacggccucgucgacuacauccagaaccacuccaagaagggcgccgaccagcagcagcccccccagcacuccaaguacaagaccuacaugugccgcgacaugaagcagcgcggcggcugcccccgcggcgccuccugcaccuucgcccacucccaggaggagcucgagaaguuccgcaagaugaacaagcgccucgucccccgccgcccccucuccgccucccucggccagcucaacgaggucggccuccccuccgccgccauccuccccgacgagggcgccgucgaccuccccucccgcaagccccccgcccuccccaacggcaucgucuccaccggcaacaccgucacccagcucaucccccgcggcaccgaccccuccuacgacuccucccucaagcccggcaagaucgaccaccucuccuccuccgcccccggcuccccccccgaccuccucgaguccguccccaaguccaucuccgcccuccccgucaacccccacuccauccccccccgcggccccgccgaccucccccccaugcccgucaccaagccccuccagauggucccccgcggcucccagcucuaccccgcccagcagaccgacgucuacuaccaggacccccgcggcgccgccccccccuucgagcccgcccccuaccagcagggcauguacuacaccccccccccccagugcgucucccgcuucguccgccccccccccuccgcccccgagcccgccccccccuaccucgaccacuacccccccuaccuccaggagcgcgucgucaacucccaguacggcacccagccccagcaguacccccccaucuaccccucccacuacgacggccgccgcgucuaccccgcccccuccuacacccgcgaggagaucuuccgcgagucccccauccccaucgagaucccccccgccgccguccccuccuacguccccgagucccgcgagcgcuaccagcagaucgaguccuacuaccccgucgccccccaccccacccagauccgccccuccuaccuccgcgagccccccuacucccgccuccccccccccccccagccccaccccucccucgacgagcuccaccgccgccgcaaggagaucauggcccagcucgaggagcgcaaggucaucucccccccccccuucgcccccucccccacccucccccccaccuuccaccccgaggaguuccucgacgaggaccucaaggucgccggcaaguacaagggcaacgacuacucccaguacucccccugguccugcgacaccaucggcuccuacaucggcaccaaggacgccaagcccaaggacgucgucgccgccggcuccgucgagaugaugaacgucgaguccaagggcaugcgcgaccagcgccucgaccuccagcgccgcgccgccgagaccuccgacgacgaccucauccccuucggcgaccgccccaccgucucccgcuucggcgccaucucccgcaccuccaagaccaucuaccagggcgccggccccaugcaggccauggccccccagggcgcccccaccaaguccaucaacaucuccgacuacucccccuacggcacccacggcggcuggggcgccucccccuacuccccccaccagaacauccccucccagggccacuucuccgagcgcgagcgcaucuccauguccgaggucgccucccacggcaagccccuccccuccgccgagcgcgagcagcuccgccucgagcuccagcagcucaaccaccagaucucccagcagacccagcuccgcggccucgagcgcgaggccaacacccucgccggccagucccagcccccccccccccccccccccaaguggcccggcaugaucuccuccgagcagcucucccucgagcuccaccaggucgagcgcgagaucggcaagcgcacccgcgagcucuccauggagaaccagugcucccucgacaugaaguccaagcucaacaccuccaagcaggccgagaacggccagcccgagccccagaacaagguccccgccgaggaccucacccucaccuucuccuccgacguccccaacggcuccgcccucacccaggagaacaucucccuccucuccaacaagaccuccucccucaaccucuccgaggaccccgagggcggcggcgacaacaacgacucccagcgcuccggcgucacccccuccuccgcccccuga

SEQ ID NO: 48628 - RNA, 516 nt, Artificial Sequence
  derived and/or modified sequence opt2 from RCAN1__Homo_sapiens__NP_001272318
auggucuacgccaaguucgagucccucuuccgcaccuacgacaaggacaucaccuuccaguacuucaaguccuucaagcgcguccgcaucaacuucuccaaccccuucuccgccgccgacgcccgccuccagcuccacaagaccgaguuccucggcaaggagaugaagcucuacuucgcccagacccuccacaucggcuccucccaccucgccccccccaaccccgacaagcaguuccucaucuccccccccgccuccccccccgucggcuggaagcaggucgaggacgccacccccgucaucaacuacgaccuccucuacgccaucuccaagcucggccccggcgagaaguacgagcuccacgccgccaccgacaccacccccuccgucgucguccacgucugcgaguccgaccaggagaaggaggaggaggaggagauggagcgcaugcgccgccccaagcccaagaucauccagacccgccgccccgaguacacccccauccaccucuccuga

SEQ ID NO: 48629 - RNA, 594 nt, Artificial Sequence
  derived and/or modified sequence opt2 from RCAN2__Homo_sapiens__NP_005813
augcccgcccccuccauggacugcgacgucuccacccucgucgccugcgucgucgacgucgaggucuucaccaaccaggaggucaaggagaaguucgagggccucuuccgcaccuacgacgacugcgucaccuuccagcucuucaaguccuuccgccgcguccgcaucaacuucuccaaccccaaguccgccgcccgcgcccgcaucgagcuccacgagacccaguuccgcggcaagaagcucaagcucuacuucgcccagguccagacccccgagaccgacggcgacaagcuccaccucgcccccccccagcccgccaagcaguuccucaucuccccccccuccuccccccccgucggcuggcagcccaucaacgacgccacccccguccucaacuacgaccuccucuacgccgucgccaagcucggccccggcgagaaguacgagcuccacgccggcaccgaguccacccccuccgucgucguccacgucugcgacuccgacaucgaggaggaggaggaccccaagaccucccccaagcccaagaucauccagacccgccgccccggccucccccccuccgucuccaacuga

SEQ ID NO: 48630 - RNA, 1596 nt, Artificial Sequence
  derived and/or modified sequence opt2 from RCBTB1__Homo_sapiens__XP_005266498
auggucgacgucggcaaguggcccaucuucacccuccucuccccccaggagaucgccuccauccgcaaggccugcgucuucggcaccuccgccuccgaggcccucuacgucaccgacaacgacgaggucuucgucuucggccucaacuacuccaacugccucggcaccggcgacaaccaguccacccucguccccaagaagcucgagggccucugcggcaagaagaucaagucccucuccuacggcuccggcccccacguccuccucuccaccgaggacggcgucgucuacgccuggggccacaacggcuacucccagcucggcaacggcaccaccaaccagggcaucgcccccguccaggucugcaccaaccuccucaucaagcaggucgucgaggucgccugcggcucccaccacuccauggcccucgccgccgacggcgaggucuucgccuggggcuacaacaacugcggccaggucggcuccggcuccaccgccaaccagcccaccccccgcaaggucaccaacugccuccacaucaagcgcgucgucggcaucgccugcggccagaccuccuccauggccguccucgacaacggcgaggucuacggcuggggcuacaacggcaacggccagcucggccucggcaacaacggcaaccagcucacccccguccgcgucgccgcccuccacuccgucugcgucaaccagaucgucugcggcuacgcccacacccucgcccucaccgacgagggccuccucuacgccuggggcgccaacaccuacggccagcucggcaccggcaacaagaacaaccuccucucccccgcccacaucauggucgagaaggagcgcgucgucgagaucgccgccugccacuccgcccacaccuccgccgccaagacccagggcggccacgucuacauguggggccagugccgcggccaguccgucauccucccccaccucacccacuucuccugcaccgacgacgucuucgccugcuucgccacccccgccgucuccuggcgccuccucuccgucgagcacgaggacuuccucaccgucgccgagucccucaagaaggaguucgacucccccgagaccgccgaccucaaguuccgcaucgacggcaaguacauccacguccacaaggccguccucaagauccgcugcgagcacuuccgcuccauguuccaguccuacuggaacgaggacaugaaggaggucaucgagaucgaccaguucuccuaccccgucuaccgcgccuuccuccaguaccucuacaccgacaccgucgaccucccccccgaggacgccaucggccuccucgaccucgccaccuccuacugcgagaaccgccucaagaagcucugccagcacaucaucaagcgcggcaucaccgucgagaacgccuucucccucuucuccgccgccguccgcuacgacgccgaggaccucgaggaguucugcuucaaguucugcaucaaccaccucaccgaggucacccagaccgccgccuucuggcagauggacggcccccuccucaaggaguucaucgccaaggccuccaagugcggcgccuucaagaacuga

SEQ ID NO: 48631 - RNA, 1671 nt, Artificial Sequence
  derived and/or modified sequence opt2 from RCBTB2__Homo_sapiens__NP_001273759
auguccgcccucccccgcgaccucgagcucuccaacccccgcgagaagcucaccaagcccguccaggccacccucuccucccucaagaugcucgacgucggcaaguggcccaucuucucccucugcuccgaggaggagcuccagcucauccgccaggccugcgucuucggcuccgccggcaacgagguccucuacaccaccgucaacgacgagaucuucguccucggcaccaacugcugcggcugccucggccucggcgacguccaguccaccaucgagccccgccgccucgacucccucaacggcaagaagaucgccugccucuccuacggcuccggcccccacaucguccucgccaccaccgagggcgaggucuucaccuggggccacaacgccuacucccagcucggcaacggcaccaccaaccacggccucguccccugccacaucuccaccaaccucuccaacaagcaggucaucgaggucgccugcggcuccuaccacucccucguccucaccuccgacggcgaggucuucgccuggggcuacaacaacuccggccaggucggcuccggcuccaccgucaaccagcccaucccccgccgcgucaccggcugccuccagaacaaggucgucgucaccaucgccugcggccagaugugcugcauggccgucgucgacaccggcgaggucuacgucuggggcuacaacggcaacggccagcucggccucggcaacuccggcaaccagcccacccccugccgcgucgccgcccuccagggcauccgcguccagcgcgucgccugcggcuacgcccacacccucguccucaccgacgagggccaggucuacgccuggggcgccaacuccuacggccagcucggcaccggcaacaaguccaaccaguccuaccccacccccgucaccgucgagaaggaccgcaucaucgagaucgccgccugccacuccacccacaccuccgccgccaagacccagggcggccacgucuacauguggggccagugccgcggccaguccgucauccucccccaccucacccacuucuccugcaccgacgacgucuucgccugcuucgccacccccgccgucaccuggcgccuccucuccgucgagcccgacgaccaccucaccgucgccgagucccucaagcgcgaguucgacaaccccgacaccgccgaccucaaguuccucgucgacggcaaguacaucuacgcccacaagguccuccucaagauccgcugcgagcacuuccgcuccucccucgaggacaacgaggacgacaucgucgagauguccgaguucuccuaccccgucuaccgcgccuuccucgaguaccucuacaccgacuccaucucccucucccccgaggaggccgucggccuccucgaccucgccaccuucuaccgcgagaaccgccucaagaagcucugccagcagaccaucaagcagggcaucugcgaggagaacgccaucgcccuccucuccgccgccgucaaguacgacgcccaggaccucgaggaguucugcuuccgcuucugcaucaaccaccucaccgucgucacccagaccuccggcuucgccgagauggaccacgaccuccucaagaacuucaucuccaaggccucccgcgucggcgccuucaagaacuga

SEQ ID NO: 48632 - RNA, 759 nt, Artificial Sequence
  derived and/or modified sequence opt2 from RCHY1__Homo_sapiens__NP_001009922
auggccgccaccgcccgcgaggacggcgccuccggccaggagcgcggccagcgcggcugcgagcacuacgaccgcggcugccuccucaaggcccccugcugcgacaagcucuacaccugccgccucugccacgacaacaacgaggaccaccagcucgaccgcuucaaggucaaggagguccagugcaucaacugcgagaagauccagcacgcccagcagaccugcgaggagugcuccacccucuucggcgaguacuacugcgacaucugccaccucuucgacaaggacaagaagcaguaccacugcgagaacugcggcaucugccgcaucggccccaaggaggacuucuuccacugccucaagugcaaccucugccucgccaugaaccuccagggccgccacaagugcaucgagaacgucucccgccagaacugccccaucugccucgaggacauccacaccucccgcgucgucgcccacguccuccccugcggccaccuccuccaccgcggcuaccgcugcccccucugcaugcacuccgcccucgacaugacccgcuacuggcgccagcucgacgacgaggucgcccagacccccaugcccuccgaguaccagaacaugaccgucgacauccucugcaacgacugcaacggccgcuccaccguccaguuccacauccucggcaugaagugcaagaucugcgaguccuacaacaccgcccaggccggcggccgccgcaucucccucgaccagcaguga

SEQ ID NO: 48633 - RNA, 648 nt, Artificial Sequence
  derived and/or modified sequence opt2 from RCL1__Homo_sapiens__NP_001273629
augccccccggcggcggcggcgaggucgucuucuccugccccguccgcaagguccucaagcccauccagcucaccgaccccggcaagaucaagcgcauccgcggcauggccuacuccguccgcgucuccccccagauggccaaccgcaucgucgacuccgcccgcuccauccucaacaaguucauccccgacaucuacaucuacaccgaccacaugaagggcgucaacuccggcaagucccccggcuucggccucucccucgucgccgagaccaccuccggcaccuuccucuccgccgagcucgccuccaacccccagggccagggcgccgccguccuccccgaggaccucggccgcaacugcgcccgccuccuccucgaggagaucuaccgcggcggcugcgucgacuccaccaaccagucccucgcccuccuccucaugacccucggccagcaggacgucuccaagguccuccucggcccccucucccccuacaccaucgaguuccuccgccaccucaaguccuucuuccagaucauguucaagaucgagaccaagcccugcggcgaggagcucaagggcggcgacaagguccucaugaccugcgucggcaucggcuucuccaaccucuccaagacccucaaguga

SEQ ID NO: 48634 - RNA, 996 nt, Artificial Sequence
  derived and/or modified sequence opt2 from RCN1__Homo_sapiens__NP_002892
auggcccgcggcggccgcggccgccgccucggccucgcccucggccuccuccucgcccucguccucgccccccgcguccuccgcgccaagcccaccguccgcaaggagcgcgucguccgccccgacuccgagcucggcgagcgcccccccgaggacaaccaguccuuccaguacgaccacgaggccuuccucggcaaggaggacuccaagaccuucgaccagcucacccccgacgaguccaaggagcgccucggcaagaucgucgaccgcaucgacaacgacggcgacggcuucgucaccaccgaggagcucaagaccuggaucaagcgcguccagaagcgcuacaucuucgacaacgucgccaaggucuggaaggacuacgaccgcgacaaggacgacaagaucuccugggaggaguacaagcaggccaccuacggcuacuaccucggcaaccccgccgaguuccacgacuccuccgaccaccacaccuucaagaagaugcucccccgcgacgagcgccgcuucaaggccgccgaccucaacggcgaccucaccgccacccgcgaggaguucaccgccuuccuccaccccgaggaguucgagcacaugaaggagaucgucguccucgagacccucgaggacaucgacaagaacggcgacggcuucgucgaccaggacgaguacaucgccgacauguucucccacgaggagaacggccccgagcccgacuggguccucuccgagcgcgagcaguucaacgaguuccgcgaccucaacaaggacggcaagcucgacaaggacgagauccgccacuggauccucccccaggacuacgaccacgcccaggccgaggcccgccaccucgucuacgaguccgacaagaacaaggacgagaagcucaccaaggaggagauccucgagaacuggaacauguucgucggcucccaggccaccaacuacggcgaggaccucaccaagaaccacgacgagcucuga

SEQ ID NO: 48635 - RNA, 954 nt, Artificial Sequence
  derived and/or modified sequence opt2 from RCN2__Homo_sapiens__NP_002893
augcgccucggcccccgcaccgccgcccucggccuccuccuccucugcgccgccgccgccggcgccggcaaggccgaggagcuccacuacccccucggcgagcgccgcuccgacuacgaccgcgaggcccuccucggcguccaggaggacgucgacgaguacgucaagcucggccacgaggagcagcagaagcgccuccaggccaucaucaagaagaucgaccucgacuccgacggcuuccucaccgaguccgagcucuccuccuggauccagauguccuucaagcacuacgccaugcaggaggccaagcagcaguucgucgaguacgacaagaacuccgacgacaccgucaccugggacgaguacaacauccagauguacgaccgcgucaucgacuucgacgagaacaccgcccucgacgacgccgaggaggaguccuuccgcaagcuccaccucaaggacaagaagcgcuucgagaaggccaaccaggacuccggccccggccucucccucgaggaguucaucgccuucgagcaccccgaggaggucgacuacaugaccgaguucgucauccaggaggcccucgaggagcacgacaagaacggcgacggcuucgucucccucgaggaguuccucggcgacuaccgcugggaccccaccgccaacgaggaccccgaguggauccucgucgagaaggaccgcuucgucaacgacuacgacaaggacaacgacggccgccucgacccccaggagcuccuccccugggucguccccaacaaccagggcaucgcccaggaggaggcccuccaccucaucgacgagauggaccucaacggcgacaagaagcucuccgaggaggagauccucgagaaccccgaccucuuccucaccuccgaggccaccgacuacggccgccagcuccacgacgacuacuucuaccacgacgagcucuga

SEQ ID NO: 48636 - RNA, 1458 nt, Artificial Sequence
  derived and/or modified sequence opt2 from RCOR1__Homo_sapiens__NP_055971
augcccgccauggucgagaagggccccgaggucuccggcaagcgccgcggccgcaacaacgccgccgccuccgccuccgccgccgccgccuccgccgccgccuccgccgccugcgccucccccgccgccaccgccgccuccggcgccgccgccuccuccgccuccgccgccgccgccuccgccgccgccgcccccaacaacggccagaacaagucccucgccgccgccgcccccaacggcaacuccuccuccaacuccugggaggagggcuccuccggcuccuccuccgacgaggagcacggcggcggcggcaugcgcgucggcccccaguaccaggccgucguccccgacuucgaccccgccaagcucgcccgccgcucccaggagcgcgacaaccucggcaugcucgucuggucccccaaccagaaccucuccgaggccaagcucgacgaguacaucgccaucgccaaggagaagcacggcuacaacauggagcaggcccucggcaugcucuucuggcacaagcacaacaucgagaagucccucgccgaccuccccaacuucacccccuuccccgacgaguggaccgucgaggacaagguccucuucgagcaggccuucuccuuccacggcaagaccuuccaccgcauccagcagaugcuccccgacaaguccaucgccucccucgucaaguucuacuacuccuggaagaagacccgcaccaagaccuccgucauggaccgccacgcccgcaagcagaagcgcgagcgcgaggaguccgaggacgagcucgaggaggccaacggcaacaaccccaucgacaucgaggucgaccagaacaaggaguccaagaaggaggucccccccaccgagaccgucccccaggucaagaaggagaagcacuccacccaggccaagaaccgcgccaagcgcaagccccccaagggcauguuccucucccaggaggacgucgaggccgucuccgccaacgccaccgccgccaccaccguccuccgccagcucgacauggagcucgucuccgucaagcgccagauccagaacaucaagcagaccaacuccgcccucaaggagaagcucgacggcggcaucgagcccuaccgccuccccgaggucauccagaagugcaacgcccgcuggaccaccgaggagcagcuccucgccguccaggccauccgcaaguacggccgcgacuuccaggccaucuccgacgucaucggcaacaaguccgucguccaggucaagaacuucuucgucaacuaccgccgccgcuucaacaucgacgagguccuccaggagugggaggccgagcacggcaaggaggagaccaacggccccuccaaccagaagcccgucaagucccccgacaacuccaucaagaugcccgaggaggaggacgaggcccccguccucgacguccgcuacgccuccgccuccuga

SEQ ID NO: 48637 - RNA, 1251 nt, Artificial Sequence
  derived and/or modified sequence opt2 from RCSD1__Homo_sapiens__NP_443094
auggaggagcgccccgccgagaccaacgccaacgucgacaacuccgccucccccuccgucgcccagcucgccggccgcuuccgcgagcaggccgccgccgccaaggagacccccgccuccaagcccacccgccgcaagccccccugcucccucccccucuucccccccaaggucgaccucggccagaacggcgaggagaaguccccccccaacgccucccacccccccaaguucaaggucaaguccuccccccucaucgagaagcuccaggccaaccucaccuucgaccccgccgcccuccuccccggcgccucccccaagucccccggccucaaggccauggucucccccuuccacuccccccccuccacccccuccucccccggcguccgcucccgccccuccgaggccgaggagguccccgucuccuucgaccagccccccgagggcucccaccuccccugcuacaacaagguccgcacccgcggcuccaucaagcgccgcccccccucccgccgcuuccgccgcucccaguccgacugcggcgagcucggcgacuuccgcgccgucgaguccucccagcagaacggcgccaaggaggaggacggcgacgagguccuccccuccaaguccaaggcccccggcuccccccucuccuccgagggcgccgccggcgagggcguccgcacccucggccccgccgagaagcccccccuccgccgcucccccucccgcaccgagaagcaggaggaggaccgcgccaccgaggaggccaagaacggcgagaaggcccgccgcuccuccgaggaggucgacggccagcaccccgcccaggaggagguccccgaguccccccagaccuccggccccgaggccgagaaccgcugcggcuccccccgcgaggagaagcccgccggcgaggaggccgagauggagaaggccaccgaggucaagggcgagcgcguccagaacgaggaggucggccccgagcacgacucccaggagaccaagaagcucgaggagggcgccgccgucaaggagaccccccacuccccccccggcggcgucaagggcggcgacguccccaagcaggagaagggcaaggagaagcagcaggagggcgccguccucgagcccggcugcuccccccagaccggccccgcccagcucgagaccuccuccgagguccaguccgagcccgccguccccaagcccgaggacgacacccccguccaggacaccaagauguga

SEQ ID NO: 48638 - RNA, 603 nt, Artificial Sequence
  derived and/or modified sequence opt2 from RCVRN__Homo_sapiens__NP_002894
augggcaacuccaaguccggcgcccucuccaaggagauccucgaggagcuccagcucaacaccaaguucuccgaggaggagcucugcuccugguaccaguccuuccucaaggacugccccaccggccgcaucacccagcagcaguuccaguccaucuacgccaaguucuuccccgacaccgaccccaaggccuacgcccagcacgucuuccgcuccuucgacuccaaccucgacggcacccucgacuucaaggaguacgucaucgcccuccacaugaccaccgccggcaagaccaaccagaagcucgagugggccuucucccucuacgacgucgacggcaacggcaccaucuccaagaacgagguccucgagaucgucauggccaucuucaagaugaucacccccgaggacgucaagcuccuccccgacgacgagaacacccccgagaagcgcgccgagaagaucuggaaguacuucggcaagaacgacgacgacaagcucaccgagaaggaguucaucgagggcacccucgccaacaaggagauccuccgccucauccaguucgagccccagaaggucaaggagaagaugaagaacgccuga

SEQ ID NO: 48639 - RNA, 588 nt, Artificial Sequence
  derived and/or modified sequence opt2 from RD3__Homo_sapiens__NP_001158160
augucccucaucuccuggcuccgcuggaacgaggcccccucccgccucuccacccgcucccccgccgagaugguccucgagacccucaugauggagcucaccggccagaugcgcgaggccgagcgccagcagcgcgagcgcuccaacgccguccgcaaggucugcaccggcgucgacuacuccuggcucgccuccaccccccgcuccaccuacgaccucucccccaucgagcgccuccagcucgaggacgucugcgucaagauccaccccuccuacugcggccccgccauccuccgcuuccgccagcuccucgccgagcaggagcccgagguccaggaggucucccagcucuuccgcuccguccuccaggagguccucgagcgcaugaagcaggaggaggaggcccacaagcucacccgccaguggucccuccgcccccgcggcucccucgccaccuucaagacccgcgcccgcaucucccccuucgccuccgacauccgcaccaucuccgaggacgucgagcgcgacaccccccccccccuccgcuccugguccaugcccgaguuccgcgcccccaaggccgacuga

SEQ ID NO: 48640 - RNA, 1026 nt, Artificial Sequence
  derived and/or modified sequence opt2 from RDH10__Homo_sapiens__NP_742034
augaacaucgucgucgaguucuucgucgucaccuucaagguccucugggccuucguccucgccgccgcccgcuggcucguccgccccaaggagaaguccgucgccggccaggucugccucaucaccggcgccggcuccggccucggccgccucuucgcccucgaguucgcccgccgccgcgcccuccucguccucugggacaucaacacccaguccaacgaggagaccgccggcaugguccgccacaucuaccgcgaccucgaggccgccgacgccgccgcccuccaggccggcaacggcgaggaggagauccucccccacugcaaccuccaggucuucaccuacaccugcgacgucggcaagcgcgagaacgucuaccucaccgccgagcgcguccgcaaggaggucggcgaggucuccguccucgucaacaacgccggcgucgucuccggccaccaccuccucgagugccccgacgagcucaucgagcgcaccaugauggucaacugccacgcccacuucuggaccaccaaggccuuccuccccaccaugcucgagaucaaccacggccacaucgucaccgucgccuccucccucggccucuucuccaccgccggcgucgaggacuacugcgccuccaaguucggcgucgucggcuuccacgagucccucucccacgagcucaaggccgccgagaaggacggcaucaagaccacccucgucugccccuaccucgucgacaccggcauguuccgcggcugccgcauccgcaaggagaucgagcccuuccuccccccccucaagcccgacuacugcgucaagcaggccaugaaggccauccucaccgaccagcccaugaucugcaccccccgccucauguacaucgucaccuucaugaaguccauccuccccuucgaggccgucgucugcauguaccgcuuccucggcgccgacaagugcauguaccccuucaucgcccagcgcaagcaggccaccaacaacaacgaggccaagaacggcaucuga

SEQ ID NO: 48641 - RNA, 957 nt, Artificial Sequence
  derived and/or modified sequence opt2 from RDH11__Homo_sapiens__NP_057110
auggucgagcucauguucccccuccuccuccuccuccuccccuuccuccucuacauggccgccccccagauccgcaagaugcucuccuccggcgucugcaccuccaccguccagcuccccggcaaggucgucgucgucaccggcgccaacaccggcaucggcaaggagaccgccaaggagcucgcccagcgcggcgcccgcgucuaccucgccugccgcgacgucgagaagggcgagcucgucgccaaggagauccagaccaccaccggcaaccagcagguccucguccgcaagcucgaccucuccgacaccaaguccauccgcgccuucgccaagggcuuccucgccgaggagaagcaccuccacguccucaucaacaacgccggcgucaugaugugccccuacuccaagaccgccgacggcuucgagaugcacaucggcgucaaccaccucggccacuuccuccucacccaccuccuccucgagaagcucaaggaguccgcccccucccgcaucgucaacgucuccucccucgcccaccaccucggccgcauccacuuccacaaccuccagggcgagaaguucuacaacgccggccucgccuacugccacuccaagcucgccaacauccucuucacccaggagcucgcccgccgccucaagggcuccggcgucaccaccuacuccguccaccccggcaccguccaguccgagcucguccgccacuccuccuucaugcgcuggaugugguggcucuucuccuucuucaucaagaccccccagcagggcgcccagaccucccuccacugcgcccucaccgagggccucgagauccucuccggcaaccacuucuccgacugccacgucgccugggucuccgcccaggcccgcaacgagaccaucgcccgccgccucugggacgucuccugcgaccuccucggccuccccaucgacuga

SEQ ID NO: 48642 - RNA, 951 nt, Artificial Sequence
  derived and/or modified sequence opt2 from RDH12__Homo_sapiens__NP_689656
augcucgucacccucggccuccucaccuccuucuucuccuuccucuacauggucgcccccuccauccgcaaguucuucgccggcggcgucugccgcaccaacguccagcuccccggcaaggucgucgucaucaccggcgccaacaccggcaucggcaaggagaccgcccgcgagcucgccucccgcggcgcccgcgucuacaucgccugccgcgacguccucaagggcgaguccgccgccuccgagauccgcgucgacaccaagaacucccagguccucguccgcaagcucgaccucuccgacaccaaguccauccgcgccuucgccgagggcuuccucgccgaggagaagcagcuccacauccucaucaacaacgccggcgucaugaugugccccuacuccaagaccgccgacggcuucgagacccaccucggcgucaaccaccucggccacuuccuccucaccuaccuccuccucgagcgccucaaggucuccgcccccgcccgcgucgucaacgucuccuccgucgcccaccacaucggcaagauccccuuccacgaccuccaguccgagaagcgcuacucccgcggcuucgccuacugccacuccaagcucgccaacguccucuucacccgcgagcucgccaagcgccuccagggcaccggcgucaccaccuacgccguccaccccggcgucguccgcuccgagcucguccgccacuccucccuccucugccuccucuggcgccucuucucccccuucgucaagaccgcccgcgagggcgcccagaccucccuccacugcgcccucgccgagggccucgagccccucuccggcaaguacuucuccgacugcaagcgcaccugggucuccccccgcgcccgcaacaacaagaccgccgagcgccucuggaacgucuccugcgagcuccucggcauccgcugggaguga

SEQ ID NO: 48643 - RNA, 1011 nt, Artificial Sequence
  derived and/or modified sequence opt2 from RDH14__Homo_sapiens__NP_065956
auggccgucgccaccgccgccgccguccucgccgcccucggcggcgcccucuggcucgccgcccgccgcuucgucggcccccgcguccagcgccuccgccgcggcggcgaccccggccucaugcacggcaagaccguccucaucaccggcgccaacuccggccucggccgcgccaccgccgccgagcuccuccgccucggcgcccgcgucaucaugggcugccgcgaccgcgcccgcgccgaggaggccgccggccagcuccgccgcgagcuccgccaggccgccgagugcggccccgagcccggcgucuccggcgucggcgagcucaucguccgcgagcucgaccucgccucccuccgcuccguccgcgccuucugccaggagaugcuccaggaggagccccgccucgacguccucaucaacaacgccggcaucuuccagugccccuacaugaagaccgaggacggcuucgagaugcaguucggcgucaaccaccucggccacuuccuccucaccaaccuccuccucggccuccucaaguccuccgcccccucccgcaucgucgucgucuccuccaagcucuacaaguacggcgacaucaacuucgacgaccucaacuccgagcaguccuacaacaaguccuucugcuacucccgcuccaagcucgccaacauccucuucacccgcgagcucgcccgccgccucgagggcaccaacgucaccgucaacguccuccaccccggcaucguccgcaccaaccucggccgccacauccacaucccccuccucgucaagccccucuucaaccucgucuccugggccuucuucaagacccccgucgagggcgcccagaccuccaucuaccucgccuccucccccgaggucgagggcgucuccggccgcuacuucggcgacugcaaggaggaggagcuccuccccaaggccauggacgaguccgucgcccgcaagcucugggacaucuccgaggucauggucggccuccucaaguga

SEQ ID NO: 48644 - RNA, 954 nt, Artificial Sequence
  derived and/or modified sequence opt2 from RDH16__Homo_sapiens__NP_003699
auguggcucuaccucgccgucuucgucggccucuacuaccuccuccacugguaccgcgagcgccagguccucucccaccuccgcgacaaguacgucuucaucaccggcugcgacuccggcuucggcaagcuccucgcccgccagcucgacgcccgcggccuccgcguccucgccgccugccucaccgagaagggcgccgagcagcuccgcggccagaccuccgaccgccucgagaccgucacccucgacgucaccaagaccgaguccgucgccgccgccgcccagugggucaaggagugcguccgcgacaagggccucuggggccucgucaacaacgccggcaucucccuccccaccgcccccaacgagcuccucaccaagcaggacuucgucaccauccucgacgucaaccuccucggcgucaucgacgucacccucucccuccucccccucguccgccgcgcccgcggccgcgucgucaacgucuccuccgucaugggccgcgucucccucuucggcggcggcuacugcaucuccaaguacggcgucgaggccuucuccgacucccuccgccgcgagcucuccuacuucggcgucaaggucgccaugaucgagcccggcuacuucaagaccgccgucaccuccaaggagcgcuuccucaaguccuuccucgagaucugggaccgcuccucccccgaggucaaggaggccuacggcgagaaguucgucgccgacuacaagaaguccgccgagcagauggagcagaagugcacccaggaccucucccucgucaccaacugcauggagcacgcccucaucgccugccacccccgcacccgcuacuccgccggcugggacgccaagcuccucuaccuccccauguccuacaugcccaccuuccucgucgacgccaucauguacugggucucccccucccccgccaaggcccucuga

SEQ ID NO: 48645 - RNA, 957 nt, Artificial Sequence
  derived and/or modified sequence opt2 from RDH5__Homo_sapiens__NP_002896
auguggcucccccuccuccucggcgcccuccucugggccguccucuggcuccuccgcgaccgccagucccuccccgccuccaacgccuucgucuucaucaccggcugcgacuccggcuucggccgccuccucgcccuccagcucgaccagcgcggcuuccgcguccucgccuccugccucacccccuccggcgccgaggaccuccagcgcgucgccuccucccgccuccacaccacccuccucgacaucaccgacccccaguccguccagcaggccgccaagugggucgagaugcacgucaaggaggccggccucuucggccucgucaacaacgccggcgucgccggcaucaucggccccacccccuggcucacccgcgacgacuuccagcgcguccucaacgucaacaccaugggccccaucggcgucacccucgcccuccucccccuccuccagcaggcccgcggccgcgucaucaacaucaccuccguccucggccgccucgccgccaacggcggcggcuacugcgucuccaaguucggccucgaggccuucuccgacucccuccgccgcgacgucgcccacuucggcauccgcgucuccaucgucgagcccggcuucuuccgcacccccgucaccaaccucgagucccucgagaagacccuccaggccugcugggcccgccucccccccgccacccaggcccacuacggcggcgccuuccucaccaaguaccucaagaugcagcagcgcaucaugaaccucaucugcgaccccgaccucaccaaggucucccgcugccucgagcacgcccucaccgcccgccacccccgcacccgcuacucccccggcugggacgccaagcuccucuggcuccccgccuccuaccuccccgccucccucgucgacgccguccucaccuggguccuccccaagcccgcccaggccgucuacuga

SEQ ID NO: 48646 - RNA, 996 nt, Artificial Sequence
  derived and/or modified sequence opt2 from RDH8__Homo_sapiens__NP_056540
augaacggccagucccagguccuccccggcggcggccacgagucccgcgagggcaucaacauggccgccgccccccgcaccguccucaucuccggcugcuccuccggcaucggccucgagcucgccguccagcucgcccacgaccccaagaagcgcuaccaggucgucgccaccaugcgcgaccucggcaagaaggagacccucgaggccgccgccggcgaggcccucggccagacccucaccgucgcccagcucgacgucugcuccgacgaguccgucgcccagugccucuccugcauccagggcgaggucgacguccucgucaacaacgccggcaugggccucgucggcccccucgagggccucucccucgccgccaugcagaacgucuucgacaccaacuucuucggcgccguccgccucgucaaggccguccuccccggcaugaagcgccgccgccagggccacaucgucgucaucuccuccgucaugggccuccagggcgucaucuucaacgacgucuacgccgccuccaaguucgcccucgagggcuucuucgagucccucgccauccagcuccuccaguucaacaucuucaucucccucgucgagcccggccccgucgucaccgaguucgagggcaagcuccucgcccaggucuccauggccgaguuccccggcaccgaccccgagacccuccacuacuuccgcgaccucuaccuccccgccucccgcaagcucuucugcuccgucggccagaacccccaggacgucguccaggccaucgucaacgucaucuccuccacccgccccccccuccgccgccagaccaacauccgcuacuccccccucaccacccucaagaccgucgacuccuccggcucccucuacguccgcaccacccaccgccuccucuuccgcugcccccgccuccucaaccucggccuccagugccucuccugcggcugccuccccacccgcguccgcccccgcuga

SEQ ID NO: 48647 - RNA, 711 nt, Artificial Sequence
  derived and/or modified sequence opt2 from RDM1__Homo_sapiens__NP_001030008
auggccgagcucguccccuucgccguccccaucgaguccgacaagacccuccucgucugggagcucuccuccggccccaccgccgaggcccuccaccacucccucuucaccgccuucucccaguucggccuccucuacuccguccgcgucuuccccaacgccgccgucgcccaccccggcuucuacgccgucaucaaguucuacuccgcccgcgccgcccaccgcgcccagaaggccugcgaccgcaagcagcucuuccagaagucccccgucaagguccgccucggcacccgccacaaggccguccagcaccaggcccucgcccucaacuccuccaagugccaggagcucgccaacuacuacuucggcuucaacggcugcuccaagcgcaucaucaagcuccaggagcucuccgaccucgaggagcgcgagaacgaggacuccauggucccccuccccaagcagucccucaaguucuucugcgcccucgaggucguccuccccuccugcgacugccgcucccccggcaucggccucgucgaggagcccauggacaaggucgaggagggcccccucuccuuccucaugaagcgcaagaccgcccagaagcucgccauccagaaggcccucuccgacgccuuccagaagcuccucaucgucguccucggcaagaccguccucaucauccucgagguccuccaguuccaguga

SEQ ID NO: 48648 - RNA, 1815 nt, Artificial Sequence
  derived and/or modified sequence opt2 from RDX__Homo_sapiens__NP_001247421
augcccaagcccaucaacguccgcgucaccaccauggacgccgagcucgaguucgccauccagcccaacaccaccggcaagcagcucuucgaccaggucgucaagaccgucggccuccgcgaggucugguucuucggccuccaguacgucgacuccaagggcuacuccaccuggcucaagcucaacaagaaggucacccagcaggacgucaagaaggagaacccccuccaguucaaguuccgcgccaaguucuuccccgaggacgucuccgaggagcucauccaggagaucacccagcgccucuucuuccuccaggucaaggaggccauccucaacgacgagaucuacugcccccccgagaccgccguccuccucgccuccuacgccguccaggccaaguacggcgacuacaacaaggagauccacaagcccggcuaccucgccaacgaccgccuccucccccagcgcguccucgagcagcacaagcucaccaaggagcagugggaggagcgcauccagaacuggcacgaggagcaccgcggcaugcuccgcgaggacuccaugauggaguaccucaagaucgcccaggaccucgagauguacggcgucaacuacuucgagaucaagaacaagaagggcaccgagcucuggcucggcgucgacgcccucggccucaacaucuacgagcacgacgacaagcucacccccaagaucggcuuccccugguccgagauccgcaacaucuccuucaacgacaagaaguucgucaucaagcccaucgacaagaaggcccccgacuucgucuucuacgccccccgccuccgcaucaacaagcgcauccucgcccucugcaugggcaaccacgagcucuacaugcgccgccgcaagcccgacaccaucgagguccagcagaugaaggcccaggcccgcgaggagaagcaccagaagcagcucgagcgcgcccagcucgagaacgagaagaagaagcgcgagaucgccgagaaggagaaggagcgcaucgagcgcgagaaggaggagcucauggagcgccucaagcagaucgaggagcagaccaucaaggcccagaaggagcucgaggagcagacccgcaaggcccucgagcucgaccaggagcgcaagcgcgccaaggaggaggccgagcgccucgagaaggagcgccgcgccgccgaggaggccaaguccgccaucgccaagcaggccgccgaccagaugaagaaccaggagcagcucgccgccgagcucgccgaguucaccgccaagaucgcccuccucgaggaggccaagaagaagaaggaggaggaggccaccgaguggcagcacaaggccuucgccgcccaggaggaccucgagaagaccaaggaggagcucaagaccgucauguccgccccccccccccccccccccccccccgucaucccccccaccgagaacgagcacgacgagcacgacgagaacaacgccgaggccuccgccgagcucuccaacgagggcgucaugaaccaccgcuccgaggaggagcgcgucaccgagacccagaagaacgagcgcgucaagaagcagcuccaggcccucuccuccgagcucgcccaggcccgcgacgagaccaagaagacccagaacgacguccuccacgccgagaacgucaaggccggccgcgacaaguacaagacccuccgccagauccgccagggcaacaccaagcagcgcaucgacgaguucgaggccauguggggccccaagcucuacgcccucuuccagaugcgcuccugccaguccuccaucaagcagauguga

SEQ ID NO: 48649 - RNA, 1644 nt, Artificial Sequence
  derived and/or modified sequence opt2 from REC8__Homo_sapiens__NP_001041670
auguucuacuaccccaacguccuccagcgccacaccggcugcuucgccaccaucuggcucgccgccacccgcggcucccgccucgucaagcgcgaguaccuccgcgucaacgucgucaagaccugcgaggagauccucaacuacguccucguccgcguccagcccccccagcccggccucccccgcccccgcuucucccucuaccucuccgcccagcuccagaucggcgucauccgcgucuacucccagcagugccaguaccucgucgaggacauccagcacauccucgagcgccuccaccgcgcccagcuccagauccgcaucgacauggagaccgagcuccccucccuccuccuccccaaccaccucgccaugauggagacccucgaggacgcccccgaccccuucuucggcaugauguccgucgacccccgccuccccucccccuucgacaucccccagauccgccaccuccucgaggccgccauccccgagcgcgucgaggagaucccccccgagguccccaccgagccccgcgagcccgagcgcauccccgucaccguccucccccccgaggccaucaccauccucgaggccgagcccauccgcaugcucgagaucgagggcgagcgcgagcuccccgaggucucccgccgcgagcucgaccuccucaucgccgaggaggaggaggccauccuccucgagaucccccgccuccccccccccgcccccgccgaggucgagggcaucggcgaggcccucggccccgaggagcuccgccucaccggcugggagcccggcgcccuccucauggaggucaccccccccgaggagcuccgccuccccgccccccccucccccgagcgccgcccccccguccccccccccccccgccgccgccgccgccgccgccuccucuucugggacaaggagacccagaucucccccgagaaguuccaggagcagcuccagacccgcgcccacugcugggagugccccaugguccagccccccgagcgcaccauccgcggccccgccgagcucuuccgcacccccacccucuccggcuggcucccccccgagcuccucggccucuggacccacugcgcccagcccccccccaaggcccuccgccgcgagcuccccgaggaggccgccgccgaggaggagcgccgcaagaucgagguccccuccgagaucgaggucccccgcgaggcccucgagcccuccgucccccucauggucucccucgagaucucccucgaggccgccgaggaggagaagucccgcaucucccucaucccccccgaggagcgcugggccuggcccgaggucgaggcccccgaggcccccgcccuccccgucguccccgagcuccccgagguccccauggagaugccccucguccucccccccgagcucgagcuccucucccucgaggccguccaccgcgccgucgcccucgagcuccaggccaaccgcgagcccgacuucuccucccucgucuccccccucuccccccgccgcauggccgcccgcgucuucuaccuccuccucguccucuccgcccagcagauccuccacgucaagcaggagaagcccuacggccgccuccucauccagcccggcccccgcuuccacuga

SEQ ID NO: 48650 - RNA, 2916 nt, Artificial Sequence
  derived and/or modified sequence opt2 from RECK__Homo_sapiens__NP_066934
auggccaccguccgcgccucccuccgcggcgcccuccuccuccuccucgccgucgccggcgucgccgaggucgccggcggccucgcccccggcuccgccggcgcccucugcugcaaccacuccaaggacaaccagaugugccgcgacgucugcgagcagaucuucuccuccaaguccgagucccgccucaagcaccuccuccagcgcgcccccgacuacugccccgagaccauggucgagaucuggaacugcaugaacuccucccuccccggcgucuucaagaaguccgacggcugggucggccucggcugcugcgagcucgccaucgcccucgagugccgccaggccugcaagcaggccuccuccaagaacgacaucuccaaggucugccgcaaggaguacgagaacgcccucuucuccugcaucucccgcaacgagaugggcuccgucugcugcuccuacgccggccaccacaccaacugccgcgaguacugccaggccaucuuccgcaccgacuccucccccggccccucccagaucaaggccgucgagaacuacugcgccuccaucuccccccagcucauccacugcgucaacaacuacacccaguccuaccccaugcgcaaccccaccgacucccucuacugcugcgaccgcgccgaggaccacgccugccagaacgccugcaagcgcauccucauguccaagaagaccgagauggagaucgucgacggccucaucgagggcugcaagacccagccccucccccaggacccccucuggcagugcuuccucgaguccucccaguccguccaccccggcgucaccguccaccccccccccuccaccggccucgacggcgccaagcuccacugcugcuccaaggccaacaccuccaccugccgcgagcucugcaccaagcucuacuccauguccuggggcaacacccaguccuggcaggaguucgaccgcuucugcgaguacaaccccgucgaggucuccaugcucaccugccucgccgacguccgcgagcccugccagcucggcugccgcaaccucaccuacugcaccaacuucaacaaccgccccaccgagcucuuccgcuccugcaacgcccaguccgaccagggcgccaugaacgacaugaagcucugggagaagggcuccaucaagaugcccuucaucaacauccccguccucgacaucaagaagugccagcccgagauguggaaggccaucgccugcucccuccagaucaagcccugccacuccaagucccgcggcuccaucaucugcaaguccgacugcgucgagauccucaagaagugcggcgaccagaacaaguuccccgaggaccacaccgccgaguccaucugcgagcuccucucccccaccgacgaccucaagaacugcaucccccucgacaccuaccuccgccccuccacccucggcaacaucgucgaggaggucacccaccccugcaaccccaaccccugccccgccaacgagcucugcgaggucaaccgcaagggcugccccuccggcgaccccugccuccccuacuucugcguccagggcugcaagcucggcgaggccuccgacuucaucguccgccagggcacccucauccagguccccuccuccgccggcgaggucggcugcuacaagaucugcuccugcggccaguccggccuccucgagaacugcauggagaugcacugcaucgaccuccagaaguccugcaucgucggcggcaagcgcaagucccacggcaccuccuucuccaucgacugcaacgucugcuccugcuucgccggcaaccucgucugcuccacccgccucugccucuccgagcacuccuccgaggacgaccgccgcaccuucaccggccuccccugcaacugcgccgaccaguucguccccgucugcggccagaacggccgcaccuaccccuccgccugcaucgcccgcugcgucggccuccaggaccaccaguucgaguucggcuccugcauguccaaggaccccugcaaccccaaccccugccagaagaaccagcgcugcauccccaagccccaggucugccucaccaccuucgacaaguucggcugcucccaguacgagugcgucccccgccagcucgccugcgaccagguccaggaccccgucugcgacaccgaccacauggagcacaacaaccucugcacccucuaccagcgcggcaagucccucuccuacaagggccccugccagcccuucugccgcgccaccgagcccgucugcggccacaacggcgagaccuacuccuccgucugcgccgccuacuccgaccgcgucgccgucgacuacuacggcgacugccaggccgucggcguccucuccgagcacuccuccgucgccgagugcgccuccgucaagugccccucccuccucgccgccggcugcaagcccaucaucccccccggcgccugcugcccccucugcgccggcaugcuccgcguccucuucgacaaggagaagcucgacaccaucgccaaggucaccaacaagaagcccaucaccguccucgagauccuccagaagauccgcaugcacgucuccgucccccagugcgacgucuucggcuacuucuccaucgaguccgagaucgucauccucaucauccccgucgaccacuaccccaaggcccuccagaucgaggccugcaacaaggaggccgagaagaucgagucccucaucaacuccgacucccccacccucgccucccacgucccccucuccgcccucaucaucucccagguccaggucuccuccuccguccccuccgccggcguccgcgcccgccccuccugccacucccuccuccucccccucucccucggccucgcccuccaccuccucuggaccuacaacuga

SEQ ID NO: 48651 - RNA, 1308 nt, Artificial Sequence
  derived and/or modified sequence opt2 from RECQL5__Homo_sapiens__NP_001003715
auguccucccaccacaccaccuuccccuucgaccccgagcgccgcguccgcuccacccucaagaaggucuucggcuucgacuccuucaagaccccccuccaggaguccgccaccauggccgucgucaagggcaacaaggacgucuucgucugcaugcccaccggcgccggcaagucccucugcuaccagcuccccgcccuccucgccaagggcaucaccaucgucgucuccccccucaucgcccucauccaggaccaggucgaccaccuccucacccucaagguccgcgucuccucccucaacuccaagcucuccgcccaggagcgcaaggagcuccucgccgaccucgagcgcgagaagccccagaccaagauccucuacaucacccccgagauggccgccuccuccuccuuccagcccacccucaacucccucgucucccgccaccuccucuccuaccucgucgucgacgaggcccacugcgucucccaguggggccacgacuuccgccccgacuaccuccgccucggcgcccuccgcucccgccucggccacgcccccugcgucgcccucaccgccaccgccaccccccagguccaggaggacgucuucgccgcccuccaccucaagaagcccgucgccaucuucaagacccccugcuuccgcgccaaccucuucuacgacguccaguucaaggagcucaucuccgaccccuacggcaaccucaaggacuucugccucaaggcccucggccaggaggccgacaagggccucuccggcugcggcaucgucuacugccgcacccgcgaggccugcgagcagcucgccaucgagcucuccugccgcggcgucaacgccaaggccuaccacgccggccucaaggccuccgagcgcacccucguccagaacgacuggauggaggagaagguccccgucaucgucgccaccaucuccuucggcaugggcgucgacaaggccaacguccgcuucgucgcccacuggaacaucgccaaguccauggccggcuacuaccaggaguccggccgcgccggccgcgacggcaagcccuccuggugccgccucuacuacucccgcaacgaccgcgaccaggucuccuuccucauccgcaaggaggucgccaagcuccaggagaagcgcggcaacaaggccuccgacaaggccaccaucauggccuucgacgcccucgucaccuucugcgaggagcucggccgcuggggccgcggccacggcaagucccuccgcgccgccuggugcucccaggucgucucccgccacgccgagcucuga

SEQ ID NO: 48652 - RNA, 1950 nt, Artificial Sequence
  derived and/or modified sequence opt2 from RECQL__Homo_sapiens__XP_006719196
auggccuccgucuccgcccucaccgaggagcucgacuccaucaccuccgagcuccacgccgucgagauccagauccaggagcucaccgagcgccagcaggagcucauccagaagaagaagguccucaccaagaagaucaagcagugccucgaggacuccgacgccggcgccuccaacgaguacgacuccucccccgccgccuggaacaaggaggacuuccccugguccggcaaggucaaggacauccuccagaacgucuucaagcucgagaaguuccgcccccuccagcucgagaccaucaacgucaccauggccggcaaggaggucuuccucgucaugcccaccggcggcggcaagucccucugcuaccagcuccccgcccucugcuccgacggcuucacccucgucaucugcccccucaucucccucauggaggaccagcucaugguccucaagcagcucggcaucuccgccaccaugcucaacgccuccuccuccaaggagcacgucaaguggguccacgccgagauggucaacaagaacuccgagcucaagcucaucuacgucacccccgagaagaucgccaaguccaagauguucaugucccgccucgagaaggccuacgaggcccgccgcuucacccgcaucgccgucgacgagguccacugcugcucccaguggggccacgacuuccgccccgacuacaaggcccucggcauccucaagcgccaguuccccaacgccucccucaucggccucaccgccaccgccaccaaccacguccucaccgacgcccagaagauccucugcaucgagaagugcuucaccuucaccgccuccuucaaccgccccaaccucuacuacgagguccgccagaagcccuccaacaccgaggacuucaucgaggacaucgucaagcucaucaacggccgcuacaagggccaguccggcaucaucuacugcuucucccagaaggacuccgagcaggucaccgucucccuccagaaccucggcauccacgccggcgccuaccacgccaaccucgagcccgaggacaagaccaccguccaccgcaagugguccgccaacgagauccaggucgucgucgccaccgucgccuucggcaugggcaucgacaagcccgacguccgcuucgucauccaccacuccauguccaaguccauggagaacuacuaccaggaguccggccgcgccggccgcgacgacaugaaggccgacugcauccucuacuacggcuucggcgacaucuuccgcaucuccuccauggucgucauggagaacgucggccagcagaagcucuacgagauggucuccuacugccagaacaucuccaagugccgccgcguccucauggcccagcacuucgacgaggucuggaacuccgaggccugcaacaagaugugcgacaacugcugcaaggacuccgccuucgagcgcaagaacaucaccgaguacugccgcgaccucaucaagauccucaagcaggccgaggagcucaacgagaagcucaccccccucaagcucaucgacuccuggaugggcaagggcgccgccaagcuccgcgucgccggcgucgucgcccccacccucccccgcgaggaccucgagaagaucaucgcccacuuccucauccagcaguaccucaaggaggacuacuccuucaccgccuacgccaccaucuccuaccucaagaucggccccaaggccaaccuccucaacaacgaggcccacgccaucaccaugcaggucaccaaguccacccagaacuccuuccgcgccgaguccucccagaccugccacuccgagcagggcgacaagaagauggaggagaagaacuccggcaacuuccagaagaaggccgccaacaugcuccagcaguccggcuccaagaacaccggcgccaagaagcgcaagaucgacgacgccuga

SEQ ID NO: 48653 - RNA, 627 nt, Artificial Sequence
  derived and/or modified sequence opt2 from REEP1__Homo_sapiens__NP_001158202
augcagaagguccucuccaacggccagaccgaggagguccgcuccggcucccgccucaucuucggcacccucuaccccgccuacuacuccuacaaggccgucaaguccaaggacaucaaggaguacgucaaguggaugauguacuggaucaucuucgcccucuucaccaccgccgagaccuucaccgacaucuuccucugcugguuccccuucuacuacgagcucaagaucgccuucgucgccuggcuccucucccccuacaccaagggcuccucccuccucuaccgcaaguucguccaccccacccucuccuccaaggagaaggagaucgacgacugccucguccaggccaaggaccgcuccuacgacgcccucguccacuucggcaagcgcggccucaacgucgccgccaccgccgccgucauggccgccuccaagggccagggcgcccucuccgagcgccuccgcuccuucuccaugcaggaccucaccaccauccgcggcgacggcgcccccgcccccuccggcccccccccccccggcuccggccgcgccuccggcaagcacggccagcccaagaugucccgcuccgccuccgaguccgccuccuccuccggcaccgccuga

SEQ ID NO: 48654 - RNA, 765 nt, Artificial Sequence
  derived and/or modified sequence opt2 from REEP2__Homo_sapiens__NP_001258732
auggucuccuggaucaucucccgccucgucguccucaucuucggcacccucuaccccgccuacuccuccuacaaggccgucaagaccaagaacgucaaggaguacgucaaguggaugauguacuggaucgucuucgccuucuucaccaccgccgagacccucaccgacaucguccucuccugguuccccuucuacuucgagcucaagaucgccuucgucaucuggcuccucucccccuacaccaagggcuccuccguccucuaccgcaaguucguccaccccacccucuccaacaaggagaaggagaucgacgaguacaucacccaggcccgcgacaaguccuacgagaccaugaugcgcgucggcaagcgcggccucaaccucgccgccaacgccgccgucaccgccgccgccaagggccagggcguccucuccgagaagcuccgcuccuucuccaugcaggaccucacccucauccgcgacgaggacgcccucccccuccagcgccccgacggccgccuccgccccucccccggcucccuccucgacaccaucgaggaccucggcgacgaccccgcccucucccuccgcuccuccaccaaccccgccgacucccgcaccgaggccuccgaggacgacaugggcgacaaggcccccaagcgcgccaagcccaucaagaaggcccccaaggccgagccccucgccuccaagacccucaagacccgccccaagaagaagaccuccggcggcggcgacuccgccuga

SEQ ID NO: 48655 - RNA, 768 nt, Artificial Sequence
  derived and/or modified sequence opt2 from REEP3__Homo_sapiens__NP_001001330
auggucuccuggaugaucucccgcgccgucguccucgucuucggcaugcucuaccccgccuacuacuccuacaaggccgucaagaccaagaacgucaaggaguacguccgcuggaugauguacuggaucgucuucgcccucuacaccgucaucgagaccgucgccgaccagaccgucgccugguucccccucuacuacgagcucaagaucgccuucgucaucuggcuccucucccccuacaccaagggcgccucccucaucuaccgcaaguuccuccacccccuccucuccuccaaggagcgcgagaucgacgacuacaucguccaggccaaggagcgcggcuacgagaccauggucaacuucggccgccagggccucaaccucgccgccaccgccgccgucaccgccgccgucaagucccagggcgccaucaccgagcgccuccgcuccuucuccaugcacgaccucaccaccauccagggcgacgagcccgucggccagcgccccuaccagccccuccccgaggccaagaagaaguccaagcccgcccccuccgaguccgccggcuacggcaucccccucaaggacggcgacgagaagaccgacgaggaggccgagggccccuacuccgacaacgagaugcucacccacaagggccuccgccgcucccaguccaugaaguccgucaagaccaccaagggccgcaaggagguccgcuacggcucccucaaguacaaggucaagaagcgcccccaggucuacuucuga

SEQ ID NO: 48656 - RNA, 570 nt, Artificial Sequence
  derived and/or modified sequence opt2 from REEP5__Homo_sapiens__NP_005660
auguccgccgccaugcgcgagcgcuucgaccgcuuccuccacgagaagaacugcaugaccgaccuccucgccaagcucgaggccaagaccggcgucaaccgcuccuucaucgcccucggcgucaucggccucgucgcccucuaccucgucuucggcuacggcgccucccuccucugcaaccucaucggcuucggcuaccccgccuacaucuccaucaaggccaucgagucccccaacaaggaggacgacacccaguggcucaccuacugggucgucuacggcgucuucuccaucgccgaguucuucuccgacaucuuccucuccugguuccccuucuacuacaugcucaagugcggcuuccuccucuggugcauggcccccucccccuccaacggcgccgagcuccucuacaagcgcaucauccgccccuucuuccucaagcacgagucccagauggacuccgucgucaaggaccucaaggacaaggccaaggagaccgccgacgccaucaccaaggaggccaagaaggccaccgucaaccuccucggcgaggagaagaaguccaccuga

SEQ ID NO: 48657 - RNA, 555 nt, Artificial Sequence
  derived and/or modified sequence opt2 from REEP6__Homo_sapiens__NP_612402
auggacggccuccgccagcgcgucgagcacuuccucgagcagcgcaaccucgucaccgagguccucggcgcccucgaggccaagaccggcgucgagaagcgcuaccucgccgccggcgccgucacccuccucucccucuaccuccucuucggcuacggcgccucccuccucugcaaccucaucggcuucgucuaccccgccuacgccuccaucaaggccaucgagucccccuccaaggacgacgacaccgucuggcucaccuacugggucgucuacgcccucuucggccucgccgaguucuucuccgaccuccuccucuccugguuccccuucuacuacgucggcaagugcgccuuccuccucuucugcauggccccccgccccuggaacggcgcccucaugcucuaccagcgcgucguccgcccccucuuccuccgccaccacggcgccgucgaccgcaucaugaacgaccucuccggccgcgcccucgacgccgccgccggcaucacccgcaacgucaagcccucccagaccccccagcccaaggacaaguga

SEQ ID NO: 48658 - RNA, 501 nt, Artificial Sequence
  derived and/or modified sequence opt2 from REG1A__Homo_sapiens__NP_002900
auggcccagaccuccuccuacuucaugcucaucuccugccucauguuccucucccagucccagggccaggaggcccagaccgagcucccccaggcccgcaucuccugccccgagggcaccaacgccuaccgcuccuacugcuacuacuucaacgaggaccgcgagaccugggucgacgccgaccucuacugccagaacaugaacuccggcaaccucgucuccguccucacccaggccgagggcgccuucgucgccucccucaucaaggaguccggcaccgacgacuucaacgucuggaucggccuccacgaccccaagaagaaccgccgcuggcacugguccuccggcucccucgucuccuacaaguccuggggcaucggcgcccccuccuccgucaaccccggcuacugcgucucccucaccuccuccaccggcuuccagaaguggaaggacguccccugcgaggacaaguucuccuucgucugcaaguucaagaacuga

SEQ ID NO: 48659 - RNA, 501 nt, Artificial Sequence
  derived and/or modified sequence opt2 from REG1B__Homo_sapiens__NP_006498
auggcccagaccaacuccuucuucaugcucaucuccucccucauguuccucucccucucccagggccaggagucccagaccgagcuccccaacccccgcaucuccugccccgagggcaccaacgccuaccgcuccuacugcuacuacuucaacgaggaccccgagaccugggucgacgccgaccucuacugccagaacaugaacuccggcaaccucgucuccguccucacccaggccgagggcgccuucgucgccucccucaucaaggaguccuccaccgacgacuccaacgucuggaucggccuccacgaccccaagaagaaccgccgcuggcacugguccuccggcucccucgucuccuacaaguccugggacaccggcucccccuccuccgccaacgccggcuacugcgccucccucaccuccugcuccggcuucaagaaguggaaggacgaguccugcgagaagaaguucuccuucgucugcaaguucaagaacuga

SEQ ID NO: 48660 - RNA, 528 nt, Artificial Sequence
  derived and/or modified sequence opt2 from REG3A__Homo_sapiens__NP_620355
augcucccccccauggcccuccccuccgucuccuggaugcuccucuccugccucaugcuccucucccagguccagggcgaggagccccagcgcgagcuccccuccgcccgcauccgcugccccaagggcuccaaggccuacggcucccacugcuacgcccucuuccucucccccaaguccuggaccgacgccgaccucgccugccagaagcgccccuccggcaaccucgucuccguccucuccggcgccgagggcuccuucgucuccucccucgucaaguccaucggcaacuccuacuccuacgucuggaucggccuccacgaccccacccagggcaccgagcccaacggcgagggcugggagugguccuccuccgacgucaugaacuacuucgccugggagcgcaaccccuccaccaucuccucccccggccacugcgccucccucucccgcuccaccgccuuccuccgcuggaaggacuacaacugcaacguccgccuccccuacgucugcaaguucaccgacuga

SEQ ID NO: 48661 - RNA, 1647 nt, Artificial Sequence
  derived and/or modified sequence opt2 from RELA__Homo_sapiens__NP_001138610
auggacgagcucuucccccucaucuuccccgccgagcccgcccaggccuccggccccuacgucgagaucaucgagcagcccaagcagcgcggcaugcgcuuccgcuacaagugcgagggccgcuccgccggcuccauccccggcgagcgcuccaccgacaccaccaagacccaccccaccaucaagaucaacggcuacaccggccccggcaccguccgcaucucccucgucaccaaggaccccccccaccgcccccacccccacgagcucgucggcaaggacugccgcgacggcuucuacgaggccgagcucugccccgaccgcugcauccacuccuuccagaaccucggcauccagugcgucaagaagcgcgaccucgagcaggccaucucccagcgcauccagaccaacaacaaccccuuccaggaggagcagcgcggcgacuacgaccucaacgccguccgccucugcuuccaggucaccguccgcgaccccuccggccgcccccuccgccucccccccguccucucccaccccaucuucgacaaccgcgcccccaacaccgccgagcucaagaucugccgcgucaaccgcaacuccggcuccugccucggcggcgacgagaucuuccuccucugcgacaagguccagaaggaggacaucgaggucuacuucaccggccccggcugggaggcccgcggcuccuucucccaggccgacguccaccgccaggucgccaucgucuuccgcaccccccccuacgccgaccccucccuccaggcccccguccgcgucuccaugcagcuccgccgccccuccgaccgcgagcucuccgagcccauggaguuccaguaccuccccgacaccgacgaccgccaccgcaucgaggagaagcgcaagcgcaccuacgagaccuucaaguccaucaugaagaagucccccuucuccggccccaccgacccccgcccccccccccgccgcaucgccguccccucccgcuccuccgccuccguccccaagcccgccccccagcccuaccccuucaccuccucccucuccaccaucaacuacgacgaguuccccaccauggucuuccccuccggccagaucucccaggccuccgcccucgcccccgcccccccccagguccucccccaggcccccgcccccgcccccgcccccgccauggucuccgcccucgcccaggcccccgcccccguccccguccucgcccccggccccccccaggccgucgccccccccgcccccaagcccacccaggccggcgagggcacccucuccgaggcccuccuccagcuccaguucgacgacgaggaccucggcgcccuccucggcaacuccaccgaccccgccgucuucaccgaccucgccuccgucgacaacuccgaguuccagcagcuccucaaccagggcauccccgucgccccccacaccaccgagcccaugcucauggaguaccccgaggccaucacccgccucgucaccggcgcccagcgcccccccgaccccgcccccgccccccucggcgcccccggccuccccaacggccuccucuccggcgacgaggacuucuccuccaucgccgacauggacuucuccgcccuccucucccagaucuccuccuga

SEQ ID NO: 48662 - RNA, 1740 nt, Artificial Sequence
  derived and/or modified sequence opt2 from RELB__Homo_sapiens__NP_006500
augcuccgcuccggccccgccuccggccccuccguccccaccggccgcgccaugcccucccgccgcgucgcccgcccccccgccgcccccgagcucggcgcccucggcucccccgaccucuccucccucucccucgccgucucccgcuccaccgacgagcucgagaucaucgacgaguacaucaaggagaacggcuucggccucgacggcggccagcccggccccggcgagggccucccccgccucgucucccgcggcgccgccucccucuccaccgucacccucggccccgucgccccccccgccacccccccccccuggggcugcccccucggccgccucgucucccccgcccccggccccggcccccagccccaccucgucaucaccgagcagcccaagcagcgcggcaugcgcuuccgcuacgagugcgagggccgcuccgccggcuccauccucggcgaguccuccaccgaggccuccaagacccuccccgccaucgagcuccgcgacugcggcggccuccgcgaggucgaggucaccgccugccucgucuggaaggacuggccccaccgcguccacccccacucccucgucggcaaggacugcaccgacggcaucugccgcguccgccuccgcccccacgucuccccccgccacuccuucaacaaccucggcauccagugcguccgcaagaaggagaucgaggccgccaucgagcgcaagauccagcucggcaucgaccccuacaacgccggcucccucaagaaccaccaggaggucgacaugaacgucguccgcaucugcuuccaggccuccuaccgcgaccagcagggccagaugcgccgcauggaccccguccucuccgagcccgucuacgacaagaaguccaccaacaccuccgagcuccgcaucugccgcaucaacaaggaguccggccccugcaccggcggcgaggagcucuaccuccucugcgacaagguccagaaggaggacaucuccgucgucuucucccgcgccuccugggagggccgcgccgacuucucccaggccgacguccaccgccagaucgccaucgucuucaagaccccccccuacgaggaccucgagaucgucgagcccgucaccgucaacgucuuccuccagcgccucaccgacggcgucugcuccgagccccuccccuucaccuaccucccccgcgaccacgacuccuacggcgucgacaagaagcgcaagcgcggcaugcccgacguccucggcgagcucaacuccuccgacccccacggcaucgaguccaagcgccgcaagaagaagcccgccauccucgaccacuuccuccccaaccacggcuccggccccuuccucccccccuccgcccuccuccccgaccccgacuucuucuccggcaccgucucccuccccggccucgagccccccggcggccccgaccuccucgacgacggcuucgccuacgaccccaccgcccccacccucuucaccaugcucgaccuccucccccccgcccccccccacgccuccgccgucgucugcuccggcggcgccggcgccgucgucggcgagacccccggccccgagccccucacccucgacuccuaccaggcccccggccccggcgacggcggcaccgccucccucgucggcuccaacauguuccccaaccacuaccgcgaggccgccuucggcggcggccuccucucccccggccccgaggccaccuga

SEQ ID NO: 48663 - RNA, 1764 nt, Artificial Sequence
  derived and/or modified sequence opt2 from REL__Homo_sapiens__NP_001278675
auggccuccggcgccuacaaccccuacaucgagaucaucgagcagccccgccagcgcggcaugcgcuuccgcuacaagugcgagggccgcuccgccggcuccauccccggcgagcacuccaccgacaacaaccgcaccuaccccuccauccagaucaugaacuacuacggcaagggcaagguccgcaucacccucgucaccaagaacgaccccuacaagccccacccccacgaccucgucggcaaggacugccgcgacggcuacuacgaggccgaguucggccaggagcgccgcccccucuucuuccagaaccucggcauccgcugcgucaagaagaaggaggucaaggaggccaucaucacccgcaucaaggccggcaucaaccccuucaacguccccgagaagcagcucaacgacaucgaggacugcgaccucaacgucguccgccucugcuuccaggucuuccuccccgacgagcacggcaaccucaccaccgcccucccccccgucgucuccaaccccaucuacgacaaccgcgcccccaacaccgccgagcuccgcaucugccgcgucaacaagaacugcggcuccguccgcggcggcgacgagaucuuccuccucugcgacaagguccagaaggacgacaucgagguccgcuucguccucaacgacugggaggccaagggcaucuucucccaggccgacguccaccgccaggucgccaucgucuucaagaccccccccuacugcaaggccaucaccgagcccgucaccgucaagaugcagcuccgccgccccuccgaccaggaggucuccgaguccauggacuuccgcuaccuccccgacgagaaggacaccuacggcaacaaggccaagaagcagaagaccacccuccucuuccagaagcucugccaggaccacgucaacuuccccgagcgcccccgccccggccuccucggcuccaucggcgagggccgcuacuucaagaaggagcccaaccucuucucccacgacgccgucguccgcgagaugcccaccggcgucuccucccaggccgaguccuacuaccccucccccggccccaucuccuccggccucucccaccacgccuccauggccccccuccccuccuccuccugguccuccgucgcccaccccaccccccgcuccggcaacaccaacccccucuccuccuucuccacccgcacccuccccuccaacucccagggcaucccccccuuccuccgcauccccgucggcaacgaccucaacgccuccaacgccugcaucuacaacaacgccgacgacaucgucggcauggaggccuccuccaugcccuccgccgaccucuacggcaucuccgaccccaacaugcucuccaacugcuccgucaacaugaugaccaccuccuccgacuccaugggcgagaccgacaacccccgccuccucuccaugaaccucgagaaccccuccugcaacuccguccucgacccccgcgaccuccgccagcuccaccagauguccuccuccuccauguccgccggcgccaacuccaacaccaccgucuucgucucccaguccgacgccuucgagggcuccgacuucuccugcgccgacaacuccaugaucaacgaguccggccccuccaacuccaccaaccccaacucccacggcuucguccaggacucccaguacuccggcaucggcuccaugcagaacgagcagcucuccgacuccuuccccuacgaguucuuccaggucuga

SEQ ID NO: 48664 - RNA, 10383 nt, Artificial Sequence
  derived and/or modified sequence opt2 from RELN__Homo_sapiens__NP_005036
auggagcgcuccggcugggcccgccagaccuuccuccucgcccuccuccucggcgccacccuccgcgcccgcgccgccgccggcuacuacccccgcuucucccccuucuucuuccucugcacccaccacggcgagcucgagggcgacggcgagcagggcgagguccucaucucccuccacaucgccggcaaccccaccuacuacguccccggccaggaguaccacgucaccaucuccaccuccaccuucuucgacggccuccucgucaccggccucuacaccuccaccuccguccaggccucccaguccaucggcggcuccuccgccuucggcuucggcaucauguccgaccaccaguucggcaaccaguucaugugcuccgucgucgccucccacgucucccaccuccccaccaccaaccucuccuucaucuggaucgccccccccgccggcaccggcugcgucaacuucauggccaccgccacccaccgcggccaggucaucuucaaggacgcccucgcccagcagcucugcgagcagggcgcccccaccgacgucaccguccacccccaccucgccgagauccacuccgacuccaucauccuccgcgacgacuucgacuccuaccaccagcuccagcucaaccccaacaucugggucgagugcaacaacugcgagaccggcgagcagugcggcgccaucaugcacggcaacgccgucaccuucugcgagcccuacggcccccgcgagcucaucaccaccggccucaacaccaccaccgccuccguccuccaguucuccaucggcuccggcuccugccgcuucuccuacuccgaccccuccaucaucguccucuacgccaagaacaacuccgccgacuggauccagcucgagaagauccgcgcccccuccaacgucuccaccaucauccacauccucuaccuccccgaggacgccaagggcgagaacguccaguuccaguggaagcaggagaaccuccgcgucggcgaggucuacgaggccugcugggcccucgacaacauccucaucaucaacuccgcccaccgccaggucguccucgaggacucccucgaccccgucgacaccggcaacuggcucuucuuccccggcgccaccgucaagcacuccugccaguccgacggcaacuccaucuacuuccacggcaacgagggcuccgaguucaacuucgccaccacccgcgacgucgaccucuccaccgaggacauccaggagcagugguccgaggaguucgagucccagcccaccggcugggacguccucggcgccgucaucggcaccgagugcggcaccaucgaguccggccucuccauggucuuccucaaggacggcgagcgcaagcucugcacccccuccauggacaccaccggcuacggcaaccuccgcuucuacuucgucaugggcggcaucugcgaccccggcaacucccacgagaacgacaucauccucuacgccaagaucgagggccgcaaggagcacaucacccucgacacccucuccuacuccuccuacaagguccccucccucgucuccgucgucaucaaccccgagcuccagacccccgccaccaaguucugccuccgccagaagaaccaccagggccacaaccgcaacgucugggccgucgacuucuuccacguccuccccguccuccccuccaccaugucccacaugauccaguucuccaucaaccucggcugcggcacccaccagcccggcaacuccgucucccucgaguucuccaccaaccacggccgcuccuggucccuccuccacaccgagugccuccccgagaucugcgccggcccccaccucccccacuccaccgucuacuccuccgagaacuacuccggcuggaaccgcaucaccaucccccuccccaacgccgcccucacccgcaacacccgcauccgcuggcgccagaccggccccauccucggcaacaugugggccaucgacaacgucuacaucggccccuccugccucaaguucugcuccggccgcggccagugcacccgccacggcugcaagugcgaccccggcuucuccggccccgccugcgagauggccucccagaccuuccccauguucaucuccgaguccuucggcuccucccgccucuccuccuaccacaacuucuacuccauccgcggcgccgaggucuccuucggcugcggcguccucgccuccggcaaggcccucgucuucaacaaggacggccgccgccagcucaucaccuccuuccucgacuccucccagucccgcuuccuccaguucacccuccgccucggcuccaaguccguccucuccaccugccgcgcccccgaccagcccggcgagggcguccuccuccacuacuccuacgacaacggcaucaccuggaagcuccucgagcacuacuccuaccucuccuaccacgagccccgcaucaucuccgucgagcuccccggcgacgccaagcaguucggcauccaguuccgcugguggcagcccuaccacuccucccagcgcgaggacgucugggccaucgacgagaucaucaugaccuccguccucuucaacuccaucucccucgacuucaccaaccucgucgaggucacccagucccucggcuucuaccucggcaacguccagcccuacugcggccacgacuggacccucugcuucaccggcgacuccaagcucgccuccuccaugcgcuacgucgagacccaguccaugcagaucggcgccuccuacaugauccaguucucccucgucaugggcugcggccagaaguacaccccccacauggacaaccaggucaagcucgaguacuccaccaaccacggccucaccuggcaccucguccaggaggagugccuccccuccaugcccuccugccaggaguucaccuccgccuccaucuaccacgccuccgaguucacccaguggcgccgcgucaucguccuccucccccagaagaccugguccuccgccacccgcuuccgcuggucccaguccuacuacaccgcccaggacgagugggcccucgacuccaucuacaucggccagcagugccccaacaugugcuccggccacggcuccugcgaccacggcaucugccgcugcgaccagggcuaccagggcaccgagugccaccccgaggccgcccuccccuccaccaucauguccgacuucgagaaccagaacggcugggaguccgacuggcaggaggucaucggcggcgagaucgucaagcccgagcagggcugcggcgucaucuccuccggcuccucccucuacuucuccaaggccggcaagcgccagcucgucuccugggaccucgacaccuccugggucgacuucguccaguucuacauccagaucggcggcgaguccgccuccugcaacaagcccgacucccgcgaggagggcguccuccuccaguacuccaacaacggcggcauccaguggcaccuccucgccgagauguacuucuccgacuucuccaagccccgcuucgucuaccucgagcuccccgccgccgccaagacccccugcacccgcuuccgcugguggcagcccgucuucuccggcgaggacuacgaccagugggccgucgacgacaucaucauccucuccgagaagcagaagcagaucauccccgucaucaaccccacccucccccagaacuucuacgagaagcccgccuucgacuaccccaugaaccagauguccgucuggcucaugcucgccaacgagggcauggucaagaacgagaccuucugcgccgccacccccuccgccaugaucuucggcaaguccgacggcgaccgcuucgccgucacccgcgaccucacccucaagcccggcuacguccuccaguucaagcucaacaucggcugcgccaaccaguucuccuccaccgcccccguccuccuccaguacucccacgacgccggcauguccugguuccucgucaaggagggcugcuaccccgccuccgccggcaagggcugcgagggcaacucccgcgagcucuccgagcccaccauguaccacaccggcgacuucgaggaguggacccgcaucaccaucgucaucccccgcucccucgccuccuccaagacccgcuuccgcuggauccaggaguccuccucccagaagaacgucccccccuucggccucgacggcgucuacaucuccgagcccugccccuccuacugcuccggccacggcgacugcaucuccggcgucugcuucugcgaccucggcuacaccgccgcccagggcaccugcgucuccaacguccccaaccacaacgagauguucgaccgcuucgagggcaagcucuccccccucugguacaagaucaccggcgcccaggucggcaccggcugcggcacccucaacgacggcaagucccucuacuucaacggccccggcaagcgcgaggcccgcaccgucccccucgacacccgcaacauccgccucguccaguucuacauccagaucggcuccaagaccuccggcaucaccugcaucaagccccgcacccgcaacgagggccucaucguccaguacuccaacgacaacggcauccucuggcaccuccuccgcgagcucgacuucauguccuuccucgagccccagaucaucuccaucgaccucccccaggacgccaagacccccgccaccgccuuccgcugguggcagccccagcacggcaagcacuccgcccagugggcccucgacgacguccucaucggcaugaacgacuccucccagaccggcuuccaggacaaguucgacggcuccaucgaccuccaggccaacugguaccgcauccagggcggccaggucgacaucgacugccucuccauggacaccgcccucaucuucaccgagaacaucggcaagccccgcuacgccgagaccugggacuuccacgucuccgccuccaccuuccuccaguucgagauguccaugggcugcuccaagcccuucuccaacucccacuccguccagcuccaguacucccucaacaacggcaaggacuggcaccucgucaccgaggagugcgucccccccaccaucggcugccuccacuacaccgaguccuccaucuacaccuccgagcgcuuccagaacuggaagcgcaucaccgucuaccucccccucuccaccaucuccccccgcacccgcuuccgcuggauccaggccaacuacaccgucggcgccgacuccugggccaucgacaacgucguccucgccuccggcugccccuggaugugcuccggccgcggcaucugcgacgccggccgcugcgucugcgaccgcggcuucggcggccccuacugcguccccgucgucccccuccccuccauccucaaggacgacuucaacggcaaccuccaccccgaccucuggcccgaggucuacggcgccgagcgcggcaaccucaacggcgagaccaucaaguccggcaccucccucaucuucaagggcgagggccuccgcaugcucaucucccgcgaccucgacugcaccaacaccauguacguccaguucucccuccgcuucaucgccaaguccacccccgagcgcucccacuccauccuccuccaguucuccaucuccggcggcaucaccuggcaccucauggacgaguucuacuucccccagaccaccaacauccucuucaucaacgucccccuccccuacaccgcccagaccaacgccacccgcuuccgccucuggcagcccuacaacaacggcaagaaggaggagaucuggaucgucgacgacuucaucaucgacggcaacaacgucaacaaccccgucaugcuccucgacaccuucgacuucggcccccgcgaggacaacugguucuucuaccccggcggcaacaucggccucuacugccccuacuccuccaagggcgcccccgaggaggacuccgccauggucuucgucuccaacgaggucggcgagcacuccaucaccacccgcgaccucaacgucaacgagaacaccaucauccaguucgagaucaacgucggcugcuccaccgacuccuccuccgccgaccccguccgccucgaguucucccgcgacuucggcgccaccuggcaccuccuccucccccucugcuaccacuccuccucccacgucuccucccucugcuccaccgagcaccaccccuccuccaccuacuacgccggcaccaugcagggcuggcgccgcgaggucguccacuucggcaagcuccaccucugcggcuccguccgcuuccgcugguaccagggcuucuaccccgccggcucccagcccgucaccugggccaucgacaacgucuacaucggcccccagugcgaggagaugugcaacggccagggcuccugcaucaacggcaccaagugcaucugcgaccccggcuacuccggccccaccugcaagaucuccaccaagaaccccgacuuccucaaggacgacuucgagggccagcucgaguccgaccgcuuccuccucauguccggcggcaagcccucccgcaagugcggcauccucuccuccggcaacaaccucuucuucaacgaggacggccuccgcaugcucaugacccgcgaccucgaccucucccacgcccgcuucguccaguucuucaugcgccucggcugcggcaagggcguccccgacccccgcucccagcccguccuccuccaguacucccucaacggcggccucuccuggucccuccuccaggaguuccucuucuccaacuccuccaacgucggccgcuacaucgcccucgagaucccccucaaggcccgcuccggcuccacccgccuccgcugguggcagcccuccgagaacggccacuucuacucccccugggucaucgaccagauccucaucggcggcaacaucuccggcaacaccguccucgaggacgacuucaccacccucgacucccgcaaguggcuccuccaccccggcggcaccaagaugcccgucugcggcuccaccggcgacgcccucgucuucaucgagaaggccuccacccgcuacgucgucuccaccgacgucgccgucaacgaggacuccuuccuccagaucgacuucgccgccuccugcuccgucaccgacuccugcuacgccaucgagcucgaguacuccgucgaccucggccucuccuggcacccccucguccgcgacugccuccccaccaacgucgagugcucccgcuaccaccuccagcgcauccucgucuccgacaccuucaacaaguggacccgcaucacccucccccucccccccuacacccgcucccaggccacccgcuuccgcuggcaccagcccgcccccuucgacaagcagcagaccugggccaucgacaacgucuacaucggcgacggcugcaucgacaugugcuccggccacggccgcugcauccagggcaacugcgucugcgacgagcaguggggcggccucuacugcgacgaccccgagaccucccuccccacccagcucaaggacaacuucaaccgcgcccccuccucccagaacuggcucaccgucaacggcggcaagcucuccaccgucugcggcgccgucgccuccggcauggcccuccacuucuccggcggcugcucccgccuccucgucaccgucgaccucaaccucaccaacgccgaguucauccaguucuacuucauguacggcugccucaucacccccaacaaccgcaaccagggcguccuccucgaguacuccgucaacggcggcaucaccuggaaccuccucauggagaucuucuacgaccaguacuccaagcccggcuucgucaacauccuccucccccccgacgccaaggagaucgccacccgcuuccgcugguggcagccccgccacgacggccucgaccagaacgacugggccaucgacaacguccucaucuccggcuccgccgaccagcgcaccgucaugcucgacaccuucuccuccgcccccgucccccagcacgagcgcucccccgccgacgccggccccgucggccgcaucgccuucgacauguucauggaggacaagaccuccgucaacgagcacuggcucuuccacgacgacugcaccgucgagcgcuucugcgacucccccgacggcgucaugcucugcggcucccacgacggccgcgaggucuacgccgucacccacgaccucacccccaccgagggcuggaucaugcaguucaagaucuccgucggcugcaaggucuccgagaagaucgcccagaaccagauccacguccaguacuccaccgacuucggcgucuccuggaacuaccucgucccccagugccuccccgccgaccccaagugcuccggcuccgucucccagcccuccgucuucuuccccaccaagggcuggaagcgcaucaccuacccccuccccgagucccucgucggcaaccccguccgcuuccgcuucuaccagaaguacuccgacaugcagugggccaucgacaacuucuaccucggccccggcugccucgacaacugccgcggccacggcgacugccuccgcgagcagugcaucugcgaccccggcuacuccggccccaacugcuaccucacccacacccucaagaccuuccucaaggagcgcuucgacuccgaggagaucaagcccgaccucuggaugucccucgagggcggcuccaccugcaccgagugcggcauccucgccgaggacaccgcccucuacuucggcggcuccaccguccgccaggccgucacccaggaccucgaccuccgcggcgccaaguuccuccaguacuggggccgcaucggcuccgagaacaacaugaccuccugccaccgccccaucugccgcaaggagggcguccuccucgacuacuccaccgacggcggcaucaccuggacccuccuccacgagauggacuaccagaaguacaucuccguccgccacgacuacauccuccuccccgaggacgcccucaccaacaccacccgccuccgcugguggcagcccuucgucaucuccaacggcaucgucgucuccggcgucgagcgcgcccagugggcccucgacaacauccucaucggcggcgccgagaucaaccccucccagcucgucgacaccuucgacgacgagggcaccucccacgaggagaacugguccuucuaccccaacgccguccgcaccgccggcuucugcggcaaccccuccuuccaccucuacuggcccaacaagaagaaggacaagacccacaacgcccucuccucccgcgagcucaucauccagcccggcuacaugaugcaguucaagaucgucgucggcugcgaggccaccuccugcggcgaccuccacuccgucaugcucgaguacaccaaggacgcccgcuccgacuccuggcagcucguccagacccagugccuccccuccuccuccaacuccaucggcugcucccccuuccaguuccacgaggccaccaucuacaacuccgucaacuccuccuccuggaagcgcaucaccauccagcuccccgaccacgucuccuccuccgccacccaguuccgcuggauccagaagggcgaggagaccgagaagcaguccugggccaucgaccacgucuacaucggcgaggccugccccaagcucugcuccggccacggcuacugcaccaccggcgccaucugcaucugcgacgaguccuuccagggcgacgacugcuccgucuucucccacgaccuccccuccuacaucaaggacaacuucgaguccgcccgcgucaccgaggccaacugggagaccauccagggcggcgucaucggcuccggcugcggccagcucgcccccuacgcccacggcgacucccucuacuucaacggcugccagauccgccaggccgccaccaagccccucgaccucacccgcgccuccaagaucauguucguccuccagaucggcuccaugucccagaccgacuccugcaacuccgaccucuccggcccccacgccgucgacaaggccguccuccuccaguacuccgucaacaacggcaucaccuggcacgucaucgcccagcaccagcccaaggacuucacccaggcccagcgcgucuccuacaacgucccccucgaggcccgcaugaagggcguccuccuccgcugguggcagccccgccacaacggcaccggccacgaccagugggcccucgaccacgucgaggucguccucgucuccacccgcaagcagaacuacaugaugaacuucucccgccagcacggccuccgccacuucuacaaccgccgccgccgcucccuccgccgcuaccccuga

SEQ ID NO: 48665 - RNA, 897 nt, Artificial Sequence
  derived and/or modified sequence opt2 from REM1__Homo_sapiens__NP_054731
augacccucaacaccgagcaggaggccaagaccccccuccaccgccgcgccuccaccccccucccccucuccccccgcggccaccagcccggccgccucuccaccguccccuccacccagucccagcacccccgccucggccaguccgccucccucaacccccccacccagaagcccucccccgcccccgacgacugguccuccgaguccuccgacuccgagggcuccugggaggcccucuaccgcgucguccuccucggcgaccccggcgucggcaagaccucccucgccucccucuucgccggcaagcaggagcgcgaccuccacgagcagcucggcgaggacgucuacgagcgcacccucaccgucgacggcgaggacaccacccucgucgucgucgacaccugggaggccgagaagcucgacaaguccuggucccaggaguccugccuccagggcggcuccgccuacgucaucgucuacuccaucgccgaccgcggcuccuucgaguccgccuccgagcuccgcauccagcuccgccgcacccaccaggccgaccacguccccaucauccucgucggcaacaaggccgaccucgcccgcugccgcgaggucuccgucgaggagggccgcgccugcgccgucgucuucgacugcaaguucaucgagaccuccgccacccuccagcacaacgucgccgagcucuucgagggcgucguccgccagcuccgccuccgccgccgcgacuccgccgccaaggagccccccgccccccgccgccccgccucccucgcccagcgcgcccgccgcuuccucgcccgccucaccgcccgcuccgcccgccgccgcgcccucaaggcccgcuccaaguccugccacaaccucgccguccucuga

SEQ ID NO: 48666 - RNA, 1284 nt, Artificial Sequence
  derived and/or modified sequence opt2 from RENBP__Homo_sapiens__NP_002901
auguccaagggccuccccgcccgccaggacauggagaaggagcgcgagacccuccaggccuggaaggagcgcgucggccaggagcucgaccgcgucgucgccuucuggauggagcacucccacgaccaggagcacggcggcuucuucaccugccucggccgcgagggccgcgucuacgacgaccucaaguacgucuggcuccagggccgccaggucuggauguacugccgccucuaccgcaccuucgagcgcuuccgccacgcccagcuccucgacgccgccaaggccggcggcgaguuccuccuccgcuacgcccgcgucgccccccccggcaagaagugcgccuucguccucacccgcgacggccgccccgucaagguccagcgcaccaucuucuccgagugcuucuacaccauggccaugaacgagcucuggcgcgccaccggcgagguccgcuaccagaccgaggccgucgagaugauggaccagaucguccacuggguccaggaggacgccuccggccucggccgcccccagcuccagggcgcccccgccgccgagcccauggccguccccaugaugcuccucaaccucgucgagcagcucggcgaggccgacgaggagcucgccggcaaguacgccgagcucggcgacuggugcgcccgccgcauccuccagcacguccagcgcgacggccaggccguccucgagaacgucuccgagggcggcaaggagcuccccggcugccucggccgccagcagaaccccggccacacccucgaggccggcugguuccuccuccgccacugcauccgcaagggcgaccccgagcuccgcgcccacgucaucgacaaguuccuccuccuccccuuccacuccggcugggaccccgaccacggcggccucuucuacuuccaggacgccgacaacuucugccccacccagcucgagugggccaugaagcucugguggccccacuccgaggccaugaucgccuuccucaugggcuacuccgacuccggcgaccccguccuccuccgccucuucuaccaggucgccgaguacaccuuccgccaguuccgcgaccccgaguacggcgagugguucggcuaccucucccgcgagggcaaggucgcccucuccaucaagggcggccccuucaagggcugcuuccacgucccccgcugccucgccaugugcgaggagaugcucggcgcccuccucucccgccccgcccccgcccccucccccgcccccacccccgccugccgcggcgccgaguga

SEQ ID NO: 48667 - RNA, 1221 nt, Artificial Sequence
  derived and/or modified sequence opt2 from REN__Homo_sapiens__NP_000528
auggacggcuggcgccgcaugccccgcuggggccuccuccuccuccucuggggcuccugcaccuucggccuccccaccgacaccaccaccuucaagcgcaucuuccucaagcgcaugcccuccauccgcgagucccucaaggagcgcggcgucgacauggcccgccucggccccgaguggucccagcccaugaagcgccucacccucggcaacaccaccuccuccgucauccucaccaacuacauggacacccaguacuacggcgagaucggcaucggcacccccccccagaccuucaaggucgucuucgacaccggcuccuccaacgucuggguccccuccuccaagugcucccgccucuacaccgccugcgucuaccacaagcucuucgacgccuccgacuccuccuccuacaagcacaacggcaccgagcucacccuccgcuacuccaccggcaccgucuccggcuuccucucccaggacaucaucaccgucggcggcaucaccgucacccagauguucggcgaggucaccgagaugcccgcccuccccuucaugcucgccgaguucgacggcgucgucggcaugggcuucaucgagcaggccaucggccgcgucacccccaucuucgacaacaucaucucccagggcguccucaaggaggacgucuucuccuucuacuacaaccgcgacuccgagaacucccagucccucggcggccagaucguccucggcggcuccgacccccagcacuacgagggcaacuuccacuacaucaaccucaucaagaccggcgucuggcagauccagaugaagggcgucuccgucggcuccuccacccuccucugcgaggacggcugccucgcccucgucgacaccggcgccuccuacaucuccggcuccaccuccuccaucgagaagcucauggaggcccucggcgccaagaagcgccucuucgacuacgucgucaagugcaacgagggccccacccuccccgacaucuccuuccaccucggcggcaaggaguacacccucaccuccgccgacuacgucuuccaggaguccuacuccuccaagaagcucugcacccucgccauccacgccauggacauccccccccccaccggccccaccugggcccucggcgccaccuucauccgcaaguucuacaccgaguucgaccgccgcaacaaccgcaucggcuucgcccucgcccgcuga

SEQ ID NO: 48668 - RNA, 2310 nt, Artificial Sequence
  derived and/or modified sequence opt2 from REPS1__Homo_sapiens__NP_001122089
auggagggccucacccucuccgacgccgagcagaaguacuacuccgaccucuucuccuacugcgacaucgaguccaccaagaaggucgucgucaacggccgcguccucgagcucuuccgcgccgcccagcuccccaacgacgucguccuccagaucauggagcucugcggcgccacccgccucggcuacuucggccgcucccaguucuacaucgcccucaagcucgucgccgucgcccaguccggcuucccccuccgcgucgaguccaucaacaccgucaaggaccucccccucccccgcuucgucgccuccaagaacgagcaggagucccgccacgccgccuccuacuccuccgacuccgagaaccagggcuccuacuccggcgucaucccccccccccccggccgcggccaggucaagaagggcuccgucucccacgacaccguccagccccgcaccuccgccgacgcccaggagcccgccucccccgucgucuccccccagcaguccccccccaccuccccccacaccuggcgcaagcacucccgccaccccuccggcggcaacuccgagcgcccccucgccggccccggccccuucuggucccccuucggcgaggcccaguccggcuccuccgccggcgacgccgucugguccggccacucccccccccccccccaggagaacugggucuccuucgccgacaccccccccaccuccacccuccucaccaugcaccccgccuccguccaggaccagaccaccguccgcaccgucgccuccgccaccaccgccaucgagauccgccgccaguccuccuccuacgacgaccccuggaagaucaccgacgagcagcgccaguacuacgucaaccaguucaagaccauccagcccgaccucaacggcuucauccccggcuccgccgccaaggaguucuucaccaaguccaagcuccccauccucgagcucucccacaucugggagcucuccgacuucgacaaggacggcgcccucacccucgacgaguucugcgccgccuuccaccucgucgucgcccgcaagaacggcuacgaccuccccgagaagcuccccgagucccucaugcccaagcucaucgaccucgaggacuccgccgacgucggcgaccagcccggcgaggucggcuacuccggcucccccgccgaggccccccccuccaagucccccuccaugcccucccucaaccagaccuggcccgagcucaaccaguccuccgaggacaccgccaucguccaccccguccccauccgcaugacccccuccaagauccacaugcaggagauggagcucaagcgcaccggcuccgaccacaccaaccccaccuccccccuccucgucaagcccuccgaccuccucgaggagaacaagaucaacuccuccgucaaguucgccuccggcaacaccgucgccgacggcuacuccuccuccgacuccuucaccuccgaccccgagcagaucggcuccaacgucacccgccagcgcucccacuccggcaccucccccgacaacaccgcccccccccccccccccccccgcccccagcccucccacucccgcuccuccucccucgacaugaaccgcaccuucaccgucaccaccggccagcagcaggccggcgucgucgcccacccccccgccguccccccccgcccccagcccucccaggcccccggccccgccguccaccgccccgucgacgccgacggccucaucacccacaccuccaccuccccccagcagauccccgagcagcccaacuucgccgacuucucccaguucgaggucuucgccgccuccaacgucaacgacgagcaggacgacgaggccgagaagcaccccgagguccuccccgccgagaaggccuccgaccccgccuccucccuccgcgucgccaagaccgacuccaagaccgaggagaagaccgccgccuccgcccccgccaacgucuccaagggcaccaccccccucgcccccccccccaagcccguccgccgccgccucaaguccgaggacgagcuccgccccgaggucgacgagcacacccagaagaccggcguccucgccgccguccucgccucccagcccuccaucccccgcuccgucggcaaggacaagaaggccauccaggccuccauccgccgcaacaaggagaccaacaccguccucgcccgccucaacuccgagcuccagcagcagcucaaggacguccucgaggagcgcaucucccucgagguccagcucgagcagcuccgccccuucucccaccucuga

SEQ ID NO: 48669 - RNA, 1980 nt, Artificial Sequence
  derived and/or modified sequence opt2 from REPS2__Homo_sapiens__NP_001074444
auggaggccgccgccgccgccgccgccgccgccgccgccgccgccgccgccggcggcggcugcggcuccggcccccccccccuccuccucuccgagggcgagcagcagugcuacuccgagcucuucgcccgcugcgccggcgccgccggcggcggccccggcuccggcccccccgaggccgcccgcgucgcccccggcaccgccaccgccgccgccggccccgucgccgaccucuuccgcgccucccagcuccccgccgagacccuccaccagaucaccgagcucugcggcgccaagcgcgucggcuacuucggccccacccaguucuacaucgcccucaagcucaucgccgccgcccaguccggccuccccguccgcaucgaguccaucaagugcgagcucccccucccccgcuucaugauguccaagaacgacggcgagauccgcuucggcaaccccgccgagcuccacggcaccaagguccagauccccuaccucaccaccgagaagaacuccuucaagcgcauggacgacgaggacaagcaggagacccagucccccaccauguccccccucgccuccccccccuccucccccccccacuaccagcgcgucccccucucccacggcuacuccaagcuccgcuccuccgccgagcagaugcaccccgcccccuacgaggcccgccagccccucguccagcccgagggcuccuccuccggcggccccggcaccaagccccuccgccaccaggccucccucauccgcuccuucuccgucgagcgcgagcuccaggacaacuccuccuaccccgacgagcccuggcgcaucaccgaggagcagcgcgaguacuacgucaaccaguuccgcucccuccagcccgaccccuccuccuucaucuccggcuccgucgccaagaacuucuucaccaaguccaagcucuccauccccgagcucuccuacaucugggagcucuccgacgccgacugcgacggcgcccucacccuccccgaguucugcgccgccuuccaccucaucgucgcccgcaagaacggcuacccccuccccgagggccucccccccacccuccagcccgaguaccuccaggccgccuuccccaagcccaagugggacugccagcucuucgacuccuacuccgagucccuccccgccaaccagcagccccgcgaccucaaccgcauggagaagaccuccgucaaggacauggccgaccuccccguccccaaccaggacgucaccuccgacgacaagcaggcccucaaguccaccaucaacgaggcccuccccaaggacgucuccgaggaccccgccacccccaaggacuccaacucccucaaggcccgcccccgcucccgcuccuacuccuccaccuccaucgaggaggccaugaagcgcggcgaggacccccccaccccccccccccgcccccagaagacccacucccgcgccuccucccucgaccucaacaaggucuuccagcccuccguccccgccaccaaguccggccuccucccccccccccccgcccuccccccccgccccugccccucccaguccgagcaggucuccgaggccgagcuccucccccagcucucccgcgcccccucccaggccgccgaguccucccccgccaagaaggacguccucuacucccagccccccuccaagcccauccgccgcaaguuccgccccgagaaccaggccaccgagaaccaggagcccuccaccgccgccuccggccccgccuccgccgccaccaugaagccccaccccaccguccagaagcaguccuccaagcagaagaaggccauccagaccgccauccgcaagaacaaggaggccaacgccguccucgcccgccucaacuccgagcuccagcagcagcucaaggagguccaccaggagcgcaucgcccucgagaaccagcucgagcagcuccgccccgucaccguccucuga

SEQ ID NO: 48670 - RNA, 543 nt, Artificial Sequence
  derived and/or modified sequence opt2 from RERG__Homo_sapiens__NP_001177655
auggccaaguccgccgaggucaagcucgccaucuucggccgcgccggcgucggcaaguccgaguccaccuaccgccaccaggccaccaucgacgacgaggucgucuccauggagauccucgacaccgccggccaggaggacaccauccagcgcgagggccacaugcgcuggggcgagggcuucguccucgucuacgacaucaccgaccgcggcuccuucgaggagguccucccccucaagaacauccucgacgagaucaagaagcccaagaacgucacccucauccucgucggcaacaaggccgaccucgaccacucccgccaggucuccaccgaggagggcgagaagcucgccaccgagcucgccugcgccuucuacgagugcuccgccugcaccggcgagggcaacaucaccgagaucuucuacgagcucugccgcgagguccgccgccgccgcaugguccagggcaagacccgccgccgcuccuccaccacccacgucaagcaggccaucaacaagaugcucaccaagaucuccuccuga

SEQ ID NO: 48671 - RNA, 618 nt, Artificial Sequence
  derived and/or modified sequence opt2 from RERGL__Homo_sapiens__NP_079006
auguccaacuuccuccaccucaaguacaacgagaaguccgucuccgucaccaaggcccucaccguccgcuuccucaccaagcgcuucaucggcgaguacgccuccaacuucgaguccaucuacaagaagcaccucugccucgagcgcaagcagcucaaccucgagaucuacgaccccugcucccagacccagaaggccaaguucucccucaccuccgagcuccacugggccgacggcuucgucaucgucuacgacaucuccgaccgcuccuccuucgccuucgccaaggcccucaucuaccgcauccgcgagccccagaccucccacugcaagcgcgccgucgaguccgccgucuuccucgucggcaacaagcgcgaccucugccacguccgcgaggucggcugggaggagggccagaagcucgcccucgagaaccgcugccaguucugcgagcucuccgccgccgagcagucccucgaggucgagaugauguucauccgcaucaucaaggacauccucaucaacuucaagcucaaggagaagcgccgccccuccggcuccaaguccauggccaagcucaucaacaacgucuucggcaagcgccgcaaguccgucuga

SEQ ID NO: 48672 - RNA, 3294 nt, Artificial Sequence
  derived and/or modified sequence opt2 from REST__Homo_sapiens__NP_001180437
auggccacccaggucaugggccaguccuccggcggcggcggccucuucaccuccuccggcaacaucggcauggcccuccccaacgacauguacgaccuccacgaccucuccaaggccgagcucgccgccccccagcucaucaugcucgccaacgucgcccucaccggcgaggucaacggcuccugcugcgacuaccucgucggcgaggagcgccagauggccgagcucaugcccgucggcgacaacaacuucuccgacuccgaggagggcgagggccucgaggaguccgccgacaucaagggcgagccccacggccucgagaacauggagcuccgcucccucgagcucuccgucgucgagccccagcccgucuucgaggccuccggcgcccccgacaucuacuccuccaacaaggaccucccccccgagacccccggcgccgaggacaagggcaaguccuccaagaccaagcccuuccgcugcaagcccugccaguacgaggccgaguccgaggagcaguucguccaccacauccgcguccacuccgccaagaaguucuucgucgaggaguccgccgagaagcaggccaaggcccgcgaguccggcuccuccaccgccgaggagggcgacuucuccaagggccccauccgcugcgaccgcugcggcuacaacaccaaccgcuacgaccacuacaccgcccaccucaagcaccacacccgcgccggcgacaacgagcgcgucuacaagugcaucaucugcaccuacaccaccgucuccgaguaccacuggcgcaagcaccuccgcaaccacuucccccgcaaggucuacaccugcggcaagugcaacuacuucuccgaccgcaagaacaacuacguccagcacguccgcacccacaccggcgagcgccccuacaagugcgagcucugccccuacuccuccucccagaagacccaccucacccgccacaugcgcacccacuccggcgagaagcccuucaagugcgaccagugcuccuacgucgccuccaaccagcacgaggucacccgccacgcccgccagguccacaacggccccaagccccucaacugcccccacugcgacuacaagaccgccgaccgcuccaacuucaagaagcacgucgagcuccacgucaacccccgccaguucaacugccccgucugcgacuacgccgccuccaagaagugcaaccuccaguaccacuucaaguccaagcaccccaccugccccaacaagaccauggacgucuccaaggucaagcucaagaagaccaagaagcgcgaggccgaccuccccgacaacaucaccaacgagaagaccgagaucgagcagaccaagaucaagggcgacgucgccggcaagaagaacgagaaguccgucaaggccgagaagcgcgacgucuccaaggagaagaagcccuccaacaacgucuccgucauccaggucaccacccgcacccgcaaguccgucaccgaggucaaggagauggacguccacaccggcuccaacuccgagaaguucuccaagaccaagaaguccaagcgcaagcucgaggucgacucccacucccuccacggccccgucaacgacgaggaguccuccaccaagaagaagaagaaggucgaguccaaguccaagaacaacucccaggagguccccaagggcgacuccaaggucgaggagaacaagaagcagaacaccugcaugaagaaguccaccaagaagaagacccucaagaacaaguccuccaagaaguccuccaagcccccccagaaggagcccgucgagaagggcuccgcccagauggaccccccccagaugggccccgcccccaccgaggccguccagaagggccccguccaggucgagccccccccccccauggagcacgcccagauggagggcgcccagauccgccccgcccccgacgagcccguccagauggaggucguccaggagggccccgcccagaaggagcuccucccccccgucgagcccgcccagauggucggcgcccagaucguccucgcccacauggagcuccccccccccauggagaccgcccagaccgaggucgcccagaugggccccgcccccauggagcccgcccagauggaggucgcccaggucgaguccgcccccaugcaggucguccagaaggagcccguccagauggagcucuccccccccauggaggucguccagaaggagcccguccagaucgagcucuccccccccauggaggucguccagaaggagcccgucaagaucgagcucuccccccccaucgaggucguccagaaggagcccguccagauggagcucuccccccccaugggcgucguccagaaggagcccgcccagcgcgagcccccccccccccgcgagcccccccuccacauggagcccaucuccaagaagcccccccuccgcaaggacaagaaggagaaguccaacaugcaguccgagcgcgcccgcaaggagcagguccucaucgaggucggccucguccccgucaaggacuccuggcuccucaaggaguccgucuccaccgaggaccucuccccccccucccccccccuccccaaggagaaccuccgcgaggaggccuccggcgaccagaagcuccucaacaccggcgagggcaacaaggaggccccccuccagaaggucggcgccgaggaggccgacgagucccuccccggccucgccgccaacaucaacgaguccacccacaucuccuccuccggccagaaccucaacacccccgagggcgagacccucaacggcaagcaccagaccgacuccaucgucugcgagaugaagauggacaccgaccagaacacccgcgagaaccucaccggcaucaacuccaccgucgaggagcccgucucccccaugcucccccccuccgccgucgaggagcgcgaggccgucuccaagaccgcccucgccuccccccccgccaccauggccgccaacgagucccaggagaucgacgaggacgagggcauccacucccacgagggcuccgaccucuccgacaacauguccgagggcuccgacgacuccggccuccacggcgcccgccccgucccccaggaguccucccgcaagaacgccaaggaggcccucgccgucaaggccgccaagggcgacuucgucugcaucuucugcgaccgcuccuuccgcaagggcaaggacuacuccaagcaccucaaccgccaccucgucaacgucuacuaccucgaggaggccgcccagggccaggaguga

SEQ ID NO: 48673 - RNA, 3219 nt, Artificial Sequence
  derived and/or modified sequence opt2 from RET__Homo_sapiens__NP_065681
auggccaaggccaccuccggcgccgccggccuccgccuccuccuccuccuccuccucccccuccucggcaaggucgcccucggccucuacuucucccgcgacgccuacugggagaagcucuacgucgaccaggccgccggcaccccccuccucuacguccacgcccuccgcgacgcccccgaggagguccccuccuuccgccucggccagcaccucuacggcaccuaccgcacccgccuccacgagaacaacuggaucugcauccaggaggacaccggccuccucuaccucaaccgcucccucgaccacuccuccugggagaagcucuccguccgcaaccgcggcuucccccuccucaccgucuaccucaaggucuuccucucccccaccucccuccgcgagggcgagugccaguggcccggcugcgcccgcgucuacuucuccuucuucaacaccuccuuccccgccugcuccucccucaagccccgcgagcucugcuuccccgagacccgccccuccuuccgcauccgcgagaaccgcccccccggcaccuuccaccaguuccgccuccuccccguccaguuccucugccccaacaucuccgucgccuaccgccuccucgagggcgagggccuccccuuccgcugcgcccccgacucccucgaggucuccacccgcugggcccucgaccgcgagcagcgcgagaaguacgagcucgucgccgucugcaccguccacgccggcgcccgcgaggaggucgucaugguccccuuccccgucaccgucuacgacgaggacgacuccgcccccaccuuccccgccggcgucgacaccgccuccgccgucgucgaguucaagcgcaaggaggacaccgucgucgccacccuccgcgucuucgacgccgacgucguccccgccuccggcgagcucguccgccgcuacaccuccacccuccuccccggcgacaccugggcccagcagaccuuccgcgucgagcacuggcccaacgagaccuccguccaggccaacggcuccuucguccgcgccaccguccacgacuaccgccucguccucaaccgcaaccucuccaucuccgagaaccgcaccaugcagcucgccguccucgucaacgacuccgacuuccagggccccggcgccggcguccuccuccuccacuucaacgucuccguccuccccgucucccuccaccuccccuccaccuacucccucuccgucucccgccgcgcccgccgcuucgcccagaucggcaaggucugcgucgagaacugccaggccuucuccggcaucaacguccaguacaagcuccacuccuccggcgccaacugcuccacccucggcgucgucaccuccgccgaggacaccuccggcauccucuucgucaacgacaccaaggcccuccgccgccccaagugcgccgagcuccacuacauggucgucgccaccgaccagcagaccucccgccaggcccaggcccagcuccucgucaccgucgagggcuccuacgucgccgaggaggccggcugcccccucuccugcgccgucuccaagcgccgccucgagugcgaggagugcggcggccucggcucccccaccggccgcugcgaguggcgccagggcgacggcaagggcaucacccgcaacuucuccaccugcucccccuccaccaagaccugccccgacggccacugcgacgucgucgagacccaggacaucaacaucugcccccaggacugccuccgcggcuccaucgucggcggccacgagcccggcgagccccgcggcaucaaggccggcuacggcaccugcaacugcuuccccgaggaggagaagugcuucugcgagcccgaggacauccaggacccccucugcgacgagcucugccgcaccgucaucgccgccgccguccucuucuccuucaucgucuccguccuccucuccgccuucugcauccacugcuaccacaaguucgcccacaagccccccaucuccuccgccgagaugaccuuccgccgccccgcccaggccuuccccgucuccuacuccuccuccggcgcccgccgccccucccucgacuccauggagaaccaggucuccgucgacgccuucaagauccucgaggaccccaagugggaguucccccgcaagaaccucguccucggcaagacccucggcgagggcgaguucggcaaggucgucaaggccaccgccuuccaccucaagggccgcgccggcuacaccaccgucgccgucaagaugcucaaggagaacgccucccccuccgagcuccgcgaccuccucuccgaguucaacguccucaagcaggucaaccacccccacgucaucaagcucuacggcgccugcucccaggacggcccccuccuccucaucgucgaguacgccaaguacggcucccuccgcggcuuccuccgcgagucccgcaaggucggccccggcuaccucggcuccggcggcucccgcaacuccuccucccucgaccaccccgacgagcgcgcccucaccaugggcgaccucaucuccuucgccuggcagaucucccagggcaugcaguaccucgccgagaugaagcucguccaccgcgaccucgccgcccgcaacauccucgucgccgagggccgcaagaugaagaucuccgacuucggccucucccgcgacgucuacgaggaggacuccuacgucaagcgcucccagggccgcauccccgucaaguggauggccaucgagucccucuucgaccacaucuacaccacccaguccgacgucugguccuucggcguccuccucugggagaucgucacccucggcggcaaccccuaccccggcaucccccccgagcgccucuucaaccuccucaagaccggccaccgcauggagcgccccgacaacugcuccgaggagauguaccgccucaugcuccagugcuggaagcaggagcccgacaagcgccccgucuucgccgacaucuccaaggaccucgagaagaugauggucaagcgccgcgacuaccucgaccucgccgccuccacccccuccgacucccucaucuacgacgacggccucuccgaggaggagaccccccucgucgacugcaacaacgccccccucccccgcgcccuccccuccaccuggaucgagaacaagcucuacggccgcaucucccacgccuucacccgcuucuga

SEQ ID NO: 48674 - RNA, 327 nt, Artificial Sequence
  derived and/or modified sequence opt2 from RETN__Homo_sapiens__NP_001180303
augaaggcccucugccuccuccuccuccccguccucggccuccucgucuccuccaagacccucugcuccauggaggaggccaucaacgagcgcauccaggaggucgccggcucccucaucuuccgcgccaucuccuccaucggccucgagugccaguccgucaccucccgcggcgaccucgccaccugcccccgcggcuucgccgucaccggcugcaccugcggcuccgccugcggcuccugggacguccgcgccgagaccaccugccacugccagugcgccggcauggacuggaccggcgcccgcugcugccgcguccagcccuga

SEQ ID NO: 48675 - RNA, 336 nt, Artificial Sequence
  derived and/or modified sequence opt2 from RETNLB__Homo_sapiens__NP_115968
augggccccuccuccugccuccuccucauccucaucccccuccuccagcucaucaaccccggcuccacccagugcucccucgacuccgucauggacaagaagaucaaggacguccucaacucccucgaguacucccccucccccaucuccaagaagcucuccugcgccuccgucaagucccagggccgccccuccuccugccccgccggcauggccgucaccggcugcgccugcggcuacggcugcggcuccugggacguccagcucgagaccaccugccacugccagugcuccgucgucgacuggaccaccgcccgcugcugccaccucaccuga

SEQ ID NO: 48676 - RNA, 1833 nt, Artificial Sequence
  derived and/or modified sequence opt2 from RETSAT__Homo_sapiens__NP_060220
auguggcucccccucguccuccuccucgccguccuccuccucgccguccucugcaaggucuaccucggccucuucuccggcuccucccccaaccccuucuccgaggacgucaagcgcccccccgccccccucgucaccgacaaggaggcccgcaagaagguccucaagcaggccuucuccgccaaccagguccccgagaagcucgacgucgucgucaucggcuccggcuucggcggccucgccgccgccgccauccucgccaaggccggcaagcgcguccucguccucgagcagcacaccaaggccggcggcugcugccacaccuucggcaagaacggccucgaguucgacaccggcauccacuacaucggccgcauggaggagggcuccaucggccgcuucauccucgaccagaucaccgagggccagcucgacugggccccccucuccucccccuucgacaucaugguccucgagggccccaacggccgcaaggaguaccccauguacuccggcgagaaggccuacauccagggccucaaggagaaguucccccaggaggaggccaucaucgacaaguacaucaagcucgucaaggucgucuccuccggcgccccccacgccauccuccucaaguuccucccccuccccgucguccagcuccucgaccgcugcggccuccucacccgcuucucccccuuccuccaggccuccacccagucccucgccgagguccuccagcagcucggcgccuccuccgagcuccaggccguccucuccuacaucuuccccaccuacggcgucacccccaaccacuccgccuucuccaugcacgcccuccucgucaaccacuacaugaagggcggcuucuacccccgcggcggcuccuccgagaucgccuuccacaccauccccgucauccagcgcgccggcggcgccguccucaccaaggccaccguccaguccguccuccucgacuccgccggcaaggccugcggcgucuccgucaagaagggccacgagcucgucaacaucuacugccccaucgucgucuccaacgccggccucuucaacaccuacgagcaccuccuccccggcaacgcccgcugccuccccggcgucaagcagcagcucggcaccguccgccccggccucggcaugaccuccgucuucaucugccuccgcggcaccaaggaggaccuccaccuccccuccaccaacuacuacgucuacuacgacaccgacauggaccaggccauggagcgcuacgucuccaugccccgcgaggaggccgccgagcacaucccccuccucuucuucgccuuccccuccgccaaggaccccaccugggaggaccgcuuccccggccgcuccaccaugaucaugcucauccccaccgccuacgagugguucgaggaguggcaggccgagcucaagggcaagcgcggcuccgacuacgagaccuucaagaacuccuucgucgaggccuccauguccgucguccucaagcucuucccccagcucgagggcaaggucgaguccgucaccgccggcuccccccucaccaaccaguucuaccucgccgccccccgcggcgccugcuacggcgccgaccacgaccucggccgccuccaccccugcgucauggccucccuccgcgcccagucccccauccccaaccucuaccucaccggccaggacaucuucaccugcggccucgucggcgcccuccagggcgcccuccucugcuccuccgccauccucaagcgcaaccucuacuccgaccucaagaaccucgacucccgcauccgcgcccagaagaagaagaacuga

SEQ ID NO: 48677 - RNA, 3753 nt, Artificial Sequence
  derived and/or modified sequence opt2 from REV1__Homo_sapiens__NP_001032961
augcgccgcggcggcuggcgcaagcgcgccgagaacgacggcugggagaccuggggcggcuacauggccgccaagguccagaagcucgaggagcaguuccgcuccgacgccgccaugcagaaggacggcaccuccuccaccaucuucuccggcgucgccaucuacgucaacggcuacaccgaccccuccgccgaggagcuccgcaagcucaugaugcuccacggcggccaguaccacgucuacuacucccgcuccaagaccacccacaucaucgccaccaaccuccccaacgccaagaucaaggagcucaagggcgagaaggucauccgccccgaguggaucgucgaguccaucaaggccggccgccuccucuccuacauccccuaccagcucuacaccaagcaguccuccguccagaagggccucuccuucaaccccgucugccgccccgaggacccccuccccggccccuccaacaucgccaagcagcucaacaaccgcgucaaccacaucgucaagaagaucgagaccgagaacgaggucaaggucaacggcaugaacuccuggaacgaggaggacgagaacaacgacuucuccuucgucgaccucgagcagaccucccccggccgcaagcagaacggcaucccccacccccgcggcuccaccgccaucuucaacggccacacccccuccuccaacggcgcccucaagacccaggacugccucguccccauggucaacuccgucgccucccgccucucccccgccuucucccaggaggaggacaaggccgagaaguccuccaccgacuuccgcgacugcacccuccagcagcuccagcaguccacccgcaacaccgacgcccuccgcaacccccaccgcaccaacuccuucucccucuccccccuccacuccaacaccaagaucaacggcgcccaccacuccaccguccagggccccuccuccaccaaguccaccuccuccgucuccaccuucuccaaggccgcccccuccguccccuccaagcccuccgacugcaacuucaucuccaacuucuacucccacucccgccuccaccacaucuccauguggaagugcgagcucaccgaguucgucaacacccuccagcgccaguccaacggcaucuuccccggccgcgagaagcucaagaagaugaagaccggccgcuccgcccucgucgucaccgacaccggcgacauguccguccucaacuccccccgccaccaguccugcaucaugcacgucgacauggacugcuucuucgucuccgucggcauccgcaaccgccccgaccucaagggcaagcccgucgccgucaccuccaaccgcggcaccggccgcgccccccuccgccccggcgccaacccccagcucgaguggcaguacuaccagaacaagauccucaagggcaaggccgacauccccgacuccucccucugggagaaccccgacuccgcccaggccaacggcaucgacuccguccucucccgcgccgagaucgccuccugcuccuacgaggcccgccagcucggcaucaagaacggcauguucuucggccacgccaagcagcucugccccaaccuccaggccguccccuacgacuuccacgccuacaaggaggucgcccagacccucuacgagacccucgccuccuacacccacaacaucgaggccgucuccugcgacgaggcccucgucgacaucaccgagauccucgccgagaccaagcucacccccgacgaguucgccaacgccguccgcauggagaucaaggaccagaccaagugcgccgccuccgucggcaucggcuccaacauccuccucgcccgcauggccacccgcaaggccaagcccgacggccaguaccaccucaagcccgaggaggucgacgacuucauccgcggccagcucgucaccaaccuccccggcgucggccacuccauggaguccaagcucgccucccucggcaucaagaccugcggcgaccuccaguacaugaccauggccaagcuccagaaggaguucggccccaagaccggccagaugcucuaccgcuucugccgcggccucgacgaccgccccguccgcaccgagaaggagcgcaaguccgucuccgccgagaucaacuacggcauccgcuucacccagcccaaggaggccgaggccuuccuccucucccucuccgaggagauccagcgccgccucgaggccaccggcaugaagggcaagcgccucacccucaagaucaugguccgcaagcccggcgcccccgucgagaccgccaaguucggcggccacggcaucugcgacaacaucgcccgcaccgucacccucgaccaggccaccgacaacgccaagaucaucggcaaggccaugcucaacauguuccacaccaugaagcucaacaucuccgacaugcgcggcgucggcauccacgucaaccagcucguccccaccaaccucaaccccuccaccugccccucccgccccuccguccaguccucccacuuccccuccggcuccuacuccguccgcgacgucuuccagguccagaaggccaagaaguccaccgaggaggagcacaaggaggucuuccgcgccgccgucgaccucgagaucuccuccgccucccgcaccugcaccuuccucccccccuuccccgcccaccuccccaccucccccgacaccaacaaggccgaguccuccggcaaguggaacggccuccacacccccgucuccguccagucccgccucaaccucuccaucgagguccccucccccucccagcucgaccaguccguccucgaggcccucccccccgaccuccgcgagcaggucgagcaggucugcgccguccagcaggccgagucccacggcgacaagaagaaggagcccgucaacggcugcaacaccggcauccucccccagcccgucggcaccguccuccuccagauccccgagccccaggaguccaacuccgacgccggcaucaaccucaucgcccuccccgccuucucccaggucgaccccgaggucuucgccgcccuccccgccgagcuccagcgcgagcucaaggccgccuacgaccagcgccagcgccagggcgagaacuccacccaccagcaguccgccuccgccuccguccccaagaacccccuccuccaccucaaggccgccgucaaggagaagaagcgcaacaagaagaagaagaccaucggcucccccaagcgcauccaguccccccucaacaacaagcuccucaacucccccgccaagacccuccccggcgccugcggcuccccccagaagcucaucgacggcuuccucaagcacgagggcccccccgccgagaagccccucgaggagcucuccgccuccaccuccggcguccccggccucuccucccuccaguccgaccccgccggcugcguccgcccccccgcccccaaccucgccggcgccgucgaguucaacgacgucaagacccuccuccgcgaguggaucaccaccaucuccgaccccauggaggaggacauccuccaggucgucaaguacugcaccgaccucaucgaggagaaggaccucgagaagcucgaccucgucaucaaguacaugaagcgccucaugcagcaguccgucgaguccgucuggaacauggccuucgacuucauccucgacaacguccaggucguccuccagcagaccuacggcuccacccucaaggucaccuga

SEQ ID NO: 48678 - RNA, 9159 nt, Artificial Sequence
  derived and/or modified sequence opt2 from REV3L__Homo_sapiens__NP_001273361
auggccuucuccaucgaccgcgcccucaacgucgcccucggcaaccccuccuccaccgcccagcacgucuucaaggucucccucgucuccggcaugcccuucuacggcuaccacgagaaggagcgccacuucaugaagaucuaccucuacaaccccaccauggucaagcgcaucugcgagcuccuccaguccggcgccaucaugaacaaguucuaccagccccacgaggcccacauccccuaccuccuccagcucuucaucgacuacaaccucuacggcaugaaccucaucaaccucgccgccgucaaguuccgcaaggcccgccgcaaguccaacacccuccacgccaccggcuccugcaagaaccaccucuccggcaacucccucgccgacacccucuuccgcugggagcaggacgagauccccuccucccucauccucgagggcgucgagccccaguccaccugcgagcucgaggucgacgccgucgccgccgacauccucaaccgccucgacaucgaggcccagaucggcggcaaccccggccuccaggccaucugggaggacgagaagcagcgccgccgcaaccgcaacgagaccucccagaugucccagcccgagucccaggaccaccgcuucguccccgccaccgaguccgagaagaaguuccagaagcgccuccaggagauccucaagcagaacgacuucuccgucacccucuccggcuccgucgacuacuccgacggcucccaggaguucuccgccgagcucacccuccacuccgagguccucucccccgagaugcuccagugcacccccgccaacauggucgagguccacaaggacaaggaguccuccaagggccacacccgccacaaggucgaggaggcccucaucaacgaggaggccauccucaaccucauggagaacucccagaccuuccagccccucacccagcgccucuccgagucccccgucuucauggacuccucccccgacgaggcccucguccaccuccucgccggccucgaguccgacggcuaccgcggcgagcgcaaccgcaugcccucccccugccgcuccuucggcaacaacaaguacccccagaacuccgacgacgaggagaacgagccccagaucgagaaggaggagauggagcucucccucgucaugucccagcgcugggacuccaacaucgaggagcacugcgccaagaagcgcucccucugccgcaacacccaccgcuccuccaccgaggacgacgacuccuccuccggcgaggagauggagugguccgacaacucccuccuccucgccucccucuccaucccccagcucgacggcaccgccgacgagaacuccgacaacccccucaacaacgagaacucccgcacccacuccuccgucaucgccaccuccaagcucuccgucaagcccuccaucuuccacaaggacgccgccacccucgagcccuccuccuccgccaagaucaccuuccagugcaagcacaccuccgcccucuccucccacguccucaacaaggaggaccucaucgaggaccucucccagaccaacaagaacaccgagaagggccucgacaacuccgucaccuccuucaccaacgaguccaccuacuccaugaaguaccccggcucccucuccuccaccguccacuccgagaacucccacaaggagaacuccaagaaggagauccuccccgucuccuccugcgaguccuccaucuucgacuacgaggaggacauccccuccgucacccgccagguccccucccgcaaguacaccaacauccgcaagaucgagaaggacucccccuucauccacaugcaccgccaccccaacgagaacacccucggcaagaacuccuucaacuucuccgaccucaaccacuccaagaacaaggucuccuccgagggcaacgagaagggcaacuccaccgcccucuccucccucuuccccuccuccuucaccgagaacugcgagcuccucuccugcuccggcgagaaccgcaccaugguccacucccucaacuccaccgccgacgaguccggccucaacaagcucaagauccgcuacgaggaguuccaggagcacaagaccgagaagcccucccucucccagcaggccgcccacuacauguucuuccccuccgucguccucuccaacugccucacccgcccccagaagcucucccccgucaccuacaagcuccagcccggcaacaagcccucccgccucaagcucaacaagcgcaagcucgccggccaccaggagaccuccaccaaguccuccgagaccggcuccaccaaggacaacuucauccagaacaaccccugcaacuccaaccccgagaaggacaacgcccucgccuccgaccucaccaagaccacccgcggcgccuucgagaacaagacccccaccgacggcuucaucgacugccacuucggcgacggcacccucgagaccgagcaguccuucggccucuacggcaacaaguacacccuccgcgccaagcgcaaggucaacuacgagaccgaggacuccgaguccuccuucgucacccacaacuccaagaucucccucccccaccccauggagaucggcgagucccucgacggcacccucaagucccgcaagcgccgcaagauguccaagaagcucccccccgucaucaucaaguacaucaucaucaaccgcuuccgcggccgcaagaacaugcucgucaagcucggcaagaucgacuccaaggagaagcaggucauccucaccgaggagaagauggagcucuacaagaagcucgccccccucaaggacuucuggcccaagguccccgacucccccgccaccaaguaccccaucuacccccucacccccaagaagucccaccgccgcaaguccaagcacaaguccgccaagaagaagaccggcaagcagcagcgcaccaacaacgagaacaucaagcgcacccucuccuuccgcaagaagcgcucccacgccauccucuccccccccucccccuccuacaacgccgagaccgaggacugcgaccucaacuacuccgacgucauguccaagcucggcuuccucuccgagcgcuccaccucccccaucaacuccucccccccccgcugcuggucccccaccgacccccgcgccgaggagaucauggccgccgccgagaaggaggccaugcucuucaagggccccaacgucuacaagaagaccgucaacucccgcaucggcaagaccucccgcgcccgcgcccagaucaagaaguccaaggccaagcucgccaaccccuccaucgucaccaagaagcgcaacaagcgcaaccagaccaacaagcucgucgacgacggcaagaagaagccccgcgccaagcagaagaccaacgagaagggcaccucccgcaagcacaccacccucaaggacgagaagaucaagucccaguccggcgccgaggucaaguucguccucaagcaccagaacgucuccgaguucgccuccuccuccggcggcucccagcuccucuucaagcagaaggacaugccccucaugggcuccgccgucgaccacccccucuccgccucccuccccaccggcaucaacgcccagcagaagcucuccggcugcuucuccuccuuccucgaguccaagaaguccgucgaccuccagaccuuccccuccucccgcgacgaccuccaccccuccgucgucugcaacuccaucggccccggcgucuccaagaucaacguccagcgcccccacaaccaguccgccauguucacccucaaggaguccacccucauccagaagaacaucuucgaccucuccaaccaccucucccaggucgcccagaacacccagaucuccuccggcauguccuccaagaucgaggacaacgccaacaacauccagcgcaacuaccucuccuccaucggcaagcucuccgaguaccgcaacucccucgaguccaagcucgaccaggccuacacccccaacuuccuccacugcaaggacucccagcagcagaucgucugcaucgccgagcaguccaagcacuccgagaccugcucccccggcaacaccgccuccgaggagucccagaugcccaacaacugcuucgucaccucccuccgcucccccaucaagcagaucgccugggagcagaagcagcgcggcuucauccucgacauguccaacuucaagcccgagcgcgucaagccccgcucccucuccgaggccaucucccagaccaaggcccucucccagugcaagaaccgcaacgucuccacccccuccgccuucggcgagggccaguccggccucgccguccucaaggagcuccuccagaagcgccagcagaaggcccagaacgccaacaccacccaggacccccucuccaacaagcaccagcccaacaagaacaucuccggcucccucgagcacaacaaggccaacaagcgcacccgcuccgucaccuccccccgcaagccccgcaccccccgcuccaccaagcagaaggagaagauccccaagcuccucaaggucgacucccucaaccuccagaacuccucccagcucgacaacuccgucuccgacgacucccccaucuucuucuccgaccccggcuucgaguccugcuacucccucgaggacucccucucccccgagcacaacuacaacuucgacaucaacaccaucggccagaccggcuucugcuccuucuacuccggcucccaguucguccccgccgaccagaaccucccccagaaguuccucuccgacgccguccaggaccucuuccccggccaggccaucgagaagaacgaguuccucucccacgacaaccagaagugcgacgaggacaagcaccacaccaccgacuccgccuccuggauccgcuccggcacccucucccccgagaucuucgagaaguccaccaucgacuccaacgagaaccgccgccacaaccaguggaagaacuccuuccacccccucaccacccgcuccaacuccaucauggacuccuucugcguccagcaggccgaggacugccucuccgagaagucccgccucaaccgcuccuccgucuccaaggaggucuuccucucccucccccagcccaacaacuccgacuggauccagggccacacccgcaaggagaugggccagucccucgacuccgccaacaccuccuucaccgccauccucuccucccccgacggcgagcucgucgacgucgccugcgaggaccucgagcucuacgucucccgcaacaacgacaugcucacccccacccccgacuccuccccccgcuccaccuccucccccucccaguccaagaacggcuccuucaccccccgcaccgccaacauccucaagccccucauguccccccccucccgcgaggagaucauggccacccuccucgaccacgaccucuccgagaccaucuaccaggagcccuucugcuccaaccccuccgacguccccgagaagccccgcgagaucggcggccgccuccucauggucgagacccgccucgccaacgaccucgccgaguucgagggcgacuucucccucgagggccuccgccucuggaagaccgccuucuccgccaugacccagaacccccgccccggcuccccccuccgcuccggccagggcgucgucaacaagggcuccuccaacucccccaagauggucgaggacaagaagaucgucaucaugcccugcaagugcgcccccucccgccagcucguccaggucuggcuccaggccaaggaggaguacgagcgcuccaagaagcuccccaagaccaagcccaccggcgucgucaaguccgccgagaacuucuccuccuccgucaaccccgacgacaagcccgucgucccccccaagauggacgucucccccugcauccuccccaccaccgcccacaccaaggaggacgucgacaacucccagaucgcccuccaggcccccaccaccggcugcucccagaccgccuccgagucccagaugcucccccccgucgccuccgccuccgaccccgagaaggacgaggacgacgacgacaacuacuacaucuccuacuccucccccgacucccccgucaucccccccuggcagcagcccaucucccccgacuccaaggcccucaacggcgacgaccgccccuccucccccgucgaggagcuccccucccucgccuucgagaacuuccucaagcccaucaaggacggcauccagaagucccccugcuccgagccccaggagccccucgucaucucccccaucaacacccgcgcccgcaccggcaagugcgagucccucugcuuccacuccacccccaucauccagcgcaagcuccucgagcgccuccccgaggcccccggccucuccccccucuccaccgagcccaagacccagaagcucuccaacaagaagggcuccaacaccgacacccuccgccgcguccuccucacccaggccaagaaccaguucgccgccgucaacaccccccagaaggagaccucccagaucgacggccccucccucaacaacaccuacggcuucaaggucuccauccagaaccuccaggaggccaaggcccuccacgagauccagaaccucacccucaucuccgucgagcuccacgcccgcacccgccgcgaccucgagcccgaccccgaguucgaccccaucugcgcccucuucuacugcaucuccuccgacaccccccuccccgacaccgagaagaccgagcucaccggcgucaucgucaucgacaaggacaagaccgucuucucccaggacauccgcuaccagaccccccuccucauccgcuccggcaucaccggccucgaggucaccuacgccgccgacgagaaggcccucuuccacgagaucgccaacaucaucaagcgcuacgaccccgacauccuccucggcuacgagauccagaugcacuccuggggcuaccuccuccagcgcgccgccgcccucuccaucgaccucugccgcaugaucucccgcguccccgacgacaagaucgagaaccgcuucgccgccgagcgcgacgaguacggcuccuacaccauguccgagaucaacaucgucggccgcaucacccucaaccucuggcgcaucaugcgcaacgaggucgcccucaccaacuacaccuucgagaacgucuccuuccacguccuccaccagcgcuucccccucuucaccuuccgcguccucuccgacugguucgacaacaagaccgaccucuaccgcuggaagauggucgaccacuacgucucccgcguccgcggcaaccuccagaugcucgagcagcucgaccucaucggcaagaccuccgagauggcccgccucuucggcauccaguuccuccacguccucacccgcggcucccaguaccgcgucgaguccaugaugcuccgcaucgccaagcccaugaacuacauccccgucacccccuccguccagcagcgcucccagaugcgcgccccccagugcgucccccucaucauggagcccgagucccgcuucuacuccaacuccguccucguccucgacuuccagucccucuaccccuccaucgucaucgccuacaacuacugcuucuccaccugccucggccacgucgagaaccucggcaaguacgacgaguucaaguucggcugcaccucccuccgcgucccccccgaccuccucuaccagguccgccacgacaucaccgucucccccaacggcgucgccuucgucaagcccuccguccgcaagggcguccucccccgcaugcucgaggagauccucaagacccgcuucauggucaagcaguccaugaaggccuacaagcaggaccgcgcccucucccgcaugcucgacgcccgccagcucggccucaagcucaucgccaacgucaccuucggcuacaccuccgccaacuucuccggccgcaugcccugcaucgaggucggcgacuccaucguccacaaggcccgcgagacccucgagcgcgccaucaagcucgucaacgacaccaagaaguggggcgcccgcgucgucuacggcgacaccgacuccauguucguccuccucaagggcgccaccaaggagcaguccuucaagaucggccaggagaucgccgaggccgucaccgccaccaaccccaagcccgucaagcucaaguucgagaaggucuaccuccccugcguccuccagaccaagaagcgcuacgucggcuacauguacgagacccucgaccagaaggaccccgucuucgacgccaagggcaucgagaccguccgccgcgacuccugccccgccgucuccaagauccucgagcgcucccucaagcuccucuucgagacccgcgacaucucccucaucaagcaguacguccagcgccagugcaugaagcuccucgagggcaaggccuccauccaggacuucaucuucgccaaggaguaccgcggcuccuucuccuacaagcccggcgccugcguccccgcccucgagcucacccgcaagaugcucaccuacgaccgccgcuccgagccccaggucggcgagcgcguccccuacgucaucaucuacggcacccccggcgucccccucauccagcucguccgccgccccgucgagguccuccaggaccccacccuccgccucaacgccaccuacuacaucaccaagcagauccuccccccccucgcccgcaucuucucccucaucggcaucgacgucuucuccugguaccacgagcucccccgcauccacaaggccaccuccuccucccgcuccgagcccgagggccgcaagggcaccaucucccaguacuucaccacccuccacugccccgucugcgacgaccucacccagcacggcaucugcuccaagugccgcucccagccccagcacgucgccgucauccucaaccaggagauccgcgagcucgagcgccagcaggagcagcucgucaagaucugcaagaacugcaccggcugcuucgaccgccacauccccugcgucucccucaacugccccguccucuucaagcucucccgcgucaaccgcgagcucuccaaggcccccuaccuccgccagcuccucgaccaguucuga

SEQ ID NO: 48679 - RNA, 3666 nt, Artificial Sequence
  derived and/or modified sequence opt2 from REXO1__Homo_sapiens__NP_065746
augcuccgcuccaccggcuucuuccgcgccaucgacugccccuacugguccggcgcccccggcggccccugccgccgccccuacugccacuuccgccaccgcggcgcccgcggcuccggcgcccccggcgacggcggcgaggccccccccgccgccggccucggcuacgaccccuacaaccccgagcuccccaagccccccgcccagcgcgagaacggcacccucggccucggcgaggagccccgccccgacguccucgagcucgagcucgucaaccaggccaucgaggccguccgcuccgaggucgagcucgagcagcgccgcuaccgcgagcuccucgagaccacccgcgagcaccgcuccgccgaggcccccgcccucgccccccgcggccccaacgccucccccaccgucggccccgacgaggacgccuucccccucgccuucgacuacucccccggcucccacggccuccucucccccgacgccggcuaccagcccaccccccucgccgcccccgccgagcccggcuccaaguacucccucgccucccucgaccgcggccagggccgcggcggcggcggcggcggcgcccucgaguacguccccaaggccgucucccagccccgccgccacucccgccccguccccuccggcaaguacgucgucgacaacucccgcccccccaccgaccucgaguacgacccccucuccaacuacuccgcccgccaccucucccgcgccuccucccgcgacgagcgcgccgccaagcgcccccgcggcucccgcggcuccgagcccuacacccccgcccccaagaagcucugcgaccccuucggcuccugcgacgcccgcuucuccgacuccgaggacgaggccgccaccguccccggcaacgagcccaccaccgccuccacccccaaggcccgcgccgaccccgagaucaaggccaccggccagccccccuccaaggagggccucgaggccgagggcggcggccuccgcgagaccaaggagaccgccguccagugcgacgucggcgaccuccagcccccccccgccaagcccgccucccccgcccagguccaguccucccaggacggcggcugccccaaggagggcaagcccaagaagaagaagaccggcgccccccccgcccccuccugcaaggacggcgcccagggcaaggacaagaccaaggacaagggccgcggccgccccgucgagaagccccgcgccgacaagaagggcccccaggccuccuccccccgccgcaaggccgagcgccccgagggcaccaagaagaagcccuccuccgccacccccgucgccaccuccggcaagggccgccccgaccgccccgcccgccgccccucccccaccuccggcgacucccgccccgccgccggccgcggccccccccgcccccuccagcuccccgaccgcaaguccaccaaggcccccuccggcaagcucgucgagcgcaaggcccgcucccucgacgagggcgccucccaggacgcccccaagcucaagaagcgcgcccucucccacgccgaccucuucggcgacgaguccgaggacgaggccgccggccccggcguccccuccgucuggcccuccgcccuccccucccucuccuccgacuccgacuccgacuccgacuccucccucggcuuccccgaggcccagggcccccccaagcgccucaaggccucccccccccccucccccgcccccuccuccuccuccuccuccuccuccuccaccuccuccgccggcgccgacgucgacuacuccgcccucgagaaggaggucgacuucgacuccgaccccauggaggagugccuccgcaucuucaacgaguccaccuccgucaagaccgaggaccgcggccgccucgcccgccagccccccaaggaggagaaguccgaggagaagggccucuccggccucaccacccucuuccccggccagaagcgccgcaucucccaccucuccaagcagggccaggaggucgagcccccccgccgcggccccgccgucccccccgcccgcccccccaccgcccaggaggucugcuaccuccgcgcccagcaggcccagcgcgccuccgccucccuccuccaggcccccgcccgccucgccgagaagucccccuccguccacaucuccgcccccggcgagaagcgccgcaucgcccacauccccaacccccgccucgccgccgcccccaccggcgccaagcgcacccucgccgccuccggcucccaguccuccaacggccccgagcccggcggccagcagcucaagacccgcacccucuccggcauggccuccaagaccaccaccaccaucauccccaagcgcaucgcccacucccccucccuccagucccucaagaagcccaucauccccaaggaguucggcggcaagguccccaccgucauccgccagcgcuaccucaaccucuucaucgaggagugccucaaguucugcaccuccaaccaggaggccaucgagaaggcccucaacgaggagaaggucgccuacgaccgcucccccuccaagaacaucuaccucaacgucgccgucaacacccucaagaagcuccgcggccucgcccccuccgccguccccggccucuccaagaccuccggccgccgcgucgucucccacgaggucguccucggcggccgccucgccgccaagaccuccuucucccucucccgccccuccuccccccgcgucgaggaccucaagggcgccgcccucuacucccgccuccgcgaguaccuccucacccaggaccagcucaaggagaacggcuaccccuucccccaccccgagcgccccggcggcgccaucaucuucaccgccgaggagaagcgccccaaggacuccuccugccgcaccugcugccgcugcggcaccgaguaccucgucuccuccuccggccgcugcauccgcgacgaggagugcuacuaccacuggggccgccuccgccgcaaccgcgucgccggcggcugggagacccaguacaugugcugcuccgccgccgccggcuccgucggcugccaggucgccaagcagcacguccaggacggccgcaaggagcgccucgagggcuucgucaagaccuucgagaaggagcucuccggcgacacccaccccggcaucuacgcccucgacugcgagauguccuacaccaccuacggccucgagcucacccgcgucaccgucgucgacaccgacguccacgucgucuacgacaccuucgucaagcccgacaacgagaucgucgacuacaacacccgcuucuccggcgucaccgaggccgaccucgccgacaccuccgucacccuccgcgacguccaggccguccuccucuccauguucuccgccgacaccauccucaucggccacucccucgaguccgaccuccucgcccucaaggucauccacuccaccgucgucgacaccuccguccucuucccccaccgccucggccuccccuacaagcgcucccuccgcaaccucauggccgacuaccuccgccagaucauccaggacaacgucgacggccacuccuccuccgaggacgccggcgccugcaugcaccucgucaucuggaagguccgcgaggacgccaagaccaagcgcuga

SEQ ID NO: 48680 - RNA, 714 nt, Artificial Sequence
  derived and/or modified sequence opt2 from REXO2__Homo_sapiens__NP_056338
augcucggcggcucccucggcucccgccuccuccgcggcgucggcggcucccacggccgcuucggcgcccgcggcguccgcgagggcggcgccgccauggccgccggcgaguccauggcccagcgcauggucugggucgaccucgagaugaccggccucgacaucgagaaggaccagaucaucgagauggccugccucaucaccgacuccgaccucaacauccucgccgagggccccaaccucaucaucaagcagcccgacgagcuccucgacuccauguccgacuggugcaaggagcaccacggcaaguccggccucaccaaggccgucaaggaguccaccaucacccuccagcaggccgaguacgaguuccucuccuucguccgccagcagaccccccccggccucugcccccucgccggcaacuccguccacgaggacaagaaguuccucgacaaguacaugccccaguucaugaagcaccuccacuaccgcaucaucgacgucuccaccgucaaggagcucugccgccgcugguaccccgaggaguacgaguucgcccccaagaaggccgccucccaccgcgcccucgacgacaucuccgaguccaucaaggagcuccaguucuaccgcaacaacaucuucaagaagaagaucgacgagaagaagcgcaagaucaucgagaacggcgagaacgagaagaccgucuccuga

SEQ ID NO: 48681 - RNA, 753 nt, Artificial Sequence
  derived and/or modified sequence opt2 from REXO4__Homo_sapiens__NP_001266278
augggcaaggccaagguccccgccuccaagcgcgcccccuccucccccgucgccaagcccggccccgucaagacccucacccgcaagaagaacaagaagaagaagcgcuucuggaaguccaaggcccgcgaggucuccaagaagcccgccuccggccccggcgccgucguccgcccccccaaggcccccgaggacuucucccagaacuggaaggcccuccaggaggucccccgcuggaccggcggccgccaguaccucgccccccgccccgucgagcaguccaccauccgcaaggagccccgcaagggccagauggucauccucuuccagaacgagggcaccuccuccauccgcuccggcaagcuccgccgccagccccagccccaccccccccgcgaggagcucgaggucguccagaaggaggucgccgagaugcucaagggccgcauccucgucggccacgcccuccacaacgaccucaagguccucuuccucgaccaccccaagaagaagauccgcgacacccagaaguacaagcccuucaagucccaggucaaguccggccgccccucccuccgccuccucuccgagaagauccucggccuccagguccagcaggccgagcacugcuccauccaggacgcccaggccgccaugcgccucuacgucauggucaagaaggagugggaguccauggcccgcgaccgccgcccccuccucaccgcccccgaccacugcuccgacgacgccuga

SEQ ID NO: 48682 - RNA, 3447 nt, Artificial Sequence
  derived and/or modified sequence opt2 from RFC1__Homo_sapiens__NP_001191676
auggacauccgcaaguucuucggcgucauccccuccggcaagaagcucgucuccgagaccgucaagaagaacgagaagaccaaguccgacgaggagacccucaaggccaagaagggcaucaaggagaucaaggucaacuccucccgcaaggaggacgacuucaagcagaagcagcccuccaagaagaagcgcaucaucuacgacuccgacuccgaguccgaggagacccuccaggucaagaacgccaagaagccccccgagaagcuccccgucuccuccaagcccggcaagaucucccgccaggaccccgucaccuacaucuccgagaccgacgaggaggacgacuucaugugcaagaaggccgccuccaaguccaaggagaacggccgcuccaccaacucccaccucggcaccuccaacaugaagaagaacgaggagaacaccaagaccaagaacaagccccucucccccaucaagcucacccccaccuccguccucgacuacuucggcaccggcuccguccagcgcuccaacaagaagauggucgccuccaagcgcaaggagcucucccagaacaccgacgaguccggccucaacgacgaggccaucgccaagcagcuccagcucgacgaggacgccgagcucgagcgccagcuccacgaggacgaggaguucgcccgcacccucgccaugcucgacgaggagcccaagaccaagaaggcccgcaaggacaccgaggccggcgagaccuucuccuccguccaggccaaccucuccaaggccgagaagcacaaguacccccacaaggucaagaccgcccaggucuccgacgagcgcaaguccuacuccccccgcaagcaguccaaguacgaguccuccaaggagucccagcagcacuccaaguccuccgccgacaagaucggcgaggucuccucccccaaggccuccuccaagcucgccaucaugaagcgcaaggaggaguccuccuacaaggagaucgagcccgucgccuccaagcgcaaggagaacgccaucaagcucaagggcgagaccaagacccccaagaagaccaaguccucccccgccaagaaggaguccgucucccccgaggacuccgagaagaagcgcaccaacuaccaggccuaccgcuccuaccucaaccgcgagggccccaaggcccucggcuccaaggagauccccaagggcgccgagaacugccucgagggccucaucuucgucaucaccggcguccucgaguccaucgagcgcgacgaggccaagucccucaucgagcgcuacggcggcaaggucaccggcaacgucuccaagaagaccaacuaccucgucaugggccgcgacuccggccaguccaaguccgacaaggccgccgcccucggcaccaagaucaucgacgaggacggccuccucaaccucauccgcaccaugcccggcaagaaguccaaguacgagaucgccgucgagaccgagaugaagaaggaguccaagcucgagcgcaccccccagaagaacguccagggcaagcgcaagaucucccccuccaagaaggaguccgaguccaagaagucccgccccaccuccaagcgcgacucccucgccaagaccaucaagaaggagaccgacgucuucuggaagucccucgacuucaaggagcaggucgccgaggagaccuccggcgacuccaaggcccgcaaccucgccgacgacuccuccgagaacaaggucgagaaccuccucugggucgacaaguacaagcccaccucccucaagaccaucaucggccagcagggcgaccaguccugcgccaacaagcuccuccgcuggcuccgcaacuggcagaaguccuccuccgaggacaagaagcacgccgccaaguucggcaaguucuccggcaaggacgacggcuccuccuucaaggccgcccuccucuccggcccccccggcgucggcaagaccaccaccgccucccucgucugccaggagcucggcuacuccuacgucgagcucaacgccuccgacacccgcuccaaguccucccucaaggccaucgucgccgagucccucaacaacaccuccaucaagggcuucuacuccaacggcgccgccuccuccgucuccaccaagcacgcccucaucauggacgaggucgacggcauggccggcaacgaggaccgcggcggcauccaggagcucaucggccucaucaagcacaccaagauccccaucaucugcaugugcaacgaccgcaaccaccccaagauccgcucccucguccacuacugcuucgaccuccgcuuccagcgcccccgcgucgagcagaucaagggcgccaugauguccaucgccuucaaggagggccucaagauccccccccccgccaugaacgagaucauccucggcgccaaccaggacauccgccagguccuccacaaccucuccauguggugcgcccgcuccaaggcccucaccuacgaccaggccaaggccgacucccaccgcgccaagaaggacaucaagaugggccccuucgacgucgcccgcaaggucuucgccgccggcgaggagaccgcccacaugucccucgucgacaaguccgaccucuucuuccacgacuacuccaucgccccccucuucguccaggagaacuacauccacgucaagcccgucgccgccggcggcgacaugaagaagcaccucaugcuccucucccgcgccgccgacuccaucugcgacggcgaccucgucgacucccagauccgcuccaagcagaacuggucccuccuccccgcccaggccaucuacgccuccguccuccccggcgagcucaugcgcggcuacaugacccaguuccccaccuuccccuccuggcucggcaagcacuccuccaccggcaagcacgaccgcaucguccaggaccucgcccuccacaugucccuccgcaccuacuccuccaagcgcaccgucaacauggacuaccucucccuccuccgcgacgcccucguccagccccucaccucccagggcgucgacggcguccaggacgucgucgcccucauggacaccuacuaccucaugaaggaggacuucgagaacaucauggagaucuccuccuggggcggcaagcccucccccuucuccaagcucgaccccaaggucaaggccgccuucacccgcgccuacaacaaggaggcccaccucacccccuacucccuccaggccaucaaggccucccgccacuccaccucccccucccucgacuccgaguacaacgaggagcucaacgaggacgacucccaguccgacgagaaggaccaggacgccaucgagaccgacgccaugaucaagaagaagaccaaguccuccaagcccuccaagcccgagaaggacaaggagccccgcaagggcaagggcaaguccuccaagaaguga

SEQ ID NO: 48683 - RNA, 963 nt, Artificial Sequence
  derived and/or modified sequence opt2 from RFC2__Homo_sapiens__NP_002905
auggaggucgaggccgucugcggcggcgccggcgaggucgaggcccaggacuccgaccccgcccccgccuucuccaaggcccccggcuccgccggccacuacgagcuccccugggucgagaaguaccgccccgucaagcucaacgagaucgucggcaacgaggacaccgucucccgccucgaggucuucgcccgcgagggcaacguccccaacaucaucaucgccggcccccccggcaccggcaagaccaccuccauccucugccucgcccgcgcccuccucggccccgcccucaaggacgccaugcucgagcucaacgccuccaacgacuccaugaccgacggcgcccagcaggcccuccgccgcaccauggagaucuacuccaagaccacccgcuucgcccucgccugcaacgccuccgacaagaucaucgagcccauccagucccgcugcgccguccuccgcuacaccaagcucaccgacgcccagauccucacccgccucaugaacgucaucgagaaggagcgcguccccuacaccgacgacggccucgaggccaucaucuucaccgcccagggcgacaugcgccaggcccucaacaaccuccaguccaccuucuccggcuucggcuucaucaacuccgagaacgucuucaaggucugcgacgagccccacccccuccucgucaaggagaugauccagcacugcgucaacgccaacaucgacgaggccuacaagauccucgcccaccucuggcaccucggcuacucccccgaggacaucaucggcaacaucuuccgcgucugcaagaccuuccagauggccgaguaccucaagcucgaguucaucaaggagaucggcuacacccacaugaagaucgccgagggcgucaacucccuccuccagauggccggccuccucgcccgccucugccagaagaccauggcccccgucgccuccuga

SEQ ID NO: 48684 - RNA, 1071 nt, Artificial Sequence
  derived and/or modified sequence opt2 from RFC3__Homo_sapiens__NP_002906
augucccucugggucgacaaguaccgccccugcucccucggccgccucgacuaccacaaggagcaggccgcccagcuccgcaaccucguccagugcggcgacuucccccaccuccucgucuacggccccuccggcgccggcaagaagacccgcaucaugugcauccuccgcgagcucuacggcgucggcgucgagaagcuccgcaucgagcaccagaccaucaccacccccuccaagaagaagaucgagaucuccaccaucgccuccaacuaccaccucgaggucaaccccuccgacgccggcaacuccgaccgcgucgucauccaggagaugcucaagaccgucgcccagucccagcagcucgagaccaacucccagcgcgacuucaaggucguccuccucaccgaggucgacaagcucaccaaggacgcccagcacgcccuccgccgcaccauggagaaguacauguccaccugccgccucauccucugcugcaacuccaccuccaaggucaucccccccauccgcucccgcugccucgccguccgcguccccgcccccuccaucgaggacaucugccacguccucuccaccgucugcaagaaggagggccucaaccuccccucccagcucgcccaccgccucgccgagaaguccugccgcaaccuccgcaaggcccuccucaugugcgaggccugccgcguccagcaguaccccuucaccgccgaccaggagauccccgagaccgacugggaggucuaccuccgcgagaccgccaacgccaucgucucccagcagaccccccagcgccuccucgagguccgcggccgccucuacgagcuccucacccacugcaucccccccgagaucaucaugaagggccuccucuccgagcuccuccacaacugcgacggccagcucaagggcgaggucgcccagauggccgccuacuacgagcaccgccuccagcucggcuccaaggccaucuaccaccucgaggccuucgucgccaaguucauggcccucuacaagaaguucauggaggacggccucgagggcaugauguucuga

SEQ ID NO: 48685 - RNA, 1092 nt, Artificial Sequence
  derived and/or modified sequence opt2 from RFC4__Homo_sapiens__NP_853551
augcaggccuuccucaagggcaccuccaucuccaccaagcccccccucaccaaggaccgcggcgucgccgccuccgccggcuccuccggcgagaacaagaaggccaagcccguccccugggucgagaaguaccgccccaagugcgucgacgaggucgccuuccaggaggaggucgucgccguccucaagaagucccucgagggcgccgaccuccccaaccuccucuucuacggcccccccggcaccggcaagaccuccaccauccucgccgccgcccgcgagcucuucggccccgagcucuuccgccuccgcguccucgagcucaacgccuccgacgagcgcggcauccaggucguccgcgagaaggucaagaacuucgcccagcucaccgucuccggcucccgcuccgacggcaagcccugcccccccuucaagaucgucauccucgacgaggccgacuccaugaccuccgccgcccaggccgcccuccgccgcaccauggagaaggaguccaagaccacccgcuucugccucaucugcaacuacgucucccgcaucaucgagccccucaccucccgcugcuccaaguuccgcuucaagccccucuccgacaagauccagcagcagcgccuccucgacaucgccaagaaggagaacgucaagaucuccgacgagggcaucgccuaccucgucaaggucuccgagggcgaccuccgcaaggccaucaccuuccuccaguccgccacccgccucaccggcggcaaggagaucaccgagaaggucaucaccgacaucgccggcgucauccccgccgagaagaucgacggcgucuucgccgccugccaguccggcuccuucgacaagcucgaggccgucgucaaggaccucaucgacgagggccacgccgccacccagcucgucaaccagcuccacgacgucgucgucgagaacaaccucuccgacaagcagaaguccaucaucaccgagaagcucgccgaggucgacaagugccucgccgacggcgccgacgagcaccuccagcucaucucccucugcgccaccgucaugcagcagcucucccagaacugcuga

SEQ ID NO: 48686 - RNA, 768 nt, Artificial Sequence
  derived and/or modified sequence opt2 from RFC5__Homo_sapiens__NP_001123584
augguccucgagcucaacgccuccgacgaccgcggcaucgacaucauccgcggccccauccucuccuucgccuccacccgcaccaucuucaagaagggcuucaagcucgucauccucgacgaggccgacgccaugacccaggacgcccagaacgcccuccgccgcgucaucgagaaguucaccgagaacacccgcuucugccucaucugcaacuaccucuccaagaucauccccgcccuccagucccgcugcacccgcuuccgcuucggcccccucacccccgagcucauggucccccgccucgagcacgucgucgaggaggagaaggucgacaucuccgaggacggcaugaaggcccucgucacccucuccuccggcgacaugcgccgcgcccucaacauccuccaguccaccaacauggccuucggcaaggucaccgaggagaccgucuacaccugcaccggccacccccucaaguccgacaucgccaacauccucgacuggaugcucaaccaggacuucaccaccgccuaccgcaacaucaccgagcucaagacccucaagggccucgcccuccacgacauccucaccgagauccaccucuucguccaccgcgucgacuuccccuccuccguccgcauccaccuccucaccaagauggccgacaucgaguaccgccucuccgucggcaccaacgagaagauccagcucuccucccucaucgccgccuuccaggucacccgcgaccucaucgucgccgaggccuga

SEQ ID NO: 48687 - RNA, 1092 nt, Artificial Sequence
  derived and/or modified sequence opt2 from RFFL__Homo_sapiens__NP_001017368
augugggccaccugcugcaacugguucugccucgacggccagcccgaggaggucccccccccccagggcgcccgcaugcaggccuacuccaaccccggcuacuccuccuuccccucccccaccggccucgagcccuccugcaaguccugcggcgcccacuucgccaacaccgcccgcaagcagaccugccucgacugcaagaagaacuucugcaugaccugcuccucccaggucggcaacggcccccgccucugccuccucugccagcgcuuccgcgccaccgccuuccagcgcgaggagcucaugaagaugaaggucaaggaccuccgcgacuaccucucccuccacgacaucuccaccgagaugugccgcgagaaggaggagcucguccuccucguccucggccagcagcccgucaucucccaggaggaccgcacccgcgccuccacccucucccccgacuuccccgagcagcaggccuuccucacccagccccacuccuccauggucccccccaccucccccaaccuccccuccuccuccgcccaggccaccuccgucccccccgcccagguccaggagaaccagcaggccaacggccacgucucccaggaccaggaggagcccgucuaccucgaguccgucgcccgcguccccgccgaggacgagacccaguccaucgacuccgaggacuccuucguccccggccgccgcgccucccucuccgaccucaccgaccucgaggacaucgagggccucaccguccgccagcucaaggagauccucgcccgcaacuucgucaacuacaagggcugcugcgagaagugggagcucauggagcgcgucacccgccucuacaaggaccagaagggccuccagcaccucgucuccggcgccgaggaccagaacggcggcgccguccccuccggccucgaggagaaccucugcaagaucugcauggacucccccaucgacugcguccuccucgagugcggccacauggucaccugcaccaagugcggcaagcgcaugaacgagugccccaucugccgccaguacgucauccgcgccguccacgucuuccgcuccuga

SEQ ID NO: 48688 - RNA, 468 nt, Artificial Sequence
  derived and/or modified sequence opt2 from RFK__Homo_sapiens__NP_060809
augcgccaccuccccuacuucugccgcggccaggucguccgcggcuucggccgcggcuccaagcagcucggcauccccaccgccaacuuccccgagcaggucgucgacaaccuccccgccgacaucuccaccggcaucuacuacggcugggccuccgucggcuccggcgacguccacaagauggucgucuccaucggcuggaaccccuacuacaagaacaccaagaaguccauggagacccacaucaugcacaccuucaaggaggacuucuacggcgagauccucaacgucgccaucgucggcuaccuccgccccgagaagaacuucgacucccucgagucccucaucuccgccauccagggcgacaucgaggaggccaagaagcgccucgagcuccccgagcaccucaagaucaaggaggacaacuucuuccaggucuccaaguccaagaucaugaacggccacuga

SEQ ID NO: 48689 - RNA, 954 nt, Artificial Sequence
  derived and/or modified sequence opt2 from RFPL1__Homo_sapiens__NP_066306
augaagcgccucucccucgucaccaccaaccgccucuccccccacggcaacuuccucccccucugcaccuucccccucgccgucgacauggccgcccucuuccaggaggccuccuccugccccgucugcuccgacuaccucgagaagcccaugucccucgagugcggcugcgccgucugcuucaagugcaucaacucccuccagaaggagccccacggcgaggaccuccucugcugcugcugcuccauggucucccagaagaacaagauccgccccuccuggcagcucgagcgccucgccucccacaucaaggagcucgagcccaagcucaagaagauccuccagaugaacccccgcaugcgcaaguuccaggucgacaugacccucgacgccgacaccgccaacaacuuccuccucaucuccgacgaccuccgcuccguccgcuccggcugcaucacccagaaccgccaggaccucgccgagcgcuucgacgucuccaucugcauccucggcuccccccgcuucaccugcggccgccacuacugggaggucgacgucggcaccuccaccgagugggaccucggcgucugccgcgaguccguccaccgcaagggccgcauccaccucaccaccgagcgcggcuucuggaccgucucccuccgcgacggcucccgccucuccgccuccaccgucccccucaccuuccucuucgucgaccgcaagcuccagcgcgucggcaucuuccucgacaugggcaugcagaacgucuccuucuucgacgccgagggcggcucccacgucuacaccuuccgcuccgucuccgccgaggagccccuccaccucuucuucgccccccccuccccccccaacggcgacaaguccguccucuccaucugccccgucaucaaccccggcaccaccgacgcccccguccaccccggcgaggccaaguga

SEQ ID NO: 48690 - RNA, 1626 nt, Artificial Sequence
  derived and/or modified sequence opt2 from RFT1__Homo_sapiens__NP_443091
augggcucccaggagguccucggccacgccgcccgccucgccuccuccggccuccuccuccagguccucuuccgccucaucaccuucguccucaacgccuucauccuccgcuuccucuccaaggagaucgucggcgucgucaacguccgccucacccuccucuacuccaccacccucuuccucgcccgcgaggccuuccgccgcgccugccucuccggcggcacccagcgcgacuggucccagacccucaaccuccucuggcucaccgucccccucggcgucuucuggucccucuuccucggcuggaucuggcuccagcuccucgagguccccgaccccaacgucgucccccacuacgccaccggcgucguccucuucggccucuccgccgucgucgagcuccucggcgagcccuucuggguccucgcccaggcccacauguucgucaagcucaaggucaucgccgagucccucuccgucauccucaaguccguccucaccgccuuccucguccucuggcucccccacuggggccucuacaucuucucccucgcccagcucuucuacaccaccguccucguccucugcuacgucaucuacuucaccaagcuccucggcucccccgaguccaccaagcuccagacccuccccgucucccgcaucaccgaccuccuccccaacaucacccgcaacggcgccuucaucaacuggaaggaggccaagcucaccugguccuucuucaagcaguccuuccucaagcagauccucaccgagggcgagcgcuacgucaugaccuuccucaacguccucaacuucggcgaccagggcgucuacgacaucgucaacaaccucggcucccucgucgcccgccucaucuuccagcccaucgaggaguccuucuacaucuucuucgccaagguccucgagcgcggcaaggacgccacccuccagaagcaggaggacgucgccgucgccgccgccguccucgagucccuccucaagcucgcccuccucgccggccucaccaucaccgucuucggcuucgccuacucccagcucgcccucgacaucuacggcggcaccaugcucuccuccggcuccggccccguccuccuccgcuccuacugccucuacguccuccuccucgccaucaacggcgucaccgagugcuucaccuucgccgccauguccaaggaggaggucgaccgcuacaacuucgucaugcucgcccucuccuccuccuuccucguccucuccuaccuccucacccgcuggugcggcuccgucggcuucauccucgccaacugcuucaacaugggcauccgcaucacccagucccucugcuucauccaccgcuacuaccgccgcuccccccaccgcccccucgccggccuccaccucucccccguccuccucggcaccuucgcccucuccggcggcgucaccgccgucuccgaggucuuccucugcugcgagcagggcuggcccgcccgccucgcccacaucgccgucggcgccuucugccucggcgccacccucggcaccgccuuccucaccgagaccaagcucauccacuuccuccgcacccagcucggcgucccccgccgcaccgacaagaugaccuga

SEQ ID NO: 48691 - RNA, 1737 nt, Artificial Sequence
  derived and/or modified sequence opt2 from RFTN1__Homo_sapiens__NP_055965
augggcugcggccucaacaagcucgagaagcgcgacgagaagcgccccggcaacaucuacuccacccucaagcgcccccaggucgagaccaagaucgacgucuccuacgaguaccgcuuccucgaguucaccacccucuccgccgccgagcuccccggcuccuccgccguccgccucgccucccuccgcgaccuccccgcccagcuccucgagcucuaccagcagggcuucucccucgccgcccuccaccccuucguccagcccacccacgagcgcgagaagaccccccucgagcacaucuuccgcgccauccucaucaagaagaccgaccgcucccagaagaccgaccuccacaacgagggcuacauccucgagcucgacugcugcuccucccucgaccaccccaccgaccagaagcucauccccgaguucaucaagaagauccaggaggccgccucccagggccucaaguucgucggcgucaucccccaguaccacuccuccgucaacuccgccggcuccuccgcccccgucuccaccgccaacuccaccgaggacgcccgcgacgccaagaacgcccgcggcgaccacgccucccucgagaacgagaagcccggcaccggcgacgucugcuccgcccccgccggccgcaaccagucccccgagcccuccuccggcccccgcggcgaggucccccucgccaagcagcccuccucccccuccggcgagggcgacggcggcgagcucuccccccagggcgucuccaagacccucgacggccccgaguccaacccccucgagguccacgaggagccccucuccggcaagauggagaucuucacccucuucaacaagcccaagucccaccagaagugccgccaguacuaccccgucaccaucccccuccacgucuccaagaacggccagaccgucuccggccucgacgccaacuggcucgagcacauguccgaccacuuccgcaagggcggcaugcucgucaacgccgucuucuaccucggcaucgucaacgacucccuccacggccucaccgacggcgucuucaucuucgaggccgucuccaccgaggacuccaagaccauccagggcuacgacgccaucgucgucgagcaguggaccguccucgagggcgucgagguccagaccgacuacgucccccuccucaacucccucgccgccuacggcuggcagcucaccugcguccuccccacccccgucgucaagaccaccuccgagggcuccgucuccaccaagcagaucgucuuccuccagcgccccugccucccccagaagaucaagaagaaggaguccaaguuccaguggcgcuucucccgcgaggagaugcacaaccgccagaugcgcaaguccaagggcaagcucuccgcccgcgacaagcagcaggccgaggagaacgagaagaaccucgaggaccaguccuccaaggccggcgacaugggcaacugcgucuccggccagcagcaggagggcggcgucuccgaggagaugaagggccccguccaggaggacaagggcgagcagcucucccccggcggccuccucugcggcgucggcgucgagggcgaggccguccagaacggccccgccucccacucccgcgcccucgucggcaucugcaccggccacuccaaccccggcgaggacgcccgcgacggcgacgccgaggagguccgcgagcucggcaccgucgaggagaacuga

SEQ ID NO: 48692 - RNA, 1506 nt, Artificial Sequence
  derived and/or modified sequence opt2 from RFTN2__Homo_sapiens__NP_653230
augggcugcggccuccgcaagcucgaggaccccgacgacuccucccccggcaagaucuucuccacccucaagcgcccccaggucgagaccaagaccgaguucgccuacgaguacguccuccucgacuucacccuccaggccuccuccaaccccgaggucaucaagaucaacuccauccucgacaucgucaccaaggucgagaacuacuaccucaagggcuacaucgucggcgccauccaccccgucauccagcccgucggccagcgcaagcaccuccccgccuccuaccucuaccgcgucguccuccuccgccucaagcucucccccaagaacuccgccgcccccuccggccagcgccgcccccgccucgucaucgaggagugcccccucaccuccgaggcccagaccaacgacgccgccaaggagcucaucgagaagaucaacgucgccgccaagcgcggcaugaaguucgucggcuucaucucccagcacuacucccccuccaaguucugcaacggcaccaaccacgacggcgacaucgaguccaugcuccacguccgccacggcuccgacgagaacugccgcuccuggaacgagggcacccucuccggccaguccuccgaguccggcaucgaggaggagcuccaccacgaguccggccaguaccagauggagcagaacggcucccccaccuccuccaagucccgcaagggcgaggccuccgacaacaagcucuacaccgucuucaacgccuucgacgacgacuccaccuccugggccuaccaggagggcauccucuccaugaaggucacccgcaagggcuccgucaucuccacccucgacgccgacuggcucgagcucaccaccuucuacuacaagcagggccucucccucaucgacuccuucgucuucugggagaccuccaagggcgagcaccuccccaagucccucgagggcuucuucaucuacgaggaggagggcuccggcguccccggcuccucccgcaagggcaacgacgccaucgucgucgagcaguggaccgucaucgagggcugcgagaucaagaccgacuacggcccccuccuccacacccucgccgaguucggcuggcuccucaccuccguccuccccacccccguccuccgccacgacuccgagggcaaccucgccaccaagcagaucgucuuccuccagcgccccgucauguggaacuccgccgcccagacccccgacaagaaggccucccgccacaucaagggcgaggacaagaacaaggccaccucccgcuccaucggccucgacaccaccuccucccagcccgccgagucccgccaccuccccgaggagugccgccucucccccucccgcgagugcuggaccaaggagggccgccucgcccagcacaacuccuucuccggcuucuccuccuccgacaacguccuccgcgagcucgacgacggccaguucgaccaggaggacggcgucacccaggucaccugcauguga

SEQ ID NO: 48693 - RNA, 2124 nt, Artificial Sequence
  derived and/or modified sequence opt2 from RFWD2__Homo_sapiens__NP_001001740
auguccggcucccgccaggccggcuccggcuccgccggcaccucccccggcuccuccgccgccuccuccgucaccuccgccuccuccucccucuccuccucccccuccccccccuccgucgccgucuccgccgccgcccucgucuccggcggcgucgcccaggccgccggcuccggcggccucggcggccccguccgccccguccucgucgcccccgccgucuccggcuccggcggcggcgccgucuccaccggccucucccgccacuccugcgccgcccgccccuccgccggcgucggcggcuccuccuccucccucggcuccggcucccgcaagcgcccccuccucgccccccucugcaacggccucaucaacuccuacgaggacaaguccaacgacuucgucugccccaucugcuucgacaugaucgaggaggccuacaugaccaagugcggccacuccuucugcuacaagugcauccaccagucccucgaggacaacaaccgcugccccaagugcaacuacgucgucgacaacaucgaccaccucuaccccaacuuccucgucaacgagcucauccucaagcagaagcagcgcuucgaggagaagcgcuucaagcucgaccacuccaacggccaccgcuggcagaucuuccaggacuggcucggcaccgaccaggacaaccucgaccucgccaacgucaaccucaugcucgagcuccucguccagaagaagaagcagcucgaggccgagucccacgccgcccagcuccagauccucauggaguuccucaaggucgcccgccgcaacaagcgcgaggagauguccggccucuacucccccgucuccgaggacuccaccgucccccaguucgaggcccccucccccucccacuccuccaucaucgacuccaccgaguacucccagccccccggcuucuccggcuccucccagaccaagaagcagcccugguacaacuccacccucgccucccgccgcaagcgccucaccgcccacuucgaggaccucgagcagugcuacuucuccacccgcaugucccgcaucuccgacgacucccgcaccgccucccagcucgacgaguuccaggagugccucuccaaguucacccgcuacaacuccguccgcccccucgccacccucuccuacgccuccgaccucuacaacggcuccuccaucgucuccuccaucgaguucgaccgcgacugcgacuacuucgccaucgccggcgucaccaagaagaucaaggucuacgaguacgacaccgucauccaggacgccgucgacauccacuaccccgagaacgagaugaccugcaacuccaagaucuccugcaucuccugguccuccuaccacaagaaccuccucgccuccuccgacuacgagggcaccgucauccucugggacggcuucaccggccagcgcuccaaggucuaccaggagcacgagaagcgcugcugguccgucgacuucaaccucauggaccccaagcuccucgccuccggcuccgacgacgccaaggucaagcucugguccaccaaccucgacaacuccgucgccuccaucgaggccaaggccaacgucugcugcgucaaguucucccccuccucccgcuaccaccucgccuucggcugcgccgaccacugcguccacuacuacgaccuccgcaacaccaagcagcccaucauggucuucaagggccaccgcaaggccgucuccuacgccaaguucgucuccggcgaggagaucgucuccgccuccaccgacucccagcucaagcucuggaacgucggcaagcccuacugccuccgcuccuucaagggccacaucaacgagaagaacuucgucggccucgccuccaacggcgacuacaucgccugcggcuccgagaacaacucccucuaccucuacuacaagggccucuccaagacccuccucaccuucaaguucgacaccgucaaguccguccucgacaaggaccgcaaggaggacgacaccaacgaguucgucuccgccgucugcuggcgcgcccuccccgacggcgaguccaacguccucaucgccgccaacucccagggcaccaucaagguccucgagcucgucuga

SEQ ID NO: 48694 - RNA, 2325 nt, Artificial Sequence
  derived and/or modified sequence opt2 from RFWD3__Homo_sapiens__NP_060594
auggcccacgaggccauggaguacgacguccagguccagcucaaccacgccgagcagcagcccgcccccgccggcauggccuccucccagggcggccccgcccuccuccagcccguccccgccgacgucgucuccucccagggcguccccuccauccuccagcccgcccccgccgaggucaucuccucccaggccacccccccccuccuccagcccgccccccagcucuccgucgaccucaccgaggucgagguccucggcgaggacaccgucgagaacaucaacccccgcaccuccgagcagcaccgccagggcuccgacggcaaccacaccauccccgccuccucccuccacuccaugaccaacuucaucuccggccuccagcgccuccacggcaugcucgaguuccuccgccccuccuccuccaaccacuccgucggccccaugcgcacccgccgccgcgucuccgccucccgccgcgcccgcgccggcggcucccagcgcaccgacuccgcccgccuccgcgccccccucgacgccuacuuccaggucucccgcacccagcccgaccuccccgccaccaccuacgacuccgagacccgcaaccccgucuccgaggagcuccaggucuccuccuccuccgacuccgacuccgacuccuccgccgaguacggcggcgucgucgaccaggccgaggaguccggcgccgucauccucgaggagcagcucgccggcgucuccgccgagcaggaggucaccugcaucgacggcggcaagacccuccccaagcagcccuccccccagaaguccgagccccuccuccccuccgccuccauggacgaggaggagggcgacaccugcaccaucugccucgagcaguggaccaacgccggcgaccaccgccucuccgcccuccgcugcggccaccucuucggcuaccgcugcaucuccaccuggcucaagggccagguccgcaagugcccccagugcaacaagaaggcccgccacuccgacaucgucguccucuacgcccgcacccuccgcgcccucgacaccuccgagcaggagcgcaugaaguccucccuccucaaggagcagaugcuccgcaagcaggccgagcucgaguccgcccagugccgccuccagcuccagguccucaccgacaagugcacccgccuccagcgccgcguccaggaccuccagaagcucaccucccaccagucccagaaccuccagcagccccgcggcucccaggccuggguccucuccugcucccccuccucccagggccagcacaagcacaaguaccacuuccagaagaccuucaccgucucccaggccggcaacugccgcaucauggccuacugcgacgcccucuccugccucgucaucucccagcccuccccccaggccuccuuccuccccggcuucggcgucaagaugcucuccaccgccaacaugaaguccucccaguacauccccaugcacggcaagcagauccgcggccucgccuucuccuccuaccuccgcggccuccuccucuccgccucccucgacaacaccaucaagcucaccucccucgagaccaacaccgucguccagaccuacaacgccggccgccccgucugguccugcugcuggugccucgacgaggccaacuacaucuacgccggccucgccaacggcuccauccucgucuacgacguccgcaacaccuccucccacguccaggagcucgucgcccagaaggcccgcugcccccucgucucccucuccuacaugccccgcgccgccuccgccgccuuccccuacggcggcguccucgccggcacccucgaggacgccuccuucugggagcagaagauggacuucucccacuggccccacguccucccccucgagcccggcggcugcaucgacuuccagaccgagaacuccucccgccacugccucgucaccuaccgccccgacaagaaccacaccaccauccgcuccguccucauggagauguccuaccgccucgacgacaccggcaaccccaucugcuccugccagcccguccacaccuucuucggcggccccaccugcaagcuccucaccaagaacgccaucuuccagucccccgagaacgacggcaacauccucgucugcaccggcgacgaggccgccaacuccgcccuccucugggacgccgccuccggcucccuccuccaggaccuccagaccgaccagcccguccucgacaucugccccuucgaggucaaccgcaacuccuaccucgccacccucaccgagaagaugguccacaucuacaagugggaguga

SEQ ID NO: 48695 - RNA, 2940 nt, Artificial Sequence
  derived and/or modified sequence opt2 from RFX1__Homo_sapiens__NP_002909
auggccacccaggccuacaccgagcuccaggccgcccccccccccucccagcccccccaggcccccccccaggcccagccccagcccccccccccccccccccccgccgccccccagcccccccagccccccaccgccgccgccaccccccagccccaguacgucaccgagcuccaguccccccagccccaggcccagccccccggcggccagaagcaguacgucaccgagcuccccgccguccccgcccccucccagcccaccggcgcccccacccccucccccgccccccagcaguacaucgucgucaccgucuccgagggcgccaugcgcgccuccgagaccgucuccgaggccucccccggcuccaccgccucccagaccggcguccccacccaggucguccagcagguccagggcacccagcagcgccuccucguccagaccuccguccaggccaagcccggccacgucuccccccuccagcucaccaacauccaggucccccagcaggcccuccccacccagcgccucgucguccaguccgccgcccccggcuccaagggcggccaggucucccucaccguccacggcacccagcagguccacuccccccccgagcagucccccguccaggccaacuccuccuccuccaagaccgccggcgcccccaccggcaccgucccccagcagcuccagguccacggcguccagcaguccguccccgucacccaggagcgcuccgucguccaggccaccccccaggcccccaagcccggccccguccagccccucaccguccagggccuccagcccguccacgucgcccaggagguccagcagcuccagcagguccccgucccccacgucuacuccucccagguccaguacgucgagggcggcgacgccuccuacaccgccuccgccauccgcuccuccaccuacuccuaccccgagaccccccucuacacccagaccgccuccaccuccuacuacgaggccgccggcaccgccacccaggucuccacccccgccaccucccaggccgucgccuccuccggcuccaugcccauguacgucuccggcucccaggucgucgccuccuccaccuccaccggcgccggcgccuccaacuccuccggcggcggcggcuccggcggcggcggcggcggcggcggcggcggcggcggcggcggcuccggcuccaccggcggcggcggcuccggcgccggcaccuacgucauccagggcggcuacaugcucggcuccgccucccaguccuacucccacaccacccgcgccucccccgccaccguccaguggcuccucgacaacuacgagaccgccgagggcgucucccucccccgcuccacccucuacugccacuaccuccuccacugccaggagcagaagcucgagcccgucaacgccgccuccuucggcaagcucauccgcuccgucuucaugggccuccgcacccgccgccucggcacccgcggcaacuccaaguaccacuacuacggccuccgcaucaaggccuccuccccccuccuccgccucauggaggaccagcagcacauggccaugcgcggccagcccuucucccagaagcagcgccucaagcccauccagaagauggagggcaugaccaacggcgucgccgucggccagcagcccuccaccggccucuccgacaucuccgcccagguccagcaguaccagcaguuccucgacgccucccgcucccuccccgacuucaccgagcucgaccuccagggcaagguccuccccgagggcgucggccccggcgacaucaaggccuuccagguccucuaccgcgagcacugcgaggccaucgucgacgucauggucaaccuccaguucacccucgucgagacccucuggaagaccuucuggcgcuacaaccucucccagcccuccgaggcccccccccucgccguccacgacgaggccgagaagcgccuccccaaggccauccucguccuccucuccaaguucgagcccguccuccaguggaccaagcacugcgacaacguccucuaccagggccucgucgagauccucauccccgacguccuccgccccauccccuccgcccucacccaggccauccgcaacuucgccaagucccucgaguccuggcucacccacgccauggucaacauccccgaggagaugcuccgcgucaaggucgccgccgccggcgccuucgcccagacccuccgccgcuacaccucccucaaccaccucgcccaggccgcccgcgccguccuccagaacaccgcccagaucaaccagaugcucuccgaccucaaccgcgucgacuucgccaacguccaggagcaggccuccugggucugccgcugcgaggaccgcgucguccagcgccucgagcaggacuucaaggucacccuccagcagcagaacucccucgagcagugggccgccuggcucgacggcgucgucucccagguccucaagcccuaccagggcuccgccggcuuccccaaggccgccaagcucuuccuccucaagugguccuucuacuccuccauggucauccgcgaccucacccuccgcuccgccgccuccuucggcuccuuccaccucauccgccuccucuacgacgaguacauguacuaccucaucgagcaccgcgucgcccaggccaagggcgagacccccaucgccgucaugggcgaguucgccaaccucgccaccucccucaacccccucgaccccgacaaggacgaggaggaggaggaggaggaggaguccgaggacgagcucccccaggacaucucccucgccgccggcggcgagucccccgcccucggccccgagacccucgagccccccgccaagcucgcccgcaccgacgcccgcggccucuucguccaggcccuccccuccuccuga

SEQ ID NO: 48696 - RNA, 2172 nt, Artificial Sequence
  derived and/or modified sequence opt2 from RFX2__Homo_sapiens__NP_000626
augcagaacuccgagggcggcgccgacucccccgccuccgucgcccuccgccccuccgccgccgccccccccguccccgccuccccccagcgcguccucguccaggccgccuccuccaaccccaagggcgcccagaugcagcccaucucccucccccgcguccagcaggucccccagcagguccagcccguccagcacgucuaccccgcccagguccaguacgucgagggcggcgacgccgucuacaccaacggcgccauccgcaccgccuacaccuacaaccccgagccccagauguacgcccccuccuccaccgccuccuacuucgaggcccccggcggcgcccaggucaccgucgccgccuccuccccccccgccguccccucccacuccauggucggcaucaccauggacgucggcggcucccccaucgucuccuccgccggcgccuaccucauccacggcggcauggacuccacccgccacucccucgcccacaccucccgcuccucccccgccacccucgagauggccaucgagaaccuccagaaguccgagggcaucaccucccacaaguccggccuccucaacucccaccuccaguggcuccucgacaacuacgagaccgccgagggcgucucccucccccgcuccucccucuacaaccacuaccuccgccacugccaggagcacaagcucgaccccgucaacgccgccuccuucggcaagcucauccgcuccgucuucaugggccuccgcacccgccgccucggcacccgcggcaacuccaaguaccacuacuacggcauccgccucaagcccgacuccccccucaaccgccuccaggaggacacccaguacauggccaugcgccagcagcccaugcaccagaagccccgcuaccgccccgcccagaagaccgacucccucggcgacuccggcucccacuccggccuccacuccacccccgagcagaccauggccguccagucccagcaccaccagcaguacaucgacgucucccacgucuuccccgaguuccccgcccccgaccucggcuccuuccuccuccaggacggcgucacccuccacgacgucaaggcccuccagcucgucuaccgccgccacugcgaggccaccgucgacgucgucaugaaccuccaguuccacuacaucgagaagcucuggcucuccuucuggaacuccaaggccuccuccuccgacggccccaccucccuccccgccuccgacgaggaccccgagggcgccguccuccccaaggacaagcucaucucccucugccagugcgaccccauccuccgcuggaugcgcuccugcgaccacauccucuaccaggcccucgucgagauccucauccccgacguccuccgccccguccccuccacccucacccaggccauccgcaacuucgccaagucccucgagggcuggcucaccaacgccauguccgacuucccccagcaggucauccagaccaaggucggcgucgucuccgccuucgcccagacccuccgccgcuacaccucccucaaccaccucgcccaggccgcccgcgccguccuccagaacaccucccagaucaaccagaugcucuccgaccucaaccgcgucgacuucgccaacguccaggagcaggccuccugggucugccagugcgaggaguccgucguccagcgccucgagcaggacuucaagcucacccuccagcagcaguccucccucgaccagugggccuccuggcucgacuccgucgucacccagguccucaagcagcacgccggcucccccuccuuccccaaggccgcccgccaguuccuccucaagugguccuucuacuccuccauggucauccgcgaccucacccuccgcuccgccgccuccuucggcuccuuccaccucauccgccuccucuacgacgaguacauguucuaccucgucgagcaccgcgucgccgaggccaccggcgagacccccaucgccgucaugggcgaguucaacgaccucgccucccucucccucacccuccucgacaaggacgacaugggcgacgagcagcgcggcuccgaggccggccccgacgcccgcucccucggcgagccccucgucaagcgcgagcgcuccgaccccaaccacucccuccagggcaucuga

SEQ ID NO: 48697 - RNA, 1242 nt, Artificial Sequence
  derived and/or modified sequence opt2 from RFX3__Homo_sapiens__NP_001269046
augcagaccuccgagaccggcuccgacaccggcuccaccgucacccuccagaccuccgucgccucccaggccgccguccccacccaggucguccagcagguccccguccagcagcagguccagcagguccagaccguccagcagguccagcacgucuaccccgcccagguccaguacgucgagggcuccgacaccgucuacaccaacggcgccauccgcaccaccaccuaccccuacaccgagacccagauguacucccagaacaccggcggcaacuacuucgacacccagggcuccuccgcccaggucaccaccgucgucuccucccacuccauggucggcaccggcggcauccagaugggcgucaccggcggccagcucaucuccuccuccggcggcaccuaccucaucggcaacuccauggagaacuccggccacuccgucacccacaccacccgcgccucccccgccaccaucgagauggccaucgagacccuccagaaguccgacggccucuccacccaccgcuccucccuccucaacucccaccuccaguggcuccucgacaacuacgagaccgccgagggcgucucccucccccgcuccacccucuacaaccacuaccuccgccacugccaggagcacaagcucgaccccgucaacgccgccuccuucggcaagcucauccgcuccaucuucaugggccuccgcacccgccgccucggcacccgcggcaacuccaaguaccacuacuacggcauccgcgucaagcccgacuccccccucaaccgccuccaggaggacaugcaguacauggccaugcgccagcagcccaugcagcagaagcagcgcuacaagcccaugcagaaggucgacggcgucgccgacggcuucaccggcuccggccagcagaccggcaccuccgucgagcagaccgucaucgcccagucccagcaccaccagcaguuccucgacgccucccgcgcccuccccgaguucggcgaggucgagaucuccucccuccccgacggcaccaccuucgaggacaucaagucccuccagucccucuaccgcgagcacugcgaggccauccucgacgucgucgucaaccuccaguucucccucaucgagaagcucuggcagaccuucuggcgcuacucccccuccacccccaccgacggcaccaccaucaccgagucccgcuccgaguccaccuccuuccccauccacuuccacggcuga

SEQ ID NO: 48698 - RNA, 2235 nt, Artificial Sequence
  derived and/or modified sequence opt2 from RFX4__Homo_sapiens__NP_001193620
augaucaagcgccgcgcccaccccggcgccggcggcgaccgcacccgcccccgccgccgccgcuccaccgaguccuggaucgagcgcugccucaacgaguccgagaacaagcgcuacuccucccacaccucccucggcaacgucuccaacgacgagaacgaggagaaggagaacaaccgcgccuccaagccccacuccacccccgccacccuccaguggcucgaggagaacuacgagaucgccgagggcgucugcaucccccgcuccgcccucuacaugcacuaccucgacuucugcgagaagaacgacacccagcccgucaacgccgccuccuucggcaagaucauccgccagcaguucccccagcucaccacccgccgccucggcacccgcggccaguccaaguaccacuacuacggcaucgccgucaaggaguccucccaguacuacgacgucauguacuccaagaagggcgccgccugggucuccgagaccggcaagaaggaggucuccaagcagaccgucgccuacuccccccgcuccaagcucggcacccuccuccccgaguuccccaacgucaaggaccucaaccuccccgccucccuccccgaggagaaggucuccaccuucaucaugauguaccgcacccacugccagcgcauccucgacaccgucauccgcgccaacuucgacgagguccaguccuuccuccuccacuucuggcagggcaugcccccccacaugcuccccguccucggcuccuccaccgucgucaacaucgucggcgucugcgacuccauccucuacaaggccaucuccggcguccucaugcccaccguccuccaggcccuccccgacucccucacccaggucauccgcaaguucgccaagcagcucgacgaguggcucaaggucgcccuccacgaccuccccgagaaccuccgcaacaucaaguucgagcucucccgccgcuucucccagauccuccgccgccagaccucccucaaccaccucugccaggccucccgcaccgucauccacuccgccgacaucaccuuccagaugcucgaggacuggcgcaacgucgaccucaacuccaucaccaagcagacccucuacaccauggaggacucccgcgacgagcaccgcaagcucaucacccagcucuaccaggaguucgaccaccuccucgaggagcagucccccaucgaguccuacaucgaguggcucgacaccauggucgaccgcugcgucgucaaggucgccgccaagcgccagggcucccucaagaaggucgcccagcaguuccuccucaugugguccugcuucggcacccgcgucauccgcgacaugacccuccacuccgcccccuccuucggcuccuuccaccucauccaccucauguucgacgacuacguccucuaccuccucgagucccuccacugccaggagcgcgccaacgagcucaugcgcgccaugaagggcgagggcuccaccgccgagguccgcgaggagaucauccucaccgaggccgccgcccccacccccucccccguccccuccuucucccccgccaaguccgccaccuccgucgagguccccccccccuccucccccgucuccaaccccucccccgaguacaccggccucuccaccaccggcgccaugcaguccuacaccuggucccucaccuacaccgucaccaccgccgccggcucccccgccgagaacucccagcagcuccccugcaugcgcaacacccacguccccuccuccuccgucacccaccgcauccccgucuacccccaccgcgaggagcacggcuacaccggcuccuacaacuacggcuccuacggcaaccagcacccccaccccaugcagucccaguaccccgcccucccccacgacaccgccaucuccggcccccuccacuacgcccccuaccaccgcuccuccgcccaguaccccuucaacucccccaccucccgcauggagcccugccucauguccuccaccccccgccuccaccccacccccgucaccccccgcuggcccgagguccccuccgccaacaccugcuacaccucccccuccguccacuccgcccgcuacggcaacuccuccgacauguacaccccccucaccacccgccgcaacuccgaguacgagcacaugcagcacuuccccggcuucgccuacaucaacggcgaggccuccaccggcugggccaaguga

SEQ ID NO: 48699 - RNA, 1851 nt, Artificial Sequence
  derived and/or modified sequence opt2 from RFX5__Homo_sapiens__NP_001020774
auggccgaggacgagcccgacgccaagucccccaagaccggcggccgcgccccccccggcggcgccgaggccggcgagcccaccacccuccuccagcgccuccgcggcaccaucuccaaggccguccagaacaaggucgagggcauccuccaggacguccagaaguucuccgacaacgacaagcucuaccucuaccuccagcuccccuccggccccaccaccggcgacaaguccuccgagcccuccacccucuccaacgaggaguacauguacgccuaccgcuggauccgcaaccaccucgaggagcacaccgacaccugccuccccaagcaguccgucuacgacgccuaccgcaaguacugcgagucccucgccugcugccgcccccucuccaccgccaacuucggcaagaucauccgcgagaucuuccccgacaucaaggcccgccgccucggcggccgcggccaguccaaguacugcuacuccggcauccgccgcaagacccucgucuccaugcccccccuccccggccucgaccucaagggcuccgagucccccgagaugggccccgaggucacccccgccccccgcgacgagcucgucgaggccgccugcgcccucaccugcgacugggccgagcgcauccucaagcgcuccuucuccuccaucgucgaggucgcccgcuuccuccuccagcagcaccucaucuccgcccgcuccgcccacgcccacguccucaaggccaugggccucgccgaggaggacgagcacgccccccgcgagcgcuccuccaagcccaagaacggccucgagaaccccgagggcggcgcccacaagaagcccgagcgccucgcccagccccccaaggaccucgaggcccgcaccggcgccggcccccucgcccgcggcgagcgcaagaaguccgucgucgaguccuccgcccccggcgccaacaaccuccaggucaacgcccucgucgcccgccucccccuccuccucccccgcgccccccgcucccucaucccccccauccccgucuccccccccauccucgccccccgccucuccuccggcgcccucaaggucgccacccucccccucuccucccgcgccggcgccccccccgccgccguccccaucaucaacaugauccuccccaccguccccgcccuccccggccccggccccggccccggccgcgccccccccggcggccucacccagccccgcggcaccgagaaccgcgaggucggcaucggcggcgaccagggcccccacgacaagggcgucaagcgcaccgccgagguccccgucuccgaggccuccggccaggccccccccgccaaggccgccaagcaggacaucgaggacaccgccuccgacgccaagcgcaagcgcggccgcccccgcaagaaguccggcggcuccggcgagcgcaacuccaccccccucaaguccgccgccgccauggaguccgcccaguccucccgccuccccugggagaccuggggcuccggcggcgagggcaacuccgccggcggcgccgagcgccccggccccaugggcgaggccgagaagggcgccguccucgcccagggccagggcgacggcaccgucuccaagggcggccgcggccccggcucccagcacaccaaggaggccgaggacaagaucccccucguccccuccaaggucuccgucaucaagggcucccgcucccagaaggaggccuucccccucgccaagggcgaggucgacaccgccccccagggcaacaaggaccucaaggagcacguccuccaguccucccucucccaggagcacaaggaccccaaggccaccccccccuga

SEQ ID NO: 48700 - RNA, 2787 nt, Artificial Sequence
  derived and/or modified sequence opt2 from RFX6__Homo_sapiens__NP_775831
auggccaagguccccgagcucgaggacaccuuccuccaggcccagcccgccccccagcucucccccggcauccaggaggacugcugcguccagcuccucggcaagggccuccucgucuaccccgaggagaccgucuaccucgccgccgagggccagcccggcggcgagcagggcggcggcgagaagggcgaggaccccgagcuccccggcgccgucaaguccgagaugcaccucaacaacggcaacuucuccuccgaggaggaggacgccgacaaccacgacuccaagaccaaggccgccgaccaguaccucucccagaagaagaccaucacccagaucgucaaggacaagaagaagcagacccagcucacccuccaguggcucgaggagaacuacaucgucugcgagggcgucugccucccccgcugcauccucuacgcccacuaccucgacuucugccgcaaggagaagcucgagcccgccugcgccgccaccuucggcaagaccauccgccagaaguucccccuccucaccacccgccgccucggcacccgcggccacuccaaguaccacuacuacggcaucggcaucaaggaguccuccgccuacuaccacuccgucuacuccggcaagggccucacccgcuucuccggcuccaagcucaagaacgagggcggcuucacccgcaaguacucccucuccuccaagaccggcacccuccuccccgaguuccccuccgcccagcaccucgucuaccagggcugcaucuccaaggacaaggucgacacccucaucaugauguacaagacccacugccagugcauccucgacaacgccaucaacggcaacuucgaggagauccagcacuuccuccuccacuucuggcagggcaugcccgaccaccuccucccccuccucgagaaccccgucaucaucgacaucuucugcgucugcgacuccauccucuacaagguccucaccgacguccucauccccgccaccaugcaggagaugcccgagucccuccucgccgacauccgcaacuucgccaagaacugggagcagugggucgucuccucccucgagaaccuccccgaggcccucaccgacaagaagauccccaucguccgccgcuucgucuccucccucaagcgccagaccuccuuccuccaccucgcccagaucgcccgccccgcccucuucgaccagcacgucgucaacuccauggucuccgacaucgagcgcgucgaccucaacuccaucggcucccaggcccuccucaccaucuccggcuccaccgacaccgaguccggcaucuacaccgagcacgacuccaucaccgucuuccaggagcucaaggaccuccucaagaagaacgccaccgucgaggccuucaucgaguggcucgacaccgucgucgagcagcgcgucaucaagaccuccaagcagaacggccgcucccucaagaagcgcgcccaggacuuccuccucaagugguccuucuucggcgcccgcgucaugcacaaccucacccucaacaacgccuccuccuucggcuccuuccaccucauccgcaugcuccucgacgaguacauccuccucgccauggagacccaguucaacaacgacaaggagcaggagcuccagaaccuccucgacaaguacaugaagaacuccgacgccuccaaggccgccuucaccgccucccccuccuccugcuuccucgccaaccgcaacaagggcuccauggucuccuccgacgccgucaagaacgagucccacgucgagaccaccuaccucccccuccccuccucccagcccggcggccucggccccgcccuccaccaguuccccgccggcaacaccgacaacaugccccucaccggccagauggagcucucccagaucgccggccaccucaugaccccccccaucucccccgccauggccucccgcggcuccgucaucaaccagggccccauggccggccgcccccccuccgucggccccguccucuccgcccccucccacugcuccaccuaccccgagcccaucuaccccacccucccccaggccaaccacgacuucuacuccaccuccuccaacuaccagaccgucuuccgcgcccagccccacuccaccuccggccucuacccccaccacaccgagcacggccgcugcauggccuggaccgagcagcagcucucccgcgacuucuucuccggcuccugcgccggcucccccuacaacucccgcccccccuccuccuacggccccucccuccaggcccaggacucccacaacaugcaguuccucaacaccggcuccuucaacuuccucuccaacaccggcgccgccuccugccagggcgccacccucccccccaacucccccaacggcuacuacggcuccaacaucaacuaccccgagucccaccgccucggcuccauggucaaccagcacgucuccgucaucuccuccauccgcucccucccccccuacuccgacauccacgacccccucaacauccucgacgacuccggccgcaagcagaccuccuccuucuacaccgacaccuccucccccgucgccugccgcacccccguccucgccuccucccuccagacccccauccccuccuccuccucccagugcauguacggcaccuccaaccaguaccccgcccaggagacccucgacucccacggcaccuccucccgcgagauggucuccucccucccccccaucaacaccgucuucaugggcaccgccgccggcggcaccuga

SEQ ID NO: 48701 - RNA, 1422 nt, Artificial Sequence
  derived and/or modified sequence opt2 from RFX8__Homo_sapiens__NP_001139136
auguacgagaucuacgucgagaccugcggccagaacaccgagaaccaggucaaccccgccaccuucggcaagugcgaggaccacucccccaugaagaccgaccccgucggcuccccccucuccgaguuccgccgcugccccuuccucgagcaggagcucgccaagaaguacuccugcaacaugauggccuuccucgccgacgaguacugcaacuacugccgcgacauccuccgcaacgucgaggaccuccucaccuccuucuggaagucccuccagcaggacaccgucaugcucaugucccuccccgacgucugccagcucuucaagugcuacgacguccagcucuacaagggcaucgaggacguccuccuccacgacuuccucgaggacgucuccauccaguaccucaaguccguccagcucuucuccaagaaguucaagcucuggcuccucaacgcccucgagggcguccccgcccuccuccagaucuccaagcucaaggaggucacccucuucgucaagcgccuccgccgcaagaccuaccucuccaacauggccaagaccaugcgcaugguccucaaguccaagcgccgcgucuccguccucaaguccgaccuccaggccaucaucaaccagggcacccucgccaccuccaagaaggcccucgccuccgaccgcuccggcgccgacgagcucgagaacaaccccgagaugaagugccuccgcaaccucaucucccuccucggcaccuccaccgaccuccgcgucuuccucuccugccucuccucccaccuccaggccuucgucuuccagaccucccgcuccaaggaggaguucaccaagcucgccgccuccuuccagcuccgcuggaaccuccuccucaccgccgucuccaaggccaugacccucugccaccgcgacuccuucggcuccuggcaccucuuccaccuccuccuccucgaguacaugauccacauccuccaguccugccucgaggaggaggaggaggaggaggacaugggcaccgucaaggagaugcuccccgacgaccccacccucggccagcccgaccaggcccucuuccacucccucaacuccucccucucccaggccugcgccucccccuccauggagccccucggcgucaugcccacccacaugggccagggccgcuaccccgucggcgucuccaacaugguccuccgcauccucggcuuccucgucgacaccgccaugggcaacaagcucauccagguccuccucgaggacgagaccaccgaguccgccgucaagcucucccuccccaugggccaggaggcccucaucacccucaaggacggccagcaguucgucauccagaucuccgacgucccccaguccuccgaggacaucuacuuccgcgagaacaacgccaacgucuga

SEQ ID NO: 48702 - RNA, 717 nt, Artificial Sequence
  derived and/or modified sequence opt2 from RFXANK__Homo_sapiens__NP_001265656
auggagcucacccagcccgccgaggaccucauccagacccagcagacccccgccuccgagcucggcgaccccgaggaccccggcgaggaggccgccgacggcuccgacaccgucguccucucccucuuccccugcacccccgagcccgucaaccccgagcccgacgccuccgucuccuccccccaggccggcuccucccucaagcacuccaccacccucaccaaccgccagcgcggcaacgaggucuccgcccuccccgccacccucgacugcgacaaccucgucaacaagcccgacgagcgcggcuucaccccccucaucugggccuccgccuucggcgagaucgagaccguccgcuuccuccucgaguggggcgccgacccccacauccucgccaaggagcgcgaguccgcccucucccucgccuccaccggcggcuacaccgacaucgucggccuccuccucgagcgcgacgucgacaucaacaucuacgacuggaacggcggcaccccccuccucuacgccguccgcggcaaccacgucaagugcgucgaggcccuccucgcccgcggcgccgaccucaccaccgaggccgacuccggcuacacccccauggaccucgccgucgcccucggcuaccgcaagguccagcaggucaucgagaaccacauccucaagcucuuccaguccaaccucguccccgccgaccccgaguga

SEQ ID NO: 48703 - RNA, 819 nt, Artificial Sequence
  derived and/or modified sequence opt2 from RFXAP__Homo_sapiens__NP_000529
auggaggcccagggcgucgccgagggcgccggccccggcgccgccuccggcgucccccaccccgccgcccucgcccccgccgccgcccccacccucgcccccgccuccgucgccgccgccgccucccaguucacccuccucgucaugcagcccugcgccggccaggacgaggccgccgcccccggcggcuccgucggcgccggcaagcccguccgcuaccucugcgagggcgccggcgacggcgaggaggaggccggcgaggacgaggccgaccuccucgacaccuccgacccccccggcggcggcgaguccgccgccucccucgaggaccucgaggacgaggagacccacuccggcggcgagggcuccuccggcggcgcccgccgccgcggcuccggcggcggcuccauguccaagaccugcaccuacgagggcugcuccgagaccaccucccaggucgccaagcagcgcaagcccuggaugugcaagaagcaccgcaacaagauguacaaggacaaguacaagaagaagaaguccgaccaggcccucaacugcggcggcaccgccuccaccggcuccgccggcaacgucaagcucgaggaguccgccgacaacauccucuccaucgucaagcagcgcaccggcuccuucggcgaccgccccgcccgccccacccuccucgagcagguccucaaccagaagcgccucucccuccuccgcucccccgaggucguccaguuccuccagaagcagcagcagcuccucaaccagcagguccucgagcagcgccagcagcaguuccccggcaccuccauguga

SEQ ID NO: 48704 - RNA, 414 nt, Artificial Sequence
  derived and/or modified sequence opt2 from RGCC__Homo_sapiens__NP_054778
augaagccccccgccgcccagggcucccccgccgccgccgccgccgccgcccccgcccucgacuccgccgccgccgaggaccucuccgacgcccucugcgaguucgacgccguccucgccgacuucgccucccccuuccacgagcgccacuuccacuacgaggagcaccucgagcgcaugaagcgccgcuccuccgccuccgucuccgacuccuccggcuucuccgacuccgaguccgccgacucccucuaccgcaacuccuucuccuucuccgacgagaagcucaacucccccaccgacuccacccccgcccuccucuccgccaccgucaccccccagaaggccaagcucggcgacaccaaggagcucgaggccuucaucgccgaccucgacaagacccucgccuccauguga

SEQ ID NO: 48705 - RNA, 2301 nt, Artificial Sequence
  derived and/or modified sequence opt2 from RGL1__Homo_sapiens__NP_001284598
auggaggucaagcccgucggcgagcccacccaggaggucuccaaguucaagcucuccaccaaggucgaguccaccggccacuggcucgucgaggaccacguccgcaucugggagguccucaagaccgaggaggucgagggcgaccagcucccccccggccacaccgucucccaguacgagaccugcaagauccgcaccaucaaggccggcacccucgagaagcucgucgagaaccuccucaccgccuucggcgacaacgacuucaccuacaucuccaucuuccucuccaccuaccgcggcuucgccuccaccaaggagguccucgagcuccuccucgaccgcuacggcaaccucaccucccccaacugcgaggaggacggcucccaguccuccuccgaguccaagauggucauccgcaacgccaucgccuccauccuccgcgccuggcucgaccagugcgccgaggacuuccgcgagcccccccacuuccccugccuccagaagcuccucgacuaccucacccgcaugaugcccggcuccgaccccgagcgccgcgcccagaaccuccucgagcaguuccagaagcaggaggucgagaccgacaacggccuccccaacaccaucuccuucucccucgaggaggaggaggagcucgagggcggcgaguccgccgaguucaccugcuucuccgaggaccucgucgccgagcagcucaccuacauggacgcccagcucuucaagaaggucgucccccaccacugccucggcugcaucuggucccgccgcgacaagaaggagaacaagcaccucgcccccaccauccgcgccaccaucucccaguucaacacccucaccaagugcgucgucuccaccauccucggcggcaaggagcucaagacccagcagcgcgccaagaucaucgagaaguggaucaacaucgcccacgagugccgccuccucaagaacuucuccucccuccgcgccaucgucuccgcccuccaguccaacuccaucuaccgccucaagaagaccugggccgccgucccccgcgaccgcaugcucauguucgaggagcucuccgacaucuucuccgaccacaacaaccaccucaccucccgcgagcuccucaugaaggagggcaccuccaaguucgccaaccucgacuccuccgucaaggagaaccagaagcgcacccagcgccgccuccagcuccagaaggacaugggcgucaugcagggcaccguccccuaccucggcaccuuccucaccgaccucaccaugcucgacaccgcccuccaggacuacaucgagggcggccucaucaacuucgagaagcgccgccgcgaguucgaggucaucgcccagaucaagcuccuccaguccgccugcaacuccuacugcaugacccccgaccagaaguucauccagugguuccagcgccagcagcuccucaccgaggaggaguccuacgcccucuccugcgagaucgaggccgccgccgacgccuccaccaccucccccaagccccgcaaguccauggucaagcgccucucccuccucuuccucggcuccgacaugaucaccucccccacccccaccaaggagcagcccaaguccaccgccuccggcuccuccggcgaguccauggacuccgucuccgucuccuccugcgaguccaaccacuccgaggccgaggagggcuccaucacccccauggacacccccgacgagccccagaagaagcucuccgaguccuccuccuccugcuccuccauccacuccauggacaccaacuccuccggcauguccucccucaucaacccccucuccuccccccccuccugcaacaacaaccccaagauccacaagcgcuccgucuccgucaccuccaucaccuccaccguccucccccccgucuacaaccagcagaacgaggacaccugcaucauccgcaucuccgucgaggacaacaacggcaacauguacaaguccaucaugcucaccucccaggacaagacccccgccgucauccagcgcgccaugcucaagcacaaccucgacuccgaccccgccgaggaguacgagcucguccaggucaucuccgaggacaaggagcucgucauccccgacuccgccaacgucuucuacgccaugaacucccaggucaacuucgacuucauccuccgcaagaagaacuccauggaggagcaggucaagcuccgcucccgcaccucccucacccucccccgcaccgccaagcgcggcugcugguccaaccgccacuccaagaucacccucuga

SEQ ID NO: 48706 - RNA, 2334 nt, Artificial Sequence
  derived and/or modified sequence opt2 from RGL2__Homo_sapiens__NP_004752
augcucccccgcccccuccgccuccuccucgacaccuccccccccggcggcgucguccucuccuccuuccgcucccgcgaccccgaggagggcggcggccccggcggccucgucgucggcggcggccaggaggaggaggaggaggaggaggaggaggcccccgucuccgucugggacgaggaggaggacggcgccgucuucaccgucaccucccgccaguaccgcccccucgacccccucguccccaugccccccccccgcuccucccgccgccuccgcgccggcacccucgaggcccucguccgccaccuccucgacacccgcaccuccggcaccgacgucuccuucauguccgccuuccucgccacccaccgcgccuucaccuccacccccgcccuccucggccucauggccgaccgccucgaggcccucgagucccaccccaccgacgagcucgagcgcaccaccgaggucgccaucuccguccucuccaccuggcucgccucccaccccgaggacuucggcuccgaggccaagggccagcucgaccgccucgaguccuuccuccuccagaccggcuacgccgccggcaagggcgucggcggcggcuccgccgaccucauccgcaaccuccgcucccgcgucgacccccaggcccccgaccuccccaagccccucgcccuccccggcgacccccccgccgaccccaccgacguccucgucuuccucgccgaccaccucgccgagcagcucacccuccucgacgccgagcucuuccucaaccucauccccucccagugccucggcggccucuggggccaccgcgaccgccccggccacucccaccucugccccuccguccgcgccaccgucacccaguucaacaaggucgccggcgccgucgucuccuccguccucggcgccaccuccaccggcgagggccccggcgaggucaccauccgcccccuccgccccccccagcgcgcccgccuccucgagaaguggauccgcgucgccgaggagugccgccuccuccgcaacuucuccuccgucuacgccgucgucuccgcccuccaguccucccccauccaccgccuccgcgccgccuggggcgaggccacccgcgacucccuccgcgucuucuccucccucugccagaucuucuccgaggaggacaacuacucccagucccgcgagcuccucguccaggaggucaagcuccaguccccccucgagccccacuccaagaaggccccccgcuccggcucccgcggcggcggcgucguccccuaccucggcaccuuccucaaggaccucgucaugcucgacgccgccuccaaggacgagcucgagaacggcuacaucaacuucgacaagcgccgcaaggaguucgccguccucuccgagcuccgccgccuccagaacgagugccgcggcuacaaccuccagcccgaccacgacauccagcgcuggcuccagggccuccgcccccucaccgaggcccagucccaccgcgucuccugcgaggucgagccccccggcuccuccgacccccccgccccccgcguccuccgccccacccucgucaucucccaguggaccgagguccucggcuccgucggcguccccaccccccucgucuccugcgaccgccccuccaccggcggcgacgaggcccccaccacccccgccccccuccucacccgccucgcccagcacaugaaguggcccuccgucuccucccucgacuccgcccucgaguccucccccucccuccacucccccgccgaccccucccaccucuccccccccgccuccuccccccgccccucccgcggccaccgccgcuccgccuccugcggcuccccccucuccggcggcgccgaggaggccuccggcggcaccggcuacggcggcgagggcuccggccccggcgccuccgacugccgcaucauccgcguccagauggagcucggcgaggacggcuccgucuacaaguccauccucgucaccucccaggacaaggcccccuccgucaucucccgcguccucaagaagaacaaccgcgacuccgccgucgccuccgaguacgagcucguccagcuccuccccggcgagcgcgagcucaccauccccgccuccgccaacgucuucuacgccauggacggcgccucccacgacuuccuccuccgccagcgccgccgcuccuccaccgccacccccggcgucaccuccggccccuccgccuccggcaccccccccuccgagggcggcggcggcuccuucccccgcaucaaggccaccggccgcaagaucgcccgcgcccucuucuga

SEQ ID NO: 48707 - RNA, 1422 nt, Artificial Sequence
  derived and/or modified sequence opt2 from RGL4__Homo_sapiens__NP_705843
augcgcaagcuccucaccaaccuccccgccgccgccguccucuccgcccaggucuacuccgccguccuccagggccucugggaggagaacgucugcggcacccccggccgcacccgcgucugcaccgcccuccucuacggccaggucugccccuuccaggacuccaccgacggccuccgcaccaucaccuccauccucuucaacuggccccccgagaacaccuccgucuacuaccagcccccccagcgcuccuccuuccgcaucaagcucgccuuccgcaaccucuccuggcccggccucggccucgaggaccaccaggagaucguccucggccagcucguccuccccgagcccaacgaggccaagcccgacgaccccgccccccgccccggccagcacgcccucaccaugcccgcccucgagcccgcccccccccuccucgccgaccucggccccgcccucgagcccgagucccccgccgcccucggcccccccggcuaccuccacuccgcccccggccccgcccccgcccccggcgagggccccccccccggcaccguccucgagccccaguccgcccccgaguccuccugccccugccgcggcuccgucaagaaccagcccuccgaggagcuccccgacaugaccaccuuccccccccgccuccucgccgagcagcucacccucauggacgccgagcucuucaagaaggucguccuccacgagugccucggcugcaucuggggccagggccaccucaagggcaacgagcacauggcccccaccguccgcgccaccaucgcccacuucaaccgccucaccaacugcaucaccaccuccugccucggcgaccacuccaugcgcgcccgcgaccgcgcccgcgucgucgagcacuggaucaaggucgcccgcgagugccucucccucaacaacuucuccuccguccacgucaucgucuccgcccucugcuccaaccccaucggccagcuccacaagaccugggccggcgucuccuccaaguccaugaaggagcucaaggagcucugcaagaaggacaccgccgucaagcgcgaccuccucaucaaggccggcuccuucaaggucgccacccaggagcgcaacccccagcgcguccagaugcgccuccgccgccagaagaagggcgucguccccuuccucggcgacuuccucaccgagcuccagcgccucgacuccgccauccccgacgaccucgacggcaacaccaacaagcgcuccaaggagguccgcguccuccaggagaugcagcuccuccaggucgccgccaugaacuaccgccuccgcccccucgagaaguucgucaccuacuucacccgcauggagcagcucuccgacaaggaguccuacaagcucuccugccagcucgagcccgagaaccccuga

SEQ ID NO: 48708 - RNA, 1377 nt, Artificial Sequence
  derived and/or modified sequence opt2 from RGMA__Homo_sapiens__NP_001159755
augggcggccucggcccccgccgcgccggcaccucccgcgagcgccucgucgucaccggccgcgccggcuggaugggcaugggccgcggcgccggccgcuccgcccucggcuucuggcccacccucgccuuccuccucugcuccuuccccgccgccaccucccccugcaagauccucaagugcaacuccgaguucugguccgccaccuccggcucccacgcccccgccuccgacgacacccccgaguucugcgccgcccuccgcuccuacgcccucugcacccgccgcaccgcccgcaccugccgcggcgaccucgccuaccacuccgccguccacggcaucgaggaccucaugucccagcacaacugcuccaaggacggccccaccucccagccccgccuccgcacccucccccccgccggcgacucccaggagcgcuccgacucccccgagaucugccacuacgagaaguccuuccacaagcacuccgccacccccaacuacacccacugcggccucuucggcgacccccaccuccgcaccuucaccgaccgcuuccagaccugcaagguccagggcgccuggccccucaucgacaacaacuaccucaacguccaggucaccaacacccccguccuccccggcuccgccgccaccgccaccuccaagcucaccaucaucuucaagaacuuccaggagugcgucgaccagaaggucuaccaggccgagauggacgagcuccccgccgccuucgucgacggcuccaagaacggcggcgacaagcacggcgccaacucccucaagaucaccgagaaggucuccggccagcacgucgagauccaggccaaguacaucggcaccaccaucgucguccgccaggucggccgcuaccucaccuucgccguccgcaugcccgaggaggucgucaacgccgucgaggacugggacucccagggccucuaccucugccuccgcggcugcccccucaaccagcagaucgacuuccaggccuuccacaccaacgccgagggcaccggcgcccgccgccucgccgccgccucccccgcccccaccgcccccgagaccuuccccuacgagaccgccgucgccaagugcaaggagaagcuccccgucgaggaccucuacuaccaggccugcgucuucgaccuccucaccaccggcgacgucaacuucacccucgccgccuacuacgcccucgaggacgucaagaugcuccacuccaacaaggacaagcuccaccucuacgagcgcacccgcgaccuccccggccgcgccgccgccggccucccccucgccccccgcccccuccucggcgcccucgucccccuccucgcccuccuccccgucuucugcuga

SEQ ID NO: 48709 - RNA, 1437 nt, Artificial Sequence
  derived and/or modified sequence opt2 from RGMB__Homo_sapiens__NP_001012779
augauccgcaagaagcgcaagcgcuccgccccccccggccccugccgcucccacggcccccgccccgccaccgcccccgcccccccccccucccccgagcccacccgccccgccuggaccggcaugggccuccgcgccgcccccuccuccgccgccgccgccgccgccgaggucgagcagcgccgcucccccggccucugcccccccccccucgagcuccuccuccuccuccucuucucccucggccuccuccacgccggcgacugccagcagcccgcccagugccgcauccagaagugcaccaccgacuucgucucccucaccucccaccucaacuccgccgucgacggcuucgacuccgaguucugcaaggcccuccgcgccuacgccggcugcacccagcgcaccuccaaggccugccgcggcaaccucgucuaccacuccgccguccucggcaucuccgaccucaugucccagcgcaacugcuccaaggacggccccaccuccuccaccaaccccgaggucacccacgaccccugcaacuaccacucccacgccggcgcccgcgagcaccgccgcggcgaccagaacccccccuccuaccucuucugcggccucuucggcgacccccaccuccgcaccuucaaggacaacuuccagaccugcaaggucgagggcgccuggccccucaucgacaacaacuaccucuccguccaggucaccaacguccccgucguccccggcuccuccgccaccgccaccaacaagaucaccaucaucuucaaggcccaccacgagugcaccgaccagaaggucuaccaggccgucaccgacgaccuccccgccgccuucgucgacggcaccaccuccggcggcgacuccgacgccaagucccuccgcaucgucgagcgcgaguccggccacuacgucgagaugcacgcccgcuacaucggcaccaccgucuucguccgccaggucggccgcuaccucacccucgccauccgcaugcccgaggaccucgccauguccuacgaggagucccaggaccuccagcucugcgucaacggcugcccccucuccgagcgcaucgacgacggccagggccaggucuccgccauccucggccacucccucccccgcaccucccucguccaggccuggcccggcuacacccucgagaccgccaacacccagugccacgagaagaugcccgucaaggacaucuacuuccaguccugcgucuucgaccuccucaccaccggcgacgccaacuucaccgccgccgcccacuccgcccucgaggacgucgaggcccuccacccccgcaaggagcgcuggcacaucuuccccuccuccggcaacggcaccccccgcggcggcuccgaccucuccgucucccucggccucaccugccucauccucaucgucuuccucuga

SEQ ID NO: 48710 - RNA, 900 nt, Artificial Sequence
  derived and/or modified sequence opt2 from RGN__Homo_sapiens__NP_004674
auguccuccaucaagaucgagugcguccuccccgagaacugccgcugcggcgagucccccgucugggaggaggucuccaacucccuccucuucgucgacauccccgccaagaaggucugccgcugggacuccuucaccaagcagguccagcgcgucaccauggacgcccccgucuccuccgucgcccuccgccaguccggcggcuacgucgccaccaucggcaccaaguucugcgcccucaacuggaaggagcaguccgccgucguccucgccaccgucgacaacgacaagaagaacaaccgcuucaacgacggcaaggucgaccccgccggccgcuacuucgccggcaccauggccgaggagaccgcccccgccguccucgagcgccaccagggcgcccucuacucccucuuccccgaccaccacgucaagaaguacuucgaccaggucgacaucuccaacggccucgacuggucccucgaccacaagaucuucuacuacaucgacucccucuccuacuccgucgacgccuucgacuacgaccuccagaccggccagaucuccaaccgccgcuccgucuacaagcucgagaaggaggagcagauccccgacggcaugugcaucgacgccgagggcaagcucugggucgccugcuacaacggcggccgcgucauccgccucgaccccgucaccggcaagcgccuccagaccgucaagcuccccgucgacaagaccaccuccugcugcuucggcggcaagaacuacuccgagauguacgucaccugcgcccgcgacggcauggaccccgagggccuccuccgccagcccgaggccggcggcaucuucaagaucaccggccucggcgucaagggcaucgcccccuacuccuacgccggcuga

SEQ ID NO: 48711 - RNA, 5271 nt, Artificial Sequence
  derived and/or modified sequence opt2 from RGPD2__Homo_sapiens__NP_001071638
augcgccgcuccaaggccuacggcgagcgcuaccucgccuccguccagggcuccgcccccucccccggcaagaagcuccgcggcuucuacuucgccaagcucuacuacgaggccaaggaguacgaccucgccaagaaguacgucugcaccuaccucuccguccaggagcgcgacccccgcgcccaccgcuuccucggccuccucuacgagcucgaggagaacaccgagaaggccgucgagugcuaccgccgcucccucgagcucaaccccccccagaaggaccucguccucaagaucgccgagcuccucugcaagaacgacgucaccgacggccgcgccaaguacugggucgagcgcgccgccaagcucuuccccggcucccccgccaucuacaagcucaaggagcaccuccucgacugcgagggcgaggacggcuggaacaagcucuucgacuggauccaguccgagcucuacguccgccccgacgacguccacaugaacauccgccucgucgagcucuaccgcuccaacaagcgccucaaggacgccgucgcccgcugccacgaggccgagcgcaacaucgcccuccgcuccucccucgaguggaacuccugcgucguccagacccucaaggaguaccucgagucccuccagugccucgaguccgacaaguccgacuggcgcgccaccaacaccgaccuccuccucgccuacgccaaccucaugcuccucacccucuccacccgcgacguccaggagucccgcgagcuccucgaguccuucgacuccgcccuccaguccgccaaguccucccucggcggcaacgacgagcucuccgccaccuuccucgagaugaagggccacuucuacaugcacgccggcucccuccuccucaagaugggccagcacggcaacaacguccaguggcaggcccucuccgagcucgccgcccucugcuacgucaucgccuuccaggucccccgccccaagaucaagcucaucaagggcgaggccggccagaaccuccucgagaugauggccugcgaccgccucucccaguccggccacaugcuccucaaccucucccgcggcaagcaggacuuccucaaggaggucgucgagaccuucgccaacaaguccggccaguccguccucuacaacgcccucuucuccucccaguccuccaaggacaccuccuuccucggcuccgacgacaucggcaacaucgacguccaggagcccgagcucgaggaccucgcccgcuacgacgucggcgccauccaggcccacaacggcucccuccagcaccucaccuggcucggccuccaguggaacucccuccccgcccuccccggcauccgcaaguggcucaagcagcucuuccaccaccucccccaggagaccucccgccucgagaccaacgcccccgaguccaucugcauccucgaccucgaggucuuccuccucggcgucgucuacaccucccaccuccagcucaaggagaagugcaacucccaccacuccuccuaccagccccucugccucccccuccccgucugcaagcgccucugcaccgagcgccagaaguccuggugggacgccgucugcacccucauccaccgcaaggccguccccggcaacuccgccgagcuccgccucgucguccagcacgagaucaacacccuccgcgcccaggagaagcacggccuccagcccgcccuccucguccacugggccaagugccuccagaagaugggccgcggccucaacuccuccuacgaccagcaggaguacaucggccgcuccguccacuacuggaagaagguccucccccuccucaagaucaucaagaagaacuccauccccgagcccaucgacccccucuucaagcacuuccacuccgucgacauccaggccuccgagaucgucgaguacgaggaggacgcccacaucaccuucgccauccucgacgccguccacggcaacaucgaggacgccgucaccgccuucgaguccaucaaguccgucgucuccuacuggaaccucgcccucaucuuccaccgcaaggccgaggacaucgagaacgacgccgucuuccccgaggagcaggaggagugcaagaacuaccuccgcaagacccgcgacuaccucaucaagaucaucgacgacuccgacuccaaccucuccgucgucaagaagcuccccgucccccucgaguccgucaaggagaugcucaaguccgucaugcaggagcucgaggacuacuccgagggcggcccccucuacaagaacggcucccuccgcaacgccgacuccgagaucaagcacuccacccccucccccaccaaguacucccucucccccuccaaguccuacaaguacucccccaagacccccccccgcugggccgaggaccagaacucccuccgcaagaugaucugccaggaggucaaggccaucaccaagcucaacuccuccaaguccgccucccgccaccgcuggcccaccgagaacuacggccccgacuccguccccgacggcuaccagggcucccagaccuuccacggcgccccccucaccgucgccaccaccggccccuccgucuacuacucccagucccccgccuacaacucccaguaccuccuccgccccgccgccaacgucacccccaccaagggcuccuccaacaccgaguucaaguccaccaaggagggcuucuccaucgccgucuccgccgacggcuucaaguucggcaucuccgagcccggcaaccaggagaagaaguccgagaagccccucgagaacgacaccggcuuccaggcccaggacaucuccggccagaagaacggccgcggcgucaucuucggccagaccuccuccaccuucaccuucgccgacgucgccaaguccaccuccggcgagggcuuccaguucggcaagaaggaccccaacuucaagggcuucuccggcgccggcgagaagcucuucuccucccagugcggcaagauggccaacaaggccaacaccuccggcgacuucgagaaggacgacgacgccugcaagaccgaggacuccgacgacauccacuucgagcccgucguccagaugcccgagaaggucgagcucgucaccggcgaggagggcgagaagguccucuacucccagggcgucaagcucuuccgcuucgacgccgagaucucccaguggaaggagcgcggccucggcaaccucaagauccucaagaacgaggucaacggcaagccccgcaugcucaugcgccgcgaccagguccucaaggucugcgccaaccacuggaucaccaccaccaugaaccucaagccccucuccggcuccgaccgcgccuggauguggcucgccuccgacuucuccgacggcgacgccaagcucgagcgccucgccgcccaguucaagacccccgagcucgccgaggaguucaagcagaaguucgaggagugccagcgccuccuccucgacaucccccuccagaccccccacaagcucgucgacaccggccgcgccgccaagcucauccagcgcgccgaggagaugaaguccggccucaaggacuucaagaccuuccucaccaacgaccagaccaaggucaccgaggaggagaacaagggcuccggcaccggcgccgccggcgccuccgacaccaccaucaagcccaaccccgagaacaccggccccacccucgagugggacaacuacgaccuccgcgaggacgcccucgacgacaacgucuccuccuccuccguccacgacuccccccucgccuccucccccguccgcaagaacaucuuccgcuucgacgaguccaccaccggcuucaacuucuccuucaaguccgcccucucccucuccaagucccccgccaagcucaaccaguccggcaccuccgucggcaccgacgaggaguccgacgucacccaggaggaggagcgcgacggccaguacuucgagcccgucgucccccuccccgaccucgucgaggucuccuccggcgaggagaacgagcaggucgucuucucccacauggccgagcucuaccgcuacgacaaggacgucggccaguggaaggagcgcggcaucggcgacaucaagauccuccagaacuacgacaacaagcagguccgcaucgucaugcgccgcgaccagguccucaagcucugcgccaaccaccgcaucacccccgacaugucccuccagaacaugaagggcaccgagcgcgucugggucuggaccgccugcgacuucgccgacggcgagcgcaaggucgagcaccucgccguccgcuucaagcuccaggacgucgccgacuccuucaagaagaucuucgacgaggccaagaccgcccaggagaaggacucccucaucaccccccacgucucccgcuccuccaccccccgcgagucccccugcggcaagaucgccgucgccguccucgaggagaccacccgcgagcgcaccgacgucauccagggcgacgacgucgccgacgccgccuccgaggucgaggucuccuccaccuccgagaccaccaccaaggccgucgucuccccccccaaguucgucuucggcuccgaguccgucaagcgcaucuucuccuccgagaaguccaaccccuucgccuucggcaacuccuccgccaccggcucccucuucggcuucuccuucaacgccccccucaaguccaacgacuccgagaccuccuccgucgcccaguccggcuccgaguccaaggucgagcccaagaagugcgagcucuccaagaacuccgacaucgagcaguccuccgacuccaaggucaagaaccucuccgccuccuuccccauggaggaguccuccaucaacuacaccuucaagacccccgagaaggagcccccccucuggcacgccgaguucaccaaggaggagcucguccagaagcucuccuccaccaccaaguccgccgaccagcucaacggccuccuccgcgagaccgaggccaccuccgccguccucauggagcagaucaagcuccucaaguccgagauccgccgccucgagcgcaaccaggaggaguccgccgccaacgucgagcaccucaagaacguccuccuccaguucaucuuccucaagcccggcuccgagcgcgagucccuccuccccgucaucaacaccaugcuccagcucucccccgaggagaagggcaagcucgccgccgucgcccagggccuccaggagaccuccauccccaagaagaaguga

SEQ ID NO: 48712 - RNA, 876 nt, Artificial Sequence
  derived and/or modified sequence opt2 from RGR__Homo_sapiens__NP_001012738
auggccgagaccuccgcccuccccaccggcuucggcgagcucgagguccucgccgucggcaugguccuccucgucgaggcccucuccggccucucccucaacacccucaccaucuucuccuucugcaagacccccgagcuccgcacccccugccaccuccucguccucucccucgcccucgccgacuccggcaucucccucaacgcccucgucgccgccaccuccucccuccuccgccgcuggcccuacggcuccgacggcugccaggcccacggcuuccagggcuucgucaccgcccucgccuccaucugcuccuccgccgccaucgccuggggccgcuaccaccacuacugcacccgcucccagcucgccuggaacuccgccgucucccucguccucuucgucuggcucuccuccgccuucugggccgcccucccccuccucggcuggggccacuacgacuacgagccccucggcaccugcugcacccucgacuacuccaagggcgaccgcaacuucaccuccuuccucuucaccauguccuucuucaacuucgccaugccccucuucaucaccaucaccuccuacucccucauggagcagaagcucggcaaguccggccaccuccaggucaacaccacccuccccgcccgcacccuccuccucggcuggggccccuacgccauccucuaccucuacgccgucaucgccgacgucaccuccaucucccccaagcuccagaugguccccgcccucaucgccaagaugguccccaccaucaacgccaucaacuacgcccucggcaacgagauggucugccgcggcaucuggcagugccucuccccccagaagcgcgagaaggaccgcaccaaguga

SEQ ID NO: 48713 - RNA, 546 nt, Artificial Sequence
  derived and/or modified sequence opt2 from RGS10__Homo_sapiens__NP_001005339
auguucaaccgcgccgucucccgccucucccgcaagcgcccccccuccgacauccacgacuccgacggcuccuccuccuccucccaccagucccucaaguccaccgccaagugggccgccucccucgagaaccuccucgaggaccccgagggcgucaagcgcuuccgcgaguuccucaagaaggaguucuccgaggagaacguccucuucuggcucgccugcgaggacuucaagaagaugcaggacaagacccagaugcaggagaaggccaaggagaucuacaugaccuuccucuccuccaaggccuccucccaggucaacgucgagggccagucccgccucaacgagaagauccucgaggagccccacccccucauguuccagaagcuccaggaccagaucuucaaccucaugaaguacgacuccuacucccgcuuccucaaguccgaccucuuccucaagcacaagcgcaccgaggaggaggaggaggaccuccccgacgcccagaccgccgccaagcgcgccucccgcaucuacaacaccuga

SEQ ID NO: 48714 - RNA, 1341 nt, Artificial Sequence
  derived and/or modified sequence opt2 from RGS11__Homo_sapiens__NP_003825
auggagcgcgucgucgucuccaugcaggaccccgaccagggcgucaagaugcgcucccagcgccuccucgucaccgucaucccccacgccgucaccggcuccgacgucguccaguggcucgcccagaaguucugcgucuccgaggaggaggcccuccaccucggcgccguccucguccagcacggcuacaucuacccccuccgcgacccccgcucccucaugcuccgccccgacgagacccccuaccgcuuccagacccccuacuucuggaccuccacccuccgccccgccgccgagcucgacuacgccaucuaccucgccaagaagaacauccgcaagcgcggcacccucgucgacuacgagaaggacugcuacgaccgccuccacaagaagaucaaccacgccugggaccucguccucaugcaggcccgcgagcagcuccgcgccgccaagcagcgcuccaagggcgaccgccucgucaucgccugccaggagcagaccuacuggcucgucaaccgccccccccccggcgcccccgacguccucgagcagggccccggccgcggcuccugcgccgccucccgcguccucaugaccaaguccgccgacuuccacaagcgcgagaucgaguacuuccgcaaggcccucggccgcacccgcgucaaguccuccgucugccucgaggccuaccucuccuucugcggccagcgcggcccccacgacccccucgucuccggcugccuccccuccaaccccuggaucuccgacaacgacgccuacugggucaugaacgcccccaccgucgccgcccccaccaagcuccgcgucgagcgcuggggcuucuccuuccgcgagcuccucgaggaccccgucggccgcgcccacuucauggacuuccucggcaaggaguucuccggcgagaaccucuccuucugggaggccugcgaggagcuccgcuacggcgcccaggcccagguccccacccucgucgacgccgucuacgagcaguuccucgcccccggcgccgcccacugggucaacaucgacucccgcaccauggagcagacccucgagggccuccgccagccccaccgcuacguccucgacgacgcccagcuccacaucuacaugcucaugaagaaggacuccuacccccgcuuccucaaguccgacauguacaaggcccuccucgccgaggccggcaucccccucgagaugaagcgccgcgucuuccccuucaccuggcgcccccgccacuccucccccucccccgcccuccuccccacccccgucgagcccaccgccgccugcggccccggcggcggcgacggcgucgccuga

SEQ ID NO: 48715 - RNA, 2400 nt, Artificial Sequence
  derived and/or modified sequence opt2 from RGS12__Homo_sapiens__NP_937870
augaaccucggcaaggagcucuccaacgagacccacgucuccaacgaccagcaguccgccaccgucuccgacggcgagcucaccggcgccgaccucaaggacugcgucuccaacaacucccucuccuccaacgccucccuccccuccguccaguccugccgccgccuccgcgagcgccgcgucgccuccugggccgucuccuucgagcgccuccuccaggaccccgucggcguccgcuacuucuccgacuuccuccgcaaggaguucuccgaggagaacauccucuucuggcaggccugcgaguacuucaaccacguccccgcccacgacaagaaggagcucuccuaccgcgcccgcgagaucuucuccaaguuccucugcuccaaggccaccacccccgucaacaucgacucccaggcccagcucgccgacgacguccuccgcgccccccaccccgacauguucaaggagcagcagcuccagaucuucaaccucaugaaguucgacuccuacacccgcuuccucaaguccccccucuaccaggagugcauccucgccgaggucgagggccgcgcccuccccgacucccagcagguccccuccucccccgccuccaagcacucccucggcuccgaccacuccuccgucuccacccccaagaagcucuccggcaaguccaaguccggccgcucccucaacgaggagcucggcgacgaggacuccgagaagaagcgcaagggcgccuucuucuccuggucccgcacccgcuccaccggccgcucccagaagaagcgcgagcacggcgaccacgccgacgacgcccuccacgccaacggcggccucugccgccgcgagucccagggcuccgucuccuccgccggcucccucgaccucuccgaggccugccgcacccucgcccccgagaaggacaaggccaccaagcacugcugcauccaccuccccgacggcaccuccugcgucgucgccgucaaggccggcuucuccaucaaggacauccucuccggccucugcgagcgccacggcaucaacggcgccgccgccgaccucuuccucgucggcggcgacaagccccucguccuccaccaggacuccuccauccucgagucccgcgaccuccgccucgagaagcgcacccucuuccgccucgaccucguccccaucaaccgcuccgucggccucaaggccaagcccaccaagcccgucaccgagguccuccgccccgucgucgcccgcuacggccucgaccucuccggccuccucguccgccucuccggcgagaaggagccccucgaccucggcgcccccaucuccucccucgacggccagcgcgucguccucgaggagaaggaccccucccgcggcaaggccuccgccgacaagcagaagggcguccccgucaagcagaacaccgccgucaacuccuccucccgcaaccacuccgccaccggcgaggagcgcacccucggcaaguccaacuccaucaagaucaagggcgagaacggcaagaacgcccgcgacccccgccucuccaagcgcgaggaguccaucgccaagaucggcaagaagaaguaccagaagaucaaccucgacgaggccgaggaguucuucgagcucaucuccaaggcccaguccaaccgcgccgacgaccagcgcggccuccuccgcaaggaggaccucguccuccccgaguuccuccgccucccccccggcuccaccgagcucacccuccccacccccgccgccgucgccaagggcuucuccaagcgcuccgccaccggcaacggccgcgaguccgccucccagcccggcgagcagugggagcccguccaggaguccuccgacucccccuccaccucccccggcuccgccuccuccccccccggcccccccggcaccaccccccccggccagaagucccccuccggccccuucugcaccccccagucccccgucucccucgcccaggagggcaccgcccagaucuggaagcgccagucccaggaggucgaggccggcggcauccagaccgucgaggacgagcacgucgccgagcucacccucaugggcgagggcgacaucuccucccccaacuccacccuccuccccccccccuccaccccccaggagguccccggccccucccgccccggcuccggcacccacggcucccgcgaccuccccgucaaccgcaucaucgacgucgaccucgucaccggcuccgcccccggccgcgacggcggcaucgccggcgcccaggccggccccggccgcucccaggccuccggcggcccccccaccuccgaccuccccggccucggccccguccccggcgagcccgccaagcccaagaccuccgcccaccacgccaccuucgucuga

SEQ ID NO: 48716 - RNA, 480 nt, Artificial Sequence
  derived and/or modified sequence opt2 from RGS13__Homo_sapiens__NP_002918
augucccgccgcaacugcuggaucugcaagaugugccgcgacgaguccaagcgcccccccuccaaccucacccucgaggagguccuccagugggcccaguccuucgagaaccucauggccaccaaguacggccccgucgucuacgccgccuaccucaagauggagcacuccgacgagaacauccaguucuggauggccugcgagaccuacaagaagaucgccucccgcuggucccgcaucucccgcgccaagaagcucuacaagaucuacauccagccccaguccccccgcgagaucaacaucgacuccuccacccgcgagaccaucauccgcaacauccaggagcccaccgagaccugcuucgaggaggcccagaagaucgucuacaugcacauggagcgcgacuccuacccccgcuuccucaaguccgagauguaccagaagcuccucaagaccaugcaguccaacaacuccuucuga

SEQ ID NO: 48717 - RNA, 1701 nt, Artificial Sequence
  derived and/or modified sequence opt2 from RGS14__Homo_sapiens__NP_006471
augcccggcaagcccaagcaccucggcguccccaacggccgcaugguccucgccgucuccgacggcgagcucuccuccaccaccggcccccagggccagggcgagggccgcggcuccucccucuccauccacucccuccccuccggccccuccucccccuuccccaccgaggagcagcccgucgccuccugggcccucuccuucgagcgccuccuccaggacccccucggccucgccuacuucaccgaguuccucaagaaggaguucuccgccgagaacgucaccuucuggaaggccugcgagcgcuuccagcagauccccgccuccgacacccagcagcucgcccaggaggcccgcaacaucuaccaggaguuccucuccucccaggcccucucccccgucaacaucgaccgccaggccuggcucggcgaggagguccucgccgagccccgccccgacauguuccgcgcccagcagcuccagaucuucaaccucaugaaguucgacuccuacgcccgcuucgucaaguccccccucuaccgcgagugccuccucgccgaggccgagggccgcccccuccgcgagcccggcuccucccgccucggcucccccgacgccacccgcaagaagcccaagcucaagcccggcaagucccucccccucggcgucgaggagcucggccagcucccccccgucgagggccccggcggccgcccccuccgcaaguccuuccgccgcgagcucggcggcaccgccaacgccgcccuccgccgcgagucccagggcucccucaacuccuccgccucccucgaccucggcuuccucgccuucgucuccuccaaguccgagucccaccgcaagucccucggcuccaccgagggcgaguccgagucccgccccggcaaguacugcugcgucuaccuccccgacggcaccgccucccucgcccucgcccgccccggccucaccauccgcgacaugcucgccggcaucugcgagaagcgcggccucucccuccccgacaucaaggucuaccucgucggcaacgagcaggcccucguccucgaccaggacugcaccguccucgccgaccaggagguccgccucgagaaccgcaucaccuucgagcucgagcucaccgcccucgagcgcgucguccgcaucuccgccaagcccaccaagcgccuccaggaggcccuccagcccauccucgagaagcacggccucuccccccucgaggucguccuccaccgccccggcgagaagcagccccucgaccucggcaagcucgucuccuccgucgccgcccagcgccucguccucgacacccuccccggcgucaagaucuccaaggcccgcgacaagucccccugccgcucccagggcugccccccccgcacccaggacaaggccacccaccccccccccgccucccccuccucccucgucaagguccccuccuccgccaccggcaagcgccagaccugcgacaucgagggccucgucgagcuccucaaccgcguccaguccuccggcgcccacgaccagcgcggccuccuccgcaaggaggaccucguccuccccgaguuccuccagcuccccgcccagggccccuccuccgaggagacccccccccagaccaaguccgccgcccagcccaucggcggcucccucaacuccaccaccgacuccgcccucuga

SEQ ID NO: 48718 - RNA, 609 nt, Artificial Sequence
  derived and/or modified sequence opt2 from RGS16__Homo_sapiens__NP_002919
augugccgcacccucgccgccuuccccaccaccugccucgagcgcgccaaggaguucaagacccgccucggcaucuuccuccacaaguccgagcucggcugcgacaccggcuccaccggcaaguucgaguggggcuccaagcacuccaaggagaaccgcaacuucuccgaggacguccucggcuggcgcgaguccuucgaccuccuccucuccuccaagaacggcgucgccgccuuccacgccuuccucaagaccgaguucuccgaggagaaccucgaguucuggcucgccugcgaggaguucaagaagauccgcuccgccaccaagcucgccucccgcgcccaccagaucuucgaggaguucaucugcuccgaggcccccaaggaggucaacaucgaccacgagacccacgagcucacccgcaugaaccuccagaccgccaccgccaccugcuucgacgccgcccagggcaagacccgcacccucauggagaaggacuccuacccccgcuuccucaagucccccgccuaccgcgaccucgccgcccaggccuccgccgccuccgccacccucuccuccugcucccucgacgagcccucccacaccuga

SEQ ID NO: 48719 - RNA, 666 nt, Artificial Sequence
  derived and/or modified sequence opt2 from RGS17__Homo_sapiens__XP_011534055
auguccucccagcucggccccgaggucgccgagaugcgcaagcgccagcagucccagaacgagggcacccccgccgucucccaggcccccggcaaccagcgccccaacaacaccugcugcuucugcuggugcugcugcugcuccugcuccugccucaccguccgcaacgaggagcgcggcgagaacgccggccgccccacccacaccaccaagauggaguccauccagguccucgaggagugccagaaccccaccgccgaggagguccucuccuggucccagaacuucgacaagaugaugaaggcccccgccggccgcaaccucuuccgcgaguuccuccgcaccgaguacuccgaggagaaccuccucuucuggcucgccugcgaggaccucaagaaggagcagaacaagaaggucaucgaggagaaggcccgcaugaucuacgaggacuacaucuccauccucucccccaaggaggucucccucgacucccgcguccgcgaggucaucaaccgcaaccuccucgaccccaacccccacauguacgaggacgcccagcuccagaucuacacccucaugcaccgcgacuccuucccccgcuuccucaacucccagaucuacaaguccuucgucgaguccaccgccggcuccuccuccgaguccuga

SEQ ID NO: 48720 - RNA, 708 nt, Artificial Sequence
  derived and/or modified sequence opt2 from RGS18__Homo_sapiens__NP_570138
auggagaccacccuccucuucuucucccagaucaacaugugcgaguccaaggagaagaccuucuucaagcucauccacggcuccggcaaggaggagaccuccaaggaggccaagauccgcgccaaggagaagcgcaaccgccucucccuccucguccagaagcccgaguuccacgaggacacccgcuccucccgcuccggccaccucgccaaggagacccgcgucucccccgaggaggccgucaaguggggcgaguccuucgacaagcuccucucccaccgcgacggccucgaggccuucacccgcuuccucaagaccgaguucuccgaggagaacaucgaguucuggaucgccugcgaggacuucaagaaguccaagggcccccagcagauccaccucaaggccaaggccaucuacgagaaguucauccagaccgacgcccccaaggaggucaaccucgacuuccacaccaaggaggucaucaccaacuccaucacccagcccacccuccacuccuucgacgccgcccagucccgcgucuaccagcucauggagcaggacuccuacacccgcuuccucaaguccgacaucuaccucgaccucauggagggccgcccccagcgccccaccaaccuccgccgccgcucccgcuccuucaccugcaacgaguuccaggacguccaguccgacgucgccaucuggcucuga

SEQ ID NO: 48721 - RNA, 654 nt, Artificial Sequence
  derived and/or modified sequence opt2 from RGS19__Homo_sapiens__XP_011526788
augcccaccccccacgaggccgagaagcagaucaccggccccgaggaggccgaccgcccccccuccauguccucccacgacaccgccucccccgccgcccccucccgcaaccccugcugccucugcuggugcugcugcugcuccugcuccuggaaccaggagcgccgccgcgccuggcaggccucccgcgaguccaagcuccagccccuccccuccugcgaggucugcgccacccccucccccgaggagguccaguccugggcccaguccuucgacaagcucaugcacucccccgccggccgcuccgucuuccgcgccuuccuccgcaccgaguacuccgaggagaacaugcucuucuggcucgccugcgaggagcucaaggccgaggccaaccagcacgucgucgacgagaaggcccgccucaucuacgaggacuacgucuccauccucucccccaaggaggucucccucgacucccgcguccgcgagggcaucaacaagaagaugcaggagcccuccgcccacaccuucgacgacgcccagcuccagaucuacacccucaugcaccgcgacuccuacccccgcuuccucuccucccccaccuaccgcgcccuccuccuccagggccccucccaguccuccuccgaggccuga

SEQ ID NO: 48722 - RNA, 630 nt, Artificial Sequence
  derived and/or modified sequence opt2 from RGS1__Homo_sapiens__NP_002913
augcgcgccgccgccaucuccacccccaagcucgacaagaugcccggcauguucuucuccgccaaccccaaggagcucaagggcaccacccacucccuccucgacgacaagaugcagaagcgccgccccaagaccuucggcauggacaugaaggccuaccuccgcuccaugaucccccaccucgaguccggcaugaaguccuccaaguccaaggacguccucuccgccgccgaggucaugcaguggucccagucccucgagaagcuccucgccaaccagaccggccagaacgucuucggcuccuuccucaaguccgaguucuccgaggagaacaucgaguucuggcucgccugcgaggacuacaagaagaccgaguccgaccuccuccccugcaaggccgaggagaucuacaaggccuucguccacuccgacgccgccaagcagaucaacaucgacuuccgcacccgcgaguccaccgccaagaagaucaaggcccccacccccaccugcuucgacgaggcccagaaggucaucuacacccucauggagaaggacuccuacccccgcuuccucaaguccgacaucuaccucaaccuccucaacgaccuccaggccaacucccucaaguga

SEQ ID NO: 48723 - RNA, 726 nt, Artificial Sequence
  derived and/or modified sequence opt2 from RGS20__Homo_sapiens__NP_003693
augcgcaccgccgacggcggcgagcccgccggcgccuccucccccgccggccgcgucgacggcggccuccagaugggcuccgagcgcauggagaugcgcaagcgccagaugcccgccgcccaggacacccccggcgccgcccccggccagcccggcgccggcucccgcggcuccaacgccugcugcuucugcuggugcugcugcugcuccugcuccugccucaccguccgcaaccaggaggaccagcgccccaccaucgccucccacgagcuccgcgccgaccuccccaccugggaggagucccccgcccccacccucgaggaggucaacgccugggcccaguccuucgacaagcucauggucacccccgccggccgcaacgccuuccgcgaguuccuccgcaccgaguucuccgaggagaacaugcucuucuggauggccugcgaggagcucaagaaggaggccaacaagaacaucaucgaggagaaggcccgcaucaucuacgaggacuacaucuccauccucucccccaaggaggucucccucgacucccgcguccgcgaggucaucaaccgcaacauggucgagcccucccagcacaucuucgacgacgcccagcuccagaucuacacccucaugcaccgcgacuccuacccccgcuucaugaacuccgccgucuacaaggaccuccuccagucccucuccgagaaguccaucgaggccuga

SEQ ID NO: 48724 - RNA, 459 nt, Artificial Sequence
  derived and/or modified sequence opt2 from RGS21__Homo_sapiens__NP_001034241
augcccgucaagugcugcuucuaccgcucccccaccgccgagaccaugaccugguccgagaacauggacacccuccucgccaaccaggccggccucgacgccuuccgcaucuuccucaaguccgaguucuccgaggagaacgucgaguucuggcucgccugcgaggacuucaagaagaccaagaacgccgacaagaucgccuccaaggccaagaugaucuacuccgaguucaucgaggccgacgcccccaaggagaucaacaucgacuucggcacccgcgaccucaucuccaagaacaucgccgagcccacccucaagugcuucgacgaggcccagaagcucaucuacugccucauggccaaggacuccuucccccgcuuccucaaguccgagaucuacaagaagcucgucaacucccagcagguccccaaccacaagaaguggcuccccuuccucuga

SEQ ID NO: 48725 - RNA, 3759 nt, Artificial Sequence
  derived and/or modified sequence opt2 from RGS22__Homo_sapiens__NP_001273621
augcccgagaagcgccucaccgccgagccccccaccaucaccgaggaggaguucgaggacucccucgccaccgacgacuuccucgucgacuacuucaacgaguuccucucccuccccaccuucuccgaggccauccgcuucaacgccgacuacggcgucuucgaggucgccaacgacgccccccaguuccucgagaagcagcucaagaagauccuccagaaccagcagccccgcaaccccaucuacgacgucguccgcaagggcaagaacgaggucaagcccguccagaugaacgcccccgacgaggacgagaccaucaacgucaacuacaacaucaugugccucucccgcgaggagggcaucaaguggaucaagaaggagcgccuccccgccuuccucgaguccgacugcuacuucgaguaccgccucgccaagcucgucucccagguccgcugguccaaguccggcaugaacuucaccgucggcuccaacuucucccccuggaucgucaagaagccccccucccuccccccccccgccaccgaggaggacaaccucgccuccuacacccagaccaaggacugguucgcccucgccaagcagucccagcagaccgucuccaccuucucccuccccugcugcguccccuacaacaagcucaagucccccgccaucuccuccgucuccgagaacuucaucuucgacgacggcguccacccccgcaccaagaaggaccccuccaagaccaacaagcucaucuccgaguucgaggaggaggagggcgaggaggaggaggucuccgucucccuccaggacacccccucccaggcccuccuccgcgucuaccucgagaagaagcaggacgucgacgagucccucaccaugcacuucuccaccugcgaggaguuccucuccuccuacaucuacuucauccuccgcggcgccauccagcagaucgucggcaagcccgucggcgagacccccgacuacaucaacuucaacaacaucaccaaggucuccuucgacgacugcuucgaguccauccacggcaagaacuuccucuccgagcucguccagaccaccaaggagcgcuccgaggagaucgagcagaccucccucuccuccaagaacgaguccgccggccccgagucccgcgccgacuggugcaucucccaccgcaccuacgacaucggcaaccgcaaggaguucgagcgcuucaagaaguucaucaagggcacccucggcgagcgcuacugguggcucuggauggacaucgagcgccucaagguccucaaggaccccggccgccaccagcgccaccucgagaagaugaagaagugcuaccucgucuccaacggcgacuacuaccucuccgccgagauccucuccaaguucaagcuccucgacggcucccaguggaacgaggagcaccuccgcaacauccaguccgagguccucaagccccuccuccucuacugggccccccgcuucugcgucacccacuccgccuccaccaaguacgccuccgccgagcucaaguucuggcaccuccgccaggccaagccccgcaaggacaucgaccccuucccccagauggccacccuccucccccuccgccccaaguccugcaucccccagauccccgagauccagaaggaggaguucucccucucccagccccccaagucccccaacaagucccccgaggucaagaccgccacccagaagcccuggaagcgcgagcuccucuaccccggcuccuccaaggacgacgucaucgagaagggcuccaaguacauguccgaguccuccaaggucauccaccucaccuccuucaccgacaucuccgagugccucaagccccagcucgaccgccgcuacgccuacaccgaggagccccgcgucaagaccgucuccgacgucggcgcccucggcggcuccgacauggagaaccuccuccagucccucuacgucgagaaccgcgccggcuucuucuucaccaaguucugcgagcacuccggcaacaagcucuggaagaacuccgucuacuucugguucgaccuccaggccuaccaccagcucuucuaccaggagacccuccagcccuucaaggucugcaagcaggcccaguaccucuucgccaccuacgucgcccccuccgccacccucgacaucggccuccagcaggagaagaagaaggagaucuacaugaagauccagccccccuucgaggaccucuucgacaccgccgaggaguacauccuccuccuccuccucgagcccuggaccaagauggucaaguccgaccagaucgccuacaagaaggucgagcucgucgaggagacccgccagcucgacuccaccuacuuccgcaagcuccaggcccuccacaaggagaccuucuccaagaaggccgaggacaccaccugcgagaucggcaccggcauccucucccucuccaacgucuccaagcgcaccgaguacugggacaacguccccgccgaguacaagcacuucaaguucuccgaccuccucaacaacaagcucgaguucgagcacuuccgccaguuccucgagacccacuccuccuccauggaccucaugugcuggaccgacaucgagcaguuccgccgcaucaccuaccgcgaccgcaaccagcgcaaggccaaguccaucuacaucaagaacaaguaccucaacaagaaguacuucuucggccccaacucccccgccucccucuaccagcagaaccaggucaugcaccucuccggcggcuggggcaagauccuccacgagcagcucgacgcccccguccucgucgagauccagaagcacguccagaaccgccucgagaacgucuggcucccccucuuccucgccuccgagcaguucgccgcccgccagaagaucaagguccagaugaaggacaucgccgaggagcuccuccuccagaaggccgagaagaagaucggcgucuggaagcccgucgaguccaaguggaucuccuccuccugcaagaucaucgccuuccgcaaggcccuccucaaccccgucaccucccgccaguuccagcgcuucgucgcccucaagggcgaccuccucgagaacggccuccucuucuggcaggagguccagaaguacaaggaccucugccacucccacugcgacgaguccgucauccagaagaagaucaccaccaucaucaacugcuucaucaacuccuccaucccccccgcccuccagaucgacauccccgucgagcaggcccagaagaucaucgagcaccgcaaggagcucggccccuacgucuuccgcgaggcccagaugaccaucuucggcguccucuucaaguucuggccccaguucugcgaguuccgcaagaaccucaccgacgagaacaucauguccguccucgagcgccgccaggaguacaacaagcagaagaagaagcucgccguccucgaggacgagaaguccggcaaggacggcaucaagcaguacgccaacaccuccguccccgccaucaagaccgcccuccucuccgacuccuuccucggccuccagcccuacggccgccagcccaccuggugcuacuccaaguacaucgaggcccucgagcaggagcgcauccuccucaagauccaggaggagcucgagaagaagcucuucgccggccuccagccccucaccaacuucaaggccuccuccuccaccaugucccucaagaagaacauguccgcccacuccucccagaaguga

SEQ ID NO: 48726 - RNA, 636 nt, Artificial Sequence
  derived and/or modified sequence opt2 from RGS2__Homo_sapiens__NP_002914
augcaguccgccauguuccucgccguccagcacgacugccgccccauggacaaguccgccggcuccggccacaaguccgaggagaagcgcgagaagaugaagcgcacccuccucaaggacuggaagacccgccucuccuacuuccuccagaacuccuccacccccggcaagcccaagaccggcaagaaguccaagcagcaggccuucaucaagcccucccccgaggaggcccagcucugguccgaggccuucgacgagcuccucgccuccaaguacggccucgccgccuuccgcgccuuccucaaguccgaguucugcgaggagaacaucgaguucuggcucgccugcgaggacuucaagaagaccaaguccccccagaagcucuccuccaaggcccgcaagaucuacaccgacuucaucgagaaggaggcccccaaggagaucaacaucgacuuccagaccaagacccucaucgcccagaacauccaggaggccaccuccggcugcuucaccaccgcccagaagcgcgucuacucccucauggagaacaacuccuacccccgcuuccucgaguccgaguucuaccaggaccucugcaagaagccccagaucaccaccgagccccacgccaccuga

SEQ ID NO: 48727 - RNA, 1776 nt, Artificial Sequence
  derived and/or modified sequence opt2 from RGS3__Homo_sapiens__NP_001263190
augaaccgcuucaacggccucugcaaggucugcuccgagcgccgcuaccgccagaucaccaucccccgcggcaaggacggcuucggcuucaccaucugcugcgacucccccguccgcguccaggccgucgacuccggcggccccgccgagcgcgccggccuccagcagcucgacaccguccuccagcucaacgagcgccccgucgagcacuggaagugcgucgagcucgcccacgagauccgcuccugccccuccgagaucauccuccucgucuggcgcauggucccccaggucaagcccggccccgacggcggcguccuccgccgcgccuccugcaaguccacccacgaccuccaguccccccccaacaagcgcgagaagaacugcacccacggcguccaggcccgccccgagcagcgccacuccugccaccucgucugcgacuccuccgacggccuccuccucggcggcugggagcgcuacaccgaggucgccaagcgcggcggccagcacacccuccccgcccucucccgcgccaccgcccccaccgaccccaacuacaucauccucgccccccucaaccccggcucccagcuccuccgccccgucuaccaggaggacaccauccccgaggaguccggcucccccuccaagggcaaguccuacaccggccucggcaagaagucccgccucaugaagaccguccagaccaugaagggccacggcaacuaccagaacugccccgucguccgcccccacgccacccacuccuccuacggcaccuacgucacccucgcccccaagguccucgucuuccccgucuucguccagccccucgaccucugcaaccccgcccgcacccuccuccucuccgaggagcuccuccucuacgagggccgcaacaaggccgccgaggucacccucuucgccuacuccgaccuccuccucuucaccaaggaggacgagcccggccgcugcgacguccuccgcaacccccucuaccuccaguccgucaagcuccaggagggcuccuccgaggaccucaaguucugcguccucuaccucgccgagaaggccgagugccucuucacccucgaggcccacucccaggagcagaagaagcgcgucugcuggugccucuccgagaacaucgccaagcagcagcagcucgccgccuccccccccgacuccaagauguccggcgccgacaccgucggcgacgacgacgaggccucccgcaagcgcaaguccaagaaccucgccaaggacaugaagaacaagcucggcaucuuccgccgccgcaacgagucccccggcgccccccccgccggcaaggccgacaagaugaugaaguccuucaagcccaccuccgaggaggcccucaaguggggcgagucccucgagaagcuccucguccacaaguacggccucgccgucuuccaggccuuccuccgcaccgaguucuccgaggagaaccucgaguucuggcucgccugcgaggacuucaagaaggucaagucccaguccaagauggccuccaaggccaagaagaucuucgccgaguacaucgccauccaggccugcaaggaggucaaccucgacuccuacacccgcgagcacaccaaggacaaccuccaguccgucacccgcggcugcuucgaccucgcccagaagcgcaucuucggccucauggagaaggacuccuacccccgcuuccuccgcuccgaccucuaccucgaccucaucaaccagaagaagaugucccccccccucuga

SEQ ID NO: 48728 - RNA, 909 nt, Artificial Sequence
  derived and/or modified sequence opt2 from RGS4__Homo_sapiens__NP_001095915
auguacaacaugaugcuccucauccagaagcgcaagggcaucggcucccagcuccuccgcgccggcgaggccgagggcgaccgcggcgccggcaccgccgagcgcuccuccgacuggcucgacggccgcuccugggccaucaaggagacccccaccggccucgccggccgccgcuccgaggacuccgacaacaucuucaccggcgaggaggccaaguacgcccagucccgcucccacuccuccuccugccgcaucuccuuccuccucgccaacuccaagcuccucaacaagaugugcaagggccucgccggccuccccgccuccugccuccgcuccgccaaggacaugaagcaccgccucggcuuccuccuccagaaguccgacuccugcgagcacaacuccucccacaacaagaaggacaaggucgucaucugccagcgcgucucccaggaggaggucaagaagugggccgagucccucgagaaccucaucucccacgagugcggccucgccgccuucaaggccuuccucaaguccgaguacuccgaggagaacaucgacuucuggaucuccugcgaggaguacaagaagaucaagucccccuccaagcucucccccaaggccaagaagaucuacaacgaguucaucuccguccaggccaccaaggaggucaaccucgacuccugcacccgcgaggagaccucccgcaacaugcucgagcccaccaucaccugcuucgacgaggcccagaagaagaucuucaaccucauggagaaggacuccuaccgccgcuuccucaagucccgcuucuaccucgaccucgucaaccccuccuccugcggcgccgagaagcagaagggcgccaaguccuccgccgacugcgccucccucgucccccagugcgccuga

SEQ ID NO: 48729 - RNA, 222 nt, Artificial Sequence
  derived and/or modified sequence opt2 from RGS5__Homo_sapiens__NP_001241677
auggccgagaaggccaagcagaucuacgaggaguucauccagaccgaggcccccaaggaggucaacaucgaccacuucaccaaggacaucaccaugaagaaccucgucgagcccucccucuccuccuucgacauggcccagaagcgcauccacgcccucauggagaaggacucccucccccgcuucguccgcuccgaguucuaccaggagcucaucaaguga

SEQ ID NO: 48730 - RNA, 1458 nt, Artificial Sequence
  derived and/or modified sequence opt2 from RGS6__Homo_sapiens__NP_001191346
auggcccagggcuccggcgaccagcgcgccgucggcgucgccgaccccgaggaguccucccccaacaugaucgucuacugcaagaucgaggacaucaucaccaagaugcaggacgacaagaccggcggcguccccauccgcaccgucaaguccuuccucuccaagauccccuccgucgucaccggcaccgacaucguccaguggcucaugaagaaccucuccaucgaggaccccgucgaggccauccaccucggcucccucaucgccgcccagggcuacaucuuccccaucuccgaccacguccucaccaugaaggacgacggcaccuucuaccgcuuccaggcccccuacuucuggcccuccaacugcugggagcccgagaacaccgacuacgccaucuaccucugcaagcgcaccaugcagaacaaggcccgccucgagcucgccgacuacgaggccgagaaccucgcccgccuccagcgcgccuucgcccgcaagugggaguucaucuucaugcaggccgaggcccaggucaagaucgaccgcaagaaggacaagaccgagcgcaagauccucgacucccaggagcgcgccuucugggacguccaccgccccguccccggcugcgucaacaccaccgagauggacauccgcaagugccgccgccucaagaacccccagaaggucaagaaguccgucuacggcgucaccgaggagucccaggcccagucccccguccacguccucucccagcccauccgcaagaccaccaaggaggacauccgcaagcagaucaccuuccucaacgcccagaucgaccgccacugccucaagauguccaaggucgccgagucccucaucgccuacaccgagcaguacgucgaguacgacccccucaucacccccgccgagcccuccaaccccuggaucuccgacgacgucgcccucugggacaucgagauguccaaggagcccucccagcagcgcgucaagcgcuggggcuucuccuucgacgagauccucaaggaccaggucggccgcgaccaguuccuccgcuuccucgaguccgaguucuccuccgagaaccuccgcuucuggcucgccguccaggaccucaagaagcagccccuccaggacgucgccaagcgcgucgaggagaucuggcaggaguuccucgcccccggcgcccccuccgccaucaaccucgacucccacuccuacgagaucaccucccagaacgucaaggacggcggccgcuacaccuucgaggacgcccaggagcacaucuacaagcucaugaaguccgacuccuacgcccgcuuccuccgcuccaacgccuaccaggaccuccuccucgccaagaagaagcccgaguccgagcagggccgccgcaccucccucgagaaguucacccgcuccguccucuacuccaacaccccccucgccaagcgccccuga

SEQ ID NO: 48731 - RNA, 774 nt, Artificial Sequence
  derived and/or modified sequence opt2 from RGS7BP__Homo_sapiens__NP_001025046
auguccuccgcccccaacggccgcaagaagcgccccucccgcuccacccgcuccuccaucuuccagaucuccaagcccccccuccaguccggcgacugggagcgccgcggcuccggcuccgaguccgcccacaagacccagcgcgcccucgacgacugcaagaugcucguccaggaguucaacacccaggucgcccucuaccgcgagcucgucaucuccaucggcgacgucuccgucuccugccccucccuccgcgccgagaugcacaagacccgcaccaagggcugcgagauggcccgccaggcccaccagaagcucgccgccaucuccggccccgaggacggcgagauccaccccgagaucugccgccucuacauccagcuccagugcugccucgagauguacaccaccgagaugcucaaguccaucugccuccucggcucccuccaguuccaccgcaagggcaaggagcccggcggcggcaccaagucccucgacugcaagaucgaggaguccgccgagacccccgcccucgaggacuccuccuccucccccgucgacucccagcagcacuccuggcaggucuccaccgacaucgagaacaccgagcgcgacaugcgcgagaugaagaaccuccucuccaagcuccgcgagaccaugccccucccccucaagaaccaggacgacuccucccuccucaaccucacccccuacccccucguccgccgccgcaagcgccgcuucuucggccucugcugccucaucuccuccuga

SEQ ID NO: 48732 - RNA, 1275 nt, Artificial Sequence
  derived and/or modified sequence opt2 from RGS7__Homo_sapiens__NP_001269702
auggcccagggcaacaacuacggccagaccuccaacggcgucgccgacgagucccccaacaugcucgucuaccgcaagauggaggacgucaucgcccgcaugcaggacgagaagaacggcauccccauccgcaccgucaaguccuuccucuccaagauccccuccgucuucuccggcuccgacaucguccaguggcucaucaagaaccucaccaucgaggaccccgccgucuaccucugcaagcgcaccaugcagaacaaggcccgccucgagcucgccgacuacgaggccgagucccucgcccgccuccagcgcgccuucgcccgcaagugggaguucaucuucaugcaggccgaggcccaggccaaggucgacaagaagcgcgacaagaucgagcgcaagauccucgacucccaggagcgcgccuucugggacguccaccgccccguccccggcugcgucaacaccaccgaggucgacaucaagaaguccucccgcaugcgcaacccccacaagacccgcaaguccgucuacggccuccagaacgacauccgcucccacucccccacccacacccccacccccgagaccaagccccccaccgaggacgagcuccagcagcagaucaaguacuggcagauccagcucgaccgccaccgccucaagauguccaaggucgccgacucccuccucuccuacaccgagcaguaccucgaguacgaccccuuccuccucccccccgaccccuccaaccccuggcucuccgacgacaccaccuucugggagcucgaggccuccaaggagcccucccagcagcgcgucaagcgcuggggcuucggcauggacgaggcccucaaggaccccgucggccgcgagcaguuccucaaguuccucgaguccgaguucuccuccgagaaccuccgcuucuggcucgccgucgaggaccucaagaagcgccccaucaaggagguccccucccgcguccaggagaucuggcaggaguuccucgcccccggcgcccccuccgccaucaaccucgacuccaaguccuacgacaagaccacccagaacgucaaggagcccggccgcuacaccuucgaggacgcccaggagcacaucuacaagcucaugaaguccgacuccuacccccgcuucauccgcuccuccgccuaccaggagcuccuccaggccaagaagaagggccgcaacauccccaucuuccccugccacaagaacugcacccccacccuccgcgccuccaccaaccuccucuga

SEQ ID NO: 48733 - RNA, 543 nt, Artificial Sequence
  derived and/or modified sequence opt2 from RGS8__Homo_sapiens__XP_005245612
auggccgcccuccucaugccccgccgcaacaagggcaugcgcacccgccucggcugccucucccacaaguccgacuccugcuccgacuucaccgccauccuccccgacaagcccaaccgcgcccucaagcgccucuccaccgaggaggccacccgcugggccgacuccuucgacguccuccucucccacaaguacggcgucgccgccuuccgcgccuuccucaagaccgaguucuccgaggagaaccucgaguucuggcucgccugcgaggaguucaagaagacccgcuccaccgccaagcucgucuccaaggcccaccgcaucuucgaggaguucgucgacguccaggccccccgcgaggucaacaucgacuuccagacccgcgaggccacccgcaagaaccuccaggagcccucccucaccugcuucgaccaggcccagggcaagguccacucccucauggagaaggacuccuacccccgcuuccuccgcuccaagauguaccucgaccuccucucccagucccagcgccgccucuccuga

SEQ ID NO: 48734 - RNA, 708 nt, Artificial Sequence
  derived and/or modified sequence opt2 from RGS9BP__Homo_sapiens__NP_997274
auggcccgcgaggagugcaaggcccuccucgacggccucaacaagaccaccgccugcuaccaccaccucguccucaccgucggcggcuccgccgacucccagaaccuccgccaggagcuccagaagacccgccagaaggcccaggagcucgccgucuccaccugcgcccgccucaccgccguccuccgcgaccgcggccucgccgccgacgagcgcgccgaguucgagcgccucugggucgccuucuccggcugccucgaccuccucgaggccgacaugcgccgcgcccucgagcucggcgccgccuucccccuccacgccccccgccgcccccucguccgcaccggcgucgccggcgccuccuccggcgucgccgcccgcgcccucuccacccgcucccuccgccucgaggccgagggcgacuucgacgucgccgaccuccgcgagcucgagcgcgagguccuccaggucggcgagaugaucgacaacauggagaugaaggucaacgucccccgcuggaccguccaggcccgccaggccgccggcgccgagcuccucuccaccgucuccgccggccccuccuccgucgucucccuccaggagcgcggcggcggcugcgacccccgcaaggcccucgccgccauccucuucggcgccguccuccucgccgccgucgcccucgccgucugcgucgccaagcucuccuga

SEQ ID NO: 48735 - RNA, 2016 nt, Artificial Sequence
  derived and/or modified sequence opt2 from RGS9__Homo_sapiens__NP_001075424
augaccauccgccaccagggccagcaguaccgcccccgcauggccuuccuccagaagaucgaggcccucgucaaggacaugcagaaccccgagaccggcguccgcaugcagaaccagcgcguccucgucaccuccgucccccacgccaugaccggcuccgacguccuccaguggaucguccagcgccucuggaucuccucccucgaggcccagaaccucggcaacuucaucguccgcuacggcuacaucuacccccuccaggaccccaagaaccucauccucaagcccgacggcucccucuaccgcuuccagacccccuacuucuggcccacccagcaguggcccgccgaggacaccgacuacgccaucuaccucgccaagcgcaacaucaagaagaagggcauccucgaggaguacgagaaggagaacuacaacuuccucaaccagaagaugaacuacaagugggacuucgucaucaugcaggccaaggagcaguaccgcgccggcaaggagcgcaacaaggccgaccgcuacgcccucgacugccaggagaaggccuacuggcucguccaccgcugcccccccggcauggacaacguccucgacuacggccucgaccgcgucaccaaccccaacgaggucaagaagcagaccgucgucgccgucaagaaggagaucauguacuaccagcaggcccucaugcgcuccaccgucaaguccuccgucucccucggcggcaucgucaaguacuccgagcaguucuccuccaacgacgccaucauguccggcugccuccccuccaaccccuggaucaccgacgacacccaguucugggaccucaacgccaagcucgucgagauccccaccaagaugcgcgucgagcgcugggccuucaacuucuccgagcucauccgcgaccccaagggccgccaguccuuccaguacuuccucaagaaggaguucuccggcgagaaccucggcuucugggaggccugcgaggaccucaaguacggcgaccaguccaaggucaaggagaaggccgaggagaucuacaagcucuuccucgcccccggcgcccgccgcuggaucaacaucgacggcaagaccauggacaucaccgucaagggccucaagcacccccaccgcuacguccucgacgccgcccagacccacaucuacaugcucaugaagaaggacuccuacgcccgcuaccucaagucccccaucuacaaggacaugcucgccaaggccaucgagccccaggagaccaccaagaaguccuccacccuccccuucaugcgccgccaccuccgcuccucccccucccccgucauccuccgccagcucgaggaggaggccaaggcccgcgaggccgccaacaccgucgacaucacccagcccggccagcacauggcccccuccccccaccucaccgucuacaccggcaccugcaugccccccucccccuccucccccuucuccuccuccugccgcuccccccgcaagcccuucgccucccccucccgcuucauccgccgccccuccaccaccaucugccccucccccauccgcgucgcccucgaguccuccuccggccucgagcagaagggcgagugcuccggcuccauggccccccgcggccccuccgucaccgaguccuccgaggccucccucgacaccuccuggccccgcucccgcccccgcgccccccccaaggcccgcauggcccucuccuucucccgcuuccuccgccgcggcugccucgccucccccgucuucgcccgccucucccccaagugccccgccgucucccacggccgcguccagccccucggcgacgucggccagcagcucccccgccucaaguccaagcgcgucgccaacuucuuccagaucaagauggacguccccaccggcuccggcaccugccucauggacuccgaggacgccggcaccggcgaguccggcgaccgcgccaccgagaaggaggucaucugccccugggagucccucuga

SEQ ID NO: 48736 - RNA, 3231 nt, Artificial Sequence
  derived and/or modified sequence opt2 from RGSL1__Homo_sapiens__NP_001131141
auguccuccgccgagaucaucggcuccaccaaccucaucauccuccucgaggacgaggucuucgccgacuucuucaacaccuuccucucccuccccgucuucggccagacccccuucuacaccgucgagaacucccaguggucccucuggcccgagauccccugcaaccucaucgccaaguacaagggccuccucaccuggcucgagaagugccgccuccccuucuucugcaagaccaaccucugcuuccacuacauccucugccaggaguucaucuccuucaucaagucccccgagggcggcgaggagcucgucgacuucuggauccucgccgagaacauccucuccaucgacgagauggaccucgagguccgcgacuacuaccucucccuccuccucaugcuccgcgccacccaccuccaggagggcucccgcgucgucacccucugcaacaugaacaucaagucccuccucaaccucuccaucuggcaccccaaccaguccaccacccgccgcgagauccucucccacaugcagaaggucgcccucuucaagcuccaguccuacuggcuccccaacuucuacacccacaccaagaugaccauggccaaggaggaggccugccacggccucaugcaggaguacgagacccgccucuacuccgucugcuacacccacaucggcggccucccccucaacauguccaucaagaagugccaccacuuccagaagcgcuacuccucccgcaaggccaagcgcaagauguggcagcucgucgaccccgacuccuggucccucgagauggaccucaagcccgacgccaucggcaugccccuccaggagaccugcccccaggagaaggucgucauccagaugcccucccucaagauggccuccuccaaggagacccgcaucuccucccucgagaaggacaugcacuacgccaagaucuccuccauggagaacaaggccaagucccaccuccacauggaggcccccuucgagaccaaggucuccacccaccuccgcaccgucauccccaucgucaaccacuccuccaagaugaccauccagaaggccaucaagcaguccuucucccucggcuacauccaccucgcccucugcgccgacgccugcgccggcaaccccuuccgcgaccaccucaagaagcucaaccucaaggucgagauccagcuccucgaccucuggcaggaccuccagcacuuccucuccguccuccucaacaacaagaagaacggcaacgccaucuuccgccaccuccucggcgaccgcaucugcgagcucuaccucaacgagcagaucggccccugccucccccucaagucccagaccauccagggccucaaggagcuccuccccuccggcgacgucauccccuggauccccaaggcccagaaggagaucugcaagaugcucucccccugguacgacgaguuccucgacgaggaggacuacugguuccuccucuucaccacccagaaccgcuucaucuccucccgccagcacaagcgcgaguucaucggcaaggaggagaacauccuccucuacaagcgcauccagcagucccucgagcucucccaggcccucgccgacaugaaggagauggacuaccgccaguggcgcaagaucgccaccgaggaccucaagcagggcggcucccuccaggucgagcucaccucccccgucuuccucaccgacaucaccaagauguccuucgaggagcucugcuacaagaaccccaagauggccauccagaagaucuccgacgacuacaagaucuacugcgagaaggcccccaagaucgacuucaagauggagaucaucaaggagaccaagaccgucucccgcuccaaccgcaagaugucccuccucaagcgcacccucguccgcaagcccuccaugcgcccccgcaaccucaccgagguccuccucaacacccagcaccucgaguucuuccgcgaguuccucaaggagcgcaaggccaagaucccccuccaguuccucaccgccguccagaagaucuccaucgagaccaacgagaagaucugcaagucccucaucgagaacgucaucaagaccuucuuccagggccagcucucccccgaggagaugcuccagugcgacgcccccaucaucaaggagaucgccuccaugcgccacgucaccaccuccacccuccucacccuccagggccacgucaugaaguccaucgaggagaagugguucaaggacuaccaggaccucuuccccccccaccaccaggaggucgagguccaguccgagguccagaucuccucccgcaagcccuccaagaucgucuccaccuaccuccaggagucccagaagaagggcuggaugcgcaugaucuccuucauccgcuccuucugcaaguaccgccgcuucaugcucaaccccuccaagcgccaggaguucgaggacuaccuccaccaggagaugcagaacuccaaggagaacuucaccaccgcccacaacaccuccggccgcuccgccccccccuccaccaacguccgcuccgccgaccaggagaacggcgagaucacccucgucaagcgccgcaucuucggccaccgcaucaucaccgucaacuucgccaucaacgaccucuacuucuucuccgagauggagaaguucaacgaccucgucuccuccgcccacaugcuccaggucaaccgcgccuacaacgagaacgacgucauccucaugcgcuccaagaugaacaucauccagaagcucuuccucaacuccgacaucccccccaagcuccgcgucaacguccccgaguuccagaaggacgccauccucgccgccaucaccgagggcuaccucgaccgcuccgucuuccacggcgccaucauguccgucuuccccgucgucauguacuucuggaagcgcuucugcuucuggaaggccacccgcuccuaccuccaguaccgcggcaagaaguucaaggaccgcaaguccccccccaaguccaccgacaaguaccccuucuccuccggcggcgacaacgccauccuccgcuucacccuccuccgcggcaucgaguggcuccagccccagcgcgaggccaucuccuccguccagaacuccuccuccuccaagcucacccagccccgccucgucgucuccgccaugcagcuccaccccguccagggccagaagcucuccuacaucaagaaggagaaguga

SEQ ID NO: 48737 - RNA, 1230 nt, Artificial Sequence
  derived and/or modified sequence opt2 from RHAG__Homo_sapiens__NP_000315
augcgcuucaccuucccccucauggccaucguccucgagaucgccaugaucguccucuucggccucuucgucgaguacgagaccgaccagaccguccucgagcagcucaacaucaccaagcccaccgacaugggcaucuucuucgagcucuacccccucuuccaggacguccacgucaugaucuucgucggcuucggcuuccucaugaccuuccucaagaaguacggcuucuccuccgucggcaucaaccuccucgucgccgcccucggccuccaguggggcaccaucguccagggcauccuccagucccagggccagaaguucaacaucggcaucaagaacaugaucaacgccgacuucuccgccgccaccguccucaucuccuucggcgccguccucggcaagaccucccccacccagaugcucaucaugaccauccucgagaucgucuucuucgcccacaacgaguaccucgucuccgagaucuucaaggccuccgacaucggcgccuccaugaccauccacgccuucggcgccuacuucggccucgccgucgccggcauccucuaccgcuccggccuccgcaagggccacgagaacgaggaguccgccuacuacuccgaccucuucgccaugaucggcacccucuuccucuggauguucuggcccuccuucaacuccgccaucgccgagcccggcgacaagcagugccgcgccaucgucaacaccuacuucucccucgccgccugcguccucaccgccuucgccuucuccucccucgucgagcaccgcggcaagcucaacaugguccacauccagaacgccacccucgccggcggcgucgccgucggcaccugcgccgacauggccauccaccccuucggcuccaugaucaucggcuccaucgccggcauggucuccguccucggcuacaaguuccucaccccccucuucaccaccaagcuccgcauccacgacaccugcggcguccacaaccuccacggccuccccggcgucgucggcggccucgccggcaucgucgccgucgccaugggcgccuccaacaccuccauggccaugcaggccgccgcccucggcuccuccaucggcaccgccgucgucggcggccucaugaccggccucauccucaagcucccccucuggggccagcccuccgaccagaacugcuacgacgacuccgucuacuggaagguccccaagacccgcuga

SEQ ID NO: 48738 - RNA, 1095 nt, Artificial Sequence
  derived and/or modified sequence opt2 from RHBDD2__Homo_sapiens__NP_001035546
auggccgccuccggccccggcugccgcuccuggugccucugccccgagguccccuccgccaccuucuucaccgcccuccucucccuccucgucuccggcccccgccucuuccuccuccagcagccccucgcccccuccggccucacccucaaguccgaggcccuccgcaacuggcaggucuaccgccucgucaccuacaucuucgucuacgagaaccccaucucccuccucugcggcgccaucaucaucuggcgcuucgccggcaacuucgagcgcaccgucggcaccguccgccacugcuucuucaccgucaucuucgccaucuucuccgccaucaucuuccucuccuucgaggccgucuccucccucuccaagcucggcgaggucgaggacgcccgcggcuucacccccgucgccuucgccaugcucggcgucaccaccguccgcucccgcaugcgccgcgcccucgucuucggcauggucguccccuccguccucguccccuggcuccuccucggcgccuccuggcucaucccccagaccuccuuccucuccaacgucugcggccucuccaucggccucgccuacggccucaccuacugcuacuccaucgaccucuccgagcgcgucgcccucaagcucgaccagaccuuccccuucucccucaugcgccgcaucuccgucuucaaguacgucuccggcuccuccgccgagcgccgcgccgcccagucccgcaagcucaaccccguccccggcuccuaccccacccaguccugccacccccaccucucccccucccaccccgucucccagacccagcacgccuccggccagaagcucgccuccuggcccuccugcacccccggccacaugcccacccucccccccuaccagcccgccuccggccucugcuacguccagaaccacuucggccccaaccccaccuccuccuccgucuaccccgccuccgccggcaccucccucggcauccagccccccacccccgucaacucccccggcaccgucuacuccggcgcccucggcacccccggcgccgccggcuccaaggaguccucccgcguccccaugcccuga

SEQ ID NO: 48739 - RNA, 1161 nt, Artificial Sequence
  derived and/or modified sequence opt2 from RHBDD3__Homo_sapiens__NP_036397
augcacgcccgcggcccccacggccagcucucccccgcccucccccucgccuccuccguccucaugcuccucauguccacccucuggcucgucggcgccggccccggccucguccucgcccccgagcuccuccucgaccccuggcagguccaccgccuccucacccacgcccucggccacaccgcccuccccggccuccuccucucccuccuccuccuccccaccgucggcuggcagcaggagugccaccucggcacccuccgcuuccuccacgccuccgcccuccucgcccucgccuccggccuccucgccguccuccucgccggccucggccucuccuccgccgccggcuccugcggcuacaugcccguccaccucgccaugcucgccggcgagggccaccgcccccgccgcccccgcggcgcccucccccccuggcucucccccuggcuccuccucgcccucaccccccuccucuccuccgagccccccuuccuccagcuccucugcggccuccucgccggccucgccuacgccgccggcgccuuccgcuggcucgagcccuccgagcgccgccuccagguccuccaggagggcguccucugccgcacccucgccggcugcuggccccuccgccuccucgccacccccggcucccucgccgagcuccccgucacccaccccgccggcguccgcccccccauccccggcccccccuacgucgccucccccgaccucuggucccacugggaggacuccgcccuccccccccccucccuccgccccguccagcccaccugggagggcuccuccgaggccggccucgacugggccggcgccuccuucucccccggcacccccaugugggccgcccucgacgagcagaugcuccaggagggcauccaggccucccuccucgacggccccgcccaggagccccaguccgcccccuggcucuccaaguccuccgucuccucccuccgccuccagcagcucgagcgcaugggcuuccccaccgagcaggccgucgucgcccucgccgccaccggccgcgucgagggcgccgucucccuccucgucggcggccaggucggcaccgagacccucgucacccacggcaagggcggccccgcccacuccgagggccccggcccccccuga

SEQ ID NO: 48740 - RNA, 2568 nt, Artificial Sequence
  derived and/or modified sequence opt2 from RHBDF1__Homo_sapiens__NP_071895
auguccgaggcccgccgcgacuccaccuccucccuccagcgcaagaagccccccuggcucaagcucgacauccccuccgccgucccccucaccgccgaggagcccuccuuccuccagccccuccgccgccaggccuuccuccgcuccgucuccaugcccgccgagaccgcccacaucuccuccccccaccacgagcuccgccgccccguccuccagcgccagaccuccaucacccagaccauccgccgcggcaccgccgacugguucggcgucuccaaggacuccgacuccacccagaaguggcagcgcaaguccauccgccacugcucccagcgcuacggcaagcucaagccccagguccuccgcgagcucgaccuccccucccaggacaacgucucccucaccuccaccgagaccccccccccccucuacgucggccccugccagcucggcaugcagaagaucaucgacccccucgcccgcggccgcgccuuccgcgucgccgacgacaccgccgagggccucuccgccccccacacccccgucacccccggcgccgccucccucugcuccuucuccuccucccgcuccggcuuccaccgccucccccgccgccgcaagcgcgaguccgucgccaagauguccuuccgcgccgccgccgcccucaugaagggccgcuccguccgcgacggcaccuuccgccgcgcccagcgccgcuccuucacccccgccuccuuccucgaggaggacaccaccgacuuccccgacgagcucgacaccuccuucuucgcccgcgagggcauccuccacgaggagcucuccaccuaccccgacgaggucuucgagucccccuccgaggccgcccucaaggacugggagaaggcccccgagcaggccgaccucaccggcggcgcccucgaccgcuccgagcucgagcgcucccaccucaugcucccccucgagcgcggcuggcgcaagcagaaggagggcgccgccgccccccagcccaagguccgccuccgccaggaggucgucuccaccgccggcccccgccgcggccagcgcaucgccguccccguccgcaagcucuucgcccgcgagaagcgccccuacggccucggcauggucggccgccucaccaaccgcaccuaccgcaagcgcaucgacuccuucgucaagcgccagaucgaggacauggacgaccaccgccccuucuucaccuacuggcucaccuucguccacucccucgucaccauccucgccgucugcaucuacggcaucgcccccgucggcuucucccagcacgagaccgucgacuccguccuccgcaaccgcggcgucuacgagaacgucaaguacguccagcaggagaacuucuggaucggccccuccuccgaggcccucauccaccucggcgccaaguucucccccugcaugcgccaggacccccagguccacuccuucauccgcuccgcccgcgagcgcgagaagcacuccgccugcugcguccgcaacgaccgcuccggcugcguccagaccuccgaggaggagugcuccuccacccucgccgucugggucaaguggcccauccaccccuccgcccccgagcucgccggccacaagcgccaguucggcuccgucugccaccaggacccccgcgucugcgacgagcccuccuccgaggacccccacgaguggcccgaggacaucaccaaguggcccaucugcaccaagaacuccgccggcaaccacaccaaccacccccacauggacugcgucaucaccggccgccccugcugcaucggcaccaagggccgcugcgagaucaccucccgcgaguacugcgacuucaugcgcggcuacuuccacgaggaggccacccucugcucccagguccacugcauggacgacgucugcggccuccuccccuuccucaaccccgagguccccgaccaguucuaccgccucuggcucucccucuuccuccacgccggcauccuccacugccucgucuccaucugcuuccagaugaccguccuccgcgaccucgagaagcucgccggcuggcaccgcaucgccaucaucuaccuccucuccggcgucaccggcaaccucgccuccgccaucuuccuccccuaccgcgccgaggucggccccgccggcucccaguucggcauccucgccugccucuucgucgagcucuuccaguccuggcagauccucgcccgccccuggcgcgccuucuucaagcuccucgccgucguccucuuccucuucaccuucggccuccuccccuggaucgacaacuucgcccacaucuccggcuucaucuccggccucuuccucuccuucgccuuccuccccuacaucuccuucggcaaguucgaccucuaccgcaagcgcugccagaucaucaucuuccaggucgucuuccucggccuccucgccggccucgucguccucuucuacgucuaccccguccgcugcgaguggugcgaguuccucaccugcauccccuucaccgacaaguucugcgagaaguacgagcucgacgcccagcuccacuga

SEQ ID NO: 48741 - RNA, 2484 nt, Artificial Sequence
  derived and/or modified sequence opt2 from RHBDF2__Homo_sapiens__NP_001005498
auggccuccgccgacaagaacggcggcuccgucuccuccgucuccuccucccgccuccagucccgcaagccccccaaccucuccaucaccauccccccccccgagaaggagacccaggcccccggcgagcaggacuccaugcuccccgagcgcaagaaccccgccuaccucaaguccgucucccuccaggagccccgcucccgcuggcaggaguccuccgagaagcgccccggcuuccgccgccaggccucccucucccaguccauccgcaagggcgccgcccagugguucggcgucuccggcgacugggagggccagcgccagcaguggcagcgccgcucccuccaccacugcuccaugcgcuacggccgccucaaggccuccugccagcgcgaccucgagcuccccucccaggaggcccccuccuuccagggcaccgagucccccaagcccugcaagaugcccaagaucgucgacccccucgcccgcggccgcgccuuccgccaccccgaggagauggaccgcccccacgccccccaccccccccucacccccggcguccucucccucaccuccuucaccuccguccgcuccggcuacucccaccucccccgccgcaagcgcauguccgucgcccacaugucccuccaggccgccgccgcccuccucaagggccgcuccguccucgacgccaccggccagcgcugccgcgucgucaagcgcuccuucgccuuccccuccuuccucgaggaggacgucgucgacggcgccgacaccuucgacuccuccuucuucuccaaggaggagauguccuccaugcccgacgacgucuucgagucccccccccucuccgccuccuacuuccgcggcaucccccacuccgccucccccgucucccccgacggcguccagaucccccucaaggaguacggccgcgcccccguccccggcccccgccgcggcaagcgcaucgccuccaaggucaagcacuucgccuucgaccgcaagaagcgccacuacggccucggcgucgucggcaacuggcucaaccgcuccuaccgccgcuccaucuccuccaccguccagcgccagcucgaguccuucgacucccaccgccccuacuucaccuacuggcucaccuucguccacgucaucaucacccuccucgucaucugcaccuacggcaucgcccccgucggcuucgcccagcacgucaccacccagcucguccuccgcaacaagggcgucuacgaguccgucaaguacauccagcaggagaacuucugggucggccccuccuccaucgaccucauccaccucggcgccaaguucucccccugcauccgcaaggacggccagaucgagcagcucguccuccgcgagcgcgaccucgagcgcgacuccggcugcugcguccagaacgaccacuccggcugcauccagacccagcgcaaggacugcuccgagacccucgccaccuucgucaaguggcaggacgacaccggcccccccauggacaaguccgaccucggccagaagcgcaccuccggcgccgucugccaccaggacccccgcaccugcgaggagcccgccuccuccggcgcccacaucuggcccgacgacaucaccaaguggcccaucugcaccgagcaggcccgcuccaaccacaccggcuuccuccacauggacugcgagaucaagggccgccccugcugcaucggcaccaagggcuccugcgagaucaccacccgcgaguacugcgaguucaugcacggcuacuuccacgaggaggccacccucugcucccagguccacugccucgacaaggucugcggccuccuccccuuccucaaccccgagguccccgaccaguucuaccgccucuggcucucccucuuccuccacgccggcgucguccacugccucgucuccgucgucuuccagaugaccauccuccgcgaccucgagaagcucgccggcuggcaccgcaucgccaucaucuucauccucuccggcaucaccggcaaccucgccuccgccaucuuccuccccuaccgcgccgaggucggccccgccggcucccaguucggccuccucgccugccucuucgucgagcucuuccaguccuggccccuccucgagcgccccuggaaggccuuccucaaccucuccgccaucguccucuuccucuucaucugcggccuccuccccuggaucgacaacaucgcccacaucuucggcuuccucuccggccuccuccucgccuucgccuuccuccccuacaucaccuucggcaccuccgacaaguaccgcaagcgcgcccucauccucgucucccuccucgccuucgccggccucuucgccgcccucguccucuggcucuacaucuaccccaucaacuggcccuggaucgagcaccucaccugcuuccccuucaccucccgcuucugcgagaaguacgagcucgaccagguccuccacuga

SEQ ID NO: 48742 - RNA, 1122 nt, Artificial Sequence
  derived and/or modified sequence opt2 from RHBDL1__Homo_sapiens__NP_001265649
auggaccgcuccucccuccuccagcucauccaggagcagcagcucgaccccgagaacaccggcuucaucggcgccgacaccuucaccggccucguccacucccacgagcucccccucgaccccgccaagcucgacaugcucgucgcccucgcccaguccaacgagcagggccaggucugcuaccaggagcucgucgaccucaucuccuccaagcgcuccuccuccuucaagcgcgccaucgccaacggccagcgcgcccucccccgcgacggcccccucgacgagcccggccucggcgucuacaagcgcuucguccgcuacgucgccuacgagauccuccccugcgaggucgaccgccgcugguacuucuaccgccaccgcuccugccccccccccgucuucauggccuccgucacccucgcccagaucaucgucuuccucugcuacggcgcccgccucaacaaguggguccuccagaccuaccaccccgaguacaugaaguccccccucgucuaccaccccggccaccgcgcccgcgccuggcgcuuccucaccuacauguucaugcacgucggccucgagcagcucggcuucaacgcccuccuccagcucaugaucggcgucccccucgagaugguccacggccuccuccgcaucucccuccucuaccucgccggcguccucgccggcucccucaccgucuccaucaccgacaugcgcgcccccgucgucggcggcuccggcggcgucuacgcccucugcuccgcccaccucgccaacgucgucaugaacugggccggcaugcgcugccccuacaagcuccuccgcaugguccucgcccucgucugcauguccuccgaggucggccgcgccgucuggcuccgcuucucccccccccuccccgccuccggcccccagcccuccuucauggcccaccucgccggcgccgucgucggcgucuccaugggccucaccauccuccgcuccuacgaggagcgccuccgcgaccagugcggcuggugggucguccuccucgccuacggcaccuuccuccucuucgccgucuucuggaacgucuucgccuacgaccuccucggcgcccacaucccccccccccccuga

SEQ ID NO: 48743 - RNA, 1152 nt, Artificial Sequence
  derived and/or modified sequence opt2 from RHBDL2__Homo_sapiens__NP_001291675
augcagcucggcaagcgccacaagcucaccaccaaguccgucugccacggcaagggcgucgucauccgcguccucgcccuccccggccccuccuggguccgccgccgccgcgagggcaaggcccucgaguccucccgcugcgcccgccagccccgcgaggagcgccagcccgaggaccucggcccccccgccguccccugggacuccugccccuccggcgaggagggcggcccccgcaccauggccgccguccacgaccucgagauggaguccaugaaccucaacaugggccgcgagaugaaggaggagcucgaggaggaggagaagaugcgcgaggacggcggcggcaaggaccgcgccaaguccaagaagguccaccgcaucgucuccaaguggaugcuccccgagaagucccgcggcaccuaccucgagcgcgccaacugcuuccccccccccgucuucaucaucuccaucucccucgccgagcucgccgucuucaucuacuacgccgucuggaagccccagaagcaguggaucacccucgacaccggcauccucgagucccccuucaucuacucccccgagaagcgcgaggaggccuggcgcuucaucuccuacaugcucguccacgccggcguccagcacauccucggcaaccucugcaugcagcucguccucggcaucccccucgagaugguccacaagggccuccgcgucggccucgucuaccucgccggcgucaucgccggcucccucgccuccuccaucuucgacccccuccgcuaccucgucggcgccuccggcggcgucuacgcccucaugggcggcuacuucaugaacguccucgucaacuuccaggagaugauccccgccuucggcaucuuccgccuccucaucaucauccucaucaucguccucgacaugggcuucgcccucuaccgccgcuucuucguccccgaggacggcucccccgucuccuucgccgcccacaucgccggcggcuucgccggcauguccaucggcuacaccgucuucuccugcuucgacaaggcccuccucaaggacccccgcuucuggaucgccaucgccgccuaccucgccugcguccucuucgccgucuucuucaacaucuuccucucccccgccaacuga

SEQ ID NO: 48744 - RNA, 1125 nt, Artificial Sequence
  derived and/or modified sequence opt2 from RHCE__Homo_sapiens__XP_011540191
augcccggcaccguccucgucggccaggaccucaccgucauggccgcccucggccucggcuuccucaccuccaacuuccgccgccacuccugguccuccgucgccuucaaccucuucaugcucgcccucggcguccagugggccauccuccucgacggcuuccucucccaguucccccccggcaaggucgucaucacccucuucuccauccgccucgccaccauguccgccauguccguccucaucuccgccggcgccguccucggcaaggucaaccucgcccagcucgucgucaugguccucgucgaggucaccgcccucggcacccuccgcauggucaucuccaacaucuucaacaccgacuaccacaugaaccuccgccacuucuacgucuucgccgccuacuucggccucaccgucgccuggugccuccccaagccccuccccaagggcaccgaggacaacgaccagcgcgccaccauccccucccucuccgccaugcucggcgcccucuuccucuggauguucuggcccuccgucaacuccgcccuccuccgcucccccauccagcgcaagaacgccauguucaacaccuacuacgcccucgccgucuccgucgucaccgccaucuccggcuccucccucgcccacccccagcgcaagaucuccaugaccuacguccacuccgccguccucgccggcggcgucgccgucggcaccuccugccaccucauccccucccccuggcucgccaugguccucggccucgucgccggccucaucuccaucggcggcgccaagugccuccccgucugcugcaaccgcguccucggcauccaccacaucuccgucaugcacuccaucuucucccuccucggccuccucggcgagaucaccuacaucguccuccucguccuccacaccgucuggaacggcaacggcaugaucggcuuccagguccuccucuccaucggcgagcucucccucgccaucgucaucgcccucaccuccggccuccucaccggccuccuccucaaccucaagaucuggaaggccccccacgucgccaaguacuucgacgaccaggucuucuggaaguucccccaccucgccgucggcuucuga

SEQ ID NO: 48745 - RNA, 1440 nt, Artificial Sequence
  derived and/or modified sequence opt2 from RHCG__Homo_sapiens__XP_011519965
auggccuggaacaccaaccuccgcuggcgccucccccucaccugccuccuccuccaggucaucauggucauccucuucggcgucuucguccgcuacgacuucgaggccgacgcccacuggugguccgagcgcacccacaagaaccucuccgacauggagaacgaguucuacuaccgcuaccccuccuuccaggacguccacgucauggucuucgucggcuucggcuuccucaugaccuuccuccagcgcuacggcuucuccgccgucggcuucaacuuccuccucgccgccuucggcauccagugggcccuccucaugcagggcugguuccacuuccuccaggaccgcuacaucgucgucggcgucgagaaccucaucaacgccgacuucugcgucgccuccgucugcgucgccuucggcgccguccucggcaaggucucccccauccagcuccucaucaugaccuucuuccaggucacccucuucgccgucaacgaguucauccuccucaaccuccucaaggucaaggacgccggcggcuccaugaccauccacaccuucggcgccuacuucggccucaccgucacccgcauccucuaccgccgcaaccucgagcaguccaaggagcgccagaacuccgucuaccaguccgaccucuucgccaugaucggcacccucuuccucuggauguacuggcccuccuucaacuccgccaucuccuaccacggcgacucccagcaccgcgccgccaucaacaccuacugcucccucgccgccugcguccucaccuccgucgccaucuccuccgcccuccacaagaagggcaagcucgacaugguccacauccagaacgccacccucgccggcggcgucgccgucggcaccgccgccgagaugaugcucaugcccuacggcgcccucaucaucggcuucgucugcggcaucaucuccacccucggcuucgucuaccucacccccuuccucgagucccgccuccacauccaggacaccugcggcaucaacaaccuccacggcauccccggcaucaucggcggcaucgucggcgccgucaccgccgccuccgccucccucgaggucuacggcaaggagggccucguccacuccuucgacuuccagggcuucaacggcgacuggaccgcccgcacccagggcaaguuccagaucuacggccuccucgucacccucgccauggcccucaugggcggcaucaucgucggccucauccuccgccuccccuucuggggccagcccuccgacgagaacugcuucgaggacgccgucuacugggagaugcccgagggcaacuccaccgucuacauccccgaggaccccaccuucaagcccuccggccccuccguccccuccguccccauggucuccccccuccccauggccuccuccgucccccucguccccuga

SEQ ID NO: 48746 - RNA, 555 nt, Artificial Sequence
  derived and/or modified sequence opt2 from RHEB__Homo_sapiens__NP_005605
augccccaguccaagucccgcaagaucgccauccucggcuaccgcuccgucggcaaguccucccucaccauccaguucgucgagggccaguucgucgacuccuacgaccccaccaucgagaacaccuucaccaagcucaucaccgucaacggccaggaguaccaccuccagcucgucgacaccgccggccaggacgaguacuccaucuucccccagaccuacuccaucgacaucaacggcuacauccucgucuacuccgucaccuccaucaaguccuucgaggucaucaaggucauccacggcaagcuccucgacauggucggcaagguccagauccccaucaugcucgucggcaacaagaaggaccuccacauggagcgcgucaucuccuacgaggagggcaaggcccucgccgaguccuggaacgccgccuuccucgaguccuccgccaaggagaaccagaccgccgucgacgucuuccgccgcaucauccucgaggccgagaagauggacggcgccgccucccagggcaaguccuccugcuccgucauguga

SEQ ID NO: 48747 - RNA, 552 nt, Artificial Sequence
  derived and/or modified sequence opt2 from RHEBL1__Homo_sapiens__NP_653194
augccccucguccgcuaccgcaaggucgucauccucggcuaccgcugcgucggcaagaccucccucgcccaccaguucgucgagggcgaguucuccgagggcuacgaccccaccgucgagaacaccuacuccaagaucgucacccucggcaaggacgaguuccaccuccaccucgucgacaccgccggccaggacgaguacuccauccuccccuacuccuucaucaucggcguccacggcuacguccucgucuacuccgucaccucccuccacuccuuccaggucaucgagucccucuaccagaagcuccacgagggccacggcaagacccgcguccccgucguccucgucggcaacaaggccgaccucucccccgagcgcgagguccaggccgucgagggcaagaagcucgccgaguccuggggcgccaccuucauggaguccuccgcccgcgagaaccagcucacccagggcaucuucaccaaggucauccaggagaucgcccgcgucgagaacuccuacggccaggagcgccgcugccaccucauguga

SEQ ID NO: 48748 - RNA, 717 nt, Artificial Sequence
  derived and/or modified sequence opt2 from RHNO1__Homo_sapiens__NP_001239428
augcccccccgcaagaagcgccgccagcccucccagaaggccccccuccucuuccaccagcagccccucgagggccccaagcacuccugcgccuccacccagcuccccaucacccacacccgccagguccccuccaagcccaucgaccacuccaccaucaccuccugggucucccccgacuucgacaccgccgccggcucccucuuccccgccuaccagaagcaccagaaccgcgcccgccacuccucccgcaagcccaccaccuccaaguucccccaccucaccuucgaguccccccaguccuccuccuccgagacccucggcaucccccucauccgcgagugccccuccgaguccgagaaggacgucucccgccgcccccucguccccguccucuccccccaguccugcggcaacauguccguccaggcccuccagucccuccccuacgucuucaucccccccgacauccagacccccgaguccuccuccgucaaggaggagcucaucccccaggaccagaaggagaacucccuccucuccugcacccuccacaccggcacccccaacucccccgagcccggccccguccucgucaaggacacccccgaggacaaguacggcaucaaggucaccuggcgccgccgccagcaccuccucgccuaccuccgcgagcgcggcaagcucucccgcucccaguuccucgucaaguccuga

SEQ ID NO: 48749 - RNA, 591 nt, Artificial Sequence
  derived and/or modified sequence opt2 from RHOB__Homo_sapiens__NP_004031
auggccgccauccgcaagaagcucgucgucgucggcgacggcgccugcggcaagaccugccuccucaucgucuucuccaaggacgaguuccccgaggucuacguccccaccgucuucgagaacuacgucgccgacaucgaggucgacggcaagcaggucgagcucgcccucugggacaccgccggccaggaggacuacgaccgccuccgcccccucuccuaccccgacaccgacgucauccucaugugcuucuccgucgacucccccgacucccucgagaacauccccgagaaguggguccccgaggucaagcacuucugccccaacguccccaucauccucgucgccaacaagaaggaccuccgcuccgacgagcacguccgcaccgagcucgcccgcaugaagcaggagcccguccgcaccgacgacggccgcgccauggccguccgcauccaggccuacgacuaccucgagugcuccgccaagaccaaggagggcguccgcgaggucuucgagaccgccacccgcgccgcccuccagaagcgcuacggcucccagaacggcugcaucaacugcugcaagguccucuga

SEQ ID NO: 48750 - RNA, 2091 nt, Artificial Sequence
  derived and/or modified sequence opt2 from RHOBTB1__Homo_sapiens__XP_011538726
auggacgccgacauggacuacgagcgccccaacgucgagaccaucaagugcgucgucgucggcgacaacgccgucggcaagacccgccucaucugcgcccgcgccugcaacaccacccucacccaguaccagcuccucgccacccacguccccaccgucugggccaucgaccaguaccgcgucugccaggagguccucgagcgcucccgcgacgucgucgacgaggucuccgucucccuccgccucugggacaccuucggcgaccaccacaaggaccgccgcuucgccuacggccgcuccgacgucgucguccucugcuucuccaucgccaaccccaacucccucaaccacgucaaguccaugugguaccccgagaucaagcacuucugcccccgcacccccgucauccucgucggcugccagcucgaccuccgcuacgccgaccucgaggccgucaaccgcgcccgccgcccccucgcccgccccaucaagcgcggcgacauccucccccccgagaagggccgcgaggucgccaaggagcucggccuccccuacuacgagaccuccgucuucgaccaguucggcaucaaggacgucuucgacaacgccauccgcgccgcccucaucucccgccgccaccuccaguucuggaagucccaccucaagaagguccagaagccccuccuccaggcccccuuccucccccccaaggcccccccccccgucaucaagauccccgagugccccuccaugggcaccaacgaggccgccugccuccucgacaacccccucugcgccgacguccucuucauccuccaggaccaggagcacaucuucgcccaccgcaucuaccucgccaccuccuccuccaaguucuacgaccucuuccucauggagugcgaggagucccccaacggcuccgagggcgccugcgagaaggagaagcagucccgcgacuuccagggccgcauccucuccgucgaccccgaggaggagcgcgaggagggccccccccgcaucccccaggccgaccaguggaaguccuccaacaagucccucgucgaggcccucggccucgaggccgagggcgccguccccgagacccagacccucaccggcugguccaagggcuucaucggcaugcaccgcgagaugcaggucaaccccaucuccaagcgcaugggccccaugaccgucguccgcauggacgccuccguccagcccggccccuuccgcacccuccuccaguuccucuacaccggccagcucgacgagaaggagaaggaccucgucggccucgcccagaucgccgagguccucgagauguucgaccuccgcaugauggucgagaacaucaugaacaaggaggccuucaugaaccaggagaucaccaaggccuuccacguccgcaaggccaaccgcaucaaggagugccucuccaagggcaccuucuccgacgucaccuucaagcucgacgacggcgccaucuccgcccacaagccccuccucaucugcuccugcgaguggauggccgccauguucggcggcuccuucgucgaguccgccaacuccgaggucuaccuccccaacaucaacaagaucuccaugcaggccguccucgacuaccucuacaccaagcagcucucccccaaccucgaccucgacccccucgagcucaucgcccucgccaaccgcuucugccucccccaccucgucgcccucgccgagcagcacgccguccaggagcucaccaaggccgccaccuccggcgucggcaucgacggcgagguccucuccuaccucgagcucgcccaguuccacaacgcccaccagcucgccgccuggugccuccaccacaucugcaccaacuacaacuccgucugcuccaaguuccgcaaggagaucaaguccaaguccgccgacaaccaggaguacuucgagcgccaccgcuggccccccgucugguaccucaaggaggaggaccacuaccagcgcgucaagcgcgagcgcgagaaggaggacaucgcccucaacaagcaccgcucccgccgcaaguggugcuucuggaacuccucccccgccgucgccuga

SEQ ID NO: 48751 - RNA, 2250 nt, Artificial Sequence
  derived and/or modified sequence opt2 from RHOBTB2__Homo_sapiens__NP_001153508
augcaggccuggcgcaagggccccgacggcccccagaagaccuccuccgacuccaugucccgccucauggacuccgacauggacuacgagcgccccaacgucgagaccaucaagugcgucgucgucggcgacaacgccgucggcaagacccgccucaucugcgcccgcgccugcaacgccacccucacccaguaccagcuccucgccacccacguccccaccgucugggccaucgaccaguaccgcgucugccaggagguccucgagcgcucccgcgacgucgucgacgacgucuccgucucccuccgccucugggacaccuucggcgaccaccacaaggaccgccgcuucgccuacggccgcuccgacgucgucguccucugcuucuccaucgccaaccccaacucccuccaccacgucaagaccaugugguaccccgagaucaagcacuucugcccccgcgcccccgucauccucgucggcugccagcucgaccuccgcuacgccgaccucgaggccgucaaccgcgcccgccgcccccucgcccgccccaucaagcccaacgagauccucccccccgagaagggccgcgaggucgccaaggagcucggcauccccuacuacgagaccuccgucgucgcccaguucggcaucaaggacgucuucgacaacgccauccgcgccgcccucaucucccgccgccaccuccaguucuggaagucccaccuccgcaacguccagcgcccccuccuccaggcccccuuccucccccccaagccccccccccccaucaucgucguccccgacccccccuccuccuccgaggagugccccgcccaccuccucgaggacccccucugcgccgacgucauccucguccuccaggagcgcguccgcaucuucgcccacaagaucuaccucuccaccuccuccuccaaguucuacgaccucuuccucauggaccucuccgagggcgagcucggcggccccuccgagcccggcggcacccaccccgaggaccaccagggccacuccgaccagcaccaccaccaccaccaccaccaccacggccgcgacuuccuccuccgcgccgccuccuucgacgucugcgaguccgucgacgaggccggcggcuccggccccgccggccuccgcgccuccaccuccgacggcauccuccgcggcaacggcaccggcuaccuccccggccgcggccgcguccucuccuccuggucccgcgccuucgucuccauccaggaggagauggccgaggacccccucaccuacaagucccgccucauggucgucgucaagauggacuccuccauccagcccggccccuuccgcgccguccucaaguaccucuacaccggcgagcucgacgagaacgagcgcgaccucaugcacaucgcccacaucgccgagcuccucgaggucuucgaccuccgcaugauggucgccaacauccucaacaacgaggccuucaugaaccaggagaucaccaaggccuuccacguccgccgcaccaaccgcgucaaggagugccucgccaagggcaccuucuccgacgucaccuucauccucgacgacggcaccaucuccgcccacaagccccuccucaucuccuccugcgacuggauggccgccauguucggcggccccuucgucgaguccuccacccgcgaggucgucuuccccuacaccuccaaguccugcaugcgcgccguccucgaguaccucuacaccggcauguucaccuccucccccgaccucgacgacaugaagcucaucauccucgccaaccgccucugccucccccaccucgucgcccucaccgagcaguacaccgucaccggccucauggaggccacccagaugauggucgacaucgacggcgacguccucgucuuccucgagcucgcccaguuccacugcgccuaccagcucgccgacuggugccuccaccacaucugcaccaacuacaacaacgucugccgcaaguucccccgcgacaugaaggccaugucccccgagaaccaggaguacuucgagaagcaccgcuggccccccgucugguaccucaaggaggaggaccacuaccagcgcgcccgcaaggagcgcgagaaggaggacuaccuccaccucaagcgccagcccaagcgccgcuggcucuucuggaacucccccuccucccccuccuccuccgccgccuccuccuccucccccuccuccuccuccgccgucgucuga

SEQ ID NO: 48752 - RNA, 1836 nt, Artificial Sequence
  derived and/or modified sequence opt2 from RHOBTB3__Homo_sapiens__NP_055714
auguccauccacaucgucgcccucggcaacgagggcgacaccuuccaccaggacaaccgccccuccggccucauccgcaccuaccucggccgcuccccccucgucuccggcgacgaguccucccuccuccucaacgccgccuccaccgucgcccgccccgucuucaccgaguaccaggccuccgccuucggcaacgucaagcucgucguccacgacugccccgucugggacaucuucgacuccgacugguacaccucccgcaaccucaucggcggcgccgacaucaucgucaucaaguacaacgucaacgacaaguucuccuuccacgaggucaaggacaacuacauccccgucaucaagcgcgcccucaacuccguccccgucaucaucgccgccgucggcacccgccagaacgaggagcuccccugcaccugcccccucugcaccuccgaccgcggcuccugcgucuccaccaccgagggcauccagcucgccaaggagcucggcgccaccuaccucgagcuccacucccucgacgacuucuacaucggcaaguacuucggcggcguccucgaguacuucaugauccaggcccucaaccagaagaccuccgagaagaugaagaagcgcaagauguccaacuccuuccacggcauccgccccccccagcucgagcagcccgagaagaugcccguccucaaggccgaggccucccacuacaacuccgaccucaacaaccuccucuucugcugccagugcgucgacgucgucuucuacaaccccaaccucaagaaggucgucgaggcccacaagaucguccucugcgccgucucccacgucuucaugcuccucuucaacgucaagucccccaccgacauccaggacuccuccaucauccgcaccacccaggaccucuucgccaucaaccgcgacaccgccuuccccggcgccucccacgaguccuccggcaaccccccccuccgcgucaucgucaaggacgcccucuucugcuccugccucuccgacauccuccgcuucaucuacuccggcgccuuccagugggaggagcucgaggaggacauccgcaagaagcucaaggacuccggcgacgucuccaacgucaucgagaaggucaagugcauccucaagacccccggcaagaucaacugccuccgcaacugcaagaccuaccaggcccgcaagccccucugguucuacaacaccucccucaaguucuuccucaacaagcccaugcucgccgacgucgucuucgagauccagggcaccaccguccccgcccaccgcgccauccucgucgcccgcugcgaggucauggccgccauguucaacggcaacuacauggaggccaaguccguccucauccccgucuacggcgucuccaaggagaccuuccucuccuuccucgaguaccucuacaccgacuccugcugccccgccggcaucuuccaggccaugugccuccucaucugcgccgagauguaccaggucucccgccuccagcacaucugcgagcucuucaucaucacccagcuccaguccaugcccucccgcgagcucgccuccaugaaccucgacaucgucgaccuccucaagaaggccaaguuccaccacuccgacugccucuccaccuggcuccuccacuucaucgccaccaacuaccucaucuucucccagaagcccgaguuccaggaccucuccgucgaggagcgcuccuucgucgagaagcaccgcuggcccuccaacauguaccucaagcagcucgccgaguaccgcaaguacauccacucccgcaagugccgcugccucgucauguga

SEQ ID NO: 48753 - RNA, 633 nt, Artificial Sequence
  derived and/or modified sequence opt2 from RHOD__Homo_sapiens__NP_055393
augaccgccgcccaggccgccggcgaggaggccccccccggcguccgcuccgucaaggucguccucgucggcgacggcggcugcggcaagaccucccuccucauggucuucgccgacggcgccuuccccgaguccuacacccccaccgucuucgagcgcuacauggucaaccuccaggucaagggcaagcccguccaccuccacaucugggacaccgccggccaggacgacuacgaccgccuccgcccccucuucuaccccgacgccuccguccuccuccucugcuucgacgucaccucccccaacuccuucgacaacaucuucaaccgcugguaccccgaggucaaccacuucugcaagaagguccccaucaucgucgucggcugcaagaccgaccuccgcaaggacaagucccucgucaacaagcuccgccgcaacggccucgagcccgucaccuaccaccgcggccaggagauggcccgcuccgucggcgccgucgccuaccucgagugcuccgcccgccuccacgacaacguccacgccgucuuccaggaggccgccgaggucgcccucuccucccgcggccgcaacuucuggcgccgcaucacccagggcuucugcgucgucaccuga

SEQ ID NO: 48754 - RNA, 636 nt, Artificial Sequence
  derived and/or modified sequence opt2 from RHOF__Homo_sapiens__NP_061907
auggacgcccccggcgcccucgcccagaccgccgcccccggccccggccgcaaggagcucaagaucgucaucgucggcgacggcggcugcggcaagaccucccuccucauggucuacucccagggcuccuuccccgagcacuacgcccccuccgucuucgagaaguacaccgccuccgucaccgucggcuccaaggaggucacccucaaccucuacgacaccgccggccaggaggacuacgaccgccuccgcccccucuccuaccagaacacccaccucguccucaucugcuacgacgucaugaaccccaccuccuacgacaacguccucaucaagugguuccccgaggucacccacuucugccgcggcauccccaugguccucaucggcugcaagaccgaccuccgcaaggacaaggagcagcuccgcaagcuccgcgccgcccagcucgagcccaucaccuacaugcagggccucuccgccugcgagcagauccgcgccgcccucuaccucgagugcuccgccaaguuccgcgagaacgucgaggacgucuuccgcgaggccgccaaggucgcccucuccgcccucaagaaggcccagcgccagaagaagcgccgccucugccuccuccucuga

SEQ ID NO: 48755 - RNA, 576 nt, Artificial Sequence
  derived and/or modified sequence opt2 from RHOG__Homo_sapiens__XP_005252973
augcaguccaucaagugcgucgucgucggcgacggcgccgucggcaagaccugccuccucaucugcuacaccaccaacgccuuccccaaggaguacauccccaccgucuucgacaacuacuccgcccaguccgccgucgacggccgcaccgucaaccucaaccucugggacaccgccggccaggaggaguacgaccgccuccgcacccucuccuacccccagaccaacgucuucgucaucugcuucuccaucgccuccccccccuccuacgagaacguccgccacaaguggcaccccgaggucugccaccacugccccgacguccccauccuccucgucggcaccaagaaggaccuccgcgcccagcccgacacccuccgccgccucaaggagcagggccaggcccccaucaccccccagcagggccaggcccucgccaagcagauccacgccguccgcuaccucgagugcuccgcccuccagcaggacggcgucaaggaggucuucgccgaggccguccgcgccguccucaaccccacccccaucaagcgcggccgcuccugcauccuccucuga

SEQ ID NO: 48756 - RNA, 576 nt, Artificial Sequence
  derived and/or modified sequence opt2 from RHOH__Homo_sapiens__NP_001265298
augcucuccuccaucaagugcguccucgucggcgacuccgccgucggcaagaccucccuccucguccgcuucaccuccgagaccuuccccgaggccuacaagcccaccgucuacgagaacaccggcgucgacgucuucauggacggcauccagaucucccucggccucugggacaccgccggcaacgacgccuuccgcuccauccgcccccucuccuaccagcaggccgacgucguccucaugugcuacuccgucgccaaccacaacuccuuccucaaccucaagaacaaguggaucggcgagauccgcuccaaccuccccugcacccccguccucgucgucgccacccagaccgaccagcgcgagaugggcccccaccgcgccuccugcgucaacgccauggagggcaagaagcucgcccaggacguccgcgccaagggcuaccucgagugcuccgcccucuccaaccgcggcguccagcaggucuucgagugcgccguccgcaccgccgucaaccaggcccgccgccgcaaccgccgccgccucuucuccaucaacgagugcaagaucuucuga

SEQ ID NO: 48757 - RNA, 1047 nt, Artificial Sequence
  derived and/or modified sequence opt2 from RHO__Homo_sapiens__NP_000530
augaacggcaccgagggccccaacuucuacguccccuucuccaacgccaccggcgucguccgcucccccuucgaguacccccaguacuaccucgccgagcccuggcaguucuccaugcucgccgccuacauguuccuccucaucguccucggcuuccccaucaacuuccucacccucuacgucaccguccagcacaagaagcuccgcaccccccucaacuacauccuccucaaccucgccgucgccgaccucuucaugguccucggcggcuucaccuccacccucuacaccucccuccacggcuacuucgucuucggccccaccggcugcaaccucgagggcuucuucgccacccucggcggcgagaucgcccucuggucccucgucguccucgccaucgagcgcuacgucgucgucugcaagcccauguccaacuuccgcuucggcgagaaccacgccaucaugggcgucgccuucaccugggucauggcccucgccugcgccgcccccccccucgccggcuggucccgcuacauccccgagggccuccagugcuccugcggcaucgacuacuacacccucaagcccgaggucaacaacgaguccuucgucaucuacauguucgucguccacuucaccauccccaugaucaucaucuucuucugcuacggccagcucgucuucaccgucaaggaggccgccgcccagcagcaggaguccgccaccacccagaaggccgagaaggaggucacccgcauggucaucaucauggucaucgccuuccucaucugcuggguccccuacgccuccgucgccuucuacaucuucacccaccagggcuccaacuucggccccaucuucaugaccauccccgccuucuucgccaaguccgccgccaucuacaaccccgucaucuacaucaugaugaacaagcaguuccgcaacugcaugcucaccaccaucugcugcggcaagaacccccucggcgacgacgaggccuccgccaccgucuccaagaccgagaccucccaggucgcccccgccuga

SEQ ID NO: 48758 - RNA, 645 nt, Artificial Sequence
  derived and/or modified sequence opt2 from RHOJ__Homo_sapiens__NP_065714
augaacugcaaggagggcaccgacuccuccugcggcugccgcggcaacgacgagaagaagaugcucaagugcgucgucgucggcgacggcgccgucggcaagaccugccuccucauguccuacgccaacgacgccuuccccgaggaguacguccccaccgucuucgaccacuacgccgucaccgucaccgucggcggcaagcagcaccuccucggccucuacgacaccgccggccaggaggacuacaaccagcuccgcccccucuccuaccccaacaccgacgucuuccucaucugcuucuccgucgucaaccccgccuccuaccacaacguccaggaggaguggguccccgagcucaaggacugcaugccccacguccccuacguccucaucggcacccagaucgaccuccgcgacgaccccaagacccucgcccgccuccucuacaugaaggagaagccccucaccuacgagcacggcgucaagcucgccaaggccaucggcgcccagugcuaccucgagugcuccgcccucacccagaagggccucaaggccgucuucgacgaggccauccucaccaucuuccaccccaagaagaagaagaagcgcugcuccgagggccacuccugcugcuccaucaucuga

SEQ ID NO: 48759 - RNA, 618 nt, Artificial Sequence
  derived and/or modified sequence opt2 from RHOQ__Homo_sapiens__NP_036381
auggcccacggccccggcgcccucaugcucaagugcgucgucgucggcgacggcgccgucggcaagaccugccuccucauguccuacgccaacgacgccuuccccgaggaguacguccccaccgucuucgaccacuacgccgucuccgucaccgucggcggcaagcaguaccuccucggccucuacgacaccgccggccaggaggacuacgaccgccuccgcccccucuccuaccccaugaccgacgucuuccucaucugcuucuccgucgucaaccccgccuccuuccagaacgucaaggaggaguggguccccgagcucaaggaguacgcccccaacguccccuuccuccucaucggcacccagaucgaccuccgcgacgaccccaagacccucgcccgccucaacgacaugaaggagaagcccaucugcgucgagcagggccagaagcucgccaaggagaucggcgccugcugcuacgucgagugcuccgcccucacccagaagggccucaagaccgucuucgacgaggccaucaucgccauccucacccccaagaagcacaccgucaagaagcgcaucggcucccgcugcaucaacugcugccucaucaccuga

SEQ ID NO: 48760 - RNA, 1980 nt, Artificial Sequence
  derived and/or modified sequence opt2 from RHOT1__Homo_sapiens__NP_001028738
augaagaaggacguccgcauccuccucgucggcgagccccgcgucggcaagaccucccucaucaugucccucgucuccgaggaguuccccgaggagguccccccccgcgccgaggagaucaccauccccgccgacgucacccccgagcgcguccccacccacaucgucgacuacuccgaggccgagcaguccgacgagcagcuccaccaggagaucucccaggccaacgucaucugcaucgucuacgccgucaacaacaagcacuccaucgacaaggucaccucccgcuggaucccccucaucaacgagcgcaccgacaaggacucccgccucccccucauccucgucggcaacaaguccgaccucgucgaguacuccuccauggagaccauccuccccaucaugaaccaguacaccgagaucgagaccugcgucgagugcuccgccaagaaccucaagaacaucuccgagcucuucuacuacgcccagaaggccguccuccaccccaccggcccccucuacugccccgaggagaaggagaugaagcccgccugcaucaaggcccucacccgcaucuucaagaucuccgaccaggacaacgacggcacccucaacgacgccgagcucaacuucuuccagcgcaucugcuucaacaccccccucgccccccaggcccucgaggacgucaagaacgucguccgcaagcacaucuccgacggcgucgccgacuccggccucacccucaagggcuuccucuuccuccacacccucuucauccagcgcggccgccacgagaccaccuggaccguccuccgccgcuucggcuacgacgacgaccucgaccucacccccgaguaccucuucccccuccucaagaucccccccgacugcaccaccgagcucaaccaccacgccuaccucuuccuccaguccaccuucgacaagcacgaccucgaccgcgacugcgcccucucccccgacgagcucaaggaccucuucaaggucuuccccuacauccccuggggccccgacgucaacaacaccgucugcaccaacgagcgcggcuggaucaccuaccagggcuuccucucccaguggacccucaccaccuaccucgacguccagcgcugccucgaguaccucggcuaccucggcuacuccauccucaccgagcaggagucccaggccuccgccgucaccgucacccgcgacaagaagaucgaccuccagaagaagcagacccagcgcaacgucuuccgcugcaacgucaucggcgucaagaacugcggcaaguccggcguccuccaggcccuccucggccgcaaccucaugcgccagaagaagauccgcgaggaccacaaguccuacuacgccaucaacaccgucuacgucuacggccaggagaaguaccuccuccuccacgacaucuccgaguccgaguuccucaccgaggccgagaucaucugcgacgucgucugccucgucuacgacgucuccaaccccaaguccuucgaguacugcgcccgcaucuucaagcagcacuucauggacucccgcauccccugccucaucgucgccgccaaguccgaccuccacgaggucaagcaggaguacuccaucucccccaccgacuucugccgcaagcacaagaugccccccccccaggccuucaccugcaacaccgccgacgcccccuccaaggacaucuucgucaagcucaccaccauggccauguacccccacgcccgccuccgcugcaugugcaccugcaaccgcugcaccuucugcaucugccagaacuuccucaacuccgaccuccuccaguccgucaagaacaagaucuucaccgccguccucaaccgccacgucacccaggccgaccucaaguccuccaccuucuggcuccgcgccuccuucggcgccaccgucuucgccguccucggcuucgccauguacaaggcccuccucaagcagcgcuga

SEQ ID NO: 48761 - RNA, 777 nt, Artificial Sequence
  derived and/or modified sequence opt2 from RHOU__Homo_sapiens__NP_067028
augcccccccagcagggcgaccccgccuuccccgaccgcugcgaggccccccccguccccccccgccgcgagcgcggcggccgcggcggccgcggccccggcgagcccggcggccgcggccgcgccggcggcgccgagggccgcggcgucaagugcguccucgucggcgacggcgccgucggcaagaccucccucgucgucuccuacaccaccaacggcuaccccaccgaguacauccccaccgccuucgacaacuucuccgccgucgucuccgucgacggccgccccguccgccuccagcucugcgacaccgccggccaggacgaguucgacaagcuccgcccccucugcuacaccaacaccgacaucuuccuccucugcuucuccgucgucucccccuccuccuuccagaacgucuccgagaaguggguccccgagauccgcugccacugccccaaggcccccaucauccucgucggcacccaguccgaccuccgcgaggacgucaagguccucaucgagcucgacaagugcaaggagaagcccguccccgaggaggccgccaagcucugcgccgaggagaucaaggccgccuccuacaucgagugcuccgcccucacccagaagaaccucaaggaggucuucgacgccgccaucgucgccggcauccaguacuccgacacccagcagcagcccaagaaguccaagucccgcacccccgacaagaugaagaaccucuccaaguccugguggaagaaguacugcugcuucgucuga

SEQ ID NO: 48762 - RNA, 711 nt, Artificial Sequence
  derived and/or modified sequence opt2 from RHOV__Homo_sapiens__NP_598378
augcccccccgcgagcucuccgaggccgagccccccccccuccgcgcccccaccccccccccccgccgccgcuccgccccccccgagcucggcaucaagugcguccucgucggcgacggcgccgucggcaaguccucccucaucgucuccuacaccugcaacggcuaccccgcccgcuaccgccccaccgcccucgacaccuucuccguccagguccucgucgacggcgcccccguccgcaucgagcucugggacaccgccggccaggaggacuucgaccgccuccgcucccucugcuaccccgacaccgacgucuuccucgccugcuucuccgucguccagcccuccuccuuccagaacaucaccgagaaguggcuccccgagauccgcacccacaacccccaggcccccguccuccucgucggcacccaggccgaccuccgcgacgacgucaacguccucauccagcucgaccagggcggccgcgagggccccgucccccagccccaggcccagggccucgccgagaagauccgcgccugcugcuaccucgagugcuccgcccucacccagaagaaccucaaggaggucuucgacuccgccauccucuccgccaucgagcacaaggcccgccucgagaagaagcucaacgccaagggcguccgcacccucucccgcugccgcuggaagaaguucuucugcuucgucuga

SEQ ID NO: 48763 - RNA, 555 nt, Artificial Sequence
  derived and/or modified sequence opt2 from RHOXF1__Homo_sapiens__NP_644811
auggcccgcucccucguccacgacaccgucuucuacugccucuccgucuaccaggucaagaucucccccaccccccagcucggcgccgccuccuccgccgagggccacgucggccagggcgcccccggccucaugggcaacaugaaccccgagggcggcgucaaccacgagaacggcaugaaccgcgacggcggcaugauccccgagggcggcggcggcaaccaggagccccgccagcagccccagcccccccccgaggagcccgcccaggccgccauggagggcccccagcccgagaacaugcagccccgcacccgccgcaccaaguucacccuccuccaggucgaggagcucgaguccgucuuccgccacacccaguaccccgacguccccacccgccgcgagcucgccgagaaccucggcgucaccgaggacaagguccgcgucugguucaagaacaagcgcgcccgcugccgccgccaccagcgcgagcucaugcucgccaacgagcuccgcgccgaccccgacgacugcgucuacaucgucgucgacuga

SEQ ID NO: 48764 - RNA, 867 nt, Artificial Sequence
  derived and/or modified sequence opt2 from RHOXF2__Homo_sapiens__NP_115887
auggagccccccgaccagugcucccaguacaugaccucccuccucucccccgccgucgacgacgagaaggagcuccaggacaugaacgccaugguccucucccucaccgaggaggucaaggaggaggaggaggacgcccagcccgagcccgagcagggcaccgccgccggcgagaagcucaaguccgccggcgcccagggcggcgaggagaaggacggcggcggcgaggagaaggacggcggcggcgccggcguccccggccaccucugggagggcgaccucgagggcaccuccggcuccgacggcaacgucgaggacuccgaccaguccgagaaggagcccggccagcaguacucccgcccccagggcgccgucggcggccucgagcccggcaacgcccagcagcccaacguccacgccuucaccccccuccagcuccaggagcucgagcgcaucuuccagcgcgagcaguuccccuccgaguuccuccgccgccgccucgcccgcuccaugaacgucaccgagcucgccguccagaucugguucgagaaccgccgcgccaaguggcgccgccaccagcgcgcccucauggcccgcaacaugcuccccuucauggccgucggccagcccgucauggucaccgccgccgaggccaucaccgccccccucuucaucuccggcaugcgcgacgacuacuucugggaccacucccacuccuccucccucugcuuccccaugccccccuuccccccccccucccucccccucccccucaugcuccucccccccaugccccccgccggccaggccgaguucggccccuuccccuucgucaucguccccuccuucaccuuccccaacgucuga

SEQ ID NO: 48765 - RNA, 2013 nt, Artificial Sequence
  derived and/or modified sequence opt2 from RHPN1__Homo_sapiens__NP_443156
augauccucgaggagcgccccgacggcgccggcgccggcgaggaguccccccgccuccagggcugcgacucccucacccagauccagugcggccagcuccagucccgccgcgcccagauccaccagcagaucgacaaggagcuccagaugcgcaccggcgccgagaaccucuaccgcgccaccuccaacaaccgcguccgcgagaccgucgcccucgagcucuccuacgucaacuccaaccuccagcuccucaaggaggagcucgaggagcucuccggcggcgucgaccccggccgccacggcuccgaggccgucaccguccccaugaucccccucggccucaaggagaccaaggagcucgacugguccaccccccucaaggagcucaucuccguccacuucggcgaggacggcgccuccuacgaggccgagauccgcgagcucgaggcccuccgccaggccaugcgcacccccucccgcaacgaguccggccucgagcuccucaccgccuacuacaaccagcucugcuuccucgacgcccgcuuccucacccccgcccgcucccucggccucuucuuccacugguacgacucccucaccggcguccccgcccagcagcgcgcccucgccuucgagaagggcuccguccucuucaacaucggcgcccuccacacccagaucggcgcccgccaggaccgcuccugcaccgagggcgcccgccgcgccauggaggccuuccagcgcgccgccggcgccuucucccuccuccgcgagaacuucucccacgcccccucccccgacauguccgccgccucccucugcgcccucgagcagcucaugauggcccaggcccaggagugcgucuucgagggccucuccccccccgccuccauggccccccaggacugccucgcccagcuccgccucgcccaggaggccgcccaggucgccgccgaguaccgccucguccaccgcaccauggcccagccccccguccacgacuacguccccgucuccuggaccgcccucguccacgucaaggccgaguacuuccgcucccucgcccacuaccacgucgccauggcccucugcgacggcucccccgccaccgagggcgagcuccccacccacgagcaggucuuccuccagccccccaccuccuccaagccccgcggccccguccucccccaggagcucgaggagcgccgccagcucggcaaggcccaccucaagcgcgccauccucggccaggaggaggcccuccgccuccacgcccucugccgcguccuccgcgaggucgaccuccuccgcgccgucaucucccagacccuccagcgcucccucgccaaguacgccgagcucgaccgcgaggacgacuucugcgaggccgccgaggcccccgacauccagcccaagacccaccagaagcccgaggcccgcaugccccgccucucccagggcaagggccccgacaucuuccaccgccucggcccccucuccgucuucuccgccaagaaccgcuggcgccucgucggccccguccaccucacccgcggcgagggcggcuucggccucacccuccgcggcgacucccccguccucaucgccgccgucauccccggcucccaggccgccgccgccggccucaaggagggcgacuacaucgucuccgucaacggccagcccugccgcugguggcgccacgccgaggucgucaccgagcucaaggccgccggcgaggccggcgccucccuccaggucgucucccuccuccccuccucccgccuccccucccucggcgaccgccgccccguccuccucggcccccgcggccuccuccgcucccagcgcgagcacggcugcaagacccccgccuccaccugggccuccccccgcccccuccucaacuggucccgcaaggcccagcagggcaagaccggcggcugcccccagcccugcgcccccgucaagcccgccccccccuccucccucaagcaccccggcuggcccuga

SEQ ID NO: 48766 - RNA, 2061 nt, Artificial Sequence
  derived and/or modified sequence opt2 from RHPN2__Homo_sapiens__NP_149094
augaccgacgcccuccuccccgccgccccccagccccucgagaaggagaacgacggcuacuuccgcaagggcugcaacccccucgcccagaccggccgcuccaagcuccagaaccagcgcgccgcccucaaccagcagauccucaaggccguccgcaugcgcaccggcgccgagaaccuccucaaggucgccaccaacuccaagguccgcgagcagguccgccucgagcucuccuucgucaacuccgaccuccagaugcucaaggaggagcucgagggccucaacaucuccgucggcgucuaccagaacaccgaggaggccuucaccaucccccucaucccccucggccucaaggagaccaaggacgucgacuucgccgucguccucaaggacuucauccucgagcacuacuccgaggacggcuaccucuacgaggacgagaucgccgaccucauggaccuccgccaggccugccgcacccccucccgcgacgaggccggcgucgagcuccucaugaccuacuucauccagcucggcuucgucgagucccgcuucuucccccccacccgccagaugggccuccucuucaccugguacgacucccucaccggcguccccgucucccagcagaaccuccuccucgagaaggccuccguccucuucaacaccggcgcccucuacacccagaucggcacccgcugcgaccgccagacccaggccggccucgaguccgccaucgacgccuuccagcgcgccgccggcguccucaacuaccucaaggacaccuucacccacacccccuccuacgacaugucccccgccaugcucuccguccucgucaagaugaugcucgcccaggcccaggaguccgucuucgagaagaucucccuccccggcauccgcaacgaguucuucaugcucgucaaggucgcccaggaggccgccaaggucggcgaggucuaccagcagcuccacgccgccaugucccaggcccccgucaaggagaacauccccuacuccugggccucccucgccugcgucaaggcccaccacuacgccgcccucgcccacuacuucaccgccauccuccucaucgaccaccaggucaagcccggcaccgaccucgaccaccaggagaagugccucucccagcucuacgaccacaugcccgagggccucaccccccucgccacccucaagaacgaccagcagcgccgccagcucggcaagucccaccuccgccgcgccauggcccaccacgaggaguccguccgcgaggccucccucugcaagaagcuccgcuccaucgagguccuccagaagguccucugcgccgcccaggagcgcucccgccucaccuacgcccagcaccaggaggaggacgaccuccucaaccucaucgacgcccccuccgucgucgccaagaccgagcaggaggucgacaucauccucccccaguucuccaagcucaccgucaccgacuucuuccagaagcucggcccccucuccgucuucuccgccaacaagcgcuggacccccccccgcuccauccgcuucaccgccgaggagggcgaccucggcuucacccuccgcggcaacgcccccguccagguccacuuccucgaccccuacugcuccgccuccgucgccggcgcccgcgagggcgacuacaucgucuccauccagcucgucgacugcaaguggcucacccucuccgaggucaugaagcuccucaaguccuucggcgaggacgagaucgagaugaaggucgucucccuccucgacuccaccuccuccaugcacaacaaguccgccaccuacuccgucggcaugcagaagaccuacuccaugaucugccucgccaucgacgacgacgacaagaccgacaagaccaagaagaucuccaagaagcucuccuuccucuccuggggcaccaacaagaaccgccagaaguccgccuccacccucugccuccccuccgucggcgccgcccgcccccaggucaagaagaagcuccccucccccuucucccuccucaacuccgacuccuccugguacuga

SEQ ID NO: 48767 - RNA, 1149 nt, Artificial Sequence
  derived and/or modified sequence opt2 from RIBC2__Homo_sapiens__NP_056468
augggcucccagaccauggccgucgcccucccccgcgaccuccgccaggacgccaaccucgccaagcgccgccacgccgagcucugccgccagaagcgcgucuucaacgcccgcaaccgcaucaucggcggcgacaccgaggccugggacguccagguccacgaccagaagaucaaggaggccaccgagaaggcccgccacgagaccuucgccgccgagaugcgccagaacgacaagaucaugugcauccucgagaaccgcaagaagcgcgaccgcaagaaccucugccgcgccaucaacgacuuccagcaguccuuccagaagcccgagacccgccgcgaguucgaccucuccgacccccucgcccucaagaaggaccuccccgcccgccaguccgacaacgacguccgcaacaccaucuccggcaugcagaaguucaugggcgaggaccucaacuuccacgagcgcaagaaguuccaggaggagcagaaccgcgaguggucccuccagcagcagcgcgaguggaagaacgcccgcgccgagcagaagugcgccgaggcccucuacaccgagacccgccuccaguucgacgagaccgccaagcaccuccagaagcucgaguccaccacccgcaaggccgucugcgccuccgucaaggacuucaacaagucccaggccaucgaguccgucgagcgcaagaagcaggagaagaagcaggagcaggaggacaaccucgccgagaucaccaaccuccuccgcggcgaccuccucuccgagaacccccagcaggccgccuccuccuucggcccccaccgcgucguccccgaccgcuggaagggcaugacccaggagcagcucgagcagauccgccucguccagaagcagcagauccaggagaagcuccgccuccaggaggagaagcgccagcgcgaccucgacugggaccgccgccgcauccagggcgcccgcgccacccuccucuucgagcgccagcaguggcgccgccagcgcgaccuccgccgcgcccucgacuccuccaaccucucccucgccaaggagcagcaccuccagaagaaguacaugaacgaggucuacaccaaccagcccaccggcgacuacuucacccaguucaacaccggcucccgcuga

SEQ ID NO: 48768 - RNA, 3498 nt, Artificial Sequence
  derived and/or modified sequence opt2 from RIC1__Homo_sapiens__NP_001129392
auguacuuccucuccggcuggcccaagcgccuccucugcccccucggcucccccgccgaggcccccuuccacguccaguccgacccccagcgcgccuucuucgccguccucgccgccgcccgccucuccaucugguacucccgccccuccguccucaucgucaccuacaaggagcccgccaaguccuccacccaguucggcuccuacaagcaggccgaguggcgccccgacuccaccaugaucgccgucuccaccgccaacggcuacauccucuucuuccacaucaccuccacccgcggcgacaaguaccucuacgagcccgucuaccccaagggcuccccccagaugaagggcaccccccacuucaaggaggagcagugcgcccccgcccucaaccucgagaugcgcaagauccucgaccuccaggcccccaucaugucccuccaguccguccucgaggaccuccucgucgccaccuccgacggccuccuccaccucauccacugggagggcaugaccaacggccgcaaggccaucaaccucugcaccguccccuucuccgucgaccuccaguccucccgcgucggcuccuuccucggcuucaccgacguccacauccgcgacauggaguacugcgccacccucgacggcuucgccgucgucuucaacgacggcaaggucggcuucaucacccccgucuccucccgcuucaccgccgagcagcuccacggcgucuggccccaggacgucgucgacggcaccugcgucgccgucaacaacaaguaccgccucauggccuucggcugcgucuccggcuccguccaggucuacaccaucgacaacuccaccggcgccaugcuccucucccacaagcucgagcucaccgccaagcaguaccccgacaucuggaacaagaccggcgccgucaagcucaugcgcuggucccccgacaacuccgucgucaucgucaccugggaguacggcggccucucccucugguccgucuucggcgcccagcucaucugcacccucggcggcgacuucgccuaccgcuccgacggcaccaagaaggacccccucaagaucaacuccauguccuggggcgccgagggcuaccaccucugggucaucuccggcuucggcucccagaacaccgagaucgaguccgaccuccgcuccgucgucaagcagcccuccauccuccucuuccaguucaucaaguccguccucaccgucaaccccugcauguccaaccaggagcagguccuccuccagggcgaggaccgccucuaccucaacugcggcgaggccucccagacccagaacccccgcuccuccuccacccacuccgagcacaagcccucccgcgagaagucccccuucgccgacggcggccucgagucccagggccucuccacccuccucggccaccgccacuggcacgucguccagaucuccuccaccuaccucgaguccaacuggcccauccgcuucuccgccaucgacaagcucggccagaacaucgccgucgucggcaaguucggcuucgcccacuacucccuccucaccaagaaguggaagcucuucggcaacaucacccaggagcagaacaugaucgucaccggcggccucgccugguggaacgacuucaugguccucgccugcuacaacaucaacgaccgccaggaggagcuccgcgucuaccuccgcaccuccaaccucgacaacgccuucgcccacgucaccaaggcccaggccgagacccuccuccucuccgucuuccaggacauggucaucgucuuccgcgccgacugcuccaucugccucuacuccaucgagcgcaaguccgacggccccaacaccaccgccggcauccagguccuccaggaggucuccaugucccgcuacaucccccaccccuuccucgucgucuccgucacccucaccuccgucuccaccgagaacggcaucacccucaagaugccccagcaggcccgcggcgccgaguccaucaugcucaaccucgccggccagcucaucaugaugcagcgcgaccgcuccggcccccagauccgcgagaaggacuccaaccccaacaaccagcgcaagcuccuccccuucugcccccccgucguccucgcccaguccgucgagaacgucuggaccaccugccgcgccaacaagcagaagcgccaccuccucgaggcccucuggcucuccugcggcggcgccggcaugaaggucuggcucccccucuucccccgcgaccaccgcaagccccacuccuuccucucccagcgcaucaugcuccccuuccacaucaacaucuacccccucgccguccucuucgaggacgcccucguccucggcgccgucaacgacacccuccucuacgacucccucuacacccgcaacaacgcccgcgagcagcucgagguccucuuccccuucugcgucgucgagcgcaccucccagaucuaccuccaccacauccuccgccagcuccucguccgcaaccucggcgagcaggcccuccuccucgcccaguccugcgccacccuccccuacuucccccacguccucgagcucaugcuccacgagguccucgaggaggaggccaccucccgcgagcccauccccgacccccuccuccccaccgucgccaaguucaucaccgaguucccccucuuccuccagaccgucguccacugcgcccgcaagaccgaguacgcccucuggaacuaccucuucgccgccgucggcaaccccaaggaccucuucgaggagugccucauggcccaggaccucgacaccgccgccuccuaccucaucauccuccagaacauggagguccccgccgucucccgccagcacgccacccuccucuucaacaccgcccucgagcagggcaagugggaccucugccgccacaugauccgcuuccucaaggccaucggcuccggcgaguccgagaccccccccuccacccccaccgcccaggagcccuccuccuccggcggcuucgaguucuuccgcaaccgcuccaucucccucucccaguccgccgagaacguccccgccuccaaguucucccuccagaagacccucuccaugcccuccggccccuccggcaagcgcugguccaaggacuccgacugcgccgagaacauguacaucgacaugaugcucuggcgccacgcccgccgccuccucgaggacguccgccucaaggaccucggcugcuucgccgcccagcucggcuucgagcucaucuccuggcucugcaaggagcgcacccgcgccgcccgcgucgacaacuucgucaucgcccucaagcgccuccacaaggacuuccucuggccccuccccaucauccccgccuccuccaucuccucccccuucaagaacggcaaguaccgcaccggcaacgucgacuucaugucccucguccagggcgagcucuacuucacccccugcaucuacaccuucugcuacuga

SEQ ID NO: 48769 - RNA, 564 nt, Artificial Sequence
  derived and/or modified sequence opt2 from RIC3__Homo_sapiens__NP_001128581
auggccuacuccaccguccagcgcgucgcccucgccuccggccucguccucgcccucucccuccuccuccccaaggccuuccucucccgcggcaagcgccaggagcccccccccacccccgagggcuaccccgaggagaccuaccccaucuacgaccucuccgacugcaucaagcgccgccaggagaccauccucgucgacuaccccgaccccaaggagcucuccgccgaggagaucgccgagcgcaugggcaugaucgaggaggaggaguccgaccaccucggcugggagucccuccccaccgacccccgcgcccaggaggacaacuccgucaccuccugcgaccccaagcccgagaccugcuccugcugcuuccacgaggacgaggaccccgccguccucgccgagaacgccggcuucuccgccgacuccuaccccgagcaggaggagaccaccaaggaggaguggucccaggacuucaaggacgagggccucggcaucuccaccgacaaggccuacaccggcuccaugcuccgcaagcgcaacccccagggccucgaguga

SEQ ID NO: 48770 - RNA, 5199 nt, Artificial Sequence
  derived and/or modified sequence opt2 from RICTOR__Homo_sapiens__NP_001272368
auggccgccaucggccgcggccgcucccucaagaaccuccgcguccgcggccgcaacgacuccggcgaggagaacgucccccucgaccucacccgcgagcccuccgacaaccuccgcgagauccuccagaacgucgcccgccuccagggcgucuccaacaugcgcaagcucggccaccucaacaacuucaccaagcuccucugcgacaucggccacuccgaggagaagcucggcuuccacuacgaggacaucaucaucugccuccgccucgcccuccucaacgaggccaaggagguccgcgccgccggccuccgcgcccuccgcuaccucauccaggacuccuccauccuccagaagguccucaagcucaaggucgacuaccucaucgcccgcugcaucgacauccagcaguccaacgaggucgagcgcacccaggcccuccgccucguccgcaagaugaucaccgucaacgccucccucuuccccuccuccgucaccaacucccucaucgccgucggcaacgacggccuccaggagcgcgaccgcaugguccgcgccugcaucgccaucaucugcgagcucgcccuccagaaccccgaggucgucgcccuccgcggcggccucaacaccauccucaagaacgucaucgacugccagcucucccgcaucaacgaggcccucaucaccaccauccuccaccuccucaaccaccccaagacccgccaguacguccgcgccgacgucgagcucgagcgcauccucgcccccuacaccgacuuccacuaccgccacucccccgacaccgccgagggccagcucaaggaggaccgcgaggcccgcuuccucgccuccaagaugggcaucaucgccaccuuccgcuccugggccggcaucaucaaccucugcaagcccggcaacuccggcauccagucccucaucggcguccucugcauccccaacauggagauccgccgcggccuccucgagguccucuacgacaucuuccgccucccccuccccgucgucaccgaggaguucaucgaggcccuccucuccgucgaccccggccgcuuccaggacuccuggcgccucuccgacggcuucgucgccgccgaggccaagaccauccucccccaccgcgcccgcucccgccccgaccucauggacaacuaccucgcccucauccucuccgccuucauccgcaacggccuccucgagggccucgucgaggucaucaccaacuccgacgaccacaucuccguccgcgccaccauccuccucggcgagcuccuccacauggccaacaccauccucccccacucccacucccaccaccuccacugccuccccacccucaugaacauggccgccuccuucgacauccccaaggagaagcgccuccgcgccuccgccgcccucaacugccucaagcgcuuccacgagaugaagaagcgcggccccaagcccuacucccuccaccucgaccacaucauccagaaggccaucgccacccaccagaagcgcgaccaguaccuccgcguccagaaggacaucuucauccucaaggacaccgaggaggcccuccucaucaaccuccgcgacucccagguccuccagcacaaggagaaccucgaguggaacuggaaccucaucggcaccauccucaaguggcccaacgucaaccuccgcaacuacaaggacgagcagcuccaccgcuucguccgccgccuccucuacuucuacaagcccuccuccaagcucuacgccaaccucgaccucgacuucgccaaggccaagcagcucaccgucgucggcugccaguucaccgaguuccuccucgaguccgaggaggacggccagggcuaccucgaggaccucgucaaggacaucguccaguggcucaacgccuccuccggcaugaagcccgagcgcucccuccagaacaacggccuccucaccacccucucccagcacuacuuccucuucaucggcacccucuccugccacccccacggcgucaagaugcucgagaagugcuccgucuuccagugccuccucaaccucugcucccucaagaaccaggaccaccuccucaagcucaccgucuccucccucgacuacucccgcgacggccucgcccgcgucauccucuccaagauccucaccgccgccaccgacgccugccgccucuacgccaccaagcaccuccgcguccuccuccgcgccaacgucgaguucuucaacaacuggggcaucgagcuccucgucacccagcuccacgacaagaacaagaccaucuccuccgaggcccucgacauccucgacgaggccugcgaggacaaggccaaccuccacgcccucauccagaugaagcccgcccucucccaccucggcgacaagggccuccuccuccuccuccgcuuccucuccauccccaagggcuucuccuaccucaacgagcgcggcuacgucgccaagcagcucgagaaguggcaccgcgaguacaacuccaaguacgucgaccucaucgaggagcagcucaacgaggcccucaccaccuaccgcaagcccgucgacggcgacaacuacguccgccgcuccaaccagcgccuccagcgcccccacgucuaccuccccauccaccucuacggccagcucguccaccacaagaccggcugccaccuccucgagguccagaacaucaucaccgagcucugccgcaacguccgcacccccgaccucgacaagugggaggagaucaagaagcucaaggccucccucugggcccucggcaacaucggcuccuccaacuggggccucaaccuccuccaggaggagaacgucauccccgacauccucaagcucgccaagcagugcgagguccucuccauccgcggcaccugcgucuacguccucggccucaucgccaagaccaagcagggcugcgacauccucaagugccacaacugggacgccguccgccacucccgcaagcaccucuggcccgucguccccgacgacgucgagcagcucugcaacgagcucuccuccauccccuccacccucucccucaacuccgaguccaccuccucccgccacaacuccgaguccgaguccguccccuccuccauguucauccucgaggacgaccgcuucggcuccuccuccaccuccaccuucuuccucgacaucaacgaggacaccgagcccaccuucuacgaccgcuccggccccaucaaggacaagaacuccuuccccuucuucgccuccuccaagcucgucaagaaccgcauccucaacucccucacccuccccaacaagaagcaccgcuccuccuccgaccccaagggcggcaagcucuccuccgaguccaagaccuccaaccgccgcauccgcacccucaccgagcccuccgucgacuucaaccacuccgacgacuucacccccaucuccaccguccagaagacccuccagcucgagaccuccuucaugggcaacaagcacaucgaggacaccggcuccacccccuccaucggcgagaacgaccucaaguucaccaagaacuucggcaccgagaaccaccgcgagaacaccucccgcgagcgccucgucgucgaguccuccaccuccucccacaugaagauccgcucccaguccuucaacaccgacaccaccaccuccggcaucuccuccauguccuccucccccucccgcgagaccgucggcgucgacgccaccaccauggacaccgacugcggcuccauguccaccgucgucuccaccaagaccaucaagaccucccacuaccucaccccccaguccaaccaccucucccucuccaaguccaacuccgucucccucgucccccccggcuccucccacacccucccccgccgcgcccagucccucaaggcccccuccaucgccaccaucaagucccucgccgacugcaacuucuccuacaccuccucccgcgacgccuucggcuacgccacccucaagcgccuccagcagcagcgcaugcaccccucccucucccacuccgaggcccucgccucccccgccaaggacguccucuucaccgacaccaucaccaugaaggccaacuccuucgagucccgccucacccccucccgcaucgacuucaagaagaagcacgucggcggcauccgcucccuccgccccaccaucaccaacaaccucuuccgcuucaugaaggcccucuccuacgccucccucgacaaggaggaccuccucucccccaucaaccagaacacccuccagcgcuccuccuccguccgcuccauggucuccuccgccaccuacggcggcuccgacgacuacaucggccucgcccuccccgucgacaucaacgacaucuuccaggucaaggacauccccuacuuccagaccaagaacauccccccccacgacgaccgcggcgcccgcgccuucgcccacgacgccggcggccuccccuccggcaccggcggccucgucaagaacuccuuccaccuccuccgccagcagaugucccucaccgagaucaugaacuccauccacuccgacgccucccucuuccucgaguccaccgaggacaccggccuccaggagcacaccgacgacaacugccucuacugcgucugcaucgagauccucggcuuccagcccuccaaccagcucuccgccaucugcucccacuccgacuuccaggacauccccuacuccgacuggugcgagcagaccauccacaacccccucgaggucguccccuccaaguucuccggcaucuccggcugcuccgacggcgucucccaggagggcuccgccuccuccaccaaguccaccgagcuccuccucggcgucaagaccauccccgacgacacccccaugugccgcauccuccuccgcaaggagguccuccgccucgucaucaaccucuccuccuccgucuccaccaagugccacgagaccggccuccucaccaucaaggagaaguacccccagaccuucgacgacaucugccucuacuccgaggucucccaccuccucucccacugcaccuuccgccuccccugccgccgcuucauccaggagcucuuccaggacguccaguuccuccagaugcacgaggaggccgaggccguccucgccaccccccccaagcagcccaucgucgacaccuccgccgaguccuga

SEQ ID NO: 48771 - RNA, 7341 nt, Artificial Sequence
  derived and/or modified sequence opt2 from RIF1__Homo_sapiens__NP_001171134
augaccgcccgcggccaguccccccucgccccccuccucgagacccucgaggaccccuccgccucccacggcggccagaccgacgccuaccucacccucaccucccgcaugaccggcgaggagggcaaggaggucaucaccgagaucgagaagaagcucccccgccucuacaagguccucaagacccacaucuccucccagaacuccgagcucuccuccgccgcccuccaggcccucggcuucugccucuacaaccccaagaucaccuccgagcucuccgaggccaacgcccucgagcuccucuccaagcucaacgacaccaucaagaacuccgacaagaacguccgcacccgcgcccucugggucaucuccaagcagaccuuccccuccgaggucgucggcaagauggucuccuccaucaucgacucccucgagauccucuucaacaagggcgagacccacuccgccgucgucgacuucgaggcccucaacgucaucguccgccucaucgagcaggcccccauccagaugggcgaggaggccguccgcugggccaagcucgucaucccccucgucguccacuccgcccagaagguccaccuccgcggcgccaccgcccucgagaugggcaugccccuccuccuccagaagcagcaggagaucgccuccaucaccgagcagcucaugaccaccaagcucaucuccgagcuccagaagcucuucauguccaagaacgagaccuacguccucaagcucuggccccucuucgucaagcuccucggccgcacccuccaccgcuccggcuccuucaucaacucccuccuccagcucgaggagcucggcuuccgcuccggcgcccccaugaucaagaagaucgccuucaucgccuggaagucccucaucgacaacuucgcccucaaccccgacauccucugcuccgccaagcgccucaagcuccucaugcagccccucuccuccauccacguccgcaccgagacccucgcccucaccaagcucgaggucuggugguaccuccucaugcgccucggcccccaccuccccgccaacuucgagcaggucugcgucccccucauccaguccaccaucuccaucgacuccaacgccuccccccagggcaacuccugccacgucgccaccucccccggccucaaccccaugacccccguccacaagggcgccuccucccccuacggcgcccccggcaccccccgcaugaaccucuccuccaaccucggcggcauggccaccauccccuccauccagcuccucggccucgagaugcuccuccacuuccuccucggccccgaggcccucuccuucgccaagcagaacaagcucguccucucccucgagccccucgagcacccccucaucuccucccccuccuucuucuccaagcacgccaacacccucaucaccgccguccacgacuccuucgucgccgucggcaaggacgcccccgacgucgucgucuccgccaucuggaaggagcucaucucccucgucaaguccgucaccgaguccggcaacaagaaggagaagcccggcuccgagguccucacccuccuccucaagucccucgaguccaucgucaaguccgaggucuuccccgucuccaagacccucguccucauggagaucaccaucaagggccucccccagaagguccucggcucccccgccuaccaggucgccaacauggacauccucaacggcacccccgcccucuuccucauccagcucaucuucaacaacuuccucgagugcggcgucuccgacgagcgcuucuuccucucccucgagucccucgucggcugcguccucuccggccccaccuccccccucgccuucuccgacuccguccucaacgucaucaaccagaacgccaagcagcucgagaacaaggagcaccucuggaagaugugguccgucaucgucaccccccucaccgagcucaucaaccagaccaacgaggucaaccagggcgacgcccucgagcacaacuucuccgccaucuacggcgcccucacccuccccgucaaccacaucuucuccgagcagcgcuuccccgucgccaccaugaagacccuccuccgcaccugguccgagcucuaccgcgccuucgcccgcugcgccgcccucgucgccaccgccgaggagaaccucugcugcgaggagcucuccuccaagaucauguccucccucgaggacgagggcuucuccaaccuccucuucgucgaccgcaucaucuacaucaucaccgucauggucgacugcaucgacuucucccccuacaacaucaaguaccagcccaaggucaaguccccccagcgccccuccgacugguccaagaagaagaacgagccccucggcaagcucaccucccucuucaagcucaucgucaaggucaucuacuccuuccacacccucuccuucaaggaggcccacuccgacacccucuucaccaucggcaacuccaucaccggcaucaucuccuccguccucggccacaucucccuccccuccaugauccgcaagaucuucgccacccucacccgcccccucgcccucuucuacgagaacuccaagcucgacgagguccccaaggucuacuccugccucaacaacaagcucgagaagcuccucggcgagaucaucgccugccuccaguucuccuacaccggcaccuacgacuccgagcuccucgagcagcucuccccccuccucugcaucaucuuccuccacaagaacaagcagauccgcaagcaguccgcccaguucuggaacgccaccuucgccaaggucaugaugcucgucuaccccgaggagcucaagcccguccucacccaggccaagcagaaguuccuccuccuccuccccggccucgagaccgucgagaugauggaggaguccuccggccccuacuccgacggcaccgagaacucccagcucaacgucaagaucuccggcauggagcgcaaguccaacggcaagcgcgacuccuuccucgcccagaccaagaacaagaaggagaacaugaagcccgccgccaagcucaagcucgaguccuccucccucaaggucaagggcgagauccuccucgaggaggagaaguccaccgacuucgucuucaucccccccgagggcaaggacgccaaggagcgcauccucaccgaccaccagaaggagguccucaagaccaagcgcugcgacauccccgccauguacaacaaccucgacgucucccaggacacccucuucacccaguacucccaggaggagcccauggagauccccacccucacccgcaagcccaaggaggacuccaagaugaugaucaccgaggagcagauggacuccgacaucgucaucccccaggacgucaccgaggacugcggcauggccgagcaccucgagaaguccucccucuccaacaacgagugcggcucccucgacaagaccucccccgagauguccaacuccaacaacgacgagcgcaagaaggcccucaucuccucccgcaagaccuccaccgagugcgccuccuccaccgagaacuccuucgucgucuccuccuccuccgucuccaacaccaccgucgccggcaccccccccuaccccaccucccgccgccagaccuucaucacccucgagaaguucgacggcuccgagaaccgccccuucucccccuccccccucaacaacaucuccuccaccgucaccgucaagaacaaccaggagaccaugaucaagaccgacuuccuccccaaggccaagcagcgcgagggcaccuucuccaaguccgacuccgagaagaucgucaacggcaccaagcgcuccucccgccgcgccggcaaggccgagcagaccggcaacaagcgcuccaagccccucaugcgcuccgagcccgagaagaacaccgaggaguccgucgagggcaucgucguccucgagaacaacccccccggccuccucaaccagaccgagugcgucuccgacaaccagguccaccucuccgaguccaccauggagcacgacaacaccaagcucaaggccgccaccgucgagaacgccguccuccucgagaccaacaccgucgaggagaagaacgucgagaucaaccucgaguccaaggagaacaccccccccgucgucaucuccgccgaccagauggucaacgaggacucccagguccagaucacccccaaccagaagacccuccgccgcuccucccgccgccgcuccgaggucgucgaguccaccaccgagucccaggacaaggagaacucccaccagaagaaggagcgccgcaaggaggaggagaagccccuccagaaguccccccuccacaucaaggacgacguccuccccaagcagaagcucaucgccgagcagacccuccaggagaaccucaucgagaagggcuccaaccuccacgagaagacccucggcgagaccuccgccaacgccgagaccgagcagaacaagaagaaggccgaccccgagaacaucaaguccgagggcgacggcacccaggacaucgucgacaaguccuccgagaagcucguccgcggccgcacccgcuaccagacccgccgcgccucccagggccuccucuccuccaucgagaacuccgaguccgacuccuccgaggccaaggaggagggcucccgcaagaagcgcuccggcaaguggaagaacaaguccaacgaguccgucgacauccaggaccaggaggagaaggucgucaagcaggagugcaucaaggccgagaaccagucccacgacuacaaggccaccuccgaggaggacgucuccaucaagucccccaucugcgagaagcaggacgaguccaacaccgucaucugccaggacuccaccgucaccuccgaccuccuccagguccccgacgaccuccccaacgucugcgaggagaagaacgagaccuccaaguacgccgaguacuccuucaccucccuccccguccccgaguccaaccuccgcacccgcaacgccaucaagcgccuccacaagcgcgacuccuucgacaacugcucccucggcgaguccuccaagaucggcaucuccgacaucuccucccucuccgagaagaccuuccagacccucgagugccagcacaagcgcucccgccgcguccgccgcuccaagggcugcgacugcugcggcgagaagucccagccccaggagaagucccucaucggccucaagaacaccgagaacaacgacgucgagaucuccgagaccaagaaggccgacguccaggcccccgucucccccuccgagaccucccaggccaaccccuacuccgagggccaguuccucgacgagcaccacuccgucaacuuccaccucggccucaaggaggacaacgacaccaucaacgacucccucaucgucuccgagaccaaguccaaggagaacaccaugcaggagucccuccccuccggcaucgucaacuuccgcgaggagaucugcgacauggacuccuccgaggccaugucccucgagucccaggagucccccaacgagaacuucaagaccgucggccccugccucggcgacuccaagaacgucucccaggagucccucgagaccaaggaggagaagcccgaggagacccccaagauggagcucucccucgagaacgucaccgucgagggcaacgccugcaaggucaccgaguccaaccucgagaaggccaagaccauggagcucaacgucggcaacgaggccuccuuccacggccaggagcgcaccaagaccggcaucuccgaggaggccgccaucgaggagaacaagcgcaacgacgacuccgaggccgacaccgccaagcucaacgccaaggaggucgccaccgaggaguucaacuccgacaucucccucuccgacaacaccacccccgucaagcucaacgcccagaccgagaucuccgagcagaccgccgccggcgagcucgacggcggcaacgacgucuccgaccuccacuccuccgaggagaccaacaccaagaugaagaacaacgaggagaugaugaucggcgaggccauggccgagaccggccacgacggcgagaccgagaacgagggcaucaccaccaagaccuccaagcccgacgaggccgagaccaacaugcucaccgccgagauggacaacuucgucugcgacaccgucgagauguccaccgaggagggcaucaucgacgccaacaagaccgagaccaacaccgaguacuccaaguccgaggagaagcucgacaacaaccagauggucauggaguccgacauccuccaggaggaccaccacaccucccagaaggucgaggagcccucccagugccucgccuccggcaccgccaucuccgagcucaucaucgaggacaacaacgccuccccccagaagcuccgcgagcucgaccccucccucgucuccgccaacgacucccccuccggcaugcagacccgcugcgucugguccccccucgccucccccuccaccuccauccucaagcgcggccucaagcgcucccaggaggacgagaucuccucccccgucaacaagguccgccgcgucuccuucgccgaccccaucuaccaggccggccucgccgacgacaucgaccgccgcugcuccaucguccgcucccacuccuccaacuccucccccaucggcaaguccgucaagaccucccccaccacccaguccaagaucuccgagauggccaaggaguccauccccugccccaccgaguccgucuaccccccccucgucaacugcgucgcccccgucgacaucauccucccccagaucaccuccaacaugugggcccgcggccucggccagcucauccgcgccaagaacaucaagaccaucggcgaccucuccacccucaccgccuccgagaucaagacccuccccauccgcucccccaaggucuccaacgucaagaaggcccuccgcaucuaccacgagcagcaggucaagacccgcggccucgaggagauccccgucuucgacaucuccgagaagaccgucaacggcaucgagaacaagucccucucccccgacgaggagcgccucgucuccgacaucaucgaccccgucgcccucgagaucccccucuccaagaaccuccucgcccagaucuccgcccucgcccuccagcucgacuccgaggaccuccacaacuacuccggcucccagcucuucgagaugcacgagaagcucuccugcauggccaacuccgucaucaagaaccuccagucccgcuggcgcucccccucccacgagaacuccaucuga

SEQ ID NO: 48772 - RNA, 1206 nt, Artificial Sequence
  derived and/or modified sequence opt2 from RILP__Homo_sapiens__NP_113618
auggagccccgccgcgccgcccccggcguccccggcuggggcucccgcgaggccgccggcuccgccuccgccgccgagcucgucuaccaccucgccggcgcccucggcaccgagcuccaggaccucgcccgccgcuucggccccgaggccgccgccggccucgucccccucgucguccgcgcccucgagcuccucgagcaggccgccgucggccccgcccccgacucccuccaggucuccgcccagcccgccgagcaggagcuccgccgccuccgcgaggagaacgagcgccuccgccgcgagcuccgcgccggcccccaggaggagcgcgcccuccuccgccagcucaaggaggucaccgaccgccagcgcgacgagcuccgcgcccacaaccgcgaccuccgccagcgcggccaggagaccgaggcccuccaggagcagcuccagcgccuccuccucgucaacgccgagcuccgccacaagcucgccgccaugcagacccagcuccgcgccgcccaggaccgcgagcgcgagcgccagcagcccggcgaggccgccaccccccaggccaaggagcgcgcccgcggccaggccggccgccccggccaccagcacggccaggagcccgagugggccaccgccggcgccggcgcccccggcaaccccgaggaccccgccgaggccgcccagcagcucggccgccccuccgaggccggccagugccgcuucucccgcgaggaguucgagcagauccuccaggagcgcaacgagcucaaggccaaggucuuccuccucaaggaggagcucgccuacuuccagcgcgagcuccucaccgaccaccgcguccccggccuccuccucgaggccaugaaggucgccguccgcaagcagcgcaagaagaucaaggccaagaugcucggcacccccgaggaggccgaguccuccgaggacgaggccggccccuggauccuccucuccgacgacaagggcgaccacccccccccccccgaguccaagauccaguccuucuucggccucugguaccgcggcaaggccgaguccuccgaggacgagaccuccucccccgcccccuccaagcucggcggcgaggaggaggcccagccccagucccccgcccccgacccccccugcuccgcccuccacgagcaccucugccucggcgccuccgccgcccccgaggccuga

SEQ ID NO: 48773 - RNA, 1212 nt, Artificial Sequence
  derived and/or modified sequence opt2 from RILPL1__Homo_sapiens__NP_847884
auggaggaggagcgcggcuccgcccucgccgccgaguccgcccucgagaagaacgucgccgagcucaccgucauggacgucuacgacaucgccucccucgucggccacgaguucgagcgcgucaucgaccagcacggcugcgaggccaucgcccgccucaugcccaaggucguccgcguccucgagauccucgagguccucgucucccgccaccacgucgcccccgagcucgacgagcuccgccucgagcucgaccgccuccgccucgagcgcauggaccgcaucgagaaggagcgcaagcaccagaaggagcucgagcucgucgaggacgucuggcgcggcgaggcccaggaccuccucucccagaucgcccagcuccaggaggagaacaagcagcucaugaccaaccucucccacaaggacgucaacuucuccgaggaggaguuccagaagcacgagggcauguccgagcgcgagcgccaggucaugaagaagcucaaggaggucgucgacaagcagcgcgacgagauccgcgccaaggaccgcgagcucggccucaagaacgaggacgucgaggcccuccagcagcagcagacccgccucaugaagaucaaccacgaccuccgccaccgcgucaccgucgucgaggcccagggcaaggcccucaucgagcagaaggucgagcucgaggccgaccuccagaccaaggagcaggagaugggcucccuccgcgccgagcucggcaagcuccgcgagcgccuccagggcgagcacucccagaacggcgaggaggagcccgagaccgagcccgucggcgaggaguccaucuccgacgccgagaaggucgccauggaccucaaggaccccaaccgcccccgcuucacccuccaggagcuccgcgacguccuccacgagcgcaacgagcucaaguccaaggucuuccuccuccaggaggagcucgccuacuacaaguccgaggagauggaggaggagaaccgcaucccccagcccccccccaucgcccacccccgcaccuccccccagcccgaguccggcaucaagcgccucuucuccuucuucucccgcgacaagaagcgccucgccaacacccagcgcaacguccacauccaggaguccuucggccagugggccaacacccaccgcgacgacggcuacaccgagcagggccaggaggcccuccagcaccucuga

SEQ ID NO: 48774 - RNA, 3159 nt, Artificial Sequence
  derived and/or modified sequence opt2 from RIMBP2__Homo_sapiens__NP_056162
augcgcgaggccgccgagcgccgccagcagcuccagcucgagcacgaccaggcccucgccguccucuccgccaagcagcaggagaucgaccuccuccagaaguccaagguccgcgagcucgaggagaagugccgcacccaguccgagcaguucaaccuccucucccgcgaccucgagaaguuccgccagcacgccggcaagaucgaccuccucggcggcuccgccgucgccccccucgacaucuccaccgcccccuccaagcccuucccccaguucaugaacggccucgccaccucccucggcaagggccaggaguccgccaucggcggcuccuccgccaucggcgaguacauccgcccccucccccagcccggcgaccgccccgagccccucuccgccaagcccaccuuccucucccgcuccggcuccgcccgcugccgcuccgaguccgacauggagaacgagcgcaacuccaacaccuccaagcagcgcuacuccggcaagguccaccucugcgucgcccgcuacuccuacaaccccuucgacggccccaacgagaaccccgaggccgagcucccccucaccgccggcaaguaccucuacgucuacggcgacauggacgaggacggcuucuacgagggcgagcuccucgacggccagcgcggccucguccccuccaacuucgucgacuucguccaggacaacgagucccgccucgccuccacccucggcaacgagcaggaccagaacuucaucaaccacuccggcaucggccucgagggcgagcacauccucgaccuccacucccccacccacaucgacgccggcaucaccgacaacuccgccggcacccucgacgucaacaucgacgacaucggcgaggacaucguccccuacccccgcaagaucacccucaucaagcagcucgccaaguccgucaucgucggcugggagccccccgccgucccccccggcuggggcaccgucuccuccuacaacguccucgucgacaaggagacccgcaugaaccucacccucggcucccgcaccaaggcccucaucgagaagcucaacauggccgccugcaccuaccgcaucuccguccagugcgucaccucccgcggcuccuccgacgagcuccagugcacccuccucgucggcaaggacgucgucgucgcccccucccaccuccgcgucgacaacaucacccagaucuccgcccagcucuccuggcuccccaccaacuccaacuacucccacgucaucuuccucaacgaggaggaguucgacaucgucaaggccgcccgcuacaaguaccaguucuucaaccuccgccccaacauggccuacaaggucaagguccucgccaagccccaccagaugcccuggcagcucccccucgagcagcgcgagaagaaggaggccuucgucgaguucuccacccuccccgccggcccccccgcccccccccaggacgucaccguccaggccggcgucacccccgccaccauccgcgucuccuggcgcccccccguccucacccccaccggccucuccaacggcgccaacgucaccggcuacggcgucuacgccaagggccagcgcgucgccgaggucaucuuccccaccgccgacuccaccgccgucgagcucguccgccuccgcucccucgaggccaagggcgucaccguccgcacccucuccgcccagggcgaguccgucgacuccgccgucgccgccgucccccccgagcuccucgucccccccaccccccacccccgccccgccccccaguccaagccccucgccuccuccggcguccccgagaccaaggacgagcaccucggcccccacgcccgcauggacgaggccugggagcagucccgcgcccccggccccguccacggccacaugcucgagccccccgucggccccggccgccgcucccccucccccucccgcauccucccccagccccagggcacccccgucuccaccaccgucgccaaggccauggcccgcgaggccgcccagcgcgucgccgaguccucccgccucgagaagcgcuccgucuuccucgagcgcuccuccgccggccaguacgccgccuccgacgaggaggacgccuacgacucccccgacuucaagcgccgcggcgccuccgucgacgacuuccucaagggcuccgagcucggcaagcagccccacugcugccacggcgacgaguaccacaccgaguccucccgcggcuccgaccucuccgacaucauggaggaggacgaggaggagcucuacuccgagaugcagcucgaggacggcggccgccgccgccccuccggcaccucccacaacgcccucaagauccucggcaaccccgccuccgccggccgcgucgaccacaugggccgccgcuucccccgcggcuccgccggcccccagcgcucccgccccgucaccguccccuccaucgacgacuacggccgcgaccgccucucccccgacuucuacgaggaguccgagaccgaccccggcgccgaggagcuccccgcccgcaucuucgucgcccucuucgacuacgacccccucaccaugucccccaaccccgacgccgccgaggaggagcuccccuucaaggagggccagaucaucaaggucuacggcgacaaggacgccgacggcuucuaccgcggcgagaccugcgcccgccucggccucauccccugcaacauggucuccgagauccaggccgacgacgaggagaugauggaccagcuccuccgccagggcuuccucccccucaacacccccgucgagaagaucgagcgcucccgccgcuccggccgccgccacuccgucuccacccgccgcauggucgcccucuacgacuacgacccccgcgaguccucccccaacgucgacgucgaggccgagcucaccuucugcaccggcgacaucaucaccgucuucggcgagaucgacgaggacggcuucuacuacggcgagcucaacggccagaagggccucguccccuccaacuuccucgaggagguccccgacgacgucgaggucuaccucuccgacgcccccucccacuacucccaggacacccccaugcgcuccaaggccaagcgcaagaaguccguccacuucacccccuga

SEQ ID NO: 48775 - RNA, 4920 nt, Artificial Sequence
  derived and/or modified sequence opt2 from RIMBP3C__Homo_sapiens__NP_001122105
auggccaaggacucccccuccccccucggcgccucccccaagaagcccggcugcuccucccccgccgccgccguccucgagaaccagcgccgcgagcucgagaagcuccgcgccgagcucgaggccgagcgcgccggcuggcgcgccgagcgccgccgcuucgccgcccgcgagcgccagcuccgcgaggaggccgagcgcgagcgccgccagcucgccgaccgccuccgcuccaagugggaggcccagcgcucccgcgagcuccgccagcuccaggaggagaugcagcgcgagcgcgaggccgagauccgccagcuccuccgcuggaaggaggccgagcagcgccagcuccagcagcuccuccaccgcgagcgcgacggcgucguccgccaggcccgcgagcuccagcgccagcucgccgaggagcucgucaaccgcggccacugcucccgccccggcgccuccgaggucuccgccgcccagugccgcugccgccuccaggagguccucgcccagcuccgcuggcagaccgacggcgagcaggccgcccgcauccgcuaccuccaggccgcccucgaggucgagcgccagcucuuccucaaguacauccucgcccacuuccgcggccaccccgcccucuccggcucccccgacccccaggccguccacucccucgaggagccccucccccagaccuccuccggcuccugccacgcccccaagcccgccugccagcucggcucccucgacucccucuccgccgaggucggcguccgcucccgcucccucggccucgucuccuccgccugcuccuccucccccgacggccuccucuccacccacgccuccucccucgacugcuucgcccccgccugcucccgcucccucgacuccacccgcucccuccccaaggccuccaaguccgaggagcgccccuccucccccgacaccuccacccccggcucccgccgccucucccccccccccuccccccucccccccccccccccccccuccgcccaccgcaagcucuccaacccccgcggcggcgagggcuccgagucccagcccugcgagguccucacccccuccccccccggccucggccaccacgagcucaucaagcucaacuggcuccucgccaaggcccucuggguccucgcccgccgcugcuacacccuccaggaggagaacaagcagcuccgccgcgccggcugccccuaccaggccgacgagaaggucaagcgccucaaggucaagcgcgccgagcucaccggccucgcccgccgccucgccgaccgcgcccgcgagcuccaggagaccaaccuccgcgccgucuccgcccccauccccggcgaguccugcgccggccucgagcucugccaggucuucgcccgccagcgcgcccgcgaccucuccgagcaggccuccgccccccucgccaaggacaagcagaucgaggagcuccgccaggagugccaccuccuccaggcccgcgucgccuccggccccugcuccgaccuccacaccggccgcggcggccccugcacccaguggcucaacguccgcgaccucgaccgccuccagcgcgagucccagcgcgagguccuccgccuccagcgccagcucaugcuccagcagggcaacggcggcgccuggcccgaggccggcggccaguccgccaccugcgaggagguccgccgccagaugcucgcccucgagcgcgagcucgaccagcgccgccgcgagugccaggagcucggcacccaggccgcccccgcccgccgccgcggcgaggaggccgagacccagcuccaggccgcccuccucaagaacgccuggcucgccgaggagaacggccgccuccaggccaagaccgacuggguccgcaaggucgaggccgagaacuccgagguccgcggccaccucggccgcgccugccaggagcgcgacgccuccggccucaucgccgagcagcuccuccagcaggccgcccgcggccaggaccgccagcagcagcuccagcgcgacccccagaaggcccucugcgaccuccaccccuccuggaaggagauccaggcccuccagugccgccccggccacccccccgagcagcccugggagaccucccagaugcccgagucccaggucaagggcucccgccgccccaaguuccacgcccgccccgaggacuacgccgucucccagcccaaccgcgacauccaggagaagcgcgaggccucccucgaggagucccccgucgcccucggcgaguccgccuccgucccccaggucuccgagaccguccccgccucccagccccucuccaagaagaccuccucccaguccaacuccuccuccgagggcuccaugugggccaccguccccuccucccccacccucgaccgcgacaccgccuccgaggucgacgaccucgagcccgacuccgucucccucgcccucgagaugggcggcuccgccgcccccgccgcccccaagcucaagaucuucauggcccaguacaacuacaaccccuucgagggccccaacgaccaccccgagggcgagcucccccucaccgccggcgacuacaucuacaucuucggcgacauggacgaggacggcuucuacgagggcgagcucgacgacggccgccgcggccucguccccuccaacuucgucgagcagauccccgacuccuacauccccggcugccuccccgccaagucccccgaccucggccccucccagcuccccgccggccaggacgaggcccucgaggaggacucccuccucuccggcaaggcccagggcauggucgaccgcggccucugccagaugguccgcgucggcuccaagaccgaggucgccaccgagauccucgacaccaagaccgaggccugccagcucggccuccuccaguccaugggcaagcagggccucucccgcccccuccucggcaccaagggcguccuccgcauggcccccaugcagcuccaccuccagaacgucaccgccaccuccgccaacaucaccugggucuacuccucccaccgccacccccacgucgucuaccucgacgaccgcgagcacgcccucacccccgccggcgucuccugcuacaccuuccagggccucugccccggcacccacuaccgcguccgcgucgagguccgccuccccugggaccuccuccaggucuacuggggcaccauguccuccaccgucaccuucgacacccuccucgccggcccccccuaccccccccucgacguccucgucgagcgccacgccucccccggcguccucgucgucuccuggcuccccgucaccaucgacuccgccggcuccuccaacggcguccaggucaccggcuacgccgucuacgccgacggccucaaggucugcgaggucgccgacgccaccgccggcuccaccguccucgaguucucccagcuccaggucccccucaccuggcagaaggucuccguccgcaccaugucccucugcggcgagucccucgacuccguccccgcccagauccccgaggacuucuucaugugccaccgcuggcccgagaccccccccuucuccuacaccugcggcgaccccuccaccuaccgcgucaccuuccccgucugcccccagaagcucucccucgccccccccuccgccaaggccuccccccacaaccccggcuccugcggcgagccccaggccaaguuccucgaggccuucuucgaggagcccccccgccgccagucccccgucuccaaccucggcuccgagggcgagugccccuccuccggcgccggcucccaggcccaggagcucgccgaggccugggagggcugccgcaaggaccuccucuuccagaaguccccccagaaccaccgcccccccuccgucuccgaccagcccggcgagaaggagaacugcuaccagcacaugggcaccuccaagucccccgcccccggcuucauccaccuccgcaccgagugcggcccccgcaaggagcccugccaggagaaggccgcccucgagcgcguccuccgccagaagcaggacgcccagggcuucacccccccccagcucggcgccucccagcaguacgccuccgacuuccacaacguccucaaggaggagcaggaggcccucugccucgaccuccgcggcaccgagcgccgcgaggagcgccgcgagcccgagccccacucccgccagggccaggcccucggcgucaagcgcggcugccagcuccacgagcccuccuccgcccucugccccgcccccuccgccaaggucaucaagaugccccgcggcggcccccagcagcucggcaccggcgccaacacccccgcccgcgucuucgucgcccucuccgacuacaacccccucgucauguccgccaaccucaaggccgccgaggaggagcucgucuuccagaagcgccagcuccuccgcgucuggggcucccaggacacccacgacuucuaccucuccgagugcaaccgccaggucggcaacauccccggccgccucgucgccgagauggaggucggcaccgagcagaccgaccgccgcuggcgcucccccgcccagggccaccuccccuccgucgcccaccucgaggacuuccagggccucaucaucccccagggcuccucccucguccuccagggcaacuccaagcgccucccccucuggacccccaagaucaugaucgccgcccucgacuacgaccccggcgacggccagaugggcggccagggcaagggccgccucgcccuccgcgccggcgacgucgucauggucuacggccccauggacgaccagggcuucuacuacggcgagcucggcggccaccgcggccucguccccgcccaccuccucgaccacaugucccuccacggccacuga

SEQ ID NO: 48776 - RNA, 3039 nt, Artificial Sequence
  derived and/or modified sequence opt2 from RIMS1__Homo_sapiens__NP_001161879
augugcgcccccggcauccacgucuccuccgagggcugggaggagguccgcuccgucgacuccgaggagggcaccaucgaggcccgccgcgccgucgccggcgaccucgacuacuacuggcucgaccccgccaccuggcacucccgcgagaccucccccaucuccucccaccccgucaccuggcagcccuccaaggagggcgaccgccucaucggccgcgucauccucaacaagcgcaccaccaugcccaaggacuccggcgcccuccucggccucaaggucgucggcggcaagaugaccgaccucggccgccucggcgccuucaucaccaaggucaagaagggcucccucgccgacgucgucggccaccuccgcgccggcgacgagguccucgaguggaacggcaagccccuccccggcgccaccaacgaggaggucuacaacaucauccucgaguccaaguccgagccccaggucgagaucaucgucucccgccccaucggcgacaucccccgcauccccgaguccucccaccccccccucgaguccuccuccuccuccuucgagucccagaagauggagcgccccuccaucuccgucaucucccccaccucccccggcgcccucaaggacgccccccagguccuccccggccagcucuccgucaagcucugguacgacaaggucggccaccagcucaucgucaacguccuccaggccaccgaccuccccgcccgcgucgacggccgcccccgcaaccccuacgucaagauguacuuccuccccgaccgcuccgacaaguccaagcgccgcaccaagaccgucaagaagauccucgagcccaaguggaaccagaccuucgucuacucccacguccaccgccgcgacuuccgcgagcgcaugcucgagaucaccgucugggaccagccccgcguccaggaggaggaguccgaguuccucggcgagauccucaucgagcucgagaccgcccuccucgacgacgagccccacugguacaagcuccagacccacgacgaguccucccucccccucccccagcccucccccuucaugccccgccgccacauccacggcgaguccuccuccaagaagcuccagcgcucccagcgcaucuccgacuccgacaucuccgacuacgaggucgacgacggcaucggcgucgucccccccggcuaccgcuccuccgcccgcgaguccaaguccaccacccucaccguccccgagcagcagcgcaccacccaccaccgcucccgcuccgucuccccccaccgcggcaacgaccagggcaagccccgcucccgccuccccaacgucccccuccagcgcucccucgacgagauccaccccacccgccgcucccgcucccccacccgccaccacgacgccucccgcucccccgucgaccaccgcacccgcgacgucgacucccaguaccucuccgagcaggacuccgagcuccucaugcucccccgcgccaagcgcggccgcuccgccgagugccuccacaccaccuccgagcuccagcccuuccucgaccgcgcccgcuccgccuccaccaacugccuccgccccgacaccucccuccacucccccgagcgcgagcgccacucccgcaaguccgagcgcuccuccauccagaagcagacccgcaagggcaccgccuccgacgccgagcgcaugcaccgccagcgcucccccacccaguccccccccgccgacaccuccuucuccucccgccgcggccgccagcucccccagguccccguccgcuccggcuccaucgagcaggccucccucgucgucgaggagcgcacccgccagaugaagaugaagguccaccgcuucaagcagaccaccggcuccggcuccucccaggagcucgaccgcgagcaguacuccaaguacaacauccacaaggaccaguaccgcuccugcgacaacgucuccgccaaguccuccgacuccgacgucuccgacgucuccgccaucucccgcaccuccuccgccucccgccucuccuccaccuccuucauguccgagcaguccgagcgcccccgcggccgcaucuccuccuucacccccaagaugcagggccgccgcaugggcaccuccggccgcuccaucaugaaguccaccuccgucuccggcgagauguacacccucgagcacaacgacggcucccaguccgacaccgccgucggcaccgucggcgccggcggcaagaagcgccgcuccucccucuccgccaaggucgucgccaucgucucccgccgcucccgcuccaccucccagcucucccagaccgaguccggccacaagaagcucaaguccaccauccagcgcuccaccgagaccggcauggccgccgagaugcgcaagaugguccgccagcccucccgcgaguccaccgacggcuccaucaacuccuacuccuccgagggcaaccucaucuuccccggcguccgccucggcgccgacucccaguucuccgacuuccucgacggccucggccccgcccagcucgucggccgccagacccucgccacccccgccaugggcgacauccagaucggcauggaggacaagaagggccagcucgaggucgaggucauccgcgcccgcucccucacccagaagcccggcuccaaguccacccccgcccccuacgucaaggucuaccuccucgagaacggcgccugcaucgccaagaagaagacccgcaucgcccgcaagacccucgacccccucuaccagcagucccucgucuucgacgaguccccccagggcaagguccuccaggucaucgucuggggcgacuacggccgcauggaccacaagugcuucaugggcgucgcccagauccuccucgaggagcucgaccucuccuccauggucaucggcugguacaagcucuucccccccuccucccucgucgaccccacccucaccccccucacccgccgcgccucccaguccucccucgaguccuccaccggcccccccugcauccgcuccuga

SEQ ID NO: 48777 - RNA, 4050 nt, Artificial Sequence
  derived and/or modified sequence opt2 from RIMS2__Homo_sapiens__NP_001093587
auguccgcccccgucggcccccgcggccgccucgcccccauccccgccgccucccagcccccccuccagcccgagaugcccgaccucucccaccucaccgaggaggagcgcaagaucauccucgccgucauggaccgccagaagaaggaggaggagaaggagcaguccguccucaagaagcuccaccagcaguucgagauguacaaggagcaggucaagaagaugggcgaggagucccagcagcagcaggagcagaagggcgacgcccccaccugcggcaucugccacaagaccaaguucgccgacggcugcggccacaacugcuccuacugccagaccaaguucugcgcccgcugcggcggccgcgucucccuccgcuccaacaaggucaugugggucugcaaccucugccgcaagcagcaggagauccucaccaaguccggcgccugguucuacaacuccggcuccaacaccccccagcagcccgaccagaagguccuccgcggccuccgcaacgaggaggccccccaggagaagaagcccaagcuccacgagcagacccaguuccagggccccuccggcgaccucuccguccccgccgucgagaagucccgcucccacggccucacccgccagcacuccaucaagaacggcuccggcgucaagcaccacaucgccuccgacaucgccuccgaccgcaagcgcucccccuccgucucccgcgaccagaaccgccgcuacgaccagcgcgaggagcgcgaggaguacucccaguacgccaccuccgacaccgccaugccccgcucccccuccgacuacgccgaccgccgcucccagcacgagccccaguucuacgaggacuccgaccaccucuccuaccgcgacuccaaccgccgcucccaccgccacuccaaggaguacaucgucgacgacgaggacgucgagucccgcgacgaguacgagcgccagcgccgcgaggaggaguaccagucccgcuaccgcuccgaccccaaccucgcccgcuaccccgucaagccccagcccuacgaggagcagaugcgcauccacgccgaggucucccgcgcccgccacgagcgccgccacuccgacgucucccucgccaacgccgaccucgaggacucccgcaucuccaugcuccgcauggaccgccccucccgccagcgcuccaucuccgagcgccgcgccgccauggagaaccagcgcuccuacuccauggagcgcacccgcgaggcccagggccccuccuccuacgcccagcgcaccaccaaccacuccccccccaccccccgccgcuccccccuccccaucgaccgccccgaccuccgccgcaccgacucccuccgcaagcagcaccaccucgaccccuccuccgccguccgcaagaccaagcgcgagaagauggagaccaugcuccgcaacgacucccucuccuccgaccaguccgaguccguccgcccccccccccccaagccccacaaguccaagaagggcggcaagaugcgccagaucucccucuccuccuccgaggaggagcucgccuccacccccgaguacaccuccugcgacgacgucgagaucgaguccgaguccgucuccgagaagggcgacauggacuacaacuggcucgaccacaccuccuggcacuccuccgaggccucccccaugucccuccaccccgucaccuggcagcccuccaaggacggcgaccgccucaucggccgcauccuccucaacaagcgccucaaggacggcuccgucccccgcgacuccggcgccaugcucggccucaaggucgucggcggcaagaugaccgaguccggccgccucugcgccuucaucaccaaggucaagaagggcucccucgccgacaccgucggccaccuccgccccggcgacgagguccucgaguggaacggccgccuccuccagggcgccaccuucgaggaggucuacaacaucauccucgaguccaagcccgagccccaggucgagcucgucgucucccgccccaucggcgacaucccccgcauccccgacuccacccacgcccagcucgaguccuccuccuccuccuucgagucccagaagauggaccgccccuccaucuccgucaccucccccaugucccccggcaugcuccgcgacgucccccaguuccucuccggccagcucuccucccagucccucucccgccgcaccacccccuucgucccccgcguccagaucaagcucugguucgacaaggucggccaccagcucaucgucaccauccucggcgccaaggaccuccccucccgcgaggacggccgcccccgcaaccccuacgucaagaucuacuuccuccccgaccgcuccgacaagaacaagcgccgcaccaagaccgucaagaagacccucgagcccaaguggaaccagaccuucaucuacucccccguccaccgccgcgaguuccgcgagcgcaugcucgagaucacccucugggaccaggcccgcguccgcgaggaggaguccgaguuccucggcgagauccucaucgagcucgagaccgcccuccucgacgacgagccccacugguacaagcuccagacccacgacgucuccucccucccccucccccaccccucccccuacaugccccgccgccagcuccacggcgagucccccacccgccgccuccagcgcuccaagcgcaucuccgacuccgaggucuccgacuacgacugcgacgacggcaucggcgucgucuccgacuaccgccacgacggccgcgaccuccaguccuccacccucuccguccccgagcaggucauguccuccaaccacugcucccccuccggcuccccccaccgcgucgacgucaucggccgcacccgcuccuggucccccuccgucccccccccccagucccgcaacgucgagcagggccuccgcggcacccgcaccaugaccggccacuacaacaccaucucccgcauggaccgccaccgcgucauggacgaccacuacucccccgaccgcgaccgcgacugcgaggccgccgaccgccagcccuaccaccgcucccgcuccaccgagcagcgcccccuccucgagcgcaccaccacccgcucccgcuccaccgagcgccccgacaccaaccucaugcgcuccaugcccucccucaugaccggccgcuccgccccccccucccccgcccucucccgcucccacccccgcaccggcuccguccagaccucccccuccuccacccccgucgccggccgccgcggccgccagcucccccagcucccccccaagggcacccucgaccgcaaggccggcggcaagaagcuccgcuccaccguccagcgcuccaccgagaccggccucgccgucgagaugcgcaacuggaugacccgccaggccucccgcgaguccaccgacggcuccaugaacuccuacuccuccgagggcaaccucaucuuccccggcguccgccucgccuccgacucccaguucuccgacuuccucgacggccucggccccgcccagcucgucggccgccagacccucgccacccccgccaugggcgacauccaggucggcaugauggacaagaagggccagcucgaggucgagaucauccgcgcccgcggccucgucgucaagcccggcuccaagacccuccccgcccccuacgucaaggucuaccuccucgacaacggcgucugcaucgccaagaagaagaccaaggucgcccgcaagacccucgagccccucuaccagcagcuccucuccuucgaggaguccccccagggcaagguccuccagaucaucgucuggggcgacuacggccgcauggaccacaaguccuucaugggcgucgcccagauccuccucgacgagcucgagcucuccaacauggucaucggcugguucaagcucuucccccccuccucccucgucgaccccacccucgccccccucacccgccgcgccucccaguccucccucgaguccuccaccggccccuccuacucccgcuccuga

SEQ ID NO: 48778 - RNA, 813 nt, Artificial Sequence
  derived and/or modified sequence opt2 from RIMS4__Homo_sapiens__NP_001192246
auggagcgcucccagucccgccucucccucuccgccuccuucgaggcccucgccaucuacuuccccugcaugaacuccuucgacgacgaggacgccgagggcgacucccgccgccucaagggcgccauccagcgcuccaccgagaccggccucgccgucgagaugcccucccgcacccuccgccaggccucccacgaguccaucgaggacuccaugaacuccuacggcuccgagggcaaccucaacuacggcggcgucugccucgccuccgacgcccaguucuccgacuuccucggcuccaugggccccgcccaguucgucggccgccagacccucgccaccacccccaugggcgacgucgagaucggccuccaggagcgcaacggccagcucgaggucgacaucauccaggcccgcggccucaccgccaagcccggcuccaagacccuccccgccgccuacaucaaggccuaccuccucgagaacggcaucugcaucgccaagaagaagaccaaggucgcccgcaagucccucgacccccucuacaaccagguccuccucuuccccgaguccccccagggcaagguccuccaggucaucgucuggggcaacuacggccgcauggagcgcaagcaguucaugggcgucgcccgcguccuccucgaggagcucgaccucaccacccucgccgucggcugguacaagcucuuccccaccuccuccauggucgaccccgccaccggcccccuccuccgccaggccucccagcucucccucgaguccaccgucggccccugcggcgagcgcuccuga

SEQ ID NO: 48779 - RNA, 2352 nt, Artificial Sequence
  derived and/or modified sequence opt2 from RIN1__Homo_sapiens__NP_004283
auggagucccccggcgaguccggcgccggcucccccggcgcccccucccccuccuccuucaccaccggccaccucgcccgcgagaagcccgcccaggacccccucuacgacguccccaacgccuccggcggccaggccggcggcccccagcgccccggccgcgucgucucccuccgcgagcgccuccuccucacccgccccgucuggcuccagcuccaggccaacgccgccgccgcccuccacaugcuccgcaccgagccccccggcaccuuccucguccgcaaguccaacacccgccagugccaggcccucugcaugcgccuccccgaggccuccggccccuccuucgucuccucccacuacauccucgagucccccggcggcgucucccucgagggcuccgagcucauguuccccgaccucguccagcucaucugcgccuacugccacacccgcgacauccuccuccucccccuccagcucccccgcgccauccaccacgccgccacccacaaggagcucgaggccaucucccaccucggcaucgaguucugguccuccucccucaacaucaaggcccagcgcggccccgccggcggccccguccucccccagcucaaggcccgcuccccccaggagcucgaccagggcaccggcgccgcccucugcuucuucaacccccucuuccccggcgaccucggccccaccaagcgcgagaaguucaagcgcuccuucaagguccgcgucuccaccgagaccuccuccccccucuccccccccgccgucccccccccccccguccccguccuccccggcgccguccccucccagaccgagcgccucccccccugccagcuccuccgccgcgaguccuccgucggcuaccgcguccccgccggcuccggccccucccucccccccaugcccucccuccaggaggucgacugcggcucccccuccuccuccgaggaggagggcguccccggcucccgcggcucccccgccaccuccccccaccucggccgccgccgcccccuccuccgcuccauguccgccgccuucugcucccuccucgcccccgagcgccaggucggccgcgccgccgccgcccucaugcaggaccgccacaccgccgccggccagcucguccaggaccuccucacccagguccgcgccggccccgagccccaggagcuccagggcauccgccaggcccucucccgcgcccgcgccaugcucuccgccgagcucggccccgagaagcuccucucccccaagcgccucgagcacguccucgagaagucccuccacugcuccguccucaagccccuccgccccauccucgccgcccgccuccgccgccgccucgccgccgacggcucccucggccgccucgccgagggccuccgccucgcccgcgcccagggccccggcgccuucggcucccaccucucccuccccucccccgucgagcucgagcagguccgccagaagcuccuccagcuccuccgcaccuacucccccuccgcccaggucaagcgccuccuccaggccugcaagcuccucuacauggcccuccgcacccaggagggcgagggcgccggcgccgacgaguuccucccccuccucucccucguccucgcccacugcgaccuccccgagcuccuccucgaggccgaguacauguccgagcuccucgagcccucccuccucaccggcgagggcggcuacuaccucaccucccucuccgccucccucgcccuccucuccggccucggccaggcccacacccucccccucucccccguccaggagcuccgccgcucccucucccucugggagcagcgccgccuccccgccacccacugcuuccagcaccuccuccgcgucgccuaccaggaccccuccuccggcugcaccuccaagacccucgccgucccccccgaggccuccaucgccacccucaaccagcucugcgccaccaaguuccgcgucacccagcccaacaccuucggccucuuccucuacaaggagcagggcuaccaccgccucccccccggcgcccucgcccaccgccuccccaccaccggcuaccucgucuaccgccgcgccgaguggcccgagacccagggcgccgucaccgaggaggagggcuccggccaguccgaggcccgcucccgcggcgaggagcagggcugccagggcgacggcgacgccggcgucaaggccuccccccgcgacauccgcgagcaguccgagaccaccgccgagggcggccagggccaggcccaggagggccccgcccagcccggcgagcccgaggccgagggcucccgcgccgccgaggaguga

SEQ ID NO: 48780 - RNA, 2835 nt, Artificial Sequence
  derived and/or modified sequence opt2 from RIN2__Homo_sapiens__NP_001229510
augcucgacuccuucucccaggaguccacccuccccuuccgcgaggcccgcaagcgcaccuccuuccagcccguccaggucuggcgcaacuucaccgccucccagaccaccgagucccccgccugcuccggcgccucccucggcgagaugaccgccuggaccaugggcgcccgcggccucgacaagcgcggcuccuucuucaagcucaucgacaccaucgccuccgagaucggcgagcucaagcaggagaugguccgcaccgacgucaaccucgagaacggccucgagcccgccgagacccacuccaugguccgccacaaggacggcggcuacuccgaggaggaggacgucaagaccugcgcccgcgacuccggcuacgacucccucuccaaccgccucuccauccucgaccgccuccuccacacccaccccaucuggcuccagcucucccucuccgaggaggaggccgccgagguccuccaggcccagccccccggcaucuuccucguccacaaguccaccaagaugcagaagaagguccucucccuccgccuccccugcgaguucggcgccccccucaaggaguucgccaucaaggaguccaccuacaccuucucccucgagggcuccggcaucuccuucgccgaccucuuccgccucaucgccuucuacugcaucucccgcgacguccuccccuucacccucaagcuccccuacgccaucuccaccgccaaguccgaggcccagcucgaggagcucgcccagaugggccucaacuucugguccucccccgccgacuccaagccccccaaccucccccccccccaccgcccccucuccuccgacggcgucugccccgccucccuccgccagcucugccucaucaacggcguccacuccaucaagacccgcacccccuccgagcucgagugcucccagaccaacggcgcccucugcuucaucaacccccucuuccucaagguccacucccaggaccucuccggcggccucaagcgccccuccacccgcacccccaacgccaacggcaccgagcgcacccgcuccccccccccccgcccccccccccccgccaucaacucccuccacaccuccccccgccucgcccgcaccgagacccagaccuccaugcccgagaccgucaaccacaacaagcacggcaacgucgcccuccccggcaccaagcccacccccaucccccccccccgccucaagaagcaggccuccuuccucgaggccgagggcggcgccaagacccucuccggcggccgccccggcgccggccccgagcucgagcucggcaccgccggcucccccggcggcgccccccccgaggccgcccccggcgacugcacccgcgcccccccccccuccuccgagucccgcccccccugccacggcggccgccagcgccucuccgacauguccaucuccaccuccuccuccgacucccucgaguucgaccgcuccaugccccucuucggcuacgaggccgacaccaacuccucccucgaggacuacgagggcgaguccgaccaggagaccauggccccccccaucaaguccaagaagaagcgcuccuccuccuucguccuccccaagcucgucaagucccagcuccagaaggucuccggcgucuucuccuccuucaugacccccgagaagcgcaugguccgccgcaucgccgagcucucccgcgacaagugcaccuacuucggcugccucguccaggacuacgucuccuuccuccaggagaacaaggagugccacgucuccuccaccgacaugcuccagaccauccgccaguucaugacccaggucaagaacuaccucucccaguccuccgagcucgacccccccaucgagucccucauccccgaggaccagaucgacgucguccucgagaaggccaugcacaagugcauccucaagccccucaagggccacgucgaggccaugcucaaggacuuccacauggccgacggcuccuggaagcagcucaaggagaaccuccagcucguccgccagcgcaacccccaggagcucggcgucuucgcccccacccccgacuucgucgacgucgagaagaucaaggucaaguucaugaccaugcagaagauguacucccccgagaagaaggucaugcuccuccuccgcgucugcaagcucaucuacaccgucauggagaacaacuccggccgcauguacggcgccgacgacuuccuccccguccucaccuacgucaucgcccagugcgacaugcucgagcucgacaccgagaucgaguacaugauggagcuccucgaccccucccuccuccacggcgagggcggcuacuaccucaccuccgccuacggcgcccucucccucaucaagaacuuccaggaggagcaggccgcccgccuccucuccuccgagacccgcgacacccuccgccaguggcacaagcgccgcaccaccaaccgcaccauccccuccgucgacgacuuccagaacuaccuccgcgucgccuuccaggaggucaacuccggcugcaccggcaagacccuccucguccgccccuacaucaccaccgaggacgucugccagaucugcgccgagaaguucaaggucggcgaccccgaggaguacucccucuuccucuucgucgacgagaccuggcagcagcucgccgaggacaccuacccccagaagaucaaggccgagcuccacucccgcccccagccccacaucuuccacuucgucuacaagcgcaucaagaacgaccccuacggcaucaucuuccagaacggcgaggaggaccucaccaccuccuga

SEQ ID NO: 48781 - RNA, 2958 nt, Artificial Sequence
  derived and/or modified sequence opt2 from RIN3__Homo_sapiens__NP_079108
augauccgccacgccggcgcccccgcccgcggcgaccccaccggccccguccccgucgucggcaagggcgaggaggaggaggaggaggacggcaugcgccucugccuccccgccaaccccaagaacugccucccccaccgccgcggcaucuccauccucgagaagcucaucaagaccugccccgucuggcuccagcucucccucggccaggccgaggucgcccgcauccuccaccgcgucgucgccggcauguuccucguccgccgcgacuccuccuccaagcagcucguccucugcguccacuuccccucccucaacgaguccuccgccgagguccucgaguacaccaucaaggaggagaaguccauccucuaccucgagggcuccgcccucgucuucgaggacaucuuccgccucaucgccuucuacugcgucucccgcgaccuccuccccuucacccuccgccucccccaggccauccucgaggccuccuccuucaccgaccucgagaccaucgccaaccucggccucggcuucugggacuccucccucaaccccccccaggagcgcggcaagcccgccgagcccccccgcgaccgcgcccccggcuucccccucgucuccucccuccgccccaccgcccacgacgccaacugcgccugcgagaucgagcucuccgucggcaacgaccgccucugguucgucaaccccaucuucaucgaggacugcuccuccgcccuccccaccgaccagcccccccucggcaacugccccgcccgcccccucccccccaccuccgacgccaccucccccaccucccgcugggccccccgccgcccccccccccccccccccguccucccccuccagcccugcucccccgcccagccccccguccuccccgcccucgcccccgcccccgccugcccccuccccaccuccccccccguccccgccccccacgucaccccccacgcccccggcccccccgaccaccccaaccagccccccaugaugaccugcgagcgccuccccugccccaccgccggccucggcccccuccgcgaggaggccaugaagcccggcgccgccuccuccccccuccagcagguccccgcccccccccuccccgccaagaagaaccuccccaccgcccccccccgccgccgcgucuccgagcgcgucucccucgaggaccagucccccggcauggccgccgagggcgaccagcucucccuccccccccagggcaccuccgacggccccgaggacaccccccgcgaguccaccgagcagggccaggacaccgaggucaaggccuccgacccccacuccaugcccgagcucccccgcaccgccaagcagccccccgucccccccccccgcaagaagcgcaucucccgccagcucgccuccacccuccccgccccccucgagaacgccgagcucugcacccaggccauggcccucgagacccccacccccggccccccccgcgagggccagucccccgccucccaggccggcacccagcacccccccgcccaggccaccgcccacucccaguccucccccgaguucaagggcucccucgccucccucuccgacucccucggcgucuccgucauggccaccgaccaggacuccuacuccaccuccuccaccgaggaggagcucgagcaguucuccucccccuccgucaagaagaagcccuccaugauccucggcaaggcccgccaccgccucuccuucgccuccuucuccuccauguuccacgccuuccucuccaacaaccgcaagcucuacaagaaggucgucgagcucgcccaggacaagggcuccuacuucggcucccucguccaggacuacaaggucuacucccucgagaugauggcccgccagaccuccuccaccgagaugcuccaggagauccgcaccaugaugacccagcucaaguccuaccuccuccaguccaccgagcucaaggcccucgucgaccccgcccuccacuccgaggaggagcucgaggccaucgucgaguccgcccucuacaagugcguccucaagccccucaaggaggccaucaacuccugccuccaccagauccacuccaaggacggcucccuccagcagcucaaggagaaccagcucgucauccucgccaccaccaccaccgaccucggcgucaccaccuccguccccgagguccccaugauggagaagauccuccagaaguucaccuccaugcacaaggccuacucccccgagaagaagaucuccauccuccucaagaccugcaagcucaucuacgacuccauggcccucggcaaccccggcaagcccuacggcgccgacgacuuccuccccguccucauguacguccucgcccgcuccaaccucaccgagaugcuccucaacgucgaguacaugauggagcucauggaccccgcccuccagcucggcgagggcuccuacuaccucaccaccaccuacggcgcccucgagcacaucaaguccuacgacaagaucaccgucacccgccagcucuccgucgagguccaggacuccauccaccgcugggagcgccgccgcacccucaacaaggcccgcgccucccgcuccuccguccaggacuucaucugcgucuccuaccucgagcccgagcagcaggcccgcacccucgccucccgcgccgacacccaggcccaggcccucugcgcccagugcgccgagaaguucgccgucgagcgcccccaggcccaccgccucuucguccucgucgacggccgcugcuuccagcucgccgacgacgcccucccccacugcaucaagggcuaccuccuccgcuccgagcccaagcgcgacuuccacuucgucuaccgcccccucgacggcggcggcggcggcggcggcggcuccccccccugccucgucguccgcgagcccaacuuccucuga

SEQ ID NO: 48782 - RNA, 1221 nt, Artificial Sequence
  derived and/or modified sequence opt2 from RING1__Homo_sapiens__NP_002922
augaccacccccgccaacgcccagaacgccuccaagaccugggagcucucccucuacgagcuccaccgcaccccccaggaggccaucauggacggcaccgagaucgccgucuccccccgcucccuccacuccgagcucaugugccccaucugccucgacaugcucaagaacaccaugaccaccaaggagugccuccaccgcuucugcuccgacugcaucgucaccgcccuccgcuccggcaacaaggagugccccaccugccgcaagaagcucgucuccaagcgcucccuccgccccgaccccaacuucgacgcccucaucuccaagaucuaccccucccgcgaggaguacgaggcccaccaggaccgcguccucauccgccucucccgccuccacaaccagcaggcccucuccuccuccaucgaggagggccuccgcaugcaggccaugcaccgcgcccagcgcguccgccgccccauccccggcuccgaccagaccaccaccauguccggcggcgagggcgagcccggcgagggcgagggcgacggcgaggacgucuccuccgacuccgcccccgacuccgcccccggccccgcccccaagcgcccccgcggcggcggcgccggcggcuccuccgucggcaccggcggcggcggcaccggcggcgucggcggcggcgccggcuccgaggacuccggcgaccgcggcggcacccucggcggcggcacccucggcccccccuccccccccggcgcccccuccccccccgagcccggcggcgagaucgagcucgucuuccgcccccacccccuccucgucgagaagggcgaguacugccagacccgcuacgucaagaccaccggcaacgccaccgucgaccaccucuccaaguaccucgcccuccgcaucgcccucgagcgccgccagcagcaggaggccggcgagcccggcggccccggcggcggcgccuccgacaccggcggccccgacggcugcggcggcgagggcggcggcgccggcggcggcgacggccccgaggagcccgcccuccccucccucgagggcgucuccgagaagcaguacaccaucuacaucgcccccggcggcggcgccuucaccacccucaacggcucccucacccucgagcucgucaacgagaaguucuggaaggucucccgcccccucgagcucugcuacgcccccaccaaggaccccaaguga

SEQ ID NO: 48783 - RNA, 2379 nt, Artificial Sequence
  derived and/or modified sequence opt2 from RINT1__Homo_sapiens__NP_068749
augcuccccgccggcgagaucggcgccucccccgccgcccccugcugcuccgaguccggcgacgagcgcaagaaccucgaggagaaguccgacaucaacgucaccguccucaucggcuccaagcaggucuccgagggcaccgacaacggcgaccuccccuccuacgucuccgccuucaucgagaaggaggucggcaacgaccucaagucccucaagaagcucgacaagcucaucgagcagcgcaccgucuccaagaugcagcucgaggagcagguccucaccaucuccuccgagauccccaagcgcauccgcuccgcccucaagaacgccgaggaguccaagcaguuccucaaccaguuccucgagcaggagacccaccucuucuccgccaucaacucccaccuccucaccgcccagcccuggauggacgaccucggcaccaugaucucccagaucgaggagaucgagcgccaccucgccuaccucaaguggaucucccagaucgaggagcucuccgacaacauccagcaguaccucaugaccaacaacguccccgaggccgccuccacccucgucuccauggccgagcucgacaucaagcuccaggaguccuccugcacccaccuccucggcuucaugcgcgccaccgucaaguucuggcacaagauccucaaggacaagcucaccuccgacuucgaggagauccucgcccagcuccacuggcccuucaucgcccccccccagucccagaccgucggccucucccgccccgccuccgcccccgagaucuacuccuaccucgagacccucuucugccagcuccucaagcuccagaccuccgacgagcuccucaccgagcccaagcagcuccccgagaaguacucccuccccgccucccccuccgucauccuccccauccaggucaugcucaccccccuccagaagcgcuuccgcuaccacuuccgcggcaaccgccagaccaacguccucuccaagcccgagugguaccucgcccagguccucauguggaucggcaaccacaccgaguuccucgacgagaagauccagcccauccucgacaaggucggcucccucgucaacgcccgccucgaguucucccgcggccucaugaugcucguccucgagaagcucgccaccgacauccccugccuccucuacgacgacaaccucuucugccaccucgucgacgagguccuccucuucgagcgcgagcuccacuccguccacggcuaccccggcaccuucgccuccugcaugcacauccucuccgaggagaccugcuuccagcgcuggcucaccgucgagcgcaaguucgcccuccagaagauggacuccaugcucuccuccgaggccgccugggucucccaguacaaggacaucaccgacgucgacgagaugaagguccccgacugcgccgagaccuucaugacccuccuccucgucaucaccgaccgcuacaagaaccuccccaccgccucccgcaagcuccaguuccucgagcuccagaaggaccucgucgacgacuuccgcauccgccucacccaggucaugaaggaggagacccgcgccucccucggcuuccgcuacugcgccauccucaacgccgucaacuacaucuccaccguccucgccgacugggccgacaacgucuucuuccuccagcuccagcaggccgcccucgaggucuucgccgagaacaacacccucuccaagcuccagcucggccagcucgccuccauggaguccuccgucuucgacgacaugaucaaccuccucgagcgccucaagcacgacaugcucacccgccaggucgaccacgucuuccgcgaggucaaggacgccgccaagcucuacaagaaggagcgcuggcucucccuccccucccaguccgagcaggccgucaugucccucuccuccuccgccugcccccuccuccucacccuccgcgaccaccuccuccagcucgagcagcagcucugcuucucccucuucaagaucuucuggcagaugcucgucgagaagcucgacgucuacaucuaccaggagaucauccucgccaaccacuucaacgagggcggcgccgcccagcuccaguucgacaugacccgcaaccucuucccccucuucucccacuacugcaagcgccccgagaacuacuucaagcacaucaaggaggccugcaucguccucaaccucaacgucggcuccgcccuccuccucaaggacguccuccaguccgccuccggccagcuccccgccaccgccgcccucaacgaggucggcaucuacaagcucgcccagcaggacgucgagauccuccucaaccuccgcaccaacuggcccaacaccggcaaguga

SEQ ID NO: 48784 - RNA, 1707 nt, Artificial Sequence
  derived and/or modified sequence opt2 from RIOK1__Homo_sapiens__NP_113668
auggacuaccgccgccuccucaugucccgcgucguccccggccaguucgacgacgccgacuccuccgacuccgagaaccgcgaccucaagaccgucaaggagaaggacgacauccucuucgaggaccuccaggacaacgucaacgagaacggcgagggcgagaucgaggacgaggaggaggagggcuacgacgacgacgacgacgacugggacugggacgagggcgucggcaagcucgccaagggcuacgucuggaacggcggcuccaacccccaggccaaccgccagaccuccgacuccuccuccgccaagauguccacccccgccgacaagguccuccgcaaguucgagaacaagaucaaccucgacaagcucaacgucaccgacuccgucaucaacaaggucaccgagaagucccgccagaaggaggccgacauguaccgcaucaaggacaaggccgaccgcgccaccgucgagcagguccucgacccccgcacccgcaugauccucuucaagaugcucacccgcggcaucaucaccgagaucaacggcugcaucuccaccggcaaggaggccaacgucuaccacgccuccaccgccaacggcgagucccgcgccaucaagaucuacaagaccuccauccucgucuucaaggaccgcgacaaguacgucuccggcgaguuccgcuuccgccacggcuacugcaagggcaacccccgcaagauggucaagaccugggccgagaaggagaugcgcaaccucauccgccucaacaccgccgagauccccugccccgagcccaucaugcuccgcucccacguccucgucauguccuucaucggcaaggacgacaugcccgccccccuccucaagaacguccagcucuccgaguccaaggcccgcgagcucuaccuccaggucauccaguacaugcgccgcauguaccaggacgcccgccucguccacgccgaccucuccgaguucaacaugcucuaccacggcggcggcgucuacaucaucgacgucucccaguccgucgagcacgaccacccccacgcccucgaguuccuccgcaaggacugcgccaacgucaacgacuucuucaugcgccacuccgucgccgucaugaccguccgcgagcucuucgaguucgucaccgaccccuccaucacccacgagaacauggacgccuaccucuccaaggccauggagaucgccucccagcgcaccaaggaggagcgcuccucccaggaccacgucgacgaggaggucuucaagcgcgccuacaucccccgcacccucaacgaggucaagaacuacgagcgcgacauggacaucaucaugaagcucaaggaggaggacauggccaugaacgcccagcaggacaacauccucuaccagaccgucaccggccucaagaaggaccucuccggcguccagaagguccccgcccuccucgagaaccaggucgaggagcgcaccugcuccgacuccgaggacaucggcuccuccgagugcuccgacaccgacuccgaggagcagggcgaccacgcccgccccaagaagcacaccaccgaccccgacaucgacaagaaggagcgcaagaagauggucaaggaggcccagcgcgagaagcgcaagaacaagauccccaagcacgucaagaagcgcaaggagaagaccgccaagaccaagaagggcaaguga

SEQ ID NO: 48785 - RNA, 1425 nt, Artificial Sequence
  derived and/or modified sequence opt2 from RIOK2__Homo_sapiens__NP_001153221
augggcaaggucaacgucgccaagcuccgcuacaugucccgcgacgacuuccgcguccucaccgccgucgagaugggcaugaagaaccacgagaucguccccggcucccucaucgccuccaucgccucccucaagcacggcggcugcaacaagguccuccgcgagcucgucaagcacaagcucaucgccugggagcgcaccaagaccguccagggcuaccgccucaccaacgccggcuacgacuaccucgcccucaagacccucuccucccgccaggucgucgaguccgucggcaaccagaugggcgucggcaaggaguccgacaucuacaucgucgccaacgaggagggccagcaguucgcccucaagcuccaccgccucggccgcaccuccuuccgcaaccucaagaacaagcgcgacuaccacaagcaccgccacaacgucuccuggcucuaccucucccgccucuccgccaugaaggaguucgccuacaugaaggcccucuacgagcgcaaguuccccguccccaagcccaucgacuacaaccgccacgccgucgucauggagcucaucaacggcuacccccucugccagauccaccacgucgaggaccccgccuccgucuacgacgaggccauggagcucaucgucaagcucgccaaccacggccucauccacggcgacuucaacgaguucaaccucauccucgacgaguccgaccacaucaccaugaucgacuucccccagauggucuccaccucccaccccaacgccgagugguacuucgaccgcgacgucaagugcaucaaggacuucuucaugaagcgcuucuccuacgaguccgagcucuuccccaccuucaaggacauccgccgcgaggacacccucgacgucgaggucuccgccuccggcuacaccaaggagaugcaggccgacgacgagcuccuccacccccucggccccgacgacaagaacaucgagaccaaggagggcuccgaguucuccuucuccgacggcgaggucgccgagaaggccgaggucuacggcuccgagaacgaguccgagcgcaacugccucgaggaguccgagggcugcuacugccgcuccuccggcgaccccgagcagaucaaggaggacucccucuccgaggaguccgccgacgcccgcuccuucgagaugaccgaguucaaccaggcccucgaggagaucaagggccaggucgucgagaacaacuccgucaccgaguucuccgaggagaagaaccgcaccgagaacuacaaccgccaggacggccagcgcguccagggcggcguccccgccggcuccgacgaguacgaggacgagugcccccaccucaucgcccucuccucccucaaccgcgaguuccgccccuuccgcuaccgccuccucuccaucgccuucuga

SEQ ID NO: 48786 - RNA, 1560 nt, Artificial Sequence
  derived and/or modified sequence opt2 from RIOK3__Homo_sapiens__NP_003822
auggaccucgucggcgucgccucccccgagcccggcaccgccgccgccuggggccccuccaagugccccugggccaucccccagaacaccaucuccugcucccucgccgacgucauguccgagcagcucgccaaggagcuccagcucgaggaggaggccgccgucuuccccgaggucgccgucgccgagggccccuucaucaccggcgagaacaucgacaccuccuccgaccucaugcucgcccagaugcuccagauggaguacgaccgcgaguacgacgcccagcuccgccgcgaggagaagaaguucaacggcgacuccaaggucuccaucuccuucgagaacuaccgcaagguccaccccuacgaggacuccgacuccuccgaggacgaggucgacuggcaggacacccgcgacgaccccuaccgccccgccaagcccguccccacccccaagaagggcuucaucggcaagggcaaggacaucaccaccaagcacgacgaggucgucugcggccgcaagaacaccgcccgcauggagaacuucgcccccgaguuccaggucggcgacggcaucggcauggaccucaagcucuccaaccacgucuucaacgcccucaagcagcacgccuacuccgaggagcgccgcuccgcccgccuccacgagaagaaggagcacuccaccgccgagaaggccgucgaccccaagacccgccuccucauguacaagauggucaacuccggcaugcucgagaccaucaccggcugcaucuccaccggcaaggaguccgucgucuuccacgccuacggcggcuccauggaggacgagaaggaggacuccaaggucauccccaccgagugcgccaucaaggucuucaagaccacccucaacgaguucaagaaccgcgacaaguacaucaaggacgacuuccgcuucaaggaccgcuucuccaagcucaacccccgcaagaucauccgcaugugggccgagaaggagaugcacaaccucgcccgcaugcagcgcgccggcauccccugccccaccgucguccuccucaagaagcacauccucgucauguccuucaucggccacgaccagguccccgcccccaagcucaaggaggucaagcucaacuccgaggagaugaaggaggccuacuaccagacccuccaccucaugcgccagcucuaccacgagugcacccucguccacgccgaccucuccgaguacaacaugcucuggcacgccggcaaggucuggcucaucgacgucucccaguccgucgagcccacccacccccacggccucgaguuccucuuccgcgacugccgcaacgucucccaguucuuccagaagggcggcgucaaggaggcccucuccgagcgcgagcucuucaacgccgucuccggccucaacaucaccgccgacaacgaggccgacuuccucgccgagaucgaggcccucgagaagaugaacgaggaccacguccagaagaacggccgcaaggccgccuccuuccucaaggacgacggcgaccccccccuccucuacgacgaguga

SEQ ID NO: 48787 - RNA, 2016 nt, Artificial Sequence
  derived and/or modified sequence opt2 from RIPK1__Homo_sapiens__NP_003795
augcagcccgacaugucccucaacgucaucaagaugaaguccuccgacuuccucgaguccgccgagcucgacuccggcggcuucggcaaggucucccucugcuuccaccgcacccagggccucaugaucaugaagaccgucuacaagggccccaacugcaucgagcacaacgaggcccuccucgaggaggccaagaugaugaaccgccuccgccacucccgcgucgucaagcuccucggcgucaucaucgaggagggcaaguacucccucgucauggaguacauggagaagggcaaccucaugcacguccucaaggccgagauguccaccccccucuccgucaagggccgcaucauccucgagaucaucgagggcaugugcuaccuccacggcaagggcgucauccacaaggaccucaagcccgagaacauccucgucgacaacgacuuccacaucaagaucgccgaccucggccucgccuccuucaagaugugguccaagcucaacaacgaggagcacaacgagcuccgcgaggucgacggcaccgccaagaagaacggcggcacccucuacuacauggcccccgagcaccucaacgacgucaacgccaagcccaccgagaaguccgacgucuacuccuucgccgucguccucugggccaucuucgccaacaaggagcccuacgagaacgccaucugcgagcagcagcucaucaugugcaucaaguccggcaaccgccccgacgucgacgacaucaccgaguacugcccccgcgagaucaucucccucaugaagcucugcugggaggccaaccccgaggcccgccccaccuuccccggcaucgaggagaaguuccgccccuucuaccucucccagcucgaggaguccgucgaggaggacgucaagucccucaagaaggaguacuccaacgagaacgccgucgucaagcgcaugcagucccuccagcucgacugcgucgccguccccuccucccgcuccaacuccgccaccgagcagcccggcucccuccacuccucccagggccucggcaugggccccgucgaggaguccugguucgcccccucccucgagcacccccaggaggagaacgagcccucccuccaguccaagcuccaggacgaggccaacuaccaccucuacggcucccgcauggaccgccagaccaagcagcagccccgccagaacgucgccuacaaccgcgaggaggagcgccgccgccgcgucucccacgaccccuucgcccagcagcgccccuacgagaacuuccagaacaccgagggcaagggcaccgccuacuccuccgccgccucccacggcaacgccguccaccagcccuccggccucaccucccagccccagguccucuaccagaacaacggccucuacuccucccacggcuucggcacccgcccccucgaccccggcaccgccggcccccgcgucugguaccgccccauccccucccacaugcccucccuccacaacauccccguccccgagaccaacuaccucggcaacacccccaccaugcccuucuccucccucccccccaccgacgaguccaucaaguacaccaucuacaacuccaccggcauccagaucggcgccuacaacuacauggagaucggcggcaccuccuccucccuccucgacuccaccaacaccaacuucaaggaggagcccgccgccaaguaccaggccaucuucgacaacaccaccucccucaccgacaagcaccucgaccccauccgcgagaaccucggcaagcacuggaagaacugcgcccgcaagcucggcuucacccagucccagaucgacgagaucgaccacgacuacgagcgcgacggccucaaggagaaggucuaccagaugcuccagaagugggucaugcgcgagggcaucaagggcgccaccgucggcaagcucgcccaggcccuccaccagugcucccgcaucgaccuccucuccucccucaucuacgucucccagaacuga

SEQ ID NO: 48788 - RNA, 1623 nt, Artificial Sequence
  derived and/or modified sequence opt2 from RIPK2__Homo_sapiens__NP_003812
augaacggcgaggccaucugcuccgcccuccccaccauccccuaccacaagcucgccgaccuccgcuaccucucccgcggcgccuccggcaccgucuccuccgcccgccacgccgacuggcgcguccaggucgccgucaagcaccuccacauccacaccccccuccucgacuccgagcgcaaggacguccuccgcgaggccgagauccuccacaaggcccgcuucuccuacauccuccccauccucggcaucugcaacgagcccgaguuccucggcaucgucaccgaguacaugcccaacggcucccucaacgagcuccuccaccgcaagaccgaguaccccgacgucgccuggccccuccgcuuccgcauccuccacgagaucgcccucggcgucaacuaccuccacaacaugacccccccccuccuccaccacgaccucaagacccagaacauccuccucgacaacgaguuccacgucaagaucgccgacuucggccucuccaaguggcgcaugaugucccucucccagucccgcuccuccaaguccgcccccgagggcggcaccaucaucuacaugccccccgagaacuacgagcccggccagaagucccgcgccuccaucaagcacgacaucuacuccuacgccgucaucaccugggagguccucucccgcaagcagcccuucgaggacgucaccaacccccuccagaucauguacuccgucucccagggccaccgccccgucaucaacgaggagucccuccccuacgacaucccccaccgcgcccgcaugaucucccucaucgaguccggcugggcccagaaccccgacgagcgccccuccuuccucaagugccucaucgagcucgagcccguccuccgcaccuucgaggagaucaccuuccucgaggccgucauccagcucaagaagaccaagcuccaguccgucuccuccgccauccaccucugcgacaagaagaagauggagcucucccucaacauccccgucaaccacggcccccaggaggaguccugcggcuccucccagcuccacgagaacuccggcucccccgagaccucccgcucccuccccgccccccaggacaacgacuuccucucccgcaaggcccaggacugcuacuucaugaagcuccaccacugccccggcaaccacuccugggacuccaccaucuccggcucccagcgcgccgccuucugcgaccacaagaccacccccugcuccuccgccaucaucaacccccucuccaccgccggcaacuccgagcgccuccagcccggcaucgcccagcaguggauccaguccaagcgcgaggacaucgucaaccagaugaccgaggccugccucaaccagucccucgacgcccuccucucccgcgaccucaucaugaaggaggacuacgagcucgucuccaccaagcccacccgcaccuccaagguccgccagcuccucgacaccaccgacauccagggcgaggaguucgccaaggucaucguccagaagcucaaggacaacaagcagaugggccuccagcccuaccccgagauccucgucgucucccgcucccccucccucaaccuccuccagaacaaguccauguga

SEQ ID NO: 48789 - RNA, 1557 nt, Artificial Sequence
  derived and/or modified sequence opt2 from RIPK3__Homo_sapiens__NP_006862
auguccugcgucaagcucuggcccuccggcgcccccgccccccucgucuccaucgaggagcucgagaaccaggagcucgucggcaagggcggcuucggcaccgucuuccgcgcccagcaccgcaaguggggcuacgacgucgccgucaagaucgucaacuccaaggccaucucccgcgaggucaaggccauggccucccucgacaacgaguucguccuccgccucgagggcgucaucgagaaggucaacugggaccaggaccccaagcccgcccucgucaccaaguucauggagaacggcucccucuccggccuccuccagucccagugcccccgccccuggccccuccucugccgccuccucaaggaggucguccucggcauguucuaccuccacgaccagaaccccguccuccuccaccgcgaccucaagcccuccaacguccuccucgaccccgagcuccacgucaagcucgccgacuucggccucuccaccuuccagggcggcucccaguccggcaccggcuccggcgagcccggcggcacccucggcuaccucgcccccgagcucuucgucaacgucaaccgcaaggccuccaccgccuccgacgucuacuccuucggcauccucaugugggccguccucgccggccgcgaggucgagcuccccaccgagcccucccucgucuacgaggccgucugcaaccgccagaaccgccccucccucgccgagcucccccaggccggccccgagacccccggccucgagggccucaaggagcucaugcagcucugcugguccuccgagcccaaggaccgccccuccuuccaggagugccuccccaagaccgacgaggucuuccagauggucgagaacaacaugaacgccgccgucuccaccgucaaggacuuccucucccagcuccgcuccuccaaccgccgcuucuccauccccgaguccggccagggcggcaccgagauggacggcuuccgccgcaccaucgagaaccagcacucccgcaacgacgucauggucuccgaguggcucaacaagcucaaccucgaggagccccccuccuccguccccaagaagugccccucccucaccaagcgcucccgcgcccaggaggagcaggucccccaggccuggaccgccggcaccuccuccgacuccauggcccagcccccccagacccccgagaccuccaccuuccgcaaccagaugcccucccccaccuccaccggcacccccucccccggcccccgcggcaaccagggcgccgagcgccagggcaugaacugguccugccgcacccccgagcccaaccccgucaccggccgcccccucgucaacaucuacaacugcuccggcguccaggucggcgacaacaacuaccucaccaugcagcagaccaccgcccuccccaccuggggccucgcccccuccggcaagggccgcggccuccagcaccccccccccgucggcucccaggagggccccaaggaccccgaggccuggucccgcccccagggcugguacaaccacuccggcaaguga

SEQ ID NO: 48790 - RNA, 2355 nt, Artificial Sequence
  derived and/or modified sequence opt2 from RIPK4__Homo_sapiens__NP_065690
auggagggcgacggcggcacccccugggcccucgcccuccuccgcaccuucgacgccggcgaguucaccggcugggagaaggucggcuccggcggcuucggccaggucuacaagguccgccacguccacuggaagaccuggcucgccaucaagugcucccccucccuccacgucgacgaccgcgagcgcauggagcuccucgaggaggccaagaagauggagauggccaaguuccgcuacauccuccccgucuacggcaucugccgcgagcccgucggccucgucauggaguacauggagaccggcucccucgagaagcuccucgccuccgagccccuccccugggaccuccgcuuccgcaucauccacgagaccgccgucggcaugaacuuccuccacugcauggcccccccccuccuccaccucgaccucaagcccgccaacauccuccucgacgcccacuaccacgucaagaucuccgacuucggccucgccaagugcaacggccucucccacucccacgaccucuccauggacggccucuucggcaccaucgccuaccucccccccgagcgcauccgcgagaagucccgccucuucgacaccaagcacgacgucuacuccuucgccaucgucaucuggggcguccucacccagaagaagcccuucgccgacgagaagaacauccuccacaucauggucaaggucgucaagggccaccgccccgagcucccccccgucugccgcgcccgcccccgcgccugcucccaccucauccgccucaugcagcgcugcuggcagggcgacccccgcguccgccccaccuuccaggagaucaccuccgagaccgaggaccucugcgagaagcccgacgacgaggucaaggagaccgcccacgaccucgacgucaaguccccccccgagccccgcuccgaggucguccccgcccgccucaagcgcgccuccgcccccaccuucgacaacgacuacucccucuccgagcuccucucccagcucgacuccggcgucucccaggccgucgagggccccgaggagcucucccgcuccuccuccgaguccaagcuccccuccuccggcuccggcaagcgccucuccggcgucuccuccgucgacuccgccuucuccucccgcggcucccucucccucuccuucgagcgcgagcccuccaccuccgaccucggcaccaccgacguccagaagaagaagcucgucgacgccaucgucuccggcgacaccuccaagcucaugaagauccuccagccccaggacgucgaccucgcccucgacuccggcgccucccuccuccaccucgccgucgaggccggccaggaggagugcgccaaguggcuccuccucaacaacgccaaccccaaccucuccaaccgccgcggcuccaccccccuccacauggccgucgagcgccgcguccgcggcgucgucgagcuccuccucgcccgcaagaucuccgucaacgccaaggacgaggaccaguggaccgcccuccacuucgccgcccagaacggcgacgaguccuccacccgccuccuccucgagaagaacgccuccgucaacgaggucgacuucgagggccgcacccccaugcacgucgccugccagcacggccaggagaacaucguccgcauccuccuccgccgcggcgucgacgucucccuccagggcaaggacgccuggcucccccuccacuacgccgccuggcagggccaccuccccaucgucaagcuccucgccaagcagcccggcgucuccgucaacgcccagacccucgacggccgcaccccccuccaccucgccgcccagcgcggccacuaccgcgucgcccgcauccucaucgaccucugcuccgacgucaacgucugcucccuccucgcccagaccccccuccacgucgccgccgagaccggccacaccuccaccgcccgccuccuccuccaccgcggcgccggcaaggaggccaugaccuccgacggcuacaccgcccuccaccucgccgcccgcaacggccaccucgccaccgucaagcuccucgucgaggagaaggccgacguccucgcccgcggcccccucaaccagaccgcccuccaccucgccgccgcccacggccacuccgaggucgucgaggagcucgucuccgccgacgucaucgaccucuucgacgagcagggccucuccgcccuccaccucgccgcccagggccgccacgcccagaccgucgagacccuccuccgccacggcgcccacaucaaccuccagucccucaaguuccagggcggccacggccccgccgccacccuccuccgccgcuccaagaccuga

SEQ ID NO: 48791 - RNA, 387 nt, Artificial Sequence
  derived and/or modified sequence opt2 from RIPPLY2__Homo_sapiens__NP_001009994
auggagaacgccggcggcgccgagggcaccgaguccggcgccgccgccugcgccgccaccgacggccccacccgccgcgccggcgccgacuccggcuacgccggcuucuggcgccccugggucgacgccggcggcaagaaggaggaggagacccccaaccacgccgccgaggccaugcccgacggccccggcaugaccgccgccuccggcaagcucuaccaguuccgccaccccguccgccucuucuggcccaaguccaagugcuacgacuaccucuaccaggaggccgaggcccuccucaagaacuuccccauccaggccaccaucuccuucuacgaggacuccgacuccgaggacgagaucgaggaccucaccugcgagaacuga

SEQ ID NO: 48792 - RNA, 552 nt, Artificial Sequence
  derived and/or modified sequence opt2 from RIT1__Homo_sapiens__NP_001243749
augaccaugcaguucaucucccaccgcuuccccgaggaccacgaccccaccaucgaggacgccuacaagauccgcauccgcaucgacgacgagcccgccaaccucgacauccucgacaccgccggccaggccgaguucaccgccaugcgcgaccaguacaugcgcgccggcgagggcuucaucaucugcuacuccaucaccgaccgccgcuccuuccacgagguccgcgaguucaagcagcucaucuaccgcguccgccgcaccgacgacacccccgucguccucgucggcaacaaguccgaccucaagcagcuccgccaggucaccaaggaggagggccucgcccucgcccgcgaguucuccugccccuucuucgagaccuccgccgccuaccgcuacuacaucgacgacgucuuccacgcccucguccgcgagauccgccgcaaggagaaggaggccguccucgccauggagaagaaguccaagcccaagaacuccgucuggaagcgccucaagucccccuuccgcaagaagaaggacuccgucaccuga

SEQ ID NO: 48793 - RNA, 462 nt, Artificial Sequence
  derived and/or modified sequence opt2 from RIT2__Homo_sapiens__NP_001259006
auggaggucgagaacgaggccuccugcucccccggcuccgccuccggcggcucccgcgaguacaaggucgucaugcucggcgccggcggcgucggcaaguccgccaugaccaugcaguucaucucccaccaguuccccgacuaccacgaccccaccaucgaggacgccuacaagacccagguccgcaucgacaacgagcccgccuaccucgacauccucgacaccgccggccaggccgaguucaccgccaugcgcgagcaguacaugcgcggcggcgagggcuucaucaucugcuacuccgucaccgaccgccaguccuuccaggaggccgccaaguucaaggagcucaucuuccagguccgccacaccuacgagaucccccucguccucgucggcaacaagaucgaccucgagcaguuccgccagcccacccucaaggaguucggccgcgaggaguucuga

SEQ ID NO: 48794 - RNA, 882 nt, Artificial Sequence
  derived and/or modified sequence opt2 from RITA1__Homo_sapiens__NP_001273144
augcuccgcgagccccgcaagcagggccucgccggccgcgcccaccuccucucccccggcaccaccggcuccaugaagacccccgucgagcucgccgucuccggcaugcagacccucggccuccagcaccgcugccgcggcggcuaccgcgucaaggcccgcaccuccuacgucgacgagacccucuucggcucccccgccggcacccgccccaccccccccgacuucgacccccccugggucgagaaggccaaccgcacccgcggcgucggcaaggaggccuccaaggcccucggcgccaagggcuccugcgagaccacccccucccgcggcuccacccccacccucaccccccgcaagaagaacaaguaccgccccaucucccacacccccuccuacugcgacgagucccucuucggcucccgcuccgagggcgccuccuucggcgccccccgcauggccaagggcgacgccgccaagcuccgcgcccuccucuggacccccccccccaccccccgcggcucccacuccccccgcccccgcgaggccccccuccgcgccauccaccccgccggccccuccaagaccgagcccggccccgccgccgacucccagaagcucuccaugggcggccuccacuccucccgcccccucaagcgcggccucucccacucccucacccaccucaacguccccuccaccggccaccccgccaccuccgccccccacaccaacggcccccaggaccuccgccccuccaccuccggcgucaccuuccgcuccccccucgucaccucccgcgcccgcuccgucuccaucuccguccccuccaccccccgccgcggcggcgccacccagaagcccaagccccccuggaaguga

SEQ ID NO: 48795 - RNA, 954 nt, Artificial Sequence
  derived and/or modified sequence opt2 from RLBP1__Homo_sapiens__XP_011520172
auguccgagggcgucggcaccuuccgcaugguccccgaggaggagcaggagcuccgcgcccagcucgagcagcucaccaccaaggaccacggccccgucuucggccccugcucccagcucccccgccacacccuccagaaggccaaggacgagcucaacgagcgcgaggagacccgcgaggaggccguccgcgagcuccaggagaugguccaggcccaggccgccuccggcgaggagcucgccgucgccgucgccgagcgcguccaggagaaggacuccggcuucuuccuccgcuucauccgcgcccgcaaguucaacgucggccgcgccuacgagcuccuccgcggcuacgucaacuuccgccuccaguaccccgagcucuucgacucccucucccccgaggccguccgcugcaccaucgaggccggcuaccccggcguccucuccucccgcgacaaguacggccgcgucgucaugcucuucaacaucgagaacuggcagucccaggagaucaccuucgacgagauccuccaggccuacugcuucauccucgagaagcuccucgagaacgaggagacccagaucaacggcuucugcaucaucgagaacuucaagggcuucaccaugcagcaggccgccucccuccgcaccuccgaccuccgcaagauggucgacaugcuccaggacuccuuccccgcccgcuucaaggccauccacuucauccaccagcccugguacuucaccaccaccuacaacgucgucaagcccuuccucaaguccaagcuccucgagcgcgucuucguccacggcgacgaccucuccggcuucuaccaggagaucgacgagaacauccuccccuccgacuucggcggcacccuccccaaguacgacggcaaggccgucgccgagcagcucuucggcccccaggcccaggccgagaacaccgccuucuga

SEQ ID NO: 48796 - RNA, 4578 nt, Artificial Sequence
  derived and/or modified sequence opt2 from RLF__Homo_sapiens__XP_011540196
augaaggccuccgucugcaagaccaucgccugccuccuccccgaggaccucgagguccgccgcgccugccagcucaccgaguuccucaucgagcccucccucgacggcuucaacaugcucgaggagcucuaccuccagcccgaccagaaguucgacgaggagaacgcccccguccccaacucccuccgcugcgagcuccuccucgcccucaaggcccacuggcccuucgaccccgaguucugggacuggaagacccucaagcgccacugccaccagcuccucggccaggaggccuccgacuccgacgacgaccucuccggcuacgagauguccaucaacgacaccgacguccucgaguccuuccucuccgacuacgacgagggcaaggaggacaagcaguaccgccgccgcgaccucaccgaccagcacaaggagaagcgcgacaagaagcccaucggcuccuccgagcgcuaccagcgcuggcuccaguacaaguucuucugccuccucugcaagcgcgagugcaucgaggcccgcauccuccaccacuccaagaugcacauggaggacggcaucuacaccugccccgucugcaucaagaaguucaagcgcaaggagauguucgucccccacgucauggagcacgucaagaugccccccucccgccgcgaccgcuccaagaagaagcuccuccucaagggcucccagaagggcaucugccccaagucccccuccgccauccccgagcagaaccacucccucaacgaccaggccaagggcgagucccacgaguacgucaccuucuccaagcucgaggacugccaccuccaggaccgcgaccucuaccccugccccggcaccgacugcucccgcgucuucaagcaguucaaguaccucuccguccaccucaaggccgagcaccagaacaacgacgagaacgccaagcacuaccucgacaugaagaaccgccgcgagaagugcaccuacugccgccgccacuucauguccgccuuccaccuccgcgagcacgagcagguccacugcggcccccagcccuacaugugcgucuccaucgacugcuacgcccgcuucggcuccgucaacgagcuccucaaccacaagcagaagcacgacgaccuccgcuacaagugcgagcucaacggcugcaacaucgucuucuccgaccucggccagcucuaccaccacgaggcccagcacuuccgcgacgccuccuacaccugcaacuuccucggcugcaagaaguucuacuacuccaagaucgaguaccagaaccaccucuccaugcacaacgucgagaacuccaacggcgacaucaagaaguccgucaagcucgaggaguccgccaccggcgagaagcaggacugcaucaaccagccccaccuccucaaccagaccgacaagucccaccuccccgaggaccucuucugcgccgaguccgccaacucccagaucgacaccgagaccgccgagaaccucaaggagaacuccgacuccaacuccuccgaccagcucucccacuccuccuccgccuccaugaacgaggagcucaucgacacccucgaccacuccgagaccaugcaggacguccuccucuccaacgagaaggucuucggccccuccucccucaaggagaagugcuccuccauggccgucugcuucgacggcaccaaguucaccugcggcuucgacggcugcggcuccaccuacaagaacgcccgcggcaugcagaagcaccuccgcaagguccaccccuaccacuucaagcccaagaagaucaagaccaaggaccucuuccccucccucggcaacgagcacaaccagaccaccgagaagcucgacgccgagcccaagcccugcuccgacaccaacuccgacucccccgacgagggccucgaccacaacauccacaucaagugcaagcgcgagcaccagggcuacuccuccgaguccuccaucugcgccuccaagcgccccugcaccgaggacaccaugcucgagcuccuccuccgccucaagcaccucucccucaagaacuccaucacccacggcuccuucuccggcucccuccagggcuaccccuccuccggcgccaagucccuccaguccgucuccuccaucuccgaccucaacuuccagaaccaggacgagaacaugcccucccaguaccucgcccagcucgccgccaagcccuucuucugcgagcuccagggcugcaaguacgaguucgucacccgcgaggcccuccucaugcacuaccucaagaagcacaacuacuccaaggagaagguccuccagcucaccauguuccagcaccgcuacucccccuuccagugccacaucugccagcgcuccuucacccgcaagacccaccuccgcauccacuacaagaacaagcaccagaucggcuccgaccgcgccacccacaagcuccucgacaacgagaagugcgaccacgagggccccugcuccgucgaccgccucaagggcgacugcuccgccgagcucggcggcgaccccuccuccaacuccgagaagccccacugccaccccaagaaggacgagugcuccuccgagaccgaccucgaguccuccugcgaggagaccgaguccaagaccuccgacaucuccucccccaucggcucccaccgcgaggagcaggagggccgcgagggccgcggcucccgccgcaccgucgccaagggcaaccucugcuacauccucaacaaguaccacaagcccuuccacugcauccacaagaccugcaacuccuccuucaccaaccucaagggccucauccgccacuaccgcaccguccaccaguacaacaaggagcagcucugccucgagaaggacaaggcccgcaccaagcgcgagcucgucaagugcaagaagaucuucgccugcaaguacaaggagugcaacaagcgcuuccucugcuccaaggcccucgccaagcacugcuccgacucccacaaccucgaccacaucgaggagcccaagguccucuccgaggccggcuccgccgcccgcuucuccugcaaccagccccagugccccgccgucuucuacaccuucaacaagcucaagcaccaccucauggagcagcacaacaucgagggcgagauccacuccgacuacgagauccacugcgaccucaacggcugcggccagaucuucacccaccgcuccaacuacucccagcacgucuacuaccgccacaaggacuacuacgacgaccucuuccgcucccagaaggucgccaacgagcgccuccuccgcuccgagaaggucugccagaccgccgacacccagggccacgagcaccagaccacccgccgcuccuucaacgccaaguccaagaagugcggccucaucaaggagaagaaggcccccaucuccuucaagacccgcgccgaggcccuccacaugugcgucgagcacuccgagcacacccaguaccccugcaugguccagggcugccucuccgucgucaagcucgaguccuccaucguccgccacuacaagcgcacccaccagauguccuccgccuaccucgagcagcagauggagaaccucgucgucugcgucaaguacggcaccaagaucaaggaggagccccccuccgaggccgaccccugcaucaagaaggaggagaaccgcuccugcgaguccgagcgcaccgagcacucccacucccccggcgacuccuccgcccccauccagaacaccgacugcugccacuccuccgagcgcgacggcggccagaagggcugcaucgaguccuccuccgucuucgacgccgacacccuccucuaccgcggcacccucaagugcaaccacuccuccaagaccaccucccucgagcagugcaacaucguccagccccccccccccugcaagaucgagaacuccauccccaaccccaacggcaccgaguccggcaccuacuucaccuccuuccagcucccccucccccgcaucaaggaguccgagacccgccagcacuccuccggccaggagaacaccgucaagaaccccacccacguccccaaggagaacuuccgcaagcacucccagccccgcuccuucgaccucaagaccuacaagcccaugggcuucgaguccuccuuccucaaguucauccaggaguccgaggagaaggaggacgacuucgacgacugggagcccuccgagcaccucacccucuccaacuccucccaguccuccaacgaccucaccggcaacgucgucgccaacaacauggucaacgacuccgagcccgaggucgacaucccccacuccuccuccgacuccaccauccacgagaaccucaccgccauccccccccucaucgucgccgagaccaccaccguccccucccucgagaaccuccgcgucguccucgacaaggcccucaccgacugcggcgagcucgcccucaagcagcuccacuaccuccgccccgucgucguccucgagcgcuccaaguucuccacccccauccucgaccucuuccccaccaagaagaccgacgagcucugcgucggcuccuccuga

SEQ ID NO: 48797 - RNA, 1875 nt, Artificial Sequence
  derived and/or modified sequence opt2 from RLIM__Homo_sapiens__NP_899196
auggagaacuccgacuccaacgacaagggcuccggcgaccaguccgccgcccagcgccgcucccagauggaccgccucgaccgcgaggaggccuucuaccaguucgucaacaaccucuccgaggaggacuaccgccucaugcgcgacaacaaccuccucggcacccccggcgaguccaccgaggaggagcuccuccgccgccuccagcagaucaaggagggcccccccccccagaacuccgacgagaaccgcggcggcgacuccuccgacgacgucuccaacggcgacuccaucaucgacuggcucaacuccguccgccagaccggcaacaccacccgcuccggccagcgcggcaaccaguccuggcgcgccgucucccgcaccaaccccaacuccggcgacuuccgcuucucccucgagaucaacgucaaccgcaacaacggcucccagaacuccgagaacgagaacgagcccuccgcccgccgcuccuccggcgagaacgucgagaacaacucccagcgccaggucgagaacccccgcuccgaguccaccuccgcccgccccucccgcuccgagcgcaacuccaccgaggcccucaccgaggucccccccacccgcggccagcgccgcgcccgcucccgcucccccgaccaccgccgcacccgcgcccgcgccgagcgcucccgcuccccccuccaccccauguccgagaucccccgccgcucccaccacuccaucuccucccagaccuucgagcacccccucgucaacgagaccgagggcuccucccgcacccgccaccacgucacccuccgccagcagaucuccggccccgagcuccucucccgcggccucuucgccgccuccggcacccgcaacgccucccagggcgccggcuccuccgacaccgccgccuccggcgaguccaccggcuccggccagcgcccccccaccaucguccucgaccuccagguccgccgcguccgccccggcgaguaccgccagcgcgacuccaucgccucccgcacccgcucccgcucccagacccccaacaacaccgucaccuacgaguccgagcgcggcggcuuccgccgcaccuucucccgcuccgagcgcgccggcguccgcaccuacgucuccaccauccgcauccccauccgccgcauccucaacaccggccucuccgagaccaccuccgucgccauccagaccaugcuccgccagaucaugaccggcuucggcgagcucuccuacuucauguacuccgacuccgacuccgagcccaccggcuccgucuccaaccgcaacauggagcgcgccgagucccgcuccggccgcggcggcuccggcggcggcuccuccuccggcuccuccuccuccuccuccuccuccuccuccuccuccuccuccuccuccuccuccuccucccccuccuccuccuccggcggcgaguccuccgagaccuccuccgaccucuucgagggcuccaacgagggcuccuccuccuccggcuccuccggcgcccgccgcgagggccgccaccgcgcccccgucaccuucgacgaguccggcucccuccccuuccucucccucgcccaguucuuccuccucaacgaggacgacgacgaccagccccgcggccucaccaaggagcagaucgacaaccucgccaugcgcuccuucggcgagaacgacgcccucaagaccugcuccgucugcaucaccgaguacaccgagggcaacaagcuccgcaagcuccccugcucccacgaguaccacguccacugcaucgaccgcuggcucuccgagaacuccaccugccccaucugccgccgcgccguccucgccuccggcaaccgcgaguccgucgucuga

SEQ ID NO: 48798 - RNA, 558 nt, Artificial Sequence
  derived and/or modified sequence opt2 from RLN1__Homo_sapiens__NP_008842
augccccgccucuuccucuuccaccuccucgaguucugccuccuccucaaccaguucucccgcgccgucgccgccaaguggaaggacgacgucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaucaucaugcucgaguucaucgccaaccucccccccgagcucaaggccgcccucuccgagcgccagcccucccuccccgagcuccagcaguacguccccgcccucaaggacuccaaccucuccuucgaggaguucaagaagcucauccgcaaccgccaguccgaggccgccgacuccaaccccuccgagcucaaguaccucggccucgacacccacucccagaagaagcgccgccccuacgucgcccucuucgagaagugcugccucaucggcugcaccaagcgcucccucgccaaguacugcuga

SEQ ID NO: 48799 - RNA, 354 nt, Artificial Sequence
  derived and/or modified sequence opt2 from RLN2__Homo_sapiens__NP_005050
augccccgccucuucuucuuccaccuccucggcgucugccuccuccucaaccaguucucccgcgccgucgccgacuccuggauggaggaggucaucaagcucugcggccgcgagcucguccgcgcccagaucgccaucugcggcauguccaccugguccaagcgcucccucucccaggaggacgccccccagaccccccgccccgucgccggcgacuucauccagaccgucucccucggcaucucccccgacggcggcaaggcccuccgcaccggcuccugcuucacccgcgaguuccucggcgcccucuccaagcucugccaccccuccuccaccaagauccagaagcccuga

SEQ ID NO: 48800 - RNA, 429 nt, Artificial Sequence
  derived and/or modified sequence opt2 from RLN3__Homo_sapiens__NP_543140
auggcccgcuacaugcuccuccuccuccucgccgucuggguccucaccggcgagcucuggcccggcgccgaggcccgcgccgcccccuacggcguccgccucugcggccgcgaguucauccgcgccgucaucuucaccugcggcggcucccgcuggcgccgcuccgacauccucgcccacgaggccaugggcgacaccuuccccgacgccgacgccgacgaggacucccucgccggcgagcucgacgaggccaugggcuccuccgaguggcucgcccucaccaaguccccccaggccuucuaccgcggccgccccuccuggcagggcacccccggcguccuccgcggcucccgcgacguccucgccggccucuccuccuccugcugcaaguggggcugcuccaaguccgagaucuccucccucugcuga

SEQ ID NO: 48801 - RNA, 855 nt, Artificial Sequence
  derived and/or modified sequence opt2 from RMDN1__Homo_sapiens__NP_001273648
auggcccucgccgcccgccucuggcgccuccuccccuuccgccgcggcgccgcccccggcucccgccuccccgccggcaccuccggcucccgcggccacugcggccccugccgcuuccgcggcuucgaggucaugggcaaccccggcaccuucaagcgcggccuccuccucuccgcccucuccuaccucggcuucgagaccuaccaggucaucucccaggccgccgucguccacgccaccgccaaggucgaggagauccucgagcaggccgacuaccucuacgaguccggcgagaccgagaagcucuaccagcuccucacccaguacaaggaguccgaggacgccgagcuccucuggcgccucgcccgcgccucccgcgacgucgcccagcucucccgcaccuccgaggaggagaagaagcuccucgucuacgaggcccucgaguacgccaagcgcgcccucgagaagaacgaguccuccuucgccucccacaagaaggccaucgagcucaaccccaaggacgccaccuccauccaccucaugggcaucuggugcuacaccuucgccgagaugcccugguaccagcgccgcaucgccaagaugcucuucgccaccccccccuccuccaccuacgagaaggcccucggcuacuuccaccgcgccgagcaggucgaccccaacuucuacuccaagaaccuccuccuccucggcaagaccuaccucaagcuccacaacaagaagcucgccgccuucuggcucaugaaggccaaggacuaccccgcccacaccgaggaggacaagcagauccagaccgaggccgcccagcuccucaccuccuucuccgagaagaacuga

SEQ ID NO: 48802 - RNA, 1233 nt, Artificial Sequence
  derived and/or modified sequence opt2 from RMDN2__Homo_sapiens__NP_001164263
augcccuacuccaccaacaaggagcucauccucggcaucauggucggcaccgccggcaucucccuccuccuccucugguaccacaagguccgcaagcccggcaucgccaugaagcuccccgaguuccucucccucggcaacaccuucaacuccaucacccuccaggacgagauccacgacgaccagggcaccaccgucaucuuccaggagcgccagcuccagauccucgagaagcucaacgagcuccucaccaacauggaggagcucaaggaggagauccgcuuccucaaggaggccauccccaagcucgaggaguacauccaggacgagcucggcggcaagaucaccguccacaagaucuccccccagcaccgcgcccgcaagcgccgccuccccaccauccaguccuccgccaccuccaacuccuccgaggaggccgaguccgagggcggcuacaucaccgccaacaccgacaccgaggagcaguccuuccccguccccaaggccuucaacacccgcgucgaggagcucaaccucgacguccuccuccagaaggucgaccaccuccgcauguccgaguccggcaaguccgaguccuucgagcuccuccgcgaccacaaggagaaguuccgcgacgagaucgaguucauguggcgcuucgcccgcgccuacggcgacauguacgagcucuccaccaacacccaggagaagaagcacuacgccaacaucggcaagacccucuccgagcgcgccaucaaccgcgcccccaugaacggccacugccaccucugguacgccguccucugcggcuacgucuccgaguucgagggccuccagaacaagaucaacuacggccaccucuucaaggagcaccucgacaucgccaucaagcuccuccccgaggagcccuuccucuacuaccucaagggccgcuacugcuacaccgucuccaagcucuccuggaucgagaagaagauggccgccacccucuucggcaagauccccuccuccaccguccaggaggcccuccacaacuuccucaaggccgaggagcucugccccggcuacuccaaccccaacuacauguaccucgccaagugcuacaccgaccucgaggagaaccagaacgcccucaaguucugcaaccucgcccuccuccuccccaccgucaccaaggaggacaaggaggcccagaaggagaugcagaagaucaugaccucccucaagcgcuga

SEQ ID NO: 48803 - RNA, 1413 nt, Artificial Sequence
  derived and/or modified sequence opt2 from RMDN3__Homo_sapiens__NP_001291731
augucccgccucggcgcccucggcggcgcccgcgccggccucggccuccuccucggcaccgccgccggccucggcuuccucugccuccucuacucccagcgcuggaagcgcacccagcgccacggccgcucccagucccuccccaacucccucgacuacacccagaccuccgaccccggccgccacgucaugcuccuccgcgccguccccggcggcgccggcgacgccuccguccuccccucccucccccgcgagggccaggagaagguccucgaccgccucgacuucguccucaccucccucgucgcccuccgccgcgaggucgaggagcuccgcuccucccuccgcggccucgccggcgagaucgucggcgagguccgcugccacauggaggagaaccagcgcgucgcccgccgccgccgcuuccccuucguccgcgagcgcuccgacuccaccggcuccuccuccgucuacuucaccgccuccuccggcgccaccuucaccgacgccgaguccgagggcggcuacaccaccgccaacgccgaguccgacaacgagcgcgacuccgacaaggaguccgaggacggcgaggacgaggucuccugcgagaccgucaagaugggccgcaaggacucccucgaccucgaggaggaggccgccuccggcgccuccuccgcccucgaggccggcggcuccuccggccucgaggacguccucccccuccuccagcaggccgacgagcuccaccgcggcgacgagcagggcaagcgcgagggcuuccagcuccuccucaacaacaagcucgucuacggcucccgccaggacuuccucuggcgccucgcccgcgccuacuccgacaugugcgagcucaccgaggaggucuccgagaagaaguccuacgcccucgacggcaaggaggaggccgaggccgcccucgagaagggcgacgaguccgccgacugccaccucugguacgccguccucugcggccagcucgccgagcacgaguccauccagcgccgcauccaguccggcuucuccuucaaggagcacgucgacaaggccaucgcccuccagcccgagaaccccauggcccacuuccuccucggccgcuggugcuaccaggucucccaccucuccuggcucgagaagaagaccgccaccgcccuccucgaguccccccucuccgccaccgucgaggacgcccuccaguccuuccucaaggccgaggagcuccagcccggcuucuccaaggccggccgcgucuacaucuccaagugcuaccgcgagcucggcaagaacuccgaggcccgcugguggaugaagcucgcccucgagcuccccgacgucaccaaggaggaccucgccauccagaaggaccucgaggagcucgaggucauccuccgcgacuga

SEQ ID NO: 48804 - RNA, 1878 nt, Artificial Sequence
  derived and/or modified sequence opt2 from RMI1__Homo_sapiens__XP_011517336
augaacgucaccuccaucgcccuccgcgccgagaccuggcuccucgccgccuggcacgucaaggucccccccauguggcucgaggccugcaucaacuggauccaggaggagaacaacaacgucaaccucucccaggcccagaugaacaagcaggucuucgagcaguggcuccucaccgaccuccgcgaccucgagcacccccuccuccccgacggcauccucgagauccccaagggcgagcucaacggcuucuacgcccuccagaucaacucccucgucgacgucucccagcccgccuacucccagauccagaagcuccgcggcaagaacaccaccaacgaccucgucaccgccgaggcccaggucacccccaagcccugggaggccaagcccucccgcaugcucaugcuccagcucaccgacggcaucguccagauccagggcauggaguaccagcccauccccauccuccacuccgaccucccccccggcaccaagauccucaucuacggcaacaucuccuuccgccucggcguccuccuccucaagcccgagaacgucaagguccucggcggcgaggucgacgcccuccucgaggaguacgcccaggagaagguccucgcccgccucaucggcgagcccgaccucgucgucuccgucauccccaacaacuccaacgagaacaucccccgcgucaccgacguccucgaccccgcccucggccccuccgacgaggagcuccucgccucccucgacgagaacgacgagcucaccgccaacaacgacaccuccuccgagcgcugcuucaccaccggcuccuccuccaacaccauccccacccgccaguccuccuucgagcccgaguucgucaucuccccccgccccaaggaggagcccuccaaccucuccauccacgucauggacggcgagcucgacgacuucucccucgaggaggcccuccuccucgaggagaccguccagaaggagcagauggagaccaaggagcuccagccccucaccuucaaccgcaacgccgaccgcuccaucgagcgcuucucccacaaccccaacaccaccaacaacuucucccucaccugcaagaacggcaacaacaacugguccgagaagaacgucuccgagcagaugaccaacgaggacaaguccuucggcugccccuccguccgcgaccagaaccgcuccaucuucuccguccacugcaacgucccccucgcccacgacuucaccaacaaggagaagaaccucgagaccgacaacaagaucaagcagaccuccuccuccgacucccacucccucaacaacaagauccucaaccgcgaggucgucaacuacguccagaagcgcaacucccagaucuccaacgagaacgacugcaaccuccaguccugcucccuccgcuccuccgagaacuccaucaaccucuccaucgccauggaccucuacuccccccccuucgucuaccucuccguccucauggccuccaagcccaaggaggucaccaccgucaaggucaaggccuucaucgucacccucaccggcaaccucuccuccuccggcggcaucugguccaucaccgccaaggucuccgacggcaccgccuaccucgacgucgacuucgucgacgagauccucaccucccucaucggcuucuccguccccgagaugaagcaguccaagaaggacccccuccaguaccagaaguuccucgagggccuccagaagugccagcgcgaccucaucgaccucugcugccucaugaccaucuccuucaaccccucccucuccaaggccaugguccucgcccuccaggacgucaacauggagcaccucgagaaccucaagaagcgccucaacaaguga

SEQ ID NO: 48805 - RNA, 444 nt, Artificial Sequence
  derived and/or modified sequence opt2 from RMI2__Homo_sapiens__NP_689521
auggccgccgccgccgacuccuucuccggcggccccgccggcguccgccucccccgcucccccccccucaagguccucgccgagcagcuccgccgcgacgccgagggcggccccggcgccuggcgccucucccgcgccgccgccggccgcggcccccucgaccucgccgccgucuggaugcagggccgcgucgucauggccgaccgcggcgaggcccgccuccgcgaccccuccggcgacuucuccguccgcggccucgagcgcgucccccgcggccgccccugccucguccccggcaaguacgucauggucaugggcgucguccaggccugcucccccgagcccugccuccaggccgucaagaugaccgaccucuccgacaaccccauccacgaguccaugugggagcucgaggucgaggaccuccaccgcaacauccccuga

SEQ ID NO: 48806 - RNA, 840 nt, Artificial Sequence
  derived and/or modified sequence opt2 from RMND1__Homo_sapiens__NP_001258866
augcacugcaccgccuucgccaccgccgacgaguaccaccucggcaaccucucccaggaccucgccucccacggcuacgucgaggucaccucccucccccgcgacgccgccaacauccucgucaugggcgucgagaacuccgccaaggagggcgaccccggcaccaucuucuucuuccgcgagggcgccgccgucuucuggaacgucaaggacaagaccaugaagcacgucaugaagguccucgagaagcacgagauccagcccuacgagaucgcccucguccacugggagaacgaggagcucaacuacaucaagaucgagggccaguccaagcuccaccgcggcgagaucaagcucaacuccgagcucgaccucgacgacgccauccucgagaaguucgccuucuccaacgcccucugccucuccgucaagcucgccaucugggaggccucccucgacaaguucaucgaguccauccaguccauccccgaggcccucaaggccggcaagaaggucaagcucucccacgaggaggucaugcagaagaucggcgagcucuucgcccuccgccaccgcaucaaccucuccuccgacuuccucaucacccccgacuucuacugggaccgcgagaaccucgagggccucuacgacaagaccugccaguuccucuccaucggccgccgcgucaaggucaugaacgagaagcuccagcacugcauggagcucaccgaccucaugcgcaaccaccucaacgagaagcgcgcccuccgccucgaguggaugaucgucauccucaucaccaucgaggucauguucgagcucggccgcgucuucuucuga

SEQ ID NO: 48807 - RNA, 600 nt, Artificial Sequence
  derived and/or modified sequence opt2 from RNASE11__Homo_sapiens__NP_660293
auggagaccuucccccuccuccuccucucccucggccucguccucgccgaggccuccgaguccaccaugaagaucaucaaggaggaguucaccgacgaggagaugcaguacgacauggccaaguccggccaggagaagcagaccaucgagauccucaugaaccccauccuccucgucaagaacaccucccucuccauguccaaggacgacauguccuccacccuccucaccuuccgcucccuccacuacaacgaccccaagggcaacuccuccggcaacgacaaggagugcugcaacgacaugaccgucuggcgcaaggucuccgaggccaacggcuccugcaagugguccaacaacuucauccgcuccuccaccgaggucaugcgccgcguccaccgcgcccccuccugcaaguucguccagaaccccggcaucuccugcugcgagucccucgagcucgagaacaccgucugccaguucaccaccggcaagcaguucccccgcugccaguaccacuccgucaccucccucgagaagauccucaccguccucaccggccacucccucauguccuggcucgucugcggcuccaagcucuga

SEQ ID NO: 48808 - RNA, 444 nt, Artificial Sequence
  derived and/or modified sequence opt2 from RNASE12__Homo_sapiens__NP_001019993
augaucaucauggucaucaucuuccucguccuccucuucugggagaacgaggucaacgacgaggccgucauguccacccucgagcaccuccacgucgacuacccccagaacgacguccccguccccgcccgcuacugcaaccacaugaucauccagcgcgucauccgcgagcccgaccacaccugcaagaaggagcacgucuucauccacgagcgcccccgcaagaucaacggcaucugcaucucccccaagaaggucgccugccagaaccucuccgccaucuucugcuuccaguccgagaccaaguucaagaugaccgucugccagcucaucgagggcacccgcuaccccgccugccgcuaccacuacucccccaccgagggcuucguccucgucaccugcgacgaccuccgccccgacuccuuccucggcuacgucaaguga

SEQ ID NO: 48809 - RNA, 471 nt, Artificial Sequence
  derived and/or modified sequence opt2 from RNASE13__Homo_sapiens__NP_001012264
auggcccccgccgucacccgccuccucuuccuccagcucguccucggccccacccucgucauggacaucaagaugcagaucggcucccgcaacuucuacacccucuccaucgacuacccccgcgucaacuaccccaagggcuuccgcggcuacugcaacggccucauguccuacaugcgcggcaagaugcagaacuccgacugccccaagauccacuacgucauccacgcccccuggaaggccauccagaaguucugcaaguacuccgacuccuucugcgagaacuacaacgaguacugcacccucacccaggacucccuccccaucaccgucugcucccucucccaccagcagccccccaccuccugcuacuacaacuccacccucaccaaccagaagcucuaccuccucugcucccgcaaguacgaggccgaccccaucggcaucgccggccucuacuccggcaucuga

SEQ ID NO: 48810 - RNA, 471 nt, Artificial Sequence
  derived and/or modified sequence opt2 from RNASE1__Homo_sapiens__NP_937875
auggcccucgagaagucccucguccgccuccuccuccucguccucauccuccucguccucggcuggguccagcccucccucggcaaggagucccgcgccaagaaguuccagcgccagcacauggacuccgacuccucccccuccuccuccuccaccuacugcaaccagaugaugcgccgccgcaacaugacccagggccgcugcaagcccgucaacaccuucguccacgagccccucgucgacguccagaacgucugcuuccaggagaaggucaccugcaagaacggccagggcaacugcuacaaguccaacuccuccaugcacaucaccgacugccgccucaccaacggcucccgcuaccccaacugcgccuaccgcaccucccccaaggagcgccacaucaucgucgccugcgagggcucccccuacguccccguccacuucgacgccuccgucgaggacuccaccuga

SEQ ID NO: 48811 - RNA, 486 nt, Artificial Sequence
  derived and/or modified sequence opt2 from RNASE2__Homo_sapiens__NP_002925
augguccccaagcucuucaccucccagaucugccuccuccuccuccucggccuccucgccgucgagggcucccuccacgucaagcccccccaguucaccugggcccagugguucgagacccagcacaucaacaugaccucccagcagugcaccaacgccaugcaggucaucaacaacuaccagcgccgcugcaagaaccagaacaccuuccuccucaccaccuucgccaacgucgucaacgucugcggcaaccccaacaugaccugccccuccaacaagacccgcaagaacugccaccacuccggcucccaggucccccucauccacugcaaccucaccacccccuccccccagaacaucuccaacugccgcuacgcccagacccccgccaacauguucuacaucgucgccugcgacaaccgcgaccagcgccgcgaccccccccaguaccccgucguccccguccaccucgaccgcaucaucuga

SEQ ID NO: 48812 - RNA, 483 nt, Artificial Sequence
  derived and/or modified sequence opt2 from RNASE3__Homo_sapiens__NP_002926
augguccccaagcucuucaccucccagaucugccuccuccuccuccucggccucaugggcgucgagggcucccuccacgcccgccccccccaguucacccgcgcccagugguucgccauccagcacaucucccucaaccccccccgcugcaccaucgccaugcgcgccaucaacaacuaccgcuggcgcugcaagaaccagaacaccuuccuccgcaccaccuucgccaacgucgucaacgucugcggcaaccaguccauccgcugcccccacaaccgcacccucaacaacugccaccgcucccgcuuccgcgucccccuccuccacugcgaccucaucaaccccggcgcccagaacaucuccaacugcaccuacgccgaccgccccggccgccgcuucuacgucgucgccugcgacaaccgcgacccccgcgacuccccccgcuaccccgucguccccguccaccucgacaccaccaucuga

SEQ ID NO: 48813 - RNA, 444 nt, Artificial Sequence
  derived and/or modified sequence opt2 from RNASE4__Homo_sapiens__NP_002928
auggcccuccagcgcacccacucccuccuccuccuccuccuccucacccuccucggccucggccucguccagcccuccuacggccaggacggcauguaccagcgcuuccuccgccagcacguccaccccgaggagaccggcggcuccgaccgcuacugcaaccucaugaugcagcgccgcaagaugacccucuaccacugcaagcgcuucaacaccuucauccacgaggacaucuggaacauccgcuccaucugcuccaccaccaacauccagugcaagaacggcaagaugaacugccacgagggcgucgucaaggucaccgacugccgcgacaccggcuccucccgcgcccccaacugccgcuaccgcgccaucgccuccacccgccgcgucgucaucgccugcgagggcaacccccagguccccguccacuucgacggcuga

SEQ ID NO: 48814 - RNA, 453 nt, Artificial Sequence
  derived and/or modified sequence opt2 from RNASE6__Homo_sapiens__NP_005606
augguccucugcuucccccuccuccuccuccuccucguccucuggggccccgucugcccccuccacgccuggcccaagcgccucaccaaggcccacugguucgagauccagcacauccagcccuccccccuccagugcaaccgcgccauguccggcaucaacaacuacacccagcacugcaagcaccagaacaccuuccuccacgacuccuuccagaacgucgccgccgucugcgaccuccucuccaucgucugcaagaaccgccgccacaacugccaccaguccuccaagcccgucaacaugaccgacugccgccucaccuccggcaaguacccccagugccgcuacuccgccgccgcccaguacaaguucuucaucgucgccugcgaccccccccagaaguccgacccccccuacaagcucguccccguccaccucgacuccauccucuga

SEQ ID NO: 48815 - RNA, 471 nt, Artificial Sequence
  derived and/or modified sequence opt2 from RNASE7__Homo_sapiens__NP_115961
auggcccccgcccgcgccggcuucugcccccuccuccuccuccuccuccucggccucugggucgccgagauccccgucuccgccaagcccaagggcaugaccuccucccagugguucaagauccagcacaugcagcccuccccccaggccugcaacuccgccaugaagaacaucaacaagcacaccaagcgcugcaaggaccucaacaccuuccuccacgagcccuucuccuccgucgccgccaccugccagacccccaagaucgccugcaagaacggcgacaagaacugccaccagucccacggcgccgucucccucaccaugugcaagcucaccuccggcaaguaccccaacugccgcuacaaggagaagcgccagaacaaguccuacgucgucgccugcaagcccccccagaagaaggacucccagcaguuccaccucguccccguccaccucgaccgcguccucuga

SEQ ID NO: 48816 - RNA, 465 nt, Artificial Sequence
  derived and/or modified sequence opt2 from RNASE8__Homo_sapiens__NP_612204
auggcccccgcccgcgccggcugcugcccccuccuccuccuccuccucggccucugggucgccgagguccucguccgcgccaagcccaaggacaugaccuccucccagugguucaagacccagcacguccagcccuccccccaggccugcaacuccgccauguccaucaucaacaaguacaccgagcgcugcaaggaccucaacaccuuccuccacgagcccuucuccuccgucgccaucaccugccagacccccaacaucgccugcaagaacuccugcaagaacugccaccagucccacggccccaugucccucaccaugggcgagcucaccuccggcaaguaccccaacugccgcuacaaggagaagcaccucaacacccccuacaucgucgccugcgaccccccccagcagggcgaccccggcuacccccucguccccguccaccucgacaaggucgucuga

SEQ ID NO: 48817 - RNA, 618 nt, Artificial Sequence
  derived and/or modified sequence opt2 from RNASE9__Homo_sapiens__NP_001103826
augaugcgcacccucaucaccacccacccccucccccuccuccuccucccccagcagcuccuccagcucguccaguuccaggaggucgacaccgacuucgacuuccccgaggaggacaagaaggaggaguucgaggagugccucgagaaguucuucuccaccggccccgcccgcccccccaccaaggagaaggucaagcgccgcguccucaucgagcccggcaugccccucaaccacaucgaguacugcaaccacgagaucaugggcaagaacgucuacuacaagcaccgcugggucgccgagcacuacuuccuccucaugcaguacgacgagcuccagaagaucugcuacaaccgcuucguccccugcaagaacggcauccgcaagugcaaccgcuccaagggccucgucgagggcgucuacugcaaccucaccgaggccuucgagauccccgccugcaaguacgagucccucuaccgcaagggcuacguccucaucaccugcuccuggcagaacgagaugcagaagcgcaucccccacaccaucaacgaccucgucgagccccccgagcaccgcuccuuccucuccgaggacggcgucuucgucaucucccccuga

SEQ ID NO: 48818 - RNA, 861 nt, Artificial Sequence
  derived and/or modified sequence opt2 from RNASEH1__Homo_sapiens__NP_002927
auguccuggcuccucuuccucgcccaccgcgucgcccucgccgcccuccccugccgccgcggcucccgcggcuucggcauguucuacgccguccgccgcggccgcaagaccggcgucuuccucaccuggaacgagugccgcgcccaggucgaccgcuuccccgccgcccgcuucaagaaguucgccaccgaggacgaggccugggccuucguccgcaaguccgccucccccgaggucuccgagggccacgagaaccagcacggccaggaguccgaggccaaggccuccaagcgccuccgcgagccccucgacggcgacggccacgaguccgccgagcccuacgccaagcacaugaagcccuccgucgagcccgccccccccgucucccgcgacaccuucuccuacaugggcgacuucgucgucgucuacaccgacggcugcugcuccuccaacggccgccgccgcccccgcgccggcaucggcgucuacuggggccccggccacccccucaacgucggcauccgccuccccggccgccagaccaaccagcgcgccgagauccacgccgccugcaaggccaucgagcaggccaagacccagaacaucaacaagcucguccucuacaccgacuccauguucaccaucaacggcaucaccaacuggguccagggcuggaagaagaacggcuggaagaccuccgccggcaaggaggucaucaacaaggaggacuucgucgcccucgagcgccucacccagggcauggacauccaguggaugcacguccccggccacuccggcuucaucggcaacgaggaggccgaccgccucgcccgcgagggcgccaagcaguccgaggacuga

SEQ ID NO: 48819 - RNA, 900 nt, Artificial Sequence
  derived and/or modified sequence opt2 from RNASEH2A__Homo_sapiens__NP_006388
auggaccucuccgagcucgagcgcgacaacaccggccgcugccgccucuccucccccguccccgccgucugccgcaaggagcccugcguccucggcgucgacgaggccggccgcggccccguccucggccccauggucuacgccaucugcuacugcccccucccccgccucgccgaccucgaggcccucaaggucgccgacuccaagacccuccucgaguccgagcgcgagcgccucuucgccaagauggaggacaccgacuucgucggcugggcccucgacguccucucccccaaccucaucuccaccuccaugcucggccgcgucaaguacaaccucaacucccucucccacgacaccgccaccggccucauccaguacgcccucgaccagggcgucaacgucacccaggucuucgucgacaccgucggcaugcccgagaccuaccaggcccgccuccagcaguccuuccccggcaucgaggucaccgucaaggccaaggccgacgcccucuaccccgucgucuccgccgccuccaucugcgccaaggucgcccgcgaccaggccgucaagaaguggcaguucgucgagaagcuccaggaccucgacaccgacuacggcuccggcuaccccaacgaccccaagaccaaggccuggcucaaggagcacgucgagcccgucuucggcuucccccaguucguccgcuucuccuggcgcaccgcccagaccauccucgagaaggaggccgaggacgucaucugggaggacuccgccuccgagaaccaggagggccuccgcaagaucaccuccuacuuccucaacgagggcucccaggcccgcccccgcuccucccaccgcuacuuccucgagcgcggccucgaguccgccaccucccucuga

SEQ ID NO: 48820 - RNA, 774 nt, Artificial Sequence
  derived and/or modified sequence opt2 from RNASEH2B__Homo_sapiens__NP_001135751
auggccgccggcgucgacugcggcgacggcgucggcgcccgccagcacgucuuccucgucuccgaguaccucaaggacgccuccaagaagaugaagaacggccucauguucgucaagcucgucaaccccugcuccggcgagggcgccaucuaccucuucaacaugugccuccagcagcucuucgaggucaaggucuucaaggagaagcaccacuccugguucaucaaccaguccguccaguccggcggccuccuccacuucgccacccccgucgacccccucuuccuccuccuccacuaccucaucaaggccgacaaggagggcaaguuccagccccucgaccaggucgucgucgacaacgucuuccccaacugcauccuccuccucaagcuccccggccucgagaagcuccuccaccacgucaccgaggagaagggcaaccccgagaucgacaacaagaaguacuacaaguacuccaaggagaagacccucaaguggcucgagaagaaggucaaccagaccgucgccgcccucaagaccaacaacgucaacgucuccucccgcguccaguccaccgccuucuucuccggcgaccaggccuccaccgacaaggaggaggacuacauccgcuacgcccacggccucaucuccgacuacauccccaaggagcucuccgacgaccucuccaaguaccucaagcuccccgagcccuccgccucccuccccaacccccccuccaagauggccgcccagcgccagaagcgcggcaaguga

SEQ ID NO: 48821 - RNA, 495 nt, Artificial Sequence
  derived and/or modified sequence opt2 from RNASEH2C__Homo_sapiens__NP_115569
auggaguccggcgacgaggccgccaucgagcgccaccgcguccaccuccgcuccgccacccuccgcgacgccguccccgccacccuccaccuccuccccugcgaggucgccgucgacggccccgcccccgucggccgcuucuucacccccgccauccgccagggccccgagggccucgaggucuccuuccgcggccgcugccuccgcggcgaggaggucgccgucccccccggccucgucggcuacgucauggucaccgaggagaagaaggucuccaugggcaagcccgacccccuccgcgacuccggcaccgacgaccaggaggaggagccccucgagcgcgacuucgaccgcuucaucggcgccaccgccaacuucucccgcuucacccucuggggccucgagaccauccccggccccgacgccaagguccgcggcgcccucaccuggcccucccucgccgccgccauccacgcccagguccccgaggacuga

SEQ ID NO: 48822 - RNA, 414 nt, Artificial Sequence
  derived and/or modified sequence opt2 from RNASEK__Homo_sapiens__NP_001004333
augggcuggcuccgccccggcccccgcccccucugcccccccgcccgcgccuccugggccuucucccaccgcuuccccuccccccucgccccccgccgcucccccacccccuucuucauggccucccuccucugcugcggccccaagcucgccgccugcggcaucguccucuccgccuggggcgucaucaugcucaucaugcucggcaucuucuucaacguccacuccgccguccucaucgaggacguccccuucaccgagaaggacuucgagaacggcccccagaacaucuacaaccucuacgagcaggucuccuacaacugcuucaucgccgccggccucuaccuccuccucggcggcuucuccuucugccagguccgccucaacaagcgcaaggaguacaugguccgcuga

SEQ ID NO: 48823 - RNA, 2226 nt, Artificial Sequence
  derived and/or modified sequence opt2 from RNASEL__Homo_sapiens__NP_066956
auggagucccgcgaccacaacaacccccaggagggccccaccuccuccuccggccgccgcgccgccgucgaggacaaccaccuccucaucaaggccguccagaacgaggacgucgaccucguccagcagcuccucgagggcggcgccaacgucaacuuccaggaggaggagggcggcuggaccccccuccacaacgccguccagaugucccgcgaggacaucgucgagcuccuccuccgccacggcgccgaccccguccuccgcaagaagaacggcgccacccccuucauccucgccgccaucgccggcuccgucaagcuccucaagcucuuccucuccaagggcgccgacgucaacgagugcgacuucuacggcuucaccgccuucauggaggccgccgucuacggcaaggucaaggcccucaaguuccucuacaagcgcggcgccaacgucaaccuccgccgcaagaccaaggaggaccaggagcgccuccgcaagggcggcgccaccgcccucauggacgccgccgagaagggccacgucgagguccucaagauccuccucgacgagaugggcgccgacgucaacgccugcgacaacaugggccgcaacgcccucauccacgcccuccucuccuccgacgacuccgacgucgaggccaucacccaccuccuccucgaccacggcgccgacgucaacguccgcggcgagcgcggcaagaccccccucauccucgccgucgagaagaagcaccucggccucguccagcgccuccucgagcaggagcacaucgagaucaacgacaccgacuccgacggcaagaccgcccuccuccucgccgucgagcucaagcucaagaagaucgccgagcuccucugcaagcgcggcgccuccaccgacugcggcgaccucgucaugaccgcccgccgcaacuacgaccacucccucgucaagguccuccucucccacggcgccaaggaggacuuccacccccccgccgaggacuggaagccccaguccucccacuggggcgccgcccucaaggaccuccaccgcaucuaccgccccaugaucggcaagcucaaguucuucaucgacgagaaguacaagaucgccgacaccuccgagggcggcaucuaccucggcuucuacgagaagcaggaggucgccgucaagaccuucugcgagggcuccccccgcgcccagcgcgaggucuccugccuccaguccucccgcgagaacucccaccucgucaccuucuacggcuccgagucccaccgcggccaccucuucgucugcgucacccucugcgagcagacccucgaggccugccucgacguccaccgcggcgaggacgucgagaacgaggaggacgaguucgcccgcaacguccucuccuccaucuucaaggccguccaggagcuccaccucuccugcggcuacacccaccaggaccuccagccccagaacauccucaucgacuccaagaaggccgcccaccucgccgacuucgacaaguccaucaagugggccggcgacccccaggaggucaagcgcgaccucgaggaccucggccgccucguccucuacgucgucaagaagggcuccaucuccuucgaggaccucaaggcccaguccaacgaggaggucguccagcucucccccgacgaggagaccaaggaccucauccaccgccucuuccaccccggcgagcacguccgcgacugccucuccgaccuccucggccaccccuucuucuggaccugggagucccgcuaccgcacccuccgcaacgucggcaacgaguccgacaucaagacccgcaaguccgaguccgagauccuccgccuccuccagcccggccccuccgagcacuccaaguccuucgacaaguggaccaccaagaucaacgagugcgucaugaagaagaugaacaaguucuacgagaagcgcggcaacuucuaccagaacaccgucggcgaccuccucaaguucauccgcaaccucggcgagcacaucgacgaggagaagcacaagaagaugaagcucaagaucggcgaccccucccucuacuuccagaagaccuuccccgaccucgucaucuacgucuacaccaagcuccagaacaccgaguaccgcaagcacuucccccagacccacucccccaacaagccccagugcgacggcgccggcggcgccuccggccucgccucccccggcugcuga

SEQ ID NO: 48824 - RNA, 771 nt, Artificial Sequence
  derived and/or modified sequence opt2 from RNASET2__Homo_sapiens__NP_003721
augcgccccgccgcccuccgcggcgcccuccucggcugccucugccucgcccuccucugccucggcggcgccgacaagcgccuccgcgacaaccacgaguggaagaagcucaucaugguccagcacuggcccgagaccgucugcgagaagauccagaacgacugccgcgacccccccgacuacuggaccauccacggccucuggcccgacaaguccgagggcugcaaccgcuccuggcccuucaaccucgaggagaucaaggaccuccuccccgagaugcgcgccuacuggcccgacgucauccacuccuuccccaaccgcucccgcuucuggaagcacgagugggagaagcacggcaccugcgccgcccaggucgacgcccucaacucccagaagaaguacuucggccgcucccucgagcucuaccgcgagcucgaccucaacuccguccuccucaagcucggcaucaagcccuccaucaacuacuaccaggucgccgacuucaaggacgcccucgcccgcgucuacggcgucauccccaagauccagugccucccccccucccaggacgaggagguccagaccaucggccagaucgagcucugccucaccaagcaggaccagcagcuccagaacugcaccgagcccggcgagcagcccucccccaagcaggaggucuggcucgccaacggcgccgccgagucccgcggccuccgcgucugcgaggacggccccgucuucuaccccccccccaagaagaccaagcacuga

SEQ ID NO: 48825 - RNA, 699 nt, Artificial Sequence
  derived and/or modified sequence opt2 from RND1__Homo_sapiens__NP_055285
augaaggagcgccgcgccccccagcccgucgucgcccgcugcaagcucguccucgucggcgacguccagugcggcaagaccgccaugcuccagguccucgccaaggacugcuaccccgagaccuacguccccaccgucuucgagaacuacaccgccugccucgagaccgaggagcagcgcgucgagcucucccucugggacaccuccggcucccccuacuacgacaacguccgcccccucugcuacuccgacuccgacgccguccuccucugcuucgacaucucccgccccgagaccgucgacuccgcccucaagaaguggcgcaccgagauccucgacuacugccccuccacccgcguccuccucaucggcugcaagaccgaccuccgcaccgaccucuccacccucauggagcucucccaccagaagcaggcccccaucuccuacgagcagggcugcgccaucgccaagcagcucggcgccgagaucuaccucgagggcuccgccuucaccuccgagaaguccauccacuccaucuuccgcaccgccuccaugcucugccucaacaagcccuccccccucccccagaagucccccguccgcucccucuccaagcgccuccuccaccuccccucccgcuccgagcucaucuccuccaccuucaagaaggagaaggccaaguccugcuccaucauguga

SEQ ID NO: 48826 - RNA, 735 nt, Artificial Sequence
  derived and/or modified sequence opt2 from RND3__Homo_sapiens__NP_005159
augaaggagcgccgcgccucccagaagcucuccuccaaguccaucauggaccccaaccagaacgucaagugcaagaucgucgucgucggcgacucccagugcggcaagaccgcccuccuccacgucuucgccaaggacugcuuccccgagaacuacguccccaccgucuucgagaacuacaccgccuccuucgagaucgacacccagcgcaucgagcucucccucugggacaccuccggcucccccuacuacgacaacguccgcccccucuccuaccccgacuccgacgccguccucaucugcuucgacaucucccgccccgagacccucgacuccguccucaagaaguggaagggcgagauccaggaguucugccccaacaccaagaugcuccucgucggcugcaaguccgaccuccgcaccgacgucuccacccucgucgagcucuccaaccaccgccagacccccgucuccuacgaccagggcgccaacauggccaagcagaucggcgccgccaccuacaucgagugcuccgcccuccaguccgagaacuccguccgcgacaucuuccacgucgccacccucgccugcgucaacaagaccaacaagaacgucaagcgcaacaagucccagcgcgccaccaagcgcaucucccacaugcccucccgccccgagcucuccgccgucgccaccgaccuccgcaaggacaaggccaaguccugcaccgucauguga

SEQ ID NO: 48827 - RNA, 756 nt, Artificial Sequence
  derived and/or modified sequence opt2 from RNF103-CHMP3__Homo_sapiens__NP_001185883
auggagggcgagcucuacuccgcccucaaggaggaggaggccuccgaguccgucuccuccaccaacuucuccggcgagaugcacuucuacgagcucgucgaggacaccaaggacggcaucuggcucguccaggucaacgaguggucccucaagauccgcaaggagaugcgcgucgucgaccgccagauccgcgacauccagcgcgaggaggagaaggucaagcgcuccgucaaggacgccgccaagaagggccagaaggacgucugcaucguccucgccaaggagaugauccgcucccgcaaggccgucuccaagcucuacgccuccaaggcccacaugaacuccguccucaugggcaugaagaaccagcucgccguccuccgcgucgccggcucccuccagaaguccaccgaggucaugaaggccaugcagucccucgucaagauccccgagauccaggccaccaugcgcgagcucuccaaggagaugaugaaggccggcaucaucgaggagaugcucgaggacaccuucgaguccauggacgaccaggaggagauggaggaggaggccgagauggagaucgaccgcauccucuucgagaucaccgccggcgcccucggcaaggcccccuccaaggucaccgacgcccuccccgagcccgagccccccggcgccauggccgccuccgaggacgaggaggaggaggaggaggcccucgaggccaugcagucccgccucgccacccuccgcuccuga

SEQ ID NO: 48828 - RNA, 2046 nt, Artificial Sequence
  derived and/or modified sequence opt2 from RNF103__Homo_sapiens__NP_001185880
augucccgccuccgcccccgccccccccucauccacggcugcggcggcuucuucgaggccaucgucugguacgagaccggcaucuucgccacccagcucgucgaccccgucgcccucuccuucaagaagcucaagaccauccucgagugccgcggccucggcuacuccggccuccccgagaagaaggacguccgcgagcucgucgagaaguccggcgaccucauggagggcgagcucuacuccgcccucaaggaggaggaggccuccgaguccgucuccuccaccaacuucuccggcgagaugcacuucuacgagcucgucgaggacaccaaggacggcaucuggcucguccaggucaucgccaacgaccgcuccccccucgucggcaagauccacugggagaagauggucaagaaggucucccgcuucggcauccgcaccggcaccuucaacugcuccuccgacccccgcuacugccgccgccgcggcuggguccgcuccacccucaucauguccgucccccagaccuccaccuccaagggcaaggucaugcucaaggaguacuccggccgcaagaucgaggucgagcacaucuucaaguggaucaccgcccacgccgccucccgcaucaagaccaucuacaacgccgagcaccucaaggaggaguggaacaaguccgaccaguacuggcucaagaucuaccucuucgccaaccucgaccagccccccgccuucuucuccgcccucuccaucaaguucaccggccgcgucgaguucaucuucgucaacgucgagaacugggacaacaaguccuacaugaccgacaucggcaucuacaacaugcccuccuacauccuccgcacccccgagggcaucuaccgcuacggcaaccacaccggcgaguucaucucccuccaggccauggacuccuuccuccgcucccuccagcccgaggucaacgaccucuucguccucucccucguccucgucaaccucauggccuggauggaccucuucaucacccagggcgccaccaucaagcgcuucgucguccucaucuccacccucggcaccuacaacucccuccucaucaucuccuggcuccccguccucggcuuccuccagcuccccuaccucgacuccuucuacgaguacucccucaagcuccuccgcuacuccaacaccaccacccucgccuccuggguccgcgccgacuggauguucuacuccucccaccccgcccucuuccucuccaccuaccucggccacggccuccucaucgacuacuucgagaagaagcgccgccgcaacaacaacaacgacgaggucaacgccaacaaccucgaguggcucuccucccucugggacugguacaccuccuaccucuuccaccccaucgccuccuuccagaacuuccccgucgaguccgacugggacgaggaccccgaccucuuccucgagcgccucgccuuccccgaccucuggcuccacccccucauccccaccgacuacaucaagaaccuccccauguggcgcuucaagugccucggcguccaguccgaggaggagauguccgagggcucccaggacaccgagaacgacuccgaguccgagaacaccgacacccucuccuccgagaaggaggucuucgaggacaagcaguccguccuccacaacucccccggcaccgccucccacugcgacgccgaggccugcuccugcgccaacaaguacugccagaccucccccugcgagcgcaagggccgcuccuacggcuccuacaacaccaacgaggacauggagcccgacuggcucaccuggcccgccgacaugcuccacugcaccgagugcgucgucugccucgagaacuucgagaacggcugccuccucaugggccuccccugcggccacgucuuccaccagaacugcaucgucauguggcucgccggcggccgccacugcugccccgucugccgcuggcccuccuacaagaagaagcagcccuacgcccagcaccagccccucuccaacgacguccccuccuga

SEQ ID NO: 48829 - RNA, 3081 nt, Artificial Sequence
  derived and/or modified sequence opt2 from RNF111__Homo_sapiens__XP_006720638
augcacgucuucucccucaucgacggcuccuccggccucgccguccuccgccucucccucaaguuccccaugucccaguggacccccgaguacaacgagcucuacacccucaaggucgacaugaaguccgagauccccuccgacgcccccaagacccaggagucccucaagggcauccuccuccaccccgagcccaucggcgccgccaaguccuuccccgccggcgucgagaugaucaacuccaaggucggcaacgaguucucccaccucugcgacgacucccagaagcaggagaaggagaugaacggcaaccagcaggagcaggagaagucccucgucguccgcaagaagcgcaagucccagcaggccggccccuccuacguccagaacugcgucaaggagaaccagggcauccucggccuccgccagcaccucggcacccccuccgacgaggacaacgacuccuccuucuccgacugccucuccucccccuccuccucccuccacuucggcgacuccgacaccgucaccuccgacgaggacaaggaggucuccguccgccacucccagaccauccucaacgccaagucccgcucccacuccgcccgcucccacaaguggccccgcaccgagaccgaguccgucuccggccuccucaugaagcgccccugccuccacggcuccucccuccgccgccuccccugccgcaagcgcuucgucaagaacaacuccucccagcgcacccagaagcagaaggagcgcauccucaugcagcgcaagaagcgcgagguccucgcccgccgcaaguacgcccuccuccccuccuccuccuccuccuccgagaacgaccucuccuccgaguccuccuccuccuccuccaccgagggcgaggaggaccucuucgucuccgccuccgagaaccaccagaacaaccccgccguccccuccggcuccaucgacgaggacgucgucgucaucgaggccuccuccaccccccaggucaccgccaacgaggagaucaacgucaccuccaccgacuccgaggucgagaucgucaccgucggcgaguccuaccgcucccgcuccacccucggccacucccgcucccacuggucccagggcuccuccucccacgccucccgcccccaggagccccgcaaccgcucccgcaucuccaccgucauccagccccuccgccagaacgccgccgaggucgucgaccucaccgucgacgaggacgagcccaccgucguccccaccaccuccgcccgcauggagucccaggccaccuccgccuccaucaacaacuccaaccccuccaccuccgagcaggccuccgacaccgccuccgccgucaccuccucccagcccuccaccgucuccgagaccuccgccacccucaccuccaacuccaccaccggcaccuccaucggcgacgacucccgccgcaccaccuccuccgccgucaccgagaccggcccccccgccaugccccgccuccccuccugcugcccccagcacucccccugcggcggcuccucccagaaccaccacgcccucggccacccccacaccuccugcuuccagcagcacggccaccacuuccagcaccaccaccaccaccaccacaccccccaccccgccguccccgucucccccuccuucuccgaccccgccugccccgucgagcgccccccccagguccaggcccccugcggcgccaacuccuccuccggcaccuccuaccacgagcagcaggcccuccccgucgaccucuccaacuccggcauccgcucccacggcuccggcuccuuccacggcgccuccgccuucgaccccugcugccccgucuccuccucccgcgccgccaucuucggccaccaggccgccgccgccgcccccucccagccccucuccuccaucgacggcuacggcuccuccauggucgcccagccccagccccagccccccccccagcccucccucuccuccugccgccacuacaugcccccccccuacgccucccucacccgcccccuccaccaccaggccuccgccugcccccacucccacggcaacccccccccccagacccagccccccccccaggucgacuacgucaucccccaccccguccacgccuuccacucccagaucuccucccacgccaccucccaccccgucgccccccccccccccacccaccucgccuccaccgccgcccccaucccccagcaccucccccccacccaccagcccaucucccaccacauccccgccaccgccccccccgcccagcgccuccacccccacgaggucaugcagcgcauggagguccagcgccgccgcaugaugcagcaccccaccggccucuucgucuucugcgucucccgccgcgcccacgagcgcccccccccccacccccaccgcaugcaccccaacuacggccacggccaccacauccacgucccccagaccauguccucccacccccgccaggcccccgagcgcuccgccugggagcucggcaucgaggccggcgucaccgccgccaccuacacccccggcgcccuccacccccaccucgcccacuaccacgcccccccccgccuccaccaccuccagcucggcgcccucccccucaugguccccgacauggccggcuacccccacauccgcuacaucuccuccggccucgacggcaccuccuuccgcggccccuuccgcggcaacuucgaggagcucauccaccucgaggagcgccucggcaacgucaaccgcggcgccucccagggcaccaucgagcgcugcaccuacccccacaaguacaagaaggucaccaccgacugguucucccagcgcaagcuccacugcaagcaggacggcgaggagggcaccgaggaggacaccgaggagaagugcaccaucugccucuccauccucgaggagggcgaggacguccgccgccuccccugcaugcaccucuuccaccaggucugcgucgaccaguggcucaucaccaacaagaagugccccaucugccgcgucgacaucgaggcccagcuccccuccgaguccuga

SEQ ID NO: 48830 - RNA, 1896 nt, Artificial Sequence
  derived and/or modified sequence opt2 from RNF112__Homo_sapiens__NP_009079
augccccgccccgcccucuccgucaccuccuucugccaccgccucggcaagcgcgagcgcaagcaguccuucaugggcaacuccggcaacuccuggucccacacccccuuccccaagcucgagcucggccucggcccccagcccauggccccccgcgagcuccccaccugcuccaucugccucgagcgccuccgcgaccccaucucccucgacugcggccacgacuucugcauccgcugcuucuccacccaccgccuccccggcugcgagccccccugcugccccgagugccgcaagaucugcaagcagaagcgcggccuccgcucccucggcgagaagaugaagcuccucccccagcgcccccucccccccgcccuccaggagaccugccccguccgcgccgagccccuccuccucguccgcaucaacgccuccggcggccucauccuccgcaugggcgccaucaaccgcugccucaagcacccccucgcccgcgacacccccgucugccuccucgccguccucggcgagcagcacuccggcaaguccuuccuccucaaccaccuccuccagggccuccccggccucgaguccggcgagggcggccgcccccgcggcggcgaggccucccuccagggcugccgcuggggcgccaacggccucgcccgcggcaucuggauguggucccaccccuuccuccucggcaaggagggcaagaaggucgccgucuuccucgucgacaccggcgacgccaugucccccgagcucucccgcgagacccgcaucaagcucugcgcccucaccaccaugcucuccuccuaccagauccucuccaccucccaggagcucaaggacaccgaccucgacuaccucgagauguucguccacgucgccgaggucaugggcaagcacuacggcaugguccccauccagcaccucgaccuccucguccgcgacuccucccaccccaacaaggccggccagggccacgucggcaacaucuuccagcgccucuccggccgcuaccccaagguccaggagcuccuccagggcaagcgcgcccgcugcugccuccuccccgcccccggccgccgccgcaugaaccagggccacgccucccccggcgacaccgacgacgacuuccgccaccuccucggcgccuacgucuccgacguccucuccgccgccccccagcacgccaagucccgcugccagggcuacuggaacgagggccgcgccgucgcccgcggcgaccgccgccuccucaccggccagcagcucgcccaggagaucaagaaccucuccggcuggaugggccgcaccggccccggcuucaccucccccgacgagauggccgcccagcuccacgaccuccgcaaggucgaggccgccaagcgcgaguucgaggaguacguccgccagcaggacgucgccaccaagcgcaucuucuccgcccuccgcguccuccccgacaccaugcgcaaccuccucuccacccagaaggacgccauccucgcccgccacggcgucgcccuccucugcaagggccgcgaccagacccucgaggcccucgaggccgagcuccaggccaccgccaaggccuucauggacuccuacaccaugcgcuucugcggccaccucgccgccgucggcggcgccgucggcgccggccucaugggccucgccggcggcgucgucggcgccggcauggccgccgccgcccucgccgccgaggccggcauggucgccgccggcgccgccgucggcgccaccggcgccgccgucgucggcggcggcgucggcgccggccucgccgccaccgucggcugcauggagaaggaggaggacgagcgccuccucgagggcgaccgcgagccccuccuccaggaggaguga

SEQ ID NO: 48831 - RNA, 687 nt, Artificial Sequence
  derived and/or modified sequence opt2 from RNF114__Homo_sapiens__NP_061153
auggccgcccagcagcgcgacugcggcggcgccgcccagcucgccggccccgccgccgaggccgacccccucggccgcuucaccugccccgucugccucgaggucuacgagaagcccguccagguccccugcggccacgucuucugcuccgccugccuccaggagugccucaagcccaagaagcccgucugcggcgucugccgcuccgcccucgcccccggcguccgcgccgucgagcucgagcgccagaucgaguccaccgagaccuccugccacggcugccgcaagaacuucuuccucuccaagauccgcucccacgucgccaccugcuccaaguaccagaacuacaucauggagggcgucaaggccaccaucaaggacgccucccuccagccccgcaacguccccaaccgcuacaccuuccccugccccuacugccccgagaagaacuucgaccaggagggccucgucgagcacugcaagcucuuccacuccaccgacaccaaguccgucgucugccccaucugcgccuccaugcccuggggcgaccccaacuaccgcuccgccaacuuccgcgagcacauccagcgccgccaccgcuucuccuacgacaccuucgucgacuacgacgucgacgaggaggacaugaugaaccagguccuccagcgcuccaucaucgaccaguga

SEQ ID NO: 48832 - RNA, 3945 nt, Artificial Sequence
  derived and/or modified sequence opt2 from RNF123__Homo_sapiens__NP_071347
auggccuccaagggcgccggcauguccuucucccgcaaguccuaccgccucaccuccgacgccgagaagucccgcgucaccggcaucguccaggagaagcuccucaacgacuaccucaaccgcaucuucuccuccuccgagcacgccccccccgccgccaccucccgcaagccccucaacuuccagaaccuccccgagcaccucgaccagcuccuccaggucgacaacgaggaggaggagucccagggccaggucgagggccgccucggccccuccaccgucguccucgaccacaccggcggcuucgagggccuccuccucgucgacgacgaccuccucggcgucaucggccacuccaacuucggcaccauccgcuccaccaccugcgucuacaagggcaaguggcucuacgagguccucaucuccucccagggccucaugcagaucggcuggugcaccaucuccugccgcuucaaccaggaggagggcgucggcgacacccacaacuccuacgccuacgacggcaaccgcguccgcaaguggaacgucaccaccaccaacuacggcaaggccugggccgccggcgacaucgucuccugccucaucgaccucgacgacggcacccucuccuucugccucaacggcgucucccucggcaccgccuucgagaaccucucccgcggccucggcauggccuacuuccccgccaucucccucuccuucaaggaguccgucgccuucaacuucggcucccgcccccuccgcuaccccgucgccggcuaccgcccccuccaggacccccccuccgccgaccucguccgcgcccagcgccuccucggcugcuuccgcgccguccucuccgucgagcucgaccccgucgagggccgccuccucgacaaggaguccuccaaguggcgccuccgcggccagcccaccguccuccucacccucgcccacaucuuccaccacuucgccccccuccuccgcaaggucuaccucgucgaggccguccucauguccuuccuccucggcaucgucgagaagggcacccccacccaggcccaguccgucguccaccagguccucgaccuccucuggcucuucauggaggacuacgagguccaggacugccucaagcagcucaugaugucccuccuccgccucuaccgcuucucccccaucguccccgaccucggccuccagauccacuaccuccgccucaccaucgccauccuccgccacgagaagucccgcaaguuccuccucuccaacguccucuucgacguccuccgcuccgucgucuucuucuacaucaaguccccccuccgcgucgaggaggccggccuccaggagcucauccccaccaccugguggccccacugcuccucccgcgagggcaaggaguccaccgagaugaaggaggagaccgccgaggagcgccuccgccgccgcgccuacgagcgcggcugccagcgccuccgcaagcgcaucgaggucgucgaggagcuccagguccagauccucaagcuccuccucgacaacaaggacgacaacggcggcgaggccucccgcuacaucuuccucaccaaguuccgcaaguuccuccaggagaacgccuccggccgcggcaacaugcccaugcucugcccccccgaguacauggucugcuuccuccaccgccucaucuccgcccuccgcuacuacugggacgaguacaaggccuccaacccccacgccuccuucuccgaggaggccuacauccccccccaggucuucuacaacggcaaggucgacuacuucgaccuccagcgccucggcggccuccucucccaccuccgcaagacccucaaggacgaccucgccuccaaggccaacaucgucaucgacccccucgagcuccaguccaccgccauggacgaccucgacgaggacgaggagcccgcccccgccauggcccagcgccccaugcaggcccucgccgucggcggcccccucccccucccccgccccggcuggcucuccucccccacccucggccgcgccaaccgcuuccucuccaccgccgccgucucccucaugaccccccgccgcccccucuccaccuccgagaaggucaagguccgcacccucuccgucgagcagcgcacccgcgaggacaucgagggcucccacuggaacgagggccuccuccucggccgcccccccgaggagcccgagcagccccucaccgagaacucccuccucgagguccucgacggcgccgucaugauguacaaccucuccguccaccagcagcucggcaagauggucggcgucuccgacgacgucaacgaguacgccauggcccuccgcgacaccgaggacaagcuccgccgcugccccaagcgccgcaaggacauccucgccgagcucaccaagucccagaaggucuucuccgagaagcucgaccaccucucccgccgccucgccuggguccacgccaccgucuacucccaggagaagaugcucgacaucuacuggcuccuccgcgucugccuccgcaccaucgagcacggcgaccgcaccggcucccucuucgccuucaugcccgaguucuaccucuccgucgccaucaacuccuacuccgcccucaagaacuacuucggccccguccacuccauggaggagcuccccggcuacgaggagacccucacccgccucgccgccauccucgccaagcacuucgccgacgcccgcaucgucggcaccgacauccgcgacucccucaugcaggcccucgccuccuacgucugcuacccccacucccuccgcgccgucgagcgcauccccgaggagcagcgcaucgccaugguccgcaaccuccucgcccccuacgagcagcgccccugggcccagaccaacuggauccucguccgccucuggcgcggcugcggcuucggcuaccgcuacacccgccucccccaccuccucaagaccaagcucgaggacgccaaccuccccucccuccagaagcccugccccuccacccuccuccagcagcacauggccgaccuccuccagcagggccccgacgucgcccccuccuuccucaacuccguccucaaccagcucaacugggccuucuccgaguucaucggcaugauccaggagauccagcaggccgccgagcgccucgagcgcaacuucgucgacucccgccagcucaaggucugcgccaccugcuucgaccucuccgucucccuccuccgcguccucgagaugaccaucacccucguccccgagaucuuccucgacuggacccgccccaccuccgagaugcuccuccgccgccucgcccagcuccucaaccagguccucaaccgcgucaccgccgagcgcaaccucuucgaccgcgucgucacccuccgccuccccggccucgaguccgucgaccacuaccccauccucgucgccgucaccggcauccucguccagcuccucguccgcggccccgccuccgagcgcgagcaggccaccuccguccuccucgccgaccccugcuuccagcuccgcuccaucugcuaccuccucggccagcccgagccccccgcccccggcaccgcccuccccgcccccgaccgcaagcgcuucucccuccaguccuacgccgacuacaucuccgccgacgagcucgcccaggucgagcagaugcucgcccaccucaccuccgccuccgcccaggccgccgccgccucccuccccaccuccgaggaggaccucugccccaucugcuacgcccaccccaucuccgccgucuuccagcccugcggccacaaguccugcaaggccugcaucaaccagcaccucaugaacaacaaggacugcuucuucugcaagaccaccaucgucuccgucgaggacugggagaagggcgccaacaccuccaccaccuccuccgccgccuga

SEQ ID NO: 48833 - RNA, 699 nt, Artificial Sequence
  derived and/or modified sequence opt2 from RNF125__Homo_sapiens__NP_060301
augggcuccguccucuccaccgacuccggcaaguccgcccccgccuccgccaccgcccgcgcccucgagcgccgccgcgaccccgagcuccccgucaccuccuucgacugcgccgucugccucgagguccuccaccagcccguccgcacccgcugcggccacgucuucugccgcuccugcaucgccaccucccucaagaacaacaaguggaccugccccuacugccgcgccuaccuccccuccgagggcguccccgccaccgacgucgccaagcgcaugaaguccgaguacaagaacugcgccgagugcgacacccucgucugccucuccgagaugcgcgcccacauccgcaccugccagaaguacaucgacaaguacggcccccuccaggagcucgaggagaccgccgcccgcugcgucugccccuucugccagcgcgagcucuacgaggacucccuccucgaccacugcaucacccaccaccgcuccgagcgccgccccgucuucugcccccucugccgccucauccccgacgagaaccccuccuccuucuccggcucccucauccgccaccuccaggucucccacacccucuucuacgacgacuucaucgacuucaacaucaucgaggaggcccucauccgccgcguccucgaccgcucccuccucgaguacgucaaccacuccaacaccaccuga

SEQ ID NO: 48834 - RNA, 1209 nt, Artificial Sequence
  derived and/or modified sequence opt2 from RNF128__Homo_sapiens__NP_078815
augaaccaggagaaccgcuccuccuucuucuggcuccucgucaucuucaccuuccuccucaagaucaccgccuccuucuccauguccgccuacgucaccgucaccuacuacaacgagaccuccaacuacaccgccaucgagaccugcgagugcggcgucuacggccucgccucccccgucgccaacgccaugggcgucgucggcauccccaagaacaacaacuaccaggccugcgaccacaacaccgaguucuccaacaccaagaagcccuggaucgcccucaucgagcgcggcaacugcaccuucuccgagaagauccagaccgccggccgccgcaacgccgacgccgucgucaucuacaacgcccccgagaccggcaaccagaccauccagauggccaacuucggcgccgucgacaucgucgccaucaugaucggcaaccucaagggcaccaagauccuccaguccauccagcgcggcauccaggucaccauggucaucgaggucggcaagaagcacggccccugggucaaccacuacuccaucuucuucgucuccgucuccuucuucaucaucaccgccgccaccgucggcuacuucaucuucuacuccgcccgccgccuccgcaacgcccgcgcccagucccgcaagcagcgccagcucaaggccgacgccaagaaggccaucggccgccuccagcuccgcacccucaagcagggcgacaaggagaucggccccgacggcgacuccugcgccgucugcaucgagcucuacaagcccaacgaccucguccgcauccucaccugcaaccacaucuuccacaagaccugcgucgaccccuggcuccucgagcaccgcaccugccccaugugcaagugcgacauccucaaggcccucggcaucgaggucgacgucgaggacggcuccgucucccuccagguccccgucuccaacgagaucuccaacuccgccuccucccacgaggaggacaaccgcuccgagaccgccuccuccggcuacgccuccguccagggcaccgacgagcccccccucgaggagcacguccaguccaccaacgagucccuccagcucgucaaccacgaggccaacuccgucgccgucgacgucaucccccacgucgacaaccccaccuucgaggaggacgagacccccaaccaggagaccgccguccgcgagaucaaguccuga

SEQ ID NO: 48835 - RNA, 1260 nt, Artificial Sequence
  derived and/or modified sequence opt2 from RNF130__Homo_sapiens__NP_060904
auguccugcgccggccgcgccggccccgcccgccucgccgcccucgcccuccucaccugcucccucuggcccgcccgcgccgacaacgccucccaggaguacuacaccgcccucaucaacgucaccguccaggagcccggccgcggcgccccccucaccuuccgcaucgaccgcggccgcuacggccucgacucccccaaggccgagguccgcggccagguccucgccccccucccccuccacggcgucgccgaccaccucggcugcgacccccagacccgcuucuucgucccccccaacaucaagcaguggaucgcccuccuccagcgcggcaacugcaccuucaaggagaagaucucccgcgccgccuuccacaacgccgucgccgucgucaucuacaacaacaaguccaaggaggagcccgucaccaugacccaccccggcaccggcgacaucaucgccgucaugaucaccgagcuccgcggcaaggacauccucuccuaccucgagaagaacaucuccguccagaugaccaucgccgucggcacccgcaugccccccaagaacuucucccgcggcucccucgucuucgucuccaucuccuucaucguccucaugaucaucuccuccgccuggcucaucuucuacuucauccagaagauccgcuacaccaacgcccgcgaccgcaaccagcgccgccucggcgacgccgccaagaaggccaucuccaagcucaccacccgcaccgucaagaagggcgacaaggagaccgaccccgacuucgaccacugcgccgucugcaucgaguccuacaagcagaacgacgucguccgcauccuccccugcaagcacgucuuccacaaguccugcgucgaccccuggcucuccgagcacugcaccugccccaugugcaagcucaacauccucaaggcccucggcaucguccccaaccuccccugcaccgacaacgucgccuucgacauggagcgccucacccgcacccaggccgucaaccgccgcuccgcccucggcgaccucgccggcgacaacucccucggccucgagccccuccgcaccuccggcaucuccccccucccccaggacggcgagcucaccccccgcaccggcgagaucaacaucgccgucaccaaggagugguucaucaucgccuccuucggccuccucuccgcccucacccucugcuacaugaucauccgcgccaccgccucccucaacgccaacgaggucgagugguucuga

SEQ ID NO: 48836 - RNA, 861 nt, Artificial Sequence
  derived and/or modified sequence opt2 from RNF135__Homo_sapiens__NP_001171921
auggccggccucggccucggcuccgccguccccgucuggcucgccgaggacgaccucggcugcaucaucugccagggccuccucgacuggcccgccacccuccccugcggccacuccuucugccgccacugccucgaggcccucuggggcgcccgcgacgcccgccgcugggccugccccaccugccgccagggcgccgcccagcagccccaccuccgcaagaacacccuccuccaggaccucgccgacaaguaccgccgcgccgcccgcgagauccaggccggcuccgaccccgcccacugccccugccccggcuccuccucccucuccuccgccgccgcccgcccccgccgccgccccgagcuccagcgcgucgccgucgagaaguccaucaccgaggucgcccaggagcucaccgagcucgucgagcaccucgucgacaucguccgcucccuccagaaccagcgcccccucuccgaguccggccccgacaacgagcucuccauccucggcaaggccuucuccuccggcgucgaccucuccauggccucccccaagcucgucaccuccgacaccgccgccggcaagauccgcgacauccuccacgaccucgaggagauccaggagaagcuccaggaguccgucaccuggaaggaggcccccgaggcccagaugcagggcucccuccucccccgccucgagugcuccggcaccaucaccgccgccuccaucucccaggcccaggagaacuccuggaagccccgccuccccccccacgcccacugccucacccgcgccacccuccacuccggcgagcuccucggccuccucuccggccccuccauccagccccucaccuga

SEQ ID NO: 48837 - RNA, 738 nt, Artificial Sequence
  derived and/or modified sequence opt2 from RNF138__Homo_sapiens__NP_057355
auggccgaggaccucuccgccgccaccuccuacaccgaggacgacuucuacugccccgucugccaggagguccucaagacccccguccgcaccaccgccugccagcacgucuucugccgcaagugcuuccucaccgccaugcgcgaguccggcgcccacugcccccucugccgcggcaacgucacccgccgcgagcgcgccugccccgagcgcgcccucgaccucgagaacaucaugcgcaaguucuccggcuccugccgcugcugcgccaagcagaucaaguucuaccgcaugcgccaccacuacaaguccugcaagaaguaccaggacgaguacggcgucuccuccaucauccccaacuuccagaucucccaggacuccgucggcaacuccaaccgcuccgagaccuccaccuccgacaacaccgagaccuaccaggagaacaccuccuccuccggccaccccaccuucaagugcccccucugccaggaguccaacuucacccgccagcgccuccucgaccacugcaacuccaaccaccucuuccagaucguccccgucaccugccccaucugcgucucccuccccuggggcgaccccucccagaucacccgcaacuucgucucccaccucaaccagcgccaccaguucgacuacggcgaguucgucaaccuccagcucgacgaggagacccaguaccagaccgccgucgaggaguccuuccaggucaacaucuga

SEQ ID NO: 48838 - RNA, 1995 nt, Artificial Sequence
  derived and/or modified sequence opt2 from RNF139__Homo_sapiens__NP_009149
auggccgccgucggccccccccagcagcagguccgcauggcccaccagcaggucugggccgcccucgaggucgcccuccgcguccccugccucuacaucaucgacgccaucuucaacuccuaccccgacuccucccagucccgcuucugcaucguccuccagaucuuccuccgccucuucggcgucuucgccuccuccaucguccucauccucucccagcgcucccucuucaaguucuacaccuacuccuccgccuuccuccucgccgccaccuccguccucgucaacuacuacgccucccuccacaucgacuucuacggcgccuacaacaccuccgccuucggcaucgagcuccucccccgcaagggccccucccucuggauggcccucaucguccuccagcucaccuucggcaucggcuacgucacccuccuccagauccacuccaucuacucccagcucaucauccucgaccuccucguccccgucaucggccucaucaccgagcucccccuccacauccgcgagacccuccucuucaccuccucccucauccucacccucaacaccgucuucguccucgccgucaagcucaagugguucuacuacuccacccgcuacgucuaccuccucguccgccacauguaccgcaucuacggccuccagcuccucauggaggacaccuggaagcgcauccgcuuccccgacauccuccgcgucuucuggcucacccgcgucaccgcccaggccaccguccucauguacauccuccgcauggccaacgagaccgacuccuucuucaucuccugggacgacuucugggaccucaucugcaaccucaucaucuccggcugcgacuccacccucaccguccucggcauguccgccgucaucuccuccgucgcccacuaccucggccucggcauccucgccuucaucggcuccaccgaggaggacgaccgccgccucggcuucgucgcccccguccucuucuucauccucgcccuccagaccggccucuccggccuccgccccgaggagcgccucauccgccucucccgcaacaugugccuccuccucaccgccguccuccacuucauccacggcaugaccgaccccguccucaugucccucuccgccucccacgucuccuccuuccgccgccacuuccccguccucuucgucuccgccugccucuucauccuccccguccuccucuccuacguccucuggcaccacuacgcccucaacaccuggcucuucgccgucaccgccuucugcgucgagcucugccucaaggucaucgucucccucaccgucuacacccucuucaugaucgacggcuacuacaacguccucugggagaagcucgacgacuacgucuacuacguccgcuccaccggcuccaucaucgaguucaucuucggcgucgucauguucggcaacggcgccuacaccaugauguucgaguccggcuccaagauccgcgccuucaugaugugccuccacgccuacuucaacaucuaccuccaggccaagaacggcuggaagaccuucaugaaccgccgcaccgccgucaagaagaucaacucccuccccgagaucaagggcucccgccuccaggagaucaacgacgucugcgccaucugcuaccacgaguucaccaccuccgcccgcaucacccccugcaaccacuacuuccacgcccucugccuccgcaaguggcucuacauccaggacaccugccccaugugccaccagaaggucuacaucgaggacgacaucaaggacaacuccaacgucuccaacaacaacggcuucaucccccccaacgagacccccgaggaggccguccgcgaggccgccgccgaguccgaccgcgagcucaacgaggacgacuccaccgacugcgacgacgacguccagcgcgagcgcaacggcgucauccagcacaccggcgccgccgccgaggaguucaacgacgacaccgacuga

SEQ ID NO: 48839 - RNA, 879 nt, Artificial Sequence
  derived and/or modified sequence opt2 from RNF144A__Homo_sapiens__XP_005246259
augaccaccacccgcuaccgccccaccugggaccucgcccucgacccccucgucuccugcaagcucugccucggcgaguaccccgucgagcagaugaccaccaucgcccagugccagugcaucuucugcacccucugccucaagcaguacgucgagcuccucaucaaggagggccucgagaccgccaucuccugccccgacgccgccugccccaagcagggccaccuccaggagaacgagaucgagugcauggucgccgccgagaucaugcagcgcuacaagaagcuccaguucgagcgcgagguccucuucgaccccugccgcaccuggugccccgccuccaccugccaggccgucugccagcuccaggacgucggccuccagaccccccagcccguccagugcaaggccugccgcauggaguucugcuccaccugcaaggccuccuggcaccccggccagggcugccccgagaccaugcccaucaccuuccuccccggcgagaccuccgccgccuucaagauggaggaggacgacgcccccaucaagcgcugccccaagugcaaggucuacaucgagcgcgacgagggcugcgcccagaugaugugcaagaacugcaagcacgccuucugcugguacugccucgagucccucgacgacgacuuccuccucauccacuacgacaagggccccugccgcaacaagcucggccacucccgcgccuccgucaucuggcaccgcacccaggucgucggcaucuucgccggcuucggccuccuccuccucgucgccucccccuuccuccuccucgccacccccuucguccucugcugcaagugcaagugcuccaagggcgacgacgacccccuccccaccuga

SEQ ID NO: 48840 - RNA, 912 nt, Artificial Sequence
  derived and/or modified sequence opt2 from RNF144B__Homo_sapiens__XP_005249041
augggcuccgccggccgccuccacuaccucgccaugaccgccgagaaccccacccccggcgaccucgcccccgccccccucaucaccugcaagcucugccucugcgagcagucccucgacaagaugaccacccuccaggagugccagugcaucuucugcaccgccugccucaagcaguacaugcagcucgccauccgcgagggcugcggcucccccaucaccugccccgacauggucugccucaaccacggcacccuccaggaggccgagaucgccugccucguccccgucgaccaguuccagcucuaccagcgccucaaguucgagcgcgagguccaccucgaccccuaccgcaccuggugccccgucgccgacugccagaccgucugccccgucgccuccuccgaccccggccagcccguccucgucgagugccccuccugccaccucaaguucugcuccugcugcaaggacgccuggcacgccgaggucuccugccgcgacucccagcccaucguccuccccaccgagcaccgcgcccucuucggcaccgacgccgaggcccccaucaagcagugccccgucugccgcgucuacaucgagcgcaacgagggcugcgcccagaugaugugcaagaacugcaagcacaccuucugcugguacugccuccagaaccucgacaacgacaucuuccuccgccacuacgacaagggccccugccgcaacaagcucggccacucccgcgccuccgucauguggaaccgcacccaggucgucggcauccucgucggccucggcaucaucgcccucgucaccuccccccuccuccuccucgccucccccugcaucaucugcugcgucugcaaguccugccgcggcaagaagaagaagcacgaccccuccaccaccuga

SEQ ID NO: 48841 - RNA, 1080 nt, Artificial Sequence
  derived and/or modified sequence opt2 from RNF146__Homo_sapiens__NP_001229778
augauggccggcugcggcgagaucgaccacuccaucaacaugcuccccaccaaccgcaaggccaacgaguccugcuccaacaccgcccccucccucaccguccccgagugcgccaucugccuccagaccugcguccaccccgucucccuccccugcaagcacgucuucugcuaccucugcgucaagggcgccuccuggcucggcaagcgcugcgcccucugccgccaggagauccccgaggacuuccucgacaagcccacccuccucucccccgaggagcucaaggccgccucccgcggcaacggcgaguacgccugguacuacgagggccgcaacggcugguggcaguacgacgagcgcaccucccgcgagcucgaggacgccuucuccaagggcaagaagaacaccgagaugcucaucgccggcuuccucuacgucgccgaccucgagaacaugguccaguaccgccgcaacgagcacggccgccgccgcaagaucaagcgcgacaucaucgacauccccaagaagggcgucgccggccuccgccucgacugcgacgccaacaccgucaaccucgcccgcgaguccuccgccgacggcgccgacuccgucuccgcccaguccggcgccuccguccagccccucgucuccuccguccgcccccucaccuccgucgacggccagcucaccucccccgccacccccucccccgacgccuccaccucccucgaggacuccuucgcccaccuccagcucuccggcgacaacaccgccgagcgcucccaccgcggcgagggcgaggaggaccacgagucccccuccuccggccgcguccccgcccccgacaccuccaucgaggagaccgaguccgacgccuccuccgacuccgaggacgucuccgccgucgucgcccagcacucccucacccagcagcgccuccucgucuccaacgccaaccagaccguccccgaccgcuccgaccgcuccggcaccgaccgcuccgucgccggcggcggcaccgucuccgucuccguccgcucccgccgccccgacggccagugcaccgucaccgaggucuga

SEQ ID NO: 48842 - RNA, 1203 nt, Artificial Sequence
  derived and/or modified sequence opt2 from RNF149__Homo_sapiens__NP_775918
auggccuggcgccgccgcgaggccuccgucggcgcccgcggcguccucgcccucgcccuccucgcccucgcccucugcguccccggcgcccgcggccgcgcccucgagugguucuccgccgucgucaacaucgaguacgucgacccccagaccaaccucaccgucugguccgucuccgaguccggccgcuucggcgacuccucccccaaggagggcgcccacggccucgucggcguccccugggcccccggcggcgaccucgagggcugcgcccccgacacccgcuucuucguccccgagcccggcggccgcggcgccgcccccugggucgcccucgucgcccgcggcggcugcaccuucaaggacaagguccucgucgccgcccgccgcaacgccuccgccgucguccucuacaacgaggagcgcuacggcaacaucacccuccccaugucccacgccggcaccggcaacaucgucgucaucaugaucuccuaccccaagggccgcgagauccucgagcucguccagaagggcauccccgucaccaugaccaucggcgucggcacccgccacguccaggaguucaucuccggccaguccgucgucuucgucgccaucgccuucaucaccaugaugaucaucucccucgccuggcucaucuucuacuacauccagcgcuuccucuacaccggcucccagaucggcucccagucccaccgcaaggagaccaagaaggucaucggccagcuccuccuccacaccgucaagcacggcgagaagggcaucgacgucgacgccgagaacugcgccgucugcaucgagaacuucaaggucaaggacaucauccgcauccuccccugcaagcacaucuuccaccgcaucugcaucgaccccuggcuccucgaccaccgcaccugccccaugugcaagcucgacgucaucaaggcccucggcuacuggggcgagcccggcgacguccaggagaugcccgcccccgaguccccccccggccgcgaccccgccgccaaccucucccucgcccuccccgacgacgacggcuccgacgacuccuccccccccuccgccucccccgccgaguccgagccccagugcgaccccuccuucaagggcgacgccggcgagaacaccgcccuccucgaggccggccgcuccgacucccgccacggcggccccaucuccuga

SEQ ID NO: 48843 - RNA, 1047 nt, Artificial Sequence
  derived and/or modified sequence opt2 from RNF14__Homo_sapiens__XP_005268598
augcaguuccucaaggaggagacccucgccuaccucaacaucgucucccccuucgagcucaagaucggcucccagaagaagguccagcgccgcaccgcccaggccucccccaacaccgagcucgacuucggcggcgccgccggcuccgacgucgaccaggaggagaucgucgacgagcgcgccguccaggacgucgagucccucuccaaccucauccaggagauccucgacuucgaccaggcccagcagaucaagugcuucaacuccaagcucuuccucugcuccaucugcuucugcgagaagcucggcuccgagugcauguacuuccucgagugccgccacgucuacugcaaggccugccucaaggacuacuucgagauccagauccgcgacggccagguccagugccucaacugccccgagcccaagugccccuccgucgccacccccggccaggucaaggagcucgucgaggccgagcucuucgcccgcuacgaccgccuccuccuccaguccucccucgaccucauggccgacgucgucuacugcccccgccccugcugccagcuccccgucaugcaggagcccggcugcaccaugggcaucugcuccuccugcaacuucgccuucugcacccucugccgccucaccuaccacggcgucucccccugcaaggucaccgccgagaagcucauggaccuccgcaacgaguaccuccaggccgacgaggccaacaagcgccuccucgaccagcgcuacggcaagcgcgucauccagaaggcccucgaggagauggaguccaaggaguggcucgagaagaacuccaaguccugccccugcugcggcacccccaucgagaagcucgacggcugcaacaagaugaccugcaccggcugcaugcaguacuucugcuggaucugcaugggcucccucucccgcgccaaccccuacaagcacuucaacgaccccggcucccccugcuucaaccgccucuucuacgccgucgacgucgacgacgacaucugggaggacgaggucgaggacuga

SEQ ID NO: 48844 - RNA, 1317 nt, Artificial Sequence
  derived and/or modified sequence opt2 from RNF150__Homo_sapiens__NP_065775
auggccaugucccucauccaggccugcugcucccucgcccucuccaccuggcuccucuccuucugcuucguccaccuccucugccucgacuucaccgucgccgagaaggaggagugguacaccgccuucgucaacaucaccuacgccgagcccgcccccgaccccggcgccggcgccgccggcggcggcggcgccgagcuccacaccgagaagaccgagugcggccgcuacggcgagcacucccccaagcaggacgcccgcggcgaggucgucauggccuccuccgcccacgaccgccucgccugcgaccccaacaccaaguucgccgcccccacccgcggcaagaacuggaucgcccucauccccaagggcaacugcaccuaccgcgacaagauccgcaacgccuuccuccagaacgccuccgccgucgucaucuucaacgucggcuccaacaccaacgagaccaucaccaugccccacgccggcgucgaggacaucgucgccaucaugauccccgagcccaagggcaaggagaucgucucccuccucgagcgcaacaucaccgucaccauguacaucaccaucggcacccgcaaccuccagaaguacgucucccgcaccuccgucgucuucgucuccaucuccuucaucguccucaugaucaucucccucgccuggcucgucuucuacuacauccagcgcuuccgcuacgccaacgcccgcgaccgcaaccagcgccgccucggcgacgccgccaagaaggccaucuccaagcuccagauccgcaccaucaagaagggcgacaaggagaccgaguccgacuucgacaacugcgccgucugcaucgagggcuacaagcccaacgacgucguccgcauccuccccugccgccaccucuuccacaaguccugcgucgaccccuggcuccucgaccaccgcaccugccccaugugcaagaugaacauccucaaggcccucggcaucccccccaacgccgacugcauggacgaccuccccaccgacuucgagggcucccucggcggcccccccaccaaccagaucaccggcgccuccgacaccaccgucaacgaguccuccgucacccucgaccccgccguccgcaccgucggcgcccuccaggucguccaggacaccgaccccaucccccaggagggcgacgucaucuucaccaccaacuccgagcaggagcccgccgucuccuccgacuccgacaucucccucaucauggccauggaggucggccucuccgacgucgagcucuccaccgaccaggacugcgaggaggucaaguccuga

SEQ ID NO: 48845 - RNA, 612 nt, Artificial Sequence
  derived and/or modified sequence opt2 from RNF152__Homo_sapiens__NP_775828
auggagacccucucccaggacucccuccucgagugccagaucugcuucaacuacuacuccccccgccgccgccccaagcuccucgacugcaagcacaccugcugcuccgucugccuccagcagaugcgcaccucccagaaggacguccgcugccccuggugccgcggcgucaccaagcucccccccggcuucuccgucucccagcuccccgacgaccccgagguccucgccgucaucgccaucccccacaccuccgagcacacccccgucuucaucaagcuccccuccaacggcugcuacaugcucccccuccccaucuccaaggagcgcgcccuccuccccggcgacaugggcugccgccuccuccccggcucccagcagaaguccgucaccgucgucaccauccccgccgagcagcagccccuccagggcggcgccccccaggaggccgucgaggaggagcaggaccgccgcggcgucgucaaguccuccaccugguccggcgucugcaccgucauccucgucgccugcguccucgucuuccuccucggcaucguccuccacaacauguccugcaucuccaagcgcuucaccgucaucuccugcggcuga

SEQ ID NO: 48846 - RNA, 2040 nt, Artificial Sequence
  derived and/or modified sequence opt2 from RNF157__Homo_sapiens__NP_443148
augggcgcccucaccucccgccagcacgccggcgucgaggaggucgacauccccuccaacuccgucuaccgcuacccccccaaguccggcuccuacuucgccucccacuucaucaugggcggcgagaaguucgacuccacccaccccgagggcuaccucuucggcgagaacuccgaccucaacuuccucggcaaccgccccgucgucuuccccuacgccgccccccccccccaggagcccgucaagacccuccgcucccucgucaacauccgcaaggacacccuccgccucgucaagugcgccgaggaggucaagucccccggcgaggaggccuccaaggccaagguccacuacaacgucgaguucaccuucgacaccgacgcccgcgucgccaucaccaucuacuaccaggccaccgaggaguuccagaacggcaucgccuccuacauccccaaggacaacucccuccaguccgagaccguccaguacaagcgcggcgucugccagcaguucugccuccccucccacaccgucgaccccuccgagugggccgaggaggagcucggcuucgaccucgaccgcgaggucuacccccucgucguccacgccgucgucgacgagggcgacgaguacuucggccacugccacguccuccucggcaccuucgagaagcacaccgacggcaccuucugcgucaagccccucaagcagaagcaggucgucgacggcgucuccuaccuccuccaggagaucuacggcaucgagaacaaguacaacacccaggacuccaaggucgccgaggacgaggucuccgacaacuccgccgagugcgucgucugccucuccgacguccgcgacacccucauccuccccugccgccaccucugccucugcaacaccugcgccgacacccuccgcuaccaggccaacaacugccccaucugccgccuccccuuccgcgcccuccuccagauccgcgccaugcgcaagaagcucggcccccucucccccaccuccuucaaccccaucaucuccucccagaccuccgacuccgaggagcaccccuccuccgagaacaucccccccggcuacgaggucgucucccuccucgaggcccucaacggcccccucacccccucccccgccguccccccccuccacguccucggcgacggccaccucuccggcaugcuccccuccuacggcuccgacggccaccucccccccguccgcaccaucuccccccucgaccgccucuccgacuccuccucccagggccucaagcucaagaagucccucuccaaguccaccucccagaacuccuccguccuccacgaggaggaggacgagcacuccugcuccgaguccgagacccagcucucccagcgccccuccguccagcaccucggcgaggagugcggcgucacccccgaguccgagaaccucacccucuccuccuccggcgccaucgaccaguccuccugcaccggcaccccccucuccuccaccaucuccucccccgagggccccgccuccuccucccucgcccaguccgucauguccauggccuccucccagaucuccaccgacaccgucuccuccauguccggcuccuacaucgcccccggcaccgaggaggagggcgaggcccucuccuccccccagcccgccucccgcgcccccuccgaggagggcgagggccuccccgccgagucccccgacuccaacuucgccggccuccccgccggcgagcaggacgccgagggcaacgacgucaucgaggaggaggacggcucccccacccaggagggccagcgcaccugcgccuuccucggcauggagugcgacaacaacaacgacuucgacaucgccuccgucaaggcccucgacaacaagcucugcuccgaggucugccuccccggcgccuggcaggccgacgacaacgccgucucccgcaacgcccagcgccgccgccucuccuccuccucccucgaggacuccgagacccgccccugcgucuggggcccccucgccgucuga

SEQ ID NO: 48847 - RNA, 1053 nt, Artificial Sequence
  derived and/or modified sequence opt2 from RNF167__Homo_sapiens__NP_056343
augcaccccgccgccuucccccuccccgucgucgucgccgccguccucuggggcgccgcccccacccgcggccucauccgcgccaccuccgaccacaacgccuccauggacuucgccgaccuccccgcccucuucggcgccacccucucccaggagggccuccagggcuuccucgucgaggcccaccccgacaacgccugcucccccaucgccccccccccccccgcccccgucaacggcuccgucuucaucgcccuccuccgccgcuucgacugcaacuucgaccucaagguccucaacgcccagaaggccggcuacggcgccgccgucguccacaacgucaacuccaacgagcuccucaacauggucuggaacuccgaggagauccagcagcagaucuggauccccuccgucuucaucggcgagcgcuccuccgaguaccuccgcgcccucuucgucuacgagaagggcgcccgcguccuccucguccccgacaacaccuucccccucggcuacuaccucauccccuucaccggcaucgucggccuccucguccucgccaugggcgccgucaugaucgcccgcugcauccagcaccgcaagcgccuccagcgcaaccgccucaccaaggagcagcucaagcagauccccacccacgacuaccagaagggcgaccaguacgacgucugcgccaucugccucgacgaguacgaggacggcgacaagcuccgcguccuccccugcgcccacgccuaccacucccgcugcgucgaccccuggcucacccagacccgcaagaccugccccaucugcaagcagcccguccaccgcggccccggcgacgaggaccaggaggaggagacccagggccaggaggagggcgacgagggcgagccccgcgaccaccccgccuccgagcgcaccccccuccucggcuccucccccacccuccccaccuccuucggcucccucgcccccgccccccucgucuuccccggccccuccaccgaccccccccucuccccccccuccucccccgucauccucgucuga

SEQ ID NO: 48848 - RNA, 1716 nt, Artificial Sequence
  derived and/or modified sequence opt2 from RNF168__Homo_sapiens__NP_689830
auggcccuccccaaggacgccauccccucccucuccgagugccagugcggcaucugcauggagauccucgucgagcccgucacccuccccugcaaccacacccucugcaagcccugcuuccaguccaccgucgagaaggccucccucugcugccccuucugccgccgccgcgucuccuccuggacccgcuaccacacccgccgcaacucccucgucaacgucgagcucuggaccaucauccagaagcacuacccccgcgagugcaagcuccgcgccuccggccaggaguccgaggaggucgccgacgacuaccagcccguccgccuccucuccaagcccggcgagcuccgccgcgaguacgaggaggagaucuccaaggucgccgccgagcgccgcgccuccgaggaggaggagaacaaggccuccgaggaguacauccagcgccuccucgccgaggaggaggaggaggagaagcgccaggccgagaagcgccgccgcgccauggaggagcagcucaaguccgacgaggagcucgcccgcaagcucuccaucgacaucaacaacuucugcgagggcuccaucuccgccuccccccucaacucccgcaaguccgaccccgucacccccaaguccgagaagaaguccaagaacaagcagcgcaacaccggcgacauccagaaguaccucacccccaagucccaguucggcuccgccucccacuccgaggccguccaggagguccgcaaggacuccgucuccaaggacaucgacuccuccgaccgcaagucccccaccggccaggacaccgagaucgaggacaugcccacccucuccccccagaucucccucggcgucggcgagcagggcgccgacuccuccaucgagucccccaugcccuggcucugcgccugcggcgccgagugguaccacgagggcaacgucaagacccgccccuccaaccacggcaaggagcucugcguccucucccacgagcgccccaagacccgcguccccuacuccaaggagaccgccgucaugcccugcggccgcaccgaguccggcugcgcccccaccuccggcgucacccagaccaacggcaacaacaccggcgagaccgagaacgaggaguccugccuccucaucuccaaggagaucuccaagcgcaagaaccaggaguccuccuucgaggccgucaaggaccccugcuucuccgccaagcgccgcaaggucucccccgaguccucccccgaccaggaggagaccgagaucaacuucacccagaagcucaucgaccucgagcaccuccucuucgagcgccacaagcaggaggagcaggaccgccuccucgcccuccagcuccagaaggaggucgacaaggagcagaugguccccaaccgccagaagggcucccccgacgaguaccaccuccgcgccaccuccuccccccccgacaagguccucaacggccagcgcaagaaccccaaggacggcaacuucaagcgccagacccacaccaagcaccccacccccgagcgcggcucccgcgacaagaaccgccaggucucccucaagaugcagcucaagcaguccgucaaccgccgcaagaugcccaacuccacccgcgaccacugcaaggucuccaaguccgcccacucccuccagcccuccaucucccagaaguccgucuuccagauguuccagcgcugcaccaaguga

SEQ ID NO: 48849 - RNA, 777 nt, Artificial Sequence
  derived and/or modified sequence opt2 from RNF170__Homo_sapiens__NP_001153695
auggccaaguaccagggcgagguccagucccucaagcucgacgacgacuccgucaucgagggcgucuccgaccagguccucgucgccgucgucgucuccuucgcccucaucgccacccucgucuacgcccucuuccgcaacguccaccagaacauccaccccgagaaccaggagcucguccgcguccuccgcgagcagcuccagaccgagcaggacgcccccgccgccacccgccagcaguucuacaccgacauguacugccccaucugccuccaccaggccuccuuccccgucgagaccaacugcggccaccucuucugcggcgccugcaucaucgccuacuggcgcuacggcuccuggcucggcgccaucuccugccccaucugccgccagaccgucacccuccuccucaccgucuucggcgaggacgaccagucccaggacguccuccgccuccaccaggacaucaacgacuacaaccgccgcuucuccggccagccccgcuccaucauggagcgcaucauggaccuccccacccuccuccgccacgccuuccgcgagauguucuccgucggcggccucuucuggauguuccgcauccgcaucauccucugccucaugggcgccuucuucuaccucaucuccccccucgacuucguccccgaggcccucuucggcauccucggcuuccucgacgacuucuucgucaucuuccuccuccucaucuacaucuccaucauguaccgcgaggucaucacccagcgccucacccgcuga

SEQ ID NO: 48850 - RNA, 1779 nt, Artificial Sequence
  derived and/or modified sequence opt2 from RNF180__Homo_sapiens__NP_001107033
augaagcgcuccaaggagcucaucaccaagaaccacucccaggaggagaccuccauccuccgcugcuggaagugccgcaagugcaucgccuccuccggcugcuucauggaguaccucgagaaccaggucaucaaggacaaggacgacuccgucgacgcccagaacaucugccacgucuggcacaugaacgucgaggcccuccccgaguggaucuccugccucauccagaaggcccaguggaccgucggcaagcucaacugccccuucugcggcgcccgccucggcggcuucaacuucgucuccacccccaagugcuccugcggccagcucgccgccguccaccucuccaagucccgcaccgacuaccagcccacccaggccggccgccucaugcgccccuccgucaaguaccucucccacccccgcguccaguccggcugcgacaaggaggcccuccucaccggcggcggcuccgagaaccgcaaccaccgccuccucaacauggcccgcaacaacaacgaccccggccgccucaccgaggcccucugccucgagguccgccccaccuacuucgagaugaagaacgagaagcuccucuccaaggccuccgagcccaaguaccagcucuucgucccccagcucgucaccggccgcugcgccacccgcgccuuccaccgcaagucccacucccucgaccucaacaucuccgagaagcucacccuccuccccacccucuacgagauccacuccaagaccaccgccuacucccgccucaacgagacccagcccaucgaccucuccggccucccccuccaguccuccaagaacuccuacuccuuccagaaccccuccuccuucgaccccuccaugcuccuccagcgcuucuccgucgccccccacgagacccagacccagcgcggcggcgaguuccagugcggccucgaggccgccuccgucuacuccgaccacaccaacaccaacaaccucaccuuccucauggaccuccccuccgccggccgcuccaugcccgaggccuccgaccaggaggagcaccucuccccccucgacuuccuccacuccgccaacuucucccucggcuccaucaaccagcgccucaacaagcgcgagcgcuccaagcucaagaaccuccgccgcaagcagcgccgccgcgagcgcuggcuccagaagcagggcaaguacuccggcgucggccuccucgaccacaugacccucaacaacgagauguccaccgacgaggacaacgaguacgccgaggagaaggacuccuacaucugcgccgucugccucgacgucuacuucaaccccuacaugugcuaccccugccaccacaucuucugcgagcccugccuccgcacccucgccaaggacaaccccuccuccacccccugcccccucugccgcaccaucaucucccgcgucuucuuccagaccgagcucaacaacgccaccaagaccuucuucaccaaggaguaccucaagaucaagcaguccuuccagaaguccaacuccgccaaguggccccuccccuccugccgcaaggccuuccaccucuucggcggcuuccgccgccacgccgcccccgucacccgccgccaguucccccacggcgcccaccgcauggacuaccuccacuucgaggacgacucccgcggcuggugguucgacauggacauggucaucaucuacaucuacuccgucaacugggucaucggcuucaucgucuucugcuuccucugcuacuucuucuuccccuucuga

SEQ ID NO: 48851 - RNA, 744 nt, Artificial Sequence
  derived and/or modified sequence opt2 from RNF182__Homo_sapiens__NP_001158506
auggccucccagccccccgaggacaccgccgagucccaggccuccgacgagcucgagugcaagaucugcuacaaccgcuacaaccucaagcagcgcaagcccaagguccucgagugcugccaccgcgucugcgccaagugccucuacaagaucaucgacuucggcgacuccccccagggcgucaucgucugccccuucugccgcuucgagaccugccuccccgacgacgaggucuccucccuccccgacgacaacaacauccucgucaaccucaccugcggcggcaagggcaagaagugccuccccgagaaccccaccgagcuccuccucacccccaagcgccucgccucccucgucucccccucccacaccuccuccaacugccucgucaucaccaucauggagguccagcgcgaguccucccccucccucuccuccacccccgucgucgaguucuaccgccccgccuccuucgacuccgucaccaccgucucccacaacuggaccgucuggaacugcaccucccuccucuuccagaccuccauccgcguccucgucuggcuccucggccuccucuacuucuccucccucccccucggcaucuaccuccucgucuccaagaaggucacccucggcgucgucuucgucucccucguccccuccucccucgucauccucauggucuacggcuucugccagugcgucugccacgaguuccucgacugcauggccccccccuccuga

SEQ ID NO: 48852 - RNA, 2517 nt, Artificial Sequence
  derived and/or modified sequence opt2 from RNF19A__Homo_sapiens__XP_005250910
augcaggagcaggagaucggcuucaucuccaaguacaacgagggccucugcgucaacaccgaccccgucuccauccucaccuccauccucgacaugucccuccaccgccagaugggcuccgaccgcgaccuccaguccuccgccuccuccgucucccuccccuccgucaagaaggcccccaagaagcgccgcaucuccaucggcucccucuuccgccgcaagaaggacaacaagcgcaagucccgcgagcucaacggcggcgucgacggcaucgccuccaucgaguccauccacuccgagaugugcaccgacaagaacuccaucuucuccaccaacaccuccuccgacaacggccucaccuccaucuccaagcagaucggcgacuucaucgagugcccccucugccuccuccgccacuccaaggaccgcuuccccgacaucaugaccugccaccaccgcuccugcgucgacugccuccgccaguaccuccgcaucgagaucuccgagucccgcgucaacaucuccugccccgagugcaccgagcgcuucaacccccacgacauccgccucauccucuccgacgacguccucauggagaaguacgaggaguucaugcuccgccgcuggcucgucgccgaccccgacugccgcuggugccccgcccccgacugcggcuacgccgucaucgccuucggcugcgccuccugccccaagcucaccugcggccgcgagggcugcggcaccgaguucugcuaccacugcaagcagaucuggcaccccaaccagaccugcgacgccgcccgccaggagcgcgcccagucccuccgccuccgcaccauccgcuccuccuccaucuccuacucccaggaguccggcgccgccgccgacgacaucaagcccugcccccgcugcgccgccuacaucaucaagaugaacgacggcuccugcaaccacaugaccugcgccgucugcggcugcgaguucugcuggcucugcaugaaggagaucuccgaccuccacuaccucucccccuccggcugcaccuucuggggcaagaagcccuggucccgcaagaagaagauccucuggcagcucggcacccucgucggcgcccccgucggcaucgcccucaucgccggcaucgccauccccgccaugaucaucggcauccccgucuacgucggccgcaagauccacaaccgcuacgagggcaaggacgucuccaagcacaagcgcaaccucgccaucgccggcggcgucacccucuccgucaucgucucccccgucgucgccgccgucaccgucggcaucggcguccccaucaugcucgccuacgucuacggcgucguccccaucucccucugccgcuccggcggcugcggcgucuccgccggcaacggcaagggcguccgcaucgaguucgacgacgagaacgacaucaacgucggcggcaccaacaccgccgucgacaccaccuccgucgccgaggcccgccacaaccccuccaucggcgagggcuccgucggcggccucaccggcucccucuccgccuccggcucccacauggaccgcaucggcgccauccgcgacaaccucuccgagaccgccuccaccauggcccucgccggcgccuccaucaccggcucccucuccggcuccgccauggucaacugcuucaaccgccucgagguccaggccgacguccagaaggagcgcuacucccucuccggcgaguccggcaccgucucccucggcaccgucuccgacaacgccuccaccaaggccauggccggcuccauccucaacuccuacaucccccucgacaaggagggcaacuccauggagguccaggucgacaucgaguccaagcccuccaaguuccgccacaacuccggcuccuccuccgucgacgacggcuccgccacccgcucccacgccggcggcuccuccuccggccuccccgagggcaaguccuccgccaccaagugguccaaggaggccaccgccggcaagaaguccaaguccggcaagcuccgcaagaagggcaacaugaagaucaacgagacccgcgaggacauggacgcccagcuccucgagcagcaguccaccaacuccuccgaguucgaggcccccucccucuccgacuccaugcccuccgucgccgacucccacuccucccacuucuccgaguucuccugcuccgaccucgaguccaugaagaccuccugcucccacggcuccuccgacuaccacacccgcuucgccaccgucaacauccuccccgaggucgagaacgaccgccucgagaacuccccccaccagugcuccaucuccgucgucacccagaccgccuccugcuccgaggucucccagcucaaccacaucgccgaggagcacggcaacaacggcaucaagcccaacgucgaccucuacuucggcgacgcccucaaggagaccaacaacaaccacucccaccagaccauggagcucaaggucgccauccagaccgagaucuga

SEQ ID NO: 48853 - RNA, 2049 nt, Artificial Sequence
  derived and/or modified sequence opt2 from RNF207__Homo_sapiens__XP_011539741
augcccgaggaggccucccccgccggccaccccgaggacacccgccgcggcaucccccgcgucggcguccgccgcggccgccgcggccacggccgcggccgcccccgcgccgagugggagcccucccccggcgccggccucaacuuccagggccgccuccuccucggccgcgccaccgcccgcugccuccgcgcccgccccggcgccgcccuccgcgcccucgacggcggccgcgaggcccgccgcaccggcuccucccagcaguccggccccgccgacgucggcuccuaccuccgcgcccccggcggccccgagcuccccggcugccccgagcacccccccgccggcguccccgccgucccccgcgccguccgcgcccccgucuccuccggccucuucccccgccuccucugccgccuccccgccuggccccgcgaccgccgccccccccaccuccccgccguccccgacgucgagaccaccuacuucugcaacaccugcggccagccccucugcgcccgcugccgcgacgagacccaccgcgcccgcauguucgcccgccacgacaucgucgcccucggccagcgcucccgcgacgucccccagaagugcacccuccacgccgagcccuaccuccucuucuccaccgacaagaagcuccuccucugcauccgcugcuuccgcgacaugcagaaggagucccgcgcccacugcgucgaccucgaguccgccuacguccagggcugcgagcgccucgagcaggccguccucgccgucaaggcccuccagaccgccacccgcgaggccaucgcccuccuccaggccauggucgaggagguccgccacuccgccgccgaggaggaggacgccauccacgcccucuucggcuccaugcaggaccgccucgccgagcgcaaggcccuccuccuccaggccguccagucccaguacgaggagaaggacaaggccuucaaggagcagcucucccaccucgccacccuccuccccacccuccagguccaccucgucaucugcuccuccuuccucucccucgccaacaaggccgaguuccucgaccucggcuacgagcucauggagcgccuccagggcaucgucacccgcccccaccaccuccgccccauccaguccuccaagaucgccuccgaccaccgcgccgaguucgcccgcugccucgagccccuccuccuccucggcccccgccgcgucgccgccgccgccuccggcgccaacacccucgccggcggccucggccccaaggcccucaccggcccccacugccccucccccgucggcaagauguccggcucccccguccagaagcccacccuccaccgcuccaucuccaccaagguccuccucgccgagggcgagaacacccccuucgccgagcacugccgccacuacgaggacuccuaccgccaccuccaggccgagaugcagucccucaaggaccagguccaggagcuccaccgcgaccucaccaagcaccacucccucaucaaggccgagaucaugggcgacguccuccacaagucccuccagcucgacguccagaucgccuccgagcacgccucccucgagggcaugcgcgucgucuuccaggagaucugggaggaggccuaccagcgcgucgccaacgagcaggagaucuacgaggcccagcuccacgaccuccuccagcuccgccaggagaacgccuaccucaccaccaucaccaagcagaucacccccuacguccgcuccaucgccaaggucaaggagcgccucgagccccgcuuccaggcccccgucgacgagcaguccgagucccuccagaacacccacgacgacucccgcaacaacgccgccuccgcccgcaacaaccccggcuccguccccgagaagcgcgagaagaccuccgagcccaagggcaacuccugggcccccaacggccucuccgaggagccccuccucaagaacauggaccaccaccgcuccaagcagaagaacggcggcgacguccccaccuggcgcgagcaccccaccuga

SEQ ID NO: 48854 - RNA, 2928 nt, Artificial Sequence
  derived and/or modified sequence opt2 from RNF20__Homo_sapiens__NP_062538
auguccggcaucggcaacaagcgcgccgccggcgagcccggcaccuccaugccccccgagaagaaggccgccgucgaggacuccggcaccaccgucgagaccaucaagcucggcggcgucuccuccaccgaggagcucgacauccgcacccuccagaccaagaaccgcaagcucgccgagaugcucgaccagcgccaggccaucgaggacgagcuccgcgagcacaucgagaagcucgagcgccgccaggccaccgacgacgccucccuccucaucgucaaccgcuacuggucccaguucgacgagaacauccgcaucauccucaagcgcuacgaccucgagcagggccucggcgaccuccucaccgagcgcaaggcccucgucguccccgagcccgagcccgacuccgacuccaaccaggagcgcaaggacgaccgcgagcgcggcgagggccaggagcccgccuucuccuuccucgccacccucgccuccuccuccuccgaggagauggagucccagcuccaggagcgcgucgaguccucccgccgcgccgucucccagaucgucaccgucuacgacaagcuccaggagaaggucgagcuccucucccgcaagcucaacuccggcgacaaccucaucgucgaggaggccguccaggagcucaacuccuuccucgcccaggagaacaugcgccuccaggagcucaccgaccuccuccaggagaagcaccgcaccaugucccaggaguucuccaagcuccaguccaaggucgagaccgccgagucccgcgucuccguccucgaguccaugaucgacgaccuccagugggacaucgacaagauccgcaagcgcgagcagcgccucaaccgccaccucgccgagguccucgagcgcgucaacuccaagggcuacaaggucuacggcgccggcuccucccucuacggcggcaccaucaccaucaacgcccgcaaguucgaggagaugaacgccgagcucgaggagaacaaggagcucgcccagaaccgccucugcgagcucgagaagcuccgccaggacuucgaggaggucaccacccagaacgagaagcucaaggucgagcuccgcuccgccgucgagcaggucgucaaggagacccccgaguaccgcugcaugcagucccaguucuccguccucuacaacgagucccuccagcucaaggcccaccucgacgaggcccgcacccuccuccacggcacccgcggcacccaccagcaccaggucgagcucaucgagcgcgacgaggucucccuccacaagaagcuccgcaccgaggucauccagcucgaggacacccucgcccagguccgcaaggaguacgagaugcuccgcaucgaguucgagcagacccucgccgccaacgagcaggccggccccaucaaccgcgagaugcgccaccucaucuccucccuccagaaccacaaccaccagcucaagggcgagguccuccgcuacaagcgcaagcuccgcgaggcccaguccgaccucaacaagacccgccuccgcuccggcuccgcccuccuccagucccaguccuccaccgaggaccccaaggacgagcccgccgagcucaagcccgacuccgaggaccucuccucccaguccuccgccuccaaggccucccaggaggacgccaacgagaucaaguccaagcgcgacgaggaggagcgcgagcgcgagcgccgcgagaaggagcgcgagcgcgagcgcgagcgcgagaaggagaaggagcgcgagcgcgagaagcagaagcucaaggaguccgagaaggagcgcgacuccgccaaggacaaggagaagggcaagcacgacgacggccgcaagaaggaggccgagaucaucaagcagcucaagaucgagcucaagaaggcccaggagucccagaaggagaugaagcuccuccucgacauguaccgcuccgcccccaaggagcagcgcgacaagguccagcucauggccgccgagaagaaguccaaggccgagcucgaggaccuccgccagcgccucaaggaccucgaggacaaggagaagaaggagaacaagaagauggccgacgaggacgcccuccgcaagauccgcgccgucgaggagcagaucgaguaccuccagaagaagcucgccauggccaagcaggaggaggaggcccuccucuccgagauggacgucaccggccaggccuucgaggacaugcaggagcagaacauccgccucaugcagcagcuccgcgagaaggacgacgccaacuucaagcucauguccgagcgcaucaaguccaaccagauccacaagcuccucaaggaggagaaggaggagcucgccgaccagguccucacccucaagacccaggucgacgcccagcuccaggucguccgcaagcucgaggagaaggagcaccuccuccaguccaacaucggcaccggcgagaaggagcucggccuccgcacccaggcccucgagaugaacaagcgcaaggccauggaggccgcccagcucgccgacgaccucaaggcccagcucgagcucgcccagaagaagcuccacgacuuccaggacgagaucgucgagaacuccgucaccaaggagaaggacauguucaacuucaagcgcgcccaggaggacaucucccgccuccgccgcaagcucgagaccaccaagaagcccgacaacguccccaagugcgacgagauccucauggaggagaucaaggacuacaaggcccgccucaccugccccugcugcaacaugcgcaagaaggacgccguccucaccaagugcuuccacgucuucugcuucgagugcgucaagacccgcuacgacacccgccagcgcaagugccccaagugcaacgccgccuucggcgccaacgacuuccaccgcaucuacaucggcuga

SEQ ID NO: 48855 - RNA, 15624 nt, Artificial Sequence
  derived and/or modified sequence opt2 from RNF213__Homo_sapiens__NP_001243000
auggagugccccuccugccagcacgucuccaaggaggagacccccaaguucugcucccagugcggcgagcgccucccccccgccgcccccaucgccgacuccgagaacaacaacuccaccauggccuccgccuccgagggcgagauggagugcggccaggagcucaaggaggagggcggccccugccucuuccccggcuccgacuccuggcaggagaaccccgaggagcccugcuccaaggccuccuggaccguccaggaguccaagaagaagaagcgcaagaagaagaagaagggcaacaaguccgccuccuccgagcucgccucccucccccucucccccgccucccccugccaccucacccuccucuccaaccccuggccccaggacaccgcccucccccacucccaggcccagcaguccggccccaccggccagcccucccagccccccggcaccgccaccaccccccucgagggcgacggccucuccgcccccaccgaggucggcgacuccccccuccaggcccaggcccucggcgaggccggcgucgccaccggcuccgaggcccaguccuccccccaguuccaggaccacaccgagggcgaggaccaggacgccuccauccccuccggcggccgcggccucucccaggagggcaccggcccccccaccuccgccggcgagggccacucccgcaccgaggacgccgcccaggagcuccuccuccccgaguccaagggcggcuccuccgagcccggcaccgagcuccagaccaccgagcagcaggccggcgccuccgccuccauggccgucgacgccgucgccgagcccgccaacgccgucaagggcgccggcaaggagaugaaggagaagacccagcgcaugaagcagccccccgccaccaccccccccuucaagacccacugccaggaggccgagaccaagaccaaggacgagauggccgccgccgaggagaaggucggcaagaacgagcagggcgagcccgaggaccucaagaagcccgagggcaagaaccgcuccgccgccgccgucaagaacgagaaggagcagaagaaccaggaggccgacguccaggaggucaaggccuccacccucucccccggcggcggcgucaccgucuucuuccacgccaucaucucccuccacuuccccuucaaccccgaccuccacaaggucuucauccgcggcggcgaggaguucggcgaguccaagugggacuccaacaucugcgagcuccacuacacccgcgaccucggccacgaccgcguccucgucgagggcaucgucugcaucuccaagaagcaccucgacaaguacauccccuacaaguacgucaucuacaacggcgaguccuucgaguacgaguucaucuacaagcaccagcagaagaagggcgaguacgucaaccgcugccucuucaucaaguccucccuccucggcuccggcgacuggcaccaguacuacgacaucgucuacaugaagccccacggccgccuccagaaggucaugaaccacaucaccgacggcccccgcaaggaccucgucaagggcaagcagaucgccgccgcccucaugcucgacuccaccuucuccauccuccagaccugggacaccaucaaccucaacuccuucuucacccaguucgagcaguucugcuucguccuccagcagcccaugaucuacgagggccaggcccagcucuggaccgaccuccaguaccgcgagaaggaggucaagcgcuaccucuggcagcaccucaagaagcacgucgucccccuccccgacggcaaguccaccgacuuccuccccgucgacugccccguccgcuccaagcucaagaccggccucaucguccucuucgucgucgagaagaucgagcuccuccucgagggcucccucgacuggcucugccaccuccucaccuccgacgccuccucccccgacgaguuccaccgcgaccucucccacauccucggcaucccccaguccuggcgccucuaccucgucaaccucugccagcgcugcauggacacccgcaccuacaccuggcucggcgcccuccccguccuccacugcugcauggagcucgccccccgccacaaggacgccuggcgccagcccgaggacaccugggccgcccucgagggccucuccuucucccccuuccgcgagcagaugcucgacaccuccucccuccuccaguucaugcgcgagaagcagcaccuccucuccaucgacgagccccucuuccgcuccugguucucccuccucccccucucccaccucgucauguacauggagaacuucaucgagcaccucggccgcuuccccgcccacauccucgacugccucuccggcaucuacuaccgccuccccggccucgagcagguccucaacacccaggacguccaggacguccagaacguccagaacauccucgagaugcuccuccgccuccucgacaccuaccgcgacaagauccccgaggaggcccucucccccuccuaccucaccgucugccucaagcuccacgaggccaucugcuccuccaccaagcuccucaaguucuacgagcuccccgcccucuccgccgagaucgucugccgcaugauccgccuccucucccucgucgacuccgccggccagcgcgacgagaccggcaacaacuccguccagaccgucuuccagggcacccucgccgccaccaagcgcuggcuccgcgaggucuucaccaagaacaugcucaccuccuccggcgccuccuucaccuacgucaaggagaucgaggucuggcgccgccucgucgagauccaguuccccgccgagcacggcuggaaggagucccuccucggcgacauggaguggcgccucaccaaggaggagccccucucccagaucaccgccuacugcaacuccugcugggacaccaagggccucgaggacuccgucgccaagaccuucgagaagugcaucaucgaggccgucuccuccgccugccagucccagaccuccauccuccagggcuucuccuacuccgaccuccgcaaguucggcaucguccucuccgccgucaucaccaaguccuggccccgcaccgccgacaacuucgacgacauccucaagcaccuccucacccucgccgacgucaagcacgucuuccgccucugcggcaccgacgagaagauccucgccaacgucaccgaggacgccaagcgccucaucgccgucgccgacuccguccucaccaaggucgucggcgaccuccucuccggcaccauccucgucggccagcucgagcucaucaucaagcacaagaaccaguuccucgacaucuggcagcuccgcgagaagucccucuccccccaggacgagcagugcgccgucgaggaggcccucgacuggcgccgcgaggagcuccuccuccucaagaaggagaagcgcugcgucgacucccuccucaagaugugcggcaacgucaagcaccucauccaggucgacuucggcguccucgccguccgccacucccaggaccucuccuccaagcgccucaacgacaccgucaccguccgccucuccaccuccuccaacucccagcgcgccacccacuaccaccucuccucccagguccaggagauggccggcaagaucgaccuccuccgcgacucccacaucuuccagcucuucuggcgcgaggccgccgagccccucuccgagcccaaggaggaccaggaggccgccgagcuccucuccgagcccgaggaggaguccgagcgccacauccucgagcucgaggaggucuacgacuaccucuaccagcccuccuaccgcaaguucaucaagcuccaccaggaccucaaguccggcgaggucacccucgccgagaucgacgucaucuucaaggacuucgucaacaaguacaccgaccucgacuccgagcucaagaucaugugcaccgucgaccaccaggaccagcgcgacuggaucaaggaccgcgucgagcagaucaaggaguaccaccaccuccaccaggccguccacgccgccaaggucauccuccaggucaaggagucccucggccucaacggcgacuucuccguccucaacacccuccucaacuucaccgacaacuucgacgacuuccgccgcgagacccucgaccagaucaaccaggagcucauccaggccaagaagcuccuccaggacaucuccgaggcccgcugcaagggccuccaggcccucucccuccgcaaggaguucaucugcuggguccgcgaggcccucggcggcaucaacgagcucaaggucuucgucgaccucgccuccaucuccgccggcgagaacgacaucgacgucgaccgcgucgccugcuuccacgacgccguccagggcuacgccucccuccucuucaagcucgaccccuccgucgacuucuccgccuucaugaagcaccucaagaagcucuggaaggcccucgacaaggaccaguaccucccccgcaagcucugcgacuccgcccgcaaccucgaguggcucaagaccgucaacgagucccacggcuccgucgagcgcuccucccucacccucgccaccgccaucaaccagcgcggcaucuacgucauccaggcccccaagggcggccagaagaucucccccgacaccguccuccaccucauccuccccgagucccccggcucccacgaggagucccgcgaguacucccucgaggaggucaaggagcuccucaacaagcucaugcucauguccggcaagaaggaccgcaacaacaccgaggucgagcgcuucuccgaggucuucugcuccguccagcgccucucccaggccuucaucgaccuccacuccgccggcaacaugcucuuccgcaccuggaucgccauggccuacugcucccccaagcagggcgucucccuccagauggacuucggccucgaccucgucaccgagcucaaggagggcggcgacgucaccgagcuccucgccgcccucugccgccagauggagcacuuccucgacuccuggaagcgcuucgucacccagaagcgcauggagcacuucuaccucaacuucuacaccgccgagcagcucgucuaccucuccaccgagcuccgcaagcagccccccuccgacgccgcccucaccaugcucuccuucaucaaguccaacugcacccuccgcgacguccuccgcgccuccgucggcugcggcuccgaggccgcccgcuaccgcaugcgccgcgucauggaggagcucccccucaugcuccucuccgaguucucccucgucgacaagcuccgcaucaucauggagcaguccaugcgcugccuccccgccuuccuccccgacugccucgaccucgagacccucggccacugccucgcccaccucgccggcaugggcggcucccccgucgagcgcugccucccccgcggccuccaggucggccagcccaaccucgucgucugcggccacuccgagguccuccccgccgcccucgccgucuacaugcagacccccucccagccccuccccaccuacgacgagguccuccucugcacccccgccaccaccuucgaggaggucgcccuccuccuccgccgcugccucacccucggcucccucggccacaaggucuacucccuccucuucgccgaccagcucuccuacgaggucgcccgccaggccgaggagcucuuccacaaccucugcacccagcagcaccgcgaggacuaccagcucgucauggucugcgacggcgacugggagcacugcuaccuccccuccgccuucucccagcacaaggucuucgucaccccccaggccccccucgaggccauccaggccuaccucgccggccacuaccgcguccccaagcagacccucuccgccgccgccgucuucaacgaccgccucugcgucggcaucgucgccuccgagcgcgccggcgucggcaagucccucuacgucaagcgccuccacgacaagaugaagaugcagcucaacgucaagaacgucccccucaagaccauccgccucaucgacccccaggucgacgagucccgcguccucggcgcccuccuccccuuccucgacgcccaguaccagaagguccccguccucuuccaccucgacgucaccuccuccguccagaccggcaucugggucuuccucuucaagcuccucauccuccaguaccucauggacaucaacggcaagauguggcuccgcaaccccugccaccucuacaucgucgagauccucgagcgccgcaccuccguccccucccgcuccuccuccgcccuccgcacccgcgucccccaguucuccuuccucgacaucuuccccaaggucaccugccgcccccccaaggaggucaucgacauggagcucuccgcccuccgcuccgacaccgagcccggcauggaccucugggaguucugcuccgagaccuuccagcgccccuaccaguaccuccgccgcuucaaccagaaccaggaccucgacaccuuccaguaccaggagggcuccgucgagggcacccccgaggagugccuccagcacuuccucuuccacugcggcgucaucaaccccuccugguccgagcuccgcaacuucgcccgcuuccucaacuaccagcuccgcgacugcgaggccucccucuucugcaaccccuccuucaucggcgacacccuccgcggcuucaagaaguucgucgucaccuucaugaucuucauggcccgcgacuucgccacccccucccuccacaccuccgaccagucccccggcaagcacauggucaccauggacggcguccgcgaggaggaccucgcccccuucucccuccgcaagcgcugggaguccgagccccaccccuacgucuucuucaacgacgaccacaccaccaugaccuucaucggcuuccaccuccagcccaacaucaacggcuccgucgacgccaucucccaccucaccggcaaggucaucaagcgcgacgucaugacccgcgaccucuaccagggccuccuccuccagcgcguccccuucaacgucgacuucgacaagcucccccgccacaagaagcucgagcgccucugccucacccucggcaucccccaggccaccgaccccgacaagaccuacgagcucaccaccgacaacaugcucaagauccucgccaucgagaugcgcuuccgcugcggcauccccgucaucaucaugggcgagaccggcugcggcaagacccgccucaucaaguuccucuccgaccuccgccgcggcggcaccaacgccgacaccaucaagcucgucaagguccacggcggcaccaccgccgacaugaucuacucccgcguccgcgaggccgagaacgucgccuucgccaacaaggaccagcaccagcucgacaccauccucuucuucgacgaggccaacaccaccgaggccaucuccugcaucaaggagguccucugcgaccacauggucgacggccagccccucgccgaggacuccggccuccacaucaucgccgccugcaaccccuaccgcaagcacuccgaggagaugaucugccgccucgaguccgccggccucggcuaccgcgucuccauggaggagaccgccgaccgccucggcuccaucccccuccgccagcucgucuaccgcguccacgcccucccccccucccucaucccccucgucugggacuucggccagcucuccgacgucgccgagaagcucuacauccagcagaucguccagcgccucgucgaguccaucucccucgacgagaacggcacccgcgucaucaccgagguccucugcgccucccagggcuucaugcgcaagaccgaggacgagugcuccuucgucucccuccgcgacgucgagcgcugcgucaaggucuuccgcugguuccacgagcacuccgccaugcuccucgcccagcucaacgccuuccucuccaaguccuccgucuccaagaaccacaccgagcgcgaccccguccucuggucccucaugcucgccaucggcgucugcuaccacgccucccucgagaagaaggacuccuaccgcaaggccaucgcccgcuucuuccccaagcccuacgacgacucccgccuccuccucgacgagaucacccgcgcccaggaccucuuccucgacggcgucccccuccgcaagaccaucgccaagaaccucgcccucaaggagaacgucuucaugauggucgucugcaucgagcucaagaucccccucuuccucgucggcaagcccggcuccuccaagucccucgccaagaccaucgucgccgacgccaugcagggccccgccgccuacuccgaccucuuccgcucccucaagcagguccaccucgucuccuuccagugcuccccccacuccaccccccagggcaucaucuccaccuuccgccagugcgcccgcuuccagcagggcaaggaccuccagcaguacgucuccgucgucguccucgacgaggucggccucgccgaggacucccccaagaugccccucaagacccuccacccccuccucgaggacggcugcaucgaggacgaccccgccccccacaagaaggucggcuucgucggcaucuccaacugggcccucgaccccgccaagaugaaccgcggcaucuucgucucccgcggcucccccaacgagaccgagcucaucgaguccgccaagggcaucugcuccuccgacauccucguccaggaccgcguccagggcuacuucgccuccuucgccaaggccuacgagaccgucugcaagcgccaggacaaggaguucuucggccuccgcgacuacuacucccucaucaagauggucuucgccgccgccaaggccuccaaccgcaagcccuccccccaggacaucgcccaggccguccuccgcaacuucuccggcaaggacgacauccaggcccucgacaucuuccucgccaaccuccccgaggccaagugcuccgaggaggucucccccaugcagcucaucaagcagaacaucuucggccccucccagaagguccccggcggcgagcaggaggacgccgagucccgcuaccuccucguccucaccaagaacuacgucgcccuccagauccuccagcagaccuucuucgagggcgaccagcagcccgagaucaucuucggcuccggcuuccccaaggaccaggaguacacccagcucugccgcaacaucaaccgcgucaagaucugcauggagaccggcaagaugguccuccuccucaaccuccagaaccucuacgagucccucuacgacgcccucaaccaguacuacguccaccucggcggccagaaguacgucgaccucggccucggcacccaccgcgucaagugccgcguccaccccaacuuccgccucaucgucaucgaggagaaggacgucgucuacaagcacuuccccaucccccucaucaaccgccucgagaagcacuaccucgacaucaacaccguccucgagaaguggcagaaguccaucgucgaggagcucugcgccugggucgagaaguucaucaacgucaaggcccaccacuuccagaagcgccacaaguacucccccuccgacgucuucaucggcuaccacuccgacgccugcgccuccgucguccuccaggucaucgagcgccagggcccccgcgcccucaccgaggagcuccaccagaaggucuccgaggaggccaaguccauccuccucaacugcgccacccccgacgccgucguccgccucuccgccuacucccucggcggcuucgccgccgaguggcucucccaggaguacuuccaccgccagcgccacaacuccuucgccgacuuccuccaggcccaccuccacaccgccgaccucgagcgccacgccaucuucaccgagaucaccaccuucucccgccuccucaccucccacgacugcgagauccucgaguccgaggucaccggccgcgcccccaagcccacccuccucuggcuccagcaguucgacaccgaguacuccuuccucaaggagguccgcaacugccucaccaacaccgccaagugcaagauccucaucuuccagaccgacuucgaggacggcauccgcuccgcccagcucaucgccuccgccaaguacuccgucaucaacgagaucaacaagauccgcgagaacgaggaccgcaucuucgucuacuucaucaccaagcucucccgcgucggccgcggcaccgccuacgucggcuuccacggcggccucuggcaguccguccacaucgacgaccuccgccgcuccacccucauggucuccgacgucacccgccuccagcacgucaccaucucccagcucuucgcccccggcgaccuccccgagcucggccucgagcaccgcgccgaggacggccacgaggaggccauggagaccgaggccuccaccuccggcgaggucgccgaggucgccgaggaggccauggagaccgaguccuccgagaaggucggcaaggagaccuccgagcucggcggcuccgacgucuccauccucgacaccacccgccuccuccgcuccugcguccaguccgccgucggcaugcuccgcgaccagaacgaguccugcacccgcaacaugcgccgcgucguccuccuccucggccuccucaacgaggacgacgccugccacgccuccuuccuccgcgucuccaagaugcgccucuccgucuuccucaagaagcaggaggagucccaguuccacccccucgaguggcucgcccgcgaggccugcaaccaggacgcccuccaggaggccggcaccuuccgccacacccucuggaagcgcguccagggcgccgucaccccccuccucgccuccaugaucuccuucaucgaccgcgacggcaaccucgagcuccucacccgccccgacaccccccccugggcccgcgaccucuggauguucaucuucuccgacaccaugcuccucaacaucccccucgucaugaacaacgagcgccacaagggcgagauggccuacaucgucguccagaaccacaugaaccucuccgagaacgccuccaacaacguccccuucuccuggaagaucaaggacuaccucgaggagcucuggguccaggcccaguacaucaccgacgccgagggccuccccaagaaguucgucgacaucuuccagcagaccccccucggccgcuuccucgcccagcuccacggcgagccccagcaggagcuccuccagugcuaccucaaggacuucauccuccucaccaugcgcgucuccaccgaggaggagcucaaguuccuccagauggcccucugguccugcacccgcaagcucaaggccgccuccgaggcccccgaggaggaggucucccuccccuggguccaccucgccuaccagcgcuuccgcucccgccuccagaacuucucccgcauccucaccaucuacccccagguccuccacucccucauggaggcccgcuggaaccacgagcucgccggcugcgagaugacccucgacgccuucgccgccauggccugcaccgagaugcucacccgcaacacccucaagcccuccccccaggccuggcuccagcucgucaagaaccucuccaugccccucgagcucaucugcuccgacgagcacaugcagggcuccggcucccucgcccaggccgucauccgcgagguccgcgcccaguggucccgcaucuucuccaccgcccucuucgucgagcacguccuccucggcaccgagucccgcguccccgagcuccagggccucgucaccgagcacgucuuccuccucgacaagugccuccgcgagaacuccgacgucaagacccacggccccuucgaggccgucaugcgcacccucugcgagugcaaggagaccgccuccaagacccucucccgcuucggcauccagcccugcuccaucugccucggcgacgccaaggaccccgucugccuccccugcgaccacguccacugccuccgcugccuccgcgccugguucgccuccgagcagaugaucugccccuacugccucaccgcccuccccgacgaguucucccccgccgucucccaggcccaccgcgaggccaucgagaagcacgcccgcuuccgccagaugugcaacuccuucuucgucgaccucgucuccaccaucugcuucaaggacaacgccccccccgagaaggaggucaucgagucccuccucucccuccucuucguccagaagggccgccuccgcgacgccgcccagcgccacugcgagcacaccaagucccucucccccuucaacgacgucgucgacaagacccccgucauccgcuccgucauccucaagcuccuccucaaguacuccuuccacgacgucaaggacuacauccaggaguaccucacccuccucaagaagaaggccuucaucaccgaggacaagaccgagcucuacaugcucuucaucaacugccucgaggacuccauccucgagaagaccuccgccuacucccgcaacgacgagcucaaccaccucgaggaggagggccgcuuccucaaggccuacucccccgccucccgcggccgcgagcccgccaacgaggccuccgucgaguaccuccaggaggucgcccgcauccgccucugccucgaccgcgccgccgacuuccucuccgagcccgagggcggccccgagauggccaaggagaagcagugcuaccuccagcaggucaagcaguucugcauccgcgucgagaacgacuggcaccgcgucuaccucguccgcaagcucuccucccagcgcggcauggaguucguccagggccucuccaagcccggccgcccccaccagugggucuuccccaaggacgucgucaagcagcagggccuccgccaggaccaccccggccagauggaccgcuaccucgucuacggcgacgaguacaaggcccuccgcgacgccgucgccaaggccguccucgagugcaagccccucggcaucaagaccgcccucaaggccugcaagaccccccagucccagcaguccgccuacuuccuccucacccucuuccgcgaggucgccauccucuaccgcucccacaacgccucccuccaccccacccccgagcagugcgaggccgucuccaaguucaucggcgagugcaagauccucuccccccccgacaucucccgcuucgccaccucccucgucgacaacuccgucccccuccuccgcgccggccccuccgacuccaaccucgacggcaccgucaccgagauggccauccacgccgccgccguccuccucugcggccagaacgagcuccucgagccccucaagaaccucgccuucucccccgccaccauggcccacgccuuccuccccaccaugcccgaggaccuccucgcccaggcccgccgcuggaagggccucgagcgcguccacugguacaccugccccaacggccaccccugcuccgucggcgagugcggccgccccauggagcaguccaucugcaucgacugccacgcccccaucggcggcaucgaccacaagccccgcgacggcuuccaccucgucaaggacaaggccgaccgcacccagaccggccacguccucggcaacccccagcgccgcgacgucgucaccugcgaccgcggccucccccccgucgucuuccuccucauccgccuccucacccaccucgcccuccuccucggcgccucccaguccucccaggcccucaucaacaucaucaagccccccguccgcgaccccaagggcuuccuccagcagcacauccucaaggaccucgagcagcucgccaagaugcucggccacuccgccgacgagaccaucggcgucguccaccucguccuccgccgccuccuccaggagcagcaccagcucuccucccgccgccuccucaacuucgacaccgagcucuccaccaaggagaugcgcaacaacugggagaaggagaucgccgccgucaucucccccgagcucgagcaccucgacaagacccuccccaccaugaacaaccucaucucccaggacaagcgcaucuccuccaaccccgucgccaagaucaucuacggcgaccccgucaccuuccucccccaccucccccgcaaguccgucguccacugcuccaagaucugguccugccgcaagcgcaucaccgucgaguaccuccagcacaucgucgagcagaagaacggcaaggagcgcguccccauccucuggcacuuccuccagaaggaggccgagcuccgccucgucaaguuccuccccgagauccucgcccuccagcgcgaccucgucaagcaguuccagaacguccagcaggucgaguacuccuccauccgcggcuuccucuccaagcacuccuccgacggccuccgccagcuccuccacaaccgcaucaccgucuuccucuccaccuggaacaagcuccgccgcucccucgagaccaacggcgagaucaaccuccccaaggacuacugcuccaccgaccucgaccucgacaccgaguucgagauccuccucccccgccgccgcggccucggccucugcgccaccgcccucgucuccuaccucauccgccuccacaacgagaucgucuacgccgucgagaagcucuccaaggagaacaacuccuacuccgucgacgccgccgaggucaccgagcuccacgucaucuccuacgaggucgagcgcgaccucaccccccucauccucuccaacugccaguaccaggucgaggagggccgcgagaccguccaggaguucgaccucgagaagauccagcgccagaucgucucccgcuuccuccagggcaagccccgccucucccucaagggcauccccacccucgucuaccgccacgacuggaacuacgagcaccucuucauggacaucaagaacaagauggcccaggacucccuccccuccuccgucaucuccgccaucuccggccagcuccaguccuacuccgacgccugcgagguccucuccgucgucgaggucacccucggcuuccucuccaccgccggcggcgaccccaacaugcagcucaacgucuacacccaggacauccuccagaugggcgaccagaccauccacguccucaaggcccucaaccgcugccagcucaagcacaccaucgcccucuggcaguuccucuccgcccacaaguccgagcagcuccuccgccuccacaaggagcccuucggcgagaucuccucccgcuacaaggccgaccucucccccgagaacgccaagcuccucuccaccuuccucaaccagaccggccucgacgccuuccuccucgagcuccacgagaugaucauccucaagcucaagaacccccagacccagaccgaggagcgcuuccgcccccaguggucccuccgcgacacccucgucuccuacaugcagaccaaggaguccgagauccuccccgagauggccucccaguuccccgaggagauccuccucgccuccugcgucuccgucuggaagaccgccgccguccucaaguggaaccgcgagaugcgcuga

SEQ ID NO: 48856 - RNA, 2112 nt, Artificial Sequence
  derived and/or modified sequence opt2 from RNF214__Homo_sapiens__NP_997226
auggccgccuccgaggucgccggcgucgucgccaacgcccccuccccccccgaguccuccucccucugcgccuccaaguccgacgagggccuccccgacggccucuccaccaaggacuccgcccagaagcagaagaacuccccccuccucuccgucuccucccagaccaucaccaaggagaacaaccgcaacguccaccucgagcacuccgagcagaaccccggcuccuccgccggcgacaccuccgccgcccaccaggucguccucggcgagaaccucaucgccaccgcccucugccucuccggcuccggcucccaguccgaccucaaggacgucgccuccaccgccggcgaggagggcgacaccucccuccgcgagucccuccaccccgucacccgcucccucaaggccggcugccacaccaagcagcucgccucccgcaacugcuccgaggagaaguccccccagaccuccauccucaaggagggcaaccgcgacaccucccucgacuuccgccccgucgucucccccgccaacggcgucgagggcguccgcgucgaccaggacgacgaccaggacuccuccucccucaagcucucccagaacaucgccguccagaccgacuucaagaccgccgacuccgaggucaacaccgaccaggacaucgagaagaaccucgacaagaugaugaccgagcgcacccuccucaaggagcgcuaccaggagguccucgacaagcagcgccaggucgagaaccagcuccagguccagcucaagcagcuccagcagcgccgcgaggaggagaugaagaaccaccaggagauccucaaggccauccaggacgucaccaucaagcgcgaggagaccaagaagaagaucgagaaggagaagaaggaguuccuccagaaggagcaggaccucaaggccgagaucgagaagcucugcgagaagggccgccgcgaggucugggagauggagcucgaccgccucaagaaccaggacggcgagaucaaccgcaacaucauggaggagaccgagcgcgccuggaaggccgagauccucucccucgagucccgcaaggagcuccucguccucaagcucgaggaggccgagaaggaggccgagcuccaccucaccuaccucaaguccaccccccccacccucgagaccguccgcuccaagcaggagugggagacccgccucaacggcguccgcaucaugaagaagaacguccgcgaccaguucaacucccacauccagcucguccgcaacggcgccaagcucuccucccucccccagauccccacccccacccucccccccccccccuccgagaccgacuucaugcuccaggucuuccagcccucccccucccucgccccccgcaugcccuucuccaucggccaggucaccaugcccauggucaugcccuccgccgacccccgcucccucuccuuccccauccucaaccccgcccucucccagcccucccagcccuccuccccccuccccggcucccacggccgcaacucccccggccucggcucccucgucuccccccacggcccccacaugccccccgccgccuccaucccccccccccccggccucggcggcgucaaggccuccgccgagaccccccgcccccagcccgucgacaagcucgagaagauccucgagaagcuccucacccgcuucccccagugcaacaaggcccagaugaccaacauccuccagcagaucaagaccgcccgcaccaccauggccggccucaccauggaggagcucauccagcucgucgccgcccgccucgccgagcacgagcgcgucgccgccuccacccagccccucggccgcauccgcgcccucuuccccgccccccucgcccagaucuccacccccauguuccuccccuccgcccaggucuccuaccccggccgcuccucccacgcccccgccaccugcaagcucugccucaugugccagaagcucguccagcccuccgagcuccaccccauggccugcacccacguccuccacaaggagugcaucaaguucugggcccagaccaacaccaacgacaccugccccuucugccccacccucaaguga

SEQ ID NO: 48857 - RNA, 2601 nt, Artificial Sequence
  derived and/or modified sequence opt2 from RNF216__Homo_sapiens__NP_996999
auggaggagggcaacaacaacgaggaggucauccaccucaacaacuuccacugccaccgcggccaggaguggaucaaccuccgcgacggccccaucaccaucuccgacuccuccgacgaggagcgcauccccaugcucgucacccccgccccccagcagcacgaggaggaggaccucgacgacgacgucauccucaccgaggacgacuccgaggacgacuacggcgaguuccucgaccucggcccccccggcaucuccgaguucaccaagcccuccggccagaccgagcgcgagcccaagcccggccccucccacaaccaggccgccaacgacaucgucaacccccgcuccgagcagaaggucaucauccucgaggagggcucccuccucuacaccgaguccgacccccucgagacccagaaccaguccuccgaggacuccgagaccgagcuccucuccaaccucggcgaguccgccgcccucgccgacgaccaggccaucgaggaggacugcuggcucgaccaccccuacuuccagucccucaaccagcagccccgcgagaucaccaaccaggucgucccccaggagcgccagcccgaggccgagcucggccgccuccucuuccagcacgaguuccccggccccgccuucccccgccccgagccccagcagggcggcaucuccggccccuccuccccccagcccgcccacccccucggcgaguucgaggaccagcagcucgccuccgacgacgaggagcccggccccgccuuccccaugcaggagucccaggagcccaaccucgagaacaucuggggccaggaggccgccgaggucgaccaggagcucgucgagcuccucgucaaggagaccgaggcccgcuuccccgacgucgccaacggcuucaucgaggagaucauccacuucaagaacuacuacgaccucaacguccucugcaacuuccuccucgagaaccccgacuaccccaagcgcgaggaccgcaucaucaucaaccccuccuccucccuccucgccucccaggacgagaccaagcuccccaagaucgacuucuucgacuacuccaagcucaccccccucgaccagcgcugcuucauccaggccgccgaccuccucauggccgacuucaagguccucuccucccaggacaucaagugggcccuccacgagcucaagggccacuacgccaucacccgcaaggcccucuccgacgccaucaagaaguggcaggagcucucccccgagaccuccggcaagcgcaagaagcgcaagcagaugaaccaguacuccuacaucgacuucaaguucgagcagggcgacaucaagaucgagaagcgcauguucuuccucgagaacaagcgccgccacugccgcuccuacgaccgccgcgcccuccuccccgccguccagcaggagcaggaguucuacgagcagaagaucaaggagauggccgagcacgaggacuuccuccucgcccuccagaugaacgaggagcaguaccagaaggacggccagcucaucgagugccgcugcugcuacggcgaguuccccuucgaggagcucacccagugcgccgacgcccaccucuucugcaaggagugccucauccgcuacgcccaggaggccgucuucggcuccggcaagcucgagcucuccugcauggagggcuccugcaccugcuccuuccccaccuccgagcucgagaagguccucccccagaccauccucuacaaguacuacgagcgcaaggccgaggaggaggucgccgccgccuacgccgacgagcucguccgcugccccuccugcuccuuccccgcccuccucgacuccgacgucaagcgcuucuccugccccaacccccacugccgcaaggagaccugccgcaagugccagggccucuggaaggagcacaacggccucaccugcgaggagcucgccgagaaggacgacaucaaguaccgcaccuccaucgaggagaagaugaccgccgcccgcauccgcaagugccacaagugcggcaccggccucaucaaguccgagggcugcaaccgcauguccugccgcugcggcgcccagaugugcuaccucugccgcgucuccaucaacggcuacgaccacuucugccagcacccccgcucccccggcgcccccugccaggagugcucccgcugcucccucuggaccgaccccaccgaggacgacgagaagcucaucgaggagauccagaaggaggccgaggaggagcagaagcgcaagaacggcgagaacaccuucaagcgcaucggccccccccucgagaagcccgucgagaagguccagcgcgucgaggcccucccccgccccgucccccagaaccucccccagccccagaugccccccuacgccuucgcccacccccccuucccccucccccccguccgccccgucuucaacaacuucccccucaacaugggccccauccccgcccccuacguccccccccuccccaacguccgcgucaacuacgacuucggccccauccacaugccccucgagcacaaccuccccaugcacuucggcccccagccccgccaccgcuucuga

SEQ ID NO: 48858 - RNA, 447 nt, Artificial Sequence
  derived and/or modified sequence opt2 from RNF24__Homo_sapiens__NP_001127809
auguccuccgacuucccccacuacaacuuccgcaugcccaacaucggcuuccagaaccucccccucaacaucuacaucgucgucuucggcaccgccaucuucgucuucauccucucccuccucuucugcugcuaccucauccgccuccgccaccaggcccacaaggaguucuacgccuacaagcaggucauccucaaggagaaggucaaggagcucaaccuccacgagcucugcgccgucugccucgaggacuucaagccccgcgacgagcucggcaucugccccugcaagcacgccuuccaccgcaagugccucaucaaguggcucgagguccgcaaggucugcccccucugcaacaugcccguccuccagcucgcccagcuccacuccaagcaggaccgcggccccccccagggcccccuccccggcgccgagaacaucgucuga

SEQ ID NO: 48859 - RNA, 864 nt, Artificial Sequence
  derived and/or modified sequence opt2 from RNF2__Homo_sapiens__XP_005245470
augugccccaucugccucgacaugcucaagaacaccaugaccaccaaggagugccuccaccgcuucugcgccgacugcaucaucaccgcccuccgcuccggcaacaaggagugccccaccugccgcaagaagcucgucuccaagcgcucccuccgccccgaccccaacuucgacgcccucaucuccaagaucuaccccucccgcgacgaguacgaggcccaccaggagcgcguccucgcccgcaucaacaagcacaacaaccagcaggcccucucccacuccaucgaggagggccucaagauccaggccaugaaccgccuccagcgcggcaagaagcagcagaucgagaacggcuccggcgccgaggacaacggcgacuccucccacugcuccaacgccuccacccacuccaaccaggaggccggccccuccaacaagcgcaccaagaccuccgacgacuccggccucgagcucgacaacaacaacgccgccauggccaucgaccccgucauggacggcgccuccgagaucgagcucgucuuccgcccccaccccacccucauggagaaggacgacuccgcccagacccgcuacaucaagaccuccggcaacgccaccgucgaccaccucuccaaguaccucgccguccgccucgcccucgaggagcuccgcuccaagggcgaguccaaccagaugaaccucgacaccgccuccgagaagcaguacaccaucuacaucgccaccgccuccggccaguucaccguccucaacggcuccuucucccucgagcucgucuccgagaaguacuggaaggucaacaagcccauggagcucuacuacgcccccaccaaggagcacaaguga

SEQ ID NO: 48860 - RNA, 3219 nt, Artificial Sequence
  derived and/or modified sequence opt2 from RNF31__Homo_sapiens__NP_060469
augcccggcgaggaggaggagcgcgccuuccucgucgcccgcgaggagcucgccuccgcccuccgccgcgacuccggccaggccuucucccucgagcagcuccgcccccuccucgccuccucccucccccucgccgcccgcuaccuccagcucgacgccgcccgccucguccgcugcaacgcccacggcgagccccgcaacuaccucaacacccucuccaccgcccucaacauccucgagaaguacggccgcaaccuccucuccccccagcgcccccgcuacuggcgcggcgucaaguucaacaaccccgucuuccgcuccaccgucgacgccguccagggcggccgcgacguccuccgccucuacggcuacaccgaggagcagcccgacggccucuccuuccccgagggccaggaggagcccgacgagcaccaggucgccaccgucacccucgagguccuccuccuccgcaccgagcucucccuccuccuccagaacacccacccccgccagcaggcccucgagcagcuccucgaggacaaggucgaggacgacaugcuccagcucuccgaguucgacccccuccuccgcgagaucgcccccggcccccucaccacccccuccguccccggcuccacccccggccccugcuuccucugcggcuccgcccccggcacccuccacugccccuccugcaagcaggcccucugccccgccugcgaccaccucuuccacggccaccccucccgcgcccaccaccuccgccagacccuccccggcguccuccagggcacccaccucucccccucccuccccgccuccgcccagccccgcccccaguccaccucccuccucgcccucggcgacuccucccucuccucccccaaccccgccuccgcccaccuccccuggcacugcgccgccugcgccaugcucaacgagcccugggccguccucugcgucgccugcgaccgcccccgcggcugcaagggccucggccucggcaccgagggcccccagggcaccggcggccucgagcccgaccucgcccgcggccgcugggccugccaguccugcaccuucgagaacgaggccgccgccguccucugcuccaucugcgagcgcccccgccucgcccagccccccucccucgucgucgacucccgcgacgccggcaucugccuccagccccuccagcagggcgacgcccuccucgccuccgcccagucccaggucugguacugcauccacugcaccuucugcaacuccucccccggcugggucugcgucaugugcaaccgcaccuccucccccauccccgcccagcacgccccccgccccuacgccuccucccucgagaagggcccccccaagcccggccccccccgccgccucuccgccccccuccccuccuccugcggcgaccccgagaagcagcgccaggacaagaugcgcgaggagggccuccagcucgucuccaugauccgcgagggcgaggccgccggcgccugccccgaggagaucuucuccgcccuccaguacuccggcaccgaggucccccuccaguggcuccgcuccgagcuccccuacguccucgagauggucgccgagcucgccggccagcaggaccccggccucggcgccuucuccugccaggaggcccgccgcgccuggcucgaccgccacggcaaccucgacgaggccgucgaggagugcguccgcacccgccgccgcaagguccaggagcuccagucccucggcuucggccccgaggagggcucccuccaggcccucuuccagcacggcggcgacgucucccgcgcccucaccgagcuccagcgccagcgccucgagcccuuccgccagcgccucugggacuccggccccgagcccacccccuccugggacggccccgacaagcagucccucguccgccgccuccucgccgucuacgcccuccccuccuggggccgcgccgagcucgcccucucccuccuccaggagaccccccgcaacuacgagcucggcgacgucgucgaggccguccgccacucccaggaccgcgccuuccuccgccgccuccucgcccaggagugcgccgucugcggcugggcccucccccacaaccgcaugcaggcccucaccuccugcgagugcaccaucugccccgacugcuuccgccagcacuucaccaucgcccucaaggagaagcacaucaccgacauggucugccccgccugcggccgccccgaccucaccgacgacacccagcuccucuccuacuucuccacccucgacauccagcuccgcgagucccucgagcccgacgccuacgcccucuuccacaagaagcucaccgagggcguccucaugcgcgaccccaaguuccucuggugcgcccagugcuccuucggcuucaucuacgagcgcgagcagcucgaggccaccugcccccagugccaccagaccuucugcguccgcugcaagcgccagugggaggagcagcaccgcggccgcuccugcgaggacuuccagaacuggaagcgcaugaacgaccccgaguaccaggcccagggccucgccauguaccuccaggagaacggcaucgacugccccaagugcaaguucuccuacgcccucgcccgcggcggcugcaugcacuuccacugcacccagugccgccaccaguucugcuccggcugcuacaacgccuucuacgccaagaacaagugccccgagcccaacugccgcgucaagaagucccuccacggccaccacccccgcgacugccucuucuaccuccgcgacuggaccgcccuccgccuccagaagcuccuccaggacaacaacgucauguucaacaccgagccccccgccggcgcccgcgccguccccggcggcggcugccgcgucaucgagcagaaggagguccccaacggccuccgcgacgaggccugcggcaaggagacccccgccggcuacgccggccucugccaggcccacuacaaggaguaccucgucucccucaucaacgcccacucccucgaccccgccacccucuacgaggucgaggagcucgagaccgccaccgagcgcuaccuccacguccgcccccagccccucgccggcgaggacccccccgccuaccaggcccgccuccuccagaagcucaccgaggaggucccccucggccaguccaucccccgccgccgcaaguga

SEQ ID NO: 48861 - RNA, 1119 nt, Artificial Sequence
  derived and/or modified sequence opt2 from RNF34__Homo_sapiens__NP_079402
augaaggccggcgccaccuccaugugggccuccugcugcggccuccucaacgaggucaugggcaccggcgccguccgcggccagcaguccgccuucgccggcgccaccggccccuuccgcuucacccccaaccccgaguucuccaccuacccccccgccgccaccgagggccccaacaucgucugcaaggccugcggccucuccuucuccgucuuccgcaagaagcacgucugcugcgacugcaagaaggacuucugcuccgucugcuccguccuccaggagaaccuccgccgcugcuccaccugccaccuccuccaggagaccgccuuccagcgcccccagcucaugcgccucaaggucaaggaccuccgccaguaccucauccuccgcaacauccccaucgacaccugccgcgagaaggaggaccucgucgaccucguccucugccaccacggccucggcuccgaggacgacauggacaccuccucccucaacuccucccgcucccagaccuccuccuucuucacccgcuccuucuucuccaacuacaccgcccccuccgccaccauguccuccuuccagggcgagcucauggacggcgaccagaccucccgcuccggcguccccgcccagguccaguccgagaucaccuccgccaacaccgaggacgacgacgacgacgacgacgaggacgacgacgacgaggaggagaacgccgaggaccgcaaccccggccucuccaaggagcgcguccgcgccucccucuccgaccucuccucccucgacgacgucgagggcauguccguccgccagcucaaggagauccucgcccgcaacuucgucaacuacuccggcugcugcgagaagugggagcucgucgagaaggucaaccgccucuacaaggagaacgaggagaaccagaaguccuacggcgagcgccuccagcuccaggacgaggaggacgacucccucugccgcaucugcauggacgccgucaucgacugcguccuccucgagugcggccacauggucaccugcaccaagugcggcaagcgcauguccgagugccccaucugccgccaguacgucguccgcgccguccacgucuucaaguccuga

SEQ ID NO: 48862 - RNA, 1263 nt, Artificial Sequence
  derived and/or modified sequence opt2 from RNF39__Homo_sapiens__NP_079512
augugguggcgcgaccucacccgccuccgccucuggcucaagcgcgaggccauccccggcgagggccgcaaggccgccaaggucaacgccggcgucggcgagaagggcaucuacaccgccuccucccgcggcggcccccccuccgcccgcuccaaggccgucaccgucgucgccgagggcgccgccucccgcuccuggcucuccauggacgcccccgagcucggccccggccucgucgagcgccucgagcagcucgccaccugcccccucugcggcggcuccuucgaggaccccguccuccucgccugcgagcacuccuucugccgcgccugccucgcccgccgcuggggcaccccccccgccaccggcaccgaggccucccccaccgccugccccugcugcggccuccccugcccccgccgcucccuccgcuccaacguccgccucgccgucgagguccgcaucucccgcgagcuccgcgagaagcucgccgagcccggcgcccgcgccggccgccgccgcggcggccgcauccccaccaugggcugccucgaccuccccggcgaggacaugcgcaagaccuggcgccgcuucgagguccccaccuccaaguccuccaacuccgaggacgaccuccccgaggacuaccccgucgucaagaagaugcuccaccgccucaccgccgaccucacccucgaccccggcaccgcccaccgccgccuccucaucuccgccgaccgccgcuccguccagcucgccccccccggcacccccgccccccccgacggccccaagcgcuucgaccagcuccccgccguccucggcgcccagggcuucggcgccggccgccacugcugggaggucgagaccgccgacgccgccuccugccgcgacuccuccggcgaggacgccgacgacgaggagucccacuacgccgucggcgccgccggcgaguccguccagcgcaagggcugcguccgccucugccccgccggcgccgucugggccgucgagggccgcggcggccgccucugggcccucaccgcccccgagcccacccuccucggcggcgucgagccccccccccgccgcauccgcgucgaccucgacugggagcgcggccgcgucgccuucuacgacggccgcucccucgaccuccucuacgccuuccaggcccccggcccccucggcgagcgcaucuucccccucuucugcaccugcgacccccgcgccccccuccgcaucguccccgccgaguccuga

SEQ ID NO: 48863 - RNA, 2706 nt, Artificial Sequence
  derived and/or modified sequence opt2 from RNF40__Homo_sapiens__NP_001193963
auguccggccccggcaacaagcgcgccgccggcgacggcggcuccggcccccccgagaagaagcucucccgcgaggagaagaccaccaccacccucaucgagcccauccgccucggcggcaucuccuccaccgaggagauggaccucaagguccuccaguucaagaacaagaagcucgccgagcgccucgagcagcgccaggccugcgaggacgagcuccgcgagcgcaucgagaagcucgagaagcgccaggccaccgacgacgccacccuccucaucgucaaccgcuacugggcccagcucgacgagaccgucgaggcccuccuccgcugccacgagucccagggcgagcucuccuccgcccccgaggcccccggcacccaggagggccccaccugcgacggcaccccccuccccgagcccggcaccuccgagcuccgcgacccccuccucaugcagcuccgccccccccucuccgagcccgcccucgccuucgucgucgcccucggcgccuccuccuccgaggaggucgagcucgagcuccagggccgcauggaguucuccaaggccgccgucucccgcgucgucgaggccuccgaccgccuccagcgccgcgucgaggagcucugccagcgcgucuacucccgcggcgacuccgagccccucuccgaggccgcccaggcccacacccgcgagcucggccgcgagaaccgccgccuccaggaccucgccacccagcuccaggagaagcaccaccgcaucucccucgaguacuccgagcuccaggacaaggucaccuccgccgagaccaagguccucgagauggagaccaccgucgaggaccuccagugggacaucgagaagcuccgcaagcgcgagcagaagcucaacaagcaccucgccgaggcccucgagcagcucaacuccggcuacuacgucuccggcuccuccuccggcuuccagggcggccagaucacccucuccaugcagaaguccgacgagcucggccuccagaagaagcuccgcaccgaggucauccagcucgaggacacccucgcccagguccgcaaggaguacgagaugcuccgcaucgaguucgagcagaaccucgccgccaacgagcaggccggccccaucaaccgcgagaugcgccaccucaucuccucccuccagaaccacaaccaccagcucaagggcgacgcccagcgcuacaagcgcaagcuccgcgagguccaggccgagaucggcaagcuccgcgcccaggccuccggcuccgcccacuccacccccaaccucggccaccccgaggacuccggcgucuccgcccccgcccccggcaaggaggagggcggccccggccccgucuccacccccgacaaccgcaaggagauggcccccguccccggcaccaccaccaccaccaccuccgucaagaaggaggagcucguccccuccgaggaggacuuccagggcaucacccccggcgcccagggccccuccucccgcggccgcgagcccgaggcccgccccaagcgcgagcuccgcgagcgcgagggccccucccucggccccccccccgucgccuccgcccucucccgcgccgaccgcgagaaggccaaggucgaggagaccaagcgcaaggaguccgagcuccucaagggccuccgcgccgagcucaagaaggcccaggagucccagaaggagaugaagcuccuccucgacauguacaaguccgcccccaaggagcagcgcgacaagguccagcucauggccgccgagcgcaaggccaaggccgaggucgacgagcuccgcucccgcauccgcgagcucgaggagcgcgaccgccgcgaguccaagaagaucgccgacgaggacgcccuccgccgcauccgccaggccgaggagcagaucgagcaccuccagcgcaagcucggcgccaccaagcaggaggaggaggcccuccucuccgagauggacgucaccggccaggccuucgaggacaugcaggagcagaacggccgccuccuccagcagcuccgcgagaaggacgacgccaacuucaagcucauguccgagcgcaucaaggccaaccagauccacaagcuccuccgcgaggagaaggacgagcucggcgagcagguccucggccucaagucccaggucgacgcccagcuccucaccguccagaagcucgaggagaaggagcgcgcccuccagggcucccucggcggcgucgagaaggagcucacccuccgcucccaggcccucgagcucaacaagcgcaaggccgucgaggccgcccagcucgccgaggaccucaagguccagcucgagcacguccagacccgccuccgcgagauccagcccugccucgccgagucccgcgccgcccgcgagaaggaguccuucaaccucaagcgcgcccaggaggacaucucccgccuccgccgcaagcucgagaagcagcgcaaggucgaggucuacgccgacgccgacgagauccuccaggaggagaucaaggaguacaaggcccgccucaccugccccugcugcaacacccgcaagaaggacgccguccucaccaagugcuuccacgucuucugcuucgagugcguccgcggccgcuacgaggcccgccagcgcaagugccccaagugcaacgccgccuucggcgcccacgacuuccaccgcaucuacaucuccuga

SEQ ID NO: 48864 - RNA, 954 nt, Artificial Sequence
  derived and/or modified sequence opt2 from RNF41__Homo_sapiens__NP_001229755
augggcuacgacgucacccgcuuccagggcgacgucgacgaggaccucaucugccccaucugcuccggcguccucgaggagcccguccaggccccccacugcgagcacgccuucugcaacgccugcaucacccagugguucucccagcagcagaccugccccgucgaccgcuccgucgucaccgucgcccaccuccgccccgucccccgcaucaugcgcaacaugcucuccaagcuccagaucgccugcgacaacgccgucuucggcugcuccgccgucguccgccucgacaaccucaugucccaccucuccgacugcgagcacaaccccaagcgccccgucaccugcgagcagggcugcggccucgagaugcccaaggacgagcuccccaaccacaacugcaucaagcaccuccgcuccgucguccagcagcagcagacccgcaucgccgagcucgagaagaccuccgccgagcacaagcaccagcucgccgagcagaagcgcgacauccagcuccucaaggccuacaugcgcgccauccgcuccgucaaccccaaccuccagaaccucgaggagaccaucgaguacaacgagauccucgagugggucaacucccuccagcccgcccgcgucacccgcuggggcggcaugaucuccacccccgacgccguccuccaggccgucaucaagcgcucccucgucgaguccggcugccccgccuccaucgucaacgagcucaucgagaacgcccacgagcgcuccuggccccagggccucgccacccucgagacccgccagaugaaccgccgcuacuacgagaacuacgucgccaagcgcauccccggcaagcaggccgucgucgucauggccugcgagaaccagcacaugggcgacgacaugguccaggagcccggccucgucaugaucuucgcccacggcgucgaggagaucuga

SEQ ID NO: 48865 - RNA, 2352 nt, Artificial Sequence
  derived and/or modified sequence opt2 from RNF43__Homo_sapiens__NP_060233
auguccggcggccaccagcuccagcucgccgcccucuggcccuggcuccucauggccacccuccaggccggcuucggccgcaccggccucguccucgccgccgccgucgaguccgagcgcuccgccgagcagaaggccaucauccgcgucaucccccucaagauggaccccaccggcaagcucaaccucacccucgagggcgucuucgccggcgucgccgagaucacccccgccgagggcaagcucaugcagucccacccccucuaccucugcaacgccuccgacgacgacaaccucgagcccggcuucaucuccaucgucaagcucgaguccccccgccgcgccccccgccccugccucucccucgccuccaaggcccgcauggccggcgagcgcggcgccuccgccguccucuucgacaucaccgaggaccgcgccgccgccgagcagcuccagcagccccucggccucaccuggcccgucguccucaucuggggcaacgacgccgagaagcucauggaguucgucuacaagaaccagaaggcccacguccgcaucgagcucaaggagccccccgccuggcccgacuacgacgucuggauccucaugaccgucgucggcaccaucuucgucaucauccucgccuccguccuccgcauccgcugccgcccccgccacucccgccccgacccccuccagcagcgcaccgccugggccaucucccagcucgccacccgccgcuaccaggccuccugccgccaggcccgcggcgaguggcccgacuccggcuccuccugcuccuccgcccccgucugcgccaucugccucgaggaguucuccgagggccaggagcuccgcgucaucuccugccuccacgaguuccaccgcaacugcgucgaccccuggcuccaccagcaccgcaccugcccccucugcauguucaacaucaccgagggcgacuccuucucccagucccucggccccucccgcuccuaccaggagcccggccgccgccuccaccucauccgccagcaccccggccacgcccacuaccaccuccccgccgccuaccuccucggccccucccgcuccgccgucgcccgccccccccgccccggccccuuccuccccucccaggagcccggcaugggcccccgccaccaccgcuucccccgcgccgcccacccccgcgcccccggcgagcagcagcgccucgccggcgcccagcaccccuacgcccagggcuggggccucucccaccuccaguccaccucccagcaccccgccgccugccccgucccccuccgccgcgcccgcccccccgacuccuccggcuccggcgaguccuacugcaccgagcgcuccggcuaccucgccgacggccccgccuccgacuccuccuccggccccugccacggcuccuccuccgacuccgucgucaacugcaccgacaucucccuccagggcguccacggcuccuccuccaccuucugcuccucccucuccuccgacuucgacccccucgucuacugcucccccaagggcgacccccagcgcgucgacaugcagcccuccgucaccucccgcccccgcucccucgacuccgucguccccaccggcgagacccaggucuccucccacguccacuaccaccgccaccgccaccaccacuacaagaagcgcuuccaguggcacggccgcaagcccggccccgagaccggcgucccccagucccgcccccccaucccccgcacccagccccagcccgagccccccucccccgaccagcaggucacccgcuccaacuccgccgcccccuccggccgccucuccaacccccagugcccccgcgcccuccccgagcccgcccccggccccgucgacgccuccuccaucugccccuccaccuccucccucuucaaccuccagaaguccucccucuccgcccgccacccccagcgcaagcgccgcggcggccccuccgagcccacccccggcucccgcccccaggacgccaccguccaccccgccugccagaucuucccccacuacacccccuccgucgccuaccccuggucccccgaggcccacccccucaucugcggcccccccggccucgacaagcgccuccuccccgagacccccggccccugcuacuccaacucccagcccgucuggcucugccucaccccccgccagccccucgagccccacccccccggcgagggccccuccgagugguccuccgacaccgccgagggccgccccugccccuacccccacugccagguccucuccgcccagcccggcuccgaggaggagcucgaggagcucugcgagcaggccgucuga

SEQ ID NO: 48866 - RNA, 1056 nt, Artificial Sequence
  derived and/or modified sequence opt2 from RNF44__Homo_sapiens__XP_005265902
augcuccaccccgccacccagcagucccccuucauggucgaccuccacgagcagguccaccagggccccgucccccucuccuacaccgucaccaccgucaccacccagggcuucccccuccccaccggccagcacauccccggcugcuccgcccagcagcuccccgccugcuccgucauguucuccggccagcacuacccccucugcugccucccccccccccucauccaggccugcaccaugcagcagcuccccguccccuaccaggccuacccccaccucaucuccuccgaccacuacauccuccacccccccccccccgccccccccccccagcccacccacauggccccccucggccaguucgucucccuccagacccagcacccccgcaugccccuccagcgccucgacaacgacgucgaccuccgcggcgaccagcccucccucggcuccuucaccuacuccaccuccgcccccggccccgcccucucccccuccgucccccuccacuaccucccccacgacccccuccaccaggagcucuccuucggcguccccuacucccacaugaugccccgccgccucuccacccagcgcuaccgccuccagcagccccuccccccccccccccccccccccccccccccccccuacuaccccuccuuccuccccuacuuccucuccaugcuccccaugucccccaccgccaugggccccaccaucucccucgaccucgacgucgacgacgucgagauggagaacuacgaggcccuccucaaccucgccgagcgccucggcgacgccaagccccgcggccucaccaaggccgacaucgagcagcuccccuccuaccgcuucaaccccgacucccaccaguccgagcagacccucugcgucgucugcuucuccgacuucgaggcccgccagcuccuccgcguccuccccugcaaccacgaguuccacaccaagugcgucgacaaguggcucaaggccaaccgcaccugccccaucugccgcgccgacgccuccgaggucccccgcgaggccgaguga

SEQ ID NO: 48867 - RNA, 342 nt, Artificial Sequence
  derived and/or modified sequence opt2 from RNF4__Homo_sapiens__NP_001171939
auguccacccgcaagcgccgcggcggcgccaucaacucccgccaggcccagaagcgcacccgcgaggccaccuccacccccgagaucucccucgaggccgagcccaucgagcucgucgagaccgccggcgacgagaucgucgaccucaccugcgagucccucgagcccgucgucgucgaccucacccacaacgacuccgucgucaucgucgacggcccccagguccucuccgucguccccuccgccuggaccgacacccagcgcuccugccgcauggacgucuccuccuucccccagaacgccgccauguccuccgucgccuccgccuccgucauccccuga

SEQ ID NO: 48868 - RNA, 543 nt, Artificial Sequence
  derived and/or modified sequence opt2 from RNF5__Homo_sapiens__NP_008844
auggccgccgccgaggaggaggacggcggccccgagggccccaaccgcgagcgcggcggcgccggcgccaccuucgagugcaacaucugccucgagaccgcccgcgaggccgucgucuccgucugcggccaccucuacugcuggcccugccuccaccaguggcucgagacccgccccgagcgccaggagugccccgucugcaaggccggcaucucccgcgagaaggucgucccccucuacggccgcggcucccagaagccccaggacccccgccucaagacccccccccgcccccagggccagcgccccgcccccgagucccgcggcggcuuccagcccuucggcgacaccggcggcuuccacuucuccuucggcgucggcgccuuccccuucggcuucuucaccaccgucuucaacgcccacgagcccuuccgccgcggcaccggcgucgaccucggccagggccaccccgccuccuccuggcaggacucccucuuccucuuccucgccaucuucuucuucuucuggcuccucuccaucuga

SEQ ID NO: 48869 - RNA, 2058 nt, Artificial Sequence
  derived and/or modified sequence opt2 from RNF6__Homo_sapiens__NP_005968
augaaccagucccgcucccgcuccgacggcggcuccgaggagacccucccccaggaccacaaccaccacgagaacgagcgccgcuggcagcaggagcgccuccaccgcgaggaggccuacuaccaguucaucaacgagcucaacgacgaggacuaccgccucaugcgcgaccacaaccuccucggcacccccggcgagaucaccuccgaggagcuccagcagcgccucgacggcgucaaggagcagcucgccucccagcccgaccuccgcgacggcaccaacuaccgcgacuccgaggucccccgcgaguccucccacgaggacucccuccucgaguggcucaacaccuuccgccgcaccggcaacgccacccgcuccggccagaacggcaaccagaccuggcgcgccgucucccgcaccaaccccaacaacggcgaguuccgcuucucccucgagauccacgucaaccacgagaaccgcggcuucgagauccacggcgaggacuacaccgacaucccccucuccgacuccaaccgcgaccacaccgccaaccgccagcagcgcuccaccucccccgucgcccgccgcacccgcucccagaccuccgucaacuucaacggcuccuccuccaacaucccccgcacccgccucgccucccgcggccagaaccccgccgagggcuccuucuccacccucggccgccuccgcaacggcaucggcggcgccgccggcaucccccgcgccaacgccucccgcaccaacuucuccucccacaccaaccaguccggcggcuccgagcuccgccagcgcgagggccagcgcuucggcgccgcccacgucugggagaacggcgcccgcuccaacgucaccguccgcaacaccaaccagcgccucgagcccauccgccuccgcuccaccuccaacucccgcucccgcucccccauccagcgccaguccggcaccgucuaccacaacucccagcgcgagucccgccccguccagcagaccacccgccgcuccguccgccgccgcggccgcacccgcgucuuccucgagcaggaccgcgagcgcgagcgccgcggcaccgccuacacccccuucuccaacucccgccucgucucccgcaucaccgucgaggagggcgaggaguccucccgcuccuccaccgccguccgccgccaccccaccaucacccucgaccuccagguccgccgcauccgccccggcgagaaccgcgaccgcgacuccaucgccaaccgcacccgcucccgcgucggccucgccgagaacaccgucaccaucgaguccaacuccggcggcuuccgccgcaccaucucccgccucgagcgcuccggcauccgcaccuacgucuccaccaucaccgucccccuccgccgcaucuccgagaacgagcucgucgagcccuccuccgucgcccuccgcuccauccuccgccagaucaugaccggcuucggcgagcucuccucccucauggaggccgacuccgaguccgagcuccagcgcaacggccagcaccuccccgacaugcacuccgagcucuccaaccucggcaccgacaacaaccgcucccagcaccgcgagggcuccucccaggaccgccaggcccagggcgacuccaccgagaugcacggcgagaacgagaccacccagccccacacccgcaacuccgacucccgcggcggccgccagcuccgcaaccccaacaaccucgucgagaccggcacccuccccauccuccgccucgcccacuucuuccuccucaacgaguccgacgacgacgaccgcauccgcggccucaccaaggagcagaucgacaaccucuccacccgccacuacgagcacaacuccaucgacuccgagcucggcaagaucugcuccgucugcaucuccgacuacgucaccggcaacaagcuccgccagcuccccugcaugcacgaguuccacauccacugcaucgaccgcuggcucuccgagaacugcaccugccccaucugccgccagcccguccucggcuccaacaucgccaacaacggcuga

SEQ ID NO: 48870 - RNA, 294 nt, Artificial Sequence
  derived and/or modified sequence opt2 from RNF7__Homo_sapiens__NP_001188299
auggccgacgucgaggacggcgaggagaccugcgcccucgccucccacuccggcuccuccggcuccaaguccggcggcgacaagauguucucccucaagaaguggaacgccgucgccaugugguccugggacgucgagugcgacaccugcgccaucugccgcguccaggucauggucgucuggggcgagugcaaccacuccuuccacaacugcugcaugucccucugggucaagcagaacaaccgcugcccccucugccagcaggacugggucguccagcgcaucggcaaguga

SEQ ID NO: 48871 - RNA, 1458 nt, Artificial Sequence
  derived and/or modified sequence opt2 from RNF8__Homo_sapiens__NP_003949
augggcgagcccggcuucuucgucaccggcgaccgcgccggcggccgcuccuggugccuccgccgcgucggcauguccgccggcuggcuccuccucgaggacggcugcgaggucaccgucggccgcggcuucggcgucaccuaccagcucgucuccaagaucugcccccucaugaucucccgcaaccacugcguccucaagcagaaccccgagggccaguggaccaucauggacaacaagucccucaacggcgucuggcucaaccgcgcccgccucgagccccuccgcgucuacuccauccaccagggcgacuacauccagcucggcgucccccucgagaacaaggagaacgccgaguacgaguacgaggucaccgaggaggacugggagaccaucuaccccugccucucccccaagaacgaccagaugaucgagaagaacaaggagcuccgcaccaagcgcaaguucucccucgacgagcucgccggccccggcgccgagggccccuccaaccucaaguccaagaucaacaaggucuccugcgaguccggccagcccgucaagucccagggcaagggcgaggucgccuccacccccuccgacaaccucgaccccaagcucaccgcccucgagcccuccaagaccaccggcgcccccaucuaccccggcuuccccaaggucaccgagguccaccacgagcagaaggccuccaacuccuccgccucccagcgcucccuccagauguucaaggucaccaugucccgcauccuccgccucaagauccagaugcaggagaagcacgaggccgucaugaacgucaagaagcagacccagaagggcaacuccaagaaggucguccagauggagcaggagcuccaggaccuccagucccagcucugcgccgagcaggcccagcagcaggcccgcgucgagcagcucgagaagaccuuccaggaggaggagcagcaccuccagggccucgagaucgcccagggcgagaaggaccucaagcagcagcucgcccaggcccuccaggagcacugggcccucauggaggagcucaaccgcuccaagaaggacuucgaggccaucauccaggccaagaacaaggagcucgagcagaccaaggaggagaaggagaagaugcaggcccagaaggaggagguccucucccacaugaacgacguccucgagaacgagcuccagugcaucaucugcuccgaguacuucaucgaggccgucacccucaacugcgcccacuccuucugcuccuacugcaucaacgaguggaugaagcgcaagaucgagugccccaucugccgcaaggacaucaaguccaagaccuacucccucguccucgacaacugcaucaacaagauggucaacaaccucuccuccgaggucaaggagcgccgcaucguccucauccgcgagcgcaaggccaagcgccucuucuga

SEQ ID NO: 48872 - RNA, 1725 nt, Artificial Sequence
  derived and/or modified sequence opt2 from RNGTT__Homo_sapiens__NP_001273355
auggcccacaacaagauccccccccgcuggcucaacugcccccgccgcggccagcccgucgccggccgcuuccucccccucaagaccaugcucggcccccgcuacgacucccaggucgccgaggagaaccgcuuccaccccuccaugcucuccaacuaccucaagucccucaaggucaagaugggccuccucgucgaccucaccaacaccucccgcuucuacgaccgcaacgacaucgagaaggagggcaucaaguacaucaagcuccagugcaagggccacggcgagugccccaccaccgagaacaccgagaccuucauccgccucugcgagcgcuucaacgagcgcaacccccccgagcucaucggcguccacugcacccacggcuucaaccgcaccggcuuccucaucugcgccuuccucgucgagaagauggacugguccaucgaggccgccgucgccaccuucgcccaggcccgcccccccggcaucuacaagggcgacuaccucaaggagcucuuccgccgcuacggcgacaucgaggaggcccccccccccccccuccuccccgacuggugcuucgaggacgacgaggacgaggacgaggacgaggacggcaagaaggaguccgagcccggcuccuccgccuccuucggcaagcgccgcaaggagcgccucaagcucggcgccaucuuccucgagggcgucaccgucaagggcgucacccaggucaccacccagcccaagcucggcgagguccagcagaagugccaccaguucugcggcugggagggcuccggcuuccccggcgcccagcccgucuccauggacaagcagaacaucaagcuccucgaccucaagcccuacaaggucuccuggaaggccgacggcacccgcuacaugaugcucaucgacggcaccaacgaggucuucaugaucgaccgcgacaacuccgucuuccacgucuccaaccucgaguuccccuuccgcaaggaccuccgcaugcaccucuccaacacccuccucgacggcgagaugaucaucgaccgcgucaacggccaggccgucccccgcuaccucaucuacgacaucaucaaguucaacucccagcccgucggcgacugcgacuucaacguccgccuccagugcaucgagcgcgagaucaucuccccccgccacgagaagaugaagaccggccucaucgacaagacccaggagcccuucuccguccgcaacaagcccuucuucgacaucugcaccucccgcaagaaguacaagcccggccgcugcgacgacauccucaaguggaagccccccucccucaacuccgucgacuuccgccucaagaucacccgcaugggcggcgagggccuccucccccagaacgucggccuccucuacgucggcggcuacgagcgccccuucgcccagaucaaggucaccaaggagcucaagcaguacgacaacaagaucaucgagugcaaguucgagaacaacuccugggucuucaugcgccagcgcaccgacaaguccuuccccaacgccuacaacaccgccauggccgucugcaacuccaucuccaaccccgucaccaaggagaugcucuucgaguucaucgaccgcugcaccgccgccucccagggccagaagcgcaagcaccaccucgaccccgacaccgagcucaugcccccccccccccccaagcgcccccgcccccucaccuga

SEQ ID NO: 48873 - RNA, 1386 nt, Artificial Sequence
  derived and/or modified sequence opt2 from RNH1__Homo_sapiens__XP_011518565
augucccucgacauccagucccucgacauccagugcgaggagcucuccgacgcccgcugggccgagcuccucccccuccuccagcagugccaggucguccgccucgacgacugcggccucaccgaggcccgcugcaaggacaucuccuccgcccuccgcgucaaccccgcccucgccgagcucaaccuccgcuccaacgagcucggcgacgucggcguccacugcguccuccagggccuccagacccccuccugcaagauccagaagcucucccuccagaacugcugccucaccggcgccggcugcggcguccucuccuccacccuccgcacccuccccacccuccaggagcuccaccucuccgacaaccuccucggcgacgccggccuccagcuccucugcgagggccuccucgacccccagugccgccucgagaagcuccagcucgaguacugcucccucuccgccgccuccugcgagccccucgccuccguccuccgcgccaagcccgacuucaaggagcucaccgucuccaacaacgacaucaacgaggccggcguccgcguccucugccagggccucaaggacucccccugccagcucgaggcccucaagcucgaguccugcggcgucaccuccgacaacugccgcgaccucugcggcaucgucgccuccaaggccucccuccgcgagcucgcccucggcuccaacaagcucggcgacgucggcauggccgagcucugccccggccuccuccaccccuccucccgccuccgcacccucuggaucugggagugcggcaucaccgccaagggcugcggcgaccucugccgcguccuccgcgccaaggagucccucaaggagcucucccucgccggcaacgagcucggcgacgagggcgcccgccuccucugcgagacccuccucgagcccggcugccagcucgagucccucugggucaaguccugcuccuucaccgccgccugcugcucccacuucuccuccguccucgcccagaaccgcuuccuccucgagcuccagaucuccaacaaccgccucgaggacgccggcguccgcgagcucugccagggccucggccagcccggcuccguccuccgcguccucuggcucgccgacugcgacgucuccgacuccuccugcuccucccucgccgccacccuccucgccaaccacucccuccgcgagcucgaccucuccaacaacugccucggcgacgccggcauccuccagcucgucgaguccguccgccagcccggcugccuccucgagcagcucguccucuacgacaucuacugguccgaggagauggaggaccgccuccaggcccucgagaaggacaagcccucccuccgcgucaucuccuga

SEQ ID NO: 48874 - RNA, 1029 nt, Artificial Sequence
  derived and/or modified sequence opt2 from RNLS__Homo_sapiens__NP_001026879
auggcccagguccucaucgucggcgccggcaugaccggcucccucugcgccgcccuccuccgccgccagaccuccggcccccucuaccucgccgucugggacaaggccgaggacuccggcggccgcaugaccaccgccugcuccccccacaacccccagugcaccgccgaccucggcgcccaguacaucaccugcaccccccacuacgccaagaagcaccagcgcuucuacgacgagcuccucgccuacggcguccuccgcccccucuccucccccaucgagggcauggucaugaaggagggcgacugcaacuucgucgccccccagggcaucuccuccaucaucaagcacuaccucaaggaguccggcgccgaggucuacuuccgccaccgcgucacccagaucaaccuccgcgacgacaagugggaggucuccaagcagaccggcucccccgagcaguucgaccucaucguccucaccaugcccguccccgagauccuccagcuccagggcgacaucaccacccucaucuccgagugccagcgccagcagcucgaggccgucuccuacuccucccgcuacgcccucggccucuucuacgaggccggcaccaagaucgacguccccugggccggccaguacaucaccuccaaccccugcauccgcuucgucuccaucgacaacaagaagcgcaacaucgaguccuccgagaucggccccucccucgucauccacaccaccguccccuucggcgucaccuaccucgagcacuccaucgaggacguccaggagcucgucuuccagcagcucgagaacauccuccccggccucccccagcccaucgccaccaagugccagaaguggcgccacucccaggucaccaacgccgccgccaacugccccggccagaugacccuccaccacaagcccuuccucgccugcggcggcgacggcuucacccaguccaacuucgacggcugcaucaccuccgcccucugcguccucgaggcccucaagaacuacaucuga

SEQ ID NO: 48875 - RNA, 1431 nt, Artificial Sequence
  derived and/or modified sequence opt2 from RNMT__Homo_sapiens__NP_003790
auggccaacuccgccaaggccgaggaguacgagaagaugucccucgagcaggccaaggccuccgucaacuccgagaccgaguccuccuucaacaucaacgagaacaccaccgccuccggcaccggccucuccgagaagaccuccgucugccgccaggucgacaucgcccgcaagcgcaaggaguucgaggacgaccucgucaaggaguccuccuccugcggcaaggacacccccuccaagaagcgcaagcucgaccccgagaucguccccgaggagaaggacugcggcgacgccgagggcaacuccaagaagcgcaagcgcgagaccgaggacguccccaaggacaaguccuccaccggcgacggcacccagaacaagcgcaagaucgcccucgaggacguccccgagaagcagaagaaccucgaggagggccacuccuccaccgucgccgcccacuacaacgagcuccaggaggucggccucgagaagcgcucccagucccgcaucuucuaccuccgcaacuucaacaacuggaugaaguccguccucaucggcgaguuccucgagaagguccgccagaagaagaagcgcgacaucaccguccucgaccucggcugcggcaagggcggcgaccuccucaaguggaagaagggccgcaucaacaagcucgucugcaccgacaucgccgacgucuccgucaagcagugccagcagcgcuacgaggacaugaagaaccgccgcgacuccgaguacaucuucuccgccgaguucaucaccgccgacuccuccaaggagcuccucaucgacaaguuccgcgacccccagaugugcuucgacaucugcuccugccaguucgucugccacuacuccuucgaguccuacgagcaggccgacaugaugcuccgcaacgccugcgagcgccucucccccggcggcuacuucaucggcaccacccccaacuccuucgagcucauccgccgccucgaggccuccgagaccgaguccuucggcaacgagaucuacaccgucaaguuccagaagaagggcgacuacccccucuucggcugcaaguacgacuucaaccucgagggcgucgucgacguccccgaguuccucgucuacuucccccuccucaacgagauggccaagaaguacaacaugaagcucgucuacaagaagaccuuccucgaguucuacgaggagaagaucaagaacaacgagaacaagaugcuccucaagcgcaugcaggcccucgagcccuaccccgccaacgaguccuccaagcucgucuccgagaaggucgacgacuacgagcacgccgccaaguacaugaagaacucccagguccgccucccccucggcacccucuccaaguccgagugggaggccaccuccaucuaccucgucuucgccuucgagaagcagcaguga

SEQ ID NO: 48876 - RNA, 1953 nt, Artificial Sequence
  derived and/or modified sequence opt2 from RNPEP__Homo_sapiens__NP_064601
auggccuccggcgagcacucccccggcuccggcgccgcccgccgcccccuccacuccgcccaggccgucgacgucgccuccgccuccaacuuccgcgccuucgagcuccuccaccuccaccucgaccuccgcgccgaguucggcccccccggccccggcgccggcucccgcggccucuccggcaccgccguccucgaccuccgcugccucgagcccgagggcgccgccgagcuccgccucgacucccaccccugccucgaggucaccgccgccgcccuccgccgcgagcgccccggcuccgaggagccccccgccgagcccgucuccuucuacacccagcccuucucccacuacggccaggcccucugcgucuccuucccccagcccugccgcgccgccgagcgccuccagguccuccucaccuaccgcgucggcgagggccccggcgucugcuggcucgcccccgagcagaccgccggcaagaagaagcccuucgucuacacccagggccaggccguccucaaccgcgccuucuuccccugcuucgacacccccgccgucaaguacaaguacuccgcccucaucgagguccccgacggcuucaccgccgucauguccgccuccaccugggagaagcgcggccccaacaaguucuucuuccagaugugccagcccauccccuccuaccucaucgcccucgccaucggcgaccucgucuccgccgaggucggcccccgcucccgcgucugggccgagcccugccucaucgacgccgccaaggaggaguacaacggcgucaucgaggaguuccucgccaccggcgagaagcucuucggccccuacgucuggggccgcuacgaccuccucuucaugccccccuccuuccccuucggcggcauggagaaccccugccucaccuucgucacccccugccuccucgccggcgaccgcucccucgccgacgucaucauccacgagaucucccacuccugguucggcaaccucgucaccaacgccaacuggggcgaguucuggcucaacgagggcuucaccauguacgcccagcgccgcaucuccaccauccucuucggcgccgccuacaccugccucgaggccgccaccggccgcgcccuccuccgccagcacauggacaucaccggcgaggagaacccccucaacaagcuccgcgucaagaucgagcccggcgucgaccccgacgacaccuacaacgagacccccuacgagaagggcuucugcuucgucuccuaccucgcccaccucgucggcgaccaggaccaguucgacuccuuccucaaggccuacguccacgaguucaaguuccgcuccauccucgccgacgacuuccucgacuucuaccucgaguacuuccccgagcucaagaagaagcgcgucgacaucauccccggcuucgaguucgaccgcuggcucaacacccccggcuggccccccuaccuccccgaccucucccccggcgacucccucaugaagcccgccgaggagcucgcccagcucugggccgccgaggagcucgacaugaaggccaucgaggccgucgccaucucccccuggaagaccuaccagcucgucuacuuccucgacaagauccuccagaaguccccccucccccccggcaacgucaagaagcucggcgacaccuaccccuccaucuccaacgcccgcaacgccgagcuccgccuccgcuggggccagaucguccucaagaacgaccaccaggaggacuucuggaaggucaaggaguuccuccacaaccagggcaagcagaaguacacccucccccucuaccacgccaugaugggcggcuccgaggucgcccagacccucgccaaggagaccuucgccuccaccgccucccagcuccacuccaacgucgucaacuacguccagcagaucgucgcccccaagggcuccuga

SEQ ID NO: 48877 - RNA, 2178 nt, Artificial Sequence
  derived and/or modified sequence opt2 from RNPEPL1__Homo_sapiens__NP_060696
auggccgcccagugcugcugccgccaggcccccggcgccgaggccgcccccguccgccccccccccgagcccccccccgcccucgacgucgccuccgccuccuccgcccagcucuuccgccuccgccaccuccagcucggccucgagcuccgccccgaggcccgcgagcucgccggcugccucguccucgagcucugcgcccuccgccccgccccccgcgcccucguccucgacgcccaccccgcccuccgccuccacuccgccgccuuccgccgcgcccccgccgccgccgccgagacccccugcgccuucgccuucuccgcccccggccccggccccgcccccccccccccccuccccgccuuccccgaggcccccggcuccgagcccgccugcugcccccucgccuuccgcgucgaccccuucaccgacuacggcuccucccucaccgucacccucccccccgagcuccaggcccaccagcccuuccaggucauccuccgcuacaccuccaccgacgcccccgccaucugguggcucgaccccgagcucaccuacggcugcgccaagcccuucgucuucacccagggccacuccgucugcaaccgcuccuucuuccccugcuucgacacccccgccgucaagugcaccuacuccgccgucgucaaggcccccuccggcguccagguccucauguccgccacccgcuccgccuacauggaggaggagggcgucuuccacuuccacauggagcaccccguccccgccuaccucgucgcccucgucgccggcgaccucaagcccgccgacaucggcccccgcucccgcgucugggccgagcccugccuccuccccaccgccaccuccaagcucuccggcgccgucgagcaguggcucuccgccgccgagcgccucuacggccccuacauguggggccgcuacgacaucgucuuccucccccccuccuuccccaucgucgccauggagaaccccugccucaccuucaucaucuccuccauccucgaguccgacgaguuccucgucaucgacgucauccacgaggucgcccacuccugguucggcaacgccgucaccaacgccaccugggaggagauguggcucuccgagggccucgccaccuacgcccagcgccgcaucaccaccgagaccuacggcgccgccuucaccugccucgagaccgccuuccgccucgacgcccuccaccgccagaugaagcuccucggcgaggacucccccgucuccaagcuccaggucaagcucgagcccggcgucaaccccucccaccucaugaaccucuucaccuacgagaagggcuacugcuucgucuacuaccucucccagcucugcggcgacccccagcgcuucgacgacuuccuccgcgccuacgucgagaaguacaaguucaccuccgucgucgcccaggaccuccucgacuccuuccucuccuucuuccccgagcucaaggagcaguccgucgacugccgcgccggccucgaguucgagcgcuggcucaacgccaccggccccccccucgccgagcccgaccucucccagggcuccucccucacccgccccgucgaggcccucuuccagcucuggaccgccgagccccucgaccaggccgccgccuccgccuccgccaucgacaucuccaaguggcgcaccuuccagaccgcccucuuccucgaccgccuccucgacggcuccccccucccccaggaggucgucaugucccucuccaagugcuacuccucccuccucgacuccaugaacgccgagauccgcauccgcuggcuccagaucgucguccgcaacgacuacuaccccgaccuccaccgcguccgccgcuuccucgagucccagaugucccgcauguacaccaucccccucuacgaggaccucugcaccggcgcccucaaguccuucgcccucgaggucuucuaccagacccagggccgccuccaccccaaccuccgccgcgccauccagcagauccucucccagggccucggcuccuccaccgagcccgccuccgagcccuccaccgagcucggcaaggccgaggccgacaccgacuccgacgcccaggcccuccuccucggcgacgaggcccccuccuccgccaucucccuccgcgacgucaacgucuccgccuga

SEQ ID NO: 48878 - RNA, 849 nt, Artificial Sequence
  derived and/or modified sequence opt2 from RNPS1__Homo_sapiens__NP_001273555
auggcccccucccccaccaagcgcaaggaccgcuccgacgagaaguccaaggaccgcuccaaggacaagggcgccaccaaggaguccuccgagaaggaccgcggccgcgacaagacccgcaagcgccgcuccgccuccuccggcuccuccuccacccgcucccgcuccuccuccaccuccuccuccggcuccuccaccuccaccggcuccuccuccggcuccuccuccuccuccgccuccucccgcuccggcuccuccuccaccucccgcuccuccuccuccuccuccuccuccggcucccccucccccucccgccgccgccacgacaaccgccgccgcucccgcuccaaguccaagccccccaagcgcgacgagaaggagcgcaagcgccgcucccccucccccaagcccaccaagguccacaucggccgccucacccgcaacgucaccaaggaccacaucauggagaucuucuccaccuacggcaagaucaagaugaucgacaugcccgucgagcgcaugcacccccaccucuccaagggcuacgccuacgucgaguucgagaaccccgacgaggccgagaaggcccucaagcacauggacggcggccagaucgacggccaggagaucaccgccaccgccguccucgcccccuggccccgcccccccccccgccgcuucucccccccccgccgcaugcucccccccccccccauguggcgccgcucccccccccgcaugcgccgccgcucccgcuccccccgccgccgcucccccguccgccgccgcucccgcucccccggccgccgccgccaccgcucccgcuccuccuccaacuccucccgcuga

SEQ ID NO: 48879 - RNA, 4656 nt, Artificial Sequence
  derived and/or modified sequence opt2 from ROBO1__Homo_sapiens__NP_001139317
augaucgccgagcccgcccacuucuaccucuucggccucaucugccucugcuccggcucccgccuccgccaggaggacuuccccccccgcaucgucgagcaccccuccgaccucaucgucuccaagggcgagcccgccacccucaacugcaaggccgagggccgccccacccccaccaucgagugguacaagggcggcgagcgcgucgagaccgacaaggacgacccccgcucccaccgcaugcuccuccccuccggcucccucuucuuccuccgcaucguccacggccgcaagucccgccccgacgagggcgucuacgucugcgucgcccgcaacuaccucggcgaggccgucucccacaacgccucccucgaggucgccauccuccgcgacgacuuccgccagaaccccuccgacgucauggucgccgucggcgagcccgccgucauggagugccagcccccccgcggccaccccgagcccaccaucuccuggaagaaggacggcuccccccucgacgacaaggacgagcgcaucaccauccgcggcggcaagcucaugaucaccuacacccgcaaguccgacgccggcaaguacgucugcgucggcaccaacauggucggcgagcgcgaguccgaggucgccgagcucaccguccucgagcgccccuccuucgucaagcgccccuccaaccucgccgucaccgucgacgacuccgccgaguucaagugcgaggcccgcggcgaccccguccccaccguccgcuggcgcaaggacgacggcgagcuccccaagucccgcuacgagauccgcgacgaccacacccucaagauccgcaaggucaccgccggcgacaugggcuccuacaccugcgucgccgagaacauggucggcaaggccgaggccuccgccacccucaccguccaggucggcuccgagcccccccacuucgucgucaagccccgcgaccaggucgucgcccucggccgcaccgucaccuuccagugcgaggccaccggcaacccccagcccgccaucuucuggcgccgcgagggcucccagaaccuccucuucuccuaccagcccccccaguccuccucccgcuucuccgucucccagaccggcgaccucaccaucaccaacguccagcgcuccgacgucggcuacuacaucugccagacccucaacgucgccggcuccaucaucaccaaggccuaccucgaggucaccgacgucaucgccgaccgccccccccccgucauccgccagggccccgucaaccagaccgucgccgucgacggcaccuucguccucuccugcgucgccaccggcucccccguccccaccauccucuggcgcaaggacggcguccucgucuccacccaggacucccgcaucaagcagcucgagaacggcguccuccagauccgcuacgccaagcucggcgacaccggccgcuacaccugcaucgccuccacccccuccggcgaggccaccugguccgccuacaucgagguccaggaguucggcguccccguccagcccccccgccccaccgaccccaaccucauccccuccgcccccuccaagcccgaggucaccgacgucucccgcaacaccgucacccucuccuggcagcccaaccucaacuccggcgccacccccaccuccuacaucaucgaggccuucucccacgccuccggcuccuccuggcagaccgucgccgagaacgucaagaccgagaccuccgccaucaagggccucaagcccaacgccaucuaccucuuccucguccgcgccgccaacgccuacggcaucuccgaccccucccagaucuccgaccccgucaagacccaggacguccuccccaccucccagggcgucgaccacaagcagguccagcgcgagcucggcaacgccguccuccaccuccacaaccccaccguccucuccuccuccuccaucgagguccacuggaccgucgaccagcagucccaguacauccagggcuacaagauccucuaccgccccuccggcgccaaccacggcgaguccgacuggcucgucuucgagguccgcacccccgccaagaacuccgucgucauccccgaccuccgcaagggcgucaacuacgagaucaaggcccgccccuucuucaacgaguuccagggcgccgacuccgagaucaaguucgccaagacccucgaggaggcccccuccgcccccccccagggcgucaccgucuccaagaacgacggcaacggcaccgccauccucgucuccuggcagcccccccccgaggacacccagaacggcaugguccaggaguacaaggucuggugccucggcaacgagacccgcuaccacaucaacaagaccgucgacggcuccaccuucuccgucgucauccccuuccucguccccggcauccgcuacuccgucgaggucgccgccuccaccggcgccggcuccggcgucaaguccgagccccaguucauccagcucgacgcccacggcaaccccgucucccccgaggaccaggucucccucgcccagcagaucuccgacgucgucaagcagcccgccuucaucgccggcaucggcgccgccugcuggaucauccucauggucuucuccaucuggcucuaccgccaccgcaagaagcgcaacggccucaccuccaccuacgccggcauccgcaaggucaccuaccagcgcggcggcgaggccgucuccuccggcggccgccccggccuccucaacaucuccgagcccgccgcccagcccuggcucgccgacaccuggcccaacaccggcaacaaccacaacgacugcuccaucuccugcugcaccgccggcaacggcaacuccgacuccaaccucaccaccuacucccgccccggccagcccacccccuacgccaccacccagcucauccaguccaaccucuccaacaacaugaacaacggcuccggcgacuccggcgagaagcacuggaagccccucggccagcagaagcaggaggucgcccccguccaguacaacaucgucgagcagaacaagcucaacaaggacuaccgcgccaacgacaccgucccccccaccauccccuacaaccaguccuacgaccagaacaccggcggcuccuacaacuccuccgaccgcggcuccuccaccuccggcucccagggccacaagaagggcgcccgcacccccaagguccccaagcagggcggcaugaacugggccgaccuccucccccccccccccgcccacccccccccccacuccaacuccgaggaguacaacaucuccgucgacgaguccuacgaccaggagaugcccugccccgucccccccgcccgcauguaccuccagcaggacgagcucgaggaggaggaggacgagcgcggccccaccccccccguccgcggcgccgccuccucccccgccgccgucuccuacucccaccaguccaccgccacccucacccccuccccccaggaggagcuccagcccaugcuccaggacugccccgaggagaccggccacaugcagcaccagcccgaccgccgccgccagcccgucuccccccccccccccccccgccccaucucccccccccacaccuacggcuacaucuccggcccccucgucuccgacauggacaccgacgcccccgaggaggaggaggacgaggccgacauggaggucgccaagaugcagacccgccgccuccuccuccgcggccucgagcagacccccgccuccuccgucggcgaccucgaguccuccgucaccggcuccaugaucaacggcuggggcuccgccuccgaggaggacaacaucuccuccggccgcuccuccgucuccuccuccgacggcuccuucuucaccgacgccgacuucgcccaggccgucgccgccgccgccgaguacgccggccucaaggucgcccgccgccagaugcaggacgccgccggccgccgccacuuccacgccucccagugcccccgccccaccucccccgucuccaccgacuccaacauguccgccgccgucaugcagaagacccgccccgccaagaagcucaagcaccagcccggccaccuccgccgcgagaccuacaccgacgaccucccccccccccccguccccccccccgccaucaagucccccaccgcccaguccaagacccagcucgagguccgccccgucgucguccccaagcuccccuccauggacgcccgcaccgaccgcuccuccgaccgcaagggcuccuccuacaagggccgcgagguccucgacggccgccaggucgucgacaugcgcaccaaccccggcgacccccgcgaggcccaggagcagcagaacgacggcaagggccgcggcaacaaggccgccaagcgcgaccucccccccgccaagacccaccucauccaggaggacauccuccccuacugccgccccaccuuccccaccuccaacaacccccgcgaccccuccuccuccuccuccauguccucccgcggcuccggcucccgccagcgcgagcaggccaacgucggccgccgcaacaucgccgagaugcagguccucggcggcuacgagcgcggcgaggacaacaacgaggagcucgaggagaccgaguccuga

SEQ ID NO: 48880 - RNA, 4185 nt, Artificial Sequence
  derived and/or modified sequence opt2 from ROBO2__Homo_sapiens__NP_001122401
auggcccgccgccacgagcgcgucacccgccgcauguggaccugggcccccggccuccucaugaugaccgucgucuucuggggccaccagggcaacggccagggccagggcucccgccuccgccaggaggacuuccccccccgcaucgucgagcaccccuccgacgucaucgucuccaagggcgagcccaccacccucaacugcaaggccgagggccgccccacccccaccaucgagugguacaaggacggcgagcgcgucgagaccgacaaggacgacccccgcucccaccgcaugcuccuccccuccggcucccucuucuuccuccgcaucguccacggccgccgcuccaagcccgacgagggcuccuacgucugcgucgcccgcaacuaccucggcgaggccgucucccgcaacgccucccucgaggucgcccuccuccgcgacgacuuccgccagaaccccaccgacgucgucgucgccgccggcgagcccgccauccucgagugccagcccccccgcggccaccccgagcccaccaucuacuggaagaaggacaagguccgcaucgacgacaaggaggagcgcaucuccauccgcggcggcaagcucaugaucuccaacacccgcaaguccgacgccggcauguacaccugcgucggcaccaacauggucggcgagcgcgacuccgaccccgccgagcucaccgucuucgagcgccccaccuuccuccgccgccccaucaaccaggucguccucgaggaggaggccgucgaguuccgcugccagguccagggcgacccccagcccaccguccgcuggaagaaggacgacgccgaccucccccgcggccgcuacgacaucaaggacgacuacacccuccgcaucaagaagaccauguccaccgacgagggcaccuacaugugcaucgccgagaaccgcgucggcaagauggaggccuccgccacccucaccguccgcgcccccccccaguucgucguccgcccccgcgaccagaucgucgcccagggccgcaccgucaccuuccccugcgagaccaagggcaacccccagcccgccgucuucuggcagaaggagggcucccagaaccuccucuuccccaaccagccccagcagcccaacucccgcugcuccgucucccccaccggcgaccucaccaucaccaacauccagcgcuccgacgccggcuacuacaucugccaggcccucaccgucgccggcuccauccucgccaaggcccagcucgaggucaccgacguccucaccgaccgccccccccccaucauccuccagggccccgccaaccagacccucgccgucgacggcaccgcccuccucaagugcaaggccaccggcgacccccuccccgucaucuccuggcucaaggagggcuucaccuuccccggccgcgacccccgcgccaccauccaggagcagggcacccuccagaucaagaaccuccgcaucuccgacaccggcaccuacaccugcgucgccaccuccuccuccggcgagaccuccugguccgccguccucgacgucaccgaguccggcgccaccaucuccaagaacuacgaccucuccgaccuccccggcccccccuccaagccccaggucaccgacgucaccaagaacuccgucacccucuccuggcagcccggcacccccggcacccuccccgccuccgccuacaucaucgaggccuucucccaguccgucuccaacuccuggcagaccgucgccaaccacgucaagaccacccucuacaccguccgcggccuccgccccaacaccaucuaccucuucaugguccgcgccaucaacccccagggccucuccgaccccucccccauguccgaccccguccgcacccaggacaucuccccccccgcccagggcgucgaccaccgccagguccagaaggagcucggcgacguccucguccgccuccacaaccccgucguccucacccccaccaccguccaggucaccuggaccgucgaccgccagccccaguucauccagggcuaccgcgucauguaccgccagaccuccggccuccaggccaccuccuccuggcagaaccucgacgccaagguccccaccgagcgcuccgccguccucgucaaccucaagaagggcgucaccuacgagaucaagguccgccccuacuucaacgaguuccagggcauggacuccgaguccaagaccguccgcaccaccgaggaggcccccuccgcccccccccaguccgucaccguccucaccgucggcuccuacaacuccaccuccaucuccgucuccugggacccccccccccccgaccaccagaacggcaucauccaggaguacaagaucuggugccucggcaacgagacccgcuuccacaucaacaagaccgucgacgccgccauccgcuccgucaucaucggcggccucuuccccggcauccaguaccgcgucgaggucgccgccuccaccuccgccggcgucggcgucaaguccgagccccagcccaucaucaucggccgccgcaacgaggucgucaucaccgagaacaacaacuccaucaccgagcagaucaccgacgucgucaagcagcccgccuucaucgccggcaucggcggcgccugcugggucauccucaugggcuucuccaucuggcucuacuggcgccgcaagaagcgcaagggccucuccaacuacgccgucaccuuccagcgcggcgacggcggccucauguccaacggcucccgccccggccuccucaacgccggcgaccccuccuaccccuggcucgccgacuccuggcccgccaccucccuccccgucaacaacuccaacuccggccccaacgagaucggcaacuucggccgcggcgacguccucccccccguccccggccagggcgacaagaccgccaccaugcucuccgacggcgccaucuacuccuccaucgacuucaccaccaagaccuccuacaacuccuccucccagaucacccaggccacccccuacgccaccacccagauccuccacuccaacuccauccacgagcucgccgucgaccuccccgacccccaguggaaguccuccauccagcagaagaccgaccucaugggcuucggcuacucccuccccgaccagaacaagggcaacaacggcggcaagggcggcaagaagaagaagaacaagaacuccuccaagccccagaagaacaacggcuccaccugggccaacgucccccucccccccccccccguccagccccuccccggcaccgagcucgagcacuacgccgucgagcagcaggagaacggcuacgacuccgacuccuggugccccccccuccccguccagaccuaccuccaccagggccucgaggacgagcucgaggaggacgacgaccgcguccccaccccccccguccgcggcgucgccuccucccccgccaucuccuucggccagcaguccaccgccacccucacccccuccccccgcgaggagaugcagcccaugcuccaggcccaccucgacgagcucacccgcgccuaccaguucgacaucgccaagcagaccuggcacauccaguccaacaaccagcccccccagccccccguccccccccucggcuacgucuccggcgcccucaucuccgaccucgagaccgacgucgccgacgacgacgccgacgacgaggaggaggcccucgagaucccccgcccccuccgcgcccucgaccagacccccggcuccuccauggacaaccucgacuccuccgucaccggcaaggccuucaccuccucccagcgcccccgccccaccucccccuucuccaccgacuccaacaccuccgccgcccucucccagucccagcgcccccgccccaccaagaagcacaagggcggccgcauggaccagcagcccgcccucccccaccgccgcgagggcaugaccgacgaggaggcccucguccccuacuccaagcccuccuuccccucccccggcggccacuccuccuccggcaccgccuccuccaagggcuccaccggcccccgcaagaccgagguccuccgcgccggccaccagcgcaacgccuccgaccuccucgacaucggcuacaugggcuccaacucccagggccaguucaccggcgagcucuga

SEQ ID NO: 48881 - RNA, 4161 nt, Artificial Sequence
  derived and/or modified sequence opt2 from ROBO3__Homo_sapiens__NP_071765
augcuccgcuaccuccucaagacccuccuccagaugaaccucuucgccgacucccucgccggcgacaucuccaacuccuccgagcuccuccucggcuucaacuccucccucgccgcccucaaccacacccuccucccccccggcgaccccucccucaacggcucccgcgucggccccgaggacgccaugccccgcaucgucgagcagccccccgaccuccucgucucccgcggcgagcccgccacccuccccugccgcgccgagggccgcccccgccccaacaucgagugguacaagaacggcgcccgcgucgccaccguccgcgaggacccccgcgcccaccgccuccuccuccccuccggcgcccucuucuucccccgcaucguccacggccgccgcgcccgccccgacgagggcgucuacaccugcgucgcccgcaacuaccucggcgccgccgccucccgcaacgccucccucgaggucgccguccuccgcgacgacuuccgccagucccccggcaacgucgucgucgccgucggcgagcccgccguccucgagugcguccccccccgcggccaccccgagcccuccgucuccuggcgcaaggacggcgcccgccucaaggaggaggagggccgcaucaccauccgcggcggcaagcucaugaugucccacacccucaaguccgacgccggcauguacgucugcgucgccuccaacauggccggcgagcgcgaguccgccgccgccgaggucaugguccucgagcgccccuccuuccuccgccgccccgucaaccaggucguccucgccgacgcccccgucaccuuccucugcgaggucaagggcgacccccccccccgccuccgcuggcgcaaggaggacggcgagcuccccaccggccgcuacgagauccgcuccgaccacucccucuggaucggccacgucuccgccgaggacgagggcaccuacaccugcgucgccgagaacuccgucggccgcgccgaggccuccggcucccucuccguccacguccccccccagcucgucacccagccccaggaccagauggccgcccccggcgaguccgucgccuuccagugcgagaccaagggcaaccccccccccgccaucuucuggcagaaggagggcucccagguccuccucuuccccucccagucccuccagcccaccggccgcuucuccgucuccccccgcggccagcucaacaucaccgccguccagcgcggcgacgccggcuacuacgucugccaggccgucuccgucgccggcuccauccucgccaaggcccuccucgagaucaagggcgccucccucgacggccucccccccgucauccuccagggccccgccaaccagacccucguccucggcuccuccgucuggcuccccugccgcgucaccggcaacccccagcccuccguccgcuggaagaaggacggccaguggcuccagggcgacgaccuccaguucaagaccauggccaacggcacccucuacaucgccaacguccaggagauggacaugggcuucuacuccugcgucgccaaguccuccaccggcgaggccaccugguccggcuggcucaagaugcgcgaggacuggggcgucucccccgacccccccaccgagcccuccuccccccccggcgcccccucccagcccgucgucaccgagaucaccaagaacuccaucacccucaccuggaagcccaacccccagaccggcgccgccgucaccuccuacgucaucgaggccuucucccccgccgccggcaacaccuggcgcaccgucgccgacggcguccagcucgagacccacaccgucuccggccuccagcccaacaccaucuaccucuuccucguccgcgccgucggcgccuggggccucuccgagcccucccccgucuccgagcccguccgcacccaggacuccucccccucccgccccgucgaggaccccuggcgcggccagcagggccucgccgaggucgccguccgccuccaggagcccaucguccucggcccccgcacccuccaggucuccuggaccgucgacggccccguccagcucguccagggcuuccgcgucuccuggcgcgucgccggccccgagggcggcuccuggaccaugcucgaccuccagucccccucccagcaguccaccguccuccgcggccucccccccggcacccagauccagaucaagguccaggcccagggccaggagggccucggcgccgagucccucuccgucacccgcuccauccccgaggaggcccccuccggccccccccagggcgucgccgucgcccucggcggcgacggcaacuccuccaucaccgucuccugggagcccccccuccccucccagcagaacggcgucaucaccgaguaccagaucuggugccucggcaacgagucccgcuuccaccucaaccgcuccgccgccggcugggcccgcuccgccaugcuccgcggccucguccccggccuccucuaccgcacccucgucgccgccgccaccuccgccggcgucggcguccccuccgcccccguccucguccagcuccccuccccccccgaccucgagcccggccucgaggucggcgccggccucgccguccgccucgcccgcguccuccgcgagcccgccuuccucgccggcuccggcgccgccugcggcgcccuccuccucggccucugcgccgcccucuacuggcgccgcaagcagcgcaaggagcucucccacuacaccgccuccuucgccuacacccccgccgucuccuucccccacuccgagggccucuccggcgccuccucccgcccccccaugggccucggccccgcccccuacuccuggcucgccgacuccuggccccaccccucccgcucccccuccgcccaggagccccgcggcuccugcugccccuccaaccccgaccccgacgaccgcuacuacaacgaggccggcaucucccucuaccucgcccagaccgcccgcggcaccgccgcccccggcgagggccccgucuacuccaccaucgaccccgccggcgaggagcuccagaccuuccacggcggcuucccccagcaccccuccggcgaccucggccccuggucccaguacgccccccccgaguggucccagggcgacuccggcgccaagggcggcaaggucaagcuccucggcaagcccguccagaugcccucccucaacuggcccgaggcccuccccccccccccccccuccugcgagcucuccugccucgagggccccgaggaggagcucgagggcuccuccgagcccgaggaguggugcccccccaugcccgagcgcucccaccucaccgagcccuccuccuccggcggcugccucgucacccccucccgccgcgagacccccucccccacccccuccuacggccagcaguccaccgccacccucacccccuccccccccgaccccccccagccccccaccgacaugccccaccuccaccagaugccccgccgcgucccccucggccccuccuccccccucuccgucucccagcccaugcucggcauccgcgaggcccgccccgccggccucggcgccggccccgccgccuccccccaccucucccccucccccgcccccuccaccgccuccuccgcccccggccgcaccuggcagggcaacggcgagaugacccccccccuccagggcccccgcgcccgcuuccgcaagaagcccaaggcccuccccuaccgccgcgagaacucccccggcgaccuccccccccccccccuccccccccccgaggaggaggccuccugggcccucgagcuccgcgccgccggcuccauguccucccucgagcgcgagcgcuccggcgagcgcaaggccguccaggccgucccccucgccgcccagcgcguccuccaccccgacgaggaggccuggcuccccuacucccgccccuccuuccucucccgcggccagggcaccuccaccugcuccaccgccggcuccaacuccucccgcggcuccuccuccucccgcggcucccgcggccccggccgcucccgcucccgcucccagucccgcucccagucccagcgccccggccagaagcgccgcgaggagccccgcuga

SEQ ID NO: 48882 - RNA, 2589 nt, Artificial Sequence
  derived and/or modified sequence opt2 from ROBO4__Homo_sapiens__NP_001288017
auggucgccgucgucggcgagcaguucacccucgagugcggcccccccuggggccaccccgagcccaccgucuccugguggaaggacggcaagccccucgcccuccagcccggccgccacaccgucuccggcggcucccuccucauggcccgcgccgagaaguccgacgagggcaccuacaugugcgucgccaccaacuccgccggccaccgcgagucccgcgccgcccgcgucuccauccaggagccccaggacuacaccgagcccgucgagcuccucgccguccgcauccagcucgagaacgucacccuccucaaccccgaccccgccgagggccccaagccccgccccgccgucuggcucuccuggaaggucuccggccccgccgcccccgcccaguccuacaccgcccucuuccgcacccagaccgcccccggcggccagggcgcccccugggccgaggagcuccucgccggcuggcaguccgccgagcucggcggccuccacuggggccaggacuacgaguucaagguccgccccuccuccggccgcgcccgcggccccgacuccaacguccuccuccuccgccuccccgagaagguccccuccgcccccccccaggaggucacccucaagcccggcaacggcaccgucuucgucuccuggguccccccccccgccgagaaccacaacggcaucauccgcggcuaccaggucuggucccucggcaacaccucccucccccccgccaacuggaccgucgucggcgagcagacccagcucgagaucgccacccacaugcccggcuccuacugcguccaggucgccgccgucaccggcgccggcgccggcgagcccucccgccccgucugccuccuccucgagcaggccauggagcgcgccacccaggagcccuccgagcacggccccuggacccucgagcagcuccgcgccacccucaagcgccccgaggucaucgccaccugcggcgucgcccucuggcuccuccuccucggcaccgccgucugcauccaccgccgccgccgcgcccgcguccaccucggccccggccucuaccgcuacaccuccgaggacgccauccucaagcaccgcauggaccacuccgacucccaguggcucgccgacaccuggcgcuccaccuccggcucccgcgaccucuccuccuccuccucccucuccucccgccucggcgccgacgcccgcgacccccucgacugccgccgcucccuccucuccugggacucccgcucccccggcgucccccuccuccccgacaccuccaccuucuacggcucccucaucgccgagcuccccuccuccacccccgcccgccccuccccccagguccccgccguccgccgccuccccccccagcucgcccagcucuccucccccugcuccuccuccgacucccucugcucccgccgcggccucuccuccccccgccucucccucgcccccgccgaggccuggaaggccaagaagaagcaggagcuccagcacgccaacuccuccccccuccuccgcggcucccacucccucgagcuccgcgccugcgagcucggcaaccgcggcuccaagaaccucucccagucccccggcgccgucccccaggcccucgucgccuggcgcgcccucggccccaagcuccucuccuccuccaacgagcucgucacccgccaccucccccccgccccccucuucccccacgagaccccccccacccagucccagcagacccagccccccgucgccccccaggcccccuccuccauccuccuccccgccgcccccauccccauccucucccccugcuccccccccuccccccaggccuccucccucuccggccccucccccgccuccucccgccucuccuccuccucccucuccucccucggcgaggaccaggacuccguccucacccccgaggaggucgcccucugccucgagcucuccgagggcgaggagaccccccgcaacuccgucucccccaugccccgcgcccccuccccccccaccaccuacggcuacaucuccguccccaccgccuccgaguucaccgacaugggccgcaccggcggcggcgucggccccaagggcggcguccuccucugccccccccgccccugccucacccccacccccuccgagggcucccucgccaacggcuggggcuccgccuccgaggacaacgccgccuccgcccgcgccucccucgucuccuccuccgacggcuccuuccucgccgacgcccacuucgcccgcgcccucgccgucgccgucgacuccuucggcuucggccucgagccccgcgaggccgacugcgucuucaucgacgccuccuccccccccuccccccgcgacgagaucuuccucacccccaaccucucccucccccucugggaguggcgccccgacuggcucgaggacauggaggucucccacacccagcgccucggccgcggcaugccccccuggccccccgacucccagaucuccucccagcgcucccagcuccacugccgcaugcccaaggccggcgccucccccgucgacuacuccuga

SEQ ID NO: 48883 - RNA, 4065 nt, Artificial Sequence
  derived and/or modified sequence opt2 from ROCK1__Homo_sapiens__NP_005397
auguccaccggcgacuccuucgagacccgcuucgagaagauggacaaccuccuccgcgaccccaaguccgaggucaacuccgacugccuccucgacggccucgacgcccucgucuacgaccucgacuuccccgcccuccgcaagaacaagaacaucgacaacuuccucucccgcuacaaggacaccaucaacaagauccgcgaccuccgcaugaaggccgaggacuacgaggucgucaaggucaucggccgcggcgccuucggcgagguccagcucguccgccacaaguccacccgcaaggucuacgccaugaagcuccucuccaaguucgagaugaucaagcgcuccgacuccgccuucuucugggaggagcgcgacaucauggccuucgccaacucccccugggucguccagcucuucuacgccuuccaggacgaccgcuaccucuacauggucauggaguacaugcccggcggcgaccucgucaaccucauguccaacuacgacguccccgagaagugggcccgcuucuacaccgccgaggucguccucgcccucgacgccauccacuccaugggcuucauccaccgcgacgucaagcccgacaacaugcuccucgacaaguccggccaccucaagcucgccgacuucggcaccugcaugaagaugaacaaggagggcaugguccgcugcgacaccgccgucggcacccccgacuacaucucccccgagguccucaagucccagggcggcgacggcuacuacggccgcgagugcgacuggugguccgucggcgucuuccucuacgagaugcucgucggcgacacccccuucuacgccgacucccucgucggcaccuacuccaagaucaugaaccacaagaacucccucaccuuccccgacgacaacgacaucuccaaggaggccaagaaccucaucugcgccuuccucaccgaccgcgagguccgccucggccgcaacggcgucgaggagaucaagcgccaccucuucuucaagaacgaccagugggccugggagacccuccgcgacaccgucgcccccgucguccccgaccucuccuccgacaucgacaccuccaacuucgacgaccucgaggaggacaagggcgaggaggagaccuuccccauccccaaggccuucgucggcaaccagcuccccuucgucggcuucaccuacuacuccaaccgccgcuaccucuccuccgccaaccccaacgacaaccgcaccuccuccaacgccgacaagucccuccaggagucccuccagaagaccaucuacaagcucgaggagcagcuccacaacgagaugcagcucaaggacgagauggagcagaagugccgcaccuccaacaucaagcucgacaagaucaugaaggagcucgacgaggagggcaaccagcgccgcaaccucgaguccaccgucucccagaucgagaaggagaagaugcuccuccagcaccgcaucaacgaguaccagcgcaaggccgagcaggagaacgagaagcgccgcaacgucgagaacgaggucuccacccucaaggaccagcucgaggaccucaagaaggucucccagaacucccagcucgccaacgagaagcucucccagcuccagaagcagcucgaggaggccaacgaccuccuccgcaccgaguccgacaccgccguccgccuccgcaagucccacaccgagauguccaaguccaucucccagcucgagucccucaaccgcgagcuccaggagcgcaaccgcauccucgagaacuccaagucccagaccgacaaggacuacuaccagcuccaggccauccucgaggccgagcgccgcgaccgcggccacgacuccgagaugaucggcgaccuccaggcccgcaucaccucccuccaggaggaggucaagcaccucaagcacaaccucgagaaggucgagggcgagcgcaaggaggcccaggacaugcucaaccacuccgagaaggagaagaacaaccucgagaucgaccucaacuacaagcucaagucccuccagcagcgccucgagcaggaggucaacgagcacaaggucaccaaggcccgccucaccgacaagcaccaguccaucgaggaggccaaguccgucgccaugugcgagauggagaagaagcucaaggaggagcgcgaggcccgcgagaaggccgagaaccgcgucguccagaucgagaagcagugcuccaugcucgacgucgaccucaagcagucccagcagaagcucgagcaccucaccggcaacaaggagcgcauggaggacgaggucaagaaccucacccuccagcucgagcaggaguccaacaagcgccuccuccuccagaacgagcucaagacccaggccuucgaggccgacaaccucaagggccucgagaagcagaugaagcaggagaucaacacccuccucgaggccaagcgccuccucgaguucgagcucgcccagcucaccaagcaguaccgcggcaacgagggccagaugcgcgagcuccaggaccagcucgaggccgagcaguacuucuccacccucuacaagacccaggucaaggagcucaaggaggagaucgaggagaagaaccgcgagaaccucaagaagauccaggagcuccagaacgagaaggagacccucgccacccagcucgaccucgccgagaccaaggccgaguccgagcagcucgcccgcggccuccucgaggagcaguacuucgagcucacccaggaguccaagaaggccgccucccgcaaccgccaggagaucaccgacaaggaccacaccgucucccgccucgaggaggccaacuccaugcucaccaaggacaucgagauccuccgccgcgagaacgaggagcucaccgagaagaugaagaaggccgaggaggaguacaagcucgagaaggaggaggagaucuccaaccucaaggccgccuucgagaagaacaucaacaccgagcgcacccucaagacccaggccgucaacaagcucgccgagaucaugaaccgcaaggacuucaagaucgaccgcaagaaggccaacacccaggaccuccgcaagaaggagaaggagaaccgcaagcuccagcucgagcucaaccaggagcgcgagaaguucaaccagauggucgucaagcaccagaaggagcucaacgacaugcaggcccagcucgucgaggagugcgcccaccgcaacgagcuccagaugcagcucgccuccaaggaguccgacaucgagcagcuccgcgccaagcuccucgaccucuccgacuccaccuccgucgccuccuuccccuccgccgacgagaccgacggcaaccuccccgagucccgcaucgagggcuggcucuccguccccaaccgcggcaacaucaagcgcuacggcuggaagaagcaguacgucgucgucuccuccaagaagauccucuucuacaacgacgagcaggacaaggagcaguccaaccccuccaugguccucgacaucgacaagcucuuccacguccgccccgucacccagggcgacgucuaccgcgccgagaccgaggagauccccaagaucuuccagauccucuacgccaacgagggcgagugccgcaaggacgucgagauggagcccguccagcaggccgagaagaccaacuuccagaaccacaagggccacgaguucauccccacccucuaccacuuccccgccaacugcgacgccugcgccaagccccucuggcacgucuucaagcccccccccgcccucgagugccgccgcugccacgucaagugccaccgcgaccaccucgacaagaaggaggaccucaucugccccugcaaggucuccuacgacgucaccuccgcccgcgacaugcuccuccucgccugcucccaggacgagcagaagaagugggucacccaccucgucaagaagauccccaagaacccccccuccggcuucguccgcgccuccccccgcacccucuccacccgcuccaccgccaaccaguccuuccgcaaggucgucaagaacaccuccggcaagaccuccuga

SEQ ID NO: 48884 - RNA, 4167 nt, Artificial Sequence
  derived and/or modified sequence opt2 from ROCK2__Homo_sapiens__NP_004841
augucccgccccccccccaccggcaagaugcccggcgcccccgagaccgcccccggcgacggcgccggcgccucccgccagcgcaagcucgaggcccucauccgcgacccccgcucccccaucaacgucgagucccuccucgacggccucaacucccucguccucgaccucgacuuccccgcccuccgcaagaacaagaacaucgacaacuuccucaaccgcuacgagaagaucgucaagaagauccgcggccuccagaugaaggccgaggacuacgacgucgucaaggucaucggccgcggcgccuucggcgagguccagcucguccgccacaaggccucccagaaggucuacgccaugaagcuccucuccaaguucgagaugaucaagcgcuccgacuccgccuucuucugggaggagcgcgacaucauggccuucgccaacucccccugggucguccagcucuucuacgccuuccaggacgaccgcuaccucuacauggucauggaguacaugcccggcggcgaccucgucaaccucauguccaacuacgacguccccgagaagugggccaaguucuacaccgccgaggucguccucgcccucgacgccauccacuccaugggccucauccaccgcgacgucaagcccgacaacaugcuccucgacaagcacggccaccucaagcucgccgacuucggcaccugcaugaagauggacgagaccggcaugguccacugcgacaccgccgucggcacccccgacuacaucucccccgagguccucaagucccagggcggcgacggcuucuacggccgcgagugcgacuggugguccgucggcgucuuccucuacgagaugcucgucggcgacacccccuucuacgccgacucccucgucggcaccuacuccaagaucauggaccacaagaacucccucugcuuccccgaggacgccgagaucuccaagcacgccaagaaccucaucugcgccuuccucaccgaccgcgagguccgccucggccgcaacggcgucgaggagauccgccagcaccccuucuucaagaacgaccaguggcacugggacaacauccgcgagaccgccgcccccgucguccccgagcucuccuccgacaucgacuccuccaacuucgacgacaucgaggacgacaagggcgacgucgagaccuuccccauccccaaggccuucgucggcaaccagcuccccuucaucggcuucaccuacuaccgcgagaaccuccuccucuccgacucccccuccugccgcgagaccgacuccauccagucccgcaagaacgaggagucccaggagauccagaagaagcucuacacccucgaggagcaccucuccaacgagaugcaggccaaggaggagcucgagcagaagugcaaguccgucaacacccgccucgagaagaccgccaaggagcucgaggaggagaucacccuccgcaaguccgucgaguccgcccuccgccagcucgagcgcgagaaggcccuccuccagcacaagaacgccgaguaccagcgcaaggccgaccacgaggccgacaagaagcgcaaccucgagaacgacgucaacucccucaaggaccagcucgaggaccucaagaagcgcaaccagaacucccagaucuccaccgagaaggucaaccagcuccagcgccagcucgacgagaccaacgcccuccuccgcaccgaguccgacaccgccgcccgccuccgcaagacccaggccgaguccuccaagcagauccagcagcucgaguccaacaaccgcgaccuccaggacaagaacugccuccucgagaccgccaagcucaagcucgagaaggaguucaucaaccuccaguccgcccucgaguccgagcgccgcgaccgcacccacggcuccgagaucaucaacgaccuccagggccgcaucugcggccucgaggaggaccucaagaacggcaagauccuccucgccaaggucgagcucgagaagcgccagcuccaggagcgcuucaccgaccucgagaaggagaaguccaacauggagaucgacaugaccuaccagcucaaggucauccagcagucccucgagcaggaggaggccgagcacaaggccaccaaggcccgccucgccgacaagaacaagaucuacgaguccaucgaggaggccaaguccgaggccaugaaggagauggagaagaagcuccucgaggagcgcacccucaagcagaaggucgagaaccuccuccucgaggccgagaagcgcugcucccuccucgacugcgaccucaagcagucccagcagaagaucaacgagcuccucaagcagaaggacguccucaacgaggacguccgcaaccucacccucaagaucgagcaggagacccagaagcgcugccucacccagaacgaccucaagaugcagacccagcaggucaacacccucaagauguccgagaagcagcucaagcaggagaacaaccaccucauggagaugaagaugaaccucgagaagcagaacgccgagcuccgcaaggagcgccaggacgccgacggccagaugaaggagcuccaggaccagcucgaggccgagcaguacuucuccacccucuacaagacccagguccgcgagcucaaggaggagugcgaggagaagaccaagcucggcaaggagcuccagcagaagaagcaggagcuccaggacgagcgcgacucccucgccgcccagcucgagaucacccucaccaaggccgacuccgagcagcucgcccgcuccaucgccgaggagcaguacuccgaccucgagaaggagaagaucaugaaggagcucgagaucaaggagaugauggcccgccacaagcaggagcucaccgagaaggacgccaccaucgccucccucgaggagaccaaccgcacccucaccuccgacgucgccaaccucgccaacgagaaggaggagcucaacaacaagcucaaggacguccaggagcagcucucccgccucaaggacgaggagaucuccgccgccgccaucaaggcccaguucgagaagcagcuccucaccgagcgcacccucaagacccaggccgucaacaagcucgccgagaucaugaaccgcaaggagcccgucaagcgcggcaacgacaccgacguccgccgcaaggagaaggagaaccgcaagcuccacauggagcucaaguccgagcgcgagaagcucacccagcagaugaucaaguaccagaaggagcucaacgagaugcaggcccagaucgccgaggagucccagauccgcaucgagcuccagaugacccucgacuccaaggacuccgacaucgagcagcuccgcucccagcuccaggcccuccacaucggccucgacuccuccuccaucggcuccggccccggcgacgccgaggccgacgacggcuuccccgagucccgccucgagggcuggcucucccuccccguccgcaacaacaccaagaaguucggcugggucaagaaguacgucaucgucuccuccaagaagauccucuucuacgacuccgagcaggacaaggagcaguccaaccccuacaugguccucgacaucgacaagcucuuccacguccgccccgucacccagaccgacgucuaccgcgccgacgccaaggagaucccccgcaucuuccagauccucuacgccaacgagggcgaguccaagaaggagcaggaguuccccgucgagcccgucggcgagaaguccaacuacaucugccacaagggccacgaguucauccccacccucuaccacuuccccaccaacugcgaggccugcaugaagccccucuggcacauguucaagcccccccccgcccucgagugccgccgcugccacaucaagugccacaaggaccacauggacaagaaggaggagaucaucgcccccugcaaggucuacuacgacaucuccaccgccaagaaccuccuccuccucgccaacuccaccgaggagcagcagaagugggucucccgccucgucaagaagauccccaagaagccccccgcccccgaccccuucgcccgcuccuccccccgcaccuccaugaagauccagcagaaccaguccauccgccgccccucccgccagcucgcccccaacaagcccuccuga

SEQ ID NO: 48885 - RNA, 864 nt, Artificial Sequence
  derived and/or modified sequence opt2 from ROGDI__Homo_sapiens__NP_078865
auggccaccgucauggccgccaccgccgccgagcgcgccguccucgaggaggaguuccgcuggcuccuccacgacgagguccacgccguccucaagcagcuccaggacauccucaaggaggccucccuccgcuucacccuccccggcuccggcaccgagggccccgccaagcaggagaacuucauccucggcuccugcggcaccgaccaggucaagggcguccucacccuccagggcgacgcccucucccaggccgacgucaaccucaagaugccccgcaacaaccagcuccuccacuucgccuuccgcgaggacaagcaguggaagcuccagcagauccaggacgcccgcaaccacgucucccaggccaucuaccuccucaccucccgcgaccaguccuaccaguucaagaccggcgccgagguccucaagcucauggacgccgucaugcuccagcucacccgcgcccgcaaccgccucaccacccccgccacccucacccuccccgagaucgccgccuccggccucacccgcauguucgcccccgcccuccccuccgaccuccucgucaacgucuacaucaaccucaacaagcucugccucaccgucuaccagcuccacgcccuccagcccaacuccaccaagaacuuccgccccgccggcggcgccguccuccacucccccggcgccauguucgaguggggcucccagcgccucgaggucucccacguccacaaggucgagugcgucauccccuggcucaacgacgcccucgucuacuucaccgucucccuccagcucugccagcagcucaaggacaagaucuccgucuucuccuccuacugguccuaccgccccuucuga

SEQ ID NO: 48886 - RNA, 1056 nt, Artificial Sequence
  derived and/or modified sequence opt2 from ROM1__Homo_sapiens__NP_000318
auggcccccguccucccccucguccucccccuccagccccgcauccgccucgcccagggccucuggcuccucuccuggcuccucgcccucgccggcggcgucauccuccucugcuccggccaccuccucguccagcuccgccaccucggcaccuuccucgcccccuccugccaguuccccguccucccccaggccgcccucgccgccggcgccgucgcccucggcaccggccucgucggcgucggcgccucccgcgccucccucaacgccgcccucuacccccccuggcgcggcguccucggcccccuccucgucgccggcaccgccggcggcggcggccuccucgucgucgcccucggccucgcccucgcccuccccggcucccucgacgaggcccucgaggagggccucgucaccgcccucgcccacuacaaggacaccgagguccccggccacugccaggccaagcgccucgucgacgagcuccagcuccgcuaccacugcugcggccgccacggcuacaaggacugguucggcguccagugggucuccucccgcuaccucgaccccggcgaccgcgacgucgccgaccgcauccaguccaacgucgagggccucuaccucaccgacggcguccccuucuccugcugcaacccccacuccccccgccccugccuccagaaccgccucuccgacuccuacgcccacccccucuucgacccccgccagcccaaccagaaccucugggcccagggcugccacgagguccuccucgagcaccuccaggaccucgccggcacccucggcuccaugcucgccgucaccuuccuccuccaggcccucguccuccucggccuccgcuaccuccagaccgcccucgagggccucggcggcgucaucgacgccggcggcgagacccagggcuaccucuuccccuccggccucaaggacaugcucaagaccgccuggcuccagggcggcgucgccugccgccccgcccccgaggaggccccccccggcgaggccccccccaaggaggaccucuccgaggccuga

SEQ ID NO: 48887 - RNA, 363 nt, Artificial Sequence
  derived and/or modified sequence opt2 from ROPN1B__Homo_sapiens__XP_005247195
auguggaaggucgucaaccuccccaccgaccucuucaacuccgucaugaacgucggccgcuucaccgaggagaucgaguggcucaaguuccucgcccucgccugcuccgcccucggcgucaccaucaccaagacccucaagaucgucugcgagguccucuccugcgaccacaacggcggccucccccgcauccccuucuccaccuuccaguuccucuacaccuacaucgccgaggucgacggcgagaucugcgccucccacgucucccgcaugcucaacuacaucgagcaggaggucaucggccccgacggccucaucaccgucaacgacuucacccagaacccccgcgucuggcucgaguga

SEQ ID NO: 48888 - RNA, 441 nt, Artificial Sequence
  derived and/or modified sequence opt2 from ROPN1__Homo_sapiens__XP_011511238
auggcccagaccgacaagcccaccugcaucccccccgagcuccccaagaugcucaaggaguucgccaaggccgccauccgcguccagccccaggaccucauccagugggccgccgacuacuucgaggcccucucccgcggcgagaccccccccguccgcgagcgcuccgagcgcgucgcccucugcaaccgcgccgagcucacccccgagcuccucaagauccuccacucccaggucgccggccgccucaucauccgcgccgaggagcucgcccagauguggaaggucgucaaccuccccaccgaccucuucaacuccgucaugaacgucggccgcuucaccgaggagaucgaguggcucaaguuccucgcccucgccugcuccgcccucggcguccgccagccccgcgccgacugccgcaagcgccuccccgacaccuga

SEQ ID NO: 48889 - RNA, 693 nt, Artificial Sequence
  derived and/or modified sequence opt2 from ROPN1L__Homo_sapiens__NP_114122
augccccuccccgacaccauguucugcgcccagcagauccacaucccccccgagcuccccgacauccucaagcaguucaccaaggccgccauccgcacccagcccgccgacguccuccgcugguccgccggcuacuucuccgcccucucccgcggcgacccccuccccgucaaggaccgcauggagaugcccaccgccacccagaagaccgacaccggccucacccagggccuccucaagguccuccacaagcagugccaccacaagcgcuacgucgagcucaccgaccucgagcagaaguggaagaaccucugccuccccaaggagaaguucaaggcccuccuccagcucgaccccugcgagaacaagaucaaguggaucaacuuccucgcccucggcugcuccaugcucggcggcucccucaacaccgcccucaagcaccucugcgagauccucaccgacgaccccgagggcggccccgcccgcauccccuucaagaccuucuccuacgucuaccgcuaccucgcccgccucgacuccgacgucuccccccucgagaccgaguccuaccucgccucccucaaggagaacaucgacgcccgcaagaacggcaugaucggccucuccgacuucuucuuccccaagcgcaagcuccucgaguccaucgagaacuccgaggacgucggccacuga

SEQ ID NO: 48890 - RNA, 2625 nt, Artificial Sequence
  derived and/or modified sequence opt2 from ROR1__Homo_sapiens__XP_011539828
augaacaacaucaccaccucccucggccagaccgccgagcuccacugcaaggucuccggcaaccccccccccaccauccgcugguucaagaacgacgcccccgucguccaggagccccgccgccucuccuuccgcuccaccaucuacggcucccgccuccgcauccgcaaccucgacaccaccgacaccggcuacuuccagugcgucgccaccaacggcaaggaggucgucuccuccaccggcguccucuucgucaaguucggccccccccccaccgccucccccggcuacuccgacgaguacgaggaggacggcuucugccagcccuaccgcggcaucgccugcgcccgcuucaucggcaaccgcaccgucuacauggagucccuccacaugcagggcgagaucgagaaccagaucaccgccgccuucaccaugaucggcaccuccucccaccucuccgacaagugcucccaguucgccauccccucccucugccacuacgccuuccccuacugcgacgagaccuccuccguccccaagccccgcgaccucugccgcgacgagugcgagauccucgagaacguccucugccagaccgaguacaucuucgcccgcuccaaccccaugauccucaugcgccucaagcuccccaacugcgaggaccucccccagcccgagucccccgaggccgccaacugcauccgcaucggcauccccauggccgaccccaucaacaagaaccacaagugcuacaacuccaccggcgucgacuaccgcggcaccgucuccgucaccaaguccggccgccagugccagcccuggaacucccaguacccccacacccacaccuucaccgcccuccgcuuccccgagcucaacggcggccacuccuacugccgcaaccccggcaaccagaaggaggcccccuggugcuucacccucgacgagaacuucaaguccgaccucugcgacauccccgccugcgacuccaaggacuccaaggagaagaacaagauggagauccucuacauccucguccccuccgucgccaucccccucgccaucgcccuccucuucuucuucaucugcgucugccgcaacaaccagaaguccuccuccgcccccguccagcgccagcccaagcacguccgcggccagaacgucgagauguccaugcucaacgccuacaagcccaaguccaaggccaaggagcucccccucuccgccguccgcuucauggaggagcucggcgagugcgccuucggcaagaucuacaagggccaccucuaccuccccggcauggaccacgcccagcucgucgccaucaagacccucaaggacuacaacaacccccagcaguggaccgaguuccagcaggaggccucccucauggccgagcuccaccaccccaacaucgucugccuccucggcgccgucacccaggagcagcccgucugcaugcucuucgaguacaucaaccagggcgaccuccacgaguuccucaucaugcgcuccccccacuccgacgucggcugcuccuccgacgaggacggcaccgucaaguccucccucgaccacggcgacuuccuccacaucgccauccagaucgccgccggcauggaguaccucuccucccacuucuucguccacaaggaccucgccgcccgcaacauccucaucggcgagcagcuccacgucaagaucuccgaccucggccucucccgcgagaucuacuccgccgacuacuaccgcguccaguccaagucccuccuccccauccgcuggaugccccccgaggccaucauguacggcaaguucuccuccgacuccgacaucugguccuucggcgucguccucugggagaucuucuccuucggccuccagcccuacuacggcuucuccaaccaggaggucaucgagaugguccgcaagcgccagcuccuccccugcuccgaggacugccccccccgcauguacucccucaugaccgagugcuggaacgagauccccucccgccgcccccgcuucaaggacauccacguccgccuccgcuccugggagggccucuccucccacaccuccuccaccacccccuccggcggcaacgccaccacccagaccaccucccucuccgccucccccgucuccaaccucuccaacccccgcuaccccaacuacauguuccccucccagggcaucaccccccagggccagaucgccggcuucaucggcccccccaucccccagaaccagcgcuucauccccaucaacggcuaccccaucccccccggcuacgccgccuuccccgccgcccacuaccagcccaccggccccccccgcgucauccagcacugccccccccccaagucccgcucccccuccuccgccuccggcuccaccuccaccggccacgucaccucccuccccuccuccggcuccaaccaggaggccaacaucccccuccucccccacauguccauccccaaccaccccggcggcaugggcaucaccgucuucggcaacaagucccagaagcccuacaagaucgacuccaagcaggccucccuccucggcgacgccaacauccacggccacaccgaguccaugaucuccgccgagcucuga

SEQ ID NO: 48891 - RNA, 2832 nt, Artificial Sequence
  derived and/or modified sequence opt2 from ROR2__Homo_sapiens__NP_004551
auggcccgcggcuccgcccucccccgccgcccccuccucugcauccccgccgucugggccgccgccgcccuccuccucuccgucucccgcaccuccggcgaggucgagguccucgaccccaacgacccccucggcccccucgacggccaggacggccccauccccacccucaagggcuacuuccucaacuuccucgagcccgucaacaacaucaccaucguccagggccagaccgccauccuccacugcaaggucgccggcaaccccccccccaacguccgcuggcucaagaacgacgcccccgucguccaggagccccgccgcaucaucauccgcaagaccgaguacggcucccgccuccgcauccaggaccucgacaccaccgacaccggcuacuaccagugcgucgccaccaacggcaugaagaccaucaccgccaccggcguccucuucguccgccucggccccacccacucccccaaccacaacuuccaggacgacuaccacgaggacggcuucugccagcccuaccgcggcaucgccugcgcccgcuucaucggcaaccgcaccaucuacgucgacucccuccagaugcagggcgagaucgagaaccgcaucaccgccgccuucaccaugaucggcaccuccacccaccucuccgaccagugcucccaguucgccauccccuccuucugccacuucgucuucccccucugcgacgcccgcucccgcacccccaagccccgcgagcucugccgcgacgagugcgagguccucgaguccgaccucugccgccaggaguacaccaucgcccgcuccaacccccucauccucaugcgccuccagcuccccaagugcgaggcccuccccaugcccgagucccccgacgccgccaacugcaugcgcaucggcauccccgccgagcgccucggccgcuaccaccagugcuacaacggcuccggcauggacuaccgcggcaccgccuccaccaccaaguccggccaccagugccagcccugggcccuccagcacccccacucccaccaccucuccuccaccgacuuccccgagcucggcggcggccacgccuacugccgcaaccccggcggccagauggagggccccuggugcuucacccagaacaagaacguccgcauggagcucugcgacguccccuccugcuccccccgcgacuccuccaagaugggcauccucuacauccucguccccuccaucgccaucccccucgucaucgccugccucuucuuccucgucugcaugugccgcaacaagcagaaggccuccgccuccaccccccagcgccgccagcucauggccucccccucccaggacauggagaugccccucaucaaccagcacaagcaggccaagcucaaggagaucucccucuccgccguccgcuucauggaggagcucggcgaggaccgcuucggcaaggucuacaagggccaccucuucggccccgcccccggcgagcagacccaggccgucgccaucaagacccucaaggacaaggccgagggcccccuccgcgaggaguuccgccacgaggccaugcuccgcgcccgccuccagcaccccaacgucgucugccuccucggcgucgucaccaaggaccagccccucuccaugaucuucuccuacugcucccacggcgaccuccacgaguuccucgucaugcgcuccccccacuccgacgucggcuccaccgacgacgaccgcaccgucaaguccgcccucgagccccccgacuucguccaccucgucgcccagaucgccgccggcauggaguaccucuccucccaccacgucguccacaaggaccucgccacccgcaacguccucgucuacgacaagcucaacgucaagaucuccgaccucggccucuuccgcgaggucuacgccgccgacuacuacaagcuccucggcaacucccuccuccccauccgcuggauggcccccgaggccaucauguacggcaaguucuccaucgacuccgacaucugguccuacggcgucguccucugggaggucuucuccuacggccuccagcccuacugcggcuacuccaaccaggacgucgucgagaugauccgcaaccgccagguccuccccugccccgacgacugccccgccugggucuacgcccucaugaucgagugcuggaacgaguuccccucccgccgcccccgcuucaaggacauccacucccgccuccgcgccuggggcaaccucuccaacuacaacuccuccgcccagaccuccggcgccuccaacaccacccagaccuccucccucuccaccucccccgucuccaacgucuccaacgcccgcuacgucggccccaagcagaaggccccccccuucccccagccccaguucauccccaugaagggccagauccgccccauggucccccccccccagcucuacguccccgucaacggcuaccagcccguccccgccuacggcgccuaccuccccaacuucuaccccguccagauccccaugcagauggccccccagcagguccccccccagaugguccccaagcccuccucccaccacuccggcuccggcuccaccuccaccggcuacgucaccaccgcccccuccaacaccuccauggccgaccgcgccgcccuccucuccgagggcgccgacgacacccagaacgcccccgaggacggcgcccaguccaccguccaggaggccgaggaggaggaggagggcuccguccccgagaccgagcuccucggcgacugcgacacccuccaggucgacgaggcccagguccagcucgaggccuga

SEQ ID NO: 48892 - RNA, 1647 nt, Artificial Sequence
  derived and/or modified sequence opt2 from RORA__Homo_sapiens__NP_002934
augaacgagggcgcccccggcgacuccgaccucgagaccgaggcccgcguccccugguccaucaugggccacugccuccgcaccggccaggcccgcauguccgccacccccacccccgccggcgagggcgcccgcuccuccuccaccugcuccucccucucccgccucuucuggucccagcucgagcacaucaacugggacggcgccaccgccaagaacuucaucaaccuccgcgaguucuucuccuuccuccuccccgcccuccgcaaggcccagaucgagaucauccccugcaagaucugcggcgacaaguccuccggcauccacuacggcgucaucaccugcgagggcugcaagggcuucuuccgccgcucccagcaguccaacgccaccuacuccugcccccgccagaagaacugccucaucgaccgcaccucccgcaaccgcugccagcacugccgccuccagaagugccucgccgucggcaugucccgcgacgccgucaaguucggccgcauguccaagaagcagcgcgacucccucuacgccgagguccagaagcaccgcaugcagcagcagcagcgcgaccaccagcagcagcccggcgaggccgagccccucacccccaccuacaacaucuccgccaacggccucaccgagcuccacgacgaccucuccaacuacaucgacggccacacccccgagggcuccaaggccgacuccgccgucuccuccuucuaccucgacauccagcccucccccgaccaguccggccucgacaucaacggcaucaagcccgagcccaucugcgacuacacccccgccuccggcuucuuccccuacugcuccuucaccaacggcgagaccucccccaccgucuccauggccgagcucgagcaccucgcccagaacaucuccaagucccaccucgagaccugccaguaccuccgcgaggagcuccagcagaucaccuggcagaccuuccuccaggaggagaucgagaacuaccagaacaagcagcgcgaggucauguggcagcucugcgccaucaagaucaccgaggccauccaguacgucgucgaguucgccaagcgcaucgacggcuucauggagcucugccagaacgaccagaucguccuccucaaggccggcucccucgaggucgucuucauccgcaugugccgcgccuucgacucccagaacaacaccgucuacuucgacggcaaguacgccucccccgacgucuucaagucccucggcugcgaggacuucaucuccuucgucuucgaguucggcaagucccucugcuccaugcaccucaccgaggacgagaucgcccucuucuccgccuucguccucauguccgccgaccgcuccuggcuccaggagaaggucaagaucgagaagcuccagcagaagauccagcucgcccuccagcacguccuccagaagaaccaccgcgaggacggcauccucaccaagcucaucugcaaggucuccacccuccgcgcccucugcggccgccacaccgagaagcucauggccuucaaggccaucuaccccgacaucguccgccuccacuuccccccccucuacaaggagcucuucaccuccgaguucgagcccgccaugcagaucgacggcuga

SEQ ID NO: 48893 - RNA, 1380 nt, Artificial Sequence
  derived and/or modified sequence opt2 from RORB__Homo_sapiens__NP_008845
augcgcgcccagaucgaggucauccccugcaagaucugcggcgacaaguccuccggcauccacuacggcgucaucaccugcgagggcugcaagggcuucuuccgccgcucccagcagaacaacgccuccuacuccugcccccgccagcgcaacugccucaucgaccgcaccaaccgcaaccgcugccagcacugccgccuccagaagugccucgcccucggcaugucccgcgacgccgucaaguucggccgcauguccaagaagcagcgcgacucccucuacgccgagguccagaagcaccagcagcgccuccaggagcagcgccagcagcaguccggcgaggccgaggcccucgcccgcgucuacuccuccuccaucuccaacggccucuccaaccucaacaacgagaccuccggcaccuacgccaacggccacgucaucgaccuccccaaguccgagggcuacuacaacgucgacuccggccagcccucccccgaccaguccggccucgacaugaccggcaucaagcagaucaagcaggagcccaucuacgaccucaccuccguccccaaccucuucaccuacuccuccuucaacaacggccagcucgcccccggcaucaccaugaccgagaucgaccgcaucgcccagaacaucaucaagucccaccucgagaccugccaguacaccauggaggagcuccaccagcucgccuggcagacccacaccuacgaggagaucaaggccuaccaguccaagucccgcgaggcccucuggcagcagugcgccauccagaucacccacgccauccaguacgucgucgaguucgccaagcgcaucaccggcuucauggagcucugccagaacgaccagauccuccuccucaaguccggcugccucgaggucguccucguccgcaugugccgcgccuucaacccccucaacaacaccguccucuucgagggcaaguacggcggcaugcagauguucaaggcccucggcuccgacgaccucgucaacgaggccuucgacuucgccaagaaccucugcucccuccagcucaccgaggaggagaucgcccucuucuccuccgccguccucaucucccccgaccgcgccuggcucaucgagccccgcaagguccagaagcuccaggagaagaucuacuucgcccuccagcacgucauccagaagaaccaccucgacgacgagacccucgccaagcucaucgccaagauccccaccaucaccgccgucugcaaccuccacggcgagaagcuccaggucuucaagcagucccaccccgagaucgucaacacccucuuccccccccucuacaaggagcucuucaaccccgacugcgccaccggcugcaaguga

SEQ ID NO: 48894 - RNA, 1494 nt, Artificial Sequence
  derived and/or modified sequence opt2 from RORC__Homo_sapiens__NP_001001523
augcgcacccagaucgaggucauccccugcaagaucugcggcgacaaguccuccggcauccacuacggcgucaucaccugcgagggcugcaagggcuucuuccgccgcucccagcgcugcaacgccgccuacuccugcacccgccagcagaacugccccaucgaccgcaccucccgcaaccgcugccagcacugccgccuccagaagugccucgcccucggcaugucccgcgacgccgucaaguucggccgcauguccaagaagcagcgcgacucccuccacgccgagguccagaagcagcuccagcagcgccagcagcagcagcaggagcccgucgucaagaccccccccgccggcgcccagggcgccgacacccucaccuacacccucggccuccccgacggccagcucccccucggcuccucccccgaccuccccgaggccuccgccugcccccccggccuccucaaggccuccggcuccggccccuccuacuccaacaaccucgccaaggccggccucaacggcgccuccugccaccucgaguacucccccgagcgcggcaaggccgagggccgcgaguccuucuacuccaccggcucccagcucacccccgaccgcugcggccuccgcuucgaggagcaccgccaccccggccucggcgagcucggccagggccccgacuccuacggcucccccuccuuccgcuccacccccgaggcccccuacgccucccucaccgagaucgagcaccucguccaguccgucugcaaguccuaccgcgagaccugccagcuccgccucgaggaccuccuccgccagcgcuccaacaucuucucccgcgaggaggucaccggcuaccagcgcaaguccaugugggagaugugggagcgcugcgcccaccaccucaccgaggccauccaguacgucgucgaguucgccaagcgccucuccggcuucauggagcucugccagaacgaccagaucguccuccucaaggccggcgccauggaggucguccucguccgcaugugccgcgccuacaacgccgacaaccgcaccgucuucuucgagggcaaguacggcggcauggagcucuuccgcgcccucggcugcuccgagcucaucuccuccaucuucgacuucucccacucccucuccgcccuccacuucuccgaggacgagaucgcccucuacaccgcccucguccucaucaacgcccaccgccccggccuccaggagaagcgcaaggucgagcagcuccaguacaaccucgagcucgccuuccaccaccaccucugcaagacccaccgccaguccauccucgccaagcucccccccaagggcaagcuccgcucccucugcucccagcacgucgagcgccuccagaucuuccagcaccuccaccccaucgucguccaggccgccuuccccccccucuacaaggagcucuucuccaccgagaccgagucccccgucggccucuccaaguga

SEQ ID NO: 48895 - RNA, 7044 nt, Artificial Sequence
  derived and/or modified sequence opt2 from ROS1__Homo_sapiens__NP_002935
augaagaacaucuacugccucauccccaagcucgucaacuucgccacccucggcugccucuggaucuccgucguccagugcaccguccucaacuccugccucaaguccugcgucaccaaccucggccagcagcucgaccucggcaccccccacaaccucuccgagcccugcauccagggcugccacuucuggaacuccgucgaccagaagaacugcgcccucaagugccgcgaguccugcgaggucggcugcuccuccgccgagggcgccuacgaggaggagguccucgagaacgccgaccuccccaccgcccccuucgccuccuccaucggcucccacaacaugacccuccgcuggaaguccgccaacuucuccggcgucaaguacaucauccaguggaaguacgcccagcuccucggcuccuggaccuacaccaagaccgucucccgccccuccuacgucgucaagccccuccaccccuucaccgaguacaucuuccgcgucgucuggaucuucaccgcccagcuccagcucuacuccccccccucccccuccuaccgcacccacccccacggcguccccgagaccgccccccucauccgcaacaucgaguccuccucccccgacaccgucgaggucuccugggaccccccccaguuccccggcggccccauccucggcuacaaccuccgccucaucuccaagaaccagaagcucgacgccggcacccagcgcaccuccuuccaguucuacuccacccuccccaacaccaucuaccgcuucuccaucgccgccgucaacgaggucggcgagggccccgaggccgaguccuccaucaccaccuccuccuccgccguccagcaggaggagcaguggcucuuccucucccgcaagaccucccuccgcaagcgcucccucaagcaccucgucgacgaggcccacugccuccgccucgacgccaucuaccacaacaucaccggcaucuccgucgacguccaccagcagaucgucuacuucuccgagggcacccucaucugggccaagaaggccgccaacauguccgacgucuccgaccuccgcaucuucuaccgcggcuccggccucaucuccuccaucuccaucgacuggcucuaccagcgcauguacuucaucauggacgagcucgucugcgucugcgaccucgagaacugcuccaacaucgaggagaucaccccccccuccaucuccgccccccagaagaucgucgccgacuccuacaacggcuacgucuucuaccuccuccgcgacggcaucuaccgcgccgaccuccccguccccuccggccgcugcgccgaggccguccgcaucgucgaguccugcacccucaaggacuucgccaucaagccccaggccaagcgcaucaucuacuucaacgacaccgcccaggucuucauguccaccuuccucgacggcuccgccucccaccucauccucccccgcauccccuucgccgacgucaaguccuucgccugcgagaacaacgacuuccucgucaccgacggcaaggucaucuuccagcaggacgcccucuccuucaacgaguucaucgucggcugcgaccucucccacaucgaggaguucggcuucggcaaccucgucaucuucggcuccuccucccagcuccacccccuccccggccgcccccaggagcucuccguccucuucggcucccaccaggcccucguccaguggaagccccccgcccucgccaucggcgccaacgucauccucaucuccgacaucaucgagcucuucgagcucggccccuccgccuggcagaacuggaccuacgaggucaaggucuccacccaggacccccccgaggucacccacaucuuccucaacaucuccggcaccaugcucaacguccccgagcuccaguccgccaugaaguacaaggucuccguccgcgccuccucccccaagcgccccggccccugguccgagcccuccgucggcaccacccucguccccgccuccgagccccccuucaucauggccgucaaggaggacggccucugguccaagccccucaacuccuucggccccggcgaguuccucuccuccgacaucggcaacgucuccgacauggacugguacaacaacucccucuacuacuccgacaccaagggcgacgucuucgucuggcuccucaacggcaccgacaucuccgagaacuaccaccuccccuccaucgccggcgccggcgcccucgccuucgaguggcucggccacuuccucuacugggccggcaagaccuacgucauccagcgccaguccguccucaccggccacaccgacaucgucacccacgucaagcuccucgucaacgacauggucgucgacuccgucggcggcuaccucuacuggaccacccucuacuccgucgaguccacccgccucaacggcgaguccucccucguccuccagacccagcccugguucuccggcaagaaggucaucgcccucacccucgaccucuccgacggccuccucuacuggcucguccaggacucccagugcauccaccucuacaccgccguccuccgcggccaguccaccggcgacaccaccaucaccgaguucgccgccugguccaccuccgagaucucccagaacgcccucauguacuacuccggccgccucuucuggaucaacggcuuccgcaucaucaccacccaggagaucggccagaagaccuccgucuccguccucgagcccgcccgcuucaaccaguucaccaucauccagaccucccucaagccccuccccggcaacuucuccuucacccccaaggucauccccgacuccguccaggaguccuccuuccgcaucgagggcaacgccuccuccuuccagauccucuggaacggcccccccgccgucgacuggggcgucgucuucuacuccgucgaguucuccgcccacuccaaguuccucgccuccgagcagcacucccuccccgucuucaccgucgagggccucgagcccuacgcccucuucaaccucuccgucacccccuacaccuacuggggcaagggccccaagaccucccucucccuccgcgcccccgagaccguccccuccgcccccgagaacccccgcaucuucauccuccccuccggcaagugcugcaacaagaacgaggucgucgucgaguuccgcuggaacaagcccaagcacgagaacggcguccucaccaaguucgagaucuucuacaacaucuccaaccaguccaucaccaacaagaccugcgaggacuggaucgccgucaacgucacccccuccgucauguccuuccagcucgagggcauguccccccgcugcuucaucgccuuccagguccgcgccuucaccuccaagggccccggccccuacgccgacgucgucaaguccaccaccuccgagaucaaccccuucccccaccucaucacccuccucggcaacaagaucgucuuccucgacauggaccagaaccaggucgucuggaccuucuccgccgagcgcgucaucuccgccgucugcuacaccgccgacaacgagaugggcuacuacgccgagggcgacucccucuuccuccuccaccuccacaaccgcuccuccuccgagcucuuccaggacucccucgucuucgacaucaccgucaucaccaucgacuggaucucccgccaccucuacuucgcccucaaggagucccagaacggcaugcaggucuucgacgucgaccucgagcacaaggucaaguacccccgcgaggucaagauccacaaccgcaacuccaccaucaucuccuucuccgucuacccccuccucucccgccucuacuggaccgaggucuccaacuucggcuaccagauguucuacuacuccaucaucucccacacccuccaccgcauccuccagcccaccgccaccaaccagcagaacaagcgcaaccagugcuccugcaacgucaccgaguucgagcucuccggcgccauggccaucgacaccuccaaccucgagaagccccucaucuacuucgccaaggcccaggagaucugggccauggaccucgagggcugccagugcuggcgcgucaucaccguccccgccaugcucgccggcaagacccucgucucccucaccgucgacggcgaccucaucuacuggaucaucaccgccaaggacuccacccagaucuaccaggccaagaagggcaacggcgccaucgucucccaggucaaggcccuccgcucccgccacauccucgccuacuccuccgucaugcagcccuuccccgacaaggccuuccucucccucgccuccgacaccgucgagcccaccauccucaacgccaccaacaccucccucaccauccgccucccccucgccaagaccaaccucaccugguacggcaucaccucccccacccccaccuaccucgucuacuacgccgaggucaacgaccgcaagaacuccuccgaccucaaguaccgcauccucgaguuccaggacuccaucgcccucaucgaggaccuccagcccuucuccaccuacaugauccagaucgccgucaagaacuacuacuccgacccccucgagcaccucccccccggcaaggagaucuggggcaagaccaagaacggcguccccgaggccguccagcucaucaacaccaccguccgcuccgacaccucccucaucaucuccuggcgcgagucccacaagcccaacggccccaaggaguccguccgcuaccagcucgccaucucccaccucgcccucauccccgagaccccccuccgccaguccgaguuccccaacggccgccucacccuccucgucacccgccucuccggcggcaacaucuacguccucaagguccucgccugccacuccgaggagauguggugcaccgagucccaccccgucaccgucgagauguucaacacccccgagaagcccuacucccucguccccgagaacaccucccuccaguucaacuggaaggccccccucaacgucaaccucauccgcuucugggucgagcuccagaaguggaaguacaacgaguucuaccacgucaagaccuccugcucccagggccccgccuacgucugcaacaucaccaaccuccagcccuacaccuccuacaacguccgcgucgucgucgucuacaagaccggcgagaacuccaccucccuccccgaguccuucaagaccaaggccggcguccccaacaagcccggcauccccaagcuccucgagggcuccaagaacuccauccagugggagaaggccgaggacaacggcugccgcaucaccuacuacauccucgagauccgcaaguccaccuccaacaaccuccagaaccagaaccuccgcuggaagaugaccuucaacggcuccugcuccuccgucugcaccuggaaguccaagaaccucaagggcaucuuccaguuccgcgucgucgccgccaacaaccucggcuucggcgaguacuccggcaucuccgagaacaucauccucgucggcgacgacuucuggauccccgagaccuccuucauccucaccaucaucgucggcaucuuccucgucgucaccaucccccucaccuucgucuggcaccgccgccucaagaaccagaaguccgccaaggagggcgucaccguccucaucaacgaggacaaggagcucgccgagcuccgcggccucgccgccggcgucggccucgccaacgccugcuacgccauccacacccuccccacccaggaggagaucgagaaccuccccgccuucccccgcgagaagcucacccuccgccuccuccucggcuccggcgccuucggcgaggucuacgagggcaccgccgucgacauccucggcgucggcuccggcgagaucaaggucgccgucaagacccucaagaagggcuccaccgaccaggagaagaucgaguuccucaaggaggcccaccucauguccaaguucaaccaccccaacauccucaagcagcucggcgucugccuccucaacgagccccaguacaucauccucgagcucauggagggcggcgaccuccucaccuaccuccgcaaggcccgcauggccaccuucuacggcccccuccucacccucgucgaccucgucgaccucugcgucgacaucuccaagggcugcgucuaccucgagcgcaugcacuucauccaccgcgaccucgccgcccgcaacugccucgucuccgucaaggacuacaccuccccccgcaucgucaagaucggcgacuucggccucgcccgcgacaucuacaagaacgacuacuaccgcaagcgcggcgagggccuccuccccguccgcuggauggcccccgagucccucauggacggcaucuucaccacccaguccgacgucugguccuucggcauccucaucugggagauccucacccucggccaccagcccuaccccgcccacuccaaccucgacguccucaacuacguccagaccggcggccgccucgagcccccccgcaacugccccgacgaccucuggaaccucaugacccagugcugggcccaggagcccgaccagcgccccaccuuccaccgcauccaggaccagcuccagcucuuccgcaacuucuuccucaacuccaucuacaagucccgcgacgaggccaacaacuccggcgucaucaacgaguccuucgagggcgaggacggcgacgucaucugccucaacuccgacgacaucaugcccgucgcccucauggagaccaagaaccgcgagggccucaacuacaugguccucgccaccgagugcggccagggcgaggagaaguccgagggcccccucggcucccaggaguccgaguccugcggccuccgcaaggaggagaaggagccccacgccgacaaggacuucugccaggagaagcaggucgccuacugccccuccggcaagcccgagggccucaacuacgccugccucacccacuccggcuacggcgacggcuccgacuga

SEQ ID NO: 48896 - RNA, 6471 nt, Artificial Sequence
  derived and/or modified sequence opt2 from RP1__Homo_sapiens__NP_006260
auguccgacacccccuccaccggcuucuccaucauccaccccaccuccuccgagggccaggucccccccccccgccaccucucccucacccaccccgucgucgccaagcgcaucuccuucuacaaguccggcgacccccaguucggcggcguccgcgucgucgucaacccccgcuccuucaaguccuucgacgcccuccucgacaaccucucccgcaaggucccccuccccuucggcguccgcaacaucuccaccccccgcggccgccacuccaucacccgccucgaggagcucgaggacggcgaguccuaccucugcucccacggccgcaagguccagcccgucgaccucgacaaggcccgccgccgcccccgccccuggcucuccucccgcgccaucuccgcccacucccccccccaccccgucgccgucgccgcccccggcaugccccgccccccccgcucccucgucgucuuccgcaacggcgaccccaagacccgccgcgccguccuccucucccgccgcgucacccaguccuucgaggccuuccuccagcaccucaccgaggucaugcagcgccccgucgucaagcucuacgccaccgacggccgccgcguccccucccuccaggccgucauccucuccuccggcgccgucgucgccgccggccgcgagcccuucaagcccggcaacuacgacauccagaaguaccuccuccccgcccgccuccccggcaucucccagcgcgucuaccccaagggcaacgccaaguccgagucccgcaagaucuccacccacauguccuccuccucccgcucccagaucuacuccgucuccuccgagaagacccacaacaacgacugcuaccucgacuacuccuucguccccgagaaguaccucgcccucgagaagaacgacucccagaaccuccccaucuaccccuccgaggacgacaucgagaaguccaucaucuucaaccaggacggcaccaugaccgucgagaugaagguccgcuuccgcaucaaggaggaggagaccaucaaguggaccaccaccgucuccaagaccggccccuccaacaacgacgagaaguccgagauguccuuccccggccgcaccgagucccgcuccuccggccucaagcucgccgccugcuccuucuccgccgacgucucccccauggagcgcuccuccaaccaggagggcucccucgccgaggagaucaacauccagaugaccgaccaggucgccgagaccugcuccuccgccuccugggagaacgccaccgucgacaccgacaucauccagggcacccaggaccaggccaagcaccgcuucuaccgcccccccacccccggccuccgccgcguccgccagaagaaguccgucaucggcuccgucacccucgucuccgagaccgagguccaggagaagaugaucggccaguucuccuacuccgaggagcgcgaguccggcgagaacaaguccgaguaccacauguucacccacuccugcuccaagauguccuccgucuccaacaagcccguccucguccagaucaacaacaacgaccagauggaggaguccucccucgagcgcaagaaggagaacucccuccucaaguccuccgccaucuccgccggcgucaucgagaucaccucccagaagaugcucgagaugucccacaacaacggccuccccuccaccaucuccaacaacuccaucgucgaggaggacgucgucgacugcgucguccucgacaacaagaccggcaucaagaacuucaagaccuacggcaacaccaacgaccgcuucucccccaucuccgccgacgccacccacuucuccuccaacaacuccggcaccgacaagaacaucuccgaggcccccgccuccgaggccuccuccaccgucaccgcccgcaucgaccgccucaucaacgaguucgcccagugcggccucaccaagcuccccaagaacgagaagaagauccucuccuccgucgccuccaagaagaagaagaagucccgccagcaggccaucaacucccgcuaccaggacggccagcucgccaccaagggcauccucaacaagaacgagcgcaucaacaccaagggccgcaucaccaaggagaugaucguccaggacuccgacuccccccucaagggcggcauccucugcgaggaggaccuccagaaguccgacaccgucaucgaguccaacaccuucugcuccaaguccaaccucaacuccaccaucuccaagaacuuccaccgcaacaagcucaacaccacccagaacuccaagguccagggccuccucaccaagcgcaagucccgcucccucaacaagaucucccucggcgcccccaagaagcgcgagaucggccagcgcgacaaggucuucccccacaacgaguccaaguacugcaaguccaccuucgagaacaagucccucuuccacgucuucaacauccucgagcagaagcccaaggacuucuacgccccccagucccaggccgaggucgccuccggcuaccuccgcggcauggccaagaagucccucgucuccaaggucaccgacucccacaucacccucaagucccagaagaagcgcaagggcgacaaggucaaggccuccgccauccucuccaagcagcacgccaccacccgcgccaacucccucgccucccucaagaagcccgacuuccccgaggccaucgcccaccacuccauccagaacuacauccaguccuggcuccagaacaucaaccccuaccccacccucaagcccaucaaguccgcccccgucugccgcaacgagaccuccgucgucaacugcuccaacaacuccuucuccggcaacgacccccacaccaacuccggcaagaucuccaacuucgucauggaguccaacaagcacaucaccaagaucgccggccucaccggcgacaaccucugcaaggagggcgacaaguccuucaucgccaacgacaccggcgaggaggaccuccacgagacccaggucggcucccucaacgacgccuaccucgucccccuccacgagcacugcacccucucccaguccgccaucaacgaccacaacaccaagucccacaucgccgccgagaaguccggccccgagaagaagcucgucuaccaggagaucaaccucgcccgcaagcgccaguccgucgaggccgccauccaggucgaccccaucgaggaggagacccccaaggaccuccuccccguccucaugcuccaccagcuccaggccuccguccccggcauccacaagacccagaacggcgucguccagaugcccggcucccucgccggcguccccuuccacuccgccaucugcaacuccuccaccaaccuccuccucgccuggcuccucguccucaaccucaagggcuccaugaacuccuucugccaggucgacgcccacaaggccaccaacaaguccuccgagacccucgcccuccucgagauccucaagcacaucgccaucaccgaggaggccgacgaccucaaggccgccgucgccaaccucgucgaguccaccaccucccacuucggccucuccgagaaggagcaggacaugguccccaucgaccucuccgccaacugcuccaccgucaacauccaguccguccccaagugcuccgagaacgagcgcacccagggcaucuccucccucgacggcggcugcuccgccuccgaggccugcgcccccgaggucugcguccucgaggucaccugcucccccugcgagaugugcaccgucaacaaggccuacucccccaaggagaccugcaaccccuccgacaccuucuuccccuccgacggcuacggcgucgaccagaccuccaugaacaaggccugcuuccucggcgaggucugcucccucaccgacaccgucuucuccgacaaggccugcgcccagaaggagaaccacaccuacgagggcgccugccccaucgacgagaccuacguccccgucaacgucugcaacaccaucgacuuccucaacuccaaggagaacaccuacaccgacaaccucgacuccaccgaggagcucgagcgcggcgacgacauccagaaggaccucaacauccucaccgaccccgaguacaagaacggcuucaacacccucgucucccaccagaacgucuccaaccucuccuccugcggccucugccucuccgagaaggaggccgagcucgacaagaagcacuccucccucgacgacuucgagaacugcucccuccgcaaguuccaggacgagaacgccuacaccuccuucgacauggaggagccccgcaccuccgaggagcccggcuccaucaccaacuccaugaccuccuccgagcgcaacaucuccgagcucgaguccuucgaggagcucgagaaccacgacaccgacaucuucaacaccgucgucaacggcggcgagcaggccaccgaggagcucauccaggaggaggucgaggccuccaagacccucgagcucaucgacaucuccuccaagaacaucauggaggagaagcgcaugaacggcaucaucuacgagaucaucuccaagcgccucgccaccccccccucccucgacuucugcuacgacuccaagcagaacuccgagaaggagaccaacgagggcgagaccaagauggucaagaugauggucaagaccauggagaccggcuccuacuccgaguccucccccgaccucaagaagugcaucaagucccccgucaccuccgacugguccgacuaccgccccgacuccgacuccgagcagcccuacaagaccuccuccgacgaccccaacgacuccggcgagcucacccaggagaaggaguacaacaucggcuucgucaagcgcgccaucgagaagcucuacggcaaggccgacaucaucaagcccuccuucuuccccggcuccacccgcaagucccaggucugccccuacaacuccgucgaguuccagugcucccgcaaggccucccucuacgacuccgagggccaguccuucggcuccuccgagcaggucuccuccuccuccuccaugcuccaggaguuccaggaggagcgccaggacaagugcgacgucuccgccguccgcgacaacuacugccgcggcgacaucgucgagcccggcaccaagcagaacgacgacucccgcauccucaccgacaucgaggagggcguccucaucgacaagggcaaguggcuccucaaggagaaccaccuccuccgcauguccuccgagaaccccggcaugugcggcaacgccgacaccaccuccgucgacacccuccucgacaacaacuccuccgagguccccuacucccacuucggcaaccucgcccccggccccaccauggacgagcucuccuccuccgagcucgaggagcucacccagccccucgagcucaagugcaacuacuucaacaugccccacggcuccgacuccgagcccuuccacgaggaccuccucgacguccgcaacgagaccugcgccaaggagcgcaucgccaaccaccacaccgaggagaagggcucccaccaguccgagcgcgucugcaccuccgucacccacuccuucaucuccgccggcaacaaggucuaccccgucuccgacgacgccaucaagaaccagccccuccccggcuccaacaugauccacggcacccuccaggaggccgacucccucgacaagcucuacgcccucugcggccagcacugccccauccucaccgucaucauccagcccaugaacgaggaggaccgcggcuucgccuaccgcaaggaguccgacaucgagaacuuccucggcuucuaccucuggaugaagauccaccccuaccuccuccagaccgacaagaacgucuuccgcgaggagaacaacaaggccuccaugcgccagaaccucaucgacaacgccaucggcgacaucuucgaccaguucuacuucuccaacaccuucgaccucaugggcaagcgccgcaagcagaagcgcaucaacuuccucggccucgaggaggagggcaaccucaagaaguuccagcccgaccucaaggagcgcuucugcaugaacuuccuccacaccucccuccucgucgucggcaacgucgacuccaacacccaggaccucuccggccagaccaacgagaucuucaaggccgucgacgagaacaacaaccuccucaacaaccgcuuccagggcucccgcaccaaccucaaccaggucguccgcgagaacaucaacugccacuacuucuucgagaugcucggccaggccugccuccucgacaucugccaggucgagaccucccucaacaucuccaaccgcaacauccucgagcucugcauguucgagggcgagaaccucuucaucugggaggaggaggacauccucaaccucaccgaccucgaguccucccgcgagcaggaggaccucuga

SEQ ID NO: 48897 - RNA, 7203 nt, Artificial Sequence
  derived and/or modified sequence opt2 from RP1L1__Homo_sapiens__NP_849188
augaacuccaccccccgcaacgcccaggcccccucccaccgcgagugcuuccuccccuccgucgcccgcacccccuccgucaccaaggucacccccgccaagaagaucaccuuccucaagcgcggcgacccccgcuucgccggcguccgccucgccguccaccagcgcgccuucaagaccuucuccgcccucauggacgagcucucccagcgcgucccccucuccuucggcguccgcuccgucaccaccccccgcggccuccacucccucuccgcccucgagcagcucgaggacggcggcugcuaccucugcuccgacaagaagccccccaagacccccuccggccccggccgcccccaggagcgcaaccccaccgcccagcagcuccgcgacgucgagggccagcgcgaggcccccggcaccuccuccucccgcaagucccucaagaccccccgccgcauccuccucaucaagaacauggacccccgccuccagcagaccgucguccucucccaccgcaacacccgcaaccucgccgccuuccucggcaaggccuccgaccuccuccgcuuccccgucaagcagcucuacaccaccuccggcaagaaggucgacucccuccaggcccuccuccacucccccuccguccucgucugcgccggccacgaggccuuccgcacccccgccaugaagaacgcccgccgcuccgaggccgagacccucuccggccucaccucccgcaacaagaacggcuccuggggccccaagaccaagcccuccgucauccacucccgcuccccccccggcuccaccccccgccuccccgagcgccccggccccuccaacccccccgucggccccgcccccggccgccacccccaggacacccccgcccaguccggcccccucgucgccggcgacgacaugaagaagaagguccgcaugaacgaggacggcucccucuccgucgagaugaagguccgcuuccaccucgucggcgaggacacccuccucuggucccgccgcaugggccgcgccuccgcccucaccgccgccuccggcgaggaccccguccucggcgaggucgacccccucugcugcgucugggagggcuaccccuggggcuucuccgagcccggcgucuggggcccccgccccugccgcgucggcugccgcgaggucuucggccgcggcggccagcccggccccaaguacgagaucuggaccaacccccuccacgccucccagggcgagcgcgucgccgcccgcaagcgcuggggccucgcccagcacguccgcugcuccggccucuggggccacggcaccgccggccgcgagcgcugcucccaggacuccgccucccccgccuccuccaccggccuccccgagggcuccgagcccgaguccuccugcugcccccgcacccccgaggacggcgucgacuccgccucccccuccgcccagaucggcgccgagcgcaaggccggcggcucccucggcgaggaccccggccucugcaucgacggcgccggccucggcggccccgagcagggcggccgccucaccccccgcgcccgcuccgaggagggcgccuccuccgacuccuccgccuccaccggcucccacgagggcuccuccgaguggggcggccgcccccagggcugccccggcaaggcccgcgccgagaccucccagcaggaggccuccgagggcggcgaccccgccucccccgcccucucccucuccucccuccgcuccgacgaccuccaggccgagacccagggccagggcaccgagcaggccaccggcgccgccgucacccgcgagccccucguccucggccucuccugcuccugggacuccgagggcgccuccuccacccccuccaccugcaccuccucccagcagggccagcgccgccaccgcucccgcgccuccgccauguccucccccuccucccccggccucggccgcgucgccccccgcggccacccccgccacucccacuaccgcaaggacacccacuccccccucgacuccuccgucaccaagcaggucccccgcccccccgagcgccgccgcgccugccaggacggcuccgucccccgcuacuccggcuccuccuccuccacccgcacccaggccuccggcaaccuccgcccccccuccuccggcucccuccccucccaggaccuccucggcaccuccuccgccaccgucacccccgccguccacuccgacuucgucuccggcgucuccccccacaacgcccccuccgccggcugggccggcgacgccggcucccgcaccugcucccccgcccccauccccccccacaccuccgacuccugcuccaaguccggcgccgccucccucggcgaggaggcccgcgacaccccccagcccuccuccccccucguccuccaggucggccgccccgagcagggcgccgucggcccccaccgcucccacugcugcucccagcccggcacccagcccgcccaggaggcccagcgcggccccucccccgaggccuccuggcucugcggccgcuacugccccacccccccccgcggccgccccugcccccagcgccgcuccuccuccugcggcuccaccggcuccucccaccaguccaccgcccgcggccccggcggcuccccccaggagggcacccgccagcccggccccacccccucccccggccccaacuccggcgccucccgccgcuccuccgccucccagggcgccggcucccgcggccucuccgaggagaagacccuccgcuccggcggcggcccccagggccaggaggaggccuccggcgucucccccuccucccucccccgcuccucccccgaggccgucguccgcgaguggcucgacaacauccccgaggagcccauccucaugaccuacgagcucgccgacgagaccaccggcgccgccggcggcggccuccgcggccccgaggucgaccccggcgacgaccacucccucgagggccucggcgagcccgcccaggccggccagcagucccucgagggcgaccccggccaggaccccgagcccgagggcgcccuccucggcuccuccgacaccggcccccaguccggcgagggcgucccccagggcgccgcccccgagggcgucuccgaggcccccgccgaggccggcgccgaccgcgaggcccccgccggcugccgcgucucccuccgcgcccuccccggccgcgucuccgccuccacccagaucaugcgcgcccucaugggcuccaagcagggccgccccuccuccguccccgaggucucccgccccauggcccgccgccucuccugcuccgccggcgcccucaucaccugccucgccucccuccagcucuucgaggaggaccucggcucccccgccuccaagguccgcuucaaggacuccccccgcuaccaggagcuccucuccaucuccaaggaccucuggcccggcugcgacgucggcgaggaccagcucgacuccggccucugggagcucaccuggucccaggcccuccccgaccucggcucccacgccaugaccgagaacuucacccccaccuccuccuccggcgucgacaucuccuccggcuccggcggcuccggcgaguccuccguccccugcgccauggacggcacccucgucacccagggcaccgagcucccccucaagaccuccaaccagcgccccgacucccgcaccuacgagucccccggcgaccucgagaaccagcagcagugcugcuuccccaccuuccucaacgcccgcgccugcgccugcgccaccaacgaggacgaggccgagcgcgacuccgaggagcagcgcgccuccuccaaccucgagcagcucgccgagaacaccguccaggaggagguccagcucgaggagaccaaggagggcaccgagggcgagggccuccaggaggaggccguccagcucgaggagaccaagaccgaggagggccuccaggaggagggcguccagcucgaggagaccaaggagaccgagggcgagggccagcaggaggaggaggcccagcucgaggagaucgaggagaccggcggcgagggccuccaggaggagggcguccagcucgaggaggucaaggagggccccgagggcggccuccagggcgaggcccucgaggagggccucaaggaggagggccuccccgaggagggcuccguccacggccaggagcucuccgaggccuccucccccgacggcaagggcucccaggaggacgaccccguccaggaggaggaggccggccgcgccuccgccuccgccgagcccugccccgccgagggcaccgaggagcccaccgagccccccucccaccucuccgagaccgaccccuccgccuccgagcgccaguccggcucccagcucgagcccggccucgagaagccccccggcgccaccaugaugggccaggagcacacccaggcccagcccacccagggcgccgccgagcgcuccuccuccgucgccugcuccgccgcccucgacugcgaccccaucugggucuccguccuccucaagaagaccgagaaggccuuccucgcccaccucgccuccgccgucgccgagcuccgcgcccgcuggggccuccaggacaacgaccuccucgaccagauggccgccgagcuccagcaggacgucgcccagcgccuccaggacuccaccaagcgcgagcuccagaagcuccagggccgcgccggccgcaugguccucgagcccccccgcgaggcccucaccggcgagcuccuccuccagacccagcagcgccgccaccgccuccgcggccuccgcaaccucuccgccuucuccgagcgcacccucggccucggcccccucuccuucacccucgaggacgagcccgcccucuccaccgcccucggcucccagcucggcgaggaggccgagggcgaggaguucugccccugcgaggccugcguccgcaagaaggucucccccaugucccccaaggccaccaugggcgccacccgcggccccaucaaggaggccuucgaccuccagcagauccuccagcgcaagcgcggcgagcacaccgacggcgaggccgccgaggucgcccccggcaagacccacaccgaccccaccuccacccgcaccguccagggcgccgagggcggccucggccccggccucucccagggccccggcgucgacgagggcgaggacggcgagggcucccagcgccucaaccgcgacaaggaccccaagcucggcgaggccgagggcgacgccauggcccaggagcgcgagggcaagacccacaacuccgagaccuccgccggcuccgagcucggcgaggccgagcaggagggcgagggcaucuccgagcgcggcgagaccggcggccagggcuccggccacgaggacaaccuccagggcgaggccgccgccggcggcgaccaggaccccggccaguccgacggcgccgagggcaucgaggcccccgaggccgagggcgaggcccagcccgaguccgagggcgucgaggcccccgaggccgagggcgacgcccaggaggccgagggcgaggcccagcccgaguccgaggacgucgaggcccccgaggccgagggcgaggcccagcccgaguccgaggacgucgagacccccgaggccgagugggagguccagcccgaguccgagggcgccgaggcccccgaggccgagaaggaggcccagcccgagaccgaguccgucgaggcccucgagaccgagggcgaggacgagcccgaguccgagggcgccgaggcccaggaggccgaggaggccgcccaggaggccgagggccagacccagcccgaguccgaggucaucgagucccaggaggccgaggaggaggcccagcccgaguccgaggacgucgaggcccucgaggucgaggucgagacccaggaggccgagggcgaggcccagcccgaguccgaggacgucgaggcccccgaggccgagggcgagaugcaggaggccgaggaggaggcccagcccgaguccgacggcgucgaggcccagcccaaguccgagggcgaggaggcccaggaggucgagggcgagacccagaagaccgagggcgacgcccagcccgaguccgacggcgucgaggcccccgaggccgaggaggaggcccaggaggccgagggcgagguccaggaggccgagggcgaggcccaccccgaguccgaggacgucgacgcccaggaggccgagggcgaggcccagcccgaguccgagggcgucgaggcccccgaggccgagggcgaggcccagaaggccgagggcaucgaggcccccgagaccgagggcgaggcccagcccgaguccgagggcaucgaggcccccgaggccgagggcgaggcccagcccgaguccgagggcgucgaggcccaggacgccgagggcgaggcccagcccgaguccgagggcaucgaggcccaggaggccgaggaggaggcccagcccgagcucgagggcgucgaggcccccgaggccgagggcgaggcccagcccgaguccgagggcaucgaggcccccgaggccgagggcgaggcccagcccgagcucgagggcgucgaggcccccgaggccgaggaggaggcccagcccgagcccgagggcgucgagacccccgaggccgagggcgaggcccagcccgaguccgagggcgagacccagggcgagaagaagggcuccccccaggucucccucggcgacggccaguccgaggaggccuccgaguccuccucccccguccccgaggaccgccccacccccccccccucccccggcggcgacaccccccaccagcgccccggcucccagaccggccccuccuccucccgcgccuccuccuggggcaacugcuggcagaaggacuccgagaacgaccacguccucggcgacacccgcucccccgacgccaaguccaccggcaccccccacgccgagcgcaaggccacccgcauguaccccgaguccuccaccuccgagcaggaggaggccccccucggcucccgcacccccgagcagggcgccuccgagggcuacgaccuccaggaggaccaggcccucggcucccucgcccccaccgaggccgucggccgcgccgacggcuucggccaggacgaccucgacuucuga

SEQ ID NO: 48898 - RNA, 1053 nt, Artificial Sequence
  derived and/or modified sequence opt2 from RP2__Homo_sapiens__NP_008846
augggcugcuucuucuccaagcgccgcaaggccgacaaggagucccgccccgagaacgaggaggagcgccccaagcaguacuccugggaccagcgcgagaaggucgaccccaaggacuacauguucuccggccucaaggacgagaccgucggccgccuccccggcaccgucgccggccagcaguuccucauccaggacugcgagaacugcaacaucuacaucuucgaccacuccgccaccgucaccaucgacgacugcaccaacugcaucaucuuccucggccccgucaagggcuccgucuucuuccgcaacugccgcgacugcaagugcacccucgccugccagcaguuccgcguccgcgacugccgcaagcucgaggucuuccucugcugcgccacccagcccaucaucgaguccuccuccaacaucaaguucggcugcuuccagugguacuaccccgagcucgccuuccaguucaaggacgccggccucuccaucuucaacaacaccugguccaacauccacgacuucacccccgucuccggcgagcucaacuggucccuccuccccgaggacgccgucguccaggacuacguccccauccccaccaccgaggagcucaaggccguccgcgucuccaccgaggccaaccgcuccaucguccccaucucccgcggccagcgccagaaguccuccgacgaguccugccucgucguccucuucgccggcgacuacaccaucgccaacgcccgcaagcucaucgacgagauggucggcaagggcuucuuccucguccagaccaaggaggucuccaugaaggccgaggacgcccagcgcgucuuccgcgagaaggcccccgacuuccucccccuccucaacaagggccccgucaucgcccucgaguucaacggcgacggcgccgucgaggucugccagcucaucgucaacgagaucuucaacggcaccaagauguucgucuccgaguccaaggagaccgccuccggcgacgucgacuccuucuacaacuucgccgacauccagaugggcaucuga

SEQ ID NO: 48899 - RNA, 666 nt, Artificial Sequence
  derived and/or modified sequence opt2 from RP9__Homo_sapiens__NP_976033
auguccucccgccccggccgcgaggacgucggcgccgccggcgcccgccgcccccgcgagccccccgagcaggagcuccagcgccgccgcgagcagaagcgccgccgccacgacgcccagcagcuccagcagcucaagcaccucgaguccuucuacgagaagcccccccccggccucaucaaggaggacgagaccaagcccgaggacugcauccccgacguccccggcaacgagcacgcccgcgaguuccucgcccacgcccccaccaagggccucuggaugccccucggcaaggaggucaaggucaugcagugcuggcgcugcaagcgcuacggccaccgcaccggcgacaaggagugccccuucuucaucaagggcaaccagaagcucgagcaguuccgcgucgcccacgaggaccccauguacgacaucauccgcgacaacaagcgccacgagaaggacguccgcauccagcagcucaagcagcuccucgaggacuccaccuccgacgaggaccgcuccuccuccuccuccuccgagggcaaggagaagcacaagaagaagaagaagaaggagaagcacaagaagcgcaagaaggagaagaagaagaagaagaagcgcaagcacaaguccuccaaguccaacgagggcuccgacuccgaguga

SEQ ID NO: 48900 - RNA, 1851 nt, Artificial Sequence
  derived and/or modified sequence opt2 from RPA1__Homo_sapiens__NP_002936
auggucggccagcucuccgagggcgccaucgccgccaucaugcagaagggcgacaccaacaucaagcccauccuccaggucaucaacauccgccccaucaccaccggcaacucccccccccgcuaccgccuccucauguccgacggccucaacacccucuccuccuucaugcucgccacccagcucaacccccucgucgaggaggagcagcucuccuccaacugcgucugccagauccaccgcuucaucgucaacacccucaaggacggccgccgcgucgucauccucauggagcucgagguccucaaguccgccgaggccgucggcgucaagaucggcaaccccguccccuacaacgagggccucggccagccccaggucgccccccccgcccccgccgccucccccgccgccuccucccgcccccagccccagaacggcuccuccggcaugggcuccaccgucuccaaggccuacggcgccuccaagaccuucggcaaggccgccggccccucccucucccacaccuccggcggcacccaguccaaggucguccccaucgccucccucacccccuaccaguccaaguggaccaucugcgcccgcgucaccaacaagucccagauccgcaccugguccaacucccgcggcgagggcaagcucuucucccucgagcucgucgacgaguccggcgagauccgcgccaccgccuucaacgagcaggucgacaaguucuucccccucaucgaggucaacaaggucuacuacuucuccaagggcacccucaagaucgccaacaagcaguucaccgccgucaagaacgacuacgagaugaccuucaacaacgagaccuccgucaugcccugcgaggacgaccaccaccuccccaccguccaguucgacuucaccggcaucgacgaccucgagaacaaguccaaggacucccucgucgacaucaucggcaucugcaaguccuacgaggacgccaccaagaucaccguccgcuccaacaaccgcgaggucgccaagcgcaacaucuaccucauggacaccuccggcaaggucgucaccgccacccucuggggcgaggacgccgacaaguucgacggcucccgccagcccguccucgccaucaagggcgcccgcgucuccgacuucggcggccgcucccucuccguccucuccuccuccaccaucaucgccaaccccgacauccccgaggccuacaagcuccgcggcugguucgacgccgagggccaggcccucgacggcgucuccaucuccgaccucaaguccggcggcgucggcggcuccaacaccaacuggaagacccucuacgaggucaaguccgagaaccucggccagggcgacaagcccgacuacuucuccuccgucgccaccgucgucuaccuccgcaaggagaacugcauguaccaggccugccccacccaggacugcaacaagaaggucaucgaccagcagaacggccucuaccgcugcgagaagugcgacaccgaguuccccaacuucaaguaccgcaugauccucuccgucaacaucgccgacuuccaggagaaccagugggucaccugcuuccaggaguccgccgaggccauccucggccagaacgccgccuaccucggcgagcucaaggacaagaacgagcaggccuucgaggaggucuuccagaacgccaacuuccgcuccuucaucuuccgcguccgcgucaaggucgagaccuacaacgacgagucccgcaucaaggccaccgucauggacgucaagcccgucgacuaccgcgaguacggccgccgccucgucauguccauccgccgcuccgcccucauguga

SEQ ID NO: 48901 - RNA, 837 nt, Artificial Sequence
  derived and/or modified sequence opt2 from RPA2__Homo_sapiens__NP_001284487
augggccgcggcgaccgcaacaagcgcuccauccgcggcuucgaguccuacggcuccuccuccuacggcggcgccggcggcuacacccagucccccggcggcuucggcucccccgcccccucccaggccgagaagaagucccgcgcccgcgcccagcacaucguccccugcaccaucucccagcuccucuccgccacccucgucgacgaggucuuccgcaucggcaacgucgagaucucccaggucaccaucgucggcaucauccgccacgccgagaaggcccccaccaacaucgucuacaagaucgacgacaugaccgccgcccccauggacguccgccagugggucgacaccgacgacaccuccuccgagaacaccgucgucccccccgagaccuacgucaaggucgccggccaccuccgcuccuuccagaacaagaagucccucgucgccuucaagaucaugccccucgaggacaugaacgaguucaccacccacauccucgaggucaucaacgcccacaugguccucuccaaggccaacucccagcccuccgccggccgcgcccccaucuccaaccccggcauguccgaggccggcaacuucggcggcaacuccuucaugcccgccaacggccucaccgucgcccagaaccagguccucaaccucaucaaggccugcccccgccccgagggccucaacuuccaggaccucaagaaccagcucaagcacauguccgucuccuccaucaagcaggccgucgacuuccucuccaacgagggccacaucuacuccaccgucgacgacgaccacuucaaguccaccgacgccgaguga

SEQ ID NO: 48902 - RNA, 366 nt, Artificial Sequence
  derived and/or modified sequence opt2 from RPA3__Homo_sapiens__NP_002938
auggucgacaugauggaccucccccgcucccgcaucaacgccggcaugcucgcccaguucaucgacaagcccgucugcuucgucggccgccucgagaagauccaccccaccggcaagauguucauccucuccgacggcgagggcaagaacggcaccaucgagcucauggagccccucgacgaggagaucuccggcaucgucgaggucgucggccgcgucaccgccaaggccaccauccucugcaccuccuacguccaguucaaggaggacucccaccccuucgaccucggccucuacaacgaggccgucaagaucauccacgacuucccccaguucuacccccucggcaucguccagcacgacuga

SEQ ID NO: 48903 - RNA, 786 nt, Artificial Sequence
  derived and/or modified sequence opt2 from RPA4__Homo_sapiens__NP_037479
auguccaaguccggcuucggcuccuacggcuccaucuccgccgccgacggcgccuccggcggcuccgaccagcucugcgagcgcgacgccacccccgccaucaagacccagcgccccaagguccgcauccaggacgucguccccugcaacgucaaccagcuccucuccuccaccgucuucgaccccgucuucaagguccgcggcaucaucgucucccaggucuccaucgucggcgucauccgcggcgccgagaaggccuccaaccacaucugcuacaagaucgacgacaugaccgccaagcccaucgaggcccgccagugguucggccgcgagaaggucaagcaggucaccccccucuccgucggcgucuacgucaaggucuucggcauccucaagugccccaccggcaccaagucccucgagguccucaagauccacguccucgaggacaugaacgaguucaccguccacauccucgagaccgucaacgcccacaugaugcucgacaaggcccgccgcgacaccaccgucgaguccguccccgucucccccuccgaggucaacgacgccggcgacaacgacgagucccaccgcaacuucauccaggacgagguccuccgccucauccacgagugcccccaccaggagggcaaguccauccacgagcuccgcgcccagcucugcgaccucuccgucaaggccaucaaggaggccaucgacuaccucaccgucgagggccacaucuaccccaccgucgaccgcgagcacuucaaguccgccgacuga

SEQ ID NO: 48904 - RNA, 660 nt, Artificial Sequence
  derived and/or modified sequence opt2 from RPAIN__Homo_sapiens__NP_001028174
auggccgagucccuccgcuccccccgccgcucccucuacaagcucgucggcuccccccccuggaaggaggccuuccgccagcgcugccucgagcgcaugcgcaacucccgcgaccgccuccucaaccgcuaccgccaggccggcuccuccggccccggcaacucccagaacuccuuccucguccaggaggucauggaggaggaguggaacgcccuccaguccgucgagaacugccccgaggaccucgcccagcucgaggagcucaucgacauggccguccucgaggagauccagcaggagcucaucaaccaggagcaguccaucaucuccgaguacgagaagucccuccaguucgacgagaagugccucuccaucaugcucgccgagugggaggccaacccccucaucugccccgucugcaccaaguacaaccuccgcaucaccuccggcgucgucgucugccagugcggccucuccauccccucccacuccuccgagcucaccgagcagaagcuccgcgccugccucgagggcuccaucaacgagcacuccgcccacugcccccacacccccgaguucuccgucaccggcggcaccgaggagaaguccucccuccucauguccugccucgccugcgacaccugggccgucauccucuga

SEQ ID NO: 48905 - RNA, 4182 nt, Artificial Sequence
  derived and/or modified sequence opt2 from RPAP1__Homo_sapiens__NP_056355
augcucucccgccccaagcccggcgaguccgaggucgaccuccuccacuuccagucccaguuccucgccgccggcgccgcccccgccguccagcucgucaagaagggcaaccgcggcggcggcgacgccaacuccgaccgccccccccuccaggaccaccgcgacgucgucaugcucgacaaccuccccgaccucccccccgcccucguccccuccccccccaagcgcgcccgccccucccccggccacugccuccccgaggacgaggaccccgaggagcgccuccgccgccacgaccagcacaucaccgccguccucaccaagaucaucgagcgcgacaccuccuccgucgccgucaaccuccccguccccuccggcgucgccuuccccgccgucuuccuccgcucccgcgacacccagggcaaguccgccaccuccggcaagcgcuccaucuucgcccaggagaucgccgcccgccgcaucgccgaggccaagggccccuccgucggcgaggucguccccaacgucggcccccccgagggcgccgucaccugcgagacccccaccccccgcaaccagggcugccagcuccccggcuccucccacuccuuccagggccccaaccucgucaccggcaagggccuccgcgaccaggaggccgagcaggaggcccagaccauccacgaggagaacaucgcccgccuccaggccauggcccccgaggagauccuccaggagcagcagcgccuccucgcccagcucgaccccucccucgucgccuuccuccgcucccacucccacacccaggagcagaccggcgagaccgccuccgaggagcagcgccccggcggccccuccgccaacgucaccaaggaggagccccucauguccgccuucgccuccgagccccgcaagcgcgacaagcucgagcccgaggcccccgcccucgcccuccccgucaccccccagaaggaguggcuccacauggacaccgucgagcucgagaagcuccacuggacccaggaccucccccccguccgccgccagcagacccaggagcgcaugcaggcccgcuucucccuccagggcgagcuccucgcccccgacgucgaccuccccacccaccucggccuccaccaccacggcgaggaggccgagcgcgccggcuacucccuccaggagcucuuccaccucacccgcucccaggucucccagcagcgcgcccucgcccuccacguccucgcccaggucaucucccgcgcccaggccggcgaguucggcgaccgccucgccggcuccguccucucccuccuccucgacgccggcuuccucuuccuccuccgcuucucccucgacgaccgcgucgacggcgucaucgccaccgccauccgcgcccuccgcgcccuccucgucgcccccggcgacgaggagcuccucgacuccaccuucuccugguaccacggcgcccucaccuucccccucaugcccucccaggaggacaaggaggacgaggacgaggacgaggagugccccgccggcaaggccaagcgcaagucccccgaggaggagucccgccccccccccgaccucgcccgccacgacgucaucaagggccuccucgccaccucccuccucccccgccuccgcuacguccucgaggucaccuaccccggccccgccgucguccucgacauccucgccguccucauccgccucgcccgccacucccucgaguccgccacccgcguccucgagugcccccgccucaucgagaccaucguccgcgaguuccuccccaccuccuggucccccgucggcgccggccccacccccucccucuacaagguccccugcgccaccgccaugaagcuccuccgcguccucgccuccgccggccgcaacaucgccgcccgccuccucuccuccuucgaccuccgcucccgccucugccgcaucaucgccgaggccccccaggagcucgcccucccccccgaggaggccgagaugcucuccaccgaggcccuccgccucugggccgucgccgccuccuacggccagggcggcuaccucuaccgcgagcucuaccccguccucaugcgcgcccuccaggucgucccccgcgagcucuccacccaccccccccagccccucuccaugcagcgcaucgccucccuccucacccuccucacccagcucacccucgccgccggcuccacccccgccgagaccaucuccgacuccgccgaggccucccucuccgccacccccucccucgucaccuggacccaggucuccggccuccagccccucgucgagcccugccuccgccagacccucaagcuccucucccgccccgagauguggcgcgccgucggccccguccccgucgccugccuccucuuccucggcgccuacuaccaggccuggucccagcagcccuccuccugccccgaggacuggcuccaggacaugcagcgccucuccgaggagcuccuccucccccuccucucccagcccacccucggcucccucugggacucccuccgccacugcucccuccucugcaacccccucuccugcguccccgcccucgaggccccccccucccucgucucccucggcugcuccggcggcugcccccgccucucccucgccggcuccgccucccccuuccccuuccucaccgcccuccucucccuccucaacacccucgcccagauccacaagggccucugcggccagcucgccgccauccucgccgcccccggccuccagaacuacuuccuccagugcgucgcccccggcgccgccccccaccucacccccuucuccgccugggcccuccgccacgaguaccaccuccaguaccucgcccucgcccucgcccagaaggccgccgcccuccagccccuccccgccacccacgccgcccucuaccacggcauggcccucgcccuccucucccgccuccuccccggcuccgaguaccucacccacgagcuccuccucuccugcgucuuccgccucgaguuccuccccgagcgcaccuccggcggccccgaggccgccgacuucuccgaccagcucucccucggcuccucccgcgucccccgcugcggccagggcacccuccucgcccaggccugccaggaccuccccuccauccgcaacugcuaccucacccacugcucccccgcccgcgccucccuccucgccucccaggcccuccaccgcggcgagcuccagcgcguccccacccuccuccuccccaugcccaccgagccccuccuccccaccgacuggcccuuccucccccucauccgccucuaccaccgcgccuccgacacccccuccggccucucccccaccgacaccaugggcaccgccaugcgcguccuccaguggguccucguccucgaguccuggcgcccccaggcccucugggccgucccccccgccgcccgccucgcccgccucaugugcgucuuccucgucgacuccgagcucuuccgcgagucccccguccagcaccucgucgccgcccuccucgcccagcucugccagccccagguccuccccaaccucaaccucgacugccgccuccccggccucaccuccuuccccgaccucuacgccaacuuccucgaccacuucgaggccgucuccuucggcgaccaccucuucggcgcccucguccuccucccccuccagcgccgcuucuccgucacccuccgccucgcccucuucggcgagcacgucggcgcccuccgcgcccucucccucccccucacccagcuccccgucucccucgagugcuacaccgucccccccgaggacaaccucgcccuccuccagcucuacuuccgcacccucgucaccggcgcccuccgcccccgcuggugccccguccucuacgccgucgccgucgcccacgucaacuccuucaucuucucccaggacccccaguccuccgacgaggucaaggccgcccgccgcuccaugcuccagaagaccuggcuccucgccgacgagggccuccgccagcaccuccuccacuacaagcuccccaacuccacccuccccgagggcuucgagcucuacucccagcuccccccccuccgccagcacuaccuccagcgccucaccuccaccguccuccagaacggcgucuccgagaccuga

SEQ ID NO: 48906 - RNA, 600 nt, Artificial Sequence
  derived and/or modified sequence opt2 from RPE__Homo_sapiens__NP_001265214
auggccuccggcugcaagaucggccccuccauccucaacuccgaccucgccaaccucggcgccgagugccuccgcaugcucgacuccggcgccgacuaccuccaccucgacgucauggacggccacuucguccccaacaucaccuucggccaccccgucgucgagucccuccgcaagcagcucggccaggaccccuucuucgacaugcacaugauggucuccaagcccgagcagugggucaagcccauggccgucgccggcgccaaccaguacaccuuccaccucgaggccaccgagaaccccggcgcccucaucaaggacauccgcgagaacggcaugaaggucggccucgccaucaagcccggcaccuccgucgaguaccucgcccccugggccaaccagaucgacauggcccucgucaugaccgucgagcccggcuucggcggccagaaguucauggaggacaugaugcccaaggccggcgccaacaugaucgucuccggcuccgccaucaugcgcuccgaggacccccgcuccgucaucaaccuccuccgcaacgucugcuccgaggccgcccagaagcgcucccucgaccgcuga

SEQ ID NO: 48907 - RNA, 2448 nt, Artificial Sequence
  derived and/or modified sequence opt2 from RPGR__Homo_sapiens__NP_000319
augcgcgagcccgaggagcucaugcccgacuccggcgccgucuucaccuucggcaaguccaaguucgccgagaacaaccccggcaaguucugguucaagaacgacguccccguccaccucuccugcggcgacgagcacuccgccgucgucaccggcaacaacaagcucuacauguucggcuccaacaacuggggccagcucggccucggcuccaaguccgccaucuccaagcccaccugcgucaaggcccucaagcccgagaaggucaagcucgccgccugcggccgcaaccacacccucgucuccaccgagggcggcaacgucuacgccaccggcggcaacaacgagggccagcucggccucggcgacaccgaggagcgcaacaccuuccacgucaucuccuucuucaccuccgagcacaagaucaagcagcucuccgccggcuccaacaccuccgccgcccucaccgaggacggccgccucuucauguggggcgacaacuccgagggccagaucggccucaagaacgucuccaacgucugcgucccccagcaggucaccaucggcaagcccgucuccuggaucuccugcggcuacuaccacuccgccuucgucaccaccgacggcgagcucuacgucuucggcgagcccgagaacggcaagcucggccuccccaaccagcuccucggcaaccaccgcaccccccagcucgucuccgagauccccgagaaggucauccaggucgccugcggcggcgagcacaccgucguccucaccgagaacgccgucuacaccuucggccucggccaguucggccagcucggccucggcaccuuccucuucgagaccuccgagcccaaggucaucgagaacauccgcgaccagaccaucuccuacaucuccugcggcgagaaccacaccgcccucaucaccgacaucggccucauguacaccuucggcgacggccgccacggcaagcucggccucggccucgagaacuucaccaaccacuucauccccacccucugcuccaacuuccuccgcuucaucgucaagcucgucgccugcggcggcugccacauggucgucuucgccgccccccaccgcggcgucgccaaggagaucgaguucgacgagaucaacgacaccugccucuccgucgccaccuuccuccccuacuccucccucaccuccggcaacguccuccagcgcacccucuccgcccgcaugcgccgccgcgagcgcgagcgcucccccgacuccuucuccaugcgccgcacccucccccccaucgagggcacccucggccucuccgccugcuuccuccccaacuccgucuucccccgcugcuccgagcgcaaccuccaggaguccguccucuccgagcaggaccucaugcagcccgaggagcccgacuaccuccucgacgagaugaccaaggaggccgagaucgacaacuccuccaccgucgagucccucggcgagaccaccgacauccucaacaugacccacaucaugucccucaacuccaacgagaagucccucaagcucucccccguccagaagcagaagaagcagcagaccaucggcgagcucacccaggacaccgcccucaccgagaacgacgacuccgacgaguacgaggagauguccgagaugaaggagggcaaggccugcaagcagcacgucucccagggcaucuucaugacccagcccgccaccaccaucgaggccuucuccgacgaggaggucgagauccccgaggagaaggagggcgccgaggacuccaagggcaacggcaucgaggagcaggaggucgaggccaacgaggagaacgucaagguccacggcggccgcaaggagaagaccgagauccucuccgacgaccucaccgacaaggccgaggaccacgaguucuccaagaccgaggagcucaagcucgaggacgucgacgaggagaucaacgccgagaacgucgaguccaagaagaagaccgucggcgacgacgaguccguccccaccggcuaccacuccaagaccgagggcgccgagcgcaccaacgacgacuccuccgccgagaccaucgagaagaaggagaaggccaaccucgaggagcgcgccaucugcgaguacaacgagaaccccaagggcuacaugcucgacgacgccgacuccuccucccucgagauccucgagaacuccgagaccacccccuccaaggacaugaagaagaccaagaagaucuuccucuucaagcgcguccccuccaucaaccagaagaucgucaagaacaacaacgagccccuccccgagaucaaguccaucggcgaccagaucauccucaaguccgacaacaaggacgccgaccagaaccacaugucccagaaccaccagaacaucccccccaccaacaccgagcgccgcuccaaguccugcaccauccucuga

SEQ ID NO: 48908 - RNA, 3861 nt, Artificial Sequence
  derived and/or modified sequence opt2 from RPGRIP1__Homo_sapiens__NP_065099
augucccaccucgucgaccccaccuccggcgaccuccccguccgcgacaucgacgccaucccccucguccuccccgccuccaagggcaagaacaugaagacccagcccccccucucccgcaugaaccgcgaggagcucgaggacuccuucuuccgccuccgcgaggaccacaugcucgucaaggagcucuccuggaagcagcaggacgagaucaagcgccuccgcaccacccuccuccgccucaccgccgccggccgcgaccuccgcgucgccgaggaggccgccccccucuccgagaccgcccgccgcggccagaaggccggcuggcgccagcgccucuccaugcaccagcgcccccagaugcaccgccuccagggccacuuccacugcgucggccccgccuccccccgccgcgcccagccccgcguccaggucggccaccgccagcuccacaccgccggcgcccccguccccgagaagcccaagcgcggcccccgcgaccgccucuccuacaccgccccccccuccuucaaggagcacgccaccaacgagaaccgcggcgaggucgccuccaagcccuccgagcucgucuccggcuccaacuccaucaucuccuucuccuccgucaucuccauggccaagcccaucggccucugcaugcccaacuccgcccacaucauggccuccaacaccaugcaggucgaggagccccccaagucccccgagaagauguggcccaaggacgagaacuucgagcagcgcuccucccucgagugcgcccagaaggccgccgagcuccgcgccuccaucaaggagaaggucgagcucauccgccucaagaagcuccuccacgagcgcaacgccucccucgucaugaccaaggcccagcucaccgagguccaggaggccuacgagacccuccuccagaagaaccagggcauccucuccgccgcccacgaggcccuccucaagcaggucaacgagcuccgcgccgagcucaaggaggaguccaagaaggccgucucccucaagucccagcucgaggacgucuccauccuccagaugacccucaaggaguuccaggagcgcgucgaggaccucgagaaggagcgcaagcuccucaacgacaacuacgacaagcuccucgaguccaugcucgacuccuccgacuccuccucccagccccacugguccaacgagcucaucgccgagcagcuccagcagcaggucucccagcuccaggaccagcucgacgccgagcucgaggacaagcgcaagguccuccucgagcucucccgcgagaaggcccagaacgaggaccucaagcucgaggucaccaacauccuccagaagcacaagcaggaggucgagcuccuccagaacgccgccaccaucucccagccccccgaccgccaguccgagcccgccacccaccccgccguccuccaggagaacacccagaucgagcccuccgagcccaagaaccaggaggagaagaagcucucccagguccucaacgagcuccaggucucccacgccgagaccacccucgagcucgagaagacccgcgacaugcucauccuccagcgcaagaucaacgucugcuaccaggaggagcucgaggccaugaugaccaaggccgacaacgacaaccgcgaccacaaggagaagcucgagcgccucacccgccuccucgaccucaagaacaaccgcaucaagcagcucgagggcauccuccgcucccacgaccuccccaccuccgagcagcucaaggacgucgccuacggcacccgcccccucucccucugccucgagacccuccccgcccacggcgacgaggacaaggucgacaucucccuccuccaccagggcgagaaccucuucgagcuccacauccaccaggccuuccucaccuccgccgcccucgcccaggccggcgacacccagcccaccaccuucugcaccuacuccuucuacgacuucgagacccacugcaccccccucuccgucggcccccagccccucuacgacuucaccucccaguacgucauggagaccgacucccucuuccuccacuaccuccaggaggccuccgcccgccucgacauccaccaggccauggccuccgagcacuccacccucgccgccggcuggaucugcuucgaccgcguccucgagaccgucgagaagguccacggccucgccacccucaucggcgccggcggcgaggaguucggcguccucgaguacuggaugcgccuccgcuuccccaucaagcccucccuccaggccugcaacaagcgcaagaaggcccaggucuaccucuccaccgacguccucggcggccgcaaggcccaggaggaggaguuccgcuccgaguccugggagccccagaacgagcucuggaucgagaucaccaagugcugcggccuccgcucccgcuggcucggcacccagcccucccccuacgccgucuaccgcuucuucaccuucuccgaccacgacaccgccaucauccccgccuccaacaaccccuacuuccgcgaccaggcccgcuuccccguccucgucaccuccgaccucgaccacuaccuccgccgcgaggcccucuccauccacgucuucgacgacgaggaccucgagcccggcuccuaccucggccgcgcccgcgucccccuccucccccucgccaagaacgaguccaucaagggcgacuucaaccucaccgaccccgccgagaagcccaacggcuccauccagguccagcucgacuggaaguuccccuacaucccccccgaguccuuccucaagcccgaggcccagaccaagggcaaggacaccaaggacuccuccaagaucuccuccgaggaggagaaggccuccuuccccucccaggaccagauggccucccccgagguccccaucgaggccggccaguaccgcuccaagcgcaagcccccccacggcggcgagcgcaaggagaaggagcaccaggucgucuccuacucccgccgcaagcacggcaagcgcaucggcguccagggcaagaaccgcauggaguaccucucccucaacauccucaacggcaacacccccgagcaggucaacuacaccgaguggaaguucuccgagaccaacuccuucaucggcgacggcuucaagaaccagcacgaggaggaggagaugacccucucccacuccgcccucaagcagaaggagccccuccaccccgucaacgacaaggaguccuccgagcagggcuccgaggucuccgaggcccagaccaccgacuccgacgacgucaucgucccccccaugucccagaaguaccccaaggccgacuccgagaagaugugcaucgagaucgucucccucgccuucuaccccgaggccgaggucauguccgacgagaacaucaagcaggucuacgucgaguacaaguucuacgaccucccccucuccgagaccgagacccccgucucccuccgcaagccccgcgccggcgaggagauccacuuccacuucuccaaggucaucgaccucgacccccaggagcagcagggccgccgccgcuuccucuucgacaugcucaacggccaggaccccgaccagggccaccucaaguucaccgucgucuccgacccccucgacgaggagaagaaggagugcgaggaggucggcuacgccuaccuccagcucuggcagauccucgaguccggccgcgacauccucgagcaggagcucgacaucgucucccccgaggaccucgccacccccaucggccgccucaaggucucccuccaggccgccgccguccuccacgccaucuacaaggagaugaccgaggaccucuucuccuga

SEQ ID NO: 48909 - RNA, 3708 nt, Artificial Sequence
  derived and/or modified sequence opt2 from RPGRIP1L__Homo_sapiens__NP_001121369
auguccggccccaccgacgagaccgccggcgaccuccccgucaaggacaccggccucaaccucuucggcaugggcggccuccaggagaccuccaccacccgcaccaugaagucccgccaggccgucucccgcgucucccgcgaggagcucgaggaccgcuuccuccgccuccacgacgagaacauccuccucaagcagcacgcccgcaagcaggaggacaagaucaagcgcauggccaccaagcucauccgccucgucaacgacaagaagcgcuacgagcgcgucggcggcggccccaagcgccucggccgcgacgucgagauggaggagaugaucgagcagcuccaggagaagguccacgagcucgagaagcagaacgagacccucaagaaccgccucaucuccgccaagcagcagcuccagacccagggcuaccgccagacccccuacaacaacguccagucccgcaucaacaccggccgccgcaaggccaacgagaacgccggccuccaggagugcccccgcaagggcaucaaguuccaggacgccgacgucgccgagaccccccaccccauguucaccaaguacggcaacucccuccucgaggaggcccgcggcgagauccgcaaccucgagaacgucauccagucccagcgcggccagaucgaggagcucgagcaccucgccgagauccucaagacccagcuccgccgcaaggagaacgagaucgagcucucccuccuccagcuccgcgagcagcaggccaccgaccagcgcuccaacauccgcgacaacgucgagaugaucaagcuccacaagcagcucgucgagaaguccaacgcccucuccgccauggagggcaaguucauccagcuccaggagaagcagcgcacccuccgcaucucccacgacgcccucauggccaacggcgacgagcucaacaugcagcucaaggagcagcgccucaagugcugcucccucgagaagcagcuccacuccaugaaguucuccgagcgccgcaucgaggagcuccaggaccgcaucaacgaccucgagaaggagcgcgagcuccucaaggagaacuacgacaagcucuacgacuccgccuucuccgccgcccacgaggagcaguggaagcucaaggagcagcagcucaagguccagaucgcccagcucgagaccgcccucaaguccgaccucaccgacaagaccgagauccucgaccgccucaagaccgagcgcgaccagaacgagaagcucguccaggagaaccgcgagcuccagcuccaguaccucgagcagaagcagcagcucgacgagcucaagaagcgcaucaagcucuacaaccaggagaacgacaucaacgccgacgagcucuccgaggcccuccuccucaucaaggcccagaaggagcagaagaacggcgaccucuccuuccucgucaaggucgacuccgagaucaacaaggaccucgagcgcuccaugcgcgagcuccaggccacccacgccgagaccguccaggagcucgagaagacccgcaacaugcucaucaugcagcacaagaucaacaaggacuaccagauggaggucgaggccgucacccgcaagauggagaaccuccagcaggacuacgagcucaaggucgagcaguacguccaccuccucgacauccgcgccgcccgcauccacaagcucgaggcccagcucaaggacaucgccuacggcaccaagcaguacaaguucaagcccgagaucaugcccgacgacuccgucgacgaguucgacgagaccauccaccucgagcgcggcgagaaccucuucgagauccacaucaacaaggucaccuucuccuccgagguccuccaggccuccggcgacaaggagcccgucaccuucugcaccuacgccuucuacgacuucgagcuccagaccacccccgucguccgcggccuccaccccgaguacaacuucaccucccaguaccucguccacgucaacgaccucuuccuccaguacauccagaagaacaccaucacccucgagguccaccaggccuacuccaccgaguacgagaccaucgccgccugccagcucaaguuccacgagauccucgagaaguccggccgcaucuucugcaccgccucccucaucggcaccaagggcgacauccccaacuucggcaccgucgaguacugguuccgccuccgcguccccauggaccaggccauccgccucuaccgcgagcgcgccaaggcccucggcuacaucaccuccaacuucaagggccccgagcacaugcagucccucucccagcaggcccccaagaccgcccagcucuccuccaccgacuccaccgacggcaaccucaacgagcuccacaucaccauccgcugcugcaaccaccuccagucccgcgccucccaccuccagccccaccccuacgucgucuacaaguucuucgacuucgccgaccacgacaccgccaucauccccuccuccaacgacccccaguucgacgaccacauguacuuccccguccccaugaacauggaccucgaccgcuaccucaaguccgagucccucuccuucuacgucuucgacgacuccgacacccaggagaacaucuacaucggcaaggucaacgucccccucaucucccucgcccacgaccgcugcaucuccggcaucuucgagcucaccgaccaccagaagcaccccgccggcaccauccacgucauccucaaguggaaguucgccuaccucccccccuccggcuccaucaccaccgaggaccucggcaacuucauccgcuccgaggagcccgaggucguccagcgccucccccccgccuccuccgucuccacccucguccucgccccccgccccaagccccgccagcgccucacccccgucgacaagaaggucuccuucgucgacaucaugccccaccaguccgacgucucccaggagggcuccgucgacgaggucaaggagaacaccgagaagaugcagcagggcaaggacgacgucucccuccucuccgagggccagcucgccgagcagucccucgccuccuccgaggacgagaccgagaucaccgaggaccucgagcccgaggucgaggaggacauguccgccuccgacuccgacgacugcaucauccccggccccaucuccaagaacaucaagcagcccuccgagaagauccgcaucgagaucaucgcccucucccucaacgacucccaggucaccauggacgacaccauccagcgccucuucgucgagugccgcuucuacucccuccccgccgaggagacccccgucucccuccccaagcccaaguccggccagugggucuacuacaacuacuccaacgucaucuacgucgacaaggagaacaacaaggccaagcgcgacauccucaaggccauccuccagaagcaggagaugcccaaccgcucccuccgcuucaccgucgucuccgacccccccgaggacgagcaggaccucgagugcgaggacaucggcgucgcccacgucgaccucgccgacauguuccaggagggccgcgaccucaucgagcagaacaucgacgucuucgacgcccgcgccgacggcgagggcaucggcaagcuccgcgucaccgucgaggcccuccacgcccuccaguccgucuacaagcaguaccgcgacgaccucgaggccuga

SEQ ID NO: 48910 - RNA, 2085 nt, Artificial Sequence
  derived and/or modified sequence opt2 from RPH3A__Homo_sapiens__NP_001137326
augaccgacaccgucuucuccaacuccuccaaccgcuggauguaccccuccgaccgcccccuccaguccaacgacaaggagcagcuccaggccggcugguccguccaccccggcggccagcccgaccgccagcgcaagcaggaggagcucaccgacgaggagaaggagaucaucaaccgcgucaucgcccgcgccgagaagauggaggagauggagcaggagcgcaucggccgccucgucgaccgccucgagaacaugcgcaagaacgucgccggcgacggcgucaaccgcugcauccucugcggcgagcagcucggcaugcucggcuccgccugcgucgucugcgaggacugcaagaagaacgucugcaccaagugcggcgucgagaccaacaaccgccuccacuccgucuggcucugcaagaucugcaucgagcagcgcgaggucuggaagcgcuccggcgccugguucuucaagggcuuccccaagcagguccucccccagcccaugcccaucaagaagaccaagccccagcagcccgucuccgagcccgccgcccccgagcagcccgcccccgagcccaagcaccccgcccgcgcccccgcccgcggcgacuccgaggaccgccgcggccccggccagaagaccggccccgaccccgccuccgcccccggccgcggcaacuacggcccccccguccgccgcgccuccgaggcccgcauguccuccuccucccgcgacuccgaguccugggaccacuccggcggcgccggcgacuccucccgcucccccgccggccuccgccgcgccaacuccguccaggccucccgccccgcccccggcuccguccagucccccgcccccccccagcccggccagcccggcacccccggcggcucccgccccggccccggccccgccggccgcuuccccgaccagaagcccgaggucgcccccuccgaccccggcaccaccgcccccccccgcgaggagcgcaccggcggcgucggcggcuaccccgccgucggcgcccgcgaggaccgcaugucccaccccuccggccccuacucccaggccuccgccgccgccccccagcccgccgccgcccgccagccccccccccccgaggaggaggaggaggaggccaacuccuacgacuccgacgaggccaccacccucggcgcccucgaguucucccuccucuacgaccaggacaacuccucccuccagugcaccaucaucaaggccaagggccucaagcccauggacuccaacggccucgccgaccccuacgucaagcuccaccuccuccccggcgccuccaaguccaacaagcuccgcaccaagacccuccgcaacacccgcaaccccaucuggaacgagacccucgucuaccacggcaucaccgacgaggacaugcagcgcaagacccuccgcaucuccgucugcgacgaggacaaguucggccacaacgaguucaucggcgagacccgcuucucccucaagaagcucaagcccaaccagcgcaagaacuucaacaucugccucgagcgcgucauccccaugaagcgcgccggcaccaccggcuccgcccgcggcauggcccucuacgaggaggagcaggucgagcgcgucggcgacaucgaggagcgcggcaagauccucgucucccucauguacuccacccagcagggcggccucaucgucggcaucauccgcugcguccaccucgccgccauggacgccaacggcuacuccgaccccuucgucaagcucuggcucaagcccgacaugggcaagaaggccaagcacaagacccagaucaagaagaagacccucaaccccgaguucaacgaggaguucuucuacgacaucaagcacuccgaccucgccaagaagucccucgacaucuccgucugggacuacgacaucggcaaguccaacgacuacaucggcggcugccagcucggcaucuccgccaagggcgagcgccucaagcacugguacgagugccucaagaacaaggacaagaagaucgagcgcuggcaccagcuccagaacgagaaccacgucuccuccgacuga

SEQ ID NO: 48911 - RNA, 948 nt, Artificial Sequence
  derived and/or modified sequence opt2 from RPH3AL__Homo_sapiens__XP_011545302
auggccgacaccaucuucggcuccggcaacgaccagugggucugccccaacgaccgccagcucgcccuccgcgccaagcuccagaccggcugguccguccacaccuaccagaccgagaagcagcgccgcaagcagcaccucucccccgccgaggucgaggccauccuccaggucauccagcgcgccgagcgccucgacguccucgagcagcagcgcaucggccgccucgucgagcgccucgagaccaugcgccgcaacgucaugggcaacggccucucccagugccuccucugcggcgagguccucggcuuccucggcuccuccuccgucuucugcaaggacugccgcaagaaggucugcaccaagugcggcaucgaggccucccccggccagaagcgcccccucuggcucugcaagaucugcuccgagcagcgcgaggucuggaagcgcuccggcgccugguucuacaagggccuccccaaguacauccucccccucaagacccccggccgcgccgacgacccccacuuccgcccccuccccaccgagcccgccgagcgcgagccccgcuccuccgagaccucccgcaucuacaccugggcccgcggccgcgucgucuccuccgacuccgacuccgacuccgaccucuccuccuccucccucgaggaccgccuccccuccaccggcguccgcgaccgcaagggcgacaagcccuggaaggaguccggcggcuccgucgaggccccccgcaugggcuucacccacccccccggccaccucuccggcugccaguccucccucgccuccggcgagaccggcaccggcuccgccgacccccccggcggcccccgccccggccucacccgccgcgcccccgucaaggacacccccggccgcgcccccgccgccgacgccgcccccgccggccccuccuccugccucggcuga

SEQ ID NO: 48912 - RNA, 936 nt, Artificial Sequence
  derived and/or modified sequence opt2 from RPIA__Homo_sapiens__NP_653164
augcagcgccccggccccuucuccacccucuacggccgcguccucgccccccuccccggccgcgccggcggcgccgccuccggcggcggcggcaacuccugggaccuccccggcucccacguccgccuccccggccgcgcccaguccggcacccgcggcggcgccggcaacaccuccaccuccugcggcgacuccaacuccaucugccccgcccccuccaccauguccaaggccgaggaggccaagaagcucgccggccgcgccgccgucgagaaccacguccgcaacaaccagguccucggcaucggcuccggcuccaccaucguccacgccguccagcgcaucgccgagcgcgucaagcaggagaaccucaaccucgucugcauccccaccuccuuccaggcccgccagcucauccuccaguacggccucacccucuccgaccucgaccgccaccccgagaucgaccucgccaucgacggcgccgacgaggucgacgccgaccucaaccucaucaagggcggcggcggcugccucacccaggagaagaucgucgccggcuacgccucccgcuucaucgucaucgccgacuuccgcaaggacuccaagaaccucggcgaccaguggcacaagggcauccccaucgaggucauccccauggccuacguccccgucucccgcgccgucucccagaaguucggcggcgucgucgagcuccgcauggccgucaacaaggccggccccgucgucaccgacaacggcaacuucauccucgacuggaaguucgaccgcguccacaagugguccgaggucaacaccgccaucaagaugauccccggcgucgucgacaccggccucuucaucaacauggccgagcgcgucuacuucggcaugcaggacggcuccgucaacaugcgcgagaagcccuucugcuga

SEQ ID NO: 48913 - RNA, 654 nt, Artificial Sequence
  derived and/or modified sequence opt2 from RPL10A__Homo_sapiens__NP_009035
auguccuccaaggucucccgcgacacccucuacgaggccguccgcgagguccuccacggcaaccagcgcaagcgccgcaaguuccucgagaccgucgagcuccagaucucccucaagaacuacgacccccagaaggacaagcgcuucuccggcaccguccgccucaaguccaccccccgccccaaguucuccgucugcguccucggcgaccagcagcacugcgacgaggccaaggccgucgacaucccccacauggacaucgaggcccucaagaagcucaacaagaacaagaagcucgucaagaagcucgccaagaaguacgacgccuuccucgccuccgagucccucaucaagcagaucccccgcauccucggccccggccucaacaaggccggcaaguuccccucccuccucacccacaacgagaacauggucgccaaggucgacgaggucaaguccaccaucaaguuccagaugaagaagguccucugccucgccgucgccgucggccacgucaagaugaccgacgacgagcucgucuacaacauccaccucgccgucaacuuccucgucucccuccucaagaagaacuggcagaacguccgcgcccucuacaucaaguccaccaugggcaagccccagcgccucuacuga

SEQ ID NO: 48914 - RNA, 651 nt, Artificial Sequence
  derived and/or modified sequence opt2 from RPL10__Homo_sapiens__NP_001243506
augggccgccgccccgcccgcugcuaccgcuacugcaagaacaagcccuaccccaagucccgcuucugccgcggcguccccgacgccaagauccgcaucuucgaccucggccgcaagaaggccaaggucgacgaguucccccucugcggccacauggucuccgacgaguacgagcagcucuccuccgaggcccucgaggccgcccgcaucugcgccaacaaguacauggucaaguccugcggcaaggacggcuuccacauccgcguccgccuccaccccuuccacgucauccgcaucaacaagaugcucuccugcgccggcgccgaccgcuccaccucccagcgcuccggcgccucccccuccuccaugcucaugaaccucaagaccugguggcucaaguccggcuccucccagauggccgucggcuccuccaccucccccgucgucgcccucuggaccuccggcggccccugcacccacgagggcuuccagugcgccgccccccuccucauccucaccaacaaguucuacuuccucuccaccuacgucuucgucuccaccuuccucaccggcaaggagcucccccucggcaccuucggcucccuccccuuccacuuccgcaaccgccucaccacccagcccugcuccuga

SEQ ID NO: 48915 - RNA, 645 nt, Artificial Sequence
  derived and/or modified sequence opt2 from RPL10L__Homo_sapiens__NP_542784
augggccgccgccccgcccgcugcuaccgcuacugcaagaacaagcccuaccccaagucccgcuucugccgcggcguccccgacgccaagauccgcaucuucgaccucggccgcaagaaggccaaggucgacgaguucccccucggcggccacauggucuccgacgaguacgagcagcucuccuccgaggcccucgaggccgcccgcaucugcgccaacaaguacauggucaaguccugcggccgcgacggcuuccacaugcgcguccgccuccaccccuuccacgucauccgcaucaacaagaugcucuccugcgccggcgccgaccgccuccagaccggcaugcgcggcgccuucggcaagccccagggcaccgucgcccgcguccacaucggccaggucaucauguccauccgcaccaagcuccagaacgaggagcacgucaucgaggcccuccgccgcgccaaguucaaguuccccggccgccagaagauccacaucuccaagaaguggggcuucaccaaguucaacgccgacgaguucgaggacauggucgccaagaagugccucauccccgacggcugcggcgucaaguacguccccucccacggcccccucgacaaguggcgcguccuccacuccuga

SEQ ID NO: 48916 - RNA, 498 nt, Artificial Sequence
  derived and/or modified sequence opt2 from RPL12__Homo_sapiens__NP_000967
augccccccaaguucgaccccaacgagaucaaggucgucuaccuccgcugcaccggcggcgaggucggcgccaccuccgcccucgcccccaagaucggcccccucggccucucccccaagaaggucggcgacgacaucgccaaggccaccggcgacuggaagggccuccgcaucaccgucaagcucaccauccagaaccgccaggcccagaucgaggucguccccuccgccuccgcccucaucaucaaggcccucaaggagcccccccgcgaccgcaagaagcagaagaacaucaagcacuccggcaacaucaccuucgacgagaucgucaacaucgcccgccagaugcgccaccgcucccucgcccgcgagcucuccggcaccaucaaggagauccucggcaccgcccaguccgucggcugcaacgucgacggccgccacccccacgacaucaucgacgacaucaacuccggcgccgucgagugccccgccuccuga

SEQ ID NO: 48917 - RNA, 495 nt, Artificial Sequence
  derived and/or modified sequence opt2 from RPL13__Homo_sapiens__NP_001230060
auggcccccucccgcaacggcaugguccucaagccccacuuccacaaggacuggcagcgccgcgucgccaccugguucaaccagcccgcccgcaagauccgccgccgcaaggcccgccaggccaaggcccgccgcaucgccccccgccccgccuccggccccauccgccccaucguccgcugccccaccguccgcuaccacaccaagguccgcgccggccgcggcuucucccucgaggagcuccgcgucgccggcauccacaagaagggcgacuccuccgccgaggagcucaagcucgccacccagcucaccggccccgucaugcccguccgcaacgucuacaagaaggagaaggcccgcgucaucaccgaggaggagaagaacuucaaggccuucgccucccuccgcauggcccgcgccaacgcccgccucuucggcauccgcgccaagcgcgccaaggaggccgccgagcaggacgucgagaagaagaaguga

SEQ ID NO: 48918 - RNA, 648 nt, Artificial Sequence
  derived and/or modified sequence opt2 from RPL14__Homo_sapiens__NP_001030168
auggucuuccgccgcuucgucgaggucggccgcgucgccuacgucuccuucggcccccacgccggcaagcucgucgccaucgucgacgucaucgaccagaaccgcgcccucgucgacggccccugcacccagguccgccgccaggccaugcccuucaagugcaugcagcucaccgacuucauccucaaguucccccacuccgcccaccagaaguacguccgccaggccuggcagaaggccgacaucaacaccaagugggccgccacccgcugggccaagaagaucgaggcccgcgagcgcaaggccaagaugaccgacuucgaccgcuucaaggucaugaaggccaagaagaugcgcaaccgcaucaucaagaacgaggucaagaagcuccagaaggccgcccuccucaaggccucccccaagaaggcccccggcaccaagggcaccgccgccgccgccgccgccgccgccgccgccaagguccccgccaagaagaucaccgccgccuccaagaaggcccccgcccagaagguccccgcccagaaggccaccggccagaaggccgcccccgcccccaaggcccagaagggccagaaggcccccgcccagaaggcccccgcccccaaggccuccggcaagaaggccuga

SEQ ID NO: 48919 - RNA, 438 nt, Artificial Sequence
  derived and/or modified sequence opt2 from RPL15__Homo_sapiens__NP_001240313
augggcgccuacaaguacauccaggagcucuggcgcaagaagcaguccgacgucaugcgcuuccuccuccgcguccgcugcuggcaguaccgccagcucuccgcccuccaccgcgccccccgccccacccgccccgacaaggcccgccgccucggcuacaaggccaagcagggcuacgucaucuaccgcauccgcguccgccgcggcggccgcaagcgccccguccccaagggcgccaccuacggcaagcccguccaccacggcgucaaccagcucaaguucgcccgcucccuccaguccgucgccgaggagcgcgccggccgccacugcggcgcccuccgcguccucaacuccuacuggauggagucccacucccacuccggcggcuccgccgucggccagucccgccucaccgccaccuccgucucccgcgucuga

SEQ ID NO: 48920 - RNA, 687 nt, Artificial Sequence
  derived and/or modified sequence opt2 from RPL17-C18orf32__Homo_sapiens__NP_001186284
augguccgcuacucccucgaccccgagaaccccaccaaguccugcaagucccgcggcuccaaccuccgcguccacuucaagaacacccgcgagaccgcccaggccaucaagggcaugcacauccgcaaggccaccaaguaccucaaggacgucacccuccagaagcagugcguccccuuccgccgcuacaacggcggcgucggccgcugcgcccaggccaagcaguggggcuggacccagggccgcuggcccaagaaguccgccgaguuccuccuccacaugcucaagaacgccgaguccaacgccgagcucaagggccucgacgucgacucccucgucaucgagcacauccaggucaacaaggcccccaagaugcgccgccgcaccuaccgcgcccacggccgcaucaaccccuacauguccucccccugccacaucgagaugauccucaccgagaaggagcagaucguccccaagcccgaggaggaggucgcccagaagaagaagcuccgcuccuccucccucggcaaguggugcgccuuccucgucuccuccuuccaguucugcuccggcuccaccaagaacuccuggucccacaucuacacccucugguucccccccucccucgucgucuacggccuccgcaagcaguacaagaaccccaugauccagaccaaggccaaguga

SEQ ID NO: 48921 - RNA, 555 nt, Artificial Sequence
  derived and/or modified sequence opt2 from RPL17__Homo_sapiens__NP_001030178
augguccgcuacucccucgaccccgagaaccccaccaaguccugcaagucccgcggcuccaaccuccgcguccacuucaagaacacccgcgagaccgcccaggccaucaagggcaugcacauccgcaaggccaccaaguaccucaaggacgucacccuccagaagcagugcguccccuuccgccgcuacaacggcggcgucggccgcugcgcccaggccaagcaguggggcuggacccagggccgcuggcccaagaaguccgccgaguuccuccuccacaugcucaagaacgccgaguccaacgccgagcucaagggccucgacgucgacucccucgucaucgagcacauccaggucaacaaggcccccaagaugcgccgccgcaccuaccgcgcccacggccgcaucaaccccuacauguccucccccugccacaucgagaugauccucaccgagaaggagcagaucguccccaagcccgaggaggaggucgcccagaagaagaagaucucccagaagaagcucaagaagcagaagcucauggcccgcgaguga

SEQ ID NO: 48922 - RNA, 567 nt, Artificial Sequence
  derived and/or modified sequence opt2 from RPL18__Homo_sapiens__NP_000970
augggcgucgacauccgccacaacaaggaccgcaagguccgccgcaaggagcccaagucccaggacaucuaccuccgccuccucgucaagcucuaccgcuuccucgcccgccgcaccaacuccaccuucaaccaggucguccucaagcgccucuucaugucccgcaccaaccgccccccccucucccucucccgcaugauccgcaagaugaagcuccccggccgcgagaacaagaccgccgucgucgucggcaccaucaccgacgacguccgcguccaggagguccccaagcucaaggucugcgcccuccgcgucaccucccgcgcccgcucccgcauccuccgcgccggcggcaagauccucaccuucgaccagcucgcccucgacucccccaagggcugcggcaccguccuccucuccggcccccgcaagggccgcgaggucuaccgccacuucggcaaggcccccggcaccccccacucccacaccaagcccuacguccgcuccaagggccgcaaguucgagcgcgcccgcggccgccgcgccucccgcggcuacaagaacuga

SEQ ID NO: 48923 - RNA, 591 nt, Artificial Sequence
  derived and/or modified sequence opt2 from RPL19__Homo_sapiens__NP_000972
auguccaugcuccgccuccagaagcgccucgccuccuccguccuccgcugcggcaagaagaaggucuggcucgaccccaacgagaccaacgagaucgccaacgccaacucccgccagcagauccgcaagcucaucaaggacggccucaucauccgcaagcccgucaccguccacucccgcgcccgcugccgcaagaacacccucgcccgccgcaagggccgccacaugggcaucggcaagcgcaagggcaccgccaacgcccgcaugcccgagaaggucaccuggaugcgccgcaugcgcauccuccgccgccuccuccgccgcuaccgcgaguccaagaagaucgaccgccacauguaccacucccucuaccucaaggucaagggcaacgucuucaagaacaagcgcauccucauggagcacauccacaagcucaaggccgacaaggcccgcaagaagcuccucgccgaccaggccgaggcccgccgcuccaagaccaaggaggcccgcaagcgccgcgaggagcgccuccaggccaagaaggaggagaucaucaagacccucuccaaggaggaggagaccaagaaguga

SEQ ID NO: 48924 - RNA, 483 nt, Artificial Sequence
  derived and/or modified sequence opt2 from RPL21__Homo_sapiens__NP_000973
augaccaacaccaagggcaagcgccgcggcacccgcuacauguucucccgccccuuccgcaagcacggcgucgucccccucgccaccuacaugcgcaucuacaagaagggcgacaucgucgacaucaagggcaugggcaccguccagaagggcaugccccacaagugcuaccacggcaagaccggccgcgucuacaacgucacccagcacgccgucggcaucgucgucaacaagcaggucaagggcaagauccucgccaagcgcaucaacguccgcaucgagcacaucaagcacuccaagucccgcgacuccuuccucaagcgcgucaaggagaacgaccagaagaagaaggaggccaaggagaagggcaccuggguccagcucaagcgccagcccgcccccccccgcgaggcccacuucguccgcaccaacggcaaggagcccgagcuccucgagcccauccccuacgaguucauggccuga

SEQ ID NO: 48925 - RNA, 471 nt, Artificial Sequence
  derived and/or modified sequence opt2 from RPL23A__Homo_sapiens__NP_000975
auggcccccaaggccaagaaggaggcccccgccccccccaaggccgaggccaaggccaaggcccucaaggccaagaaggccguccucaagggcguccacucccacaagaagaagaagauccgcaccucccccaccuuccgccgccccaagacccuccgccuccgccgccagcccaaguacccccgcaaguccgccccccgccgcaacaagcucgaccacuacgccaucaucaaguucccccucaccaccgaguccgccaugaagaagaucgaggacaacaacacccucgucuucaucgucgacgucaaggccaacaagcaccagaucaagcaggccgucaagaagcucuacgacaucgacgucgccaaggucaacacccucauccgccccgacggcgagaagaaggccuacguccgccucgcccccgacuacgacgcccucgacgucgccaacaagaucggcaucaucuga

SEQ ID NO: 48926 - RNA, 423 nt, Artificial Sequence
  derived and/or modified sequence opt2 from RPL23__Homo_sapiens__NP_000969
auguccaagcgcggccgcggcggcuccuccggcgccaaguuccgcaucucccucggccuccccgucggcgccgucaucaacugcgccgacaacaccggcgccaagaaccucuacaucaucuccgucaagggcaucaagggccgccucaaccgccuccccgccgccggcgucggcgacauggucauggccaccgucaagaagggcaagcccgagcuccgcaagaagguccaccccgccgucgucauccgccagcgcaaguccuaccgccgcaaggacggcgucuuccucuacuucgaggacaacgccggcgucaucgucaacaacaagggcgagaugaagggcuccgccaucaccggccccgucgccaaggagugcgccgaccucuggccccgcaucgccuccaacgccggcuccaucgccuga

SEQ ID NO: 48927 - RNA, 474 nt, Artificial Sequence
  derived and/or modified sequence opt2 from RPL24__Homo_sapiens__NP_000977
augaaggucgagcucugcuccuucuccggcuacaagaucuaccccggccacggccgccgcuacgcccgcaccgacggcaaggucuuccaguuccucaacgccaagugcgaguccgccuuccucuccaagcgcaacccccgccagaucaacuggaccguccucuaccgccgcaagcacaagaagggccaguccgaggagauccagaagaagcgcacccgccgcgccgucaaguuccagcgcgccaucaccggcgccucccucgccgacaucauggccaagcgcaaccagaagcccgagguccgcaaggcccagcgcgagcaggccauccgcgccgccaaggaggccaagaaggccaagcaggccuccaagaagaccgccauggccgccgccaaggcccccaccaaggccgcccccaagcagaagaucgucaagcccgucaaggucuccgccccccgcgucggcggcaagcgcuga

SEQ ID NO: 48928 - RNA, 447 nt, Artificial Sequence
  derived and/or modified sequence opt2 from RPL27A__Homo_sapiens__NP_000981
augcccucccgccuccgcaagacccgcaagcuccgcggccacgucucccacggccacggccgcaucggcaagcaccgcaagcaccccggcggccgcggcaacgccggcggccuccaccaccaccgcaucaacuucgacaaguaccaccccggcuacuucggcaaggucggcaugaagcacuaccaccucaagcgcaaccaguccuucugccccaccgucaaccucgacaagcucuggacccucgucuccgagcagacccgcgucaacgccgccaagaacaagaccggcgccgcccccaucaucgacgucguccgcuccggcuacuacaagguccucggcaagggcaagcuccccaagcagcccgucaucgucaaggccaaguucuucucccgccgcgccgaggagaagaucaaguccgucggcggcgccugcguccucgucgccuga

SEQ ID NO: 48929 - RNA, 480 nt, Artificial Sequence
  derived and/or modified sequence opt2 from RPL29__Homo_sapiens__NP_000983
auggccaaguccaagaaccacaccacccacaaccagucccgcaaguggcaccgcaacggcaucaagaagccccgcucccagcgcuacgagucccucaagggcgucgaccccaaguuccuccgcaacaugcgcuucgccaagaagcacaacaagaagggccucaagaagaugcaggccaacaacgccaaggccauguccgcccgcgccgaggccaucaaggcccucgucaagcccaaggaggucaagcccaagauccccaagggcgucucccgcaagcucgaccgccucgccuacaucgcccaccccaagcucggcaagcgcgcccgcgcccgcaucgccaagggccuccgccucugccgccccaaggccaaggccaaggccaaggccaaggaccagaccaaggcccaggccgccgcccccgccuccguccccgcccaggcccccaagcgcacccaggcccccaccaaggccuccgaguga

SEQ ID NO: 48930 - RNA, 348 nt, Artificial Sequence
  derived and/or modified sequence opt2 from RPL30__Homo_sapiens__NP_000980
auggucgccgccaagaagaccaagaagucccucgaguccaucaacucccgccuccagcucgucaugaaguccggcaaguacguccucggcuacaagcagacccucaagaugauccgccagggcaaggccaagcucgucauccucgccaacaacugccccgcccuccgcaaguccgagaucgaguacuacgccaugcucgccaagaccggcguccaccacuacuccggcaacaacaucgagcucggcaccgccugcggcaaguacuaccgcgucugcacccucgccaucaucgaccccggcgacuccgacaucauccgcuccaugcccgagcagaccggcgagaaguga

SEQ ID NO: 48931 - RNA, 378 nt, Artificial Sequence
  derived and/or modified sequence opt2 from RPL31__Homo_sapiens__NP_000984
auggcccccgccaagaagggcggcgagaagaagaagggccgcuccgccaucaacgaggucgucacccgcgaguacaccaucaacauccacaagcgcauccacggcgucggcuucaagaagcgcgccccccgcgcccucaaggagauccgcaaguucgccaugaaggagaugggcacccccgacguccgcaucgacacccgccucaacaaggccgucugggccaagggcauccgcaacguccccuaccgcauccgcguccgccucucccgcaagcgcaacgaggacgaggacucccccaacaagcucuacacccucgucaccuacguccccgucaccaccuucaagaaccuccagaccgucaacgucgacgagaacuga

SEQ ID NO: 48932 - RNA, 354 nt, Artificial Sequence
  derived and/or modified sequence opt2 from RPL34__Homo_sapiens__NP_001306164
augguccagcgccucaccuaccgccgccgccucuccuacaacaccgccuccaacaagacccgccucucccgcacccccggcaaccgcaucgucuaccucuacaccaagaaggucggcaaggcccccaaguccgccugcggcgucugccccggccgccuccgcggcguccgcgccguccgccccaagguccucaugcgccucuccaagaccaagaagcacgucucccgcgccuacggcggcuccaugugcgccaagugcguccgcgaccgcaucaagcgcgccuuccucaucgaggagcagaagaucgucgucaagguccucaaggcccaggcccagucccagaaggccaaguga

SEQ ID NO: 48933 - RNA, 372 nt, Artificial Sequence
  derived and/or modified sequence opt2 from RPL35__Homo_sapiens__NP_009140
auggccaagaucaaggcccgcgaccuccgcggcaagaagaaggaggagcuccucaagcagcucgacgaccucaaggucgagcucucccagcuccgcgucgccaaggucaccggcggcgccgccuccaagcucuccaagauccgcgucguccgcaaguccaucgcccgcguccucaccgucaucaaccagacccagaaggagaaccuccgcaaguucuacaagggcaagaaguacaagccccucgaccuccgccccaagaagacccgcgccaugcgccgccgccucaacaagcacgaggagaaccucaagaccaagaagcagcagcgcaaggagcgccucuacccccuccgcaaguacgccgucaaggccuga

SEQ ID NO: 48934 - RNA, 429 nt, Artificial Sequence
  derived and/or modified sequence opt2 from RPL36A__Homo_sapiens__NP_066357
augaucgcccccaccgacucccacgaggagguccgcuccggcaccuccuacauccuccccuucgccucccgcuuccucuccuuccgcgccgacuccgcccacgccuccauggucaacguccccaagacccgccgcaccuucugcaagaagugcggcaagcaccagccccacaaggucacccaguacaagaagggcaaggacucccucuacgcccagggcaagcgccgcuacgaccgcaagcaguccggcuacggcggccagaccaagcccaucuuccgcaagaaggccaagaccaccaagaagaucguccuccgccucgagugcgucgagcccaacugccgcuccaagcgcaugcucgccaucaagcgcugcaagcacuucgagcucggcggcgacaagaagcgcaagggccaggucauccaguucuga

SEQ ID NO: 48935 - RNA, 321 nt, Artificial Sequence
  derived and/or modified sequence opt2 from RPL36AL__Homo_sapiens__NP_000992
auggucaacguccccaagacccgccgcaccuucugcaagaagugcggcaagcaccagccccacaaggucacccaguacaagaagggcaaggacucccucuacgcccagggccgccgccgcuacgaccgcaagcaguccggcuacggcggccagaccaagcccaucuuccgcaagaaggccaagaccaccaagaagaucguccuccgccucgagugcgucgagcccaacugccgcuccaagcgcaugcucgccaucaagcgcugcaagcacuucgagcucggcggcgacaagaagcgcaagggccaggucauccaguucuga

SEQ ID NO: 48936 - RNA, 279 nt, Artificial Sequence
  derived and/or modified sequence opt2 from RPL37A__Homo_sapiens__NP_000989
auggccaagcgcaccaagaaggucggcaucgucggcaaguacggcacccgcuacggcgccucccuccgcaagauggucaagaagaucgagaucucccagcacgccaaguacaccugcuccuucugcggcaagaccaagaugaagcgccgcgccgucggcaucuggcacugcggcuccugcaugaagaccgucgccggcggcgccuggaccuacaacaccaccuccgccgucaccgucaaguccgccauccgccgccucaaggagcucaaggaccaguga

SEQ ID NO: 48937 - RNA, 213 nt, Artificial Sequence
  derived and/or modified sequence opt2 from RPL38__Homo_sapiens__NP_000990
augccccgcaagaucgaggagaucaaggacuuccuccucaccgcccgccgcaaggacgccaaguccgucaagaucaagaagaacaaggacaacgucaaguucaagguccgcugcucccgcuaccucuacacccucgucaucaccgacaaggagaaggccgagaagcucaagcagucccucccccccggccucgccgucaaggagcucaaguga

SEQ ID NO: 48938 - RNA, 156 nt, Artificial Sequence
  derived and/or modified sequence opt2 from RPL39__Homo_sapiens__NP_000991
auguccucccacaagaccuuccgcaucaagcgcuuccucgccaagaagcagaagcagaaccgccccaucccccaguggauccgcaugaagaccggcaacaagauccgcuacaacuccaagcgccgccacuggcgccgcaccaagcucggccucuga

SEQ ID NO: 48939 - RNA, 156 nt, Artificial Sequence
  derived and/or modified sequence opt2 from RPL39L__Homo_sapiens__NP_443201
auguccucccacaagaccuucaccaucaagcgcuuccucgccaagaagcagaagcagaaccgccccaucccccaguggauccagaugaagcccggcuccaagauccgcuacaacuccaagcgccgccacuggcgccgcaccaagcucggccucuga

SEQ ID NO: 48940 - RNA, 1212 nt, Artificial Sequence
  derived and/or modified sequence opt2 from RPL3__Homo_sapiens__NP_000958
augucccaccgcaaguucuccgccccccgccacggcucccucggcuuccucccccgcaagcgcuccucccgccaccgcggcaaggucaaguccuuccccaaggacgaccccuccaagcccguccaccucaccgccuuccucggcuacaaggccggcaugacccacaucguccgcgaggucgaccgccccggcuccaaggucaacaagaaggaggucgucgaggccgucaccaucgucgagaccccccccauggucgucgucggcaucgucggcuacgucgagaccccccgcggccuccgcaccuucaagaccgucuucgccgagcacaucuccgacgagugcaagcgccgcuucuacaagaacuggcacaaguccaagaagaaggccuucaccaaguacugcaagaaguggcaggacgaggacggcaagaagcagcucgagaaggacuucuccuccaugaagaaguacugccaggucauccgcgucaucgcccacacccagaugcgccuccucccccuccgccagaagaaggcccaccucauggagauccaggucaacggcggcaccgucgccgagaagcucgacugggcccgcgagcgccucgagcagcagguccccgucaaccaggucuucggccaggacgagaugaucgacgucaucggcgucaccaagggcaagggcuacaagggcgucaccucccgcuggcacaccaagaagcucccccgcaagacccaccgcggccuccgcaaggucgccugcaucggcgccuggcaccccgcccgcgucgccuucuccgucgcccgcgccggccagaagggcuaccaccaccgcaccgagaucaacaagaagaucuacaagaucggccagggcuaccucaucaaggacggcaagcucaucaagaacaacgccuccaccgacuacgaccucuccgacaaguccaucaacccccucggcggcuucguccacuacggcgaggucaccaacgacuucgucaugcucaagggcugcgucgucggcaccaagaagcgcguccucacccuccgcaagucccuccucguccagaccaagcgccgcgcccucgagaagaucgaccucaaguucaucgacaccaccuccaaguucggccacggccgcuuccagaccauggaggagaagaaggccuucaugggcccccucaagaaggaccgcaucgccaaggaggagggcgccuga

SEQ ID NO: 48941 - RNA, 78 nt, Artificial Sequence
  derived and/or modified sequence opt2 from RPL41__Homo_sapiens__NP_066927
augcgcgccaaguggcgcaagaagcgcaugcgccgccucaagcgcaagcgccgcaagaugcgccagcgcuccaaguga

SEQ ID NO: 48942 - RNA, 1284 nt, Artificial Sequence
  derived and/or modified sequence opt2 from RPL4__Homo_sapiens__NP_000959
auggccugcgcccgcccccucaucuccgucuacuccgagaagggcgaguccuccggcaagaacgucacccuccccgccgucuucaaggcccccauccgccccgacaucgucaacuucguccacaccaaccuccgcaagaacaaccgccagcccuacgccgucuccgagcucgccggccaccagaccuccgccgaguccuggggcaccggccgcgccgucgcccgcaucccccgcguccgcggcggcggcacccaccgcuccggccagggcgccuucggcaacaugugccgcggcggccgcauguucgcccccaccaagaccuggcgccgcuggcaccgccgcgucaacaccacccagaagcgcuacgccaucugcuccgcccucgccgccuccgcccuccccgcccucgucauguccaagggccaccgcaucgaggagguccccgagcucccccucgucgucgaggacaaggucgagggcuacaagaagaccaaggaggccguccuccuccucaagaagcucaaggccuggaacgacaucaagaaggucuacgccucccagcgcaugcgcgccggcaagggcaagaugcgcaaccgccgccgcauccagcgccgcggccccugcaucaucuacaacgaggacaacggcaucaucaaggccuuccgcaacauccccggcaucacccuccucaacgucuccaagcucaacauccucaagcucgcccccggcggccacgucggccgcuucugcaucuggaccgaguccgccuuccgcaagcucgacgagcucuacggcaccuggcgcaaggccgccucccucaaguccaacuacaaccuccccaugcacaagaugaucaacaccgaccucucccgcauccucaagucccccgagauccagcgcgcccuccgcgccccccgcaagaagauccaccgccgcguccucaagaagaacccccucaagaaccuccgcaucaugcucaagcucaaccccuacgccaagaccaugcgccgcaacaccauccuccgccaggcccgcaaccacaagcuccgcgucgacaaggccgccgccgccgccgccgcccuccaggccaaguccgacgagaaggccgccgucgccggcaagaagcccgucgucggcaagaagggcaagaaggccgccgucggcgucaagaagcagaagaagccccucgucggcaagaaggccgccgccaccaagaagcccgcccccgagaagaagcccgccgagaagaagcccaccaccgaggagaagaagcccgccgccuga

SEQ ID NO: 48943 - RNA, 867 nt, Artificial Sequence
  derived and/or modified sequence opt2 from RPL6__Homo_sapiens__NP_001307069
auggccggcgagaaggucgagaagcccgacaccaaggagaagaagcccgaggccaagaaggucgacgccggcggcaaggucaagaagggcaaccucaaggccaagaagcccaagaagggcaagccccacugcucccgcaaccccguccucguccgcggcaucggccgcuacucccgcuccgccauguacucccgcaaggccauguacaagcgcaaguacuccgccgccaaguccaaggucgagaagaagaagaaggagaagguccucgccaccgucaccaagcccgucggcggcgacaagaacggcggcacccgcgucgucaagcuccgcaagaugccccgcuacuaccccaccgaggacgucccccgcaagcuccucucccacggcaagaagcccuucucccagcacguccgcaagcuccgcgccuccaucacccccggcaccauccucaucauccucaccggccgccaccgcggcaagcgcgucgucuuccucaagcagcucgccuccggccuccuccucgucaccggcccccucguccucaaccgcgucccccuccgccgcacccaccagaaguucgucaucgccaccuccaccaagaucgacaucuccaacgucaagauccccaagcaccucaccgacgccuacuucaagaagaagaagcuccgcaagccccgccaccaggagggcgagaucuucgacaccgagaaggagaaguacgagaucaccgagcagcgcaagaucgaccagaaggccgucgacucccagauccuccccaagaucaaggccaucccccagcuccagggcuaccuccgcuccgucuucgcccucaccaacggcaucuacccccacaagcucgucuucuga

SEQ ID NO: 48944 - RNA, 801 nt, Artificial Sequence
  derived and/or modified sequence opt2 from RPL7A__Homo_sapiens__NP_000963
augcccaagggcaagaaggccaagggcaagaaggucgcccccgcccccgccgucgucaagaagcaggaggccaagaaggucgucaacccccucuucgagaagcgccccaagaacuucggcaucggccaggacauccagcccaagcgcgaccucacccgcuucgucaaguggccccgcuacauccgccuccagcgccagcgcgccauccucuacaagcgccucaaggucccccccgccaucaaccaguucacccaggcccucgaccgccagaccgccacccagcuccucaagcucgcccacaaguaccgccccgagaccaagcaggagaagaagcagcgccuccucgcccgcgccgagaagaaggccgccggcaagggcgacguccccaccaagcgcccccccguccuccgcgccggcgucaacaccgucaccacccucgucgagaacaagaaggcccagcucgucgucaucgcccacgacgucgaccccaucgagcucgucgucuuccuccccgcccucugccgcaagaugggcguccccuacugcaucaucaagggcaaggcccgccucggccgccucguccaccgcaagaccugcaccaccgucgccuucacccaggucaacuccgaggacaagggcgcccucgccaagcucgucgaggccauccgcaccaacuacaacgaccgcuacgacgagauccgccgccacuggggcggcaacguccucggccccaaguccgucgcccgcaucgccaagcucgagaaggccaaggccaaggagcucgccaccaagcucggcuga

SEQ ID NO: 48945 - RNA, 747 nt, Artificial Sequence
  derived and/or modified sequence opt2 from RPL7__Homo_sapiens__NP_000962
auggagggcgucgaggagaagaagaaggagguccccgccguccccgagacccucaagaagaagcgccgcaacuucgccgagcucaagaucaagcgccuccgcaagaaguucgcccagaagaugcuccgcaaggcccgccgcaagcucaucuacgagaaggccaagcacuaccacaaggaguaccgccagauguaccgcaccgagauccgcauggcccgcauggcccgcaaggccggcaacuucuacguccccgccgagcccaagcucgccuucgucauccgcauccgcggcaucaacggcgucucccccaagguccgcaagguccuccagcuccuccgccuccgccagaucuucaacggcaccuucgucaagcucaacaaggccuccaucaacaugcuccgcaucgucgagcccuacaucgccuggggcuaccccaaccucaaguccgucaacgagcucaucuacaagcgcggcuacggcaagaucaacaagaagcgcaucgcccucaccgacaacgcccucaucgcccgcucccucggcaaguacggcaucaucugcauggaggaccucauccacgagaucuacaccgucggcaagcgcuucaaggaggccaacaacuuccucuggcccuucaagcucuccuccccccgcggcggcaugaagaagaagaccacccacuucgucgagggcggcgacgccggcaaccgcgaggaccagaucaaccgccucauccgccgcaugaacuga

SEQ ID NO: 48946 - RNA, 954 nt, Artificial Sequence
  derived and/or modified sequence opt2 from RPLP0__Homo_sapiens__NP_000993
augccccgcgaggaccgcgccaccuggaaguccaacuacuuccucaagaucauccagcuccucgacgacuaccccaagugcuucaucgucggcgccgacaacgucggcuccaagcagaugcagcagauccgcaugucccuccgcggcaaggccgucguccucaugggcaagaacaccaugaugcgcaaggccauccgcggccaccucgagaacaaccccgcccucgagaagcuccucccccacauccgcggcaacgucggcuucgucuucaccaaggaggaccucaccgagauccgcgacaugcuccucgccaacaagguccccgccgccgcccgcgccggcgccaucgcccccugcgaggucaccguccccgcccagaacaccggccucggccccgagaagaccuccuucuuccaggcccucggcaucaccaccaagaucucccgcggcaccaucgagauccucuccgacguccagcucaucaagaccggcgacaaggucggcgccuccgaggccacccuccucaacaugcucaacaucucccccuucuccuucggccucgucauccagcaggucuucgacaacggcuccaucuacaaccccgagguccucgacaucaccgaggagacccuccacucccgcuuccucgagggcguccgcaacgucgccuccgucugccuccagaucggcuaccccaccgucgccuccgucccccacuccaucaucaacggcuacaagcgcguccucgcccucuccgucgagaccgacuacaccuucccccucgccgagaaggucaaggccuuccucgccgaccccuccgccuucgucgccgccgcccccgucgccgccgccaccaccgccgcccccgccgccgccgccgcccccgccaaggucgaggccaaggaggaguccgaggaguccgacgaggacaugggcuucggccucuucgacuga

SEQ ID NO: 48947 - RNA, 345 nt, Artificial Sequence
  derived and/or modified sequence opt2 from RPLP1__Homo_sapiens__NP_000994
auggccuccgucuccgagcucgccugcaucuacuccgcccucauccuccacgacgacgaggucaccgucaccgaggacaagaucaacgcccucaucaaggccgccggcgucaacgucgagcccuucuggcccggccucuucgccaaggcccucgccaacgucaacaucggcucccucaucugcaacgucggcgccggcggccccgcccccgccgccggcgccgcccccgccggcggccccgcccccuccaccgccgccgcccccgccgaggagaagaaggucgaggccaagaaggaggaguccgaggaguccgacgacgacaugggcuucggccucuucgacuga

SEQ ID NO: 48948 - RNA, 1824 nt, Artificial Sequence
  derived and/or modified sequence opt2 from RPN1__Homo_sapiens__NP_002941
auggaggcccccgccgccggccucuuccuccuccuccuccucggcaccugggcccccgcccccggcuccgccuccuccgaggcccccccccucaucaacgaggacgucaagcgcaccgucgaccucuccucccaccucgccaaggucaccgccgaggucguccucgcccaccucggcggcggcuccaccucccgcgccaccuccuuccuccucgcccucgagcccgagcucgaggcccgccucgcccaccucggcguccaggucaagggcgaggacgaggaggagaacaaccucgagguccgcgagaccaagaucaagggcaaguccggccgcuucuucaccgucaagcuccccgucgcccucgaccccggcgccaagaucuccgucaucgucgagaccgucuacacccacguccuccaccccuaccccacccagaucacccaguccgagaagcaguucgucgucuucgagggcaaccacuacuucuacucccccuaccccaccaagacccagaccaugcgcgucaagcucgccucccgcaacgucgaguccuacaccaagcucggcaaccccacccgcuccgaggaccuccucgacuacggccccuuccgcgacguccccgccuacucccaggacaccuucaagguccacuacgagaacaacucccccuuccucaccaucaccuccaugacccgcgucaucgaggucucccacuggggcaacaucgccgucgaggagaacgucgaccucaagcacaccggcgccguccucaagggccccuucucccgcuacgacuaccagcgccagcccgacuccggcaucuccuccauccgcuccuucaagaccauccuccccgccgccgcccaggacgucuacuaccgcgacgagaucggcaacgucuccaccucccaccuccucauccucgacgacuccgucgagauggagauccgcccccgcuucccccucuucggcggcuggaagacccacuacaucgucggcuacaaccuccccuccuacgaguaccucuacaaccucggcgaccaguacgcccucaagaugcgcuucgucgaccacgucuucgacgagcaggucaucgacucccucaccgucaagaucauccuccccgagggcgccaagaacaucgagaucgacucccccuacgagaucucccgcgcccccgacgagcuccacuacaccuaccucgacaccuucggccgccccgucaucgucgccuacaagaagaaccucgucgagcagcacauccaggacaucgucguccacuacaccuucaacaagguccucaugcuccaggagccccuccucgucgucgccgccuucuacauccucuucuucaccgucaucaucuacguccgccucgacuucuccaucaccaaggaccccgccgccgaggcccgcaugaaggucgccugcaucaccgagcagguccucacccucgucaacaagcgcaucggccucuaccgccacuucgacgagaccgucaaccgcuacaagcagucccgcgacaucuccacccucaacuccggcaagaagucccucgagaccgagcacaaggcccucaccuccgagaucgcccuccuccagucccgccucaagaccgagggcuccgaccucugcgaccgcgucuccgagaugcagaagcucgacgcccaggucaaggagcucguccucaaguccgccgucgaggccgagcgccucgucgccggcaagcucaagaaggacaccuacaucgagaacgagaagcucaucuccggcaagcgccaggagcucgucaccaagaucgaccacauccucgacgcccucuga

SEQ ID NO: 48949 - RNA, 1848 nt, Artificial Sequence
  derived and/or modified sequence opt2 from RPN2__Homo_sapiens__NP_001129243
auggccccccccggcuccuccaccgucuuccuccucgcccucaccaucaucgccuccaccugggcccucacccccacccacuaccucaccaagcacgacgucgagcgccucaaggccucccucgaccgccccuucaccaaccucgaguccgccuucuacuccaucgucggccucuccucccucggcgcccagguccccgacgccaagaucuccaucuccaacgagaccaaggaccuccuccucgccgccgucuccgaggacuccuccgucacccagaucuaccacgccgucgccgcccucuccggcuucggccucccccucgccucccaggaggcccucuccgcccucaccgcccgccucuccaaggaggagaccguccucgccaccguccaggcccuccagaccgccucccaccucucccagcaggccgaccuccgcuccaucgucgaggagaucgaggaccucgucgcccgccucgacgagcucggcggcgucuaccuccaguucgaggagggccucgagaccaccgcccucuucgucgccgccaccuacaagcucauggaccacgucggcaccgagcccuccaucaaggaggaccaggucauccagcucaugaacgccaucuucuccaagaagaacuucgagucccucuccgaggccuucuccgucgccuccgccgccgccguccucucccacaaccgcuaccacguccccgucgucgucguccccgagggcuccgccuccgacacccacgagcaggccauccuccgccuccaggucaccaacguccucucccagccccucacccaggccaccgucaagcucgagcacgccaaguccgucgccucccgcgccaccguccuccagaagaccuccuucacccccgucggcgacgucuucgagcucaacuucaugaacgucaaguucuccuccggcuacuacgacuuccucgucgaggucgagggcgacaaccgcuacaucgccaacaccgucgagcuccgcgucaagaucuccaccgaggucggcaucaccaacgucgaccucuccaccgucgacaaggaccaguccaucgcccccaagaccacccgcgucaccuaccccgccaaggccaagggcaccuucaucgccgacucccaccagaacuucgcccucuucuuccagcucgucgacgucaacaccggcgccgagcucaccccccaccagaccuucguccgccuccacaaccagaagaccggccaggaggucgucuucgucgccgagcccgacaacaagaacgucuacaaguucgagcucgacaccuccgagcgcaagaucgaguucgacuccgccuccggcaccuacacccucuaccucaucaucggcgacgccacccucaagaaccccauccucuggaacgucgccgacgucgucaucaaguuccccgaggaggaggcccccuccaccguccucucccagaaccucuucacccccaagcaggagauccagcaccucuuccgcgagcccgagaagcgcccccccaccgucgucuccaacaccuucaccgcccucauccucuccccccuccuccuccucuucgcccucuggauccgcaucggcgccaacgucuccaacuucaccuucgcccccuccaccaucaucuuccaccucggccacgccgccaugcucggccucauguacgucuacuggacccagcucaacauguuccagacccucaaguaccucgccauccucggcuccgucaccuuccucgccggcaaccgcaugcucgcccagcaggccgucaagcgcaucgccgccgagcaguccucccgccucgccaaguaccgcacccuccgcaccgcccacuga

SEQ ID NO: 48950 - RNA, 375 nt, Artificial Sequence
  derived and/or modified sequence opt2 from RPP14__Homo_sapiens__NP_001092253
augcccgcccccgccgccaccuacgagcgcgucgucuacaagaaccccuccgaguaccacuacaugaaggucugccucgaguuccaggacugcggcgucggccucaacgccgcccaguucaagcagcuccucaucuccgccgucaaggaccucuucggcgaggucgacgccgcccucccccucgacauccucaccuacgaggagaagacccucuccgccauccuccgcaucugcuccuccggccucgucaagcucugguccucccucacccuccucggcuccuacaagggcaagaagugcgccuuccgcgucauccaggucucccccuuccuccucgcccucuccggcaacucccgcgagcucguccucgacuga

SEQ ID NO: 48951 - RNA, 489 nt, Artificial Sequence
  derived and/or modified sequence opt2 from RPP21__Homo_sapiens__NP_001186049
auggccggccccgucaaggaccgcgaggccuuccagcgccucaacuuccucuaccaggccgcccacugcguccucgcccaggaccccgagaaccaggcccucgcccgcuucuacugcuacaccgagcgcaccaucgccaagcgccucguccuccgccgcccccucuccuccuccgccccccgcgaccccuccgucaagcgcacccucugccgcggcugcuccucccuccucguccccggccucaccugcacccagcgccagcgccgcugccgcggccagcgcuggaccguccagaccugccucaccugccagcgcucccagcgcuuccucaacgaccccggccaccuccucuggggcgaccgccccgaggcccagcucggcucccaggccgacuccaagccccuccagccccuccccaacaccgcccacuccaucuccgaccgccuccccgaggagaagaugcagacccagggcuccuccaaccaguga

SEQ ID NO: 48952 - RNA, 600 nt, Artificial Sequence
  derived and/or modified sequence opt2 from RPP25__Homo_sapiens__NP_060263
auggagaacuuccgcaagguccgcuccgaggaggcccccgccggcugcggcgccgagggcggcggccccggcuccggccccuucgccgaccucgcccccggcgccguccacaugcgcgucaaggagggcuccaagauccgcaaccucauggccuucgccaccgccuccauggcccagcccgccacccgcgccaucgucuucuccggcugcggccgcgccaccaccaagaccgucaccugcgccgagauccucaagcgccgccucgccggccuccaccaggucacccgccuccgcuaccgcuccguccgcgaggucuggcagucccucccccccggccccacccagggccagacccccggcgagcccgccgccucccucuccguccucaagaacguccccggccucgccauccuccucuccaaggacgcccucgacccccgccagcccggcuaccagccccccaacccccaccccggccccuccuccccccccgccgcccccgccuccaagcgcucccucggcgagcccgccgccggcgagggcuccgccaagcgcucccagcccgagcccggcgucgccgacgaggaccagaccgccuga

SEQ ID NO: 48953 - RNA, 852 nt, Artificial Sequence
  derived and/or modified sequence opt2 from RPP38__Homo_sapiens__NP_001252530
auggccgccgccccccaggcccccggccgcggcucccuccgcaagacccgcccccucgucgucaagaccucccucaacaaccccuacaucauccgcugguccgcccucgaguccgaggacaugcacuucauccuccagacccucgaggaccgccucaaggccaucggccuccagaagaucgaggacaagaagaagaagaacaagacccccuuccucaagaaggagucccgcgagaagugcuccaucgccgucgacaucuccgagaaccucaaggagaagaagaccgacgccaagcagcaggucuccggcuggacccccgcccacguccgcaagcagcucgccaucggcgucaacgaggucacccgcgcccucgagcgccgcgagcuccuccucguccucgucugcaaguccgucaagcccgccaugaucaccucccaccucauccagcucucccucucccgcuccguccccgccugccaggucccccgccucuccgagcgcaucgcccccgucaucggccucaagugcguccucgcccucgccuucaagaagaacaccaccgacuucgucgacgagguccgcgccaucaucccccgcguccccucccucuccguccccuggcuccaggaccgcaucgaggacuccggcgagaaccucgagaccgagccccucgagucccaggaccgcgagcuccucgacaccuccuucgaggaccucuccaagcccaagcgcaagcucgccgacggccgccaggccuccgucacccuccagccccucaagaucaagaagcucauccccaaccccaacaagauccgcaagccccccaaguccaagaaggccacccccaaguga

SEQ ID NO: 48954 - RNA, 1092 nt, Artificial Sequence
  derived and/or modified sequence opt2 from RPP40__Homo_sapiens__NP_006629
auggccacccuccgccgccuccgcgaggccccccgccaccuccucgucugcgagaaguccaacuucggcaaccacaagucccgccaccgccaccucguccagacccacuacuacaacuaccgcgucuccuuccucauccccgagugcggcauccucuccgaggagcucaagaaccucgucaugaacaccggccccuacuacuucgucaagaaccucccccuccacgagcucaucacccccgaguucaucuccaccuucaucaagaagggcuccugcuacgcccucaccuacaacacccacaucgacgaggacaacaccgucgcccuccuccccaacggcaagcucauccucucccucgacaaggacaccuacgaggagaccggccuccagggccaccccucccaguucuccggccgcaagaucaugaaguucaucgucuccaucgaccucauggagcucucccucaaccucgacuccaagaaguacgagcgcaucuccugguccuucaaggagaagaagccccucaaguucgacuuccuccucgccuggcacaagaccggcuccgaggaguccaccaugauguccuacuucuccaaguaccagauccaggagcaccagcccaaggucgcccucuccacccuccgcgaccuccagugccccguccuccaguccuccgagcucgagggcacccccgaggucuccugccgcgcccucgagcucuucgacuggcucggcgccgucuucuccaacgucgaccucaacaacgagcccaacaacuucaucuccaccuacugcugccccgagcccuccaccgucgucgccaaggccuaccucugcaccaucaccggcuucauccuccccgagaagaucugccuccuccucgagcaccucugccacuacuucgacgagcccaagcucgcccccugggucacccucuccguccagggcuucgccgacucccccgucuccugggagaagaacgagcacggcuuccgcaagggcggcgagcaccucuacaacuucgucaucuucaacaaccaggacuacuggcuccagauggccgucggcgccaacgaccacugcccccccuga

SEQ ID NO: 48955 - RNA, 831 nt, Artificial Sequence
  derived and/or modified sequence opt2 from RPRD1A__Homo_sapiens__NP_001290340
augcgcaacuccaacuggcgcuucugccagaccggcaucuacuccaagcccaaccgcaagcucaccuuccucuaccucgccaacgacgucauccagaacuccaagcgcaagggccccgaguucaccaaggacuucgcccccgucaucgucgaggccuucaagcacgucuccuccgagaccgacgaguccugcaagaagcaccucggccgcguccucuccaucugggaggagcgcuccgucuacgagaacgacguccucgagcagcucaagcaggcccucuacggcgacaagaagccccgcaagcgcaccuacgagcagaucaaggucgacgagaacgagaacugcuccucccucggcucccccuccgagcccccccagacccucgaccucguccgcgcccuccaggaccucgagaacgccgccuccggcgacgccgccguccaccagcgcaucgccucccuccccgucgagguccaggaggucucccuccucgacaagaucaccgacaaggaguccggcgagcgccucuccaagauggucgaggacgccugcaugcuccucgccgacuacaacggccgccucgccgccgagaucgacgaccgcaagcagcucacccgcaugcucgccgacuuccuccgcugccagaaggaggcccucgccgagaaggagcacaagcucgaggaguacaagcgcaagcucgcccgcgucucccucguccgcaaggagcuccgcucccgcauccagucccuccccgaccucucccgccuccccaacgucaccggcucccacaugcaccuccccuucgccggcgacaucuacuccgaggacuga

SEQ ID NO: 48956 - RNA, 981 nt, Artificial Sequence
  derived and/or modified sequence opt2 from RPRD1B__Homo_sapiens__NP_067038
auguccuccuucuccgaguccgcccucgagaagaagcucuccgagcucuccaacucccagcaguccguccagacccucucccucuggcucauccaccaccgcaagcacgccggccccaucgucuccgucuggcaccgcgagcuccgcaaggccaaguccaaccgcaagcucaccuuccucuaccucgccaacgacgucauccagaacuccaagcgcaagggccccgaguucacccgcgaguucgaguccguccucgucgacgccuucucccacgucgcccgcgaggccgacgagggcugcaagaagccccucgagcgccuccucaacaucuggcaggagcgcuccgucuacggcggcgaguucauccagcagcucaagcucuccauggaggacuccaagucccccccccccaaggccaccgaggagaagaagucccucaagcgcaccuuccagcagauccaggaggaggaggacgacgacuaccccggcuccuacuccccccaggaccccuccgccggcccccuccucaccgaggagcucaucaaggcccuccaggaccucgagaacgccgccuccggcgacgccaccguccgccagaagaucgccucccucccccaggagguccaggacgucucccuccucgagaagaucaccgacaaggaggccgccgagcgccucuccaagaccgucgacgaggccugccuccuccucgccgaguacaacggccgccucgccgccgagcucgaggaccgccgccagcucgcccgcaugcucgucgaguacacccagaaccagaaggacguccucuccgagaaggagaagaagcucgaggaguacaagcagaagcucgcccgcgucacccagguccgcaaggagcucaagucccacauccagucccuccccgaccucucccuccuccccaacgucaccggcggccucgccccccuccccuccgccggcgaccucuucuccaccgacuga

SEQ ID NO: 48957 - RNA, 2805 nt, Artificial Sequence
  derived and/or modified sequence opt2 from RPRD2__Homo_sapiens__NP_001284602
auggccgccggcggcggcggcggcuccuccaaggccuccuccuccuccgccuccuccgccggcgcccucgaguccucccucgaccgcaaguuccaguccgucaccaacaccauggaguccauccagggccucuccuccuggugcaucgagaacaagaagcaccacuccaccaucgucuaccacuggaugaaguggcuccgccgcuccgccuacccccaccgccucaaccucuucuaccucgccaacgacgucauccagaacugcaagcgcaagaacgccaucaucuuccgcgaguccuucgccgacguccuccccgaggccgccgcccucgucaaggaccccuccgucuccaaguccgucgagcgcaucuucaagaucugggaggaccgcaacgucuaccccgaggagaugaucgucgcccuccgcgaggcccucaccuccaccaaccccaaggccgcccucaaguccaagaucgucgccgaguuccgcucccaggcccucaucgaggagcuccuccucuacaagcgcuccgaggaccagaucgagcucaaggagaagcagcucuccaccaugcgcgucgacgucugcuccaccgagacccucaagugccucaaggacaagaccggcggcaagaaguucuccaaggaguucgaggaggccuccuccaagcucgaggaguucgucaacggccucgacaagcaggucaagaacggccccucccucaccgaggcccucgagaacgccggcaucuucuacgaggcccaguacaaggaggucaaggucgucgccaacgccuacaagaccuucgccaaccgcgucaacaaccucaagaagaagcucgaccagcucaaguccacccuccccgaccccgaggagucccccguccccucccccuccauggacgcccccucccccaccggcuccgagucccccuuccagggcaugggcggcgaggagucccagucccccaccauggaguccgagaaguccgccacccccgagcccgucaccgacaaccgcgacgucgaggacauggagcucuccgacgucgaggacgacggcuccaagaucaucgucgaggaccgcaaggagaagcccgccgagaaguccgccgucuccaccuccguccccaccaagcccaccgagaacaucuccaaggccuccuccugcacccccguccccgucaccaugaccgccacccccccccuccccaagcccgucaacaccucccucucccccucccccgcccucgcccuccccaaccucgccaacgucgaccucgccaagaucuccuccauccucuccucccucaccuccgucaugaagaacaccggcgucucccccgccucccgccccucccccggcacccccaccucccccuccaaccucaccuccggccucaagacccccgcccccgccaccaccaccucccacaacccccucgccaacauccucuccaaggucgagaucacccccgaguccauccucuccgcccucuccaagacccagacccaguccgcccccgcccuccagggccucuccucccuccuccaguccgucaccggcaaccccguccccgccuccgaggccgccucccaguccaccuccgccucccccgccaacaccaccgucuccaccaucaagggccgcaaccuccccuccuccgcccagcccuucauccccaaguccuucaacuacucccccaacuccuccaccuccgaggucuccuccaccuccgccuccaaggccuccaucggccagucccccggccuccccuccaccaccuucaagcuccccuccaacucccucggcuucaccgccacccacaacaccucccccgccgccccccccaccgaggucaccaucugccaguccuccgaggucuccaagcccaagcucgaguccgaguccaccucccccucccucgagaugaagauccacaacuuccucaagggcaaccccggcuucuccggccucaaccucaacauccccauccucuccucccucggcuccuccgcccccuccgagucccaccccuccgacuuccagcgcggccccaccuccaccuccaucgacaacaucgacggcacccccguccgcgacgagcgcuccggcacccccacccaggacgagaugauggacaagcccaccuccuccuccgucgacaccaugucccuccucuccaagaucaucucccccggcuccuccacccccuccuccacccgcucccccccccccggccgcgacgaguccuacccccgcgagcucuccaacuccgucuccaccuaccgccccuucggccucggcuccgagucccccuacaagcagcccuccgacggcauggagcgccccuccucccucauggacuccucccaggagaaguucuaccccgacaccuccuuccaggaggacgaggacuaccgcgacuucgaguacuccggccccccccccuccgccaugaugaaccucgagaagaagcccgccaaguccauccucaaguccuccaagcucuccgacaccaccgaguaccagcccauccucuccuccuacucccaccgcgcccaggaguucggcgucaaguccgccuucccccccuccguccgcgcccuccucgacuccuccgagaacugcgaccgccucuccuccucccccggccucuucggcgccuucuccguccgcggcaacgagcccggcuccgaccgcucccccucccccaagcaccccugccgcucccacggcucccccacccacguccgccgcggcgagucccccggccuccaccacuuccaccacgucgacgacuga

SEQ ID NO: 48958 - RNA, 330 nt, Artificial Sequence
  derived and/or modified sequence opt2 from RPRM__Homo_sapiens__NP_062819
augaaccccgcccucggcaaccagaccgacgucgccggccucuuccucgccaacuccuccgaggcccucgagcgcgccguccgcugcugcacccaggccuccgucgucaccgacgacggcuucgccgagggcggccccgacgagcgcucccucuacaucaugcgcgucguccagaucgccgucaugugcguccucucccucaccgucgucuucggcaucuucuuccucggcugcaaccuccucaucaaguccgagggcaugaucaacuuccucgucaaggaccgccgccccuccaaggaggucgaggccgucgucgucggccccuacuga

SEQ ID NO: 48959 - RNA, 498 nt, Artificial Sequence
  derived and/or modified sequence opt2 from RPS10__Homo_sapiens__NP_001191020
augcucaugcccaagaagaaccgcaucgccaucuacgagcuccucuucaaggagggcgucauggucgccaagaaggacguccacaugcccaagcaccccgagcucgccgacaagaacguccccaaccuccacgucaugaaggccaugcagucccucaagucccgcggcuacgucaaggagcaguucgccuggcgccacuucuacugguaccucaccaacgagggcauccaguaccuccgcgacuaccuccaccucccccccgagaucguccccgccacccuccgccgcucccgccccgagaccggccgcccccgccccaagggccucgagggcgagcgccccgcccgccucacccgcggcgaggccgaccgcgacaccuaccgccgcuccgccgucccccccggcgccgacaagaaggccgaggccggcgccggcuccgccaccgaguuccaguuccgcggcggcuucggccgcggccgcggccagcccccccaguga

SEQ ID NO: 48960 - RNA, 456 nt, Artificial Sequence
  derived and/or modified sequence opt2 from RPS14__Homo_sapiens__NP_001020242
auggccccccgcaagggcaaggagaagaaggaggagcaggucaucucccucggcccccaggucgccgagggcgagaacgucuucggcgucugccacaucuucgccuccuucaacgacaccuucguccacgucaccgaccucuccggcaaggagaccaucugccgcgucaccggcggcaugaaggucaaggccgaccgcgacgaguccucccccuacgccgccaugcucgccgcccaggacgucgcccagcgcugcaaggagcucggcaucaccgcccuccacaucaagcuccgcgccaccggcggcaaccgcaccaagacccccggccccggcgcccaguccgcccuccgcgcccucgcccgcuccggcaugaagaucggccgcaucgaggacgucacccccauccccuccgacuccacccgccgcaagggcggccgccgcggccgccgccucuga

SEQ ID NO: 48961 - RNA, 393 nt, Artificial Sequence
  derived and/or modified sequence opt2 from RPS15A__Homo_sapiens__NP_001025180
augguccgcaugaacguccucgccgacgcccucaaguccaucaacaacgccgagaagcgcggcaagcgccagguccucauccgccccugcuccaaggucaucguccgcuuccucaccgucaugaugaagcacggcuacaucggcgaguucgagaucaucgacgaccaccgcgccggcaagaucgucgucaaccucaccggccgccucaacaagugcggcgucaucuccccccgcuucgacguccagcucaaggaccucgagaaguggcagaacaaccuccuccccucccgccaguucggcuucaucguccucaccaccuccgccggcaucauggaccacgaggaggcccgccgcaagcacaccggcggcaagauccucggcuucuucuucuga

SEQ ID NO: 48962 - RNA, 459 nt, Artificial Sequence
  derived and/or modified sequence opt2 from RPS16__Homo_sapiens__XP_005259194
augcccuccaagggcccccuccaguccguccaggucuucggccgcaagaagaccgccaccgccgucgcccacugcaagcgcggcaacggccucaucaaggucaacggccgcccccucgagaugaucgagccccgcacccuccaguacaagcuccucgagcccguccuccuccucggcaaggagcgcuucgccggcgucgacauccgcguccgcgucaagggcggcggccacgucgcccagaucuacggcgagucccaggagcucggcgccuggcgccgcuggcucugggagggcggccuccacuccgcccccguccccuucaacugcgucuccuucucccagcucuccgucucccccucccccaagcccugguggcccaucacccgcaacauguggaugcgccucccccgccgccgcuccaagaccuccuccuccuccaugaccggccccugcugguga

SEQ ID NO: 48963 - RNA, 459 nt, Artificial Sequence
  derived and/or modified sequence opt2 from RPS18__Homo_sapiens__NP_072045
augucccucgucauccccgagaaguuccagcacauccuccgcguccucaacaccaacaucgacggccgccgcaagaucgccuucgccaucaccgccaucaagggcgucggccgccgcuacgcccacgucguccuccgcaaggccgacaucgaccucaccaagcgcgccggcgagcucaccgaggacgaggucgagcgcgucaucaccaucaugcagaacccccgccaguacaagauccccgacugguuccucaaccgccagaaggacgucaaggacggcaaguacucccagguccucgccaacggccucgacaacaagcuccgcgaggaccucgagcgccucaagaagauccgcgcccaccgcggccuccgccacuucuggggccuccgcguccgcggccagcacaccaagaccaccggccgccgcggccgcaccgucggcgucuccaagaagaaguga

SEQ ID NO: 48964 - RNA, 411 nt, Artificial Sequence
  derived and/or modified sequence opt2 from RPS19BP1__Homo_sapiens__NP_919307
auguccgccgcccuccuccgccgcggccucgagcuccucgccgccuccgaggccccccgcgacccccccggccaggccaagccccgcggcgcccccgucaagcgcccccgcaagaccaaggccauccaggcccagaagcuccgcaacuccgccaagggcaagguccccaaguccgcccucgacgaguaccgcaagcgcgagugccgcgaccaccuccgcgucaaccucaaguuccucacccgcacccgcuccaccgucgccgaguccgucucccagcagauccuccgccagaaccgcggccgcaaggccugcgaccgccccgucgccaagaccaagaagaagaaggccgagggcaccgucuucaccgaggaggacuuccagaaguuccagcaggaguacuucggcuccuga

SEQ ID NO: 48965 - RNA, 429 nt, Artificial Sequence
  derived and/or modified sequence opt2 from RPS20__Homo_sapiens__NP_001139699
auggccuucaaggacaccggcaagacccccgucgagcccgaggucgccauccaccgcauccgcaucacccucaccucccgcaacgucaagucccucgagaaggucugcgccgaccucauccgcggcgccaaggagaagaaccucaaggucaagggccccguccgcaugcccaccaagacccuccgcaucaccacccgcaagacccccugcggcgagggcuccaagaccugggaccgcuuccagaugcgcauccacaagcgccucaucgaccuccacucccccuccgagaucgucaagcagaucaccuccaucuccaucgagcccggcgucgagcucaucgaguccaccgacgccgagcccauggacaccgagggccagcaguacacccuccgcuccgucuucgagucccccggcaccugccccuucuga

SEQ ID NO: 48966 - RNA, 396 nt, Artificial Sequence
  derived and/or modified sequence opt2 from RPS24__Homo_sapiens__NP_001135754
augaacgacaccgucaccauccgcacccgcaaguucaugaccaaccgccuccuccagcgcaagcagauggucaucgacguccuccaccccggcaaggccaccguccccaagaccgagauccgcgagaagcucgccaagauguacaagaccacccccgacgucaucuucgucuucggcuuccgcacccacuucggcggcggcaagaccaccggcuucggcaugaucuacgacucccucgacuacgccaagaagaacgagcccaagcaccgccucgcccgccacggccucuacgagaagaagaagaccucccgcaagcagcgcaaggagcgcaagaaccgcaugaagaagguccgcggcaccgccaaggccaacgucggcgccggcaagaagaaguga

SEQ ID NO: 48967 - RNA, 471 nt, Artificial Sequence
  derived and/or modified sequence opt2 from RPS27A__Homo_sapiens__NP_001170884
augcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcgccaagaagcgcaagaagaaguccuacaccacccccaagaagaacaagcacaagcgcaagaaggucaagcucgccguccucaaguacuacaaggucgacgagaacggcaagaucucccgccuccgccgcgagugccccuccgacgagugcggcgccggcgucuucauggccucccacuucgaccgccacuacugcggcaagugcugccucaccuacugcuucaacaagcccgaggacaaguga

SEQ ID NO: 48968 - RNA, 255 nt, Artificial Sequence
  derived and/or modified sequence opt2 from RPS27__Homo_sapiens__NP_001021
augccccucgccaaggaccuccuccaccccucccccgaggaggagaagcgcaagcacaagaagaagcgccucguccagucccccaacuccuacuucauggacgucaagugccccggcugcuacaagaucaccaccgucuucucccacgcccagaccgucguccucugcgucggcugcuccaccguccucugccagcccaccggcggcaaggcccgccucaccgagggcugcuccuuccgccgcaagcagcacuga

SEQ ID NO: 48969 - RNA, 255 nt, Artificial Sequence
  derived and/or modified sequence opt2 from RPS27L__Homo_sapiens__NP_057004
augccccucgcccgcgaccuccuccaccccucccucgaggaggagaagaagaagcacaagaagaagcgccucguccagucccccaacuccuacuucauggacgucaagugccccggcugcuacaagaucaccaccgucuucucccacgcccagaccgucguccucugcgucggcugcuccaccguccucugccagcccaccggcggcaaggcccgccucaccgagggcugcuccuuccgccgcaagcagcacuga

SEQ ID NO: 48970 - RNA, 171 nt, Artificial Sequence
  derived and/or modified sequence opt2 from RPS29__Homo_sapiens__NP_001023
augggccaccagcagcucuacuggucccacccccgcaaguucggccagggcucccgcuccugccgcgucugcuccaaccgccacggccucauccgcaaguacggccucaacaugugccgccagugcuuccgccaguacgccaaggacaucggcuucaucaagcucgacuga

SEQ ID NO: 48971 - RNA, 882 nt, Artificial Sequence
  derived and/or modified sequence opt2 from RPS2__Homo_sapiens__NP_002943
auggccgacgacgccggcgccgccggcggccccggcggccccggcggccccggcaugggcaaccgcggcggcuuccgcggcggcuucggcuccggcauccgcggccgcggccgcggccgcggccgcggccgcggccgcggccgcggcgcccgcggcggcaaggccgaggacaaggaguggaugcccgucaccaagcucggccgccucgucaaggacaugaagaucaagucccucgaggagaucuaccucuucucccuccccaucaaggaguccgagaucaucgacuucuuccucggcgccucccucaaggacgagguccucaagaucaugcccguccagaagcagacccgcgccggccagcgcacccgcuucaaggccuucgucgccaucggcgacuacaacggccacgucggccucggcgucaagugcuccaaggaggucgccaccgccauccgcggcgccaucauccucgccaagcucuccaucguccccguccgccgcggcuacuggggcaacaagaucggcaagccccacaccguccccugcaaggucaccggccgcugcggcuccguccucguccgccucauccccgccccccgcggcaccggcaucgucuccgcccccguccccaagaagcuccucaugauggccggcaucgacgacugcuacaccuccgcccgcggcugcaccgccacccucggcaacuucgccaaggccaccuucgacgccaucuccaagaccuacuccuaccucacccccgaccucuggaaggagaccgucuucaccaagucccccuaccaggaguucaccgaccaccucgucaagacccacacccgcgucuccguccagcgcacccaggcccccgccgucgccaccaccuga

SEQ ID NO: 48972 - RNA, 795 nt, Artificial Sequence
  derived and/or modified sequence opt2 from RPS3A__Homo_sapiens__NP_000997
auggccgucggcaagaacaagcgccucaccaagggcggcaagaagggcgccaagaagaaggucgucgaccccuucuccaagaaggacugguacgacgucaaggcccccgccauguucaacauccgcaacaucggcaagacccucgucacccgcacccagggcaccaagaucgccuccgacggccucaagggccgcgucuucgaggucucccucgccgaccuccagaacgacgaggucgccuuccgcaaguucaagcucaucaccgaggacguccagggcaagaacugccucaccaacuuccacggcauggaccucacccgcgacaagaugugcuccauggucaagaaguggcagaccaugaucgaggcccacgucgacgucaagaccaccgacggcuaccuccuccgccucuucugcgucggcuucaccaagaagcgcaacaaccagauccgcaagaccuccuacgcccagcaccagcagguccgccagauccgcaagaagaugauggagaucaugacccgcgagguccagaccaacgaccucaaggaggucgucaacaagcucauccccgacuccaucggcaaggacaucgagaaggccugccaguccaucuacccccuccacgacgucuucguccgcaaggucaagaugcucaagaagcccaaguucgagcucggcaagcucauggagcuccacggcgagggcuccuccuccggcaaggccaccggcgacgagaccggcgccaaggucgagcgcgccgacggcuacgagccccccguccaggaguccgucuga

SEQ ID NO: 48973 - RNA, 732 nt, Artificial Sequence
  derived and/or modified sequence opt2 from RPS3__Homo_sapiens__NP_000996
auggccguccagaucuccaagaagcgcaaguucgucgccgacggcaucuucaaggccgagcucaacgaguuccucacccgcgagcucgccgaggacggcuacuccggcgucgagguccgcgucacccccacccgcaccgagaucaucauccucgccacccgcacccagaacguccucggcgagaagggccgccgcauccgcgagcucaccgccgucguccagaagcgcuucggcuuccccgagggcuccgucgagcucuacgccgagaaggucgccacccgcggccucugcgccaucgcccaggccgagucccuccgcuacaagcuccucggcggccucgccguccgccgcgccugcuacggcguccuccgcuucaucauggaguccggcgccaagggcugcgaggucgucgucuccggcaagcuccgcggccagcgcgccaaguccaugaaguucgucgacggccucaugauccacuccggcgaccccgucaacuacuacgucgacaccgccguccgccacguccuccuccgccagggcguccucggcaucaaggucaagaucaugcuccccugggaccccaccggcaagaucggccccaagaagccccuccccgaccacgucuccaucgucgagcccaaggacgagauccuccccaccacccccaucuccgagcagaagggcggcaagcccgagccccccgccaugccccagcccguccccaccgccuga

SEQ ID NO: 48974 - RNA, 792 nt, Artificial Sequence
  derived and/or modified sequence opt2 from RPS4X__Homo_sapiens__NP_000998
auggcccgcggccccaagaagcaccucaagcgcgucgccgcccccaagcacuggaugcucgacaagcucaccggcgucuucgccccccgccccuccaccggcccccacaagcuccgcgagugccucccccucaucaucuuccuccgcaaccgccucaaguacgcccucaccggcgacgaggucaagaagaucugcaugcagcgcuucaucaagaucgacggcaagguccgcaccgacaucaccuaccccgccggcuucauggacgucaucuccaucgacaagaccggcgagaacuuccgccucaucuacgacaccaagggccgcuucgccguccaccgcaucacccccgaggaggccaaguacaagcucugcaagguccgcaagaucuucgucggcaccaagggcaucccccaccucgucacccacgacgcccgcaccauccgcuaccccgacccccucaucaaggucaacgacaccauccagaucgaccucgagaccggcaagaucaccgacuucaucaaguucgacaccggcaaccucugcauggucaccggcggcgccaaccucggccgcaucggcgucaucaccaaccgcgagcgccaccccggcuccuucgacgucguccacgucaaggacgccaacggcaacuccuucgccacccgccucuccaacaucuucgucaucggcaagggcaacaagcccuggaucucccucccccgcggcaagggcauccgccucaccaucgccgaggagcgcgacaagcgccucgccgccaagcaguccuccggcuga

SEQ ID NO: 48975 - RNA, 792 nt, Artificial Sequence
  derived and/or modified sequence opt2 from RPS4Y1__Homo_sapiens__NP_000999
auggcccgcggccccaagaagcaccucaagcgcgucgccgcccccaagcacuggaugcucgacaagcucaccggcgucuucgccccccgccccuccaccggcccccacaagcuccgcgagugccucccccucaucgucuuccuccgcaaccgccucaaguacgcccucaccggcgacgaggucaagaagaucugcaugcagcgcuucaucaagaucgacggcaagguccgcgucgacgucaccuaccccgccggcuucauggacgucaucuccaucgagaagaccggcgagcacuuccgccucgucuacgacaccaagggccgcuucgccguccaccgcaucaccgucgaggaggccaaguacaagcucugcaagguccgcaagaucaccgucggcgucaagggcaucccccaccucgucacccacgacgcccgcaccauccgcuaccccgaccccgucaucaaggucaacgacaccguccagaucgaccucggcaccggcaagaucaucaacuucaucaaguucgacaccggcaaccucugcauggucaucggcggcgccaaccucggccgcgucggcgucaucaccaaccgcgagcgccaccccggcuccuucgacgucguccacgucaaggacgccaacggcaacuccuucgccacccgccucuccaacaucuucgucaucggcaacggcaacaagcccuggaucucccucccccgcggcaagggcauccgccucaccgucgccgaggagcgcgacaagcgccucgccaccaagcaguccuccggcuga

SEQ ID NO: 48976 - RNA, 2226 nt, Artificial Sequence
  derived and/or modified sequence opt2 from RPS6KA2__Homo_sapiens__NP_001006933
augcccaucgcccagcuccucgagcucuggaagaagaucgaggucgagcccauggagaucgagaccaccgaggaggaccucaaccucgacgucgagcccgccaccgaggacaccgccgaggaggaggagggcgucgucaaggagaucgacaucucccaccacgucaaggagggcuucgagaaggccgaccccucccaguucgagcuccucaagguccucggccagggcuccuacggcaaggucuuccucguccgcaaggucaagggcuccgacgccggccagcucuacgccaugaagguccucaagaaggccacccucaagguccgcgaccgcguccgcuccaagauggagcgcgacauccucgccgaggucaaccaccccuucaucgucaagcuccacuacgccuuccagaccgagggcaagcucuaccucauccucgacuuccuccgcggcggcgaccucuucacccgccucuccaaggaggucauguucaccgaggaggacgucaaguucuaccucgccgagcucgcccucgcccucgaccaccuccacucccucggcaucaucuaccgcgaccucaagcccgagaacauccuccucgacgaggagggccacaucaagaucaccgacuucggccucuccaaggaggccaucgaccacgacaagcgcgccuacuccuucugcggcaccaucgaguacauggcccccgaggucgucaaccgccgcggccacacccaguccgccgacuggugguccuucggcguccucauguucgagaugcucaccggcucccuccccuuccagggcaaggaccgcaaggagaccauggcccucauccucaaggccaagcucggcaugccccaguuccucuccggcgaggcccagucccuccuccgcgcccucuucaagcgcaaccccugcaaccgccucggcgccggcaucgacggcgucgaggagaucaagcgccaccccuucuucgucaccaucgacuggaacacccucuaccgcaaggagaucaagccccccuucaagcccgccgucggccgccccgaggacaccuuccacuucgaccccgaguucaccgcccgcacccccaccgacucccccggcgucccccccuccgccaacgcccaccaccucuuccgcggcuucuccuucgucgccuccucccucauccaggagcccucccagcaggaccuccacaagguccccguccaccccaucguccagcagcuccacggcaacaacauccacuucaccgacggcuacgagaucaaggaggacaucggcgucggcuccuacuccgucugcaagcgcugcguccacaaggccaccgacaccgaguacgccgucaagaucaucgacaaguccaagcgcgaccccuccgaggagaucgagauccuccuccgcuacggccagcaccccaacaucaucacccucaaggacgucuacgacgacggcaaguucgucuaccucgucauggagcucaugcgcggcggcgagcuccucgaccgcauccuccgccagcgcuacuucuccgagcgcgaggccuccgacguccucugcaccaucaccaagaccauggacuaccuccacucccagggcgucguccaccgcgaccucaagcccuccaacauccucuaccgcgacgaguccggcucccccgaguccauccgcgucugcgacuucggcuucgccaagcagcuccgcgccggcaacggccuccucaugacccccugcuacaccgccaacuucgucgcccccgagguccucaagcgccagggcuacgacgccgccugcgacaucuggucccucggcauccuccucuacaccaugcucgccggcuucacccccuucgccaacggccccgacgacacccccgaggagauccucgcccgcaucggcuccggcaaguacgcccucuccggcggcaacugggacuccaucuccgacgccgccaaggacgucgucuccaagaugcuccacgucgacccccaccagcgccucaccgccaugcagguccucaagcaccccugggucgucaaccgcgaguaccucucccccaaccagcucucccgccaggacguccaccucgucaagggcgccauggccgccaccuacuucgcccucaaccgcaccccccaggccccccgccucgagcccguccucuccuccaaccucgcccagcgccgcggcaugaagcgccucaccuccacccgccucuga

SEQ ID NO: 48977 - RNA, 2223 nt, Artificial Sequence
  derived and/or modified sequence opt2 from RPS6KA3__Homo_sapiens__NP_004577
augccccucgcccagcucgccgaccccuggcagaagauggccgucgagucccccuccgacuccgccgagaacggccagcagaucauggacgagcccaugggcgaggaggagaucaacccccagaccgaggaggucuccaucaaggagaucgccaucacccaccacgucaaggagggccacgagaaggccgaccccucccaguucgagcuccucaagguccucggccagggcuccuucggcaaggucuuccucgucaagaagaucuccggcuccgacgcccgccagcucuacgccaugaagguccucaagaaggccacccucaagguccgcgaccgcguccgcaccaagauggagcgcgacauccucgucgaggucaaccaccccuucaucgucaagcuccacuacgccuuccagaccgagggcaagcucuaccucauccucgacuuccuccgcggcggcgaccucuucacccgccucuccaaggaggucauguucaccgaggaggacgucaaguucuaccucgccgagcucgcccucgcccucgaccaccuccacucccucggcaucaucuaccgcgaccucaagcccgagaacauccuccucgacgaggagggccacaucaagcucaccgacuucggccucuccaaggaguccaucgaccacgagaagaaggccuacuccuucugcggcaccgucgaguacauggcccccgaggucgucaaccgccgcggccacacccaguccgccgacuggugguccuucggcguccucauguucgagaugcucaccggcacccuccccuuccagggcaaggaccgcaaggagaccaugaccaugauccucaaggccaagcucggcaugccccaguuccucucccccgaggcccagucccuccuccgcaugcucuucaagcgcaaccccgccaaccgccucggcgccggccccgacggcgucgaggagaucaagcgccacuccuucuucuccaccaucgacuggaacaagcucuaccgccgcgagauccacccccccuucaagcccgccaccggccgccccgaggacaccuucuacuucgaccccgaguucaccgccaagacccccaaggacucccccggcaucccccccuccgccaacgcccaccagcucuuccgcggcuucuccuucgucgccaucaccuccgacgacgagucccaggccaugcagaccgucggcguccacuccaucguccagcagcuccaccgcaacuccauccaguucaccgacggcuacgaggucaaggaggacaucggcgucggcuccuacuccgucugcaagcgcugcauccacaaggccaccaacauggaguucgccgucaagaucaucgacaaguccaagcgcgaccccaccgaggagaucgagauccuccuccgcuacggccagcaccccaacaucaucacccucaaggacgucuacgacgacggcaaguacgucuacgucgucaccgagcucaugaagggcggcgagcuccucgacaagauccuccgccagaaguucuucuccgagcgcgaggccuccgccguccucuucaccaucaccaagaccgucgaguaccuccacgcccagggcgucguccaccgcgaccucaagcccuccaacauccucuacgucgacgaguccggcaaccccgaguccauccgcaucugcgacuucggcuucgccaagcagcuccgcgccgagaacggccuccucaugacccccugcuacaccgccaacuucgucgcccccgagguccucaagcgccagggcuacgacgccgccugcgacaucuggucccucggcguccuccucuacaccaugcucaccggcuacacccccuucgccaacggccccgacgacacccccgaggagauccucgcccgcaucggcuccggcaaguucucccucuccggcggcuacuggaacuccgucuccgacaccgccaaggaccucgucuccaagaugcuccacgucgacccccaccagcgccucaccgccgcccucguccuccgccaccccuggaucguccacugggaccagcucccccaguaccagcucaaccgccaggacgccccccaccucgucaagggcgccauggccgccaccuacuccgcccucaaccgcaaccagucccccguccucgagcccgucggccgcuccacccucgcccagcgccgcggcaucaagaagaucaccuccaccgcccucuga

SEQ ID NO: 48978 - RNA, 2301 nt, Artificial Sequence
  derived and/or modified sequence opt2 from RPS6KA4__Homo_sapiens__NP_001006945
augggcgacgaggacgacgacgaguccugcgccgucgagcuccgcaucaccgaggccaaccucaccggccacgaggagaaggucuccgucgagaacuucgagcuccucaagguccucggcaccggcgccuacggcaaggucuuccucguccgcaaggccggcggccacgacgccggcaagcucuacgccaugaagguccuccgcaaggccgcccucguccagcgcgccaagacccaggagcacacccgcaccgagcgcuccguccucgagcucguccgccaggcccccuuccucgucacccuccacuacgccuuccagaccgacgccaagcuccaccucauccucgacuacgucuccggcggcgagauguucacccaccucuaccagcgccaguacuucaaggaggccgagguccgcgucuacggcggcgagaucguccucgcccucgagcaccuccacaagcucggcaucaucuaccgcgaccucaagcucgagaacguccuccucgacuccgagggccacaucguccucaccgacuucggccucuccaaggaguuccucaccgaggagaaggagcgcaccuucuccuucugcggcaccaucgaguacauggcccccgagaucauccgcuccaagaccggccacggcaaggccgucgacugguggucccucggcauccuccucuucgagcuccucaccggcgccucccccuucacccucgagggcgagcgcaacacccaggccgaggucucccgccgcauccucaagugcuccccccccuuccccccccgcaucggccccgucgcccaggaccuccuccagcgccuccucugcaaggaccccaagaagcgccucggcgccggcccccagggcgcccaggagguccgcaaccaccccuucuuccagggccucgacugggucgcccucgccgcccgcaagauccccgcccccuuccgcccccagauccgcuccgagcucgacgucggcaacuucgccgaggaguucacccgccucgagcccgucuacuccccccccggcucccccccccccggcgacccccgcaucuuccagggcuacuccuucgucgcccccuccauccucuucgaccacaacaacgccgucaugaccgacggccucgaggcccccggcgccggcgaccgccccggccgcgccgccgucgcccgcuccgccaugaugcagcaguacgagcucgaccuccgcgagcccgcccucggccagggcuccuucuccgucugccgccgcugccgccagcgccaguccggccaggaguucgccgucaagauccucucccgccgccucgaggccaacacccagcgcgaggucgccgcccuccgccucugccagucccaccccaacgucgucaaccuccacgagguccaccacgaccagcuccacaccuaccucguccucgagcuccuccgcggcggcgagcuccucgagcacauccgcaagaagcgccacuucuccgaguccgaggccucccagauccuccgcucccucgucuccgccgucuccuucaugcacgaggaggccggcgucguccaccgcgaccucaagcccgagaacauccucuacgccgacgacacccccggcgcccccgucaagaucaucgacuucggcuucgcccgccuccgcccccagucccccggcguccccaugcagacccccugcuucacccuccaguacgccgcccccgagcuccucgcccagcagggcuacgacgaguccugcgaccucuggucccucggcgucauccucuacaugaugcucuccggccagguccccuuccagggcgccuccggccagggcggccagucccaggccgccgagaucaugugcaagauccgcgagggccgcuucucccucgacggcgaggccuggcagggcgucuccgaggaggccaaggagcucguccgcggccuccucaccgucgaccccgccaagcgccucaagcucgagggccuccgcggcuccuccuggcuccaggacggcuccgcccgcuccucccccccccuccgcacccccgacguccucgaguccuccggccccgccguccgcuccggccucaacgccaccuucauggccuucaaccgcggcaagcgcgagggcuucuuccucaaguccgucgagaacgccccccucgccaagcgccgcaagcagaagcuccgcuccgccaccgccucccgccgcggcucccccgcccccgccaaccccggccgcgcccccgucgccuccaagggcgccccccgccgcgccaacggcccccucccccccuccuga

SEQ ID NO: 48979 - RNA, 2409 nt, Artificial Sequence
  derived and/or modified sequence opt2 from RPS6KA5__Homo_sapiens__NP_004746
auggaggaggagggcggcuccuccggcggcgccgccggcaccuccgccgacggcggcgacggcggcgagcagcuccucaccgucaagcacgagcuccgcaccgccaaccucaccggccacgccgagaaggucggcaucgagaacuucgagcuccucaagguccucggcaccggcgccuacggcaaggucuuccucguccgcaagaucuccggccacgacaccggcaagcucuacgccaugaagguccucaagaaggccaccaucguccagaaggccaagaccaccgagcacacccgcaccgagcgccagguccucgagcacauccgccagucccccuuccucgucacccuccacuacgccuuccagaccgagaccaagcuccaccucauccucgacuacaucaacggcggcgagcucuucacccaccucucccagcgcgagcgcuucaccgagcacgagguccagaucuacgucggcgagaucguccucgcccucgagcaccuccacaagcucggcaucaucuaccgcgacaucaagcucgagaacauccuccucgacuccaacggccacgucguccucaccgacuucggccucuccaaggaguucgucgccgacgagaccgagcgcgccuacuccuucugcggcaccaucgaguacauggcccccgacaucguccgcggcggcgacuccggccacgacaaggccgucgacugguggucccucggcguccucauguacgagcuccucaccggcgccucccccuucaccgucgacggcgagaagaacucccaggccgagaucucccgccgcauccucaaguccgagccccccuacccccaggagauguccgcccucgccaaggaccucauccagcgccuccucaugaaggaccccaagaagcgccucggcugcggcccccgcgacgccgacgagaucaaggagcaccucuucuuccagaagaucaacugggacgaccucgccgccaagaagguccccgcccccuucaagcccgucauccgcgacgagcucgacgucuccaacuucgccgaggaguucaccgagauggaccccaccuacucccccgccgcccucccccaguccuccgagaagcucuuccagggcuacuccuucgucgcccccuccauccucuucaagcgcaacgccgccgucaucgacccccuccaguuccacaugggcgucgagcgccccggcgucaccaacgucgcccgcuccgccaugaugaaggacucccccuucuaccagcacuacgaccucgaccucaaggacaagccccucggcgagggcuccuucuccaucugccgcaagugcguccacaagaaguccaaccaggccuucgccgucaagaucaucuccaagcgcauggaggccaacacccagaaggagaucaccgcccucaagcucugcgagggccaccccaacaucgucaagcuccacgaggucuuccacgaccagcuccacaccuuccucgucauggagcuccucaacggcggcgagcucuucgagcgcaucaagaagaagaagcacuucuccgagaccgaggccuccuacaucaugcgcaagcucgucuccgccgucucccacaugcacgacgucggcgucguccaccgcgaccucaagcccgagaaccuccucuucaccgacgagaacgacaaccucgagaucaagaucaucgacuucggcuucgcccgccucaagccccccgacaaccagccccucaagacccccugcuucacccuccacuacgccgcccccgagcuccucaaccagaacggcuacgacgaguccugcgaccucuggucccucggcgucauccucuacaccaugcucuccggccagguccccuuccagucccacgaccgcucccucaccugcaccuccgccgucgagaucaugaagaagaucaagaagggcgacuucuccuucgagggcgaggccuggaagaacgucucccaggaggccaaggaccucauccagggccuccucaccgucgaccccaacaagcgccucaagauguccggccuccgcuacaacgaguggcuccaggacggcucccagcucuccuccaacccccucaugacccccgacauccucggcuccuccggcgccgccguccacaccugcgucaaggccaccuuccacgccuucaacaaguacaagcgcgagggcuucugccuccagaacgucgacaaggccccccucgccaagcgccgcaagaugaagaagaccuccaccuccaccgagacccgcuccuccuccuccgaguccucccacuccuccuccucccacucccacggcaagaccacccccaccaagacccuccagcccuccaaccccgccgacuccaacaaccccgagacccucuuccaguucuccgacuccgucgccuga

SEQ ID NO: 48980 - RNA, 2238 nt, Artificial Sequence
  derived and/or modified sequence opt2 from RPS6KA6__Homo_sapiens__NP_055311
augcuccccuucgccccccaggacgagcccugggaccgcgagauggaggucuucuccggcggcggcgccuccuccggcgaggucaacggccucaagauggucgacgagcccauggaggagggcgaggccgacuccugccacgacgagggcgucgucaaggagauccccaucacccaccacgucaaggagggcuacgagaaggccgaccccgcccaguucgagcuccucaagguccucggccagggcuccuucggcaaggucuuccucguccgcaagaagaccggccccgacgccggccagcucuacgccaugaagguccucaagaaggccucccucaagguccgcgaccgcguccgcaccaagauggagcgcgacauccucgucgaggucaaccaccccuucaucgucaagcuccacuacgccuuccagaccgagggcaagcucuaccucauccucgacuuccuccgcggcggcgacgucuucacccgccucuccaaggagguccucuucaccgaggaggacgucaaguucuaccucgccgagcucgcccucgcccucgaccaccuccaccagcucggcaucgucuaccgcgaccucaagcccgagaacauccuccucgacgagaucggccacaucaagcucaccgacuucggccucuccaaggaguccgucgaccaggagaagaaggccuacuccuucugcggcaccgucgaguacauggcccccgaggucgucaaccgccgcggccacucccaguccgccgacuggugguccuacggcguccucauguucgagaugcucaccggcacccuccccuuccagggcaaggaccgcaacgagaccaugaacaugauccucaaggccaagcucggcaugccccaguuccucuccgccgaggcccagucccuccuccgcaugcucuucaagcgcaaccccgccaaccgccucggcuccgagggcgucgaggagaucaagcgccaccucuucuucgccaacaucgacugggacaagcucuacaagcgcgagguccagccccccuucaagcccgccuccggcaagcccgacgacaccuucugcuucgaccccgaguucaccgccaagacccccaaggacucccccggccuccccgccuccgccaacgcccaccagcucuucaagggcuucuccuucgucgccaccuccaucgccgaggaguacaagaucacccccaucaccuccgccaacguccuccccaucguccagaucaacggcaacgccgcccaguucggcgaggucuacgagcucaaggaggacaucggcgucggcuccuacuccgucugcaagcgcugcauccacgccaccaccaacauggaguucgccgucaagaucaucgacaaguccaagcgcgaccccuccgaggagaucgagauccucaugcgcuacggccagcaccccaacaucaucacccucaaggacgucuucgacgacggccgcuacgucuaccucgucaccgaccucaugaagggcggcgagcuccucgaccgcauccucaagcagaagugcuucuccgagcgcgaggccuccgacauccucuacgucaucuccaagaccgucgacuaccuccacugccagggcgucguccaccgcgaccucaagcccuccaacauccucuacauggacgaguccgccuccgccgacuccauccgcaucugcgacuucggcuucgccaagcagcuccgcggcgagaacggccuccuccucacccccugcuacaccgccaacuucgucgcccccgagguccucaugcagcagggcuacgacgccgccugcgacaucuggucccucggcguccucuucuacaccaugcucgccggcuacacccccuucgccaacggccccaacgacacccccgaggagauccuccuccgcaucggcaacggcaaguucucccucuccggcggcaacugggacaacaucuccgacggcgccaaggaccuccucucccacaugcuccacauggacccccaccagcgcuacaccgccgagcagauccucaagcacuccuggaucacccaccgcgaccagcuccccaacgaccagcccaagcgcaacgacgucucccacgucgucaagggcgccauggucgccaccuacuccgcccucacccacaagaccuuccagcccguccucgagcccgucgccgccuccucccucgcccagcgccgcuccaugaagaagcgcaccuccaccggccucuga

SEQ ID NO: 48981 - RNA, 1509 nt, Artificial Sequence
  derived and/or modified sequence opt2 from RPS6KB1__Homo_sapiens__NP_001258971
augcgccgccgccgccgccgcgacggcuucuaccccgcccccgacuuccgcgaccgcgaggccgaggacauggccggcgucuucgacaucgaccucgaccagcccgaggacgccggcuccgaggacgagcucgaggagggcggccagcucaacgaguccauggaccacggcggcgucggccccuacgagcucggcauggagcacugcgagaaguucgagaucuccgagaccuccgucaaccgcggccccgagaagauccgccccgagugcuucgagcuccuccgcguccucggcaagggcggcuacggcaaggccaugaucguccgcaacgccaaggacaccgcccacaccaaggccgagcgcaacauccucgaggaggucaagcaccccuucaucgucgaccucaucuacgccuuccagaccggcggcaagcucuaccucauccucgaguaccucuccggcggcgagcucuucaugcagcucgagcgcgagggcaucuucauggaggacaccgccugcuucuaccucgccgagaucuccauggcccucggccaccuccaccagaagggcaucaucuaccgcgaccucaagcccgagaacaucaugcucaaccaccagggccacgucaagcucaccgacuucggccucugcaaggaguccauccacgacggcaccgucacccacaccuucugcggcaccaucgaguacauggcccccgagauccucaugcgcuccggccacaaccgcgccgucgacugguggucccucggcgcccucauguacgacaugcucaccggcgccccccccuucaccggcgagaaccgcaagaagaccaucgacaagauccucaagugcaagcucaaccucccccccuaccucacccaggaggcccgcgaccuccucaagaagcuccucaagcgcaacgccgccucccgccucggcgccggccccggcgacgccggcgagguccaggcccaccccuucuuccgccacaucaacugggaggagcuccucgcccgcaaggucgagccccccuucaagccccuccuccaguccgaggaggacgucucccaguucgacuccaaguucacccgccagacccccgucgacucccccgacgacuccacccucuccgaguccgccaaccaggucuuccucggcuucaccuacgucgcccccuccguccucgaguccgucaaggagaaguucuccuucgagcccaagauccgcuccccccgccgcuucaucggcuccccccgcacccccgucucccccgucaaguucucccccggcgacuucuggggccgcggcgccuccgccuccaccgccaacccccagacccccgucgaguaccccauggagaccuccggcaucgagcagauggacgucaccauguccggcgaggccuccgccccccuccccauccgccagcccaacuccggccccuacaagaagcaggccuuccccaugaucuccaagcgccccgagcaccuccgcaugaaccucuga

SEQ ID NO: 48982 - RNA, 1449 nt, Artificial Sequence
  derived and/or modified sequence opt2 from RPS6KB2__Homo_sapiens__NP_003943
auggccgccgucuucgaccucgaccucgagaccgaggagggcuccgagggcgagggcgagcccgagcucucccccgccgacgccugcccccucgccgagcuccgcgccgccggccucgagcccgucggccacuacgaggaggucgagcucaccgagaccuccgucaacgucggccccgagcgcaucggcccccacugcuucgagcuccuccgcguccucggcaagggcggcuacggcaaggucuuccagguccgcaagguccagggcaccaaccucggcaagaucuacgccaugaagguccuccgcaaggccaagaucguccgcaacgccaaggacaccgcccacacccgcgccgagcgcaacauccucgaguccgucaagcaccccuucaucgucgagcucgccuacgccuuccagaccggcggcaagcucuaccucauccucgagugccucuccggcggcgagcucuucacccaccucgagcgcgagggcaucuuccucgaggacaccgccugcuucuaccucgccgagaucacccucgcccucggccaccuccacucccagggcaucaucuaccgcgaccucaagcccgagaacaucaugcucuccucccagggccacaucaagcucaccgacuucggccucugcaaggaguccauccacgagggcgccgucacccacaccuucugcggcaccaucgaguacauggcccccgagauccucguccgcuccggccacaaccgcgccgucgacugguggucccucggcgcccucauguacgacaugcucaccggcuccccccccuucaccgccgagaaccgcaagaagaccauggacaagaucauccgcggcaagcucgcccucccccccuaccucacccccgacgcccgcgaccucgucaagaaguuccucaagcgcaaccccucccagcgcaucggcggcggccccggcgacgccgccgacguccagcgccaccccuucuuccgccacaugaacugggacgaccuccucgccuggcgcgucgacccccccuuccgccccugccuccaguccgaggaggacgucucccaguucgacacccgcuucacccgccagacccccgucgacucccccgacgacaccgcccucuccgaguccgccaaccaggccuuccucggcuucaccuacgucgcccccuccguccucgacuccaucaaggagggcuucuccuuccagcccaagcuccgcuccccccgccgccucaacuccuccccccgcgcccccgucuccccccucaaguucucccccuucgagggcuuccgccccucccccucccuccccgagcccaccgagcucccccuccccccccuccuccccccccccccccccuccaccaccgccccccuccccauccgcccccccuccggcaccaagaaguccaagcgcggccgcggccgccccggccgcuga

SEQ ID NO: 48983 - RNA, 585 nt, Artificial Sequence
  derived and/or modified sequence opt2 from RPS9__Homo_sapiens__XP_006726028
augcccgucgcccgcuccugggucugccgcaagaccuacgucaccccccgccgccccuucgagaagucccgccucgaccaggagcucaagcucaucggcgaguacggccuccgcaacaagcgcgaggucuggcgcgucaaguucacccucgccaagauccgcaaggccgcccgcgagcuccucacccucgacgagaaggacccccgccgccucuucgagggcaacgcccuccuccgccgccucguccgcaucggcguccucgacgagggcaagaugaagcucgacuacauccucggccucaagaucgaggacuuccucgagcgccgccuccagacccaggucuucaagcucggccucgccaaguccauccaccacgcccgcguccucauccgccagcgccacauccgcguccgcaagcaggucgucaacauccccuccuucaucguccgccucgacucccagaagcacaucgacuucucccuccgcucccccuacggcggcggccgccccggccgcgucaagcgcaagaacgccaagaagggccagggcggcgccggcgccggcgacgacgaggaggaggacuga

SEQ ID NO: 48984 - RNA, 888 nt, Artificial Sequence
  derived and/or modified sequence opt2 from RPSA__Homo_sapiens__NP_002286
auguccggcgcccucgacguccuccagaugaaggaggaggacguccucaaguuccucgccgccggcacccaccucggcggcaccaaccucgacuuccagauggagcaguacaucuacaagcgcaaguccgacggcaucuacaucaucaaccucaagcgcaccugggagaagcuccuccucgccgcccgcgccaucgucgccaucgagaaccccgccgacgucuccgucaucuccucccgcaacaccggccagcgcgccguccucaaguucgccgccgccaccggcgccacccccaucgccggccgcuucacccccggcaccuucaccaaccagauccaggccgccuuccgcgagccccgccuccucgucgucaccgacccccgcgccgaccaccagccccucaccgaggccuccuacgucaaccuccccaccaucgcccucugcaacaccgacuccccccuccgcuacgucgacaucgccauccccugcaacaacaagggcgcccacuccgucggccucaugugguggaugcucgcccgcgagguccuccgcaugcgcggcaccaucucccgcgagcaccccugggaggucaugcccgaccucuacuucuaccgcgaccccgaggagaucgagaaggaggagcaggccgccgccgagaaggccgucaccaaggaggaguuccagggcgaguggaccgcccccgcccccgaguucaccgccacccagcccgaggucgccgacugguccgagggcguccagguccccuccguccccauccagcaguuccccaccgaggacugguccgcccagcccgccaccgaggacugguccgccgcccccaccgcccaggccaccgagugggucggcgccaccaccgacugguccuga

SEQ ID NO: 48985 - RNA, 3534 nt, Artificial Sequence
  derived and/or modified sequence opt2 from RPTOR__Homo_sapiens__NP_001156506
auggaguccgagaugcuccaguccccccuccucggccucggcgaggaggacgaggccgaccucaccgacuggaaccucccccucgccuucaugaagaagcgccacugcgagaagaucgagggcuccaagucccucgcccaguccuggcgcaugaaggaccgcaugaagaccgucuccgucgcccucguccucugccucaacgucggcgucgacccccccgacgucgucaagaccacccccugcgcccgccucgagugcuggaucgacccccucuccaugggcccccagaaggcccucgagaccaucggcgccaaccuccagaagcaguacgagaacuggcagccccgcgcccgcuacaagcagucccucgaccccaccgucgacgaggucaagaagcucugcaccucccuccgccgcaacgccaaggaggagcgcguccucuuccacuacaacggccacggcgucccccgccccaccgucaacggcgaggucugggucuucaacaagaacuacacccaguacaucccccucuccaucuacgaccuccagaccuggaugggcucccccuccaucuucgucuacgacugcuccaacgccggccucaucgucaaguccuucaagcaguucgcccuccagcgcgagcaggagcucgaggucgccgccaucaaccccaaccacccccucgcccagaugccccucccccccuccaugaagaacugcauccagcucgccgccugcgaggccaccgagcuccuccccaugauccccgaccuccccgccgaccucuucaccuccugccucaccacccccaucaagaucgcccuccgcugguucugcaugcagaagugcgucucccucguccccggcgucacccucgaccucaucgagaagauccccggccgccucaacgaccgccgcaccccccucggcgagcucaacuggaucuucaccgccaucaccgacaccaucgccuggaacguccucccccgcgaccucuuccagaagcucuuccgccaggaccuccucgucgccucccucuuccgcaacuuccuccucgccgagcgcaucaugcgcuccuacaacugcacccccgucuccuccccccgccucccccccaccuacaugcacgccauguggcaggccugggaccucgccgucgacaucugccucucccagcuccccaccaucaucgaggagggcaccgccuuccgccacucccccuucuucgccgagcagcucaccgccuuccaggucuggcucaccaugggcgucgagaaccgcaacccccccgagcagcuccccaucguccuccagguccuccucucccagguccaccgccuccgcgcccucgaccuccucggccgcuuccucgaccucggccccugggccgucucccucgcccucuccgucggcaucuuccccuacguccucaagcuccuccaguccuccgcccgcgagcuccgcccccuccucgucuucaucugggccaagauccucgccgucgacuccgagcucgucgucgcccucucccaccucgucguccaguacgaguccaacuucugcaccgucgcccuccaguucaucgaggaggagaagaacuacgcccuccccucccccgccaccaccgagggcggcucccucacccccguccgcgacucccccugcaccccccgccuccgcuccgucuccuccuacggcaacauccgcgccgucgccaccgcccgcucccucaacaagucccuccagaaccucucccucaccgaggaguccggcggcgccgucgccuucucccccggcaaccucuccaccuccuccuccgccuccuccacccucggcucccccgagaacgaggagcacauccucuccuucgagaccaucgacaagaugcgccgcgccuccuccuacuccucccucaacucccucaucggcgucuccuucaacuccgucuacacccagaucuggcgcguccuccuccaccucgccgccgaccccuaccccgaggucuccgacgucgccaugaagguccucaacuccaucgccuacaaggccaccgucaacgcccgcccccagcgcguccucgacaccuccucccucacccaguccgcccccgccucccccaccaacaagggcguccacauccaccaggccggcggcuccccccccgccuccuccaccuccuccuccucccucaccaacgacgucgccaagcagcccgucucccgcgaccuccccuccggccgccccggcaccaccggccccgccggcgcccaguacaccccccacucccaccaguucccccgcacccgcaagauguucgacaagggccccgagcagaccgccgacgacgccgacgacgccgccggccacaaguccuucaucuccgccaccguccagaccggcuucugcgacugguccgcccgcuacuucgcccagcccgucaugaagauccccgaggagcacgaccucgagucccagauccgcaaggagcgcgaguggcgcuuccuccgcaacucccgcguccgccgccaggcccagcaggucauccagaagggcaucacccgccucgacgaccagaucuuccucaaccgcaaccccggcguccccuccgucgucaaguuccaccccuucacccccugcaucgccgucgccgacaaggacuccaucugcuucugggacugggagaagggcgagaagcucgacuacuuccacaacggcaacccccgcuacacccgcgucaccgccauggaguaccucaacggccaggacugcucccuccuccucaccgccaccgacgacggcgccauccgcgucuggaagaacuucgccgaccucgagaagaaccccgagauggucaccgccuggcagggccucuccgacaugcuccccaccacccgcggcgccggcauggucgucgacugggagcaggagaccggccuccucauguccuccggcgacguccgcaucguccgcaucugggacaccgaccgcgagaugaagguccaggacauccccaccggcgccgacuccugcgucaccucccucuccugcgacucccaccgcucccucaucgucgccggccucggcgacggcuccauccgcgucuacgaccgccgcauggcccucuccgagugccgcgucaugaccuaccgcgagcacaccgccugggucgucaaggccucccuccagaagcgccccgacggccacaucgucuccgucuccgucaacggcgacguccgcaucuucgacccccgcaugcccgaguccgucaacguccuccagaucgucaagggccucaccgcccucgacauccacccccaggccgaccucaucgccugcggcuccgucaaccaguucaccgccaucuacaacuccuccggcgagcucaucaacaacaucaaguacuacgacggcuucaugggccagcgcgucggcgccaucuccugccucgccuuccacccccacuggccccaccucgccgucggcuccaacgacuacuacaucuccgucuacuccgucgagaagcgcguccgcuga

SEQ ID NO: 48986 - RNA, 996 nt, Artificial Sequence
  derived and/or modified sequence opt2 from RQCD1__Homo_sapiens__NP_001258563
augcacucccucgccaccgccgcccccguccccaccacccucgcccaggucgaccgcgagaagaucuaccaguggaucaacgagcucuccucccccgagacccgcgagaacgcccuccucgagcucuccaagaagcgcgaguccguccccgaccucgcccccaugcucuggcacuccuucggcaccaucgccgcccuccuccaggagaucgucaacaucuaccccuccaucaacccccccacccucaccgcccaccaguccaaccgcgucugcaacgcccucgcccuccuccagugcgucgccucccaccccgagacccgcuccgccuuccucgccgcccacaucccccucuuccucuaccccuuccuccacaccgucuccaagacccgccccuucgaguaccuccgccucaccucccucggcgucaucgucgagaccggcuuccaccacgucggccaggccgaccucgagcuccccaccuccuccgaccuccccgccuccgccucccaguccgccggcaucaccggcgcccucgucaagaccgacgagcaggaggucaucaacuuccuccucaccaccgagaucaucccccucugccuccgcaucauggaguccggcuccgagcucuccaagaccgucgccaccuucauccuccagaagauccuccucgacgacaccggccucgccuacaucugccagaccuacgagcgcuucucccacgucgccaugauccucggcaagaugguccuccagcucuccaaggagcccuccgcccgccuccucaagcacgucguccgcugcuaccuccgccucuccgacaacccccgcgcccgcgaggcccuccgccagugccuccccgaccagcucaaggacaccaccuucgcccagguccucaaggacgacaccaccaccaagcgcuggcucgcccagcucgucaagaaccuccaggagggccaggucaccgacccccgcggcaucccccuccccccccaguga

SEQ ID NO: 48987 - RNA, 927 nt, Artificial Sequence
  derived and/or modified sequence opt2 from RRAD__Homo_sapiens__NP_001122322
augacccucaacggcggcggcuccggcgccggcggcucccgcggcggcggccaggagcgcgagcgccgccgcggcuccacccccuggggccccgcccccccccuccaccgccgcuccaugcccgucgacgagcgcgaccuccaggccgcccucacccccggcgcccucaccgccgccgccgccggcaccggcacccagggcccccgccucgacuggcccgaggacuccgaggacucccucuccuccggcggcuccgacuccgacgaguccgucuacaagguccuccuccucggcgcccccggcgucggcaaguccgcccucgcccgcaucuucggcggcgucgaggacggccccgaggccgaggccgccggccacaccuacgaccgcuccaucgucgucgacggcgaggaggccucccucauggucuacgacaucugggagcaggacggcggccgcuggcuccccggccacugcauggccaugggcgacgccuacgucaucgucuacuccgucaccgacaagggcuccuucgagaaggccuccgagcuccgcguccagcuccgccgcgcccgccagaccgacgacguccccaucauccucgucggcaacaaguccgaccucguccgcucccgcgaggucuccgucgacgagggccgcgccugcgccgucgucuucgacugcaaguucaucgagaccuccgccgcccuccaccacaacguccaggcccucuucgagggcgucguccgccagauccgccuccgccgcgacuccaaggaggccaacgcccgccgccaggccggcacccgccgccgcgagucccucggcaagaaggccaagcgcuuccucggccgcaucgucgcccgcaacucccgcaagauggccuuccgcgccaaguccaaguccugccacgaccucuccguccucuga

SEQ ID NO: 48988 - RNA, 942 nt, Artificial Sequence
  derived and/or modified sequence opt2 from RRAGA__Homo_sapiens__NP_006561
augcccaacaccgccaugaagaagaagguccuccucaugggcaaguccggcuccggcaagaccuccaugcgcuccaucaucuucgccaacuacaucgcccgcgacacccgccgccucggcgccaccaucgacgucgagcacucccacguccgcuuccucggcaaccucguccucaaccucugggacugcggcggccaggacaccuucauggagaacuacuucaccucccagcgcgacaacaucuuccgcaacgucgagguccucaucuacgucuucgacgucgagucccgcgagcucgagaaggacaugcacuacuaccaguccugccucgaggccauccuccagaacucccccgacgccaagaucuucugccucguccacaagauggaccucguccaggaggaccagcgcgaccucaucuucaaggagcgcgaggaggaccuccgccgccucucccgcccccucgagugcgccugcuuccgcaccuccaucugggacgagacccucuacaaggccugguccuccaucgucuaccagcucauccccaacguccagcagcucgagaugaaccuccgcaacuucgcccagaucaucgaggccgacgagguccuccucuucgagcgcgccaccuuccucgucaucucccacuaccagugcaaggagcagcgcgacguccaccgcuucgagaagaucuccaacaucaucaagcaguucaagcucuccugcuccaagcucgccgccuccuuccaguccauggagguccgcaacuccaacuucgccgccuucaucgacaucuucaccuccaacaccuacgucauggucgucauguccgaccccuccauccccuccgccgccacccucaucaacauccgcaacgcccgcaagcacuucgagaagcucgagcgcgucgacggccccaagcacucccuccucaugcgcuga

SEQ ID NO: 48989 - RNA, 384 nt, Artificial Sequence
  derived and/or modified sequence opt2 from RRAS2__Homo_sapiens__NP_001096139
augcgcgagcaguacaugcgcaccggcgagggcuuccuccucgucuucuccgucaccgaccgcggcuccuucgaggagaucuacaaguuccagcgccagauccuccgcgucaaggaccgcgacgaguuccccaugauccucaucggcaacaaggccgaccucgaccaccagcgccaggucacccaggaggagggccagcagcucgcccgccagcucaaggucaccuacauggaggccuccgccaagauccgcaugaacgucgaccaggccuuccacgagcucguccgcgucauccgcaaguuccaggagcaggagugcccccccucccccgagcccacccgcaaggagaaggacaagaagggcugccacugcgucaucuucuga

SEQ ID NO: 48990 - RNA, 657 nt, Artificial Sequence
  derived and/or modified sequence opt2 from RRAS__Homo_sapiens__NP_006261
auguccuccggcgccgccuccggcaccggccgcggccgcccccgcggcggcggccccggccccggcgaccccccccccuccgagacccacaagcucgucgucgucggcggcggcggcgucggcaaguccgcccucaccauccaguucauccaguccuacuucgucuccgacuacgaccccaccaucgaggacuccuacaccaagaucugcuccgucgacggcauccccgcccgccucgacauccucgacaccgccggccaggaggaguucggcgccaugcgcgagcaguacaugcgcgccggccacggcuuccuccucgucuucgccaucaacgaccgccaguccuucaacgaggucggcaagcucuucacccagauccuccgcgucaaggaccgcgacgacuuccccgucguccucgucggcaacaaggccgaccucgagucccagcgccaggucccccgcuccgaggccuccgccuucggcgccucccaccacgucgccuacuucgaggccuccgccaagcuccgccucaacgucgacgaggccuucgagcagcucguccgcgccguccgcaaguaccaggagcaggagcucccccccuccccccccuccgccccccgcaagaagggcggcggcugccccugcguccuccucuga

SEQ ID NO: 48991 - RNA, 2934 nt, Artificial Sequence
  derived and/or modified sequence opt2 from RRBP1__Homo_sapiens__NP_001036041
auggacaucuacgacacccagacccucggcgucgucgucuucggcggcuucauggucgucuccgccaucggcaucuuccucgucuccaccuucuccaugaaggagaccuccuacgaggaggcccucgccaaccagcgcaaggagauggccaagacccaccaccagaaggucgagaagaagaagaaggagaagaccgucgagaagaagggcaagaccaagaagaaggaggagaagcccaacggcaagauccccgaccacgaccccgcccccaacgucaccguccuccuccgcgagcccguccgcgcccccgccgucgccgucgcccccacccccguccagccccccaucaucgucgcccccgucgccaccguccccgccaugccccaggagaagcucgccuccucccccaaggacaagaagaagaaggagaagaaggucgccaaggucgagcccgccgucuccuccgucgucaacuccauccagguccucaccuccaaggccgccauccucgagaccgcccccaaggagggccgcaacaccgacgucgcccagucccccgaggcccccaagcaggaggcccccgccaagaagaaguccggcuccaagaagaagggcccccccgacgccgacggcccccucuaccuccccuacaagacccucgucuccaccgucggcuccauggucuucaacgagggcgaggcccagcgccucaucgagauccucuccgagaaggccggcaucauccaggacaccuggcacaaggccacccagaagggcgaccccgucgccauccucaagcgccagcucgaggagaaggagaagcuccucgccaccgagcaggaggacgccgccgucgccaaguccaagcuccgcgagcucaacaaggagauggccgccgagaaggccaaggccgccgccggcgaggccaaggucaagaagcagcucgucgcccgcgagcaggagaucaccgccguccaggcccgcaugcaggccuccuaccgcgagcacgucaaggagguccagcagcuccagggcaagauccgcacccuccaggagcagcucgagaacggccccaacacccagcucgcccgccuccagcaggagaacuccauccuccgcgacgcccucaaccaggccaccucccaggucgaguccaagcagaacgccgagcucgccaagcuccgccaggagcucuccaaggucuccaaggagcucgucgagaaguccgaggccguccgccaggacgagcagcagcgcaaggcccucgaggccaaggccgccgccuucgagaagcagguccuccagcuccaggccucccaccgcgaguccgaggaggcccuccagaagcgccucgacgaggucucccgcgagcucugccacacccaguccucccacgccucccuccgcgccgacgccgagaaggcccaggagcagcagcagcagauggccgagcuccacuccaagcuccaguccuccgaggccgagguccgcuccaagugcgaggagcucuccggccuccacggccagcuccaggaggcccgcgccgagaacucccagcucaccgagcgcauccgcuccaucgaggcccuccucgaggccggccaggcccgcgacgcccaggacguccaggccucccaggccgaggccgaccagcagcagacccgccucaaggagcucgagucccaggucuccggccucgagaaggaggccaucgagcuccgcgaggccgucgagcagcagaaggucaagaacaacgaccuccgcgagaagaacuggaaggccauggaggcccucgccaccgccgagcaggccugcaaggagaagcuccacucccucacccaggccaaggaggaguccgagaagcagcucugccucaucgaggcccagaccauggaggcccuccucgcccuccuccccgagcucuccguccucgcccagcagaacuacaccgaguggcuccaggaccucaaggagaagggccccacccuccucaagcacccccccgcccccgccgagcccuccuccgaccucgccuccaagcuccgcgaggccgaggagacccaguccacccuccaggccgagugcgaccaguaccgcuccauccucgccgagaccgagggcaugcuccgcgaccuccagaaguccgucgaggaggaggagcaggucuggcgcgccaaggucggcgccgccgaggaggagcuccagaagucccgcgucaccgucaagcaccucgaggagaucgucgagaagcucaagggcgagcucgaguccuccgaccagguccgcgagcacaccucccaccucgaggccgagcucgagaagcacauggccgccgccuccgccgagugccagaacuacgccaaggaggucgccggccuccgccagcuccuccucgagucccagucccagcucgacgccgccaaguccgaggcccagaagcaguccgacgagcucgcccucguccgccagcagcucuccgagaugaagucccacgucgaggacggcgacaucgccggcgcccccgccuccucccccgaggccccccccgccgagcaggaccccguccagcucaagacccagcucgaguggaccgaggccauccucgaggacgagcagacccagcgccagaagcucaccgccgaguucgaggaggcccagaccuccgccugccgccuccaggaggagcucgagaagcuccgcaccgccggcccccucgaguccuccgagaccgaggaggccucccagcucaaggagcgccucgagaaggagaagaagcucaccuccgaccucggccgcgccgccacccgccuccaggagcuccucaagaccacccaggagcagcucgcccgcgagaaggacaccgucaagaagcuccaggagcagcucgagaaggccgaggacggcuccuccuccaaggagggcaccuccgucuga

SEQ ID NO: 48992 - RNA, 4431 nt, Artificial Sequence
  derived and/or modified sequence opt2 from RREB1__Homo_sapiens__NP_001003700
augaccuccuccucccccgccggccucgagggcuccgaccucuccuccaucaacaccaugauguccgccgucauguccgucggcaaggucaccgagaacggcggcuccccccagggcaucaagucccccuccaagccccccggccccaaccgcaucggccgccgcaaccaggagaccaaggaggagaaguccuccuacaacugcccccucugcgagaagaucugcaccacccagcaccagcucaccaugcacauccgccagcacaacaccgacaccggcggcgccgaccacuccugcuccaucugcggcaagucccucuccuccgccuccucccucgaccgccacaugcucguccacuccggcgagcgccccuacaagugcaccgucugcggccaguccuucaccaccaacggcaacaugcaccgccacaugaagauccacgagaaggaccccaacuccgccaccgccaccgccccccccuccccccucaagcgccgccgccucuccuccaagcgcaagcucucccacgacgccgaguccgagcgcgaggaccccgcccccgccaagaagauggucgaggacggccaguccggcgaccucgagaagaaggccgacgaggucuuccacugccccgucugcuucaaggaguucgucugcaaguacggccucgagacccacauggagacccacuccgacaacccccuccgcugcgacaucugcugcgucaccuuccgcacccaccgcggccuccuccgccacaacgcccucguccacaagcagcucccccgcgacgccaugggccgccccuucauccagaacaaccccuccauccccgccggcuuccacgaccucggcuucaccgacuucuccugccgcaaguucccccgcaucucccaggccuggugcgagaccaaccuccgccgcugcaucuccgagcagcaccgcuucgucugcgacaccugcgacaaggccuuccccaugcucugcucccucgcccuccacaagcagacccacgucgccgccgaccagggccaggagaagccccaggccaccccccuccccggcgacgcccucgaccagaagggcuuccucgcccuccucggccuccagcacaccaaggacguccgccccgcccccgccgaggagccccuccccgacgacaaccaggccauccagcuccagacccucaagugccagcucccccaggaccccggcugcaccaaccuccucucccucucccccuucgaggccgccucccucggcggcucccucaccguccuccccgccaccaaggacuccaucaagcaccucucccuccagcccuuccagaagggcuucaucauccagcccgacuccuccaucgucgucaagcccaucuccggcgaguccgccaucgagcucgccgacauccagcagauccucaagauggccgccuccgcccccccccagaucucccucccccccuucuccaaggcccccgccgccccccuccaggccaucuucaagcacaugcccccccucaagcccaagccccucgucaccccccgcaccgucgucgccaccuccaccccccccccccucaucaacgcccagcaggccucccccggcugcaucucccccucccuccccccccccccccucaagcuccucaagggcuccgucgaggccgccuccaacgcccaccuccuccaguccaaguccggcacccagccccacgccgccacccgccucucccuccagcagccccgcgccgagcuccccggccagcccgagaugaagacccagcucgagcaggacuccaucaucgaggcccuccucccccucuccauggaggccaagaucaagcaggagaucaccgagggcgagcucaaggccuucaugaccgcccccggcggcaagaagacccccgccaugcgcaagguccucuaccccugccgcuucugcaaccaggucuucgccuucuccggcguccuccgcgcccacguccgcucccaccucggcaucucccccuaccagugcaacaucugcgacuacaucgccgccgacaaggccgcccucauccgccaccuccgcacccacuccggcgagcgccccuacaucugcaagaucugccacuaccccuucaccgucaaggccaacugcgagcgccaccuccgcaagaagcaccucaaggccacccgcaaggacaucgagaagaacaucgaguacgucuccuccuccgccgccgagcucgucgacgccuucugcgcccccgacaccgucugccgccucugcggcgaggaccucaagcacuaccgcgcccuccgcauccacaugcgcacccacugcggccgcggccucggcggcggccacaagggccgcaagcccuucgagugcaaggagugcuccgccgccuucgccgccaagcgcaacugcauccaccacauccucaagcagcaccuccacguccccgagcaggacaucgaguccuacguccucgccgccgacggccucggccccgccgaggcccccgccgccgaggccuccggccgcggcgaggacuccggcugcgccgcccucggcgacugcaagccccucaccgccuuccucgagccccagaacggcuuccuccaccgcggccccacccagcccccccccccccacgucuccaucaagcucgagcccgccuccuccuucgccgucgacuucaacgagccccucgacuucucccagaagggccucgcccucguccaggucaagcaggagaacaucuccuuccucucccccuccucccucguccccuacgacugcuccauggagcccaucgaccucuccauccccaagaacuuccgcaagggcgacaaggaccucgccacccccuccgaggccaagaagcccgaggaggaggccggcuccuccgagcagcccucccccugccccgcccccggccccucccuccccgucacccucggccccuccggcauccucgagucccccauggcccccgcccccgccgccacccccgagccccccgcccagccccuccagggccccguccagcucgccguccccaucuacuccuccgcccucgucuccucccccccccucgucggcuccuccgcccuccucuccggcaccgcccuccuccgcccccuccgccccaagcccccccuccuccuccccaagccccccgucaccgaggagcuccccccccucgccuccaucgcccagaucaucuccuccgucuccuccgcccccacccuccucaagaccaaggucgccgaccccggccccgccuccaccggcuccaacaccaccgccuccgacucccucggcggcuccguccccaaggccgccaccaccgccacccccgccgccaccaccucccccaaggaguccuccgagccccccgcccccgccuccucccccgaggccgccucccccaccgagcagggccccgccggcaccuccaagaagcgcggccgcaagcgcggcaugcgcucccgcccccgcgccaacuccggcggcgucgaccucgacuccuccggcgaguucgccuccaucgagaagaugcucgccaccaccgacaccaacaaguucucccccuuccuccagaccgccgaggacaacacccaggacgaggucgccggcgcccccgccgaccaccacggccccuccgacgaggagcagggcuccccccccgaggacaagcuccuccgcgccaagcgcaacuccuacaccaacugccuccagaagaucaccugcccccacugcccccgcgucuuccccugggccuccucccuccagcgccacaugcucacccacaccggccagaagcccuuccccugccagaagugcgacgccuucuucuccaccaaguccaacugcgagcgccaccagcuccgcaagcacggcgucaccaccugcucccuccgccgcaacggccucaucccccaguccaaggaguccgacgucggcucccacgacuccaccggcgagcgccccuacaagugccagaccugcgagcgcaccuucacccucaagcacucccucguccgccaccagcgcauccaccagaaggcccgccacgccaagcaccacggcaaggacuccgacaaggaggagcgcggcgaggaggacuccgagaacgaguccacccacuccggcaacaacgccgucuccgagaacgaggccgagcucgcccccaacgccuccaaccacauggccgucacccgcucccgcaaggagggccucgccuccgccaccaaggacugcucccaccgcgaggagaaggucaccgccggcuggcccuccgagcccggccagggcgaccucaaccccgagucccccgccgcccucggccaggaccuccucgagccccgcuccaagcgccccgcccaccccauccucgccaccgccgacggcgccucccagcucgucggcauggaguga

SEQ ID NO: 48993 - RNA, 1014 nt, Artificial Sequence
  derived and/or modified sequence opt2 from RRH__Homo_sapiens__NP_006574
augcuccgcaacaaccucggcaacuccuccgacuccaagaacgaggacggcuccgucuucucccagaccgagcacaacaucgucgccaccuaccucaucauggccggcaugaucuccaucaucuccaacaucaucguccucggcaucuucaucaaguacaaggagcuccgcacccccaccaacgccaucaucaucaaccucgccgucaccgacaucggcgucuccuccaucggcuaccccauguccgccgccuccgaccucuacggcuccuggaaguucggcuacgccggcugccaggucuacgccggccucaacaucuucuucggcauggccuccaucggccuccucaccgucgucgccgucgaccgcuaccucaccaucugccuccccgacgucggccgccgcaugaccaccaacaccuacaucggccucauccucggcgccuggaucaacggccucuucugggcccucaugcccaucaucggcugggccuccuacgcccccgaccccaccggcgccaccugcaccaucaacuggcgcaagaacgaccgcuccuucgucuccuacaccaugaccgucaucgccaucaacuucaucgucccccucaccgucauguucuacugcuacuaccacgucacccucuccaucaagcaccacaccaccuccgacugcaccgagucccucaaccgcgacugguccgaccagaucgacgucaccaagauguccgucaucaugaucugcauguuccucgucgccuggucccccuacuccaucgucugccucugggccuccuucggcgaccccaagaagauccccccccccauggccaucaucgccccccucuucgccaaguccuccaccuucuacaaccccugcaucuacgucgucgccaacaagaaguuccgccgcgccaugcucgccauguucaagugccagacccaccagaccaugcccgucaccuccauccuccccauggacgucucccagaacccccucgccuccggccgcaucuga

SEQ ID NO: 48994 - RNA, 2379 nt, Artificial Sequence
  derived and/or modified sequence opt2 from RRM1__Homo_sapiens__NP_001024
augcacgucaucaagcgcgacggccgccaggagcgcgucauguucgacaagaucaccucccgcauccagaagcucugcuacggccucaacauggacuucgucgaccccgcccagaucaccaugaaggucauccagggccucuacuccggcgucaccaccgucgagcucgacacccucgccgccgagaccgccgccacccucaccaccaagcaccccgacuacgccauccucgccgcccgcaucgccgucuccaaccuccacaaggagaccaagaaggucuucuccgacgucauggaggaccucuacaacuacaucaacccccacaacggcaagcacucccccauggucgccaaguccacccucgacaucguccucgccaacaaggaccgccucaacuccgccaucaucuacgaccgcgacuucuccuacaacuacuucggcuucaagacccucgagcgcuccuaccuccucaagaucaacggcaaggucgccgagcgcccccagcacaugcucaugcgcgucuccgucggcauccacaaggaggacaucgacgccgccaucgagaccuacaaccuccucuccgagcgcugguucacccacgccucccccacccucuucaacgccggcaccaaccgcccccagcucuccuccugcuuccuccucuccaugaaggacgacuccaucgagggcaucuacgacacccucaagcagugcgcccucaucuccaaguccgccggcggcaucggcgucgccgucuccugcauccgcgccaccggcuccuacaucgccggcaccaacggcaacuccaacggccucguccccaugcuccgcgucuacaacaacaccgcccgcuacgucgaccagggcggcaacaagcgccccggcgccuucgccaucuaccucgagcccuggcaccucgacaucuucgaguuccucgaccucaagaagaacaccggcaaggaggagcagcgcgcccgcgaccucuucuucgcccucuggauccccgaccucuucaugaagcgcgucgagaccaaccaggacuggucccucaugugccccaacgagugccccggccucgacgaggucuggggcgaggaguucgagaagcucuacgccuccuacgagaagcagggccgcguccgcaaggucgucaaggcccagcagcucugguacgccaucaucgagucccagaccgagaccggcacccccuacaugcucuacaaggacuccugcaaccgcaaguccaaccagcagaaccucggcaccaucaagugcuccaaccucugcaccgagaucgucgaguacaccuccaaggacgaggucgccgucugcaaccucgccucccucgcccucaacauguacgucaccuccgagcacaccuacgacuucaagaagcucgccgaggucaccaaggucgucguccgcaaccucaacaagaucaucgacaucaacuacuaccccguccccgaggccugccucuccaacaagcgccaccgccccaucggcaucggcguccagggccucgccgacgccuucauccucaugcgcuaccccuucgaguccgccgaggcccagcuccucaacaagcagaucuucgagaccaucuacuacggcgcccucgaggccuccugcgaccucgccaaggagcagggccccuacgagaccuacgagggcucccccgucuccaagggcauccuccaguacgacauguggaacgucacccccaccgaccucugggacuggaagguccucaaggagaagaucgccaaguacggcauccgcaacucccuccucaucgcccccaugcccaccgccuccaccgcccagauccucggcaacaacgaguccaucgagcccuacaccuccaacaucuacacccgccgcguccucuccggcgaguuccagaucgucaacccccaccuccucaaggaccucaccgagcgcggccucuggcacgaggagaugaagaaccagaucaucgccugcaacggcuccauccaguccauccccgagauccccgacgaccucaagcagcucuacaagaccgucugggagaucucccagaagaccguccucaagauggccgccgagcgcggcgccuucaucgaccagucccagucccucaacauccacaucgccgagcccaacuacggcaagcucaccuccaugcacuucuacggcuggaagcagggccucaagaccggcauguacuaccuccgcacccgccccgccgccaaccccauccaguucacccucaacaaggagaagcucaaggacaaggagaaggucuccaaggaggaggaggagaaggagcgcaacaccgccgccauggucugcucccucgagaaccgcgacgagugccucaugugcggcuccuga

SEQ ID NO: 48995 - RNA, 1272 nt, Artificial Sequence
  derived and/or modified sequence opt2 from RRM2B__Homo_sapiens__NP_001165948
augcuccuccuccgccuccccccccaccgcucccacgccuccccccucgacugcaagcuccaggaccgcugccgcaagugcuacuccccccgcuccggccaggccugcccccccgcccucgccgccgccuggcuccgccgcugcgagcgccgcggcggccgcccccgcggcggccgccgcaaggagcucacccucggccuccgccccgcccgcugcuccgcccccggccccgccaaggacgacgccuggcgcccccaggccggccgcuccuccuccgacaccaacgaguccgagaucaaguccaacgaggagccccuccuccgcaaguccucccgccgcuucgucaucuuccccauccaguaccccgacaucuggaagauguacaagcaggcccaggccuccuucuggaccgccgaggaggucgaccucuccaaggaccucccccacuggaacaagcucaaggccgacgagaaguacuucaucucccacauccucgccuucuucgccgccuccgacggcaucgucaacgagaaccucgucgagcgcuucucccaggagguccagguccccgaggcccgcugcuucuacggcuuccagauccucaucgagaacguccacuccgagauguacucccuccucaucgacaccuacauccgcgaccccaagaagcgcgaguuccucuucaacgccaucgagaccaugcccuacgucaagaagaaggccgacugggcccuccgcuggaucgccgaccgcaaguccaccuucggcgagcgcgucgucgccuucgccgccgucgagggcgucuucuucuccggcuccuucgccgccaucuucuggcucaagaagcgcggccucaugcccggccucaccuucuccaacgagcucaucucccgcgacgagggccuccacugcgacuucgccugccucauguuccaguaccucgucaacaagcccuccgaggagcgcguccgcgagaucaucgucgacgccgucaagaucgagcaggaguuccucaccgaggcccuccccgucggccucaucggcaugaacugcauccucaugaagcaguacaucgaguucgucgccgaccgccuccucgucgagcucggcuucuccaaggucuuccaggccgagaaccccuucgacuucauggagaacaucucccucgagggcaagaccaacuucuucgagaagcgcgucuccgaguaccagcgcuucgccgucauggccgagaccaccgacaacgucuucacccucgacgccgacuucuga

SEQ ID NO: 48996 - RNA, 1170 nt, Artificial Sequence
  derived and/or modified sequence opt2 from RRM2__Homo_sapiens__NP_001025
augcucucccuccgcgucccccucgcccccaucaccgacccccagcagcuccagcucuccccccucaagggccucucccucgucgacaaggagaacaccccccccgcccucuccggcacccgcguccucgccuccaagaccgcccgccgcaucuuccaggagcccaccgagcccaagaccaaggccgccgcccccggcgucgaggacgagccccuccuccgcgagaacccccgccgcuucgucaucuuccccaucgaguaccacgacaucuggcagauguacaagaaggccgaggccuccuucuggaccgccgaggaggucgaccucuccaaggacauccagcacugggagucccucaagcccgaggagcgcuacuucaucucccacguccucgccuucuucgccgccuccgacggcaucgucaacgagaaccucgucgagcgcuucucccaggagguccagaucaccgaggcccgcugcuucuacggcuuccagaucgccauggagaacauccacuccgagauguacucccuccucaucgacaccuacaucaaggaccccaaggagcgcgaguuccucuucaacgccaucgagaccaugcccugcgucaagaagaaggccgacugggcccuccgcuggaucggcgacaaggaggccaccuacggcgagcgcgucgucgccuucgccgccgucgagggcaucuucuucuccggcuccuucgccuccaucuucuggcucaagaagcgcggccucaugcccggccucaccuucuccaacgagcucaucucccgcgacgagggccuccacugcgacuucgccugccucauguucaagcaccucguccacaagcccuccgaggagcgcguccgcgagaucaucaucaacgccguccgcaucgagcaggaguuccucaccgaggcccuccccgucaagcucaucggcaugaacugcacccucaugaagcaguacaucgaguucgucgccgaccgccucaugcucgagcucggcuucuccaaggucuuccgcgucgagaaccccuucgacuucauggagaacaucucccucgagggcaagaccaacuucuucgagaagcgcgucggcgaguaccagcgcaugggcgucauguccucccccaccgagaacuccuucacccucgacgccgacuucuga

SEQ ID NO: 48997 - RNA, 1866 nt, Artificial Sequence
  derived and/or modified sequence opt2 from RRN3__Homo_sapiens__NP_001287993
auggccgccccccuccuccacacccgccuccccggcgacgccgccgccuccuccuccgccgucaagaagcucggcgccucccgcaccggcaucuccaacaugcgcgcccucgagaacgacuucuucaacucccccccccgcaagaccguccgcuucggcggcaccgucaccgagguccuccucaaguacaagaagggcgagaccaacgacuucgagcuccucaagaaccagcuccucgaccccgacaucaagcgccuccccuggcucaaccgcucccagaccgucgucgaggaguaccucgccuuccucggcaaccucgucuccgcccagaccgucuuccuccgccccugccucuccaugaucgccucccacuucguccccccccgcgucaucaucaaggagggcgacgucgacgucuccgacuccgacgacgaggacgacaaccuccccgccaacuucgacaccugccaccgcgcccuccagaucaucgcccgcuacguccccuccacccccugguuccucaugcccauccucgucgagaaguuccccuucguccgcaaguccgagcgcacccucgagugcuacguccacaaccuccuccgcaucuccgucuacuuccccacccuccgccacgagauccucgagcucaucaucgagaagcuccucaagcucgacgucaacgccucccgccagggcaucgaggacgccgaggagaccgccacccagaccugcggcggcaccgacuccaccgagggccucuucaacauggacgaggacgaggagaccgagcacgagaccaaggccggccccgagcgccucgaccagaugguccaccccgucgccgagcgccucgacauccucaugucccucguccucuccuacaugaaggacgucugcuacgucgacggcaaggucgacaacggcaagaccaaggaccucuaccgcgaccucaucaacaucuucgacaagcuccuccuccccacccacgccuccugccacguccaguucuucauguucuaccucugcuccuucaagcucggcuucgccgaggccuuccucgagcaccucuggaagaagcuccaggaccccuccaaccccgccaucauccgccaggccgccggcaacuacaucggcuccuuccucgcccgcgccaaguucaucccccucaucaccgucaaguccugccucgaccuccucgucaacuggcuccacaucuaccucaacaaccaggacuccggcaccaaggccuucugcgacgucgcccuccacggccccuucuacuccgccugccaggccgucuucuacaccuucgucuuccgccacaagcagcuccucuccggcaaccucaaggagggccuccaguaccuccagucccucaacuucgagcgcaucgucaugucccagcucaacccccucaagaucugccuccccuccgucgucaacuucuucgccgccaucaccaacaaguaccagcucgucuucugcuacaccaucaucgagcgcaacaaccgccagaugcuccccgucauccgcuccaccgccggcggcgacuccguccagaucugcaccaacccccucgacaccuucuuccccuucgaccccugcguccucaagcgcuccaagaaguucaucgaccccaucuaccaggucugggaggacauguccgccgaggagcuccaggaguucaagaagcccaugaagaaggacaucgucgaggacgaggacgacgacuuccucaagggcgaggucccccagaacgacaccgucaucggcaucacccccuccuccuucgacacccacuuccgcucccccuccuccuccgucggcuccccccccguccucuacaugcagcccuccccccucuga

SEQ ID NO: 48998 - RNA, 834 nt, Artificial Sequence
  derived and/or modified sequence opt2 from RRNAD1__Homo_sapiens__NP_001136032
augcccggcaucuccgcccgcggccucucccacgagggccgcaagcagcucgccgucaaccucacccgcguccucgcccucuaccgcuccauccucgacgccuacaucaucgaguucuucaccgacaaccucugggacacccuccccugcuccuggcaggaggcccucgacggccucaagcccccccagcucgccaccaugcuccucggcaugcccggcgagggcgaggucguccgcuaccgcuccgucuggccccucacccuccucgcccucaaguccaccgccugcgcccucgccuucacccgcaugcccggcuuccagacccccuccgaguuccucgagaaccccucccaguccucccgccucaccgcccccuuccgcaagcacguccgccccaagaagcagcacgagauccgccgccucggcgagcucgucaagaagcucuccgacuucaccggcugcacccaggucgucgacgucggcuccggccagggccaccucucccgcuucauggcccucggccucggccucauggucaaguccaucgagggcgaccagcgccucgucgagcgcgcccagcgccucgaccaggagcuccuccaggcccucgagaaggaggagaagcgcaacccccagaucugcgccgccggcgccaccgccuccggcgcccgcucccccgccgccaccgaguccggcugccccuccggcccccgcggccccggcgagcccugcggcggccuccuccagcccggcuccaccgccugccccaccggcggcgacgccuacuccaccggccccgccgccguccccuccggcaccggcuuccccugcuga

SEQ ID NO: 48999 - RNA, 2277 nt, Artificial Sequence
  derived and/or modified sequence opt2 from RRP1B__Homo_sapiens__NP_055871
auggcccccgccaugcagcccgccgagauccaguucgcccagcgccucgccuccuccgagaagggcauccgcgaccgcgccgucaagaagcuccgccaguacaucuccgucaagacccagcgcgagaccggcggcuucucccaggaggagcuccucaagaucuggaagggccucuucuacugcauguggguccaggacgagccccuccuccaggaggagcucgccaacaccaucgcccagcucguccacgccgucaacaacuccgccgcccagcaccucuucauccagaccuucuggcagaccaugaaccgcgaguggaagggcaucgaccgccuccgccucgacaaguacuacaugcucauccgccucguccuccgccaguccuucgagguccucaagcgcaacggcugggaggagucccgcaucaaggucuuccucgacguccucaugaaggagguccucugccccgagucccagucccccaacggcguccgcuuccacuucaucgacaucuaccucgacgagcucuccaaggucggcggcaaggagcuccucgccgaccagaaccucaaguucaucgaccccuucugcaagaucgccgccaagaccaaggaccacacccucguccagaccaucgcccgcggcgucuucgaggccaucgucgaccagucccccuucguccccgaggagaccauggaggagcagaagaccaaggucggcgacggcgaccucuccgccgaggagauccccgagaacgaggucucccuccgccgcgccgucuccaagaagaagaccgcccucggcaagaaccacucccgcaaggacggccucuccgacgagcgcggccgcgacgacugcggcaccuucgaggacaccggcccccuccuccaguucgacuacaaggccgucgccgaccgccuccucgagaugaccucccgcaagaacaccccccacuucaaccgcaagcgccucuccaagcucaucaagaaguuccaggaccucuccgagggcuccuccaucucccagcucuccuucgccgaggacaucuccgccgacgaggacgaccagauccucucccagggcaagcacaagaagaagggcaacaagcuccucgagaagaccaaccucgagaaggagaagggcucccgcgucuucugcgucgaggaggaggacuccgaguccucccuccagaagcgccgccgcaagaagaagaagaagcaccaccuccagcccgagaaccccggccccggcggcgccgcccccucccucgagcagaaccgcggccgcgagcccgaggccuccggccucaaggcccucaaggcccgcgucgccgagcccggcgccgaggccaccuccuccaccggcgaggaguccggcuccgagcacccccccgccguccccaugcacaacaagcgcaagcgcccccgcaagaaguccccccgcgcccaccgcgagaugcucgaguccgccguccucccccccgaggacaugucccaguccggccccuccggcucccacccccagggcccccgcggcucccccaccggcggcgcccagcuccucaagcgcaagcgcaagcucggcgucguccccgucaacggcuccggccucuccacccccgccuggcccccccuccagcaggagggcccccccaccggccccgccgagggcgccaacucccacaccacccucccccagcgccgccgccuccagaagaagaaggccggccccggcucccucgagcucugcggccuccccucccagaagaccgccucccucaagaagcgcaagaagaugcgcgucauguccaaccucgucgagcacaacggcguccucgaguccgaggccggccagccccaggcccucggcuccuccggcaccugcuccucccucaagaagcagaagcuccgcgccgaguccgacuucgucaaguucgacacccccuuccuccccaagccccucuucuuccgccgcgccaaguccuccaccgccacccacccccccggccccgccguccagcucaacaagacccccuccuccuccaagaaggucaccuucggccucaaccgcaacaugaccgccgaguucaagaagaccgacaaguccauccucgucucccccaccggccccucccgcgucgccuucgaccccgagcagaagccccuccacggcguccucaagacccccaccuccucccccgccuccuccccccucgucgccaagaagccccucaccaccaccccccgccgccgcccccgcgccauggacuucuucuga

SEQ ID NO: 49000 - RNA, 1386 nt, Artificial Sequence
  derived and/or modified sequence opt2 from RRP1__Homo_sapiens__NP_003674
auggucucccgcguccagcucccccccgagauccagcucgcccagcgccucgccggcaacgagcaggucacccgcgaccgcgccguccgcaagcuccgcaaguacaucgucgcccgcacccagcgcgccgccggcggcuucacccacgacgagcuccucaaggucuggaagggccucuucuacugcauguggaugcaggacaagccccuccuccaggaggagcucggccgcaccaucucccagcucguccacgccuuccagaccaccgaggcccagcaccucuuccuccaggccuucuggcagaccaugaaccgcgaguggaccggcaucgaccgccuccgccucgacaaguucuacaugcucaugcgcaugguccucaacgagucccucaagguccucaagaugcagggcugggaggagcgccagaucgaggagcuccucgagcuccucaugaccgagauccuccaccccuccucccaggcccccaacggcgucaagucccacuucaucgagaucuuccucgaggagcucaccaaggucggcgccgaggagcucaccgccgaccagaaccucaaguucaucgaccccuucugccgcaucgccgcccgcaccaaggacucccucguccucaacaacaucacccgcggcaucuucgagaccaucgucgagcaggccccccucgccaucgaggaccuccucaacgagcucgacacccaggacgaggaggucgccuccgacuccgacgaguccuccgagggcggcgagcgcggcgacgcccucucccagaagcgcuccgagaagccccccgccggcuccaucugccgcgccgagcccgaggccggcgaggagcaggccggcgacgaccgcgacuccggcggccccguccuccaguucgacuacgaggccgucgccaaccgccucuucgagauggccucccgccaguccacccccucccagaaccgcaagcgccucuacaaggucauccgcaagcuccaggaccucgccggcggcaucuuccccgaggacgagauccccgagaaggccugccgccgccuccucgagggccgccgccagaagaagaccaagaagcagaagcgccuccuccgccuccagcaggagcgcggcaagggcgagaaggagccccccucccccggcauggagcgcaagcgcucccgccgccgcggcgucggcgccgaccccgaggcccgcgccgaggccggcgagcagcccggcaccgccgagcgcgcccuccuccgcgaccagccccgcggccgcggccagcgcggcgcccgccagcgccgccgcaccccccgcccccucaccuccgcccgcgccaaggccgccaacguccaggagcccgagaagaagaagaagcgccgcgaguga

SEQ ID NO: 49001 - RNA, 1428 nt, Artificial Sequence
  derived and/or modified sequence opt2 from RRP9__Homo_sapiens__NP_004695
auguccgccaccgccgccgcccgcaagcgcggcaagcccgccuccggcgccggcgccggcgccggcgccggcaagcgccgccgcaaggccgacuccgccggcgaccgcggcaaguccaagggcggcggcaagaugaacgaggagaucuccuccgacuccgaguccgagucccucgccccccgcaagcccgaggaggaggaggaggaggagcucgaggagaccgcccaggagaagaagcuccgccucgccaagcucuaccucgagcagcuccgccagcaggaggaggagaaggccgaggcccgcgccuucgaggaggaccaggucgccggccgccucaaggaggacguccucgagcagcgcggccgccuccagaagcucgucgccaaggagauccaggcccccgccuccgccgacauccgcguccuccgcggccaccagcucuccaucaccugccucgucgucacccccgacgacuccgccaucuucuccgccgccaaggacugcuccaucaucaagugguccgucgaguccggccgcaagcuccacgucaucccccgcgccaagaagggcgccgagggcaagccccccggccacuccucccacguccucugcauggccaucuccuccgacggcaaguaccucgccuccggcgaccgcuccaagcucauccucaucugggaggcccaguccugccagcaccucuacaccuucaccggccaccgcgacgccgucuccggccucgccuuccgccgcggcacccaccagcucuacuccaccucccacgaccgcuccgucaaggucuggaacgucgccgagaacuccuacgucgagacccucuucggccaccaggacgccgucgccgcccucgacgcccucucccgcgagugcugcgucaccgccggcggccgcgacggcaccguccgcgucuggaagauccccgaggagucccagcucgucuucuacggccaccagggcuccaucgacugcauccaccucaucaacgaggagcacauggucuccggcgccgacgacggcuccgucgcccucuggggccucuccaagaagcgcccccucgcccuccagcgcgaggcccacggccuccgcggcgagcccggccucgagcagcccuucuggaucuccuccgucgccgcccuccucaacaccgaccucgucgccaccggcucccacuccuccugcguccgccucuggcagugcggcgagggcuuccgccagcucgaccuccucugcgacaucccccucgucggcuucaucaacucccucaaguucuccuccuccggcgacuuccucgucgccggcgucggccaggagcaccgccucggccgcugguggcgcaucaaggaggcccgcaacuccgucugcaucaucccccuccgccgcguccccgucccccccgccgccggcuccuga

SEQ ID NO: 49002 - RNA, 1098 nt, Artificial Sequence
  derived and/or modified sequence opt2 from RRS1__Homo_sapiens__NP_055984
auggagggccaguccgucgaggagcuccucgccaaggccgagcaggacgaggccgagaagcuccagcgcaucaccguccacaaggagcucgagcuccaguucgaccucggcaaccuccucgccuccgaccgcaacccccccaccggccuccgcugcgccggccccacccccgaggccgagcuccaggcccucgcccgcgacaacacccagcuccucaucaaccagcucuggcagcuccccaccgagcgcgucgaggaggccaucgucgcccgccuccccgagcccaccacccgccucccccgcgagaagccccucccccgcccccgcccccucacccgcuggcagcaguucgcccgccucaagggcauccgccccaagaagaagaccaaccucgucugggacgaggucuccggccaguggcgccgccgcuggggcuaccagcgcgcccgcgacgacaccaaggaguggcucaucgagguccccggcaacgccgacccccucgaggaccaguucgccaagcgcauccaggccaagaaggagcgcgucgccaagaacgagcucaaccgccuccgcaaccucgcccgcgcccacaagaugcagcuccccuccgccgccggccuccaccccaccggccaccaguccaaggaggagcucggccgcgccaugcaggucgccaaggucuccaccgccuccgucggccgcuuccaggagcgccuccccaaggagaaggucccccgcggcuccggcaagaagcgcaaguuccagccccucuucggcgacuucgccgccgagaagaagaaccagcucgagcuccuccgcgucaugaacuccaagaagccccagcucgacgucacccgcgccaccaacaagcagaugcgcgaggaggaccaggaggaggccgccaagcgccgcaagaugucccagaagggcaagcgcaagggcggccgccagggccccggcggcaagcgcaagggcggcccccccucccagggcggcaagcgcaagggcggccucggcggcaagaugaacuccggcccccccggccucggcggcaagcgcaagggcggccagcgccccggcggcaagcgccgcaaguga

SEQ ID NO: 49003 - RNA, 675 nt, Artificial Sequence
  derived and/or modified sequence opt2 from RS1__Homo_sapiens__NP_000321
augucccgcaagaucgagggcuuccuccuccuccuccucuucggcuacgaggccacccucggccucuccuccaccgaggacgagggcgaggaccccugguaccagaaggccugcaagugcgacugccagggcggccccaacgcccucugguccgccggcgccaccucccucgacugcauccccgagugccccuaccacaagccccucggcuucgaguccggcgaggucacccccgaccagaucaccugcuccaaccccgagcaguacgucggcugguacuccuccuggaccgccaacaaggcccgccucaacucccagggcuucggcugcgccuggcucuccaaguuccaggacuccucccaguggcuccagaucgaccucaaggagaucaaggucaucuccggcauccucacccagggccgcugcgacaucgacgaguggaugaccaaguacuccguccaguaccgcaccgacgagcgccucaacuggaucuacuacaaggaccagaccggcaacaaccgcgucuucuacggcaacuccgaccgcaccuccaccguccagaaccuccuccgcccccccaucaucucccgcuucauccgccucaucccccucggcuggcacguccgcaucgccauccgcauggagcuccucgagugcgucuccaagugcgccuga

SEQ ID NO: 49004 - RNA, 1086 nt, Artificial Sequence
  derived and/or modified sequence opt2 from RSAD2__Homo_sapiens__XP_011508716
auguggguccucacccccgccgccuucgccggcaagcuccucuccgucuuccgccagccccucuccucccucuggcgcucccucgucccccucuucugcuggcuccgcgccaccuucuggcuccucgccaccaagcgccgcaagcagcagcucguccuccgcggccccgacgagaccaaggaggaggaggaggaccccccccuccccaccacccccaccuccgucaacuaccacuucacccgccagugcaacuacaagugcggcuucugcuuccacaccgccaagaccuccuucguccucccccucgaggaggccaagcgcggccuccuccuccucaaggaggccggcauggagaagaucaacuucuccggcggcgagcccuuccuccaggaccgcggcgaguaccucggcaagcucguccgcuucugcaaggucgagcuccgccuccccuccgucuccaucgucuccaacggcucccucauccgcgagcgcugguuccagaacuacggcgaguaccucgacauccucgccaucuccugcgacuccuucgacgaggaggucaacguccucaucggccgcggccagggcaagaagaaccacgucgagaaccuccagaagcuccgccgcuggugccgcgacuaccgcgucgccuucaagaucaacuccgucaucaaccgcuucaacgucgaggaggacaugaccgagcagaucaaggcccucaaccccguccgcuggaaggucuuccagugccuccucaucgagggcgagaacugcggcgaggacgcccuccgcgaggccgagcgcuucgucaucggcgacgaggaguucgagcgcuuccucgagcgccacaaggaggucuccugccucguccccgaguccaaccagaagaugaaggacuccuaccucauccucgacgaguacaugcgcuuccucaacugccgcaagggccgcaaggaccccuccaaguccauccucgacgucggcgucgaggaggccaucaaguucuccggcuucgacgagaagauguuccucaagcgcggcggcaaguacaucugguccaaggccgaccucaagcucgacugguga

SEQ ID NO: 49005 - RNA, 4326 nt, Artificial Sequence
  derived and/or modified sequence opt2 from RSF1__Homo_sapiens__NP_057662
auggccaccgccgccgccgccgccgccgucauggccccccccggcugccccggcuccugccccaacuucgccgucgucugcuccuuccucgagcgcuacggcccccuccucgaccuccccgagcuccccuuccccgagcucgagcgcguccuccaggcccccccccccgacgucggcaacggcgagguccccaaggagcucgucgagcuccaccucaagcucaugcgcaagaucggcaaguccgucaccgccgaccgcugggagaaguaccucaucaagaucugccaggaguucaacuccaccugggccugggagauggagaagaagggcuaccucgagauguccgucgagugcaagcucgcccuccucaaguaccucugcgagugccaguucgacgacaaccucaaguucaagaacaucaucaacgaggaggacgccgacaccaugcgccuccagcccaucggccgcgacaaggacggccucauguacugguaccagcucgaccaggaccacaacguccgcauguacaucgaggagcaggacgaccaggacggcuccuccuggaagugcaucguccgcaaccgcaacgagcucgccgagacccucgcccuccucaaggcccagaucgaccccguccuccucaagaacuccucccagcaggacaacuccucccgcgagucccccucccucgaggacgaggagaccaagaaggaggaggagacccccaagcaggaggagcagaaggaguccgagaagaugaaguccgaggagcagcccauggaccucgagaaccgcuccaccgccaacguccucgaggagaccaccgucaagaaggagaaggaggacgagaaggagcucgucaagcuccccgucaucgucaagcucgagaagccccuccccgagaacgaggagaagaagaucaucaaggaggaguccgacuccuucaaggagaacgucaagcccaucaaggucgaggucaaggagugccgcgccgaccccaaggacaccaaguccuccauggagaagcccgucgcccaggagcccgagcgcaucgaguucggcggcaacaucaaguccucccacgagaucaccgagaaguccaccgaggagaccgagaagcucaagaacgaccagcaggccaagaucccccucaagaagcgcgagaucaagcucuccgacgacuucgacucccccgucaagggcccccucugcaaguccgucacccccaccaaggaguuccucaaggacgagaucaagcaggaggaggagaccugcaagcgcaucuccaccaucaccgcccucggccacgagggcaagcagcucgucaacggcgaggucuccgacgagcgcgucgcccccaacuucaagaccgagcccaucgagaccaaguucuacgagaccaaggaggaguccuacucccccuccaaggaccgcaacaucaucaccgagggcaacggcaccgagucccucaacuccgucaucaccuccaugaagaccggcgagcucgagaaggagaccgccccccuccgcaaggacgccgacuccuccaucuccguccucgagauccacucccagaaggcccagaucgaggagcccgacccccccgagauggagaccucccucgacuccuccgagauggccaaggaccucuccuccaagaccgcccucuccuccaccgaguccugcaccaugaagggcgaggagaagucccccaagaccaagaaggacaagcgcccccccauccucgagugccucgagaagcucgagaaguccaagaagaccuuccucgacaaggacgcccagcgccucucccccauccccgaggagguccccaaguccacccucgaguccgagaagcccggcucccccgaggccgccgagaccuccccccccuccaacaucaucgaccacugcgagaagcucgccuccgagaaggaggucgucgagugccaguccaccuccaccgucggcggccaguccgucaagaaggucgaccucgagacccucaaggaggacuccgaguucaccaaggucgagauggacaaccucgacaacgcccagaccuccggcaucgaggagcccuccgagaccaagggcuccaugcagaaguccaaguucaaguacaagcucguccccgaggaggagaccaccgccuccgagaacaccgagaucaccuccgagcgccagaaggagggcaucaagcucaccauccgcaucuccucccgcaagaagaagcccgacuccccccccaagguccucgagcccgagaacaagcaggagaagaccgagaaggaggaggagaagaccaacgucggccgcacccuccgccgcuccccccgcaucucccgccccaccgccaaggucgccgagauccgcgaccagaaggccgacaagaagcgcggcgagggcgaggacgaggucgaggaggaguccaccgcccuccagaagaccgacaagaaggagauccucaagaaguccgagaaggacaccaacuccaaggucuccaaggucaagcccaagggcaagguccgcuggaccggcucccgcacccgcggccgcuggaaguacuccuccaacgacgaguccgagggcuccggcuccgagaaguccuccgccgccuccgaggaggaggaggagaaggaguccgaggaggccauccucgccgacgacgacgagcccugcaagaagugcggccuccccaaccaccccgagcucauccuccucugcgacuccugcgacuccggcuaccacaccgccugccuccgccccccccucaugaucauccccgacggcgagugguucugcccccccugccagcacaagcuccucugcgagaagcucgaggagcagcuccaggaccucgacgucgcccucaagaagaaggagcgcgccgagcgccgcaaggagcgccucgucuacgucggcaucuccaucgagaacaucauccccccccaggagcccgacuucuccgaggaccaggaggagaagaagaaggacuccaagaaguccaaggccaaccuccucgagcgccgcuccacccgcacccgcaagugcaucuccuaccgcuucgacgaguucgacgaggccaucgacgaggccaucgaggacgacaucaaggaggccgacggcggcggcgucggccgcggcaaggacaucuccaccaucaccggccaccgcggcaaggacaucuccaccauccucgacgaggagcgcaaggagaacaagcgcccccagcgcgccgccgccgcccgccgcaagaagcgccgccgccucaacgaccucgacuccgacuccaaccucgacgaggaggaguccgaggacgaguucaagaucuccgacggcucccaggacgaguucgucgucuccgacgagaaccccgacgaguccgaggaggacccccccuccaacgacgacuccgacaccgacuucugcucccgccgccuccgccgccaccccucccgccccaugcgccagucccgccgccuccgccgcaagacccccaagaagaaguacuccgacgacgacgaggaggaggaguccgaggagaacucccgcgacuccgaguccgacuucuccgacgacuucuccgacgacuucgucgagacccgccgccgccgcucccgccgcaaccagaagcgccagaucaacuacaaggaggacuccgaguccgacggcucccagaagucccuccgccgcggcaaggagauccgccgcguccacaagcgccgccucuccuccuccgaguccgaggaguccuaccucuccaagaacuccgaggacgacgagcucgccaaggaguccaagcgcuccguccgcaagcgcggccgcuccaccgacgaguacuccgaggccgacgaggaggaggaggaggaggagggcaagcccucccgcaagcgccuccaccgcaucgagaccgacgaggaggaguccugcgacaacgcccacggcgacgccaaccagcccgcccgcgacucccagccccgcguccuccccuccgagcaggaguccaccaagaagcccuaccgcaucgaguccgacgaggaggaggacuucgagaacgucggcaaggucggcuccccccucgacuacucccucgucgaccuccccuccaccaacggccagucccccggcaaggccaucgagaaccucaucggcaagcccaccgagaagucccagacccccaaggacaacuccaccgccuccgccucccucgccuccaacggcaccuccggcggccaggaggccggcgcccccgaggaggaggaggacgagcuccuccgcgucaccgaccucgucgacuacgucugcaacuccgagcagcucuga

SEQ ID NO: 49006 - RNA, 1473 nt, Artificial Sequence
  derived and/or modified sequence opt2 from RSL1D1__Homo_sapiens__NP_056474
auggaggacuccgccuccgccucccucuccuccgccgccgccaccggcaccuccaccuccacccccgccgcccccaccgcccgcaagcagcucgacaaggagcagguccgcaaggccgucgacgcccuccucacccacugcaagucccgcaagaacaacuacggccuccuccucaacgagaacgagucccucuuccucauggucguccucuggaagauccccuccaaggagcuccgcguccgccucacccucccccacuccauccgcuccgacuccgaggacaucugccucuucaccaaggacgagcccaacuccacccccgagaagaccgagcaguucuaccgcaagcuccucaacaagcacggcaucaagaccgucucccagaucaucucccuccagacccucaagaaggaguacaaguccuacgaggccaagcuccgccuccucuccuccuucgacuucuuccucaccgacgcccgcauccgccgccuccuccccucccucaucggccgccacuucuaccagcgcaagaagguccccgucuccgucaaccuccucuccaagaaccucucccgcgagaucaacgacugcaucggcggcaccguccucaacaucuccaaguccggcuccugcuccgccauccgcaucggccacgucggcaugcagaucgagcacaucaucgagaacaucgucgccgucaccaagggccucuccgagaagcuccccgagaagugggaguccgucaagcuccucuucgucaagaccgagaaguccgccgcccuccccaucuucuccuccuucgucuccaacugggacgaggccaccaagcgcucccuccucaacaagaagaagaaggaggcccgccgcaagcgccgcgagcgcaacuucgagaagcagaaggagcgcaagaagaagcgccagcaggcccgcaagaccgccuccguccucuccaaggacgacgucgcccccgaguccggcgacaccaccgucaagaagcccgaguccaagaaggagcagacccccgagcacggcaagaagaagcgcggccgcggcaaggcccaggucaaggccaccaacgaguccgaggacgagaucccccagcucguccccaucggcaagaagacccccgccaacgagaaggucgagauccagaagcacgccaccggcaagaagucccccgccaagucccccaaccccuccaccccccgcggcaagaagcgcaaggcccuccccgccuccgagacccccaaggccgccgaguccgagacccccggcaagucccccgagaagaagcccaagaucaaggaggaggccgucaaggagaagucccccucccucggcaagaaggacgcccgccagacccccaagaagcccgaggccaaguucuucaccacccccuccaaguccguccgcaaggccucccacacccccaagaaguggcccaagaagcccaaggucccccaguccaccuga

SEQ ID NO: 49007 - RNA, 492 nt, Artificial Sequence
  derived and/or modified sequence opt2 from RSL24D1__Homo_sapiens__NP_057388
augcgcaucgagaagugcuacuucugcuccggccccaucuaccccggccacggcaugauguucguccgcaacgacugcaaggucuuccgcuucugcaaguccaagugccacaagaacuucaagaagaagcgcaacccccgcaagguccgcuggaccaaggccuuccgcaaggccgccggcaaggagcucaccgucgacaacuccuucgaguucgagaagcgccgcaacgagcccaucaaguaccagcgcgagcucuggaacaagaccaucgacgccaugaagcgcgucgaggagaucaagcagaagcgccaggccaaguucaucaugaaccgccucaagaagaacaaggagcuccagaagguccaggacaucaaggaggucaagcagaacauccaccucauccgcgccccccucgccggcaagggcaagcagcucgaggagaagaugguccagcagcuccaggaggacgucgacauggaggacgcccccuga

SEQ ID NO: 49008 - RNA, 930 nt, Artificial Sequence
  derived and/or modified sequence opt2 from RSPH1__Homo_sapiens__NP_543136
auguccgaccucggcuccgaggagcucgaggaggagggcgagaacgacaucggcgaguacgagggcggccgcaacgaggccggcgagcgccacggccgcggccgcgcccgccuccccaacggcgacaccuacgagggcuccuacgaguucggcaagcgccacggccagggcaucuacaaguucaagaacggcgcccgcuacaucggcgaguacguccgcaacaagaagcacggccagggcaccuucaucuaccccgacggcucccgcuacgagggcgagugggccaacgaccuccgccacggccacggcgucuacuacuacaucaacaacgacaccuacaccggcgagugguucgcccaccagcgccacggccagggcaccuaccucuacgccgagaccggcuccaaguacgucggcaccugggucaacggccagcaggagggcaccgccgagcucauccaccucaaccaccgcuaccagggcaaguuccucaacaagaaccccgucggccccggcaaguacgucuucgacgucggcugcgagcagcacggcgaguaccgccucaccgacauggagcgcggcgaggaggaggaggaggaggagcucgucaccgucguccccaaguggaaggccacccagaucaccgagcucgcccucuggacccccacccuccccaagaagcccaccuccaccgacggccccggccaggacgcccccggcgccgaguccgccggcgagcccggcgaggaggcccaggcccuccucgagggcuucgagggcgagauggacaugcgccccggcgacgaggacgccgacguccuccgcgaggagucccgcgaguacgaccaggaggaguuccgcuacgacauggacgagggcaacaucaacuccgaggaggaggagacccgccaguccgaccuccaggacuga

SEQ ID NO: 49009 - RNA, 2151 nt, Artificial Sequence
  derived and/or modified sequence opt2 from RSPH4A__Homo_sapiens__NP_001010892
auggaggacuccaccucccccaagcaggagaaggagaaccaggaggagcucggcgagacccgccgccccugggagggcaagaccgccgccuccccccaguacuccgagcccgaguccuccgagccccucgaggccaagcagggccccgagaccggccgccagucccgcuccucccgccccugguccccccagucccgcgccaagaccccccucggcggccccgccggccccgagaccuccucccccgcccccgucuccccccgcgagcccuccuccucccccuccccccucgcccccgcccgccaggaccucgccgcccccccccaguccgaccgcaccaccuccgucauccccgaggccggcacccccuaccccgacccccucgagcaguccuccgacaagcgcgaguccaccccccaccacaccucccaguccgagggcaacaccuuccagcagucccagcagcccaagccccaccucugcggccgccgcgacgucuccuacaacaacgccaagcagaaggagcuccgcuucgacgucuuccaggaggaggacuccaacuccgacuacgaccuccagcagcccgcccccggcggcuccgaggucgcccccuccaugcucgagaucaccauccagaacgccaaggccuaccuccucaagaccuccuccaacuccggcuucaaccucuacgaccaccucuccaacaugcucaccaagauccucaacgagcgccccgagaacgccgucgacaucuucgagaacaucucccaggacgucaagauggcccacuucuccaagaaguucgacgcccuccagaacgagaacgagcuccuccccaccuacgagaucgccgagaagcagaaggcccucuuccuccagggccaccucgagggcgucgaccaggagcucgaggacgagaucgccgagaacgcccuccccaacgucauggaguccgccuucuacuucgagcaggccggcgucggccucggcaccgacgagaccuaccgcaucuuccucgcccucaagcagcucaccgacacccaccccauccagcgcugccgcuucuggggcaagauccucggccucgagaugaacuacaucgucgccgaggucgaguuccgcgagggcgaggacgaggaggaggucgaggaggaggacgucgccgaggagcgcgacaacggcgaguccgaggcccacgaggacgaggaggacgagcuccccaaguccuucuacaaggccccccaggccauccccaaggaggagucccgcaccggcgccaacaaguacgucuacuucgucugcaacgagcccggccgccccugggucaagcucccccccgucauccccgcccagaucgucaucgcccgcaagaucaagaaguucuucaccggccgccucgacgcccccaucaucuccuacccccccuuccccggcaacgaguccaacuaccuccgcgcccagaucgcccgcaucuccgccggcacccacgucuccccccucggcuucuaccaguucggcgaggaggagggcgaggaggaggaggaggccgagggcggccgcaacuccuucgaggagaaccccgacuucgagggcauccaggucaucgaccucgucgagucccucuccaacuggguccaccacguccagcacauccucucccagggccgcugcaacugguucaacuccauccagaagaacgaggaggaggaggaggaggaggacgaggagaaggacgacuccgacuacaucgagcaggaggucggccucccccuccucacccccaucuccgaggaccucgagauccagaacaucccccccuggaccacccgccucuccuccaaccucaucccccaguacgccaucgccguccuccaguccaaccucuggcccggcgccuacgccuucuccaacggcaagaaguucgagaacuucuacaucggcuggggccacaaguacucccccgacaacuacaccccccccguccccccccccgucuaccaggaguaccccuccggccccgagaucaccgagauggacgaccccuccgucgaggaggagcaggccuuccgcgccgcccaggaggccguccuccucgccgccgagaacgaggaguccgaggaggacgaggacgaggaggacgacuacgacuga

SEQ ID NO: 49010 - RNA, 921 nt, Artificial Sequence
  derived and/or modified sequence opt2 from RSPH9__Homo_sapiens__NP_001180270
auggacgccgacucccuccuccucucccucgagcucgccuccggcuccggccagggccucucccccgaccgccgcgccucccuccucaccucccucaugcucgucaagcgcgacuaccgcuacgaccgcguccucuucuggggccgcauccucggccucgucgccgacuacuacaucgcccagggccucuccgaggaccagcucgccccccgcaagacccucuacucccucaacugcaccgaguggucccuccucccccccgccaccgaggagauggucgcccaguccuccgucgucaagggccgcuucaugggcgaccccuccuacgaguacgagcacaccgagcuccagaaggucaacgagggcgagaaggucuucgaggaggagaucgucaucgacaaggccgucgccaucaucccccgcggcgcccucuucaagacccccuucggccccacccacgucaaccgcaccuucgagggccucucccucuccgaggccaagaagcucuccuccuacuuccacuuccgcgagcccgucgagcucaagaacaagacccuccucgagaaggccgaccucgaccccucccucgacuucauggacucccucgagcacgacauccccaagggcuccgaggccgucguccagggcgacuucaccuggcuccucucccgcugcggcuucggcuggcccugcuccugggacuccugcuccgucuccaugcgcguccucgagcaccccgacggcgagggccagugccccggcggcgccgcccagcccgcccucgccggcccccaccuccuccccugcuccccccaccaggagcucuggcuccgccuccgcggccacuggcgcgaggagcacggccucgcccuccacgccaucgagugggagcccgccuggauguuccucaaccgcgucuga

SEQ ID NO: 49011 - RNA, 540 nt, Artificial Sequence
  derived and/or modified sequence opt2 from RSPO2__Homo_sapiens__NP_001269792
augcaguuccgccucuucuccuucgcccucaucauccucaacugcauggacuacucccacugccagggcaaccgcuggcgccgcuccaagcgcggcugccgcaucgagaacugcgacuccugcuucuccaaggacuucugcaccaagugcaaggucggcuucuaccuccaccgcggccgcugcuucgacgagugccccgacggcuucgccccccucgaggagaccauggagugcgucggcugcgaggucggccacugguccgaguggggcaccugcucccgcaacaaccgcaccugcggcuucaaguggggccucgagacccgcacccgccagaucgucaagaagcccgucaaggacaccauccucugccccaccaucgccgagucccgccgcugcaagaugaccaugcgccacugccccggcggcaagcgcacccccaaggccaaggagaagcgcaacaagaagaagaagcgcaagcucaucgagcgcgcccaggagcagcacuccgucuuccucgccaccgaccgcgccaaccaguga

SEQ ID NO: 49012 - RNA, 819 nt, Artificial Sequence
  derived and/or modified sequence opt2 from RSPO3__Homo_sapiens__NP_116173
augcaccuccgccucaucuccuggcucuucaucauccucaacuucauggaguacaucggcucccagaacgccucccgcggccgccgccagcgccgcaugcaccccaacgucucccagggcugccagggcggcugcgccaccugcuccgacuacaacggcugccucuccugcaagccccgccucuucuucgcccucgagcgcaucggcaugaagcagaucggcgucugccucuccuccugccccuccggcuacuacggcacccgcuaccccgacaucaacaagugcaccaagugcaaggccgacugcgacaccugcuucaacaagaacuucugcaccaagugcaaguccggcuucuaccuccaccucggcaagugccucgacaacugccccgagggccucgaggccaacaaccacaccauggagugcgucuccaucguccacugcgaggucuccgaguggaaccccuggucccccugcaccaagaagggcaagaccugcggcuucaagcgcggcaccgagacccgcguccgcgagaucauccagcaccccuccgccaagggcaaccucugcccccccaccaacgagacccgcaagugcaccguccagcgcaagaagugccagaagggcgagcgcggcaagaagggccgcgagcgcaagcgcaagaagcccaacaagggcgaguccaaggaggccauccccgacuccaagucccucgaguccuccaaggagauccccgagcagcgcgagaacaagcagcagcagaagaagcgcaagguccaggacaagcagaaguccgucuccgucuccaccguccacuga

SEQ ID NO: 49013 - RNA, 705 nt, Artificial Sequence
  derived and/or modified sequence opt2 from RSPO4__Homo_sapiens__NP_001025042
augcgcgccccccucugccuccuccuccucgucgcccacgccgucgacaugcucgcccucaaccgccgcaagaagcaggucggcaccggccucggcggcaacugcaccggcugcaucaucugcuccgaggagaacggcugcuccaccugccagcagcgccucuuccucuucauccgccgcgagggcauccgccaguacggcaagugccuccacgacugcccccccggcuacuucggcauccgcggccaggaggucaaccgcugcaagaagugcggcgccaccugcgaguccugcuucucccaggacuucugcauccgcugcaagcgccaguucuaccucuacaagggcaagugccuccccaccugcccccccggcacccucgcccaccagaacacccgcgagugccagggcgagugcgagcucggccccuggggcggcuggucccccugcacccacaacggcaagaccugcggcuccgccuggggccucgagucccgcguccgcgaggccggccgcgccggccacgaggaggccgccaccugccagguccucuccgagucccgcaagugccccauccagcgccccugccccggcgagcgcucccccggccagaagaagggccgcaaggaccgccgcccccgcaaggaccgcaagcucgaccgccgccucgacguccgcccccgccagcccggccuccagcccuga

SEQ ID NO: 49014 - RNA, 831 nt, Artificial Sequence
  derived and/or modified sequence opt2 from RSRC1__Homo_sapiens__NP_001258763
augggccgccgcuccuccgacaccgaggaggagucccgcuccaagcgcaagaagaagcaccgccgccgcuccuccuccuccuccuccuccgacucccgcaccuacucccgcaagaagggcggccgcaagucccgcuccaagucccgcuccuggucccgcgaccuccagccccgcucccacuccuacgaccgccgccgccgccaccgcuccuccuccuccuccuccuacggcucccgccgcaagcgcucccgcucccgcucccgcggccgcggcaaguccuaccgcguccagcgcucccgcuccaagucccgcacccgccgcgaguccggcaacaucaaggccggccucgagcaccucccccccgccgagcaggccaaggcccgccuccagcucguccucgaggccgccgccaaggccgacgaggcccucaaggccaaggagcgcaacgaggaggaggccaagcgccgcaaggaggaggaccaggccacccucgucgagcaggucaagcgcgucaaggagaucgaggccaucgaguccgacuccuucguccagcagaccuuccgcuccuccaaggaggucaagaaguccgucgagcccuccgaggucaagcaggccaccuccaccuccggccccgccuccgccgucgccgacccccccuccaccgagaaggagaucgaccccaccuccauccccaccgccaucaaguaccaggacgacaacucccucgcccaccccaaccucuucaucgagaaggccgacgccgaggagaagugguucaagcgccucaucgcccuccgccaggagcgccucaugggcucccccgucgccuga

SEQ ID NO: 49015 - RNA, 1305 nt, Artificial Sequence
  derived and/or modified sequence opt2 from RSRC2__Homo_sapiens__NP_075388
auggccgccuccgacaccgagcgcgacggccucgcccccgagaagaccucccccgaccgcgacaagaagaaggagcaguccgaggucuccgucuccccccgcgccuccaagcaccacuacucccgcucccgcucccgcucccgcgagcgcaagcgcaaguccgacaacgagggccgcaagcaccgcucccgcucccgcuccaaggagggccgccgccacgaguccaaggacaaguccuccaagaagcacaaguccgaggagcacaacgacaaggagcacuccuccgacaagggccgcgagcgccucaacuccuccgagaacggcgaggaccgccacaagcgcaaggagcgcaaguccucccgcggccgcucccacucccgcucccgcucccgcgagcgccgccaccgcucccgcucccgcgagcgcaagaagucccgcucccgcucccgcgagcgcaagaagucccgcucccgcucccgcgagcgcaagaagucccgcucccgcucccgcgagcgcaagcgccgcauccgcucccgcucccgcucccgcucccgccaccgccaccgcacccgcucccgcucccgcacccgcucccgcucccgcgaccgcaagaagcgcaucgagaagccccgccgcuucucccgcucccucucccgcacccccucccccccccccuuccgcggccgcaacaccgccauggacgcccaggaggcccucgcccgccgccucgagcgcgccaagaagcuccaggagcagcgcgagaaggagauggucgagaagcagaagcagcaggagaucgccgccgccgccgccaccggcggcuccguccucaacgucgccgcccuccucgccuccggcacccaggucaccccccagaucgccauggccgcccagauggccgcccuccaggccaaggcccucgccgagaccggcaucgccguccccuccuacuacaaccccgccgccgucaaccccaugaaguucgccgagcaggagaagaagcgcaagaugcucuggcagggcaagaaggagggcgacaagucccaguccgccgagaucugggagaagcucaacuucggcaacaaggaccagaacgucaaguuccgcaagcucaugggcaucaaguccgaggacgaggccggcugcuccuccgucgacgaggaguccuacaagacccucaagcagcaggaggaggucuuccgcaaccucgacgcccaguacgagauggcccgcucccagacccacacccagcgcggcaugggccucggcuucaccuccuccaugcgcggcauggacgccgucuga

SEQ ID NO: 49016 - RNA, 681 nt, Artificial Sequence
  derived and/or modified sequence opt2 from RSRP1__Homo_sapiens__XP_011540100
auguccaacuacgucaacgacauguggcccggcuccccccaggagaaggacucccccuccaccucccgcuccggcggcuccucccgccucuccucccgcucccgcucccgcuccuucucccgcuccucccgcucccacucccgcgucuccucccgcuucuccucccgcucccgccgcuccaagucccgcucccgcucccgccgccgccaccagcgcaaguaccgccgcuacucccgcuccuacucccgcucccgcucccgcucccgcucccgccgcuaccgcgagcgccgcuacggcuucacccgccgcuacuaccgcucccccucccgcuaccgcucccgcucccgcucccgcucccgcucccgcggccgcuccuacugcggccgcgccuacgccaucgcccgcggccagcgcuacuacggcuucggccgcaccgucuaccccgaggagcacucccgcuggcgcgaccgcucccgcacccgcucccgcucccgcacccccuuccgccucuccgagaaggaccgcauggagcuccucgagaucgccaagaccaacgccgccaaggcccucggcaccaccaacaucgaccuccccgccucccuccgcaccguccccuccgccaaggagaccucccgcggcaucggcgucuccuccaacggcgccaagcccgagauguucuga

SEQ ID NO: 49017 - RNA, 834 nt, Artificial Sequence
  derived and/or modified sequence opt2 from RSU1__Homo_sapiens__NP_036557
auguccaagucccucaagaagcucgucgaggagucccgcgagaagaaccagcccgaggucgacauguccgaccgcggcaucuccaacaugcucgacgucaacggccucuucacccucucccacaucacccagcucguccucucccacaacaagcucaccauggucccccccaacaucgccgagcucaagaaccucgagguccucaacuucuucaacaaccagaucgaggagcuccccacccagaucuccucccuccagaagcucaagcaccucaaccucggcaugaaccgccucaacacccucccccgcggcuucggcucccuccccgcccucgagguccucgaccucaccuacaacaaccucuccgagaacucccuccccggcaacuucuucuaccucaccacccuccgcgcccucuaccucuccgacaacgacuucgagauccucccccccgacaucggcaagcucaccaagcuccagauccucucccuccgcgacaacgaccucaucucccuccccaaggagaucggcgagcucacccagcucaaggagcuccacauccagggcaaccgccucaccguccucccccccgagcucggcaaccucgaccucaccggccagaagcaggucuucaaggccgagaacaaccccugggucacccccaucgccgaccaguuccagcucggcgucucccacgucuucgaguacauccgcuccgagaccuacaaguaccucuacggccgccacaugcaggccaaccccgagccccccaagaagaacaacgacaaguccaagaagaucucccgcaagccccucgccgccaagaaccgcuga

SEQ ID NO: 49018 - RNA, 1518 nt, Artificial Sequence
  derived and/or modified sequence opt2 from RTCB__Homo_sapiens__NP_055121
augucccgcuccuacaacgacgagcuccaguuccucgagaagaucaacaagaacugcuggcgcaucaagaagggcuucguccccaacaugcaggucgagggcgucuucuacgucaacgacgcccucgagaagcucauguucgaggagcuccgcaacgccugccgcggcggcggcgucggcggcuuccuccccgccaugaagcagaucggcaacgucgccgcccuccccggcaucguccaccgcuccaucggccuccccgacguccacuccggcuacggcuucgccaucggcaacauggccgccuucgacaugaacgaccccgaggccgucgucucccccggcggcgucggcuucgacaucaacugcggcguccgccuccuccgcaccaaccucgacgaguccgacguccagcccgucaaggagcagcucgcccaggccauguucgaccacauccccgucggcgucggcuccaagggcgucauccccaugaacgccaaggaccucgaggaggcccucgagaugggcgucgacuggucccuccgcgagggcuacgccugggccgaggacaaggagcacugcgaggaguacggccgcaugcuccaggccgaccccaacaaggucuccgcccgcgccaagaagcgcggccucccccagcucggcacccucggcgccggcaaccacuacgccgagauccaggucgucgacgagaucuucaacgaguacgccgccaagaagaugggcaucgaccacaagggccaggucugcgucaugauccacuccggcucccgcggccucggccaccaggucgccaccgacgcccucgucgccauggagaaggccaugaagcgcgacaagaucaucgucaacgaccgccagcucgccugcgcccgcaucgccucccccgagggccaggacuaccucaagggcauggccgccgccggcaacuacgccugggucaaccgcuccuccaugaccuuccucacccgccaggccuucgccaaggucuucaacaccacccccgacgaccucgaccuccacgucaucuacgacgucucccacaacaucgccaaggucgagcagcacgucgucgacggcaaggagcgcacccuccucguccaccgcaagggcuccacccgcgccuuccccccccaccacccccucaucgccgucgacuaccagcucaccggccagcccguccucaucggcggcaccaugggcaccugcuccuacguccucaccggcaccgagcagggcaugaccgagaccuucggcaccaccugccacggcgccggccgcgcccucucccgcgccaagucccgccgcaaccucgacuuccaggacguccucgacaagcucgccgacaugggcaucgccauccgcgucgccucccccaagcucgucauggaggaggcccccgaguccuacaagaacgucaccgacgucgucaacaccugccacgacgccggcaucuccaagaaggccaucaagcuccgccccaucgccgucaucaagggcuga

SEQ ID NO: 49019 - RNA, 3903 nt, Artificial Sequence
  derived and/or modified sequence opt2 from RTEL1__Homo_sapiens__NP_001269938
augcccaagaucguccucaacggcgucaccgucgacuuccccuuccagcccuacaagugccagcaggaguacaugaccaagguccucgagugccuccagcagaaggucaacggcauccucgagucccccaccggcaccggcaagacccucugccuccucugcaccacccucgccuggcgcgagcaccuccgcgacggcaucuccgcccgcaagaucgccgagcgcgcccagggcgagcucuuccccgaccgcgcccucuccuccuggggcaacgccgccgccgccgccggcgaccccaucgccugcuacaccgacauccccaagaucaucuacgccucccgcacccacucccagcucacccaggucaucaacgagcuccgcaacaccuccuaccgccccaaggucugcguccucggcucccgcgagcagcucugcauccaccccgaggucaagaagcaggaguccaaccaccuccagauccaccucugccgcaagaaggucgccucccgcuccugccacuucuacaacaacgucgaggagaagucccucgagcaggagcucgccucccccauccucgacaucgaggaccucgucaaguccggcuccaagcaccgcgucugccccuacuaccucucccgcaaccucaagcagcaggccgacaucaucuucaugcccuacaacuaccuccucgacgccaagucccgccgcgcccacaacaucgaccucaagggcaccgucgucaucuucgacgaggcccacaacgucgagaagaugugcgaggaguccgccuccuucgaccucaccccccacgaccucgccuccggccucgacgucaucgaccagguccucgaggagcagaccaaggccgcccagcagggcgagccccaccccgaguucuccgccgacucccccucccccggccucaacauggagcucgaggacaucgccaagcucaagaugauccuccuccgccucgagggcgccaucgacgccgucgagcuccccggcgacgacuccggcgucaccaagcccggcuccuacaucuucgagcucuucgccgaggcccagaucaccuuccagaccaagggcugcauccucgacucccucgaccagaucauccagcaccucgccggccgcgccggcgucuucaccaacaccgccggccuccagaagcucgccgacaucauccagaucgucuucuccgucgaccccuccgagggcucccccggcucccccgccggccucggcgcccuccaguccuacaagguccacauccaccccgacgccggccaccgccgcaccgcccagcgcuccgacgccugguccaccaccgccgcccgcaagcgcggcaagguccucuccuacuggugcuucucccccggccacuccaugcacgagcucguccgccagggcguccgcucccucauccucaccuccggcacccucgcccccgucuccuccuucgcccucgagaugcagauccccuuccccgucugccucgagaacccccacaucaucgacaagcaccagaucugggucggcgucgucccccgcggccccgacggcgcccagcucuccuccgccuucgaccgccgcuucuccgaggagugccucuccucccucggcaaggcccucggcaacaucgcccgcgucguccccuacggccuccucaucuucuuccccuccuaccccgucauggagaagucccucgaguucuggcgcgcccgcgaccucgcccgcaagauggaggcccucaagccccucuucgucgagccccgcuccaagggcuccuucuccgagaccaucuccgccuacuacgcccgcgucgccgcccccggcuccaccggcgccaccuuccucgccgucugccgcggcaaggccuccgagggccucgacuucuccgacaccaacggccgcggcgucaucgucaccggccuccccuaccccccccgcauggacccccgcgucguccucaagaugcaguuccucgacgagaugaagggccagggcggcgccggcggccaguuccucuccggccaggagugguaccgccagcaggccucccgcgccgucaaccaggccaucggccgcgucauccgccaccgccaggacuacggcgccgucuuccucugcgaccaccgcuucgccuucgccgacgcccgcgcccagcuccccuccuggguccgcccccacguccgcgucuacgacaacuucggccacgucauccgcgacgucgcccaguucuuccgcgucgccgagcgcaccaugcccgcccccgccccccgcgccaccgcccccuccguccgcggcgaggacgccgucuccgaggccaagucccccggccccuucuucuccacccgcaaggccaagucccucgaccuccacguccccucccucaagcagcgcuccuccggcucccccgccgccggcgaccccgaguccucccucugcgucgaguacgagcaggagcccguccccgcccgccagcgcccccgcggccuccucgccgcccucgagcacuccgagcagcgcgccggcucccccggcgaggagcaggcccacuccugcuccacccucucccuccucuccgagaagcgccccgccgaggagccccgcggcggccgcaagaagauccgccucgucucccaccccgaggagcccgucgccggcgcccagaccgaccgcgccaagcucuucauggucgccgucaagcaggagcucucccaggccaacuucgccaccuucacccaggcccuccaggacuacaagggcuccgacgacuucgccgcccucgccgccugccucggcccccucuucgccgaggaccccaagaagcacaaccuccuccagggcuucuaccaguucguccgcccccaccacaagcagcaguucgaggaggucugcauccagcucaccggccgcggcugcggcuaccgccccgagcacuccaucccccgccgccagcgcgcccagcccguccucgaccccaccggccgcaccgcccccgaccccaagcucaccgucuccaccgccgccgcccagcagcucgacccccaggagcaccucaaccagggccgcccccaccucuccccccgccccccccccaccggcgaccccggcucccagccccaguggggcuccggcgucccccgcgccggcaagcagggccagcacgccgucuccgccuaccucgccgacgcccgccgcgcccucggcuccgccggcugcucccagcuccucgccgcccucaccgccuacaagcaggacgacgaccucgacaagguccucgccguccucgccgcccucaccaccgccaagcccgaggacuucccccuccuccaccgcuucuccauguucguccgcccccaccacaagcagcgcuucucccagaccugcaccgaccucaccggccgccccuaccccggcauggagccccccggcccccaggaggagcgccucgccgucccccccguccucacccaccgcgccccccagcccggccccucccgcuccgagaagaccggcaagacccaguccaagaucuccuccuuccuccgccagcgccccgccggcaccgucggcgccggcggcgaggacgccggccccucccaguccuccggccccccccacggccccgccgccuccgaguggggcgagccccacggccgcgacaucgccggccagcaggccaccggcgcccccggcggcccccucuccgccggcugcgucugccagggcugcggcgccgaggacgucguccccuuccagugccccgccugcgacuuccagcgcugccaggccugcuggcagcgccaccuccaggccucccgcaugugccccgccugccacaccgccucccgcaagcaguccgucaugcaggucuucuggcccgagccccaguga

SEQ ID NO: 49020 - RNA, 492 nt, Artificial Sequence
  derived and/or modified sequence opt2 from RTKN2__Homo_sapiens__NP_001269870
auggagggccccucccuccgcggccccgcccuccgccucgccggccuccccacccagcaggacugcaacauccaggagaagaucgaccucgagauccgcaugcgcgagggcaucuggaagcuccucucccucuccacccagaaggaccagguccuccacgccgucaagaaccucauggucugcaacgcccgccucauggccuacaccuccgagcuccagaagcucgaggagcagaucgccaaccagaccggccgcugcgacgucaaguucgaguccaaggagcgcaccgccugcaagggcaagaucgccaucuccgacauccgcaucccccucauguggaaggacuccgaccacuucuccaacaaggagcgcucccgccgcuacgccaucuucugccucuucaagaugggcgccaacgucuucgacaccgacgucgucaacgucgacaagaccaucaccgacaucugcuucgagaacgucaccauccucuga

SEQ ID NO: 49021 - RNA, 1692 nt, Artificial Sequence
  derived and/or modified sequence opt2 from RTKN__Homo_sapiens__NP_001015055
auguucucccgcaaccaccgcucccgcgucaccgucgcccgcggcuccgcccucgagauggaguucaagcgcggccgcuuccgccucucccucuucuccgaccuccccgaggacaccgagcuccagcgcaagcucgaccacgagauccgcaugcgcgagggcgccugcaagcuccucgccgccugcucccagcgcgagcaggcccucgaggccaccaagucccuccucgucugcaacucccgcauccucuccuacaugggcgagcuccagcgccgcaaggaggcccagguccucggcaagaccucccgccgccccuccgacuccggcccccccgccgagcgcucccccugccgcggccgcgucugcaucuccgaccuccgcaucccccucauguggaaggacaccgaguacuucaagaacaagggcgaccuccaccgcugggccgucuuccuccuccuccagcucggcgagcacauccaggacaccgagaugauccucgucgaccgcacccucaccgacaucuccuuccaguccaacguccucuucgccgaggccggccccgacuucgagcuccgccucgagcucuacggcgccugcgucgaggaggagggcgcccucaccggcggccccaagcgccucgccaccaagcucuccuccucccucggccgcuccuccggccgccgcguccgcgccucccucgacuccgccggcggcuccggcuccucccccauccuccuccccacccccgucgucggcggcccccgcuaccaccuccucgcccacaccacccucacccucgccgccguccaggacggcuuccgcacccacgaccucacccucgccucccacgaggagaaccccgccuggcucccccucuacggcuccgucugcugccgccucgccgcccagccccucugcaugacccagcccaccgccuccggcacccuccgcguccagcaggccggcgagaugcagaacugggcccagguccacggcguccucaagggcaccaaccucuucugcuaccgccagcccgaggacgccgacaccggcgaggagccccuccucaccaucgccgucaacaaggagacccgcguccgcgccggcgagcucgaccaggcccucggccgccccuucacccucuccaucuccaaccaguacggcgacgacgaggucacccacacccuccagaccgagucccgcgaggcccuccaguccuggauggaggcccucuggcagcucuucuucgacaugucccaguggaagcagugcugcgacgagaucaugaagaucgagacccccgccccccgcaagcccccccaggcccucgccaagcagggcucccucuaccacgagauggccaucgagccccucgacgacaucgccgccgucaccgacauccucacccagcgcgagggcgcccgccucgagacccccccccccuggcucgccauguucaccgaccagcccgcccuccccaaccccugcucccccgccuccgucgcccccgcccccgacuggacccacccccuccccuggggccgcccccgcaccuucucccucgacgccgucccccccgaccacuccccccgcgcccgcuccgucgccccccuccccccccagcgcuccccccgcacccgcggccucugcuccaagggccagccccgcaccuggcuccagucccccgucuga

SEQ ID NO: 49022 - RNA, 4077 nt, Artificial Sequence
  derived and/or modified sequence opt2 from RTL1__Homo_sapiens__NP_001128360
augaucgagcccuccgaggacuccuucgagaccaugauggagcacaagaaccccuccuccaagcagauggaguccuccgagggcuccuccaacaccaccgaggccaccuccggcuccggcguccgcggcgaggccggccccgccuccggccccgcccaggagaagaaggagccccccuccggcccccuccaggagauggaggagcuccccaccgaccuccuccaggacauggaggagcccuccuccggcccccgcaaggagaucgaggacccccccaacgaccuccuccaggaccucgaggaguccugcaacggcucccaccaggcccgcggcgacccccucuccggcgccuccgaccgcaugaaggaggccuccgucaaccccuccggcgcccgcgaggagcaggaggcccacaccgaccucaaggaguccggccgcgaggagaccccccaggagcagaaccagaccgagcacuccaccgccgagcucauggccaugguccgcuccaucaucucccucuacuuccgcaugcaggaccucaaggagcagcagcgcgucgccgaggagauccucaucaagggcaucaacgccggccagcuccccgcccccaagcacuucuccggcgaccgccgcgaguuccacgaguucaucguccucugccagcucacccuccaguccuacccccgcauguucuacaacgaccgccuccgcgucggcuacgucaucaaccaccucuccggccucgcccucgagugggccaaggcccuccuccaggagaacuccccccucaucggcgacuuccccgccuuccucgaggccauguccgaggucuucgaguaccgccaggcccuccgcgucgccgaggaggccauguucaccauccgccagggcggccgcuccgccaccgaguacaucgacgaguuccagucccucguccccauccucggcuggcccgacgagguccuccaggcccaccucugccagggccucaacgaggagauccgccacuaccucuuccgcgucccccagcccgacucccucgacucccucaucguccucauccuccagaucgaggagaagcucgccgagcgccgcgccaugcuccgccucccccccgaggcccgcccccgcaaccucaccuggaucgacucccccgcccccgagcgcuggauggucuccuccuggcuccccuccgagguccaccccgacaucaaccgcgcccaccucuuccuccuccucaugguccgcgucaaccccuaccacuccgucgccguccaggcccucgucgacuccggcgccgacggcaacuucauggacgagaaguucgcccaggagcacuacgucgagcucuacgagaagcccuacccccagcccguccaguccgucgacggcucccucaucggcaacgagcccgucuggcucuacaccgagccccucgucugcauccaccagaaccaccaggaguccaucgaguucgacaucguccccucccccaacuucuccgucguccucggcauccgcuggcuccgcguccacgcccccgaggucgacuggaucaagggccgcugcaccuuccacucccccuacugccucaagaacugcuuccgcccccccccccccugcaucgcccucgagcgccacggcaugucccuccuccccggccucccccaccccuacuccgaccucgccgacgucuucaaccccaaggaggccgacgacgagaccuccgaccagcccuccuccgacggcuccgacgaccucuccgaguccgagcccuccgagcuccagcaggccggcgacuccgaccacuccgagaccuucuacgagugccccuccaccgcccccugggagcccgucggcgcccgcaugcaggagcgcgcccgccuccaggaggaguacugggaccuccaggacaugcucaccaaccgccaggacuacauccagaugauccccgagcucuucgaccagcuccacggcgccgagugguucaccaagcucgagcuccgcggcaccaucgucgaggaguccgucaacggccaccgcaccgaggacgucuggaaggccgccuucggccucgagcucgaggagaugaaguccuaccagcccuucgcccucucccccgaccccaucaucccccagaacgucauccacuucauccucaaggacaugcucggcuucuucguccucuccuacggccaggagguccucaucuacuccaugucccaggaggagcaccuccaccacguccgccagguccucguccgcuuccgccaccacaacgucuacugcucccucgacaagucccaguuccaccgccagaccgucgaguuccucggcuucgucgucacccccaagggcgucaagcucaacaagaacgucaugaccaucaucaccggcuaccccacccccggcuccaagcucucccuccgcaacuucaucgaguucgucuuccccuaccgccacuucgucgagcgcuucuccaucaucgccgagccccucguccgccagcuccucuccuccuaccaguucuacuggggcgucgaggagcaggaggccuucgagugccucaagcgcgccuuccgcaaggccccccuccuccaccaccccaagccccagaaccccuucuaccucgagaccggcgucaccggcaccgcccuccacgccucccucauccagaucgacgaccagaccggcaagcgcgccugcugcgccuucuacucccgcaacaucucccccaucgaggucgaguacucccaggccgagaugaagauccuccccauccgcgccgccuucauggucuggugccgcuaccucgagaacaccgaggagcccaucaugauccuccucaacaccgaggaccucgccucccucaacaacgaccgccucaccguccuccuccccggccacugggucuucuucuucucccacuucaacuucgacgucauggagcuccccgagcaggacggcggccgcgcccucccccccguccgcaaccuccgcuggcgccgcgccuuccagcgcaacaccgccgcccgccagacccuccuccucgccucccgcggcuucccccgcgaccccuccaccgaguccggcgaggaggagaacgaggagcaggacgagcucaacgagcagauccuccgccaggagcuccucgccaugauccccaucgaccagauccucaacuccuuccucgcccacuucuccauggcccagauccgcgccgucauccuccacuucuuccgcggccuccucuacuggaagaacacccucgcccucgccgccauccucguccuccuccgcguccgccagugccucucccuccgccccgcccccgccaugcgcgucgcccgcccccagccccagcgcucccuccgccucauccucgacuccucccucaucgccggcuccuccaucaccaccgccaucacccagcuccucacccagaugcccgcccucgucggcgccaacaccauccccgcccaggagcucgccgagcucuuccucggccccggccgcuggcagcgcaacgcccuccacucccaggcccaccgcggccuccaguucacccccggcuucuggcucacccucugcgaguucuucggcguccgcgucaccccccaggagggccaccuccccgcccuccgccagaaccgcuaccucgagcuccacgucgucggcgacgaggacgucguccuccgcgaggcccuccaggacgaccuccagcgcuaccgccagugcggccuccacgacggccuccaggacaccucccaggacaagcaggacaacgacguccaggaggccccccccucccacaccgccgccacccaccccccccgcccccgccaccucauggacccccagguccucgaguuccucggcucccgccuccuccacauccacuccgccgacggccagcuccaccuccucucccgcgagcaggccgcccgcgcccucucccaguuccucacccucaucuaccgccgcgcccuccccauccccgccugggagucccagccccgcgagcaggcccgccucgaggagcuccccgacgaggacgaggacgccaaccucgacuga

SEQ ID NO: 49023 - RNA, 2331 nt, Artificial Sequence
  derived and/or modified sequence opt2 from RTN1__Homo_sapiens__NP_066959
auggccgcccccggcgacccccaggacgagcuccucccccucgccggccccggcucccaguggcuccgccaccgcggcgagggcgagaacgaggccgucacccccaagggcgccacccccgccccccaggccggcgagcccucccccggccucggcgcccgcgcccgcgaggccgccucccgcgaggccggcuccggccccgcccgccagucccccgucgccauggagaccgccuccaccggcgucgccggcgucuccuccgccauggaccacaccuucuccaccaccuccaaggacggcgagggcuccugcuacaccucccucaucuccgacaucugcuaccccccccaggaggacuccaccuacuucaccggcauccuccagaaggagaacggccacgucaccaucuccgagucccccgaggagcucggcacccccggccccucccuccccgacguccccggcaucgagucccgcggccucuucuccuccgacuccggcaucgagaugacccccgccgaguccaccgaggucaacaagauccucgccgacccccucgaccagaugaaggccgaggccuacaaguacaucgacaucacccgccccgaggaggucaagcaccaggagcagcaccaccccgagcucgaggacaaggaccucgacuucaagaacaaggacaccgacaucuccaucaagcccgagggcguccgcgagcccgacaagcccgcccccgucgagggcaagaucaucaaggaccaccuccucgaggaguccaccuucgcccccuacaucgacgaccucuccgaggagcagcgccgcgccccccagaucaccacccccgucaagaucacccucaccgagaucgagcccuccgucgagaccaccacccaggagaagacccccgagaagcaggacaucugccucaagcccucccccgacaccguccccaccgucaccgucuccgagcccgaggacgacucccccggcuccaucaccccccccuccuccggcaccgagcccuccgccgccgagucccagggcaagggcuccaucuccgaggacgagcucaucaccgccaucaaggaggccaagggccucuccuacgagaccgccgagaacccccgccccgucggccagcucgccgaccgccccgaggucaaggcccgcuccggcccccccaccauccccuccccccucgaccacgaggccuccuccgccgaguccggcgacuccgagaucgagcucgucuccgaggaccccauggccgccgaggacgcccuccccuccggcuacgucuccuucggccacgucggcggccccccccccucccccgccucccccuccauccaguacuccauccuccgcgaggagcgcgaggccgagcucgacuccgagcucaucaucgaguccugcgacgccuccuccgccuccgaggagucccccaagcgcgagcaggacuccccccccaugaagcccuccgcccucgacgccauccgcgaggagaccggcguccgcgccgaggagcgcgcccccucccgccgcggccucgccgagcccggcuccuuccucgacuaccccuccaccgagccccagcccggccccgagcucccccccggcgacggcgcccucgagcccgagacccccaugcucccccgcaagcccgaggaggacuccuccuccaaccagucccccgccgccaccaagggccccggcccccucggccccggcgccccccccccccuccucuuccucaacaagcagaaggccaucgaccuccucuacuggcgcgacaucaagcagaccggcaucgucuucggcuccuuccuccuccuccucuucucccucacccaguucuccgucgucuccgucgucgccuaccucgcccucgccgcccucuccgccaccaucuccuuccgcaucuacaaguccguccuccaggccguccagaagaccgacgagggccaccccuucaaggccuaccucgagcucgagaucacccucucccaggagcagauccagaaguacaccgacugccuccaguucuacgucaacuccacccucaaggagcuccgccgccucuuccucguccaggaccucgucgacucccucaaguucgccguccucauguggcuccucaccuacgucggcgcccucuucaacggccucacccuccuccucauggccgucgucuccauguucacccuccccgucgucuacgucaagcaccaggcccagaucgaccaguaccucggccucguccgcacccacaucaacgccgucgucgccaagauccaggccaagauccccggcgccaagcgccacgccgaguga

SEQ ID NO: 49024 - RNA, 1638 nt, Artificial Sequence
  derived and/or modified sequence opt2 from RTN2__Homo_sapiens__NP_005610
augggccagguccuccccgucuucgcccacugcaaggaggcccccuccaccgccuccuccacccccgacuccaccgagggcggcaacgacgacuccgacuuccgcgagcuccacaccgcccgcgaguucuccgaggaggacgaggaggagaccaccucccaggacuggggcaccccccgcgagcucaccuucuccuacaucgccuucgacggcgucgucggcuccggcggccgccgcgacuccaccgcccgccgcccccgcccccagggccgcuccgucuccgagccccgcgaccagcacccccagcccucccucggcgacucccucgaguccauccccucccucucccagucccccgagcccggccgccgcggcgaccccgacaccgccccccccuccgagcgcccccucgaggaccuccgccuccgccucgaccaccucggcugggucgcccgcggcaccggcuccggcgaggacuccuccaccuccuccuccaccccccucgaggacgaggagccccaggagcccaaccgccucgagaccggcgaggccggcgaggagcucgaccuccgccuccgccucgcccagcccuccucccccgagguccucaccccccagcucucccccggcuccggcaccccccaggccggcacccccucccccucccgcucccgcgacuccaacuccggccccgaggagccccuccucgaggaggaggagaagcaguggggcccccucgagcgcgagcccguccgcggccagugccucgacuccaccgaccagcucgaguucaccgucgagccccgccuccucggcaccgccauggaguggcucaagaccucccuccuccucgccgucuacaagaccguccccauccucgagcucucccccccccucuggaccgccaucggcuggguccagcgcggccccaccccccccacccccguccuccgcguccuccucaagugggccaaguccccccgcuccuccggcguccccucccucucccucggcgccgacaugggcuccaaggucgccgaccuccucuacuggaaggacacccgcaccuccggcgucgucuucaccggccucauggucucccuccucugccuccuccacuucuccaucgucuccgucgccgcccaccucgcccuccuccuccucugcggcaccaucucccuccgcgucuaccgcaagguccuccaggccguccaccgcggcgacggcgccaaccccuuccaggccuaccucgacgucgaccucacccucacccgcgagcagaccgagcgccucucccaccagaucaccucccgcgucgucuccgccgccacccagcuccgccacuucuuccucgucgaggaccucgucgacucccucaagcucgcccuccucuucuacauccucaccuucgucggcgccaucuucaacggccucacccuccucauccucggcgucaucggccucuucaccaucccccuccucuaccgccagcaccaggcccagaucgaccaguacgucggccucgucaccaaccagcucucccacaucaaggccaagauccgcgccaagauccccggcaccggcgcccucgccuccgccgccgccgccgucuccggcuccaaggccaaggccgaguga

SEQ ID NO: 49025 - RNA, 3099 nt, Artificial Sequence
  derived and/or modified sequence opt2 from RTN3__Homo_sapiens__NP_001252518
auggccgagcccuccgccgccacccagucccacuccaucuccuccuccuccuucggcgccgagcccuccgcccccggcggcggcggcucccccggcgccugccccgcccucggcaccaaguccugcuccuccuccugcgccgacuccuucgucuccuccuccuccucccagcccgucucccucuucuccaccucccaggagggccucuccucccucugcuccgacgagcccuccuccgagaucaugaccuccuccuuccucuccuccuccgagauccacaacaccggccucaccauccuccacggcgagaagucccacguccucggcucccagcccauccucgccaaggagggcaaggaccaccucgaccuccucgacaugaagaagauggagaagccccagggcaccuccaacaacgucuccgacuccuccgucucccucgccgccggcguccacugcgaccgccccuccauccccgccuccuuccccgagcaccccgccuuccucuccaagaagaucggccaggucgaggagcagaucgacaaggagaccaagaaccccaacggcgucuccucccgcgaggccaagaccgcccucgacgccgacgaccgcuucacccuccucaccgcccagaagccccccaccgaguacuccaaggucgagggcaucuacaccuacucccucucccccuccaaggucuccggcgacgacgucaucgagaaggacucccccgagucccccuucgaggucaucaucgacaaggccgccuucgacaaggaguucaaggacuccuacaaggaguccaccgacgacuucggcuccugguccguccacaccgacaaggaguccuccgaggacaucuccgagaccaacgacaagcucuucccccuccgcaacaaggaggccggccgcuaccccauguccgcccuccucucccgccaguucucccacaccaacgccgcccucgaggaggucucccgcugcgucaacgacaugcacaacuucaccaacgagauccucaccugggaccucgucccccaggucaagcagcagaccgacaaguccuccgacugcaucaccaagaccaccggccucgacauguccgaguacaacuccgagauccccgucgucaaccucaagaccuccacccaccagaagacccccgucugcuccaucgacggcuccacccccaucaccaaguccaccggcgacugggccgaggccucccuccagcaggagaacgccaucaccggcaagcccguccccgacucccucaacuccaccaaggaguucuccaucaagggcguccagggcaacaugcagaagcaggacgacacccucgccgagcuccccggcuccccccccgagaagugcgacucccucggcuccggcgucgccaccgucaaggucguccuccccgacgaccaccucaaggacgagauggacuggcaguccuccgcccucggcgagaucaccgaggccgacuccuccggcgaguccgacgacaccgucaucgaggacaucaccgccgacaccuccuucgagaacaacaagauccaggccgagaagcccgucuccauccccuccgccgucgucaagaccggcgagcgcgagaucaaggagauccccuccugcgagcgcgaggagaagaccuccaagaacuucgaggagcucgucuccgacuccgagcuccaccaggaccagcccgacauccucggccgcucccccgccuccgaggccgccugcuccaagguccccgacaccaacgucucccucgaggacgucuccgaggucgcccccgagaagcccaucaccaccgagaaccccaagcuccccuccaccgucucccccaacgucuucaacgagaccgaguucucccucaacgucaccaccuccgccuaccucgagucccuccacggcaagaacgucaagcacaucgacgacuccucccccgaggaccucaucgccgccuucaccgagacccgcgacaagggcaucgucgacuccgagcgcaacgccuucaaggccaucuccgagaagaugaccgacuucaagaccaccccccccgucgagguccuccacgagaacgaguccggcggcuccgagaucaaggacaucggcuccaaguacuccgagcaguccaaggagaccaacggcuccgagccccucggcgucuuccccacccagggcacccccgucgccucccucgaccucgagcaggagcagcucaccaucaaggcccucaaggagcucggcgagcgccaggucgagaaguccaccuccgcccagcgcgacgccgagcuccccuccgaggagguccucaagcagaccuucaccuucgcccccgaguccuggccccagcgcuccuacgacauccucgagcgcaacgucaagaacggcuccgaccucggcaucucccagaagcccaucaccauccgcgagaccacccgcgucgacgccgucuccucccucuccaagaccgagcucgucaagaagcacguccucgcccgccuccucaccgacuucuccguccacgaccucaucuucuggcgcgacgucaagaagaccggcuucgucuucggcaccacccucaucaugcuccucucccucgccgccuucuccgucaucuccgucgucuccuaccucauccucgcccuccucuccgucaccaucuccuuccgcaucuacaaguccgucauccaggccguccagaaguccgaggagggccaccccuucaaggccuaccucgacgucgacaucacccucuccuccgaggccuuccacaacuacaugaacgccgccaugguccacaucaaccgcgcccucaagcucaucauccgccucuuccucgucgaggaccucgucgacucccucaagcucgccgucuucauguggcucaugaccuacgucggcgccgucuucaacggcaucacccuccucauccucgccgagcuccucaucuucuccguccccaucgucuacgagaaguacaagacccagaucgaccacuacgucggcaucgcccgcgaccagaccaaguccaucgucgagaagauccaggccaagcuccccggcaucgccaagaagaaggccgaguga

SEQ ID NO: 49026 - RNA, 600 nt, Artificial Sequence
  derived and/or modified sequence opt2 from RTN4__Homo_sapiens__NP_008939
auggacggccagaagaagaacuggaaggacaaggucgucgaccuccucuacuggcgcgacaucaagaagaccggcgucgucuucggcgccucccucuuccuccuccucucccucaccgucuucuccaucgucuccgucaccgccuacaucgcccucgcccuccucuccgucaccaucuccuuccgcaucuacaagggcgucauccaggccauccagaaguccgacgagggccaccccuuccgcgccuaccucgaguccgaggucgccaucuccgaggagcucguccagaaguacuccaacuccgcccucggccacgucaacugcaccaucaaggagcuccgccgccucuuccucgucgacgaccucgucgacucccucaaguucgccguccucaugugggucuucaccuacgucggcgcccucuucaacggccucacccuccucauccucgcccucaucucccucuucuccguccccgucaucuacgagcgccaccaggcccagaucgaccacuaccucggccucgccaacaagaacgucaaggacgccauggccaagauccaggccaagauccccggccucaagcgcaaggccgaguga

SEQ ID NO: 49027 - RNA, 1191 nt, Artificial Sequence
  derived and/or modified sequence opt2 from RTN4IP1__Homo_sapiens__NP_116119
auggaguuccucaagaccugcguccuccgccgcaacgccugcaccgccgucugcuucuggcgcuccaaggucguccagaagcccuccguccgccgcaucuccaccaccuccccccgcuccaccgucaugcccgccugggucaucgacaaguacggcaagaacgagguccuccgcuucacccagaacaugaugaugcccaucauccacuaccccaacgaggucaucgucaagguccacgccgccuccgucaaccccaucgacgucaacaugcgcuccggcuacggcgccaccgcccucaacaugaagcgcgacccccuccacgucaagaucaagggcgaggaguucccccucacccucggccgcgacgucuccggcgucgucauggagugcggccucgacgucaaguacuucaagcccggcgacgaggucugggccgccgucccccccuggaagcagggcacccucuccgaguucgucgucgucuccggcaacgaggucucccacaagcccaagucccucacccacacccaggccgccucccuccccuacgucgcccucaccgccugguccgccaucaacaaggucggcggccucaacgacaagaacugcaccggcaagcgcguccucauccucggcgccuccggcggcgucggcaccuucgccauccaggucaugaaggccugggacgcccacgucaccgccgucugcucccaggacgccuccgagcucguccgcaagcucggcgccgacgacgucaucgacuacaaguccggcuccgucgaggagcagcucaagucccucaagcccuucgacuucauccucgacaacgucggcggcuccaccgagaccugggcccccgacuuccucaagaagugguccggcgccaccuacgucacccucgucacccccuuccuccucaacauggaccgccucggcaucgccgacggcaugcuccagaccggcgucaccgucggcuccaaggcccucaagcacuucuggaagggcguccacuaccgcugggccuucuucauggccuccggccccugccucgacgacaucgccgagcucgucgacgccggcaagauccgccccgucaucgagcagaccuuccccuucuccaagguccccgaggccuuccucaaggucgagcgcggccacgcccgcggcaagaccgucaucaacgucgucuga

SEQ ID NO: 49028 - RNA, 1422 nt, Artificial Sequence
  derived and/or modified sequence opt2 from RTN4R__Homo_sapiens__NP_075380
augaagcgcgccuccgccggcggcucccgccuccucgccuggguccucuggcuccaggccuggcaggucgccgcccccugccccggcgccugcgucugcuacaacgagcccaaggucaccaccuccugcccccagcagggccuccaggccguccccgucggcauccccgccgccucccagcgcaucuuccuccacggcaaccgcaucucccacguccccgccgccuccuuccgcgccugccgcaaccucaccauccucuggcuccacuccaacguccucgcccgcaucgacgccgccgccuucaccggccucgcccuccucgagcagcucgaccucuccgacaacgcccagcuccgcuccgucgaccccgccaccuuccacggccucggccgccuccacacccuccaccucgaccgcugcggccuccaggagcucggccccggccucuuccgcggccucgccgcccuccaguaccucuaccuccaggacaacgcccuccaggcccuccccgacgacaccuuccgcgaccucggcaaccucacccaccucuuccuccacggcaaccgcaucuccuccguccccgagcgcgccuuccgcggccuccacucccucgaccgccuccuccuccaccagaaccgcgucgcccacguccacccccacgccuuccgcgaccucggccgccucaugacccucuaccucuucgccaacaaccucuccgcccuccccaccgaggcccucgccccccuccgcgcccuccaguaccuccgccucaacgacaaccccugggucugcgacugccgcgcccgcccccucugggccuggcuccagaaguuccgcggcuccuccuccgagguccccugcucccucccccagcgccucgccggccgcgaccucaagcgccucgccgccaacgaccuccagggcugcgccgucgccaccggccccuaccaccccaucuggaccggccgcgccaccgacgaggagccccucggccuccccaagugcugccagcccgacgccgccgacaaggccuccguccucgagcccggccgccccgccuccgccggcaacgcccucaagggccgcgucccccccggcgacuccccccccggcaacggcuccggcccccgccacaucaacgacucccccuucggcacccuccccggcuccgccgagcccccccucaccgccguccgccccgagggcuccgagccccccggcuuccccaccuccggcccccgccgccgccccggcugcucccgcaagaaccgcacccgcucccacugccgccucggccaggccggcuccggcggcggcggcaccggcgacuccgagggcuccggcgcccuccccucccucaccugcucccucaccccccucggccucgcccucguccucuggaccguccucggccccugcuga

SEQ ID NO: 49029 - RNA, 699 nt, Artificial Sequence
  derived and/or modified sequence opt2 from RTP3__Homo_sapiens__NP_113628
auggccggcgacaccgaggucuggaagcagauguuccaggagcucaugcgcgaggucaagcccuggcaccgcuggacccuccgccccgacaagggccuccuccccaacguccucaagcccggcuggaugcaguaccagcaguggaccuucgcccgcuuccagugcuccuccugcucccgcaacugggccuccgcccagguccucguccucuuccacaugaacugguccgaggagaagucccgcggccaggucaagaugcgcgucuucacccagcgcugcaagaagugcccccagccccucuucgaggaccccgaguucacccaggagaacaucucccgcauccucaagaaccucgucuuccgcauccucaagaagugcuaccgcggccgcuuccagcucaucgaggagguccccaugaucaaggacaucucccucgagggcccccacaacuccgacaacugcgaggccugccuccagggcuucugcgccggccccauccaggucaccucccucccccccucccagaccccccgcguccacuccaucuacaaggucgaggaggucgucaagcccugggccuccggcgagaacgucuacuccuacgccugccagaaccacaucugccgcaaccucuccaucuucugcugcugcgucauccucaucgucaucgucgucaucgucgucaagaccgccaucuga

SEQ ID NO: 49030 - RNA, 741 nt, Artificial Sequence
  derived and/or modified sequence opt2 from RTP4__Homo_sapiens__NP_071430
auggucgucgacuucuggaccugggagcagaccuuccaggagcucauccaggaggccaagccccgcgccaccuggacccucaagcucgacggcaaccuccagcucgacugccucgcccagggcuggaagcaguaccagcagcgcgccuucggcugguuccgcugcuccuccugccagcgcuccugggccuccgcccagguccagauccucugccacaccuacugggagcacuggaccucccagggccagguccgcaugcgccucuucggccagcgcugccagaagugcuccuggucccaguacgagaugcccgaguucuccuccgacuccaccaugcgcauccucuccaaccucguccagcacauccucaagaaguacuacggcaacggcacccgcaagucccccgagaugcccgucauccucgaggucucccucgagggcucccacgacaccgccaacugcgaggccugcacccucggcaucugcggccagggccucaaguccugcaugaccaagcccuccaagucccuccucccccaccucaagaccggcaacuccucccccggcaucggcgccgucuaccucgccaaccaggccaagaaccaguccgccgaggccaaggaggccaagggcuccggcuacgagaagcucggccccucccgcgaccccgacccccucaacaucugcgucuucauccuccuccucgucuucaucgucgucaagugcuucaccuccgaguga

SEQ ID NO: 49031 - RNA, 6681 nt, Artificial Sequence
  derived and/or modified sequence opt2 from RTTN__Homo_sapiens__NP_775901
augguccucgccggccucauccgcaagcucggccaccagcucgccgagauccgcgagcgcgcccucaaguccauccucugcaagaucgagcacaaccucaucugcuacgccgaccucauccaggagcgccagcucuuccuccaccuccucgagugguucaacuuccccuccguccccaugaaggaggagguccucaaccuccucucccgccucgucaaguacccccccgccguccagcaccucgucgacgucggcgccgucgaguuccucuccaagcuccgcuccaacgucgagcccaaccuccaggccgagaucgacggcauccucgacggccucuuccuccuccccuccgagguccccgcccucuccuccgccuccuaccagaccaaccagaccgagcucuccaagaaccccgagauccucaccggcuacuucccccaggacaaguccaacuuccagcagauggagguccccccccgccccgucgucaaccagaccgucaagugccucaaguucuccaccuuccccuggcucccccucaccaccaccgaccgccacguccucuccuccaacgaguccucccuccgcuccuccaaccacacccucaucuggaacaccugcgagcuccucaaggacgucaucaugcaggacuuccccgccgagaucuuccuccagcgccccaagaucguccagucccuccucucccuccucaagcucgccuucggcgacggcaagcaccgccucgcccuccaguccgucuccugccuccagcagcucugcauguaccuccgcaaccgccucaacuuccaccgcgaccccggcuucuucuccaacaagcacgacaccgucucccagaacuccucccucuccuacugccacgaggcccgcggcacccaccacucccagaaccccucccccggcuccuccuccccccgccccuccgucgucggccgcaccggccagcgcccccgcggcgacggccaggacugggacgccgccuccuccuccggcuccuccucccacgcccacgucaacucccgcaucuccguccacuccccccucgacaugggccacaucgaccuccccgagcucgagaccgaggacacccucgagcuccaguuccagcagcucucccucccccaguucugcgucuccauccucgaguccgccgucccccuccuccgcaccggcucccgccaggucaucauccgcguccucgagcuccucaccgaggacaugacccucaucggcgaggccaucuccaccgacaucugggacgacuccucccucuucggcaucgacaugaaggagaagcuccuccucguccucggcgcccucggcgagaccaugugcuaccacaaguccuccaucucccucgagcagcccgaggucaugcucguccaccaccgcauggccuucaucuccaucucccucuucgccguccgccuccuccagacccuccuccccgucgagaaggccuccgaguuccucuccgagcccauguccaccgcccucuuccuccucucccucgacaugcccaucucccucgaguaccccaacauccacgaggccgucgucgccuaccucgagcagcucaacuccgagaacuacuccaucuacaagcgcaccgccgaggccgucuacuccaucgagugcaccugcaacuuccucuccgacaucggcaaggagggcgagaagaaccuccucgagcucgucgagcucgccgaccaggcccuccgcuccuucuccuaccaccagcacuucccccucaucaaggagaucaucuccaucugcuccaagaucuggaaguccgcccaggccuccccccuccuccagggcgagucccagaagguccuccuccacaugcucucccacccccucccccgcgucaaggccgagaccuaccacugcugccucgagaucaccaaggagugccucggcguccacaacgucaccaagcccgucuccucccucugcaacggcauccacuuccuccuccaccccaagguccucuacgagaucuccgucuucggcauccaggagcccgaguccgaggucaacaccgccgccaaggccauccuccucuaccuccuccagggccgccucaugaugaccgcccucaccuggaacaaguucaucgagucccucugccccgucauccccauccuccagggcuacgccgacaccgaggacccccucggcaacugcauccuccuccucuccaaggccuccuccgacaccgaggagaugcuccccugcaccacccgccucaaguccaugcuccgccuccuccucgucaagaagcccuccguccgcucccucgcccucaagcuccucgccuuccaccucaccuccgaggagggcgccgacaccaagcgcccccucaucgacgcccgcguccucucccgcgucaccgaccucuucaucggcaagaagcccaucgagcuccgccucgacgaccgccgcgagcucgucaucaagcucgagaccgucgagaaggucuacgagaucuucaccuccgacgacgucgaccucguccuccgcaaguccgccgccgagcagcucgccgucaucaugcaggacaucaagaugcacgccgucgucaagaagcucugccucaucgacaagaucaucgaguaccucaacgagugcgucucccaggacggcaaggucgucgagugccucguccagcccugccucacccuccuccgcaagguccucugcggcgaccccgucaugcgcgucucccucucccagcaguccucccuccucaccguccucuuccgcgucucccucaucuuccacgaggacugcuccgucgucaccgaggucggcgcccucuucugccuccuccucuucgacgaggucucccgcauggacaugugguccgucaaccccuccaacaagcccucccuccccuccgucuucucccuccccgucuccgucuuccgccgcuaccaccuccccguccacgucaucggccaccacgccgucucccccuacuccaucguccucccccucuccgccgacugccucgcccucaagcccgucuccgacaugcuccgcaucgccuggaaccucuccugguaccacggcuccgacaaccuccucaagcagaugaacuccgagaccaagacccaggagauccucgacgcccucaagcucuccaccgaggacauccucacccucaagaucacccacauggccuccggccuccaggacugccuccacuccaucguccaggccgccacccaccgcgagguccgcgccgccgucacccgcauguccuucuaccuccucaacgaccgccucucccucaagggcugccccggccccugcggcgucacccucaagucccucgccuggcacaccgcccucaaccgcuuccuccagguccuccccgccugcaccgaggacgagaagcuccucaucgacaucauccacuuccucaacaagcucaucaaggagcagcgcaagaacuccucccucgagcuccucaacuggauccucgagcuccuccuccgccacuccgccaacccccuccucgaccuccucguccucaccgagucccaggcccgcgaggagaccgacgacauccgcaccgccguccgccagcagcuccagaaggagcucaucgcccucuucgacacccuccuccucaacuucauggaggucaccgaccgcaagugcuccgagcuccucuacgucuuccagacccagcucgcccucaagcuccuccagugccucaaggucaccgacgccccccacuucuacggccuccccucccucgagcgcacccuccgcggcauggccaaccucaccgccuuccccggcugguccucccacuccccccucaccaagccccucgacaucugcgucaaguaccucuccggccuccucgaggucaucaccuccuucuacgucgagcgcggcggcaacgccauguccuucaugggcaagggcgucaccaaguccaccauccucugccuccuccaccucucccacgagaugauggcccaggccggcucccucgaguggaugucccucugguuccucccccucggcucccacuccgaggagcacauccccacccagcagggccucgccuggcucaucccccucugggucgaccgcgaccccgagguccgcuucaccucccucggccucggcuccgcccucaccacccucgagaccggcugcgucgcccucgccaacuccugccagaacaucuccggcggccucuggggcaccgucgucaacauccuccucgaccaguccgagugcuccaugguccgccgcgaggccgccuucauccuccagaaccuccucgucauccccaugcccaccgagaucaucaaggacuacaccuggcagggccccugcguccacgacgaggacuccggccucucccucaucggcaagcccgcccuccaggcccuccucuaccacugccacuucuacgagcaccucaaccagauggucaagcacugcuaccucggccgcugcauguucgaccucaacuucuccgccuucgaccgcaacuccgaguccaacgaccucaacggccucgacgacuccuucaaguucuggcgcgcccccucccgcaccucccaggaccgcgaccccuccucccucuccaccuccgagaccaccgucgcccccucccucggcuccaccgaguuccagccccucguccaguccaccacccuccuccccgaggccucccacgaccaguucgucgcccagggccaccaggaguccaccuccccccgccccccccacgacuccucccucuccgccccccuccccaagcucugcgucuucgucacccccucccuccucuccgccaugugcucccuccucgacaaccuccucaccaucgccccccgcgacaccgccaaggccuuccgccaggcccaccucaucgagcuccucugcuccaucgccgacgccacccucauccagaccugcguccaggagcuccgcgcccuccuccccuccuccccccccgccgagcacacccaggcccaggucuccuuccuccucgaguaccucuccucccucucccgccuccuccaguccugccuccucgucgagcccgaccucgucauccaggacgagcucgucaagccccucaucaccaacaucaucggcauccucaccaucugcaccaaggacguccucgacaaggagcucaucuccgccuucuaccacaccuggacccaccucuucaaccuccucgccaugcuccuccgcaaggccggcgccaucacccuccccuucgucaccgucgcccucgccaagcacuggaccgccgccaucgacauguucugcaccugcgccggccucuccgccaccugccccgcccucuacaccgccucccuccaguuccucuccguccuccucaccgaggaggccaagggccaccuccaggccaaguccaagacccaccucugcugcucccccaccgucgccucccuccucgacgacucccaggagaaccagaagucccucgagcagcucuccgacgucauccuccagugcuacgagggcaaguccuccaaggacauccucaagcgcgucgccgccaacgcccucaugucccuccucgccgucucccgccgcgcccagaagcacgcccucaaggccaaccucaucgacaacugcauggagcagaugaagcacaucaacgcccagcucaaccucgacucccuccgccccggcaaggccgcccucaagaagaaggaggacggcgucaucaaggagcucuccaucgccaugcagcuccuccgcaacugccucuaccagaacgaggagugcaaggaggccgcccucgaggcccaccucguccccguccuccacucccucuggcccuggauccucauggacgacucccucaugcagaucucccuccagcuccucugcgucuacaccgccaacuuccccaacggcugcuccucccucugcugguccuccugcggccagcaccccguccaggccacccaccgcggcgccgucuccaacucccucaugcucugcauccucaagcucgccucccagaugccccucgagaacaccaccguccagcagauggucuucaugcuccucuccaaccucgcccucucccacgacugcaagggcgucauccagaaguccaacuuccuccagaacuuccucucccucgcccuccccaagggcggcaacaagcaccucuccaaccucaccauccucuggcucaagcuccuccucaacaucuccuccggcgaggacggccagcagaugauccuccgccucgacggcugccucgaccuccucaccgagauguccaaguacaagcacaaguccuccccccuccucccccuccucaucuuccacaacgucugcuucucccccgccaacaagcccaagauccucgccaacgagaaggucaucaccguccucgccgccugccucgaguccgagaaccagaacgcccagcgcaucggcgccgccgcccucugggcccucaucuacaacuaccagaaggccaagaccgcccucaagucccccuccgucaagcgccgcgucgacgaggccuacucccucgccaagaagaccuuccccaacuccgaggccaacccccucaacgccuacuaccucaagugccucgagaaccucguccagcuccucaacuccuccuga

SEQ ID NO: 49032 - RNA, 1803 nt, Artificial Sequence
  derived and/or modified sequence opt2 from RUFY1__Homo_sapiens__NP_001035542
augauggaggagcgcgccaaccucaugcacaugaugaagcucuccaucaagguccuccuccaguccgcccucucccucggccgcucccucgacgccgaccacgccccccuccagcaguucuucgucgucauggagcacugccucaagcacggccucaaggucaagaaguccuucaucggccagaacaaguccuucuucggcccccucgagcucgucgagaagcucugccccgaggccuccgacaucgccaccuccguccgcaaccuccccgagcucaagaccgccgucggccgcggccgcgccuggcucuaccucgcccucaugcagaagaagcucgccgacuaccucaagguccucaucgacaacaagcaccuccucuccgaguucuacgagcccgaggcccucaugauggaggaggagggcauggucaucgucggccuccucgucggccucaacguccucgacgccaaccucugccucaagggcgaggaccucgacucccaggucggcgucaucgacuucucccucuaccucaaggacguccaggaccucgacggcggcaaggagcacgagcgcaucaccgacguccucgaccagaagaacuacgucgaggagcucaaccgccaccucuccugcaccgucggcgaccuccagaccaagaucgacggccucgagaagaccaacuccaagcuccaggaggagcucuccgccgccaccgaccgcaucugcucccuccaggaggagcagcagcagcuccgcgagcagaacgagcucauccgcgagcgcuccgagaaguccgucgagaucaccaagcaggacaccaaggucgagcucgagaccuacaagcagacccgccagggccucgacgagauguacuccgacgucuggaagcagcucaaggaggagaagaagguccgccucgagcucgagaaggagcucgagcuccagaucggcaugaagaccgagauggagaucgccaugaagcuccucgagaaggacacccacgagaagcaggacacccucgucgcccuccgccagcagcucgaggaggucaaggccaucaaccuccagauguuccacaaggcccagaacgccgaguccucccuccagcagaagaacgaggccaucaccuccuucgagggcaagaccaaccaggucauguccuccaugaagcagauggaggagcgccuccagcacuccgagcgcgcccgccagggcgccgaggagcgcucccacaagcuccagcaggagcucggcggccgcaucggcgcccuccagcuccagcucucccagcuccacgagcagugcuccucccucgagaaggagcucaaguccgagaaggagcagcgccaggcccuccagcgcgagcuccagcacgagaaggacaccuccucccuccuccgcauggagcuccagcaggucgagggccucaagaaggagcuccgcgagcuccaggacgagaaggccgagcuccagaagaucugcgaggagcaggagcaggcccuccaggagaugggccuccaccucucccaguccaagcucaagauggaggacaucaaggaggucaaccaggcccucaagggccacgccuggcucaaggacgacgaggccacccacugccgccagugcgagaaggaguucuccaucucccgccgcaagcaccacugccgcaacugcggccacaucuucugcaacaccugcuccuccaacgagcucgcccuccccuccuaccccaagcccguccgcgucugcgacuccugccacacccuccuccuccagcgcugcuccuccaccgccuccuga

SEQ ID NO: 49033 - RNA, 1863 nt, Artificial Sequence
  derived and/or modified sequence opt2 from RUFY3__Homo_sapiens__NP_001032519
auguccgcccucaccccccccaccgacaugcccacccccaccaccgacaagaucacccaggccgccauggagaccaucuaccucugcaaguuccgcgucuccauggacggcgaguggcucugccuccgcgagcucgacgacaucucccucacccccgaccccgagcccacccacgaggaccccaacuaccucauggccaacgagcgcaugaaccucaugaacauggccaagcucuccaucaagggccucaucgaguccgcccucaaccucggccgcacccucgacuccgacuacgccccccuccagcaguucuucgucgucauggagcacugccucaagcacggccucaaggccaagaagaccuuccucggccagaacaaguccuucuggggcccccucgagcucgucgagaagcucguccccgaggccgccgagaucaccgccuccgucaaggaccuccccggccucaagacccccgucggccgcggccgcgccuggcuccgccucgcccucaugcagaagaagcucuccgaguacaugaaggcccucaucaacaagaaggagcuccucuccgaguucuacgagcccaacgcccucaugauggaggaggagggcgccaucaucgccggccuccucgucggccucaacgucaucgacgccaacuucugcaugaagggcgaggaccucgacucccaggucggcgucaucgacuucuccauguaccucaaggacggcaacuccuccaagggcaccgagggcgacggccagaucaccgccauccucgaccagaagaacuacgucgaggagcucaaccgccaccucaacgccaccgucaacaaccuccaggccaaggucgacgcccucgagaaguccaacaccaagcucaccgaggagcucgccgucgccaacaaccgcaucaucacccuccaggaggagauggagcgcgucaaggaggaguccuccuacauccucgaguccaaccgcaagggccccaagcaggaccgcaccgccgagggccaggcccucuccgaggcccgcaagcaccucaaggaggagacccagcuccgccucgacgucgagaaggagcucgagaugcagaucuccaugcgccaggagauggagcucgccaugaagaugcucgagaaggacgucugcgagaagcaggacgcccucgucucccuccgccagcagcucgacgaccuccgcgcccucaagcacgagcucgccuucaagcuccaguccuccgaccucggcgucaagcagaaguccgagcucaacucccgccucgaggagaagaccaaccagauggccgccaccaucaagcagcucgagcagcgccuccgccaggccgagcgcucccgccaguccgccgagcucgacaaccgccucuucaagcaggacuucggcgacaagaucaacucccuccagcucgaggucgaggagcucacccgccagcgcaaccagcucgagcucgagcucaagcaggagaaggagcgccgccuccagaacgaccgcuccauccccggccgcggcucccagaaguccgaguccaagauggacggcaagcacaagaugcaggaggagaacgucaagcucaagaagccccucgaggagucccaccgccuccagccccaccccauggacgagcaggaccagcuccuccucuccgagaagccccagcucugccagcucugccaggaggacggcucccucaccaagaacgucugcaagaacugcuccggcaccuucugcgacgccugcuccaccaacgagcucccccuccccuccuccaucaagcucgagcgcgucugcaaccccugccacaagcaccucaugaagcaguacuccaccucccccuccuga

SEQ ID NO: 49034 - RNA, 1371 nt, Artificial Sequence
  derived and/or modified sequence opt2 from RUNDC3B__Homo_sapiens__NP_001127877
auggccucccgcucccucggcggccucuccggcauccgcggcggcggcggcggcggcggcaagaagucccucuccgcccgcaacgccgccgucgagcgccgcaaccucaucaccgucugccgcuucuccgucaagacccucaucgaccgcuccugcuucgagaccaucgacgacuccucccccgaguucaacaacuucgccgccauccucgagcagauccucucccaccgccucaagggccaggucaccugguucggcuacgaguccccccgcuccuucugggacuacauccgcgucgccugccgcaaggucucccagaacugcaucugcuccaucgagaacauggagaacgucuccuccucccgcgccaagggccgcgccuggauccgcgucgcccucauggagaagcaccucuccgaguacaucuccaccgcccuccgcgacuucaagaccacccgccgcuucuacgaggacggcgccaucguccucggcgaggaggccaacaugcucgccggcaugcuccucggccucaacgccaucgacuucuccuucugccucaagggcgagggccucgacggcuccuuccccgccgucaucgacuacacccccuaccucaaguacauccaguccuccgacuccaucuccuccgacgaggaggagcuccgcacccucggcuccuccggcuccgaguccuccacccccgagaacgucggcccccccuuccucauggacgagaacuccugguucaacaagugcaagcgcgucaagcagaaguaccagcucacccucgagcagaagggcuaccucgaggagcuccuccgccuccgcgagaaccagcucuccgaguccgucucccagaacaagauccuccuccagcgcaucgaggacuccgaccucgcccacaagcucgagaaggagcagcucgaguacaucaucgucgagcuccaggaccagcucaccguccucaagaacaacgaccuccgcucccgccaggagcucaccgcccaccucaccaaccaguggcccucccccggcgcccucgacgucaacgccgucgcccucgacacccuccucuaccgcaagcacaacaagcagugguacgagaaguccuaccagucccucgaccagcucuccgccgaggucucccucucccagaccucccucgaccccggccagucccaggagggcgacggcaagcaggacacccucaacgucauguccgagggcaaggaggacacccccucccuccucggccucugcggcucccucaccuccgucgccuccuacaagucccucaccucccucaaguccaacgacuaccucgccucccccaccaccgagaugaccucccccggccucacccccuccuga

SEQ ID NO: 49035 - RNA, 1362 nt, Artificial Sequence
  derived and/or modified sequence opt2 from RUNX1__Homo_sapiens__NP_001001890
augcgcauccccgucgacgccuccaccucccgccgcuucaccccccccuccaccgcccucucccccggcaagauguccgaggcccucccccucggcgcccccgacgccggcgccgcccucgccggcaagcuccgcuccggcgaccgcuccauggucgagguccucgccgaccaccccggcgagcucguccgcaccgacucccccaacuuccucugcuccguccuccccacccacuggcgcugcaacaagacccuccccaucgccuucaaggucgucgcccucggcgacguccccgacggcacccucgucaccgucauggccggcaacgacgagaacuacuccgccgagcuccgcaacgccaccgccgccaugaagaaccaggucgcccgcuucaacgaccuccgcuucgucggccgcuccggccgcggcaaguccuucacccucaccaucaccgucuucaccaaccccccccaggucgccaccuaccaccgcgccaucaagaucaccgucgacggcccccgcgagccccgccgccaccgccagaagcucgacgaccagaccaagcccggcucccucuccuucuccgagcgccucuccgagcucgagcagcuccgccgcaccgccaugcgcgucuccccccaccaccccgcccccacccccaacccccgcgccucccucaaccacuccaccgccuucaacccccagccccagucccagaugcaggacacccgccagauccagcccuccccccccugguccuacgaccaguccuaccaguaccucggcuccaucgccucccccuccguccaccccgccacccccaucucccccggccgcgccuccggcaugaccacccucuccgccgagcucuccucccgccucuccaccgcccccgaccucaccgccuucuccgacccccgccaguuccccgcccuccccuccaucuccgacccccgcaugcacuaccccggcgccuucaccuacucccccacccccgucaccuccggcaucggcaucggcauguccgccaugggcuccgccacccgcuaccacaccuaccuccccccccccuaccccggcuccucccaggcccagggcggccccuuccaggccuccucccccuccuaccaccucuacuacggcgccuccgccggcuccuaccaguucuccauggucggcggcgagcgcucccccccccgcauccucccccccugcaccaacgccuccaccggcuccgcccuccucaaccccucccuccccaaccaguccgacgucgucgaggccgagggcucccacuccaacucccccaccaacauggcccccuccgcccgccucgaggaggccgucuggcgccccuacuga

SEQ ID NO: 49036 - RNA, 1815 nt, Artificial Sequence
  derived and/or modified sequence opt2 from RUNX1T1__Homo_sapiens__NP_001185560
augaucuccgucaagcgcaacaccuggcgcgcccucucccucgucaucggcgacugccgcaagaagggcaacuucgaguacugccaggaccgcaccgagaagcacuccaccaugcccgacucccccgucgacgucaagacccagucccgccucaccccccccaccaugccccccccccccaccacccagggcgccccccgcaccuccuccuucacccccaccacccucaccaacggcaccucccacucccccaccgcccucaacggcgcccccuccccccccaacggcuucuccaacggccccuccuccuccuccuccuccucccucgccaaccagcagcucccccccgccugcggcgcccgccagcucuccaagcucaagcgcuuccucaccacccuccagcaguucggcaacgacaucucccccgagaucggcgagcgcguccgcacccucguccucggccucgucaacuccacccucaccaucgaggaguuccacuccaagcuccaggaggccaccaacuucccccuccgccccuucgucauccccuuccucaaggccaaccucccccuccuccagcgcgagcuccuccacugcgcccgccucgccaagcagaaccccgcccaguaccucgcccagcacgagcagcuccuccucgacgccuccaccaccucccccgucgacuccuccgagcuccuccucgacgucaacgagaacggcaagcgccgcacccccgaccgcaccaaggagaacggcuucgaccgcgagccccuccacuccgagcaccccuccaagcgccccugcaccaucucccccggccagcgcuacucccccaacaacggccucuccuaccagcccaacggccucccccaccccacccccccccccccccagcacuaccgccucgacgacauggccaucgcccaccacuaccgcgacuccuaccgccaccccucccaccgcgaccuccgcgaccgcaaccgccccaugggccuccacggcacccgccaggaggagaugaucgaccaccgccucaccgaccgcgagugggccgaggaguggaagcaccucgaccaccuccucaacugcaucauggacauggucgagaagacccgccgcucccucaccguccuccgccgcugccaggaggccgaccgcgaggagcucaacuacuggauccgccgcuacuccgacgccgaggaccucaagaagggcggcggcuccuccuccucccacucccgccagcagucccccgucaaccccgaccccgucgcccucgacgcccaccgcgaguuccuccaccgccccgccuccggcuacguccccgaggagaucuggaagaaggccgaggaggccgucaacgaggucaagcgccaggccaugaccgagcuccagaaggccgucuccgaggccgagcgcaaggcccacgacaugaucaccaccgagcgcgccaagauggagcgcaccgucgccgaggccaagcgccaggccgccgaggacgcccucgccgucaucaaccagcaggaggacuccuccgaguccugcuggaacugcggccgcaaggccuccgagaccugcuccggcugcaacaccgcccgcuacugcggcuccuucugccagcacaaggacugggagaagcaccaccacaucugcggccagacccuccaggcccagcagcagggcgacacccccgccgucuccuccuccgucacccccaacuccggcgccggcucccccauggacaccccccccgccgccaccccccgcuccaccacccccggcacccccuccaccaucgagaccaccccccgcuga

SEQ ID NO: 49037 - RNA, 1500 nt, Artificial Sequence
  derived and/or modified sequence opt2 from RUNX2__Homo_sapiens__NP_001015051
auggccuccaacucccucuucuccaccgucacccccugccagcagaacuucuucugggaccccuccaccucccgccgcuucuccccccccuccuccucccuccagcccggcaagauguccgacgucucccccgucgucgccgcccagcagcagcagcagcagcagcagcagcagcagcagcagcagcagcagcagcagcagcagcagcagcaggaggccgccgccgccgccgccgccgccgccgccgccgccgccgccgccgccgccgucccccgccuccgccccccccacgacaaccgcaccauggucgagaucaucgccgaccaccccgccgagcucguccgcaccgacucccccaacuuccucugcuccguccuccccucccacuggcgcugcaacaagacccuccccgucgccuucaaggucgucgcccucggcgagguccccgacggcaccgucgucaccgucauggccggcaacgacgagaacuacuccgccgagcuccgcaacgccuccgccgucaugaagaaccaggucgcccgcuucaacgaccuccgcuucgucggccgcuccggccgcggcaaguccuucacccucaccaucaccgucuucaccaaccccccccaggucgccaccuaccaccgcgccaucaaggucaccgucgacggcccccgcgagccccgccgccaccgccagaagcucgacgacuccaagcccucccucuucuccgaccgccucuccgaccucggccgcaucccccaccccuccaugcgcgucggcguccccccccagaacccccgccccucccucaacuccgcccccucccccuucaacccccagggccagucccagaucaccgacccccgccaggcccaguccuccccccccugguccuacgaccaguccuaccccuccuaccucucccagaugaccucccccuccauccacuccaccaccccccucuccuccacccgcggcaccggccuccccgccaucaccgacgucccccgccgcaucuccggcgccuccgagcucggccccuucuccgacccccgccaguuccccuccaucuccucccucaccgagucccgcuucuccaacccccgcaugcacuaccccgccaccuucaccuacaccccccccgucaccuccggcaugucccucggcauguccgccaccacccacuaccacaccuaccuccccccccccuaccccggcuccucccagucccaguccggccccuuccagaccuccuccacccccuaccucuacuacggcaccuccuccggcuccuaccaguuccccaugguccccggcggcgaccgcucccccucccgcaugcucccccccugcaccaccaccuccaacggcuccacccuccucaaccccaaccuccccaaccagaacgacggcgucgacgccgacggcucccacuccuccucccccaccguccucaacuccuccggccgcauggacgaguccgucuggcgccccuacuga

SEQ ID NO: 49038 - RNA, 1131 nt, Artificial Sequence
  derived and/or modified sequence opt2 from RUNX3__Homo_sapiens__XP_011540653
auggccuccaacuccaucuucgacuccuuccccaccuacucccccaccuucauccgcgaccccuccaccucccgccgcuucaccccccccucccccgccuuccccugcggcggcggcggcggcaagaugggcgagaacuccggcgcccucuccgcccaggccgccgucggccccggcggccgcgcccgccccgagguccgcuccauggucgacguccucgccgaccacgccggcgagcucguccgcaccgacucccccaacuuccucugcuccguccuccccucccacuggcgcugcaacaagacccuccccgucgccuucaaggucgucgcccucggcgacguccccgacggcaccgucgucaccgucauggccggcaacgacgagaacuacuccgccgagcuccgcaacgccuccgccgucaugaagaaccaggucgcccgcuucaacgaccuccgcuucgucggccgcuccggccgcggcaaguccuucacccucaccaucaccgucuucaccaaccccacccaggucgccaccuaccaccgcgccaucaaggucaccgucgacggcccccgcgagccccgccgcaccuccgagcucaaccccuucuccgacccccgccaguucgaccgcuccuuccccacccuccccacccucaccgagucccgcuuccccgacccccgcaugcacuaccccggcgccauguccgccgccuuccccuacuccgccacccccuccggcaccuccaucuccucccucuccgucgccggcaugcccgccaccucccgcuuccaccacaccuaccuccccccccccuaccccggcgccccccagaaccaguccggccccuuccaggccaaccccucccccuaccaccucuacuacggcaccuccuccggcuccuaccaguucuccauggucgccggcuccuccuccggcggcgaccgcucccccacccgcaugcucgccuccugcaccuccuccgccgccuccgucgccgccggcaaccucaugaaccccucccucggcggccaguccgacggcgucgaggccgacggcucccacuccaacucccccaccgcccucuccacccccggccgcauggacgaggccgucuggcgccccuacuga

SEQ ID NO: 49039 - RNA, 1371 nt, Artificial Sequence
  derived and/or modified sequence opt2 from RUVBL1__Homo_sapiens__NP_003698
augaagaucgaggaggucaaguccaccaccaagacccagcgcaucgccucccacucccacgucaagggccucggccucgacgaguccggccucgccaagcaggccgccuccggccucgucggccaggagaacgcccgcgaggccugcggcgucaucgucgagcucaucaaguccaagaagauggccggccgcgccguccuccucgccggcccccccggcaccggcaagaccgcccucgcccucgccaucgcccaggagcucggcuccaagguccccuucugccccauggucggcuccgaggucuacuccaccgagaucaagaagaccgagguccucauggagaacuuccgccgcgccaucggccuccgcaucaaggagaccaaggaggucuacgagggcgaggucaccgagcucacccccugcgagaccgagaaccccaugggcggcuacggcaagaccaucucccacgucaucaucggccucaagaccgccaagggcaccaagcagcucaagcucgaccccuccaucuucgagucccuccagaaggagcgcgucgaggccggcgacgucaucuacaucgaggccaacuccggcgccgucaagcgccagggccgcugcgacaccuacgccaccgaguucgaccucgaggccgaggaguacgucccccuccccaagggcgacguccacaagaagaaggagaucauccaggacgucacccuccacgaccucgacgucgccaacgcccgcccccagggcggccaggacauccucuccaugaugggccagcucaugaagcccaagaagaccgagaucaccgacaagcuccgcggcgagaucaacaaggucgucaacaaguacaucgaccagggcaucgccgagcucguccccggcguccucuucgucgacgagguccacaugcucgacaucgagugcuucaccuaccuccaccgcgcccucgaguccuccaucgcccccaucgucaucuucgccuccaaccgcggcaacugcgucauccgcggcaccgaggacaucaccuccccccacggcaucccccucgaccuccucgaccgcgucaugaucauccgcaccaugcucuacaccccccaggagaugaagcagaucaucaagauccgcgcccagaccgagggcaucaacaucuccgaggaggcccucaaccaccucggcgagaucggcaccaagaccacccuccgcuacuccguccagcuccucacccccgccaaccuccucgccaagaucaacggcaaggacuccaucgagaaggagcacgucgaggagaucuccgagcucuucuacgacgccaaguccuccgccaagauccucgccgaccagcaggacaaguacaugaaguga

SEQ ID NO: 49040 - RNA, 1392 nt, Artificial Sequence
  derived and/or modified sequence opt2 from RUVBL2__Homo_sapiens__NP_006657
auggccaccgucaccgccaccaccaagguccccgagauccgcgacgucacccgcaucgagcgcaucggcgcccacucccacauccgcggccucggccucgacgacgcccucgagccccgccaggccucccagggcauggucggccagcucgccgcccgccgcgccgccggcgucguccucgagaugauccgcgagggcaagaucgccggccgcgccguccucaucgccggccagcccggcaccggcaagaccgccaucgccaugggcauggcccaggcccucggccccgacacccccuucaccgccaucgccggcuccgagaucuucucccucgagauguccaagaccgaggcccucacccaggccuuccgccgcuccaucggcguccgcaucaaggaggagaccgagaucaucgagggcgaggucgucgagauccagaucgaccgccccgccaccggcaccggcuccaaggucggcaagcucacccucaagaccaccgagauggagaccaucuacgaccucggcaccaagaugaucgagucccucaccaaggacaagguccaggccggcgacgucaucaccaucgacaaggccaccggcaagaucuccaagcucggccgcuccuucacccgcgcccgcgacuacgacgccaugggcucccagaccaaguucguccagugccccgacggcgagcuccagaagcgcaaggaggucguccacaccgucucccuccacgagaucgacgucaucaacucccgcacccagggcuuccucgcccucuucuccggcgacaccggcgagaucaaguccgagguccgcgagcagaucaacgccaaggucgccgaguggcgcgaggagggcaaggccgagaucauccccggcguccucuucaucgacgagguccacaugcucgacaucgaguccuucuccuuccucaaccgcgcccucgaguccgacauggcccccguccucaucauggccaccaaccgcggcaucacccgcauccgcggcaccuccuaccaguccccccacggcauccccaucgaccuccucgaccgccuccucaucgucuccaccacccccuacuccgagaaggacaccaagcagauccuccgcauccgcugcgaggaggaggacgucgagauguccgaggacgccuacaccguccucacccgcaucggccucgagaccucccuccgcuacgccauccagcucaucaccgccgccucccucgucugccgcaagcgcaagggcaccgagguccaggucgacgacaucaagcgcgucuacucccucuuccucgacgagucccgcuccacccaguacaugaaggaguaccaggacgccuuccucuucaacgagcucaagggcgagaccauggacaccuccuga

SEQ ID NO: 49041 - RNA, 2130 nt, Artificial Sequence
  derived and/or modified sequence opt2 from RXFP1__Homo_sapiens__NP_001240658
augaccuccggcuccgucuucuucuacauccucaucuucggcaaguacuucucccacggcggcggccaggacgucaagugcucccucggcuacuuccccugcggcaacaucaccaagugccucccccagcuccuccacugcaacggcgucgacgacugcggcaaccaggccgacgaggacaacugcggcgacaacaacggcuggucccuccaguucgacaaguacuucgccuccuacuacaagaugaccucccaguaccccuucgaggccgagacccccgagugccucgucggcuccguccccguccagugccucugccagggccucgagcucgacugcgacgagaccaaccuccgcgccguccccuccgucuccuccaacgucaccgccaugucccuccaguggaaccucauccgcaagcucccccccgacugcuucaagaacuaccacgaccuccagaagcucuaccuccagaacaacaagaucaccuccaucuccaucuacgccuuccgcggccucaacucccucaccaagcucuaccucucccacaaccgcaucaccuuccucaagcccggcgucuucgaggaccuccaccgccucgaguggcucaucaucgaggacaaccaccucucccgcaucuccccccccaccuucuacggccucaacucccucauccuccucguccucaugaacaacguccucacccgccuccccgacaagccccucugccagcacaugccccgccuccacuggcucgaccucgagggcaaccacauccacaaccuccgcaaccucaccuucaucuccugcuccaaccucaccguccucgucaugcgcaagaacaagaucaaccaccucaacgagaacaccuucgccccccuccagaagcucgacgaguucucccucgagggcaucgagaucuccaacauccagcagcgcauguuccgcccccucaugaaccucucccacaucuacuucaagaaguuccaguacugcggcuacgccccccacguccgcuccugcaagcccaacaccgacggcaucuccucccucgagaaccuccucgccuccaucauccagcgcgucuucgucugggucgucuccgccgucaccugcuucggcaacaucuucgucaucugcaugcgccccuacauccgcuccgagaacaagcucuacgccauguccaucaucucccucugcugcgccgacugccucaugggcaucuaccucuucgucaucggcggcuucgaccucaaguuccgcggcgaguacaacaagcacgcccagcucuggauggaguccacccacugccagcucgucggcucccucgccauccucuccaccgaggucuccguccuccuccucaccuuccucacccucgagaaguacaucugcaucgucuaccccuuccgcugcguccgccccggcaagugccgcaccaucaccguccucauccucaucuggaucaccggcuucaucgucgccuucaucccccucuccaacaaggaguucuucaagaacuacuacggcaccaacggcgucugcuucccccuccacuccgaggacaccgaguccaucggcgcccagaucuacuccgucgccaucuuccucggcaucaaccucgccgccuucaucaucaucgucuucuccuacggcuccauguucuacuccguccaccaguccgccaucaccgccaccgagauccgcaaccaggucaagaaggagaugauccucgccaagcgcuucuucuucaucgucuucaccgacgcccucugcuggauccccaucuucgucgucaaguuccucucccuccuccaggucgagauccccggcaccaucaccuccugggucgucaucuucauccuccccaucaacuccgcccucaaccccauccucuacacccucaccacccgccccuucaaggagaugauccaccgcuucugguacaacuaccgccagcgcaaguccauggacuccaagggccagaagaccuacgcccccuccuucaucugggucgagauguggccccuccaggagaugccccccgagcucaugaagcccgaccucuucaccuaccccugcgagaugucccucaucucccaguccacccgccucaacuccuacuccuga

SEQ ID NO: 49042 - RNA, 2193 nt, Artificial Sequence
  derived and/or modified sequence opt2 from RXFP2__Homo_sapiens__NP_001159530
augaucgucuuccucgucuucaagcaccucuucucccuccgccucaucaccauguucuuccuccuccacuucaucguccucaucaacgucaaggacuucgcccucacccagggcuccaugaucacccccuccugccagaagggcuacuuccccugcggcaaccucaccaagugccucccccgcgccuuccacugcgacggcaaggacgacugcggcaacggcgccgacgaggagaacugcggcgacaccuccggcugggccaccaucuucggcaccguccacggcaacgccaacuccgucgcccucacccaggagugcuuccucaagcaguacccccagugcugcgacugcaaggagaccgagcucgagugcgucaacggcgaccucaaguccguccccaugaucuccaacaacgucacccuccucucccucaagaagaacaagauccacucccuccccgacaaggucuucaucaaguacaccaagcucaagaagaucuuccuccagcacaacugcauccgccacaucucccgcaaggccuucuucggccucugcaaccuccagauccucuaccucaaccacaacugcaucaccacccuccgccccggcaucuucaaggaccuccaccagcucaccuggcucauccucgacgacaaccccaucacccgcaucucccagcgccucuucaccggccucaacucccucuucuuccucuccauggucaacaacuaccucgaggcccuccccaagcagaugugcgcccagaugccccagcucaacugggucgaccucgagggcaaccgcaucaaguaccucaccaacuccaccuuccucuccugcgacucccucaccguccucgaccucuccuccaacaccaucaccgagcucuccccccaccucuucaaggaccucaagcuccuccagaagcucaaccucuccuccaacccccucauguaccuccacaagaaccaguucgagucccucaagcagcuccagucccucgaccucgagcgcaucgagauccccaacaucaacacccgcauguuccagcccaugaagaaccucucccacaucuacuucaagaacuuccgcuacugcuccuacgccccccacguccgcaucugcaugccccucaccgacggcaucuccuccuucgaggaccuccucgccaacaacauccuccgcaucuucgucugggucaucgccuucaucaccugcuucggcaaccucuucgucaucggcaugcgcuccuucaucaaggccgagaacaccacccacgccauguccaucaagauccucugcugcgccgacugccucaugggcgucuaccucuucuucgucggcaucuucgacaucaaguaccgcggccaguaccagaaguacgcccuccucuggauggaguccguccagugccgccucaugggcuuccucgccaugcucuccaccgaggucuccguccuccuccucaccuaccucacccucgagaaguuccucgucaucgucuuccccuucuccaacauccgccccggcaagcgccagaccuccgucauccucaucugcaucuggauggccggcuuccucaucgccgucauccccuucuggaacaaggacuacuucggcaacuucuacggcaagaacggcgucugcuucccccucuacuacgaccagaccgaggacaucggcuccaagggcuacucccucggcaucuuccucggcgucaaccuccucgccuuccucaucaucgucuucuccuacaucaccauguucugcuccauccagaagaccgcccuccagaccaccgagguccgcaacugcuucggccgcgaggucgccgucgccaaccgcuucuucuucaucgucuucuccgacgccaucugcuggauccccgucuucgucgucaagauccucucccucuuccgcgucgagauccccgacaccaugaccuccuggaucgucaucuucuuccuccccgucaacuccgcccucaaccccauccucuacacccucaccaccaacuucuucaaggacaagcucaagcagcuccuccacaagcaccagcgcaaguccaucuucaagaucaagaagaagucccucuccaccuccaucgucuggaucgaggacuccuccucccucaagcucggcguccucaacaagaucacccucggcgacuccaucaugaagcccgucuccuga

SEQ ID NO: 49043 - RNA, 1410 nt, Artificial Sequence
  derived and/or modified sequence opt2 from RXFP3__Homo_sapiens__NP_057652
augcagauggccgacgccgccaccaucgccaccaugaacaaggccgccggcggcgacaagcucgccgagcucuucucccucguccccgaccuccucgaggccgccaacaccuccggcaacgccucccuccagcuccccgaccucuggugggagcucggccucgagcuccccgacggcgccccccccggccacccccccggcuccggcggcgccgaguccgccgacaccgaggcccgcguccgcauccucaucuccgucgucuacugggucgucugcgcccucggccucgccggcaaccuccucguccucuaccucaugaaguccaugcagggcuggcgcaaguccuccaucaaccucuucgucaccaaccucgcccucaccgacuuccaguucguccucacccuccccuucugggccgucgagaacgcccucgacuucaaguggcccuucggcaaggccaugugcaagaucgucuccauggucaccuccaugaacauguacgccuccgucuucuuccucaccgccauguccgucacccgcuaccacuccgucgccuccgcccucaagucccaccgcacccgcggccacggccgcggcgacugcugcggccgcucccucggcgacuccugcugcuucuccgccaaggcccucugcgucuggaucugggcccucgccgcccucgccucccuccccuccgccaucuucuccaccaccgucaaggucaugggcgaggagcucugccucguccgcuuccccgacaagcuccucggccgcgaccgccaguucuggcucggccucuaccacucccagaagguccuccucggcuucguccucccccucggcaucaucauccucugcuaccuccuccucguccgcuucaucgccgaccgccgcgccgccggcaccaagggcggcgccgccgucgccggcggccgccccaccggcgccuccgcccgccgccucuccaaggucaccaaguccgucaccaucgucguccucuccuucuuccucugcuggcuccccaaccaggcccucaccaccugguccauccucaucaaguucaacgccguccccuucucccaggaguacuuccucugccaggucuacgccuuccccgucuccgucugccucgcccacuccaacuccugccucaaccccguccucuacugccucguccgccgcgaguuccgcaaggcccucaagucccuccucuggcgcaucgccucccccuccaucaccuccaugcgccccuucaccgccaccaccaagcccgagcacgaggaccagggccuccaggcccccgcccccccccacgccgccgccgagcccgaccuccucuacuacccccccggcgucgucgucuacuccggcggccgcuacgaccuccuccccuccuccuccgccuacuga

SEQ ID NO: 49044 - RNA, 1308 nt, Artificial Sequence
  derived and/or modified sequence opt2 from RXRA__Homo_sapiens__NP_001278849
auggccgcccccucccuccaccccucccucggccccggcaucggcucccccggccagcuccacucccccaucuccacccucuccucccccaucaacggcaugggcccccccuucuccgucaucuccucccccaugggcccccacuccauguccguccccaccacccccacccucggcuucuccaccggcuccccccagcucuccucccccaugaaccccgucuccuccuccgaggacaucaagcccccccucggccucaacggcguccucaagguccccgcccaccccuccggcaacauggccuccuucaccaagcacaucugcgccaucugcggcgaccgcuccuccggcaagcacuacggcgucuacuccugcgagggcugcaagggcuucuucaagcgcaccguccgcaaggaccucaccuacaccugccgcgacaacaaggacugccucaucgacaagcgccagcgcaaccgcugccaguacugccgcuaccagaagugccucgccaugggcaugaagcgcgaggccguccaggaggagcgccagcgcggcaaggaccgcaacgagaacgaggucgaguccaccuccuccgccaacgaggacaugcccgucgagcgcauccucgaggccgagcucgccgucgagcccaagaccgagaccuacgucgaggccaacaugggccucaaccccuccucccccaacgaccccgucaccaacaucugccaggccgccgacaagcagcucuucacccucgucgagugggccaagcgcaucccccacuucuccgagcucccccucgacgaccaggucauccuccuccgcgccggcuggaacgagcuccucaucgccuccuucucccaccgcuccaucgccgucaaggacggcauccuccucgccaccggccuccacguccaccgcaacuccgcccacuccgccggcgucggcgccaucuucgaccgcguccucaccgagcucgucuccaagaugcgcgacaugcagauggacaagaccgagcucggcugccuccgcgccaucguccucuucaaccccgacuccaagggccucuccaaccccgccgaggucgaggcccuccgcgagaaggucuacgccucccucgaggccuacugcaagcacaaguaccccgagcagcccggccgcuucgccaagcuccuccuccgccuccccgcccuccgcuccaucggccucaagugccucgagcaccucuucuucuucaagcucaucggcgacacccccaucgacaccuuccucauggagaugcucgaggccccccaccagaugaccuga

SEQ ID NO: 49045 - RNA, 1614 nt, Artificial Sequence
  derived and/or modified sequence opt2 from RXRB__Homo_sapiens__NP_001257330
auguccugggccgcccgcccccccuuccucccccagcgccacgccgccggccagugcggccccgucggcguccgcaaggagaugcacugcggcgucgccucccgcuggcgccgccgccgccccuggcucgaccccgccgccgccgccgccgccgccgucgccggcggcgagcagcagacccccgagcccgagcccggcgaggccggccgcgacggcaugggcgacuccggccgcgacucccgcucccccgacuccuccucccccaacccccucccccagggcguccccccccccuccccccccggccccccccucccccccuccaccgcccccucccucggcggcuccggcgcccccccccccccccccaugcccccccccccccucggcucccccuuccccgucaucuccuccuccaugggcucccccggccuccccccccccgccccccccggcuucuccggccccgucuccuccccccagaucaacuccaccgucucccuccccggcggcggcuccggcccccccgaggacgucaagccccccguccucggcguccgcggccuccacugcccccccccccccggcggccccggcgccggcaagcgccucugcgccaucugcggcgaccgcuccuccggcaagcacuacggcgucuacuccugcgagggcugcaagggcuucuucaagcgcaccauccgcaaggaccucaccuacuccugccgcgacaacaaggacugcaccgucgacaagcgccagcgcaaccgcugccaguacugccgcuaccagaagugccucgccaccggcaugaagcgcgaggccguccaggaggagcgccagcgcggcaaggacaaggacggcgacggcgagggcgccggcggcgcccccgaggagaugcccgucgaccgcauccucgaggccgagcucgccgucgagcagaaguccgaccagggcgucgagggccccggcggcaccggcggcuccggcuccucccccaacgaccccgucaccaacaucugccaggccgccgacaagcagcucuucacccucgucgagugggccaagcgcaucccccacuucuccucccucccccucgacgaccaggucauccuccuccgcgccggcuggaacgagcuccucaucgccuccuucucccaccgcuccaucgacguccgcgacggcauccuccucgccaccggccuccacguccaccgcaacuccgcccacuccgccggcgucggcgccaucuucgaccgcucccucucccgcguccucaccgagcucgucuccaagaugcgcgacaugcgcauggacaagaccgagcucggcugccuccgcgccaucauccucuucaaccccgacgccaagggccucuccaaccccuccgaggucgagguccuccgcgagaaggucuacgccucccucgagaccuacugcaagcagaaguaccccgagcagcagggccgcuucgccaagcuccuccuccgccuccccgcccuccgcuccaucggccucaagugccucgagcaccucuucuucuucaagcucaucggcgacacccccaucgacaccuuccucauggagaugcucgaggccccccaccagcucgccuga

SEQ ID NO: 49046 - RNA, 1392 nt, Artificial Sequence
  derived and/or modified sequence opt2 from RXRG__Homo_sapiens__NP_008848
auguacggcaacuacucccacuucaugaaguuccccgccggcuacggcggcucccccggccacaccggcuccaccuccaugucccccuccgccgcccucuccaccggcaagcccauggacucccaccccuccuacaccgacacccccgucuccgccccccgcacccucuccgccgucggcaccccccucaacgcccucggcucccccuaccgcgucaucaccuccgccaugggcccccccuccggcgcccucgccgccccccccggcaucaaccucgucgccccccccuccucccagcucaacgucgucaacuccgucuccuccuccgaggacaucaagccccuccccggccuccccggcaucggcaacaugaacuaccccuccaccucccccggcucccucgucaagcacaucugcgccaucugcggcgaccgcuccuccggcaagcacuacggcgucuacuccugcgagggcugcaagggcuucuucaagcgcaccauccgcaaggaccucaucuacaccugccgcgacaacaaggacugccucaucgacaagcgccagcgcaaccgcugccaguacugccgcuaccagaagugccucgucaugggcaugaagcgcgaggccguccaggaggagcgccagcgcucccgcgagcgcgccgaguccgaggccgagugcgccaccuccggccacgaggacaugcccgucgagcgcauccucgaggccgagcucgccgucgagcccaagaccgaguccuacggcgacaugaacauggagaacuccaccaacgaccccgucaccaacaucugccacgccgccgacaagcagcucuucacccucgucgagugggccaagcgcaucccccacuucuccgaccucacccucgaggaccaggucauccuccuccgcgccggcuggaacgagcuccucaucgccuccuucucccaccgcuccgucuccguccaggacggcauccuccucgccaccggccuccacguccaccgcuccuccgcccacuccgccggcgucggcuccaucuucgaccgcguccucaccgagcucgucuccaagaugaaggacaugcagauggacaaguccgagcucggcugccuccgcgccaucguccucuucaaccccgacgccaagggccucuccaaccccuccgaggucgagacccuccgcgagaaggucuacgccacccucgaggccuacaccaagcagaaguaccccgagcagcccggccgcuucgccaagcuccuccuccgccuccccgcccuccgcuccaucggccucaagugccucgagcaccucuucuucuucaagcucaucggcgacacccccaucgacaccuuccucauggagaugcucgagaccccccuccagaucaccuga

SEQ ID NO: 49047 - RNA, 687 nt, Artificial Sequence
  derived and/or modified sequence opt2 from RYBP__Homo_sapiens__NP_036366
augaccaugggcgacaagaagucccccacccgccccaagcgccaggccaagcccgccgccgacgagggcuucugggacugcuccgucugcaccuuccgcaacuccgccgaggccuucaagugcuccaucugcgacguccgcaagggcaccuccacccgcaagccccgcaucaacucccagcucgucgcccagcaggucgcccagcaguacgccaccccccccccccccaagaaggagaagaaggagaaggucgagaagcaggacaaggagaagcccgagaaggacaaggagaucucccccuccgucaccaagaagaacaccaacaagaagaccaagcccaaguccgacauccucaaggacccccccuccgaggccaacuccauccaguccgccaacgccaccaccaagaccuccgagaccaaccacaccucccgcccccgccucaagaacgucgaccgcuccaccgcccagcagcucgccgucaccgucggcaacgucaccgucaucaucaccgacuucaaggagaagacccgcuccuccuccaccuccuccuccaccgucaccuccuccgccggcuccgagcagcagaaccaguccuccuccggcuccgaguccaccgacaagggcuccucccgcuccuccacccccaagggcgacauguccgccgucaacgacgaguccuucuga

SEQ ID NO: 49048 - RNA, 1833 nt, Artificial Sequence
  derived and/or modified sequence opt2 from RYK__Homo_sapiens__NP_001005861
augcgcggcgccgcccgccucggccgccccggccgcuccugccuccccggcgcccgcggccuccgcgccccccccccccccccccuccuccuccuccucgcccuccucccccuccuccccgcccccggcgccgccgccgcccccgccccccgcccccccgagcuccaguccgccuccgccggccccuccgucucccucuaccucuccgaggacgagguccgccgccucaucggccucgacgccgagcucuacuacguccgcaacgaccucaucucccacuacgcccucuccuucucccuccucguccccuccgagaccaacuuccuccacuucaccuggcacgccaaguccaaggucgaguacaagcucggcuuccaggucgacaacguccucgccauggacaugccccaggucaacaucuccguccagggcgaggucccccgcacccucuccgucuuccgcgucgagcucuccugcaccggcaaggucgacuccgaggucaugauccucaugcagcucaaccucaccgucaacuccuccaagaacuucaccguccucaacuucaagcgccgcaagaugugcuacaagaagcucgaggaggucaagaccuccgcccucgacaagaacaccucccgcaccaucuacgaccccguccacgccgcccccaccaccuccacccgcgucuucuacaucuccgucggcgucugcugcgccgucaucuuccucgucgccaucauccucgccguccuccaccuccacuccaugaagcgcaucgagcucgacgacuccaucuccgccuccuccuccucccagggccucucccagcccuccacccagaccacccaguaccuccgcgccgacacccccaacaacgccacccccaucaccuccucccucggcuaccccacccuccgcaucgagaagaacgaccuccgcuccgucacccuccucgaggccaagggcaaggucaaggacaucgccaucucccgcgagcgcaucacccucaaggacguccuccaggagggcaccuucggccgcaucuuccacggcauccucaucgacgagaaggaccccaacaaggagaagcaggccuucgucaagaccgucaaggaccaggccuccgagauccaggucaccaugaugcucaccgaguccugcaagcuccgcggccuccaccaccgcaaccuccuccccaucacccacgucugcaucgaggagggcgagaagcccauggucauccuccccuacaugaacuggggcaaccucaagcucuuccuccgccagugcaagcucgucgaggccaacaacccccaggccaucucccagcaggaccucguccacauggccauccagaucgccugcggcauguccuaccucgcccgccgcgaggucauccacaaggaccucgccgcccgcaacugcgucaucgacgacacccuccaggucaagaucaccgacaacgcccucucccgcgaccucuuccccauggacuaccacugccucggcgacaacgagaaccgccccguccgcuggauggcccucgagucccucgucaacaacgaguucuccuccgccuccgacgucugggccuucggcgucacccucugggagcucaugacccucggccagacccccuacgucgacaucgaccccuucgagauggccgccuaccucaaggacggcuaccgcaucgcccagcccaucaacugccccgacgagcucuucgccgucauggccugcugcugggcccucgaccccgaggagcgccccaaguuccagcagcucguccagugccucaccgaguuccacgccgcccucggcgccuacgucuga

SEQ ID NO: 49049 - RNA, 15117 nt, Artificial Sequence
  derived and/or modified sequence opt2 from RYR1__Homo_sapiens__NP_000531
augggcgacgccgagggcgaggacgagguccaguuccuccgcaccgacgacgaggucguccuccagugcuccgccaccguccucaaggagcagcucaagcucugccucgccgccgagggcuucggcaaccgccucugcuuccucgagcccaccuccaacgcccagaacgucccccccgaccucgccaucugcugcuucguccucgagcagucccucuccguccgcgcccuccaggagaugcucgccaacaccgucgaggccggcgucgaguccucccagggcggcggccaccgcacccuccucuacggccacgccauccuccuccgccacgcccacucccgcauguaccucuccugccucaccaccucccgcuccaugaccgacaagcucgccuucgacgucggccuccaggaggacgccaccggcgaggccugcugguggaccaugcaccccgccuccaagcagcgcuccgagggcgagaagguccgcgucggcgacgacaucauccucgucuccgucuccuccgagcgcuaccuccaccucuccaccgccuccggcgagcuccaggucgacgccuccuucaugcagacccucuggaacaugaaccccaucugcucccgcugcgaggagggcuucgucaccggcggccacguccuccgccucuuccacggccacauggacgagugccucaccaucucccccgccgacuccgacgaccagcgccgccucgucuacuacgagggcggcgccgucugcacccacgcccgcucccucuggcgccucgagccccuccgcaucuccugguccggcucccaccuccgcuggggccagccccuccgcguccgccacgucaccaccggccaguaccucgcccucaccgaggaccagggccucgucgucgucgacgccuccaaggcccacaccaaggccaccuccuucugcuuccgcaucuccaaggagaagcucgacgucgcccccaagcgcgacgucgagggcaugggcccccccgagaucaaguacggcgagucccucugcuucguccagcacgucgccuccggccucuggcucaccuacgccgcccccgaccccaaggcccuccgccucggcguccucaagaagaaggccaugcuccaccaggagggccacauggacgacgcccucucccucacccgcugccagcaggaggagucccaggccgcccgcaugauccacuccaccaacggccucuacaaccaguucaucaagucccucgacuccuucuccggcaagccccgcggcuccggcccccccgccggcaccgcccuccccaucgagggcgucauccucucccuccaggaccucaucaucuacuucgagccccccuccgaggaccuccagcacgaggagaagcaguccaagcuccgcucccuccgcaaccgccagucccucuuccaggaggagggcaugcucuccaugguccucaacugcaucgaccgccucaacgucuacaccaccgccgcccacuucgccgaguucgccggcgaggaggccgccgaguccuggaaggagaucgucaaccuccucuacgagcuccucgccucccucauccgcggcaaccgcuccaacugcgcccucuucuccaccaaccucgacuggcucgucuccaagcucgaccgccucgaggccuccuccggcauccucgagguccucuacugcguccucaucgagucccccgagguccucaacaucauccaggagaaccacaucaaguccaucaucucccuccucgacaagcacggccgcaaccacaagguccucgacguccucugcucccucugcgucugcaacggcgucgccguccgcuccaaccaggaccucaucaccgagaaccuccuccccggccgcgagcuccuccuccagaccaaccucaucaacuacgucaccuccauccgccccaacaucuucgucggccgcgccgagggcaccacccaguacuccaagugguacuucgaggucauggucgacgaggucacccccuuccucaccgcccaggccacccaccuccgcgucggcugggcccucaccgagggcuacacccccuaccccggcgccggcgagggcuggggcggcaacggcgucggcgacgaccucuacuccuacggcuucgacggccuccaccucuggaccggccacgucgcccgccccgucaccucccccggccagcaccuccucgcccccgaggacgucaucuccugcugccucgaccucuccguccccuccaucuccuuccgcaucaacggcugccccguccagggcgucuucgaguccuucaaccucgacggccucuucuuccccgucgucuccuucuccgccggcgucaagguccgcuuccuccucggcggccgccacggcgaguucaaguuccuccccccccccggcuacgcccccugccacgaggccguccucccccgcgagcgccuccaccucgagcccaucaaggaguaccgccgcgagggcccccgcggcccccaccucgucggccccucccgcugccucucccacaccgacuucguccccugccccgucgacaccguccagaucguccuccccccccaccucgagcgcauccgcgagaagcucgccgagaacauccacgagcucugggcccucacccgcaucgagcagggcuggaccuacggccccguccgcgacgacaacaagcgccuccaccccugccucgucgacuuccacucccuccccgagcccgagcgcaacuacaaccuccagauguccggcgagacccucaagacccuccucgcccucggcugccacgucggcauggccgacgagaaggccgaggacaaccucaagaagaccaagcuccccaagaccuacaugauguccaacggcuacaagcccgccccccucgaccucucccacguccgccucacccccgcccagaccacccucgucgaccgccucgccgagaacggccacaacgucugggcccgcgaccgcgucggccagggcugguccuacuccgccguccaggacauccccgcccgccgcaacccccgccucguccccuaccgccuccucgacgaggccaccaagcgcuccaaccgcgacucccucugccaggccguccgcacccuccucggcuacggcuacaacaucgagccccccgaccaggagcccucccaggucgagaaccagucccgcugcgaccgcguccgcaucuuccgcgccgagaaguccuacaccguccaguccggccgcugguacuucgaguucgaggccgucaccaccggcgagaugcgcgucggcugggcccgccccgagcuccgccccgacgucgagcucggcgccgacgagcucgccuacgucuucaacggccaccgcggccagcgcuggcaccucggcuccgagcccuucggccgccccuggcagcccggcgacgucgucggcugcaugaucgaccucaccgagaacaccaucaucuucacccucaacggcgagguccucauguccgacuccggcuccgagaccgccuuccgcgagaucgagaucggcgacggcuuccuccccgucugcucccucggccccggccaggucggccaccucaaccucggccaggacgucuccucccuccgcuucuucgccaucugcggccuccaggagggcuucgagcccuucgccaucaacaugcagcgccccgucaccaccugguucuccaagggccucccccaguucgagcccgucccccucgagcacccccacuacgaggucucccgcgucgacggcaccgucgacaccccccccugccuccgccucacccaccgcaccuggggcucccagaacucccucgucgagaugcucuuccuccgccucucccuccccguccaguuccaccagcacuuccgcugcaccgccggcgccaccccccucgccccccccggccuccagccccccgccgaggacgaggcccgcgccgccgagcccgaccccgacuacgagaaccuccgccgcuccgccggcggcugguccgaggccgagaacggcaaggagggcaccgccaaggagggcgcccccggcggcaccccccaggccggcggcgaggcccagcccgcccgcgccgagaacgagaaggacgccaccaccgagaagaacaagaagcgcggcuuccucuucaaggccaagaaggucgccaugaugacccagccccccgccacccccacccucccccgccucccccacgacgucguccccgccgacaaccgcgacgaccccgagaucauccucaacaccaccaccuacuacuacuccguccgcgucuucgccggccaggagcccuccugcgucugggccggcugggucacccccgacuaccaccagcacgacauguccuucgaccucuccaagguccgcgucgucaccgucaccaugggcgacgagcagggcaacguccacuccucccucaagugcuccaacugcuacauggucuggggcggcgacuucgucucccccggccagcagggccgcaucucccacaccgaccucgucaucggcugccucgucgaccucgccaccggccucaugaccuucaccgccaacggcaaggaguccaacaccuucuuccaggucgagcccaacaccaagcucuuccccgccgucuucguccuccccacccaccagaacgucauccaguucgagcucggcaagcagaagaacaucaugccccucuccgccgccauguuccaguccgagcgcaagaaccccgccccccagugccccccccgccucgagaugcagaugcucaugcccgucuccuggucccgcaugcccaaccacuuccuccaggucgagacccgccgcgccggcgagcgccucggcugggccguccagugccaggagccccucaccaugauggcccuccacauccccgaggagaaccgcugcauggacauccucgagcucuccgagcgccucgaccuccagcgcuuccacucccacacccuccgccucuaccgcgccgucugcgcccucggcaacaaccgcgucgcccacgcccucugcucccacgucgaccaggcccagcuccuccacgcccucgaggacgcccaccuccccggcccccuccgcgccggcuacuacgaccuccucaucuccauccaccucgaguccgccugccgcucccgccgcuccaugcucuccgaguacaucgucccccucacccccgagacccgcgccaucacccucuucccccccggccgcuccaccgagaacggccacccccgccacggccuccccggcgucggcgucaccaccucccuccgccccccccaccacuucuccccccccugcuucgucgccgcccuccccgccgccggcgccgccgaggcccccgcccgccucucccccgccaucccccucgaggcccuccgcgacaaggcccuccgcaugcucggcgaggccguccgcgacggcggccagcacgcccgcgaccccgucggcggcuccgucgaguuccaguucguccccguccucaagcucgucuccacccuccucgucaugggcaucuucggcgacgaggacgucaagcagauccucaagaugaucgagcccgaggucuucaccgaggaggaggaggaggaggacgaggaggaggagggcgaggaggaggacgaggaggagaaggaggaggacgaggaggagaccgcccaggagaaggaggacgaggagaaggaggaggaggaggccgccgagggcgagaaggaggagggccucgaggagggccuccuccagaugaagcuccccgaguccgucaagcuccagaugugccaccuccucgaguacuucugcgaccaggagcuccagcaccgcgucgagucccucgccgccuucgccgagcgcuacgucgacaagcuccaggccaaccagcgcucccgcuacggccuccucaucaaggccuucuccaugaccgccgccgagaccgcccgccgcacccgcgaguuccgcucccccccccaggagcagaucaacaugcuccuccaguucaaggacggcaccgacgaggaggacugcccccuccccgaggagauccgccaggaccuccucgacuuccaccaggaccuccucgcccacugcggcauccagcucgacggcgaggaggaggagcccgaggaggagaccacccucggcucccgccucaugucccuccucgagaagguccgccucgucaagaagaaggaggagaagcccgaggaggagcgcuccgccgaggaguccaagccccgcucccuccaggagcucgucucccacauggucguccgcugggcccaggaggacuucguccagucccccgagcucguccgcgccauguucucccuccuccaccgccaguacgacggccucggcgagcuccuccgcgcccucccccgcgccuacaccaucucccccuccuccgucgaggacaccaugucccuccucgagugccucggccagauccgcucccuccucaucguccagaugggcccccaggaggagaaccucaugauccaguccaucggcaacaucaugaacaacaaggucuucuaccagcaccccaaccucaugcgcgcccucggcaugcacgagaccgucauggaggucauggucaacguccucggcggcggcgaguccaaggagauccgcuuccccaagauggucaccuccugcugccgcuuccucugcuacuucugccgcaucucccgccagaaccagcgcuccauguucgaccaccucuccuaccuccucgagaacuccggcaucggccucggcaugcagggcuccaccccccucgacgucgccgccgccuccgucaucgacaacaacgagcucgcccucgcccuccaggagcaggaccucgagaaggucgucuccuaccucgccggcugcggccuccaguccugccccaugcucgucgccaagggcuaccccgacaucggcuggaaccccugcggcggcgagcgcuaccucgacuuccuccgcuucgccgucuucgucaacggcgaguccgucgaggagaacgccaacgucgucguccgccuccucauccgcaagcccgagugcuucggccccgcccuccgcggcgagggcggcuccggccuccucgccgccaucgaggaggccauccgcaucuccgaggaccccgcccgcgacggccccggcauccgccgcgaccgccgccgcgagcacuucggcgaggagccccccgaggagaaccgcguccaccucggccacgccaucauguccuucuacgccgcccucaucgaccuccucggccgcugcgcccccgagaugcaccucauccaggccggcaagggcgaggcccuccgcauccgcgccauccuccgcucccucgucccccucgaggaccucgucggcaucaucucccucccccuccagauccccacccucggcaaggacggcgcccucguccagcccaagauguccgccuccuucguccccgaccacaaggccuccaugguccucuuccucgaccgcgucuacggcaucgagaaccaggacuuccuccuccacguccucgacgucggcuuccuccccgacaugcgcgccgccgccucccucgacaccgccaccuucuccaccaccgagauggcccucgcccucaaccgcuaccucugccucgccguccucccccucaucaccaagugcgccccccucuucgccggcaccgagcaccgcgccaucauggucgacuccaugcuccacaccgucuaccgccucucccgcggccgcucccucaccaaggcccagcgcgacgucaucgaggacugccucaugucccucugccgcuacauccgccccuccaugcuccagcaccuccuccgccgccucgucuucgacguccccauccucaacgaguucgccaagaugccccucaagcuccucaccaaccacuacgagcgcugcuggaaguacuacugccuccccaccggcugggccaacuucggcgucaccuccgaggaggagcuccaccucacccgcaagcucuucuggggcaucuucgacucccucgcccacaagaaguacgaccccgagcucuaccgcauggccaugcccugccucugcgccaucgccggcgcccucccccccgacuacgucgacgccuccuacuccuccaaggccgagaagaaggccaccgucgacgccgagggcaacuucgacccccgccccgucgagacccucaacgucaucauccccgagaagcucgacuccuucaucaacaaguucgccgaguacacccacgagaagugggccuucgacaagauccagaacaacugguccuacggcgagaacaucgacgaggagcucaagacccaccccaugcuccgccccuacaagaccuucuccgagaaggacaaggagaucuaccgcuggcccaucaaggagucccucaaggccaugaucgccugggaguggaccaucgagaaggcccgcgagggcgaggaggagaagaccgagaagaagaagacccgcaagaucucccaguccgcccagaccuacgacccccgcgagggcuacaacccccagccccccgaccucuccgccgucacccucucccgcgagcuccaggccauggccgagcagcucgccgagaacuaccacaacaccuggggccgcaagaagaagcaggagcucgaggccaagggcggcggcacccacccccuccucguccccuacgacacccucaccgccaaggagaaggcccgcgaccgcgagaaggcccaggagcuccucaaguuccuccagaugaacggcuacgccgucacccgcggccucaaggacauggagcucgacuccuccuccaucgagaagcgcuucgccuucggcuuccuccagcagcuccuccgcuggauggacaucucccaggaguucaucgcccaccucgaggccgucgucuccuccggccgcgucgagaaguccccccacgagcaggagaucaaguucuucgccaagauccuccucccccucaucaaccaguacuucaccaaccacugccucuacuuccucuccacccccgccaagguccucggcuccggcggccacgccuccaacaaggagaaggagaugaucaccucccucuucugcaagcucgccgcccucguccgccaccgcgucucccucuucggcaccgacgcccccgccgucgucaacugccuccacauccucgcccgcucccucgacgcccgcaccgucaugaaguccggccccgagaucgucaaggccggccuccgcuccuucuucgaguccgccuccgaggacaucgagaagauggucgagaaccuccgccucggcaaggucucccaggcccgcacccaggucaagggcgucggccagaaccucaccuacaccaccgucgcccuccuccccguccucaccacccucuuccagcacaucgcccagcaccaguucggcgacgacgucauccucgacgacguccaggucuccugcuaccgcacccucugcuccaucuacucccucggcaccaccaagaacaccuacgucgagaagcuccgccccgcccucggcgagugccucgcccgccucgccgccgccaugcccgucgccuuccucgagccccagcucaacgaguacaacgccugcuccgucuacaccaccaaguccccccgcgagcgcgccauccucggccuccccaacuccgucgaggagaugugccccgacauccccguccucgagcgccucauggccgacaucggcggccucgccgaguccggcgcccgcuacaccgagaugccccacgucaucgagaucacccuccccaugcucugcuccuaccucccccgcuggugggagcgcggccccgaggccccccccuccgcccuccccgccggcgcccccccccccugcaccgccgucaccuccgaccaccucaacucccuccucggcaacauccuccgcaucaucgucaacaaccucggcaucgacgaggccuccuggaugaagcgccucgccgucuucgcccagcccaucgucucccgcgcccgccccgagcuccuccagucccacuucauccccaccaucggccgccuccgcaagcgcgccggcaaggucgucuccgaggaggagcagcuccgccucgaggccaaggccgaggcccaggagggcgagcuccucguccgcgacgaguucuccguccucugccgcgaccucuacgcccucuacccccuccucauccgcuacgucgacaacaaccgcgcccaguggcucaccgagcccaaccccuccgccgaggagcucuuccgcauggucggcgagaucuucaucuacugguccaagucccacaacuucaagcgcgaggagcagaacuucgucguccagaacgagaucaacaacauguccuuccucaccgccgacaacaaguccaagauggccaaggccggcgacauccaguccggcggcuccgaccaggagcgcaccaagaagaagcgccgcggcgaccgcuacuccguccagaccucccucaucgucgccacccucaagaagaugcuccccaucggccucaacaugugcgcccccaccgaccaggaccucaucacccucgccaagacccgcuacgcccucaaggacaccgacgaggagguccgcgaguuccuccacaacaaccuccaccuccagggcaaggucgagggcucccccucccuccgcuggcagauggcccucuaccgcggcguccccggccgcgaggaggacgccgacgaccccgagaagaucguccgccgcguccaggaggucuccgccguccucuacuaccucgaccagaccgagcaccccuacaaguccaagaaggccgucuggcacaagcuccucuccaagcagcgccgccgcgccgucgucgccugcuuccgcaugaccccccucuacaaccuccccacccaccgcgccugcaacauguuccucgaguccuacaaggccgccuggauccucaccgaggaccacuccuucgaggaccgcaugaucgacgaccucuccaaggccggcgagcaggaggaggaggaggaggaggucgaggagaagaagcccgacccccuccaccagcucguccuccacuucucccgcaccgcccucaccgagaaguccaagcucgacgaggacuaccucuacauggccuacgccgacaucauggccaaguccugccaccucgaggagggcggcgagaacggcgaggccgaggaggaggucgaggucuccuucgaggagaagcagauggagaagcagcgccuccucuaccagcaggcccgccuccacacccgcggcgccgccgagaugguccuccagaugaucuccgccugcaagggcgagaccggcgccauggucuccuccacccucaagcucggcaucuccauccucaacggcggcaacgccgagguccagcagaagaugcucgacuaccucaaggacaagaaggaggucggcuucuuccaguccauccaggcccucaugcagaccugcuccguccucgaccucaacgccuucgagcgccagaacaaggccgagggccucggcauggucaacgaggacggcaccgucaucaaccgccagaacggcgagaaggucauggccgacgacgaguucacccaggaccucuuccgcuuccuccagcuccucugcgagggccacaacaacgacuuccagaacuaccuccgcacccagaccggcaacaccaccaccaucaacaucaucaucugcaccgucgacuaccuccuccgccuccaggaguccaucuccgacuucuacugguacuacuccggcaaggacgucaucgaggagcagggcaagcgcaacuucuccaaggccauguccgucgccaagcaggucuucaacucccucaccgaguacauccagggccccugcaccggcaaccagcagucccucgcccacucccgccucugggacgccgucgucggcuuccuccacgucuucgcccacaugaugaugaagcucgcccaggacuccucccagaucgagcuccucaaggagcuccucgaccuccagaaggacauggucgucaugcuccucucccuccucgagggcaacgucgucaacggcaugaucgcccgccagauggucgacaugcucgucgaguccuccuccaacgucgagaugauccucaaguucuucgacauguuccucaagcucaaggacaucgucggcuccgaggccuuccaggacuacgucaccgacccccgcggccucaucuccaagaaggacuuccagaaggccauggacucccagaagcaguucuccggccccgagauccaguuccuccucuccugcuccgaggccgacgagaacgagaugaucaacugcgaggaguucgccaaccgcuuccaggagcccgcccgcgacaucggcuucaacgucgccguccuccucaccaaccucuccgagcacgucccccacgacccccgccuccacaacuuccucgagcucgccgaguccauccucgaguacuuccgccccuaccucggccgcaucgagaucaugggcgccucccgccgcaucgagcgcaucuacuucgagaucuccgagaccaaccgcgcccagugggagaugccccaggucaaggaguccaagcgccaguucaucuucgacgucgucaacgagggcggcgaggccgagaagauggagcucuucgucuccuucugcgaggacaccaucuucgagaugcagaucgccgcccagaucuccgagcccgagggcgagcccgagaccgacgaggacgagggcgccggcgccgccgaggccggcgccgagggcgccgaggagggcgccgccggccucgagggcaccgccgccaccgccgccgccggcgccaccgcccgcgucgucgccgccgccggccgcgcccuccgcggccucuccuaccgcucccuccgccgccgcguccgccgccuccgccgccucaccgcccgcgaggccgccaccgccgucgccgcccuccucugggccgccgucacccgcgccggcgccgccggcgccggcgccgccgccggcgcccucggccuccucuggggcucccucuucggcggcggccucgucgagggcgccaagaaggucaccgucaccgagcuccucgccggcaugcccgaccccaccuccgacgagguccacggcgagcagcccgccggccccggcggcgacgccgacggcgagggcgccuccgagggcgccggcgacgccgccgagggcgccggcgacgaggaggaggccguccacgaggccggccccggcggcgccgacggcgccgucgccgucaccgacggcggccccuuccgccccgagggcgccggcggccucggcgacaugggcgacaccacccccgccgagccccccacccccgagggcucccccauccucaagcgcaagcucggcgucgacggcgucgaggaggagcucccccccgagcccgagcccgagcccgagcccgagcucgagcccgagaaggccgacgccgagaacggcgagaaggaggagguccccgagcccacccccgagccccccaagaagcaggccccccccucccccccccccaagaaggaggaggccggcggcgaguucuggggcgagcucgagguccagcgcgucaaguuccucaacuaccucucccgcaacuucuacacccuccgcuuccucgcccucuuccucgccuucgccaucaacuucauccuccucuucuacaaggucuccgacuccccccccggcgaggacgacauggagggcuccgccgccggcgacgucuccggcgccggcuccggcggcuccuccggcuggggccucggcgccggcgaggaggccgagggcgacgaggacgagaacauggucuacuacuuccucgaggaguccaccggcuacauggagcccgcccuccgcugccucucccuccuccacacccucgucgccuuccucugcaucaucggcuacaacugccucaaggucccccucgucaucuucaagcgcgagaaggagcucgcccgcaagcucgaguucgacggccucuacaucaccgagcagcccgaggacgacgacgucaagggccagugggaccgccucguccucaacacccccuccuuccccuccaacuacugggacaaguucgucaagcgcaagguccucgacaagcacggcgacaucuacggccgcgagcgcaucgccgagcuccucggcauggaccucgccacccucgagaucaccgcccacaacgagcgcaagcccaaccccccccccggccuccucaccuggcucauguccaucgacgucaaguaccagaucuggaaguucggcgucaucuucaccgacaacuccuuccucuaccucggcugguacauggucaugucccuccucggccacuacaacaacuucuucuucgccgcccaccuccucgacaucgccaugggcgucaagacccuccgcaccauccucuccuccgucacccacaacggcaagcagcucgucaugaccgucggccuccucgccgucgucgucuaccucuacaccgucgucgccuucaacuucuuccgcaaguucuacaacaaguccgaggacgaggacgagcccgacaugaagugcgacgacaugaugaccugcuaccucuuccacauguacgucggcguccgcgccggcggcggcaucggcgacgagaucgaggaccccgccggcgacgaguacgagcucuaccgcgucgucuucgacaucaccuucuucuucuucgucaucgucauccuccucgccaucauccagggccucaucaucgacgccuucggcgagcuccgcgaccagcaggagcaggucaaggaggacauggagaccaagugcuucaucugcggcaucggcuccgacuacuucgacaccaccccccacggcuucgagacccacacccucgaggagcacaaccucgccaacuacauguucuuccucauguaccucaucaacaaggacgagaccgagcacaccggccaggaguccuacgucuggaagauguaccaggagcgcugcugggacuucuuccccgccggcgacugcuuccgcaagcaguacgaggaccagcucuccuga

SEQ ID NO: 49050 - RNA, 14958 nt, Artificial Sequence
  derived and/or modified sequence opt2 from RYR2__Homo_sapiens__XP_006711865
auggccgacggcggcgagggcgaggacgagauccaguuccuccgcaccgacgacgaggucguccuccagugcaccgccaccauccacaaggagcagcagaagcucugccucgccgccgagggcuucggcaaccgccucugcuuccucgaguccaccuccaacuccaagaacgucccccccgaccucuccaucugcaccuucguccucgagcagucccucuccguccgcgcccuccaggagaugcucgccaacaccgucgagaaguccgagggccaggucgacgucgagaaguggaaguucaugaugaagaccgcccagggcggcggccaccgcacccuccucuacggccacgccauccuccuccgccacuccuacuccggcauguaccucugcugccucuccaccucccgcuccuccaccgacaagcucgccuucgacgucggccuccaggaggacaccaccggcgaggccugcugguggaccauccaccccgccuccaagcagcgcuccgagggcgagaagguccgcgucggcgacgaccucauccucgucuccgucuccuccgagcgcuaccuccaccucuccuacggcaacggcucccuccacgucgacgccgccuuccagcagacccucugguccgucgcccccaucuccuccggcuccgaggccgcccagggcuaccucaucggcggcgacguccuccgccuccuccacggccacauggacgagugccucaccguccccuccggcgagcacggcgaggagcagcgccgcaccguccacuacgagggcggcgccgucuccguccacgcccgcucccucuggcgccucgagacccuccgcgucgccugguccggcucccacauccgcuggggccagcccuuccgccuccgccacgucaccaccggcaaguaccucucccucauggaggacaagaaccuccuccucauggacaaggagaaggccgacgucaaguccaccgccuucaccuuccgcuccuccaaggagaagcucgacgucggcguccgcaaggaggucgacggcaugggcaccuccgagaucaaguacggcgacuccgucugcuacauccagcacgucgacaccggccucuggcucaccuaccaguccgucgacgucaaguccguccgcaugggcuccauccagcgcaaggccaucaugcaccacgagggccacauggacgacggcaucucccucucccgcucccagcacgaggagucccgcaccgcccgcgucauccgcuccaccgucuuccucuucaaccgcuucauccgcggccucgacgcccucuccaagaaggccaaggccuccaccgucgaccuccccaucgaguccgucucccucucccuccaggaccucaucggcuacuuccacccccccgacgagcaccucgagcacgaggacaagcagaaccgccuccgcgcccucaagaaccgccagaaccucuuccaggaggagggcaugaucaaccucguccucgagugcaucgaccgccuccacgucuacuccuccgccgcccacuucgccgacgucgccggccgcgaggccggcgaguccuggaaguccauccucaacucccucuacgagcuccucgccgcccucauccgcggcaaccgcaagaacugcgcccaguucuccggcucccucgacuggcucaucucccgccucgagcgccucgaggccuccuccggcauccucgagguccuccacugcguccucgucgagucccccgaggcccucaacaucaucaaggagggccacaucaaguccaucaucucccuccucgacaagcacggccgcaaccacaagguccucgacguccucugcucccucugcgucugccacggcgucgccguccgcuccaaccagcaccucaucugcgacaaccuccuccccggccgcgaccuccuccuccagacccgccucgucaaccacgucuccuccaugcgccccaacaucuuccucggcgucuccgagggcuccgcccaguacaagaagugguacuacgagcucauggucgaccacaccgagcccuucgucaccgccgaggccacccaccuccgcgucggcugggccuccaccgagggcuacucccccuaccccggcggcggcgaggaguggggcggcaacggcgucggcgacgaccucuucuccuacggcuucgacggccuccaccucugguccggcugcaucgcccgcaccgucuccucccccaaccagcaccuccuccgcaccgacgacgucaucuccugcugccucgaccucuccgcccccuccaucuccuuccgcaucaacggccagcccguccagggcauguucgagaacuucaacaucgacggccucuucuuccccgucgucuccuucuccgccggcaucaagguccgcuuccuccucggcggccgccacggcgaguucaaguuccuccccccccccggcuacgcccccugcuacgaggccguccuccccaaggagaagcucaaggucgagcacucccgcgaguacaagcaggagcgcaccuacacccgcgaccuccucggccccaccgucucccucacccaggccgccuucacccccauccccgucgacaccucccagaucguccuccccccccaccucgagcgcauccgcgagaagcucgccgagaacauccacgagcucugggucaugaacaagaucgagcucggcuggcaguacggccccguccgcgacgacaacaagcgccagcaccccugccucgucgaguucuccaagcuccccgagcaggagcgcaacuacaaccuccagaugucccucgagacccucaagacccuccucgcccucggcugccacgucggcaucuccgacgagcacgccgaggacaaggucaagaagaugaagcuccccaagaacuaccagcucaccuccggcuacaagcccgcccccauggaccucuccuucaucaagcucacccccucccaggaggccauggucgacaagcucgccgagaacgcccacaacgucugggcccgcgaccgcauccgccagggcuggaccuacggcauccagcaggacgucaagaaccgccgcaacccccgccucguccccuacacccuccucgacgaccgcaccaagaaguccaacaaggacucccuccgcgaggccguccgcacccuccucggcuacggcuacaaccucgaggcccccgaccaggaccacgccgcccgcgccgaggucugcuccggcaccggcgagcgcuuccgcaucuuccgcgccgagaagaccuacgccgucaaggccggccgcugguacuucgaguucgagaccgucaccgccggcgacaugcgcgucggcuggucccgccccggcugccagcccgaccaggagcucggcuccgacgagcgcgccuucgccuucgacggcuucaaggcccagcgcuggcaccagggcaacgagcacuacggccgcuccuggcaggccggcgacgucgucggcugcauggucgacaugaacgagcacaccaugauguucacccucaacggcgagauccuccucgacgacuccggcuccgagcucgccuucaaggacuucgacgucggcgacggcuucauccccgucugcucccucggcgucgcccaggucggccgcaugaacuucggcaaggacgucuccacccucaaguacuucaccaucugcggccuccaggagggcuacgagcccuucgccgucaacaccaaccgcgacaucaccauguggcucuccaagcgccucccccaguuccuccagguccccuccaaccacgagcacaucgaggucacccgcaucgacggcaccaucgacuccucccccugccucaaggucacccagaaguccuucggcucccagaacuccaacaccgacaucauguucuaccgccucuccaugcccaucgagugcgccgaggucuucuccaagaccgucgccggcggccuccccggcgccggccucuucggccccaagaacgaccucgaggacuacgacgccgacuccgacuucgagguccucaugaagaccgcccacggccaccucguccccgaccgcgucgacaaggacaaggaggccaccaagcccgaguucaacaaccacaaggacuacgcccaggagaagcccucccgccucaagcagcgcuuccuccuccgccgcaccaagcccgacuacuccaccucccacuccgcccgccucaccgaggacguccucgccgacgaccgcgacgacuacgacuuccucaugcagaccuccaccuacuacuacuccguccgcaucuuccccggccaggagcccgccaacgucugggucggcuggaucaccuccgacuuccaccaguacgacaccggcuucgaccucgaccgcguccgcaccgucaccgucacccucggcgacgagaagggcaagguccacgaguccuucgccaucgacucccucugcggcuucggcaucaagcgcuccaacugcuacauggucugcgccggcgaguccaugucccccggccagggccgcaacaacaacggccucgagaucggcugcgucgucgacgccgccuccggccuccucaccuucaucgccaacggcaaggagcucuccaccuacuaccaggucgagcccuccaccaagcucuuccccgccgucuucgcccaggccaccucccccaacgucuuccaguucgagcucggccgcaucaagaacgucaugccccucuccgccggccucuucaaguccgagcacaagaaccccgucccccagugccccccccgccuccacguccaguuccucucccacguccucuggucccgcaugcccaaccaguuccucaaggucgacgucucccgcaucuccgagcgccagggcuggcucguccagugccucgacccccuccaguucaugucccuccacauccccgaggagaaccgcuccgucgacauccucgagcucaccgagcaggaggagcuccucaaguuccacuaccacacccuccgccucuacuccgccgucugcgcccucggcaaccaccgcgucgcccacgcccucugcucccacgucgacgagccccagcuccucuacgccaucgagaacaaguacaugcccggccuccuccgcgccggcuacuacgaccuccucaucgacauccaccucuccuccuacgccaccgcccgccucaugaugaacaacgaguacaucguccccaugaccgaggagaccaaguccaucacccucuuccccgacgagaacaagaagcacggccuccccggcaucggccucuccaccucccuccgcccccgcaugcaguucuccucccccuccuucgucuccaucuccaacgagugcuaccaguacucccccgaguucccccucgacauccucaaguccaagaccauccagaugcucaccgaggccgucaaggagggcucccuccacgcccgcgaccccgucggcggcaccaccgaguuccucuucgucccccucaucaagcucuucuacacccuccucaucaugggcaucuuccacaacgaggaccucaagcacauccuccagcucaucgagcccuccgucuucaaggaggccgccacccccgaggaggaguccgacacccucgagaaggagcucuccgucgacgacgccaagcuccagggcgccggcgaggaggaggccaagggcggcaagcgccccaaggagggccuccuccagaugaagcuccccgagcccgucaagcuccagaugugccuccuccuccaguaccucugcgacugccagguccgccaccgcaucgaggccaucgucgccuucuccgacgacuucgucgccaagcuccaggacaaccagcgcuuccgcuacaacgaggucaugcaggcccucaacauguccgccgcccucaccgcccgcaagaccaaggaguuccgcucccccccccaggagcagaucaacaugcuccucaacuucaaggacgacaaguccgagugccccugccccgaggagauccgcgaccagcuccucgacuuccacgaggaccucaugacccacugcggcaucgagcucgacgaggacggcucccucgacggcaacuccgaccucaccauccgcggccgccuccucucccucgucgagaaggucaccuaccucaagaagaagcaggccgagaagcccgucgaguccgacuccaagaaguccuccacccuccagcagcucaucuccgagaccaugguccgcugggcccaggaguccgucaucgaggaccccgagcucguccgcgccauguucguccuccuccaccgccaguacgacggcaucggcggccucguccgcgcccuccccaagaccuacaccaucaacggcgucuccgucgaggacaccaucaaccuccucgccucccucggccagauccgcucccuccucuccguccgcaugggcaaggaggaggagaagcucaugauccgcggccucggcgacaucaugaacaacaaggucuucuaccagcaccccaaccucaugcgcgcccucggcaugcacgagaccgucauggaggucauggucaacguccucggcggcggcgaguccaaggagaucaccuuccccaagauggucgccaacugcugccgcuuccucugcuacuucugccgcaucucccgccagaaccagaaggccauguucgaccaccucuccuaccuccucgagaacuccuccgucggccucgccucccccgccaugcgcggcuccaccccccucgacgucgccgccgccuccgucauggacaacaacgagcucgcccucgcccuccgcgagcccgaccucgagaaggucguccgcuaccucgccggcugcggccuccaguccugccagaugcucgucuccaagggcuaccccgacaucggcuggaaccccgucgagggcgagcgcuaccucgacuuccuccgcuucgccgucuucugcaacggcgaguccgucgaggagaacgccaacgucgucguccgccuccucauccgccgccccgagugcuucggccccgcccuccgcggcgagggcggcaacggccuccucgccgccauggaggaggccaucaagaucgccgaggaccccucccgcgacggccccucccccaacuccggcuccuccaagacccucgacaccgaggaggaggaggacgacaccauccacaugggcaacgccaucaugaccuucuacuccgcccucaucgaccuccucggccgcugcgcccccgagaugcaccucauccacgccggcaagggcgaggccauccgcauccgcuccauccuccgcucccucaucccccucggcgaccucgucggcgucaucuccaucgccuuccagaugcccaccaucgccaaggacggcaacgucgucgagcccgacauguccgccggcuucugccccgaccacaaggccgccaugguccucuuccucgaccgcgucuacggcaucgagguccaggacuuccuccuccaccuccucgaggucggcuuccuccccgaccuccgcgccgccgccucccucgacaccgccgcccucuccgccaccgacauggcccucgcccucaaccgcuaccucugcaccgccguccucccccuccucacccgcugcgccccccucuucgccggcaccgagcaccacgccucccucaucgacucccuccuccacaccgucuaccgccucuccaagggcugcucccucaccaaggcccagcgcgacuccaucgaggucugccuccucuccaucugcggccagcuccgccccuccaugaugcagcaccuccuccgccgccucgucuucgacgucccccuccucaacgagcacgccaagaugccccucaagcuccucaccaaccacuacgagcgcugcuggaaguacuacugccuccccggcggcuggggcaacuucggcgccgccuccgaggaggagcuccaccucucccgcaagcucuucuggggcaucuucgacgcccucucccagaagaaguacgagcaggagcucuucaagcucgcccuccccugccucuccgccgucgccggcgcccucccccccgacuacauggaguccaacuacgucuccaugauggagaagcaguccuccauggacuccgagggcaacuucaacccccagcccgucgacaccuccaacaucaccauccccgagaagcucgaguacuucaucaacaaguacgccgagcacucccacgacaagugguccauggacaagcucgccaacggcuggaucuacggcgagaucuacuccgacuccuccaagguccagccccucaugaagcccuacaagcuccucuccgagaaggagaaggagaucuaccgcuggcccaucaaggagucccucaagaccaugcucgccuggggcuggcgcaucgagcgcacccgcgagggcgacuccauggcccucuacaaccgcacccgccgcaucucccagaccucccaggucuccgucgacgccgcccacggcuacuccccccgcgccaucgacauguccaacgucacccucucccgcgaccuccacgccauggccgagaugauggccgagaacuaccacaacaucugggccaagaagaagaagauggagcucgaguccaagggcggcggcaaccacccccuccucguccccuacgacacccucaccgccaaggagaaggccaaggaccgcgagaaggcccaggacauccucaaguuccuccagaucaacggcuacgccgucucccgcggcuucaaggaccucgagcucgacacccccuccaucgagaagcgcuucgccuacuccuuccuccagcagcucauccgcuacgucgacgaggcccaccaguacauccucgaguucgacggcggcucccgcggcaagggcgagcacuuccccuacgagcaggagaucaaguucuucgccaaggucguccucccccucaucgaccaguacuucaagaaccaccgccucuacuuccucuccgccgccucccgcccccucugcuccggcggccacgccuccaacaaggagaaggagauggucaccucccucuucugcaagcucggcguccucguccgccaccgcaucucccucuucggcaacgacgccaccuccaucgucaacugccuccacauccucggccagacccucgacgcccgcaccgucaugaagaccggccucgaguccgucaaguccgcccuccgcgccuuccucgacaacgccgccgaggaccucgagaagaccauggagaaccucaagcagggccaguucacccacacccgcaaccagcccaagggcgucacccagaucaucaacuacaccaccgucgcccuccuccccaugcucuccucccucuucgagcacaucggccagcaccaguucggcgaggaccucauccucgaggacguccaggucuccugcuaccgcauccucaccucccucuacgcccucggcaccuccaaguccaucuacgucgagcgccagcgcuccgcccucggcgagugccucgccgccuucgccggcgccuuccccgucgccuuccucgagacccaccucgacaagcacaacaucuacuccaucuacaacaccaaguccucccgcgagcgcgccgcccucucccuccccaccaacgucgaggacgucugccccaacauccccucccucgagaagcucauggaggagaucgucgagcucgccgaguccggcauccgcuacacccagaugccccacgucauggaggucauccuccccaugcucugcuccuacaugucccgcuggugggagcacggccccgagaacaaccccgagcgcgccgagaugugcugcaccgcccucaacuccgagcacaugaacacccuccucggcaacauccucaagaucaucuacaacaaccucggcaucgacgagggcgccuggaugaagcgccucgccgucuucucccagcccaucaucaacaaggucaagccccagcuccucaagacccacuuccucccccucauggagaagcucaagaagaaggccgccaccgucgucuccgaggaggaccaccucaaggccgaggcccgcggcgacauguccgaggccgagcuccucauccucgacgaguucaccacccucgcccgcgaccucuacgccuucuacccccuccucauccgcuucgucgacuacaaccgcgccaaguggcucaaggagcccaaccccgaggccgaggagcucuuccgcauggucgccgaggucuucaucuacugguccaagucccacaacuucaagcgcgaggagcagaacuucgucguccagaacgagaucaacaacauguccuuccucaucaccgacaccaaguccaagauguccaaggccgccgucuccgaccaggagcgcaagaagaugaagcgcaagggcgaccgcuacuccaugcagaccucccucaucgucgccgcccucaagcgccuccuccccaucggccucaacaucugcgcccccggcgaccaggagcucaucgcccucgccaagaaccgcuucucccucaaggacaccgaggacgagguccgcgacaucauccgcuccaacauccaccuccagggcaagcucgaggaccccgccauccgcuggcagauggcccucuacaaggaccuccccaaccgcaccgacgacaccuccgaccccgagaagaccgucgagcgcguccucgacaucgccaacguccucuuccaccucgagcagaaguccaagcgcgucggccgccgccacuacugccucgucgagcacccccagcgcuccaagaaggccgucuggcacaagcuccucuccaagcagcgcaagcgcgccgucgucgccugcuuccgcauggccccccucuacaaccucccccgccaccgcgccgucaaccucuuccuccagggcuacgagaaguccuggaucgagaccgaggagcacuacuucgaggacaagcucaucgaggaccucgccaagcccggcgccgagccccccgaggaggacgagggcaccaagcgcgucgacccccuccaccagcucauccuccucuucucccgcaccgcccucaccgagaagugcaagcucgaggaggacuuccucuacauggccuacgccgacaucauggccaaguccugccacgacgaggaggacgacgacggcgaggaggaggucaaguccuucgaggucaccggcucccagcgcuccaaggagaaggagauggagaagcagaagcuccucuaccagcaggcccgccuccacgaccgcggcgccgccgagaugguccuccagaccaucuccgccuccaagggcgagaccggccccauggucgccgccacccucaagcucggcaucgccauccucaacggcggcaacuccaccguccagcagaagaugcucgacuaccucaaggagaagaaggacgucggcuucuuccagucccucgccggccucaugcaguccugcuccguccucgaccucaacgccuucgagcgccagaacaaggccgagggccucggcauggucaccgaggagggcuccggcgagaagguccuccaggacgacgaguucaccugcgaccucuuccgcuuccuccagcuccucugcgagggccacaacuccgacuuccagaacuaccuccgcacccagaccggcaacaacaccaccgucaacaucaucaucuccaccgucgacuaccuccuccgcguccaggaguccaucuccgacuucuacugguacuacuccggcaaggacgucaucgacgagcagggccagcgcaacuucuccaaggccauccaggucgccaagcaggucuucaacacccucaccgaguacauccagggccccugcaccggcaaccagcagucccucgcccacucccgccucugggacgccgucgucggcuuccuccacgucuucgcccacaugcagaugaagcucucccaggacuccucccagaucgagcuccucaaggagcucauggaccuccagaaggacauggucgucaugcuccucuccaugcucgagggcaacgucgucaacggcaccaucggcaagcagauggucgacaugcucgucgaguccuccaacaacgucgagaugauccucaaguucuucgacauguuccucaagcucaaggaccucaccuccuccgacaccuucaaggaguacgaccccgacggcaagggcgucaucuccaagcgcgacuuccacaaggccauggagucccacaagcacuacacccaguccgagaccgaguuccuccucuccugcgccgagaccgacgagaacgagacccucgacuacgaggaguucgucaagcgcuuccacgagcccgccaaggacaucggcuucaacgucgccguccuccucaccaaccucuccgagcacaugcccaacgacacccgccuccagaccuuccucgagcucgccgaguccguccucaacuacuuccagcccuuccucggccgcaucgagaucaugggcuccgccaagcgcaucgagcgcgucuacuucgagaucuccgaguccucccgcacccagugggagaagccccaggucaaggaguccaagcgccaguucaucuucgacgucgucaacgagggcggcgagaaggagaagauggagcucuucgucaacuucugcgaggacaccaucuucgagaugcagcucgccgcccagaucuccgaguccgaccucaacgagcgcuccgccaacaaggaggaguccgagaaggagcgccccgaggagcagggcccccgcauggccuucuucuccauccucaccguccgcuccgcccucuucgcccuccgcuacaacauccucacccucaugcgcaugcucucccucaagucccucaagaagcagaugaagaaggucaagaagaugaccgucaaggacauggucaccgccuucuucuccuccuacugguccaucuucaugacccuccuccacuucgucgccuccgucuuccgcggcuucuuccgcaucaucugcucccuccuccucggcggcucccucgucgagggcgccaagaagaucaaggucgccgagcuccucgccaacaugcccgaccccacccaggacgagguccgcggcgacggcgaggagggcgagcgcaagccccucgaggccgcccuccccuccgaggaccucaccgaccucaaggagcucaccgaggaguccgaccuccucuccgacaucuucggccucgaccucaagcgcgagggcggccaguacaagcucaucccccacaaccccaacgccggccucuccgaccucauguccaaccccguccccaugcccgagguccaggagaaguuccaggagcagaaggccaaggaggaggagaaggaggagaaggaggagaccaaguccgagcccgagaaggccgagggcgaggacggcgagaaggaggagaaggccaaggaggacaagggcaagcagaagcuccgccagcuccacacccaccgcuacggcgagcccgagguccccgaguccgccuucuggaagaagaucaucgccuaccagcagaagcuccucaacuacuucgcccgcaacuucuacaacaugcgcaugcucgcccucuucgucgccuucgccaucaacuucauccuccucuucuacaaggucuccaccuccuccgucgucgagggcaaggagcuccccacccgcuccuccuccgagaacgccaaggucaccucccucgacuccuccucccaccgcaucaucgccguccacuacguccucgaggaguccuccggcuacauggagcccacccuccgcauccucgccauccuccacaccgucaucuccuucuucugcaucaucggcuacuacugccucaaggucccccucgucaucuucaagcgcgagaaggaggucgcccgcaagcucgaguucgacggccucuacaucaccgagcagcccuccgaggacgacaucaagggccagugggaccgccucgucaucaacacccaguccuuccccaacaacuacugggacaaguucgucaagcgcaaggucauggacaaguacggcgaguucuacggccgcgaccgcaucuccgagcuccucggcauggacaaggccgcccucgacuucuccgacgcccgcgagaagaagaagcccaagaaggacuccucccucuccgccguccucaacuccaucgacgucaaguaccagauguggaagcucggcgucgucuucaccgacaacuccuuccucuaccucgccugguacaugaccauguccguccucggccacuacaacaacuucuucuucgccgcccaccuccucgacaucgccaugggcuucaagacccuccgcaccauccucuccuccgucacccacaacggcaagcagcucguccucaccgucggccuccucgccgucgucgucuaccucuacaccgucgucgccuucaacuucuuccgcaaguucuacaacaaguccgaggacggcgacacccccgacaugaagugcgacgacaugcucaccugcuacauguuccacauguacgucggcguccgcgccggcggcggcaucggcgacgagaucgaggaccccgccggcgacgaguacgagaucuaccgcaucaucuucgacaucaccuucuucuucuucgucaucgucauccuccucgccaucauccagggccucaucaucgacgccuucggcgagcuccgcgaccagcaggagcaggucaaggaggacauggagaccaagugcuucaucugcggcaucggcaacgacuacuucgacaccgucccccacggcuucgagacccacacccuccaggagcacaaccucgccaacuaccucuucuuccucauguaccucaucaacaaggacgagaccgagcacaccggccaggaguccuacgucuggaagauguaccaggagcgcugcugggaguucuuccccgccggcgacugcuuccgcaagcaguacgaggaccagcucaacuga

SEQ ID NO: 49051 - RNA, 14613 nt, Artificial Sequence
  derived and/or modified sequence opt2 from RYR3__Homo_sapiens__NP_001027
auggccgagggcggcgagggcggcgaggacgagauccaguuccuccgcaccgaggacgaggucguccuccagugcaucgccaccauccacaaggagcagcgcaaguucugccucgccgccgagggccucggcaaccgccucugcuuccucgagcccaccuccgaggccaaguacaucccccccgaccucugcgucugcaacuucguccucgagcagucccucuccguccgcgcccuccaggagaugcucgccaacaccggcgagaacggcggcgagggcgccgcccagggcggcggccaccgcacccuccucuacggccacgccguccuccuccgccacuccuucuccggcauguaccucaccugccucaccaccucccgcucccagaccgacaagcucgccuucgacgucggccuccgcgagcacgccaccggcgaggccugcugguggaccauccaccccgccuccaagcagcgcuccgagggcgagaagguccgcaucggcgacgaccucauccucgucuccgucuccuccgagcgcuaccuccaccucuccgucuccaacggcaacauccaggucgacgccuccuucaugcagacccucuggaacguccaccccaccugcuccggcuccuccaucgaggagggcuaccuccucggcggccacgucguccgccucuuccacggccacgacgagugccucaccauccccuccaccgaccagaacgacucccagcaccgccgcaucuucuacgaggccggcggcgccggcacccgcgcccgcucccucuggcgcgucgagccccuccgcaucuccugguccggcuccaacauccgcuggggccaggccuuccgccuccgccaccucaccaccggccacuaccucgcccucaccgaggaccagggccucauccuccaggaccgcgccaaguccgacaccaaguccaccgccuucuccuuccgcgccuccaaggagcucaaggagaagcucgacuccucccacaagcgcgacaucgagggcaugggcguccccgagaucaaguacggcgacuccgucugcuucguccagcacaucgccuccggccucugggucaccuacaaggcccaggacgccaagaccucccgccucggcccccucaagcgcaaggucauccuccaccaggagggccacauggacgacggccucacccuccagcgcugccagcgcgaggagucccaggccgcccgcaucauccgcaacaccaccgcccucuucucccaguucgucuccggcaacaaccgcaccgccgcccccaucacccuccccaucgaggagguccuccagacccuccaggaccucaucgccuacuuccagccccccgaggaggagaugcgccacgaggacaagcagaacaagcuccgcucccucaagaaccgccagaaccucuucaaggaggagggcaugcucgcccucguccucaacugcaucgaccgccucaacgucuacaacuccgucgcccacuucgccggcaucgcccgcgaggaguccggcauggccuggaaggagauccucaaccuccucuacaagcuccucgccgcccucauccgcggcaaccgcaacaacugcgcccaguucuccaacaaccucgacuggcucaucuccaagcucgaccgccucgaguccuccuccggcauccucgagguccuccacugcauccucaccgagucccccgaggcccucaaccucaucgccgagggccacaucaaguccaucaucucccuccucgacaagcacggccgcaaccacaagguccucgacauccucugcucccucugccucugcaacggcgucgccguccgcgccaaccagaaccucaucugcgacaaccuccucccccgccgcaaccuccuccuccagacccgccucaucaacgacgucaccuccauccgccccaacaucuuccucggcgucgccgagggcuccgcccaguacaagaagugguacuucgagcucaucaucgaccaggucgaccccuuccucaccgccgagcccacccaccuccgcgucggcugggccuccuccuccggcuacgcccccuaccccggcggcggcgagggcuggggcggcaacggcgucggcgacgaccucuacuccuacggcuucgacggccuccaccucugguccggccgcaucccccgcgccgucgccuccaucaaccagcaccuccuccgcuccgacgacgucgucuccugcugccucgaccucggcguccccuccaucuccuuccgcaucaacggccagcccguccagggcauguucgagaacuucaacaccgacggccucuucuuccccgucauguccuucuccgccggcgucaagguccgcuuccucaugggcggccgccacggcgaguucaaguuccucccccccuccggcuacgcccccugcuacgaggcccuccuccccaaggagaagaugcgccucgagcccgucaaggaguacaagcgcgacgccgacggcauccgcgaccuccucggcaccacccaguuccucucccaggccuccuucauccccugccccgucgacaccucccaggucauccuccccccccaccucgagaagauccgcgaccgccucgccgagaacauccacgagcucuggggcaugaacaagaucgagcucggcuggaccuucggcaagauccgcgacgacaacaagcgccagcaccccugccucgucgaguucuccaagcuccccgagaccgagaagaacuacaaccuccagauguccaccgagacccucaagacccuccucgcccucggcugccacaucgcccacgucaaccccgccgccgaggaggaccucaagaaggucaagcuccccaagaacuacaugauguccaacggcuacaagcccgccccccucgaccucuccgacgucaagcuccuccccccccaggagauccucgucgacaagcucgccgagaacgcccacaacgucugggccaaggaccgcaucaagcagggcuggaccuacggcauccagcaggaccucaagaacaagcgcaacccccgccucguccccuacgcccuccucgacgagcgcaccaagaaguccaaccgcgacucccuccgcgaggccguccgcaccuucgucggcuacggcuacaacaucgagcccuccgaccaggagcucgccgacuccgccgucgagaaggucuccaucgacaagauccgcuucuuccgcgucgagcgcuccuacgccguccgcuccggcaagugguacuucgaguucgaggucgucaccggcggcgacaugcgcgucggcugggcccgccccggcugccgccccgacgucgagcucggcgccgacgaccaggccuucgucuucgagggcaaccgcggccagcgcuggcaccagggcuccggcuacuucggccgcaccuggcagcccggcgacgucgucggcugcaugaucaaccucgacgacgccuccaugaucuucacccucaacggcgagcuccucaucaccaacaagggcuccgagcucgccuucgccgacuacgagaucgagaacggcuucguccccaucugcugccucggccucucccagaucggccgcaugaaccucggcaccgacgccuccaccuucaaguucuacaccaugugcggccuccaggagggcuucgagcccuucgccgucaacaugaaccgcgacgucgccaugugguucuccaagcgccuccccaccuucgucaacguccccaaggaccacccccacaucgaggucaugcgcaucgacggcaccauggacuccccccccugccucaaggucacccacaagaccuucggcacccagaacuccaacgccgacaugaucuacugccgccucuccaugcccgucgagugccacuccuccuucucccacucccccugccucgacuccgaggccuuccagaagcgcaagcagaugcaggagauccucucccacaccaccacccagugcuacuacgccauccgcaucuucgccggccaggaccccuccugcgucugggucggcugggucacccccgacuaccaccucuacuccgagaaguucgaccucaacaagaacugcaccgucaccgucacccucggcgacgagcgcggccgcguccacgaguccgucaagcgcuccaacugcuacauggucuggggcggcgacaucgucgccuccucccagcgcuccaaccgcuccaacgucgaccucgagaucggcugccucgucgaccucgccaugggcaugcucuccuucuccgccaacggcaaggagcucggcaccugcuaccaggucgagcccaacaccaaggucuuccccgccgucuuccuccagcccaccuccaccucccucuuccaguucgagcucggcaagcucaagaacgccaugccccucuccgccgccaucuuccgcuccgaggagaagaaccccgucccccagugccccccccgccucgacguccagaccauccagcccguccucuggucccgcaugcccaacuccuuccucaaggucgagaccgagcgcgucuccgagcgccacggcugggucguccagugccucgagccccuccagaugauggcccuccacauccccgaggagaaccgcugcgucgacauccucgagcucugcgagcaggaggaccucaugcgcuuccacuaccacacccuccgccucuacuccgccgucugcgcccucggcaacucccgcgucgccuacgcccucugcucccacgucgaccucucccagcucuucuacgccaucgacaacaaguaccuccccggccuccuccgcuccggcuucuacgaccuccucaucuccauccaccucgccuccgccaaggagcgcaagcucaugaugaagaacgaguacaucauccccaucaccuccaccacccgcaacauccgccucuuccccgacgaguccaagcgccacggccuccccggcgucggccuccgcaccugccucaagcccggcuuccgcuucuccacccccugcuucgucgucaccggcgaggaccaccagaagcagucccccgagaucccccucgagucccuccgcaccaaggcccucuccaugcucaccgaggccguccagugcuccggcgcccacauccgcgaccccgucggcggcuccgucgaguuccaguucguccccguccucaagcucaucggcacccuccucgucaugggcgucuucgacgacgacgacguccgccagauccuccuccucaucgaccccuccgucuucggcgagcacuccgccggcaccgaggagggcgccgagaaggaggaggucacccaggucgaggagaaggccgucgaggccggcgagaaggccggcaaggaggcccccgucaagggccuccuccagacccgccuccccgaguccgucaagcuccagaugugcgagcuccucuccuaccucugcgacugcgagcuccagcaccgcgucgaggccaucgucgccuucggcgacaucuacgucuccaagcuccaggccaaccagaaguuccgcuacaacgagcucaugcaggcccucaacauguccgccgcccucaccgcccgcaagaccaaggaguuccgcucccccccccaggagcagaucaacaugcuccucaacuuccagcucggcgagaacugccccugccccgaggagauccgcgaggagcucuacgacuuccacgaggaccuccuccuccacugcggcgucccccucgaggaggaggaggaggaggaggaggacaccuccuggaccggcaagcucugcgcccucgucuacaagaucaagggcccccccaagcccgagaaggagcagcccaccgaggaggaggagcgcugccccaccacccucaaggagcucaucucccagaccaugaucugcugggcccaggaggaccagauccaggacuccgagcucguccgcaugauguucaaccuccuccgccgccaguacgacuccaucggcgagcuccuccaggcccuccgcaagaccuacaccaucucccacaccuccgucuccgacaccaucaaccuccucgccgcccucggccagauccgcucccuccucuccguccgcaugggcaaggaggaggagcuccucaugaucaacggccucggcgacaucaugaacaacaaggucuucuaccagcaccccaaccucaugcgcguccucggcaugcacgagaccgucauggaggucauggucaacguccucggcaccgagaagucccagaucgccuuccccaagauggucgccuccugcugccgcuuccucugcuacuucugccgcaucucccgccagaaccagaaggccauguucgagcaccucuccuaccuccucgagaacuccuccgucggccucgccucccccuccaugcgcggcuccaccccccucgacgucgccgccuccuccgucauggacaacaacgagcucgcccucucccucgaggagcccgaccucgagaaggucgucaccuaccucgccggcugcggccuccaguccugccccaugcuccucgccaagggcuaccccgacgucggcuggaaccccaucgagggcgagcgcuaccucuccuuccuccgcuucgccgucuucgucaacuccgaguccgucgaggagaacgccuccgucgucgucaagcuccucauccgccgccccgagugcuucggccccgcccuccgcggcgagggcggcaacggccuccucgccgccaugcagggcgccaucaagaucuccgagaaccccgcccucgaccuccccucccagggcuacaagcgcgaggucuccaccggcgacgacgaggaggaggaggagaucguccacaugggcaacgccaucauguccuucuacuccgcccucaucgaccuccucggccgcugcgcccccgagaugcaccucauccagaccggcaagggcgaggccauccgcauccgcuccauccuccgcucccucguccccaccgaggaccucgucggcaucaucuccaucccccucaagcuccccucccucaacaaggacggcuccgucuccgagcccgacauggccgccaacuucugccccgaccacaaggcccccaugguccucuuccucgaccgcgucuacggcaucaaggaccagaccuuccuccuccaccuccucgaggucggcuuccuccccgaccuccgcgccuccgccucccucgacaccgucucccucuccaccaccgaggccgcccucgcccucaaccgcuacaucugcuccgccguccucccccuccucacccgcugcgccccccucuucgccggcaccgagcacugcaccucccucaucgacuccacccuccagaccaucuaccgccucuccaagggccgcucccucaccaaggcccagcgcgacaccaucgaggagugccuccucgccaucugcaaccaccuccgccccuccaugcuccagcagcuccuccgccgccucgucuucgacgucccccagcucaacgaguacugcaagaugccccucaagcuccucaccaaccacuacgagcagugcuggaaguacuacugccuccccuccggcuggggcuccuacggccucgccgucgaggaggagcuccaccucaccgagaagcucuucuggggcaucuucgacucccucucccacaagaaguacgaccccgaccucuuccgcauggcccuccccugccucuccgccaucgccggcgcccucccccccgacuaccucgacacccgcaucaccgccacccucgagaagcagaucuccgucgacgccgacggcaacuucgaccccaagcccaucaacaccaugaacuucucccuccccgagaagcucgaguacaucgucaccaaguacgccgagcacucccacgacaagugggccugcgacaagucccaguccggcuggaaguacggcaucucccucgacgagaacgucaagacccacccccucauccgccccuucaagacccucaccgagaaggagaaggagaucuaccgcuggcccgcccgcgagucccucaagaccaugcucgccgucggcuggaccgucgagcgcaccaaggagggcgaggcccucguccagcagcgcgagaacgagaagcuccgcuccgucucccaggccaaccagggcaacuccuacucccccgccccccucgaccucuccaacgucguccucucccgcgagcuccagggcauggucgaggucgucgccgagaacuaccacaacaucugggccaagaagaagaagcucgagcucgaguccaagggcggcggcucccacccccuccucguccccuacgacacccucaccgccaaggagaaguucaaggaccgcgagaaggcccaggaccucuucaaguuccuccaggucaacggcaucaucgucucccgcggcaugaaggacauggagcucgacgccuccuccauggagaagcgcuucgccuacaaguuccucaagaagauccucaaguacgucgacuccgcccaggaguucaucgcccaccucgaggccaucgucuccuccggcaagaccgagaaguccccccgcgaccaggagaucaaguucuucgccaagguccuccucccccucgucgaccaguacuucaccucccacugccucuacuuccucuccuccccccucaagccccucuccuccuccggcuacgccucccacaaggagaaggagauggucgccggccucuucugcaagcucgccgcccucguccgccaccgcaucucccucuucggcuccgacuccaccaccauggucuccugccuccacauccucgcccagacccucgacacccgcaccgucaugaaguccggcuccgagcucgucaaggccggccuccgcgccuucuucgagaacgccgccgaggaccucgagaagaccuccgagaaccucaagcucggcaaguucacccacucccgcacccagaucaagggcgucucccagaacaucaacuacaccaccgucgcccuccuccccauccucaccuccaucuucgagcacgucacccagcaccaguucggcauggaccuccuccucggcgacguccagaucuccugcuaccacauccucugcucccucuacucccucggcaccggcaagaacaucuacgucgagcgccagcgccccgcccucggcgagugccucgccucccucgccgccgccauccccgucgccuuccucgagcccacccucaaccgcuacaacccccucuccgucuucaacaccaagaccccccgcgagcgcuccauccucggcaugcccgacaccgucgaggacaugugccccgacaucccccagcucgagggccucaugaaggagaucaacgaccucgccgaguccggcgcccgcuacaccgagaugccccacgucaucgaggucauccuccccaugcucugcaacuaccucuccuacuggugggagcgcggccccgagaaccucccccccuccaccggccccugcugcaccaaggucaccuccgagcaccucucccucauccucggcaacauccucaagaucaucaacaacaaccucggcaucgacgaggccuccuggaugaagcgcaucgccgucuacgcccagcccaucaucuccaaggcccgccccgaccuccuccgcucccacuucauccccacccucgagaagcucaagaagaaggccgucaagaccguccaggaggaggagcagcucaaggccgacggcaagggcgacacccaggaggccgagcuccucauccucgacgaguucgccguccucugccgcgaccucuacgccuucuaccccaugcucauccgcuacgucgacaacaaccgcuccaacuggcucaagucccccgacgccgacuccgaccagcucuuccgcauggucgccgaggucuucauccucuggugcaagucccacaacuucaagcgcgaggagcagaacuucgucauccagaacgagaucaacaaccucgccuuccucaccggcgacuccaaguccaagauguccaaggccaugcaggucaaguccggcggccaggaccaggagcgcaagaagaccaagcgccgcggcgaccucuacuccauccagaccucccucaucgucgccgcccucaagaagaugcuccccaucggccucaacaugugcacccccggcgaccaggagcucaucucccucgccaagucccgcuacucccaccgcgacaccgacgaggagguccgcgagcaccuccgcaacaaccuccaccuccaggagaaguccgacgaccccgccgucaaguggcagcucaaccucuacaaggacguccucaaguccgaggagcccuucaaccccgagaagaccgucgagcgcguccagcgcaucuccgccgccgucuuccaccucgagcaggucgagcagccccuccgcuccaagaaggccgucuggcacaagcuccucuccaagcagcgcaagcgcgccgucgucgccugcuuccgcauggccccccucuacaaccucccccgccaccgcuccaucaaccucuuccuccacggcuaccagcgcuucuggaucgagaccgaggaguacuccuucgaggagaagcucguccaggaccucgccaagucccccaaggucgaggaggaggaggaggaggagaccgagaagcagcccgacccccuccaccagaucauccucuacuucucccgcaacgcccucaccgagcgcuccaagcucgaggacgacccccucuacaccuccuacuccuccaugauggccaaguccugccaguccggcgaggacgaggaggaggacgaggacaaggagaagaccuucgaggagaaggagauggagaagcagaagacccucuaccagcaggcccgccuccacgagcgcggcgccgccgagaugguccuccagaugaucuccgccuccaagggcgagaugucccccauggucgucgagacccucaagcucggcaucgccauccucaacggcggcaacgccggcguccagcagaagaugcucgacuaccucaaggagaagaaggacgccggcuucuuccagucccucuccggccucaugcaguccugcuccguccucgaccucaacgccuucgagcgccagaacaaggccgagggccucggcauggucaccgaggagggcacccucaucguccgcgagcgcggcgagaagguccuccagaacgacgaguucacccgcgaccucuuccgcuuccuccagcuccucugcgagggccacaacuccgacuuccagaacuuccuccgcacccagaugggcaacaccaccaccgucaacgucaucaucuccaccgucgacuaccuccuccgccuccaggaguccaucuccgacuucuacugguacuacuccggcaaggacaucaucgacgaguccggccagcacaacuucuccaaggcccucgccgucaccaagcagaucuucaacucccucaccgaguacauccagggccccugcaucggcaaccagcagucccucgcccacucccgccucugggacgccgucgucggcuuccuccacgucuucgccaacaugcagaugaagcucucccaggacuccucccagaucgagcuccucaaggagcuccucgaccuccuccaggacauggucgucaugcuccucucccuccucgagggcaacgucgucaacggcaccaucggcaagcagauggucgacacccucgucgaguccuccaccaacgucgagaugauccucaaguucuucgacauguuccucaagcucaaggaccucaccuccuccgacaccuucaaggaguacgaccccgacggcaagggcaucaucuccaagaaggaguuccagaaggccauggagggccagaagcaguacacccaguccgagaucgacuuccuccucuccugcgccgaggccgacgagaacgacauguucaacuacgucgacuucgucgaccgcuuccacgagcccgccaaggacaucggcuucaacgucgccguccuccucaccaaccucuccgagcacaugcccaacgacucccgccucaagugccuccucgaccccgccgaguccguccucaacuacuucgagcccuaccucggccgcaucgagaucaugggcggcgccaagaagaucgagcgcgucuacuucgagaucuccgaguccucccgcacccagugggagaagccccaggucaaggaguccaagcgccaguucaucuucgacgucgucaacgagggcggcgagcaggagaagauggagcucuucgucaacuucugcgaggacaccaucuucgagaugcagcucgccucccagaucuccgaguccgacuccgccgaccgccccgaggaggaggaggaggacgaggacuccuccuacguccucgagaucgccggcgaggaggaggaggacggcucccucgagcccgccuccgccuucgccauggccugcgccuccgucaagcgcaacgucaccgacuuccucaagcgcgccacccucaagaaccuccgcaagcaguaccgcaacgucaagaagaugaccgccaaggagcucgucaagguccucuucuccuucuucuggaugcucuucgucggccucuuccagcuccucuucaccauccucggcggcaucuuccagauccucugguccaccgucuucggcggcggccucgucgagggcgccaagaacauccgcgucaccaagauccucggcgacaugcccgaccccacccaguucggcauccacgacgacaccauggaggccgagcgcgccgaggucauggagcccggcaucaccaccgagcucguccacuucaucaagggcgagaagggcgacaccgacaucauguccgaccucuucggccuccaccccaagaaggagggcucccucaagcacggccccgaggucggccucggcgaccucuccgagaucaucggcaaggacgagccccccacccucgaguccaccguccagaagaagcgcaaggcccaggccgccgagaugaaggccgccaacgaggccgagggcaaggucgaguccgagaaggccgacauggaggacggcgagaaggaggacaaggacaaggaggaggagcaggccgaguaccucuggaccgaggucaccaagaagaagaagcgccgcugcggccagaaggucgagaagcccgaggccuucaccgccaacuucuucaagggccucgagaucuaccagaccaagcuccuccacuaccucgcccgcaacuucuacaaccuccgcuuccucgcccucuucgucgccuucgccaucaacuucauccuccucuucuacaaggucaccgaggagccccucgaggaggagaccgaggacgucgccaaccucuggaacuccuucaacgacgaggaggaggaggaggccauggucuucuucguccuccaggaguccaccggcuacauggcccccacccuccgcgcccucgccaucauccacaccaucaucucccucgucugcgucgucggcuacuacugccucaaggucccccucgucgucuucaagcgcgagaaggagaucgcccgcaagcucgaguucgacggccucuacaucaccgagcagcccuccgaggacgacaucaagggccagugggaccgccucgucaucaacacccccuccuuccccaacaacuacugggacaaguucgucaagcgcaaggucaucaacaaguacggcgaccucuacggcgccgagcgcaucgccgagcuccucggccucgacaagaacgcccucgacuucucccccgucgaggagaccaaggccgaggccgccucccucgucuccuggcucuccuccaucgacaugaaguaccacaucuggaagcucggcgucgucuucaccgacaacuccuuccucuaccucgccugguacaccaccauguccguccucggccacuacaacaacuucuucuucgccgcccaccuccucgacaucgccaugggcuucaagacccuccgcaccauccucuccuccgucacccacaacggcaagcagcucguccucaccgucggccuccucgccgucgucgucuaccucuacaccgucgucgccuucaacuucuuccgcaaguucuacaacaaguccgaggacgacgacgagcccgacaugaagugcgacgacaugaugaccugcuaccucuuccacauguacgucggcguccgcgccggcggcggcaucggcgacgagaucgaggaccccgccggcgaccccuacgagauguaccgcaucgucuucgacaucaccuucuucuucuucgucaucgucauccuccucgccaucauccagggccucaucaucgacgccuucggcgagcuccgcgaccagcaggagcagguccgcgaggacauggagaccaagugcuucaucugcggcaucggcaacgacuacuucgacaccaccccccacggcuucgagacccacacccuccaggagcacaaccucgccaacuaccucuucuuccucauguaccucaucaacaaggacgagaccgagcacaccggccaggaguccuacgucuggaagauguaccaggagcgcugcugggacuucuuccccgccggcgacugcuuccgcaagcaguacgaggaccagcucggcuga

SEQ ID NO: 49052 - RNA, 294 nt, Artificial Sequence
  derived and/or modified sequence opt2 from S100A10__Homo_sapiens__NP_002957
augcccucccagauggagcacgccauggagaccaugauguucaccuuccacaaguucgccggcgacaagggcuaccucaccaaggaggaccuccgcguccucauggagaaggaguuccccggcuuccucgagaaccagaaggacccccucgccgucgacaagaucaugaaggaccucgaccagugccgcgacggcaaggucggcuuccaguccuucuucucccucaucgccggccucaccaucgccugcaacgacuacuucgucguccacaugaagcagaagggcaagaaguga

SEQ ID NO: 49053 - RNA, 318 nt, Artificial Sequence
  derived and/or modified sequence opt2 from S100A11__Homo_sapiens__NP_005611
auggccaagaucuccucccccaccgagaccgagcgcugcaucgagucccucaucgccgucuuccagaaguacgccggcaaggacggcuacaacuacacccucuccaagaccgaguuccucuccuucaugaacaccgagcucgccgccuucaccaagaaccagaaggaccccggcguccucgaccgcaugaugaagaagcucgacaccaacuccgacggccagcucgacuucuccgaguuccucaaccucaucggcggccucgccauggccugccacgacuccuuccucaaggccguccccucccagaagcgcaccuga

SEQ ID NO: 49054 - RNA, 279 nt, Artificial Sequence
  derived and/or modified sequence opt2 from S100A12__Homo_sapiens__NP_005612
augaccaagcucgaggagcaccucgagggcaucgucaacaucuuccaccaguacuccguccgcaagggccacuucgacacccucuccaagggcgagcucaagcagcuccucaccaaggagcucgccaacaccaucaagaacaucaaggacaaggccgucaucgacgagaucuuccagggccucgacgccaaccaggacgagcaggucgacuuccaggaguucaucucccucgucgccaucgcccucaaggccgcccacuaccacacccacaaggaguga

SEQ ID NO: 49055 - RNA, 297 nt, Artificial Sequence
  derived and/or modified sequence opt2 from S100A13__Homo_sapiens__XP_011508166
auggccgccgagccccucaccgagcucgaggaguccaucgagaccgucgucaccaccuucuucaccuucgcccgccaggagggccgcaaggacucccucuccgucaacgaguucaaggagcucgucacccagcagcucccccaccuccucaaggacgucggcucccucgacgagaagaugaagucccucgacgucaaccaggacuccgagcucaaguucaacgaguacuggcgccucaucggcgagcucgccaaggagauccgcaagaagaaggaccucaagauccgcaagaaguga

SEQ ID NO: 49056 - RNA, 315 nt, Artificial Sequence
  derived and/or modified sequence opt2 from S100A14__Homo_sapiens__XP_005245419
augggccagugccgcuccgccaacgccgaggacgcccaggaguucuccgacgucgagcgcgccaucgagacccucaucaagaacuuccaccaguacuccgucgagggcggcaaggagacccucacccccuccgagcuccgcgaccucgucacccagcagcucccccaccucaugcccuccaacugcggccucgaggagaagaucgccaaccucggcuccugcaacgacuccaagcucgaguuccgcuccuucugggagcucaucggcgaggccgccaaguccgucaagcucgagcgccccguccgcggccacuga

SEQ ID NO: 49057 - RNA, 312 nt, Artificial Sequence
  derived and/or modified sequence opt2 from S100A16__Homo_sapiens__NP_525127
auguccgacugcuacaccgagcucgagaaggccgucaucguccucgucgagaacuucuacaaguacgucuccaaguacucccucgucaagaacaagaucuccaaguccuccuuccgcgagaugcuccagaaggagcucaaccacaugcucuccgacaccggcaaccgcaaggccgccgacaagcucauccagaaccucgacgccaaccacgacggccgcaucuccuucgacgaguacuggacccucaucggcggcaucaccggccccaucgccaagcucauccacgagcaggagcagcaguccuccuccuga

SEQ ID NO: 49058 - RNA, 285 nt, Artificial Sequence
  derived and/or modified sequence opt2 from S100A1__Homo_sapiens__NP_006262
augggcuccgagcucgagaccgccauggagacccucaucaacgucuuccacgcccacuccggcaaggagggcgacaaguacaagcucuccaagaaggagcucaaggagcuccuccagaccgagcucuccggcuuccucgacgcccagaaggacgucgacgccgucgacaaggucaugaaggagcucgacgagaacggcgacggcgaggucgacuuccaggaguacgucguccucgucgccgcccucaccgucgccugcaacaacuucuucugggagaacuccuga

SEQ ID NO: 49059 - RNA, 294 nt, Artificial Sequence
  derived and/or modified sequence opt2 from S100A2__Homo_sapiens__NP_005969
augugcuccucccucgagcaggcccucgccguccucgucaccaccuuccacaaguacuccugccaggagggcgacaaguucaagcucuccaagggcgagaugaaggagcuccuccacaaggagcuccccuccuucgucggcgagaaggucgacgaggagggccucaagaagcucaugggcucccucgacgagaacuccgaccagcaggucgacuuccaggaguacgccgucuuccucgcccucaucaccgucaugugcaacgacuucuuccagggcugccccgaccgccccuga

SEQ ID NO: 49060 - RNA, 306 nt, Artificial Sequence
  derived and/or modified sequence opt2 from S100A3__Homo_sapiens__NP_002951
auggcccgcccccucgagcaggccgucgccgccaucgucugcaccuuccaggaguacgccggccgcugcggcgacaaguacaagcucugccaggccgagcucaaggagcuccuccagaaggagcucgccaccuggacccccaccgaguuccgcgagugcgacuacaacaaguucauguccguccucgacaccaacaaggacugcgaggucgacuucgucgaguacguccgcucccucgccugccucugccucuacugccacgaguacuucaaggacugccccuccgagccccccugcucccaguga

SEQ ID NO: 49061 - RNA, 306 nt, Artificial Sequence
  derived and/or modified sequence opt2 from S100A4__Homo_sapiens__NP_002952
auggccugcccccucgagaaggcccucgacgucauggucuccaccuuccacaaguacuccggcaaggagggcgacaaguucaagcucaacaaguccgagcucaaggagcuccucacccgcgagcuccccuccuuccucggcaagcgcaccgacgaggccgccuuccagaagcucauguccaaccucgacuccaaccgcgacaacgaggucgacuuccaggaguacugcgucuuccucuccugcaucgccaugaugugcaacgaguucuucgagggcuuccccgacaagcagccccgcaagaaguga

SEQ ID NO: 49062 - RNA, 279 nt, Artificial Sequence
  derived and/or modified sequence opt2 from S100A5__Homo_sapiens__NP_002953
auggagaccccccucgagaaggcccucaccaccauggucaccaccuuccacaaguacuccggccgcgagggcuccaagcucacccucucccgcaaggagcucaaggagcucaucaagaaggagcucugccucggcgagaugaaggaguccuccaucgacgaccucaugaagucccucgacaagaacuccgaccaggagaucgacuucaaggaguacuccgucuuccucaccaugcucugcauggccuacaacgacuucuuccucgaggacaacaaguga

SEQ ID NO: 49063 - RNA, 273 nt, Artificial Sequence
  derived and/or modified sequence opt2 from S100A6__Homo_sapiens__NP_055439
auggccugcccccucgaccaggccaucggccuccucgucgccaucuuccacaaguacuccggccgcgagggcgacaagcacacccucuccaagaaggagcucaaggagcucauccagaaggagcucaccaucggcuccaagcuccaggacgccgagaucgcccgccucauggaggaccucgaccgcaacaaggaccaggaggucaacuuccaggaguacgucaccuuccucggcgcccucgcccucaucuacaacgaggcccucaagggcuga

SEQ ID NO: 49064 - RNA, 306 nt, Artificial Sequence
  derived and/or modified sequence opt2 from S100A7A__Homo_sapiens__NP_789793
auguccaacacccaggccgagcgcuccaucaucggcaugaucgacauguuccacaaguacaccggccgcgacggcaagaucgagaagcccucccuccucaccaugaugaaggagaacuuccccaacuuccucuccgccugcgacaagaagggcauccacuaccucgccaccgucuucgagaagaaggacaagaacgaggacaagaagaucgacuucuccgaguuccucucccuccucggcgacaucgccgccgacuaccacaagcagucccacggcgccgcccccugcuccggcggcucccaguga

SEQ ID NO: 49065 - RNA, 306 nt, Artificial Sequence
  derived and/or modified sequence opt2 from S100A7__Homo_sapiens__NP_002954
auguccaacacccaggccgagcgcuccaucaucggcaugaucgacauguuccacaaguacacccgccgcgacgacaagaucgagaagcccucccuccucaccaugaugaaggagaacuuccccaacuuccucuccgccugcgacaagaagggcaccaacuaccucgccgacgucuucgagaagaaggacaagaacgaggacaagaagaucgacuucuccgaguuccucucccuccucggcgacaucgccaccgacuaccacaagcagucccacggcgccgcccccugcuccggcggcucccaguga

SEQ ID NO: 49066 - RNA, 282 nt, Artificial Sequence
  derived and/or modified sequence opt2 from S100A8__Homo_sapiens__NP_002955
augcucaccgagcucgagaaggcccucaacuccaucaucgacgucuaccacaaguacucccucaucaagggcaacuuccacgccgucuaccgcgacgaccucaagaagcuccucgagaccgagugcccccaguacauccgcaagaagggcgccgacgucugguucaaggagcucgacaucaacaccgacggcgccgucaacuuccaggaguuccucauccucgucaucaagaugggcgucgccgcccacaagaagucccacgaggagucccacaaggaguga

SEQ ID NO: 49067 - RNA, 345 nt, Artificial Sequence
  derived and/or modified sequence opt2 from S100A9__Homo_sapiens__NP_002956
augaccugcaagaugucccagcucgagcgcaacaucgagaccaucaucaacaccuuccaccaguacuccgucaagcucggccaccccgacacccucaaccagggcgaguucaaggagcucguccgcaaggaccuccagaacuuccucaagaaggagaacaagaacgagaaggucaucgagcacaucauggaggaccucgacaccaacgccgacaagcagcucuccuucgaggaguucaucaugcucauggcccgccucaccugggccucccacgagaagaugcacgagggcgacgagggccccggccaccaccacaagcccggccucggcgagggcacccccuga

SEQ ID NO: 49068 - RNA, 279 nt, Artificial Sequence
  derived and/or modified sequence opt2 from S100B__Homo_sapiens__NP_006263
auguccgagcucgagaaggccauggucgcccucaucgacgucuuccaccaguacuccggccgcgagggcgacaagcacaagcucaagaaguccgagcucaaggagcucaucaacaacgagcucucccacuuccucgaggagaucaaggagcaggaggucgucgacaaggucauggagacccucgacaacgacggcgacggcgagugcgacuuccaggaguucauggccuucgucgccauggucaccaccgccugccacgaguucuucgagcacgaguga

SEQ ID NO: 49069 - RNA, 288 nt, Artificial Sequence
  derived and/or modified sequence opt2 from S100P__Homo_sapiens__NP_005971
augaccgagcucgagaccgccaugggcaugaucaucgacgucuucucccgcuacuccggcuccgagggcuccacccagacccucaccaagggcgagcucaagguccucauggagaaggagcuccccggcuuccuccaguccggcaaggacaaggacgccgucgacaagcuccucaaggaccucgacgccaacggcgacgcccaggucgacuucuccgaguucaucgucuucgucgccgccaucaccuccgccugccacaaguacuucgagaaggccggccucaaguga

SEQ ID NO: 49070 - RNA, 300 nt, Artificial Sequence
  derived and/or modified sequence opt2 from S100Z__Homo_sapiens__NP_570128
augcccacccagcucgagauggccauggacaccaugauccgcaucuuccaccgcuacuccggcaaggagcgcaagcgcuucaagcucuccaagggcgagcucaagcuccuccuccagcgcgagcucaccgaguuccucuccugccagaaggagacccagcucgucgacaagaucguccaggaccucgacgccaacaaggacaacgaggucgacuucaacgaguucgucgucauggucgccgcccucaccgucgccugcaacgacuacuucgucgagcagcucaagaagaagggcaaguga

SEQ ID NO: 49071 - RNA, 1062 nt, Artificial Sequence
  derived and/or modified sequence opt2 from S1PR2__Homo_sapiens__NP_004221
augggcucccucuacuccgaguaccucaaccccaacaagguccaggagcacuacaacuacaccaaggagacccucgagacccaggagaccaccucccgccaggucgccuccgccuucaucgucauccucugcugcgccaucgucgucgagaaccuccucguccucaucgccgucgcccgcaacuccaaguuccacuccgccauguaccucuuccucggcaaccucgccgccuccgaccuccucgccggcgucgccuucgucgccaacacccuccucuccggcuccgucacccuccgccucacccccguccagugguucgcccgcgagggcuccgccuucaucacccucuccgccuccgucuucucccuccucgccaucgccaucgagcgccacgucgccaucgccaaggucaagcucuacggcuccgacaaguccugccgcaugcuccuccucaucggcgccuccuggcucaucucccucguccucggcggccuccccauccucggcuggaacugccucggccaccucgaggccugcuccaccguccucccccucuacgccaagcacuacguccucugcgucgucaccaucuucuccaucauccuccucgccaucgucgcccucuacguccgcaucuacugcgucguccgcuccucccacgccgacauggccgccccccagacccucgcccuccucaagaccgucaccaucguccucggcgucuucaucgucugcuggcuccccgccuucuccauccuccuccucgacuacgccugccccguccacuccugccccauccucuacaaggcccacuacuucuucgccgucuccacccucaacucccuccucaaccccgucaucuacaccuggcgcucccgcgaccuccgccgcgagguccuccgcccccuccagugcuggcgccccggcgucggcguccagggccgccgccgcggcggcacccccggccaccaccuccucccccuccgcuccuccuccucccucgagcgcggcaugcacaugcccaccucccccaccuuccucgagggcaacaccgucgucuga

SEQ ID NO: 49072 - RNA, 1137 nt, Artificial Sequence
  derived and/or modified sequence opt2 from S1PR3__Homo_sapiens__NP_005217
auggccaccgcccuccccccccgccuccagcccguccgcggcaacgagacccuccgcgagcacuaccaguacgucggcaagcucgccggccgccucaaggaggccuccgagggcuccacccucaccaccguccucuuccucgucaucugcuccuucaucguccucgagaaccucaugguccucaucgccaucuggaagaacaacaaguuccacaaccgcauguacuucuucaucggcaaccucgcccucugcgaccuccucgccggcaucgccuacaaggucaacauccucauguccggcaagaagaccuucucccucucccccaccgucugguuccuccgcgagggcuccauguucgucgcccucggcgccuccaccugcucccuccucgccaucgccaucgagcgccaccucaccaugaucaagaugcgccccuacgacgccaacaagcgccaccgcgucuuccuccucaucggcaugugcuggcucaucgccuucacccucggcgcccuccccauccucggcuggaacugccuccacaaccuccccgacugcuccaccauccucccccucuacuccaagaaguacaucgccuucugcaucuccaucuucaccgccauccucgucaccaucgucauccucuacgcccgcaucuacuuccucgucaaguccuccucccgcaaggucgccaaccacaacaacuccgagcgcuccauggcccuccuccgcaccgucgucaucgucgucuccgucuucaucgccugcugguccccccucuucauccucuuccucaucgacgucgccugccgcguccaggccugccccauccucuucaaggcccagugguucaucguccucgccguccucaacuccgccaugaaccccgucaucuacacccucgccuccaaggagaugcgccgcgccuucuuccgccucgucugcaacugccucguccgcggccgcggcgcccgcgccucccccauccagcccgcccucgaccccucccgcuccaaguccuccuccuccaacaacuccucccacucccccaaggucaaggaggaccucccccacaccgcccccuccuccugcaucauggacaagaacgccgcccuccagaacggcaucuucugcaacuga

SEQ ID NO: 49073 - RNA, 1155 nt, Artificial Sequence
  derived and/or modified sequence opt2 from S1PR4__Homo_sapiens__NP_003766
augaacgccaccggcacccccgucgcccccgaguccugccagcagcucgccgccggcggccacucccgccucaucguccuccacuacaaccacuccggccgccucgccggccgcggcggccccgaggacggcggccucggcgcccuccgcggccucuccgucgccgccuccugccucgucguccucgagaaccuccucguccucgccgccaucaccucccacaugcgcucccgccgcugggucuacuacugccucgucaacaucacccucuccgaccuccucaccggcgccgccuaccucgccaacguccuccucuccggcgcccgcaccuuccgccucgcccccgcccagugguuccuccgcgagggccuccucuucaccgcccucgccgccuccaccuucucccuccucuucaccgccggcgagcgcuucgccaccaugguccgccccgucgccgaguccggcgccaccaagaccucccgcgucuacggcuucaucggccucugcuggcuccucgccgcccuccucggcaugcucccccuccucggcuggaacugccucugcgccuucgaccgcugcuccucccuccucccccucuacuccaagcgcuacauccucuucugccucgucaucuucgccggcguccucgccaccaucaugggccucuacggcgccaucuuccgccucguccaggccuccggccagaaggccccccgccccgccgcccgccgcaaggcccgccgccuccucaagaccguccucaugauccuccucgccuuccucgucugcuggggcccccucuucggccuccuccucgccgacgucuucggcuccaaccucugggcccaggaguaccuccgcggcauggacuggauccucgcccucgccguccucaacuccgccgucaaccccaucaucuacuccuuccgcucccgcgaggucugccgcgccguccucuccuuccucugcugcggcugccuccgccucggcaugcgcggccccggcgacugccucgcccgcgccgucgaggcccacuccggcgccuccaccaccgacuccucccuccgcccccgcgacuccuuccgcggcucccgcucccucuccuuccgcaugcgcgagccccucuccuccaucuccuccguccgcuccaucuga

SEQ ID NO: 49074 - RNA, 1197 nt, Artificial Sequence
  derived and/or modified sequence opt2 from S1PR5__Homo_sapiens__NP_001159687
auggaguccggccuccuccgccccgcccccgucuccgaggucaucguccuccacuacaacuacaccggcaagcuccgcggcgcccgcuaccagcccggcgccggccuccgcgccgacgccgucgucugccucgccgucugcgccuucaucguccucgagaaccucgccguccuccucguccucggccgccacccccgcuuccacgcccccauguuccuccuccucggcucccucacccucuccgaccuccucgccggcgccgccuacgccgccaacauccuccucuccggcccccucacccucaagcucucccccgcccucugguucgcccgcgagggcggcgucuucgucgcccucaccgccuccguccucucccuccucgccaucgcccucgagcgcucccucaccauggcccgccgcggccccgcccccgucuccucccgcggccgcacccucgccauggccgccgccgccuggggcgucucccuccuccucggccuccuccccgcccucggcuggaacugccucggccgccucgacgccugcuccaccguccucccccucuacgccaaggccuacguccucuucugcguccucgccuucgucggcauccucgccgccaucugcgcccucuacgcccgcaucuacugccagguccgcgccaacgcccgccgccuccccgcccgccccggcaccgccggcaccaccuccacccgcgcccgccgcaagccccgcucccucgcccuccuccgcacccucuccgucguccuccucgccuucgucgccugcuggggcccccucuuccuccuccuccuccucgacgucgccugccccgcccgcaccugccccguccuccuccaggccgaccccuuccucggccucgccauggccaacucccuccucaaccccaucaucuacacccucaccaaccgcgaccuccgccacgcccuccuccgccucgucugcugcggccgccacuccugcggccgcgaccccuccggcucccagcaguccgccuccgccgccgaggccuccggcggccuccgccgcugccucccccccggccucgacggcuccuucuccggcuccgagcgcuccuccccccagcgcgacggccucgacaccuccggcuccaccggcucccccggcgcccccaccgccgcccgcacccucgucuccgagcccgccgccgacuga

SEQ ID NO: 49075 - RNA, 369 nt, Artificial Sequence
  derived and/or modified sequence opt2 from SAA1__Homo_sapiens__NP_001171477
augaagcuccucaccggccucgucuucugcucccucguccucggcgucuccucccgcuccuucuucuccuuccucggcgaggccuucgacggcgcccgcgacauguggcgcgccuacuccgacaugcgcgaggccaacuacaucggcuccgacaaguacuuccacgcccgcggcaacuacgacgccgccaagcgcggccccggcggcgccugggccgccgaggucaucuccgacgcccgcgagaacauccagcgcuucuucggccacggcgccgaggacucccucgccgaccaggccgccaacgaguggggccgcuccggcaaggaccccaaccacuuccgccccgccggccuccccgagaaguacuga

SEQ ID NO: 49076 - RNA, 252 nt, Artificial Sequence
  derived and/or modified sequence opt2 from SAA2__Homo_sapiens__NP_001120852
augaagcuccucaccggccucgucuucugcucccucguccucuccgucuccucccgcuccuucuucuccuuccucggcgaggccuucgacggcgcccgcgacauguggcgcgccuacuccgacaugcgcgaggccaacuacaucggcuccgacaaguacuuccacgcccgcggcaacuacgacgccgccaagcgcggccccggcggcgccugggccgccgaggucaucucccucuucuccgccgagcucuga

SEQ ID NO: 49077 - RNA, 393 nt, Artificial Sequence
  derived and/or modified sequence opt2 from SAA4__Homo_sapiens__NP_006503
augcgccucuucaccggcaucgucuucugcucccucgucaugggcgucaccuccgaguccuggcgcuccuucuucaaggaggcccuccagggcgucggcgacaugggccgcgccuacugggacaucaugaucuccaaccaccagaacuccaaccgcuaccucuacgcccgcggcaacuacgacgccgcccagcgcggccccggcggcgucugggccgccaagcucaucucccgcucccgcgucuaccuccagggccucaucgacugcuaccucuucggcaacuccuccaccguccucgaggacuccaaguccaacgagaaggccgaggaguggggccgcuccggcaaggaccccgaccgcuuccgccccgacggccuccccaagaaguacuga

SEQ ID NO: 49078 - RNA, 1425 nt, Artificial Sequence
  derived and/or modified sequence opt2 from SAAL1__Homo_sapiens__NP_612430
auggaccgcaaccccuccccccccccccccggccgcgacaaggaggaggaggaggaggucgccggcggcgacugcaucggcuccaccgucuacuccaagcacuggcucuucggcguccucuccggccucauccagaucgucucccccgagaacaccaaguccuccuccgacgacgaggagcagcucaccgagcucgacgaggagauggagaacgagaucugccgcgucugggacauguccauggacgaggacgucgcccucuuccuccaggaguucaacgcccccgacaucuucaugggcguccucgccaaguccaagugcccccgccuccgcgagaucugcgucggcauccucggcaacauggccugcuuccaggagaucugcgucuccaucuccuccgacaagaaccucggccagguccuccuccacugccucuacgacuccgacccccccacccuccucgagaccucccgccuccuccucaccugccucucccaggccgaggucgccuccgucugggucgagcgcauccaggagcaccccgccaucuacgacuccaucugcuucaucauguccuccuccaccaacgucgaccuccucgucaaggucggcgaggucgucgacaagcucuucgaccucgacgagaagcucaugcucgaguggguccgcaacggcgccgcccagccccucgaccagccccaggaggaguccgaggagcagcccgucuuccgccucguccccugcauccucgaggccgccaagcagguccgcuccgagaaccccgaguggcucgacgucuacaugcacauccuccagcuccucaccaccgucgacgacggcauccaggccaucguccacugccccgacaccggcaaggacaucuggaaccuccucuucgaccucgucugccacgaguucugccaguccgacgacccccccaucauccuccaggagcagaagaccguccucgccuccgucuucuccguccucuccgccaucuacgccucccagaccgagcaggaguaccucaagaucgagaaggucgaccucccccucaucgacucccucauccgcguccuccagaacauggagcagugccagaagaagcccgagaacuccgccgaguccaacaccgaggagaccaagcgcaccgaccucacccaggacgacuuccaccucaagauccucaaggacauccucugcgaguuccucuccaacaucuuccaggcccucaccaaggagaccgucgcccagggcgucaaggagggccagcucuccaagcagaagugcuccuccgccuuccagaaccuccuccccuucuacucccccgucgucgaggacuucaucaagauccuccgcgaggucgacaaggcccucgccgacgaccucgagaagaacuuccccucccucaagguccagaccuga

SEQ ID NO: 49079 - RNA, 1077 nt, Artificial Sequence
  derived and/or modified sequence opt2 from SAC3D1__Homo_sapiens__NP_037431
augcccggcugcgagcuccccgucggcaccugccccgacaugugccccgccgccgagcgcgcccagcgcgagcgcgagcaccgccuccaccgccucgaggucguccccggcugccgccaggaccccccccgcgccgacccccagcgcgccgucaaggaguacucccgccccgccgccggcaagccccgccccccccccucccagcuccgcccccccuccguccuccucgccaccguccgcuaccucgccggcgaggucgccgaguccgccgacaucgcccgcgccgaggucgccuccuucgucgccgaccgccuccgcgccguccuccucgaccucgcccuccagggcgccggcgacgccgaggccgccgucguccucgaggccgcccucgccacccuccucaccgucgucgcccgccucggccccgacgccgcccgcggccccgccgaccccguccuccuccaggcccagguccaggagggcuucggcucccuccgccgcugcuacgcccgcggcgccggcccccacccccgccagcccgccuuccagggccucuuccuccucuacaaccucggcuccgucgaggcccuccacgagguccuccagcuccccgccgcccuccgcgccugccccccccuccgcaaggcccucgccgucgacgccgccuuccgcgagggcaacgccgcccgccucuuccgccuccuccagacccuccccuaccuccccuccugcgccguccagugccacgucggccacgcccgccgcgaggcccucgcccgcuucgcccgcgccuucuccacccccaagggccagacccucccccucggcuucauggucaaccuccucgcccucgacggccuccgcgaggcccgcgaccucugccaggcccacggccucccccucgacggcgaggagcgcgucgucuuccuccgcggccgcuacgucgaggagggccucccccccgccuccaccugcaagguccucgucgaguccaagcuccgcggccgcacccucgaggaggucgucauggccgaggaggaggacgagggcaccgaccgccccggcucccccgccuga

SEQ ID NO: 49080 - RNA, 1764 nt, Artificial Sequence
  derived and/or modified sequence opt2 from SACM1L__Homo_sapiens__NP_054735
auggccaccgccgccuacgagcagcucaagcuccacaucacccccgagaaguucuacgucgaggccugcgacgacggcgccgacgacguccucaccaucgaccgcgucuccaccgaggucacccucgccgucaagaaggacgucccccccuccgccgucacccgccccaucuucggcauccucggcaccauccaccucgucgccggcaacuaccucaucgucaucaccaagaagaucaaggucggcgaguucuucucccacgucgucuggaaggccaccgacuucgacguccucuccuacaagaagaccaugcuccaccucaccgacauccagcuccaggacaacaagaccuuccucgccaugcucaaccacguccucaacgucgacggcuucuacuucuccaccaccuacgaccucacccacacccuccagcgccucuccaacaccucccccgaguuccaggagaugucccuccucgagcgcgccgaccagcgcuucgucuggaacggccaccuccuccgcgagcucuccgcccagcccgagguccaccgcuucgcccuccccguccuccacggcuucaucaccaugcacuccugcuccaucaacggcaaguacuucgacuggauccucaucucccgccgcuccugcuuccgcgccggcguccgcuacuacguccgcggcaucgacuccgagggccacgccgccaacuucgucgagaccgagcagaucguccacuacaacggcuccaaggccuccuucguccagacccgcggcuccauccccgucuucuggucccagcgccccaaccucaaguacaagccccucccccagaucuccaaggucgccaaccacauggacggcuuccagcgccacuucgacucccaggucaucaucuacggcaagcaggucaucaucaaccucaucaaccagaagggcuccgagaagccccucgagcagaccuucgccaccauggucuccucccucggcuccggcaugaugcgcuacaucgccuucgacuuccacaaggagugcaagaacaugcgcugggaccgccucuccauccuccucgaccaggucgccgagaugcaggacgagcucuccuacuuccucgucgacuccgccggccaggucgucgccaaccaggagggcgucuuccgcuccaacugcauggacugccucgaccgcaccaacgucauccagucccuccucgcccgccgcucccuccaggcccagcuccagcgccucggcguccuccacgucggccagaagcucgaggagcaggacgaguucgagaagaucuacaagaacgccugggccgacaacgccaacgccugcgccaagcaguacgccggcaccggcgcccucaagaccgacuucacccgcaccggcaagcgcacccaccucggccucaucauggacggcuggaacuccaugauccgcuacuacaagaacaacuucuccgacggcuuccgccaggacuccaucgaccucuuccucggcaacuacuccgucgacgagcucgagucccacuccccccucuccgucccccgcgacuggaaguuccucgcccuccccaucaucauggucgucgccuucuccaugugcaucaucugccuccucauggccggcgacaccuggaccgagacccucgccuacguccucuucuggggcgucgccuccaucggcaccuucuucaucauccucuacaacggcaaggacuucgucgacgccccccgccucguccagaaggagaagaucgacuga

SEQ ID NO: 49081 - RNA, 13299 nt, Artificial Sequence
  derived and/or modified sequence opt2 from SACS__Homo_sapiens__NP_001264984
auggcccccuaccagggccccgcccucuacgucuacaacaacgccgucuucacccccgaggacuggcacggcauccaggagaucgcccgcucccgcaagaaggacgacccccucaaggucggccgcuucggcaucggcuucaacuccgucuaccacaucaccgacguccccugcaucuucuccggcgaccagaucggcaugcucgacccccaccagacccucuucggcccccacgaguccggccagugcuggaaccucaaggacgacuccaaggagaucuccgagcucuccgaccaguucgcccccuucgucggcaucuucggcuccaccaaggagaccuucaucaacggcaacuuccccggcaccuucuuccgcuucccccuccgccuccagcccucccagcucuccuccaaccucuacaacaagcagaagguccucgagcucuucgaguccuuccgcgccgacgccgacaccguccuccucuuccucaaguccguccaggacgucucccucuacguccgcgaggccgacggcaccgagaagcucgucuuccgcgucaccuccuccgaguccaaggcccucaagcacgagcgccccaacuccaucaagauccucggcaccgccaucuccaacuacugcaagaagacccccuccaacaacaucaccugcgucaccuaccacgucaacaucguccucgaggaggaguccaccaaggacgcccagaagaccuccuggcucgucugcaacuccgucggcggccgcggcaucuccuccaagcucgacucccucgccgacgagcucaaguucguccccaucaucggcaucgccaugccccucuccucccgcgacgacgaggccaagggcgccaccuccgacuucuccggcaaggccuucugcuuccucccccucccccccggcgaggaguccuccaccggccuccccguccacaucuccggcuucuucggccucaccgacaaccgccgcuccaucaaguggcgcgagcucgaccaguggcgcgaccccgccgcccucuggaacgaguuccucgucaugaacgucguccccaaggccuacgccacccucauccucgacuccaucaagcgccucgagauggagaaguccuccgacuucccccucuccgucgacgucaucuacaagcucuggcccgaggccuccaaggucaagguccacuggcagcccguccucgagccccucuucuccgagcuccuccagaacgccgucaucuacuccaucuccugcgacuggguccgccucgagcaggucuacuucuccgagcucgacgagaaccucgaguacaccaagaccguccucaacuaccuccaguccuccggcaagcagaucgccaagguccccggcaacgucgacgccgccguccagcucaccgccgccuccggcaccacccccguccgcaaggucacccccgccuggguccgccagguccuccgcaagugcgcccaccucggcugcgccgaggagaagcuccaccuccucgaguucguccucuccgaccaggccuacuccgagcuccucggccucgagcuccucccccuccagaacggcaacuucguccccuucuccuccuccgucuccgaccaggacgucaucuacaucaccuccgccgaguacccccgcucccucuuccccucccucgagggccgcuucauccucgacaaccucaagccccaccucgucgccgcccucaaggaggccgcccagacccgcggccgccccugcacccagcuccagcuccucaaccccgagcgcuucgcccgccucaucaaggaggucaugaacaccuucuggcccggccgcgagcucaucguccagugguaccccuucgacgagaaccgcaaccaccccuccgucuccuggcucaagauggucuggaagaaccucuacauccacuucuccgaggaccucacccucuucgacgagaugccccucaucccccgcaccauccucgaggagggccagaccugcgucgagcucauccgccuccgcauccccucccucgucauccucgacgacgaguccgaggcccagcuccccgaguuccucgccgacaucguccagaagcucggcggcuucguccucaagaagcucgacgccuccauccagcacccccucaucaagaaguacauccacuccccccuccccuccgccguccuccagaucauggagaagaugccccuccagaagcucugcaaccagaucaccucccuccuccccacccacaaggacgcccuccgcaaguuccucgccucccucaccgacuccuccgagaaggagaagcgcaucauccaggagcucgccaucuucaagcgcaucaaccacuccuccgaccagggcaucuccuccuacaccaagcucaagggcugcaagguccuccaccacaccgccaagcuccccgccgaccuccgccucuccaucuccgucaucgacuccuccgacgaggccaccauccgccucgccaacaugcucaagaucgagcagcucaagaccaccuccugccucaagcucguccucaaggacaucgagaacgccuucuacucccacgaggaggucacccagcucaugcucuggguccucgagaaccucuccucccucaagaacgagaaccccaacguccucgaguggcucaccccccucaaguucauccagaucucccaggagcagauggucuccgccggcgagcucuucgaccccgacaucgagguccucaaggaccucuucugcaacgaggagggcaccuacuucccccccuccgucuucaccucccccgacauccuccacucccuccgccagaucggccucaagaacgaggccucccucaaggagaaggacgucguccaggucgccaagaagaucgaggcccuccaggucggcgccugccccgaccaggacguccuccucaagaaggccaagacccuccuccucguccucaacaagaaccacacccuccuccaguccuccgagggcaagaugacccucaagaagaucaaguggguccccgccugcaaggagcgcccccccaacuaccccggcucccucgucuggaagggcgaccucugcaaccucugcgccccccccgacaugugcgacgucggccacgccauccucaucggcuccucccucccccucgucgaguccauccacgucaaccucgagaaggcccucggcaucuucaccaagcccucccucuccgccguccucaagcacuucaagaucgucgucgacugguacuccuccaagaccuucuccgacgaggacuacuaccaguuccagcacauccuccucgagaucuacggcuucaugcacgaccaccucaacgagggcaaggacuccuuccgcgcccucaaguuccccugggucuggaccggcaagaaguucugcccccucgcccaggccgucaucaagcccauccacgaccucgaccuccagcccuaccuccacaacguccccaagaccauggccaaguuccaccagcucuucaaggucugcggcuccaucgaggagcucaccuccgaccacaucuccauggucauccagaagaucuaccucaaguccgaccaggaccucuccgagcaggaguccaagcagaaccuccaccucaugcucaacaucauccgcuggcucuacuccaaccagauccccgccucccccaacacccccguccccauccaccacuccaagaaccccuccaagcucaucaugaagcccauccacgagugcugcuacugcgacaucaaggucgacgaccucaacgaccuccucgaggacuccgucgagcccaucauccucguccacgaggacauccccaugaagaccgccgaguggcucaagguccccugccucuccacccgccucaucaaccccgagaacaugggcuucgagcaguccggccagcgcgagccccucaccguccgcaucaagaacauccucgaggaguaccccuccgucuccgacaucuucaaggagcuccuccagaacgccgacgacgccaacgccaccgagugcuccuuccucaucgacaugcgccgcaacauggacauccgcgagaaccuccucgaccccggcauggccgccugccacggccccgcccucugguccuucaacaacucccaguucuccgacuccgacuucgucaacaucacccgccucggcgagucccucaagcgcggcgaggucgacaaggucggcaaguucggccucggcuucaacuccgucuaccacaucaccgacauccccaucaucaugucccgcgaguucaugaucauguucgaccccaacaucaaccacaucuccaagcacaucaaggacaaguccaaccccggcaucaagaucaacugguccaagcagcagaagcgccuccgcaaguuccccaaccaguucaagcccuucaucgacgucuucggcugccagcucccccucaccgucgaggcccccuacuccuacaacggcacccucuuccgccucuccuuccgcacccagcaggaggccaaggucuccgaggucuccuccaccugcuacaacaccgccgacaucuacucccucgucgacgaguucucccucugcggccaccgccucaucaucuucacccaguccgucaaguccauguaccucaaguaccucaagaucgaggagaccaaccccucccucgcccaggacaccgucaucaucaagaagaaguccugcuccuccaaggcccucaacacccccguccucuccguccucaaggaggccgccaagcucaugaagaccugcuccuccuccaacaagaagcuccccuccgacgagcccaaguccuccugcauccuccagaucaccgucgaggaguuccaccacgucuuccgccgcaucgccgaccuccaguccccccucuuccgcggccccgacgacgaccccgccgcccucuucgagauggccaaguccggccaguccaagaagcccuccgacgagcucucccagaagaccgucgagugcaccaccuggcuccucugcaccugcauggacaccggcgaggcccucaaguucucccucuccgaguccggccgccgccucggccucguccccugcggcgccgucggcguccagcucuccgagauccaggaccagaaguggaccgucaagccccacaucggcgaggucuucugcuaccucccccuccgcaucaagaccggccuccccguccacaucaacggcugcuucgccgucaccuccaaccgcaaggagaucuggaagaccgacaccaagggccgcuggaacaccaccuucaugcgccacgucaucgucaaggccuaccuccagguccucuccguccuccgcgaccucgccaccuccggcgagcucauggacuacaccuacuacgccgucuggcccgaccccgaccucguccacgacgacuucuccgucaucugccagggcuucuacgaggacaucgcccacggcaagggcaaggagcucaccaaggucuucuccgacggcuccaccugggucuccaugaagaacguccgcuuccucgacgacuccauccucaagcgccgcgacgucggcuccgccgccuucaagaucuuccucaaguaccucaagaagaccggcuccaagaaccucugcgccgucgagcuccccuccuccgucaagcucggcuucgaggaggccggcugcaagcagauccuccucgagaacaccuucuccgagaagcaguucuucuccgaggucuucuuccccaacauccaggagaucgaggccgagcuccgcgacccccucaugaucuucguccucaacgagaaggucgacgaguucuccggcguccuccgcgucacccccugcauccccugcucccucgagggccacccccucguccuccccucccgccucauccaccccgagggccgcgucgccaagcucuucgacaucaaggacggccgcuuccccuacggcuccacccaggacuaccucaaccccaucauccucaucaagcucguccagcucggcauggccaaggacgacauccucugggacgacaugcucgagcgcgccgucuccgucgccgagaucaacaaguccgaccacgucgccgccugccuccgcuccuccauccuccucucccucaucgacgagaagcucaagauccgcgacccccgcgccaaggacuucgccgccaaguaccagaccauccgcuuccuccccuuccucaccaagcccgccggcuucucccucgacuggaagggcaacuccuucaagcccgagaccauguucgccgccaccgaccucuacaccgccgagcaccaggacaucgucugccuccuccagcccauccucaacgagaacucccacuccuuccgcggcugcggcuccgucucccucgccgucaaggaguuccucggccuccucaagaagcccaccgucgaccucgucaucaaccagcucaaggaggucgccaaguccgucgacgacggcaucacccucuaccaggagaacaucaccaacgccugcuacaaguaccuccacgaggcccucaugcagaacgagaucaccaagauguccaucaucgacaagcucaagcccuucuccuucauccucgucgagaacgccuacgucgacuccgagaaggucuccuuccaccucaacuucgaggccgcccccuaccucuaccagcuccccaacaaguacaagaacaacuuccgcgagcucuucgagaccgucggcguccgccaguccugcaccgucgaggacuucgcccucguccucgaguccaucgaccaggagcgcggcaccaagcagaucaccgaggagaacuuccagcucugccgccgcaucaucuccgagggcaucuggucccucauccgcgagaagaagcaggaguucugcgagaagaacuacggcaagauccuccuccccgacaccaaccucaugcuccuccccgccaagucccucugcuacaacgacugccccuggaucaaggucaaggacaccaccgucaaguacugccacgccgacaucccccgcgaggucgccgucaagcucggcgccguccccaagcgccacaaggcccucgagcgcuacgccuccaacgucugcuucaccacccucggcaccgaguucggccagaaggagaagcucaccucccgcaucaaguccauccucaacgccuaccccuccgagaaggagaugcucaaggagcuccuccagaacgccgacgacgccaaggccaccgagaucugcuucgucuucgacccccgccagcaccccgucgaccgcaucuucgacgacaagugggccccccuccagggccccgcccucugcgucuacaacaaccagcccuucaccgaggacgacguccgcggcauccagaaccucggcaagggcaccaaggagggcaaccccuacaagaccggccaguacggcaucggcuucaacuccgucuaccacaucaccgacugccccuccuucaucuccggcaacgacauccucugcaucuucgacccccacgcccgcuacgcccccggcgccaccuccaucucccccggccgcauguuccgcgaccucgacgccgacuuccgcacccaguucuccgacguccucgaccucuaccucggcacccacuucaagcucgacaacugcaccauguuccgcuucccccuccgcaacgccgagauggccaaggucuccgagaucuccuccguccccgccuccgaccgcaugguccagaaccuccucgacaagcuccgcuccgacggcgccgagcuccucauguuccucaaccacauggagaagaucuccaucugcgagaucgacaaguccaccggcgcccucaacguccucuacuccgucaagggcaagaucaccgacggcgaccgccucaagcgcaagcaguuccacgccuccgucaucgacuccgucaccaagaagcgccagcucaaggacauccccguccagcagaucaccuacaccauggacaccgaggacuccgagggcaaccucaccaccuggcucaucugcaaccgcuccggcuucuccuccauggagaaggucuccaaguccgucaucuccgcccacaagaaccaggacaucacccucuucccccgcggcggcgucgccgccugcaucacccacaacuacaagaagccccaccgcgccuucugcuuccucccccucucccucgagaccggccuccccuuccacgucaacggccacuucgcccucgacuccgcccgccgcaaccucuggcgcgacgacaacggcgucggcguccgcuccgacuggaacaacucccucaugaccgcccucaucgcccccgccuacgucgagcuccucauccagcucaagaagcgcuacuuccccggcuccgaccccacccucuccguccuccagaacacccccauccacgucgucaaggacacccucaagaaguuccucuccuucuuccccgucaaccgccucgaccuccagcccgaccucuacugccucgucaaggcccucuacaacugcauccacgaggacaugaagcgccuccuccccgucguccgcgcccccaacaucgacggcuccgaccuccacuccgccgucaucaucaccuggaucaacauguccaccuccaacaagacccgccccuucuucgacaaccuccuccaggacgagcuccagcaccucaagaacgccgacuacaacaucaccacccgcaagaccgucgccgagaacgucuaccgccucaagcaccuccuccucgagaucggcuucaaccucgucuacaacugcgacgagaccgccaaccucuaccacugccucaucgacgccgacauccccgucuccuacgucacccccgccgacauccgcuccuuccucaugaccuucuccucccccgacaccaacugccacaucggcaagcuccccugccgccuccagcagaccaaccucaagcucuuccacucccucaagcuccucgucgacuacugcuucaaggacgccgaggagaacgagaucgaggucgagggccucccccuccucaucacccucgacuccguccuccagaccuucgacgccaagcgccccaaguuccucaccaccuaccacgagcucauccccucccgcaaggaccucuucaugaacacccucuaccucaaguacuccaacauccuccucaacugcaaggucgccaaggucuucgacaucuccuccuucgccgaccuccucuccuccguccucccccgcgaguacaagaccaaguccugcaccaaguggaaggacaacuucgccuccgaguccuggcucaagaacgccuggcacuucaucuccgaguccgucuccgucaaggaggaccaggaggagaccaagcccaccuucgacaucgucgucgacacccucaaggacugggcccuccuccccggcaccaaguucaccgucuccgccaaccagcucgucguccccgagggcgacguccuccucccccucucccucaugcacaucgccgucuuccccaacgcccaguccgacaaggucuuccacgcccucaugaaggccggcugcauccagcucgcccucaacaagaucugcuccaaggacuccgccuucgucccccuccucuccugccacaccgccaacaucgagucccccaccuccauccucaaggcccuccacuacaugguccagaccuccaccuuccgcgccgagaagcucgucgagaacgacuucgaggcccuccucauguacuucaacugcaaccucaaccaccucaugucccaggacgacaucaagauccucaagucccuccccugcuacaaguccaucuccggccgcuacgucuccaucggcaaguucggcaccugcuacguccucaccaaguccauccccuccgccgaggucgagaaguggacccaguccuccuccuccgccuuccucgaggagaagauccaccucaaggagcucuacgaggucaucggcugcguccccgucgacgaccucgaggucuaccucaagcaccuccuccccaagaucgagaaccucuccuacgacgccaagcucgagcaccucaucuaccucaagaaccgccucuccuccgccgaggagcucuccgagaucaaggagcagcucuucgagaagcucgagucccuccucaucauccacgacgccaacucccgccucaagcaggccaagcacuucuacgaccgcaccguccgcgucuucgaggucaugcuccccgagaagcucuucauccccaacgacuucuucaagaagcucgagcagcucaucaagcccaagaaccacgucaccuucaugaccuccugggucgaguuccuccgcaacaucggccucaaguacauccucucccagcagcagcuccuccaguucgccaaggagaucuccguccgcgccaacaccgagaacugguccaaggagacccuccagaacaccgucgacauccuccuccaccacaucuuccaggagcgcauggaccuccucuccggcaacuuccucaaggagcucucccucauccccuuccucugccccgagcgcgcccccgccgaguucauccgcuuccacccccaguaccaggaggucaacggcacccucccccucaucaaguucaacggcgcccaggucaaccccaaguucaagcagugcgacguccuccagcuccucuggaccuccugccccauccuccccgagaaggccaccccccucuccaucaaggagcaggagggcuccgaccucggcccccaggagcagcucgagcagguccucaacaugcucaacgucaaccucgaccccccccucgacaaggucaucaacaacugccgcaacaucugcaacaucaccacccucgacgaggagauggucaagacccgcgccaagguccuccgcuccaucuacgaguuccucuccgccgagaagcgcgaguuccgcuuccagcuccgcggcgucgccuucgucauggucgaggacggcuggaagcuccucaagcccgaggaggucgucaucaaccucgaguacgaguccgacuucaagcccuaccucuacaagcucccccucgagcucggcaccuuccaccagcucuucaagcaccucggcaccgaggacaucaucuccaccaagcaguacgucgagguccucucccgcaucuucaagaacuccgagggcaagcagcucgaccccaacgagaugcgcaccgucaagcgcgucgucuccggccucuuccgcucccuccagaacgacuccgucaagguccgcuccgaccucgagaacguccgcgaccucgcccucuaccuccccucccaggacggccgccucgucaaguccuccauccucgucuucgacgacgccccccacuacaagucccgcauccagggcaacaucggcguccagaugcucgucgaccucucccagugcuaccucggcaaggaccacggcuuccacaccaagcucaucaugcucuucccccagaagcuccgcccccgccuccucuccuccauccucgaggagcagcucgacgaggagacccccaaggucugccaguucggcgcccucugcucccuccagggccgccuccagcuccuccucuccuccgagcaguucaucaccggccucauccgcaucaugaagcacgagaacgacaacgccuuccucgccaacgaggagaaggccauccgccucugcaaggcccuccgcgagggccucaaggucuccugcuucgagaagcuccagaccacccuccgcgucaagggcuucaaccccaucccccacucccgcuccgagaccuucgccuuccucaagcgcuucggcaacgccgucauccuccucuacauccagcacuccgacuccaaggacaucaacuuccuccucgcccucgccaugacccucaaguccgccaccgacaaccucaucuccgacaccuccuaccucaucgccaugcucggcugcaacgacaucuaccgcaucggcgagaagcucgacucccucggcgucaaguacgacuccuccgagcccuccaagcucgagcuccccaugcccggcacccccauccccgccgagauccacuacacccuccucauggaccccaugaacgucuucuaccccggcgaguacgucggcuaccucgucgacgccgagggcggcgacaucuacggcuccuaccagcccaccuacaccuacgccaucaucguccaggaggucgagcgcgaggacgccgacaacuccuccuuccucggcaagaucuaccagaucgacaucggcuacuccgaguacaagaucgucuccucccucgaccucuacaaguucucccgccccgaggaguccucccagucccgcgacuccgcccccuccacccccaccucccccaccgaguuccucacccccggccuccgcuccauccccccccucuucuccggccgcgagucccacaagaccuccuccaagcaccagucccccaagaagcucaaggucaacucccuccccgagauccucaaggaggucaccuccgucgucgagcaggccuggaagcuccccgaguccgagcgcaagaagaucauccgccgccucuaccucaaguggcaccccgacaagaaccccgagaaccacgacaucgccaacgaggucuucaagcaccuccagaacgagaucaaccgccucgagaagcaggccuuccucgaccagaacgccgaccgcgccucccgccgcaccuucuccaccuccgccucccgcuuccaguccgacaaguacuccuuccagcgcuucuacaccuccuggaaccaggaggccaccucccacaaguccgagcgccagcagcagaacaaggagaagugcccccccuccgccggccagaccuacucccagcgcuucuucgucccccccaccuucaaguccgucggcaaccccgucgaggcccgccgcuggcuccgccaggcccgcgccaacuucuccgccgcccgcaacgaccuccacaagaacgccaacgagugggucugcuucaagugcuaccucuccaccaagcucgcccucaucgccgccgacuacgccguccgcggcaaguccgacaaggacgucaagcccaccgcccucgcccagaagaucgaggaguacucccagcagcucgagggccucaccaacgacguccacacccucgaggccuacggcgucgacucccucaagacccgcuaccccgaccuccuccccuucccccagauccccaacgaccgcuucaccuccgaggucgccaugcgcgucauggagugcaccgccugcaucaucaucaagcucgagaacuucaugcagcagaaggucuga

SEQ ID NO: 49082 - RNA, 900 nt, Artificial Sequence
  derived and/or modified sequence opt2 from SAE1__Homo_sapiens__NP_001139185
auggucgagaaggaggaggccggcggcggcaucuccgaggaggaggccgcccaguacgaccgccagauccgccucuggggccucgaggcccagaagcgccuccgcgccucccgcguccuccucgucggccucaagggccucggcgccgagaucgccaagaaccucauccucgccggcgucaagggccucaccaugcucgaccacgagcaggucacccccgaggaccccggcgcccaguuccucauccgcaccggcuccgucggccgcaaccgcgccgaggccucccucgagcgcgcccagaaccucaaccccauggucgacgucaaggucgacaccgaggacaucgagaagaagcccgaguccuucuucacccaguucgacgccgucugccucaccugcugcucccgcgacgucaucgucaaggucgaccagaucugccacaagaacuccaucaaguucuucaccggcgacgucuucggcuaccacggcuacaccuucgccaaccucggcgagcacgaguucgucgaggagaagaccaaggucgccaaggucucccagggcgucgaggacggccccgacaccaagcgcgccaagcucgacuccuccgagaccaccauggucaagaagaaggucgucuucugccccgucaaggaggcccucgaggucgacugguccuccgagaaggccaaggccgcccucaagcgcaccaccuccgacuacuuccuccuccagggccccgucuccgccggccccuccucccagcagcuccuccuccuccgcuggcacgagggcgagugggacugcggcguccccuggccccaggucaacucccgcuucggcuccccccgcgacgccaacugcuccaugcccaccugcauccccugcccccuccccuccuga

SEQ ID NO: 49083 - RNA, 2862 nt, Artificial Sequence
  derived and/or modified sequence opt2 from SAFB2__Homo_sapiens__NP_055464
auggccgagacccuccccggcuccggcgacuccggccccggcaccgccucccucggccccggcgucgccgagaccggcacccgccgccucuccgagcuccgcgucaucgaccuccgcgccgagcucaagaagcgcaaccucgacaccggcggcaacaaguccguccucauggagcgccucaagaaggccgucaaggaggagggccaggaccccgacgagaucggcaucgagcucgaggccaccuccaagaaguccgccaagcgcugcgucaagggccucaagauggaggaggagggcaccgaggacaacggccucgaggacgacucccgcgacggccaggaggacauggaggccucccucgagaaccuccagaacaugggcaugauggacauguccguccucgacgagaccgaggucgccaacuccuccgcccccgacuucggcgaggacggcaccgacggccuccucgacuccuucugcgacuccaaggaguacgucgccgcccagcuccgccagcuccccgcccagccccccgagcacgccgucgacggcgagggcuucaagaacacccucgagaccuccucccucaacuucaaggucacccccgacaucgaggagucccuccucgagcccgagaacgagaagauccucgacauccucggcgagaccugcaaguccgagcccgucaaggaggaguccuccgagcucgagcagcccuucgcccaggacaccuccuccgucggccccgaccgcaagcucgccgaggaggaggaccucuucgacuccgcccaccccgaggagggcgaccucgaccucgccuccgaguccaccgcccacgcccaguccuccaaggccgacucccuccucgccgucgucaagcgcgagcccgccgagcagcccggcgacggcgagcgcaccgacugcgagcccgucggccucgagcccgccgucgagcaguccuccgccgccuccgagcucgccgaggccuccuccgaggagcucgccgaggcccccaccgaggcccccucccccgaggcccgcgacuccaaggaggacggccgcaaguucgacuucgacgccugcaacgaggucccccccgcccccaaggaguccuccaccuccgagggcgccgaccagaagauguccuccuucaaggaggagaaggacaucaagcccaucaucaaggacgagaagggccgcgucggcuccggcuccggccgcaaccucugggucuccggccucuccuccaccacccgcgccaccgaccucaagaaccucuucuccaaguacggcaaggucgucggcgccaaggucgucaccaacgcccgcucccccggcgcccgcugcuacggcuucgucaccauguccaccuccgacgaggccaccaagugcaucucccaccuccaccgcaccgagcuccacggccgcaugaucuccgucgagaaggccaagaacgagcccgccggcaagaagcucuccgaccgcaaggagugcgaggucaagaaggagaagcucuccuccgucgaccgccaccacuccgucgagaucaagaucgagaagaccgucaucaagaaggaggagaagaucgagaagaaggaggagaagaagcccgaggacaucaagaaggaggagaaggaccaggacgagcucaagcccggccccaccaaccgcucccgcgucaccaaguccggcucccgcggcauggagcgcaccgucgucauggacaaguccaagggcgagcccgucaucuccgucaagaccaccucccgcuccaaggagcgcuccuccaagucccaggaccgcaaguccgaguccaaggagaagcgcgacauccucuccuucgacaagaucaaggagcagcgcgagcgcgagcgccagcgccagcgcgagcgcgagauccgcgagaccgagcgccgccgcgagcgcgagcagcgcgagcgcgagcagcgccucgaggccuuccacgagcgcaaggagaaggcccgccuccagcgcgagcgccuccagcucgagugccagcgccagcgccucgagcgcgagcgcauggagcgcgagcgccucgagcgcgagcgcaugcgcgucgagcgcgagcgccgcaaggagcaggagcgcauccaccgcgagcgcgaggagcuccgccgccagcaggagcagcuccgcuacgagcaggagcgccgccccggccgccgccccuacgaccucgaccgccgcgacgacgccuacuggcccgagggcaagcgcgucgccauggaggaccgcuaccgcgccgacuucccccgccccgaccaccgcuuccacgacuucgaccaccgcgaccgcggccaguaccaggaccacgccaucgaccgccgcgagggcucccgccccaugaugggcgaccaccgcgacggccagcacuacggcgacgaccgccacggccacggcggcccccccgagcgccacggccgcgacucccgcgacggcuggggcggcuacggcuccgacaagcgccucuccgagggccgcggccuccccccccccccccgcggcggccgcgacuggggcgagcacaaccagcgccucgaggagcaccaggcccgcgccuggcagggcgccauggacgccggcgccgccucccgcgagcacgcccgcuggcagggcggcgagcgcggccucuccggccccuccggccccggccacauggccucccgcggcggcgucgccggccgcggcggcuucgcccagggcggccacucccagggccacgucguccccggcggcggccucgagggcggcggcgucgccucccaggaccgcggcucccgcgucccccacccccacccccaccccccccccuacccccacuucacccgccgcuacuga

SEQ ID NO: 49084 - RNA, 2754 nt, Artificial Sequence
  derived and/or modified sequence opt2 from SAFB__Homo_sapiens__NP_001188267
auggccgagacccucuccggccucggcgacuccggcgccgccggcgccgccgcccucuccuccgccuccuccgagaccggcacccgccgccucuccgaccuccgcgucaucgaccuccgcgccgagcuccgcaagcgcaacgucgacuccuccggcaacaaguccguccucauggagcgccucaagaaggccaucgaggacgagggcggcaaccccgacgagaucgagaucaccuccgagggcaacaagaagaccuccaagcgcuccuccaagggccgcaagcccgaggaggagggcgucgaggacaacggccucgaggagaacuccggcgacggccaggaggacgucgagaccucccucgagaaccuccaggacaucgacaucauggacaucuccguccucgacgaggccgagaucgacaacggcuccgucgccgacugcgucgaggacgacgacgccgacaaccuccaggagucccucuccgacucccgcgagcucgucgagggcgagaugaaggagcuccccgagcagcuccaggagcacgccaucgaggacaaggagaccaucaacaaccucgacaccuccuccuccgacuucaccauccuccaggagaucgaggagcccucccucgagcccgagaacgagaagauccucgacauccucggcgagaccugcaaguccgagcccgucaaggaggaguccuccgagcucgagcagcccuucgcccaggacaccuccuccgucggccccgaccgcaagcucgccgaggaggaggaccucuucgacuccgcccaccccgaggagggcgaccucgaccucgccuccgaguccaccgcccacgcccaguccuccaaggccgacucccuccucgccgucgucaagcgcgagcccgccgagcagcccggcgacggcgagcgcaccgacugcgagcccgucggccucgagcccgccgucgagcaguccuccgccgccuccgagcucgccgaggccuccuccgaggagcucgccgaggcccccaccgaggcccccucccccgaggcccgcgacuccaaggaggacggccgcaaguucgacuucgacgccugcaacgaggucccccccgcccccaaggaguccuccaccuccgagggcgccgaccagaagauguccucccccgaggacgacuccgacaccaagcgccucuccaaggaggagaagggccgcuccuccugcggccgcaacuucugggucuccggccucuccuccaccacccgcgccaccgaccucaagaaccucuucuccaaguacggcaaggucgucggcgccaaggucgucaccaacgcccgcucccccggcgcccgcugcuacggcuucgucaccauguccaccgccgaggaggccaccaagugcaucaaccaccuccacaagaccgagcuccacggcaagaugaucuccgucgagaaggccaagaacgagcccgucggcaagaagaccuccgacaagcgcgacuccgacggcaagaaggagaaguccuccaacuccgaccgcuccaccaaccucaagcgcgacgacaagugcgaccgcaaggacgacgccaagaagggcgacgacggcuccggcgagaaguccaaggaccaggacgaccagaagcccggccccuccgagcgcucccgcgccaccaaguccggcucccgcggcaccgagcgcaccgucgucauggacaaguccaagggcguccccgucaucuccgucaagaccuccggcuccaaggagcgcgccuccaagucccaggaccgcaaguccgccucccgcgagaagcgcuccgucgucuccuucgacaaggucaaggagccccgcaagucccgcgacuccgagucccacucccgcguccgcgagcgcuccgagcgcgagcagcgcaugcaggcccagugggagcgcgaggagcgcgagcgccucgagaucgcccgcgagcgccucgccuuccagcgccagcgccucgagcgcgagcgcauggagcgcgagcgccucgagcgcgagcgcaugcacgucgagcacgagcgccgccgcgagcaggagcgcauccaccgcgagcgcgaggagcuccgccgccagcaggagcuccgcuacgagcaggagcgccgccccgccguccgccgccccuacgaccucgaccgccgcgacgacgccuacuggcccgaggccaagcgcgccgcccucgacgagcgcuaccacuccgacuucaaccgccaggaccgcuuccacgacuucgaccaccgcgaccgcggccgcuaccccgaccacuccgucgaccgccgcgagggcucccgcuccaugaugggcgagcgcgagggccagcacuaccccgagcgccacggcggccccgagcgccacggccgcgacucccgcgacggcuggggcggcuacggcuccgacaagcgcauguccgagggccgcggccuccccccccccccccgcggccgccgcgacuggggcgaccacggccgccgcgaggacgaccgcuccuggcagggcaccgccgacggcggcaugauggaccgcgaccacaagcgcuggcagggcggcgagcgcuccauguccggccacuccggccccggccacaugaugaaccgcggcggcauguccggccgcggcuccuucgcccccggcggcgccucccgcggccaccccaucccccacggcggcaugcagggcggcuucggcggccagucccgcggcucccgccccuccgacgcccgcuucacccgccgcuacuga

SEQ ID NO: 49085 - RNA, 2715 nt, Artificial Sequence
  derived and/or modified sequence opt2 from SAGE1__Homo_sapiens__NP_061136
augcaggccuccccccuccagaccucccagcccaccccccccgaggagcuccacgccgccgccuacgucuucaccaacgacggccagcagaugcgcuccgacgaggucaaccucgucgccaccggccaccaguccaagaagaagcacucccgcaaguccaagcgccacuccuccuccaagcgccgcaaguccauguccuccuggcucgacaagcaggaggacgccgccgucacccacuccaucugcgaggagcgcaucaacaacggccagcccgucgccgacaacguccucuccaccgccccccccuggcccgacgccaccaucgcccacaacauccgcgaggagcgcauggagaacggccagucccgcaccgacaagguccucuccaccgcccccccccagcucguccacauggccgccgccggcauccccuccauguccacccgcgaccuccacuccaccgucacccacaacauccgcgaggagcgcauggagaacggccagccccagcccgacaacguccucuccaccggccccaccggccucaucaacauggccgccacccccauccccgccauguccgcccgcgaccucuacgccaccgucacccacaacgucugcgagcagaagauggagaacguccagcccgcccccgacaacguccuccucacccuccgcccccgccgcaucaacaugaccgacaccggcaucucccccauguccacccgcgaccccuacgccaccaucaccuacaacguccccgaggagaagauggagaagggccagccccagcccgacaacauccucuccaccgccuccaccggccucaucaacgucgccggcgccggcacccccgccaucuccaccaacggccucuacuccaccgucccccacaacgucugcgaggagaagauggagaacgaccagccccagcccaacaacguccucuccaccguccagcccgucaucaucuaccucaccgccaccggcauccccggcaugaacacccgcgaccaguacgccaccaucacccacaacgucugcgaggagcgcgucgucaacaaccagccccuccccuccaacgcccucuccaccguccuccccggccucgccuaccucgccaccgccgacaugcccgccauguccacccgcgaccagcacgccaccaucauccacaaccuccgcgaggagaagaaggacaacucccagcccacccccgacaacguccucuccgccgucacccccgagcucaucaaccucgccggcgccggcaucccccccauguccacccgcgaccaguacgccaccgucaaccaccacguccacgaggcccgcauggagaacggccagcgcaagcaggacaacguccucuccaacguccucuccggccucaucaacauggccggcgccuccauccccgccauguccucccgcgaccucuacgccaccaucacccacuccguccgcgaggagaagauggaguccggcaagccccagaccgacaaggucaucuccaacgacgccccccagcucggccacauggccgccggcggcauccccuccauguccaccaaggaccucuacgccaccgucacccagaacguccacgaggagcgcauggagaacaaccagccccagcccuccuacgaccucuccaccguccuccccggccucaccuaccucaccgucgccggcauccccgccauguccacccgcgaccaguacgccaccgucacccacaacguccacgaggagaagaucaagaacggccaggccgccuccgacaacgucuucuccaccgucccccccgccuucaucaacauggccgccaccggcgucuccuccauguccacccgcgaccaguacgccgccgucacccacaacauccgcgaggagaagaucaacaacucccagcccgcccccggcaacauccucuccaccgccccccccuggcuccgccacauggccgccgccggcaucuccuccaccaucacccgcgaccucuacgucaccgccacccacuccguccacgaggagaagaugaccaacggccagcaggcccccgacaacucccucuccaccgucccccccggcugcaucaaccucuccggcgccggcaucuccugccgcuccacccgcgaccucuacgccaccgucauccacgacauccaggaggaggagauggagaacgaccagaccccccccgacggcuuccucuccaacuccgacucccccgagcucaucaacaugaccggccacugcaugccccccaacgcccucgacuccuucucccacgacuucaccucccucuccaaggacgagcuccucuacaagcccgacuccaacgaguucgccgucggcaccaagaacuacuccgucuccgccggcgacccccccgucaccgucaugucccucgucgagaccguccccaacaccccccagaucucccccgccauggccaagaagaucaacgacgacaucaaguaccagcucaugaaggagguccgccgcuucggccagaacuacgagcgcaucuucauccuccucgaggagguccagggcuccaugaaggucaagcgccaguucgucgaguucaccaucaaggaggccgcccgcuucaagaaggucguccucauccagcagcucgagaaggcccucaaggagaucgacucccacugccaccuccgcaaggucaagcacaugcgcaagcgcuga

SEQ ID NO: 49086 - RNA, 1218 nt, Artificial Sequence
  derived and/or modified sequence opt2 from SAG__Homo_sapiens__NP_000532
auggccgccuccggcaagaccuccaaguccgagcccaaccacgucaucuucaagaagaucucccgcgacaaguccgucaccaucuaccucggcaaccgcgacuacaucgaccacgucucccagguccagcccgucgacggcgucguccucgucgaccccgaccucgucaagggcaagaaggucuacgucacccucaccugcgccuuccgcuacggccaggaggacaucgacgucaucggccucaccuuccgccgcgaccucuacuucucccgcguccaggucuacccccccgucggcgccgccuccacccccaccaagcuccaggagucccuccucaagaagcucggcuccaacaccuaccccuuccuccucaccuuccccgacuaccuccccugcuccgucaugcuccagcccgccccccaggacuccggcaaguccugcggcgucgacuucgaggucaaggccuucgccaccgacuccaccgacgccgaggaggacaagauccccaagaaguccuccguccgccuccucauccgcaagguccagcacgccccccucgagaugggcccccagccccgcgccgaggccgccuggcaguucuucauguccgacaagccccuccaccucgccgucucccucaacaaggagaucuacuuccacggcgagcccauccccgucaccgucaccgucaccaacaacaccgagaagaccgucaagaagaucaaggccuucgucgagcaggucgccaacgucguccucuacuccuccgacuacuacgucaagcccgucgccauggaggaggcccaggagaaggucccccccaacuccacccucaccaagacccucacccuccucccccuccucgccaacaaccgcgagcgccgcggcaucgcccucgacggcaagaucaagcacgaggacaccaaccucgccuccuccaccaucaucaaggagggcaucgaccgcaccguccucggcauccucgucuccuaccagaucaaggucaagcucaccgucuccggcuuccucggcgagcucaccuccuccgaggucgccaccgagguccccuuccgccucaugcacccccagcccgaggaccccgccaaggaguccuaccaggacgccaaccucgucuucgaggaguucgcccgccacaaccucaaggacgccggcgaggccgaggagggcaagcgcgacaagaacgacgucgacgaguga

SEQ ID NO: 49087 - RNA, 3684 nt, Artificial Sequence
  derived and/or modified sequence opt2 from SALL1__Homo_sapiens__NP_001121364
augaacgacaccgucaacaagaccgaccaggucgacugcuccgaccucuccgagcacaacggccucgaccgcgaggaguccauggaggucgaggcccccgucgccaacaaguccggcuccggcaccuccuccggcucccacuccuccaccgcccccuccuccuccuccuccuccuccuccuccuccggcggcggcggcuccuccuccaccggcaccuccgccaucaccaccucccucccccagcucggcgaccucaccacccucggcaacuucuccgucaucaacuccaacgucaucaucgagaaccuccaguccaccaaggucgccgucgcccaguucucccaggaggcccgcugcggcggcgccuccggcggcaagcucgccguccccgcccucauggagcagcuccucgcccuccagcagcagcagauccaccagcuccagcucaucgagcagauccgccaccagauccuccuccucgccucccagaacgccgaccuccccaccuccuccucccccucccagggcacccuccgcaccuccgccaacccccucuccacccucuccucccaccucucccagcagcucgccgccgccgccggccucgcccagucccucgccucccaguccgccuccaucuccggcgucaagcagcucccccccauccagcucccccaguccuccuccggcaacaccaucauccccuccaacuccggcuccucccccaacaugaacauccucgccgccgccgucaccacccccuccuccgagaaggucgccuccuccgccggcgccucccacgucuccaaccccgccgucuccuccuccuccucccccgccuucgccaucuccucccuccucucccccgccuccaacccccuccucccccagcaggccuccgccaacuccgucuuccccuccccccuccccaacaucggcaccaccgccgaggaccucaacucccucuccgcccucgcccagcagcgcaaguccaagccccccaacgucaccgccuucgaggccaaguccaccuccgacgaggccuucuucaagcacaagugccgcuucugcgccaaggucuucggcuccgacuccgcccuccagauccaccuccgcucccacaccggcgagcgccccuucaagugcaacaucugcggcaaccgcuucuccaccaagggcaaccucaagguccacuuccagcgccacaaggagaaguacccccacauccagaugaaccccuaccccguccccgagcaccucgacaacauccccaccuccaccggcauccccuacggcauguccaucccccccgagaagcccgucaccuccuggcucgacaccaagcccguccuccccacccucaccaccuccgucggccucccccucccccccacccuccccucccucauccccuucaucaagaccgaggagcccgcccccauccccaucucccacuccgccaccuccccccccggcuccgucaaguccgacuccggcggccccgaguccgccacccgcaaccucggcggccuccccgaggaggccgagggcuccacccucccccccuccggcggcaaguccgaggaguccggcauggucaccaacuccguccccaccgccuccuccuccguccucuccucccccgccgccgacugcggccccgccggcuccgccaccaccuucaccaacccccuccucccccucauguccgagcaguucaaggccaaguuccccuucggcggccuccucgacuccgcccaggccuccgagaccuccaagcuccagcagcucgucgagaacaucgacaagaaggccaccgaccccaacgagugcaucaucugccaccgcguccucuccugccaguccgcccucaagaugcacuaccgcacccacaccggcgagcgccccuucaagugcaagaucugcggccgcgccuucaccaccaagggcaaccucaagacccacuacuccguccaccgcgccaugcccccccuccgcguccagcacuccugccccaucugccagaagaaguucaccaacgccgucguccuccagcagcacauccgcaugcacaugggcggccagauccccaacacccccguccccgacuccuacuccgaguccauggaguccgacaccggcuccuucgacgagaagaacuucgacgaccucgacaacuucuccgacgagaacauggaggacugccccgagggcuccauccccgacacccccaaguccgccgacgccucccaggacucccucuccuccuccccccucccccucgagauguccuccaucgccgcccucgagaaccagaugaagaugaucaacgccggccucgccgagcagcuccaggccucccucaaguccgucgagaacggcuccaucgagggcgacguccucaccaacgacuccuccuccgucggcggcgacauggagucccaguccgccggcucccccgccaucuccgaguccaccuccuccaugcaggcccucucccccuccaacuccacccaggaguuccacaagucccccuccaucgaggagaagccccagcgcgccguccccuccgaguucgccaacggccucucccccacccccgucaacggcggcgcccucgaccucaccuccucccacgccgagaagaucaucaaggaggacucccucggcauccucuuccccuuccgcgaccgcggcaaguucaagaacaccgccugcgacaucugcggcaagaccuucgccugccaguccgcccucgacauccacuaccgcucccacaccaaggagcgccccuucaucugcaccgucugcaaccgcggcuucuccaccaagggcaaccucaagcagcacaugcucacccaccagaugcgcgaccuccccucccagcucuucgagcccuccuccaaccucggccccaaccagaacuccgccgucauccccgccaacucccucuccucccucaucaagaccgaggucaacggcuucguccacgucuccccccaggacuccaaggacacccccaccucccacguccccuccggcccccucuccuccuccgccaccucccccguccuccuccccgcccucccccgccgcacccccaagcagcacuacugcaacaccugcggcaagaccuucuccuccuccuccgcccuccagauccacgagcgcacccacaccggcgagaagcccuucgccugcaccaucugcggccgcgccuucaccaccaagggcaaccucaagguccacaugggcacccacauguggaacuccacccccgcccgccgcggccgccgccucuccgucgacggccccaugaccuuccucggcggcaaccccgucaaguuccccgagauguuccagaaggaccucgccgcccgcuccggcuccggcgaccccuccuccuucuggaaccaguacgccgccgcccucuccaacggccucgccaugaaggccaacgagaucuccgucauccagaacggcggcaucccccccauccccggcucccucggcuccggcaacuccucccccgucuccggccucaccggcaaccucgagcgccuccagaacuccgagcccaacgccccccucgccggccucgagaagauggccuccuccgagaacggcaccaacuuccgcuucacccgcuucgucgaggacuccaaggagaucgucaccuccuga

SEQ ID NO: 49088 - RNA, 3024 nt, Artificial Sequence
  derived and/or modified sequence opt2 from SALL2__Homo_sapiens__NP_005398
augucccgccgcaagcagcgcaagccccagcagcucaucuccgacugcgagggccccuccgccuccgagaacggcgacgccuccgaggaggaccacccccaggucugcgccaagugcugcgcccaguucaccgaccccaccgaguuccucgcccaccagaacgccugcuccaccgacccccccgucauggucaucaucggcggccaggagaaccccaacaacuccuccgccuccuccgagccccgccccgagggccacaacaacccccaggucauggacaccgagcacuccaacccccccgacuccggcuccuccguccccaccgaccccaccuggggccccgagcgccgcggcgaggaguccuccggccacuuccucgucgccgccaccggcaccgccgccggcggcggcggcggccucauccucgccucccccaagcucggcgccaccccccucccccccgaguccacccccgcccccccccccccccccccccccccccccccccccggcgucggcuccggccaccucaacaucccccucauccucgaggagcuccgcguccuccagcagcgccagauccaccagaugcagaugaccgagcagaucugccgccagguccuccuccucggcucccucggccagaccgucggcgcccccgccucccccuccgagcuccccggcaccggcaccgccuccuccaccaagccccuccucccccucuucucccccaucaagcccguccagaccuccaagacccucgccuccuccuccuccuccuccuccuccuccuccggcgccgagacccccaagcaggccuucuuccaccucuaccacccccucggcucccagcaccccuucuccgccggcggcgucggccgcucccacaagcccacccccgcccccucccccgcccuccccggcuccaccgaccagcucaucgccuccccccaccucgccuuccccuccaccaccggccuccucgccgcccagugccucggcgccgcccgcggccucgaggccaccgccucccccggccuccucaagcccaagaacggcuccggcgagcucuccuacggcgaggucaugggcccccucgagaagcccggcggccgccacaagugccgcuucugcgccaaggucuucggcuccgacuccgcccuccagauccaccuccgcucccacaccggcgagcgccccuacaagugcaacgucugcggcaaccgcuucaccacccgcggcaaccucaagguccacuuccaccgccaccgcgagaaguacccccacguccagaugaacccccaccccguccccgagcaccucgacuacgucaucaccuccuccggccuccccuacggcauguccgucccccccgagaaggccgaggaggaggccgccacccccggcggcggcgucgagcgcaagccccucgucgccuccaccaccgcccucuccgccaccgagucccucacccuccucuccaccuccgccggcaccgccaccgcccccggccuccccgccuucaacaaguucguccucaugaaggccgucgagcccaagaacaaggccgacgagaacaccccccccggcuccgagggcuccgccaucuccggcgucgccgaguccuccaccgccacccgcaugcagcucuccaagcucgucaccucccuccccuccugggcccuccucaccaaccacuucaaguccaccggcuccuuccccuuccccuacguccucgagccccucggcgccucccccuccgagaccuccaagcuccagcagcucgucgagaagaucgaccgccagggcgccgucgccgucaccuccgccgccuccggcgcccccaccaccuccgcccccgcccccuccuccuccgccuccuccggccccaaccagugcgucaucugccuccgcguccucuccugcccccgcgcccuccgccuccacuacggccagcacggcggcgagcgccccuucaagugcaaggucugcggccgcgccuucuccacccgcggcaaccuccgcgcccacuucgucggccacaaggccucccccgccgcccgcgcccagaacuccugccccaucugccagaagaaguucaccaacgccgucacccuccagcagcacguccgcaugcaccucggcggccagauccccaacggcggcaccgcccuccccgagggcggcggcgccgcccaggagaacggcuccgagcaguccaccgucuccggcgcccgcuccuucccccagcagcagucccagcagcccucccccgaggaggagcucuccgaggaggaggaggaggaggacgaggaggaggaggaggacgucaccgacgaggacucccucgccggccgcggcuccgaguccggcggcgagaaggccaucuccguccgcggcgacuccgaggaggccuccggcgccgaggaggaggucggcaccgucgccgccgccgccaccgccggcaaggagauggacuccaacgagaagaccacccagcaguccucccucccccccccccccccccccgacucccucgaccagccccagcccauggagcagggcuccuccggcguccucggcggcaaggaggagggcggcaagcccgagcgcuccuccucccccgccuccgcccucacccccgagggcgaggccaccuccgucacccucgucgaggagcucucccuccaggaggccaugcgcaaggagcccggcgaguccuccucccgcaaggccugcgaggucugcggccaggccuuccccucccaggccgcccucgaggagcaccagaagacccaccccaaggagggcccccucuucaccugcgucuucugccgccagggcuuccucgagcgcgccacccucaagaagcacaugcuccucgcccaccaccagguccagcccuucgccccccacggcccccagaacaucgccgcccucucccucguccccggcugcucccccuccaucaccuccaccggccucucccccuucccccgcaaggacgaccccaccauccccuga

SEQ ID NO: 49089 - RNA, 3903 nt, Artificial Sequence
  derived and/or modified sequence opt2 from SALL3__Homo_sapiens__NP_741996
augucccgccgcaagcaggccaagccccagcaccucaaguccgacgaggagcuccucccccccgacggcgcccccgagcacgccgcccccggcgagggcgccgaggacgccgacuccggccccgagucccgcuccggcggcgaggagaccuccgucugcgagaagugcugcgccgaguucuucaagugggccgacuuccucgagcaccagcgcuccugcaccaagcucccccccguccucaucguccacgaggacgcccccgcccccccccccgaggacuuccccgagcccucccccgccuccucccccuccgagcgcgccgaguccgaggccgccgaggaggccggcgccgagggcgccgagggcgaggcccgccccgucgagaaggaggccgagcccauggacgccgagcccgccggcgacacccgcgccccccgccccccccccgccgcccccgccccccccacccccgccuacggcgcccccuccaccaacgucacccucgaggcccuccucuccaccaaggucgccgucgcccaguucucccagggcgcccgcgccgccggcggcuccggcgccggcggcggcgucgccgccgccgccgucccccucauccucgagcagcucauggcccuccagcagcagcagauccaccagcuccagcucaucgagcagauccgcucccaggucgcccucaugcagcgcccccccccccgccccucccucucccccgccgccgcccccuccgcccccggccccgcccccucccagcuccccggccucgccgcccucccccucuccgccggcgcccccgccgccgccaucgccggcuccggccccgccgcccccgccgccuucgagggcgcccagccccucucccgccccgaguccggcgccuccacccccggcggccccgccgagcccuccgcccccgccgcccccuccgccgcccccgcccccgccgcccccgcccccgcccccgccccccaguccgccgccuccucccagccccaguccgccuccaccccccccgcccucgcccccggcucccuccucggcgccgcccccggccuccccuccccccuccucccccagaccuccgccuccggcgucaucuuccccaacccccucgucuccaucgccgccaccgccaacgcccucgacccccucuccgcccucaugaagcaccgcaagggcaagccccccaacgucuccgucuucgagcccaaggccuccgccgaggaccccuucuucaagcacaagugccgcuucugcgccaaggucuucggcuccgacuccgcccuccagauccaccuccgcucccacaccggcgagcgccccuucaagugcaacaucugcggcaaccgcuucuccaccaagggcaaccucaagguccacuuccagcgccacaaggagaaguacccccacauccagaugaaccccuaccccguccccgaguaccucgacaacguccccaccugcuccggcauccccuacggcaugucccucccccccgagaagcccgucaccaccuggcucgacuccaagcccguccuccccaccguccccaccuccgucggccuccagcucccccccaccguccccggcgcccacggcuacgccgacucccccuccgccacccccgccucccgcuccccccagcgccccucccccgccuccuccgagugcgccucccucucccccggccucaaccacgucgaguccggcgucuccgccaccgccgaguccccccagucccuccucggcggccccccccucaccaaggccgagcccgucucccuccccugcaccaacgcccgcgccggcgacgcccccgucggcgcccaggccuccgccgcccccaccuccgucgacggcgcccccaccucccucggcucccccggccuccccgccgucuccgagcaguucaaggcccaguuccccuucggcggccuccucgacuccaugcagaccuccgagaccuccaagcuccagcagcucgucgagaacaucgacaagaagaugaccgaccccaaccagugcgucaucugccaccgcguccucuccugccaguccgcccucaagaugcacuaccgcacccacaccggcgagcgccccuucaagugcaagaucugcggccgcgccuucaccaccaagggcaaccucaagacccacuucggcguccaccgcgccaagcccccccuccgcguccagcacuccugccccaucugccagaagaaguucaccaacgccgucguccuccagcagcacauccgcaugcacaugggcggccagauccccaacaccccccuccccgagggcuuccaggacgccauggacuccgagcucgccuacgacgacaagaacgccgagacccucuccuccuacgacgacgacauggacgagaacuccauggaggacgacgccgagcucaaggacgccgccaccgaccccgccaagccccuccucuccuacgccggcuccugcccccccuccccccccuccgucaucuccuccaucgccgcccucgagaaccagaugaagaugaucgacuccgucauguccugccagcagcucaccggccucaaguccgucgagaacggcuccggcgaguccgaccgccucuccaacgacuccuccuccgccgucggcgaccucgagucccgcuccgccggcucccccgcccucuccgaguccuccuccucccaggcccucucccccgcccccuccaacggcgaguccuuccgcuccaagucccccggccucggcgcccccgaggagccccaggagaucccccucaagaccgagcgccccgacucccccgccgccgcccccggcuccggcggcgcccccggccgcgccggcaucaaggaggaggcccccuucucccuccucuuccucucccgcgagcgcggcaagugccccuccaccgucugcggcgucugcggcaagcccuucgccugcaaguccgcccucgagauccacuaccgcucccacaccaaggagcgccccuucgucugcgcccucugccgccgcggcugcuccaccaugggcaaccucaagcagcaccuccucacccaccgccucaaggagcuccccucccagcucuucgaccccaacuucgcccucggccccucccaguccacccccucccucaucuccuccgccgcccccaccaugaucaagauggaggucaacggccacggcaaggccauggcccucggcgagggccccccccuccccgccggcguccagguccccgccggcccccagaccgucaugggccccggccucgcccccaugcucgccccccccccccgccgcacccccaagcagcacaacugccaguccugcggcaagaccuucuccuccgccuccgcccuccagauccacgagcgcacccacaccggcgagaagcccuucggcugcaccaucugcggccgcgccuucaccaccaagggcaaccucaagguccacaugggcacccacauguggaacaacgcccccgcccgccgcggccgccgccucuccgucgagaaccccauggcccuccucggcggcgacgcccucaaguucuccgagauguuccagaaggaccucgccgcccgcgccaugaacgucgaccccuccuucuggaaccaguacgccgccgccaucaccaacggccucgccaugaagaacaacgagaucuccgucauccagaacggcggcaucccccagcuccccgucucccucggcggcuccgcccuccccccccucggcuccauggccuccggcauggacaaggcccgcaccggcuccuccccccccaucgucucccucgacaaggccuccuccgagaccgccgccucccgccccuucacccgcuucaucgaggacaacaaggagaucggcaucaacuga

SEQ ID NO: 49090 - RNA, 3162 nt, Artificial Sequence
  derived and/or modified sequence opt2 from SALL4__Homo_sapiens__NP_065169
augucccgccgcaagcaggccaagccccagcacaucaacuccgaggaggaccagggcgagcagcagccccagcagcagacccccgaguucgccgacgccgcccccgccgcccccgccgccggcgagcucggcgcccccgucaaccaccccggcaacgacgaggucgccuccgaggacgaggccaccgucaagcgccuccgccgcgaggagacccacgucugcgagaagugcugcgccgaguucuucuccaucuccgaguuccucgagcacaagaagaacugcaccaagaacccccccguccucaucaugaacgacuccgagggccccguccccuccgaggacuucuccggcgccguccucucccaccagcccaccucccccggcuccaaggacugccaccgcgagaacggcggcuccuccgaggacaugaaggagaagcccgacgccgaguccgucgucuaccucaagaccgagaccgcccucccccccaccccccaggacaucuccuaccucgccaagggcaaggucgccaacaccaacgucacccuccaggcccuccgcggcaccaaggucgccgucaaccagcgcuccgccgacgcccuccccgcccccguccccggcgccaacuccauccccuggguccucgagcagauccucugccuccagcagcagcagcuccagcagauccagcucaccgagcagauccgcauccaggucaacaugugggccucccacgcccuccacuccuccggcgccggcgccgacacccucaagacccucggcucccacaugucccagcaggucuccgccgccgucgcccuccucucccagaaggccggcucccagggccucucccucgacgcccucaagcaggccaagcucccccacgccaacauccccuccgccaccuccucccucucccccggccucgcccccuucacccucaagcccgacggcacccgcguccuccccaacgucaugucccgccuccccuccgcccuccucccccaggcccccggcuccguccucuuccagucccccuucuccaccgucgcccucgacaccuccaagaagggcaagggcaagccccccaacaucuccgccgucgacgucaagcccaaggacgaggccgcccucuacaagcacaagugcaaguacugcuccaaggucuucggcaccgacuccucccuccagauccaccuccgcucccacaccggcgagcgccccuucgucugcuccgucugcggccaccgcuucaccaccaagggcaaccucaagguccacuuccaccgccacccccaggucaaggccaacccccagcucuucgccgaguuccaggacaaggucgccgccggcaacggcauccccuacgcccucuccguccccgaccccaucgacgagcccucccucucccucgacuccaagcccguccucgucaccaccuccgucggccucccccagaaccucuccuccggcaccaaccccaaggaccucaccggcggcucccuccccggcgaccuccagcccggccccucccccgaguccgagggcggccccacccuccccggcgucggccccaacuacaacuccccccgcgccggcggcuuccagggcuccggcacccccgagcccggcuccgagacccucaagcuccagcagcucgucgagaacaucgacaaggccaccaccgaccccaacgagugccucaucugccaccgcguccucuccugccaguccucccucaagaugcacuaccgcacccacaccggcgagcgccccuuccagugcaagaucugcggccgcgccuucuccaccaagggcaaccucaagacccaccucggcguccaccgcaccaacaccuccaucaagacccagcacuccugccccaucugccagaagaaguucaccaacgccgucaugcuccagcagcacauccgcaugcacaugggcggccagauccccaacaccccccuccccgagaaccccugcgacuucaccggcuccgagcccaugaccgucggcgagaacggcuccaccggcgccaucugccacgacgacgucaucgaguccaucgacgucgaggaggucuccucccaggaggcccccuccuccuccuccaagguccccaccccccuccccuccauccacuccgccucccccacccucggcuucgccaugauggccucccucgacgcccccggcaaggucggccccgcccccuucaaccuccagcgccagggcucccgcgagaacggcuccgucgaguccgacggccucaccaacgacuccuccucccucaugggcgaccaggaguaccagucccgcucccccgacauccucgagaccaccuccuuccaggcccucucccccgccaacucccaggccgaguccaucaaguccaagucccccgacgccggcuccaaggccgaguccuccgagaacucccgcaccgagauggagggccgcuccucccuccccuccaccuucauccgcgccccccccaccuacgucaaggucgagguccccggcaccuucgucggccccuccacccucucccccggcaugaccccccuccucgccgcccagccccgccgccaggccaagcagcacggcugcacccgcugcggcaagaacuucuccuccgccuccgcccuccagauccacgagcgcacccacaccggcgagaagcccuucgucugcaacaucugcggccgcgccuucaccaccaagggcaaccucaagguccacuacaugacccacggcgccaacaacaacuccgcccgccgcggccgcaagcucgccaucgagaacaccauggcccuccucggcaccgacggcaagcgcgucuccgagaucuuccccaaggagauccucgcccccuccgucaacgucgaccccgucgucuggaaccaguacaccuccaugcucaacggcggccucgccgucaagaccaacgagaucuccgucauccaguccggcggcguccccacccuccccgucucccucggcgccaccuccgucgucaacaacgccaccgucuccaagauggacggcucccaguccggcaucuccgccgacgucgagaagcccuccgccaccgacggcguccccaagcaccaguucccccacuuccucgaggagaacaagaucgccgucuccuga

SEQ ID NO: 49091 - RNA, 1338 nt, Artificial Sequence
  derived and/or modified sequence opt2 from SAMD14__Homo_sapiens__NP_777580
auggccuccuccaagcuccgcgagcccgucgacgaggucuucgaccucgaccucgccguccccgagaccgcccgccucgacuccucccuccacaaggcccgcgcccagcuccucgccaagggccgccgccaccgccccucccgcucccgccuccgcgacuccgccuccuccgccgaggacggcgagggcuccgacggccccggcggcaaggucaccgacggcugcggcuccccccuccaccgccuccgcuccccccuccacuccggccccggcucccccgccggcggcuccuucugccucgacccccccggccuccgccgcucccucgacgaggacgagcccccccccuccccccucacccgcuaccgcccccuccacaacgccgccucccacgagggccucgccgccgccuccugcucccccccccgcuccgcccccuccuccgacuccucccccuccuucguccgccgccacccccgcgccgagccccacuccgaggacgacucccgcgacgccuccccccccgagcccgccucccccaccaucggccucgacaagaagacccgccgcaaguuccucgaccucggcgucacccuccgccgcgccuccaccggcaagucccgcaaggagaagggcuccaaccgccucuccaugggcucccgcgaguccgucgagggcuccggccgcuccggcggcucccccuuccuccccuucuccugguucaccgacuccggcaagggcuccgccuccuccggcuccaccaccucccccaccugcucccccaagcacgagggcuucucccccaagaaguccgccucccaggcccagcuccucgcccacgcccaggaggcccucuccaacuccuggugccucguccaggacuucggcuccacccagaucggcauggaguccacccucuccgacgacuccaccccccccuccuccucccccaagauccccuccggccccuggcaggaggccaagugcuccuaccccuaccacacccucucccaguccuccgacgaguuccucgacgagccccucccccccguccaccacuggaccucccagcaggucggccaguggcuccagucccucaaccucgagcaguacgccgccgaguucgccgcccgccaggucgacggcccccagcuccuccagcucgacggcuccaagcucaagucccucggccucuccaacucccacgaccgcgcccucgucaagcgcaagcucaaggagauggccgccgccgccgagaaggagcgcaaggcccaggagaaggccgcccgccagcgcgagaagcuccgccgccgcgagcaggaggccaagaaguccuga

SEQ ID NO: 49092 - RNA, 1617 nt, Artificial Sequence
  derived and/or modified sequence opt2 from SAMD1__Homo_sapiens__NP_612361
auggccggcccccccgcccuccccccccccgagaccgccgccgccgccaccaccgccgccgccgccuccuccuccgccgccuccccccacuaccaggaguggauccucgacaccaucgacucccuccgcucccgcaaggcccgccccgaccucgagcgcaucugccgcaugguccgccgccgccacggccccgagcccgagcgcacccgcgccgagcucgagaagcucauccagcagcgcgccguccuccgcgucuccuacaagggcuccaucuccuaccgcaacgccgcccgcguccagcccccccgccgcggcgccaccccccccgcccccccccgcgccccccgcggcgcccccgccgccgccgccgccgccgcccccccccccacccccgcccccccccccccccccgcccccgucgccgccgccgcccccgcccgcgccccccgcgccgccgccgccgccgccaccgccccccccucccccggccccgcccagcccggcccccgcgcccagcgcgccgccccccucgccgcccccccccccgcccccgccgccccccccgccgucgccccccccgccggcccccgccgcgcccccccccccgccgucgccgcccgcgagcccccccuccccccccccccccagccccccgcccccccccagcagcagcagcccccccccccccagccccagcccccccccgagggcggcgccguccgcgccggcggcgccgcccgccccgucucccuccgcgaggucguccgcuaccucggcggcuccggcggcgccggcggccgccucacccgcggccgcguccagggccuccucgaggaggaggccgccgcccgcggccgccucgagcgcacccgccucggcgcccucgcccucccccgcggcgaccgccccggccgcgccccccccgccgccuccgcccgccccucccgcuccaagcgcggcggcgaggagcgcguccucgagaaggaggaggaggaggacgacgacgaggacgaggacgaggaggacgacgucuccgagggcuccgagguccccgaguccgaccgccccgccggcgcccagcaccaccagcucaacggcgagcgcggcccccaguccgccaaggagcgcgucaaggaguggacccccugcggcccccaccagggccaggacgagggccgcggccccgcccccggcuccggcacccgccaggucuucuccauggccgccaugaacaaggagggcggcaccgccuccgucgccaccggccccgacucccccucccccgucccccucccccccggcaagcccgcccuccccggcgccgacggcacccccuucggcugcccccccggccgcaaggagaagcccuccgaccccgucgaguggaccgucauggacgucgucgaguacuucaccgaggccggcuuccccgagcaggccaccgccuuccaggagcaggagaucgacggcaagucccuccuccucaugcagcgcaccgacguccucaccggccucuccauccgccucggccccgcccucaagaucuacgagcaccacaucaagguccuccagcagggccacuucgaggacgacgaccccgacggcuuccucggcuga

SEQ ID NO: 49093 - RNA, 1893 nt, Artificial Sequence
  derived and/or modified sequence opt2 from SAMD4A__Homo_sapiens__NP_001155048
augauguuccgcgaccaggucggcguccucgccggcugguucaagggcuggaacgagugcgagcagaccgucgcccuccucucccuccucaagcgcgucucccagacccaggcccgcuuccuccagcucugccucgagcacucccucgccgacugcgccgagcuccacguccucgagcgcgaggccaacucccccggcaucaucaaccaguggcagcaggaguccaaggacaaggucaucucccuccuccucacccaccucccccuccucaagcccggcaaccucgacgccaaggucgaguacaugaagcuccuccccaagauccucgcccacuccaucgagcacaaccagcacaucgaggagucccgccagcuccucuccuacgcccucauccaccccgccaccucccucgaggaccgcuccgcccucgccauguggcucaaccaccucgaggaccgcaccuccaccuccuucggcggccagaaccgcggccgcuccgacuccgucgacuacggccagacccacuacuaccaccagcgccagaacuccgacgacaagcucaacggcuggcagaacucccgcgacuccggcaucugcaucaacgccuccaacuggcaggacaaguccaugggcugcgagaacggccacgucccccucuacuccuccuccuccguccccaccaccaucaacaccaucggcaccuccaccuccaccaacguccccgccuggcucaagucccuccgccuccacaaguacgccgcccucuucucccagaugaccuacgaggagaugauggcccucaccgagugccagcucgaggcccagaacgucaccaagggcgcccgccacaagaucgucaucuccauccagaagcucaaggagcgccagaaccuccucaagucccucgagcgcgacaucaucgagggcggcucccuccgcaucccccuccaggagcuccaccagaugauccucacccccaucaaggccuacuccucccccuccaccacccccgaggcccgccgccgcgagccccaggccccccgccagcccucccucaugggccccgagucccagucccccgacugcaaggacggcgccgccgccaccggcgccaccgccacccccuccgccggcgccuccggcggccuccagccccaccagcucuccuccugcgacggcgagcucgccgucgccccccuccccgagggcgaccuccccggccaguucacccgcgucaugggcaaggucugcacccagcuccucgucucccgccccgacgaggagaacaucuccuccuaccuccagcucaucgacaagugccucauccacgaggccuucaccgagacccagaagaagcgccuccucuccuggaagcagcagguccagaagcucuuccgcuccuucccccgcaagacccuccucgacaucuccggcuaccgccagcagcgcaaccgcggcuucggccaguccaacucccuccccaccgccggcuccgucggcggcggcaugggccgccgcaacccccgccaguaccagauccccucccgcaacguccccuccgcccgccucggccuccucggcaccuccggcuucgucuccuccaaccagcgcaacaccaccgccacccccaccaucaugaagcagggccgccagaaccucugguucgccaaccccggcggcuccaacuccaugcccucccgcacccacuccuccguccagcgcacccgcucccuccccguccacaccuccccccagaacaugcucauguuccagcagcccgaguuccagcuccccgucaccgagcccgacaucaacaaccgccucgagucccucugccucuccaugaccgagcacgcccucggcgacggcgucgaccgcaccuccaccaucuga

SEQ ID NO: 49094 - RNA, 522 nt, Artificial Sequence
  derived and/or modified sequence opt2 from SAMD5__Homo_sapiens__NP_001025231
augugcaccaacaucgucuacgaguggcucaaggcccuccagcucccccaguacgccgaguccuucgucgacaacggcuacgacgaccucgaggucugcaagcagaucggcgaccccgaccucgacgccaucggcguccucgcccccgcccaccgccgccgcauccucgaggccguccgccgccuccgcgagcaggacgccaacgccgccggccucuacuucacccucgagccccagcccgccccccccggcccccccgccgacgccguccccaccggccgccgcggcgagcccugcggcggccccgcccagggcacccgcggcgacucccgcggccacaccaccgccccccgcucccgcgagcucgucuccuaccccaagcucaagcucaagaucaugauccgcgacaagcucguccgcgacggcauccaccucuccaagccccccuacucccgcaagguccccauggccggcauccucgaguaccucaugaacuggcccaaguccucccagucccgcuga

SEQ ID NO: 49095 - RNA, 4770 nt, Artificial Sequence
  derived and/or modified sequence opt2 from SAMD9__Homo_sapiens__NP_060124
auggccaagcagcucaaccuccccgagaacaccgacgacuggaccaaggaggacgucaaccaguggcucgagucccacaagaucgaccagaagcaccgcgagauccucaccgagcaggacgucaacggcgccguccucaaguggcucaagaaggagcaccucgucgacaugggcaucacccacggccccgccauccagaucgaggagcucuucaaggagcuccgcaagaccgccaucgaggacuccauccagaccuccaagaugggcaagcccuccaagaacgcccccaaggaccagaccgucucccagaaggagcgccgcgagaccuccaagcagaagcagaagggcaaggagaaccccgacauggccaaccccuccgccauguccaccaccgccaagggcuccaagucccucaaggucgagcucaucgaggacaagaucgacuacaccaaggagcgccagcccuccaucgaccucaccugcgucuccuaccccuucgacgaguucuccaaccccuaccgcuacaagcucgacuucucccuccagcccgagaccggccccggcaaccucaucgaccccauccacgaguucaaggccuucaccaacaccgccaccgccaccgaggaggacgucaagaugaaguucuccaacgaggucuuccgcuucgccuccgccugcaugaacucccgcaccaacggcaccauccacuucggcgucaaggacaagccccacggcaagaucgucggcaucaaggucaccaacgacaccaaggaggcccucaucaaccacuucaaccucaugaucaacaaguacuucgaggaccaccagguccagcaggccaagaagugcauccgcgagccccgcuucgucgagguccuccuccccaacuccacccucuccgaccgcuucgucaucgaggucgacaucaucccccaguucuccgagugccaguacgacuacuuccagaucaagaugcagaacuacaacaacaagaucugggagcaguccaagaaguucucccucuucguccgcgacggcaccuccuccaaggacaucaccaagaacaaggucgacuuccgcgccuucaaggccgacuucaagacccucgccgagucccgcaaggccgccgaggagaaguuccgcgccaagaccaacaagaaggagcgcgagggccccaagcucgucaagcuccucaccggcaaccaggaccuccucgacaacuccuacuacgagcaguacauccucgucaccaacaagugccaccccgaccagaccaagcaccucgacuuccucaaggagaucaagugguucgccguccucgaguucgaccccgaguccaacaucaacggcgucgucaaggccuacaaggagucccgcgucgccaaccuccacuuccccuccgucuacgucgagcagaagaccacccccaacgagaccaucuccacccucaaccucuaccaccagcccuccuggaucuucugcaacggccgccucgaccucgacuccgagaaguacaagcccuucgaccccuccuccuggcagcgcgagcgcgccuccgacguccgcaagcucaucuccuuccucacccacgaggacaucaugccccgcggcaaguuccucgucgucuuccuccuccucuccuccgucgacgacccccgcgacccccucaucgagaccuucugcgccuucuaccaggaccucaagggcauggagaacauccucugcaucugcguccacccccacaucuuccagggcuggaaggaccuccucgaggcccgccucaucaagcaccaggacgagaucuccucccagugcaucuccgcccucucccucgaggagaucaacggcaccauccucaagcucaaguccgucacccaguccuccaagcgccuccuccccuccaucggccucuccaccguccuccucaagaaggaggaggacaucaugaccgcccucgagaucaucugcgagaacgagugcgagggcacccuccucgagaaggacaagaacaaguuccucgaguucaaggccuccaaggaggaggacuucuaccgcggcggcaaggucuccugguggaacuucuacuucuccuccgaguccuacuccucccccuucgucaagcgcgacaaguacgagcgccucgaggccaugauccagaacugcgccgacuccuccaagcccaccuccaccaagaucauccaccucuaccaccaccccggcugcggcggcaccacccucgccaugcacauccucugggagcuccgcaagaaguuccgcugcgccguccucaagaacaagaccgucgacuucuccgagaucggcgagcaggucaccucccucaucaccuacggcgccaugaaccgccaggaguacguccccguccuccuccucgucgacgacuucgaggagcaggacaacgucuaccuccuccaguacuccauccagaccgccaucgccaagaaguacauccgcuacgagaagccccucgucaucauccucaacugcaugcgcucccagaaccccgagaaguccgcccgcauccccgacuccaucgccgucauccagcagcucucccccaaggagcagcgcgccuucgagcucaagcucaaggagaucaaggagcagcacaagaacuucgaggacuucuacuccuucaugaucaugaagaccaacuucaacaaggaguacaucgagaacgucguccgcaacauccucaagggccagaacaucuucaccaaggaggccaagcucuucuccuuccucgcccuccucaacuccuacguccccgacaccaccaucucccucucccagugcgagaaguuccucggcaucggcaacaagaaggccuucuggggcaccgagaaguucgaggacaagaugggcaccuacuccaccauccucaucaagaccgaggucaucgagugcggcaacuacugcggcguccgcaucauccacucccucaucgccgaguucucccucgaggagcucaagaaguccuaccaccucaacaagucccagaucaugcucgacaugcucaccgagaaccucuucuucgacaccggcaugggcaaguccaaguuccuccaggacaugcacacccuccuccucacccgccaccgcgacgagcacgagggcgagaccggcaacugguucucccccuucaucgaggcccuccacaaggacgagggcaacgaggccgucgaggccguccuccucgaguccauccaccgcuucaaccccaacgccuucaucugccaggcccucgcccgccacuucuacaucaagaagaaggacuucggcaacgcccucaacugggccaagcaggccaagaucaucgagcccgacaacuccuacaucuccgacacccucggccaggucuacaaguccaagauccgcugguggaucgaggagaacggcggcaacggcaacaucuccgucgacgaccucaucgcccuccucgaccucgccgagcacgccuccuccgccuucaaggagucccagcagcaguccgaggaccgcgaguacgaggucaaggagcgccucuaccccaaguccaagcgccgcuacgacaccuacaacaucgccggcuaccagggcgagaucgaggucggccucuacaccauccagauccuccagcucauccccuucuucgacaacaagaacgagcucuccaagcgcuacauggucaacuucgucuccggcuccuccgacauccccggcgaccccaacaacgaguacaagcucgcccucaagaacuacauccccuaccucaccaagcucaaguucucccucaagaaguccuucgacuucuucgacgaguacuucguccuccucaagccccgcaacaacaucaagcagaacgaggaggccaagacccgccgcaaggucgccggcuacuucaagaaguacgucgacaucuucugccuccucgaggagucccagaacaacaccggccucggcuccaaguucuccgagccccuccaggucgagcgcugccgccgcaaccucgucgcccucaaggccgacaaguucuccggccuccucgaguaccucaucaagucccaggaggacgccaucuccaccaugaagugcaucgucaacgaguacaccuuccuccucgagcagugcaccgucaagauccaguccaaggagaagcucaacuucauccucgccaacaucauccucuccugcauccagcccaccucccgccucgucaagcccgucgagaagcucaaggaccagcuccgcgagguccuccagcccaucggccucaccuaccaguucuccgagcccuacuuccucgccucccuccucuucuggcccgagaaccagcagcucgaccagcacuccgagcagaugaaggaguacgcccaggcccucaagaacuccuucaagggccaguacaagcacaugcaccgcaccaagcagcccaucgccuacuucuuccucggcaagggcaagcgccucgagcgccucguccacaagggcaagaucgaccagugcuucaagaagacccccgacaucaacucccucuggcaguccggcgacgucuggaaggaggagaagguccaggagcuccuccuccgccuccagggccgcgccgagaacaacugccucuacaucgaguacggcaucaacgagaagaucaccauccccaucacccccgccuuccucggccagcuccgcuccggccgcuccaucgagaaggucuccuucuaccucggcuucuccaucggcggcccccucgccuacgacaucgagaucgucuga

SEQ ID NO: 49096 - RNA, 4755 nt, Artificial Sequence
  derived and/or modified sequence opt2 from SAMD9L__Homo_sapiens__NP_001290426
auguccaagcaggucucccuccccgagaugaucaaggacuggaccaaggagcacgucaagaagugggucaacgaggaccucaagaucaacgagcaguacggccagauccuccucuccgaggaggucaccggccucguccuccaggagcucaccgagaaggaccucgucgagaugggccuccccuggggccccgcccuccucaucaagcgcuccuacaacaagcucaacuccaagucccccgaguccgacaaccacgaccccggccagcucgacaacuccaagcccuccaagaccgagcaccagaagaaccccaagcacaccaagaaggaggaggagaacuccauguccuccaacaucgacuacgacccccgcgagauccgcgacaucaagcaggaggaguccauccucaugaaggagaacguccucgacgaggucgccaacgccaagcacaagaagaagggcaagcucaagcccgagcagcucaccugcaugcccuaccccuucgaccaguuccacgacucccaccgcuacaucgagcacuacacccuccagcccgagaccggcgcccucaaccucaucgaccccauccacgaguucaaggcccucaccaacaccgagaccgccaccgaggucgacaucaagaugaaguucuccaacgaggucuuccgcuucgccuccgccugcaugaacucccgcaccaacggcaccauccacuucggcgucaaggacaagccccacggcgagaucgucggcgucaagaucaccuccaaggccgccuucaucgaccacuucaacgucaugaucaagaaguacuucgaggaguccgagaucaacgaggccaagaagugcauccgcgagccccgcuucgucgagguccuccuccagaacaacacccccuccgaccgcuucgucaucgaggucgacaccauccccaagcacuccaucugcaacgacaaguacuucuacauccagaugcagaucugcaaggacaagaucuggaagcagaaccagaaccucucccucuucguccgcgagggcgccuccucccgcgacauccucgccaacuccaagcagcgcgacgucgacuucaaggccuuccuccagaaccucaagucccucgucgccucccgcaaggaggccgaggaggaguacggcaugaaggccaugaagaaggaguccgagggccucaagcucgucaagcuccucaucggcaaccgcgacucccucgacaacuccuacuacgacugguacauccucgucaccaacaagugccaccccaaccagaucaagcaccucgacuuccucaaggagaucaagugguucgccguccucgaguucgaccccgaguccaugaucaacggcgucgucaaggccuacaaggagucccgcgucgccaaccuccacuuccccaaccaguacgaggacaagaccaccaacaugugggagaagaucuccacccucaaccucuaccagcagcccuccuggaucuucugcaacggccgcuccgaccucaaguccgagaccuacaagccccucgagccccaccucuggcagcgcgagcgcgccuccgagguccgcaagcucauccucuuccucaccgacgagaacaucaugacccgcggcaaguuccucgucgucuuccuccuccucuccuccgucgagucccccggcgacccccucaucgagaccuucugggccuucuaccaggcccucaagggcauggagaacaugcucugcaucuccgucaacucccacaucuaccagcgcuggaaggaccuccuccagacccgcaugaagauggaggacgagcucaccaaccacuccaucuccacccucaacaucgagcucgucaacuccaccauccucaagcucaaguccgucacccgcuccucccgccgcuuccuccccgcccgcggcuccuccuccgucauccucgagaagaagaaggaggacguccucaccgcccucgagauccucugcgagaacgagugcaccgagaccgacaucgagaaggacaaguccaaguuccucgaguucaagaaguccaaggaggagcacuucuaccgcggcggcaaggucuccugguggaacuucuacuucuccuccgagaacuacuccuccgacuucgucaagcgcgacuccuacgagaagcucaaggaccucauccacugcugggccgagucccccaagcccaucuucgccaagaucaucaaccucuaccaccaccccggcugcggcggcaccacccucgccaugcacguccucugggaccucaagaagaacuuccgcugcgccguccucaagaacaagaccaccgacuucgccgagaucgccgagcaggucaucaaccucgucaccuaccgcgccaagucccaccaggacuacauccccguccuccuccucgucgacgacuucgaggagcaggagaacgucuacuuccuccagaacgccauccacuccguccucgccgagaaggaccuccgcuacgagaagacccucgucaucauccucaacugcaugcgcucccgcaaccccgacgaguccgccaagcucgccgacuccaucgcccucaacuaccagcucuccuccaaggagcagcgcgccuucggcgccaagcucaaggagaucgagaagcagcacaagaacugcgagaacuucuacuccuucaugaucaugaaguccaacuucgacgagaccuacaucgagaacgucguccgcaacauccucaagggccaggacgucgacuccaaggaggcccagcucaucuccuuccucgcccuccucuccuccuacgucaccgacuccaccaucuccgucucccagugcgagaucuuccucggcaucaucuacaccuccacccccugggagcccgagucccucgaggacaagaugggcaccuacuccacccuccucaucaagaccgaggucgccgaguacggccgcuacaccggcguccgcaucauccacccccucaucgcccucuacugccucaaggagcucgagcgcuccuaccaccucgacaagugccagaucgcccucaacauccucgaggagaaccucuucuacgacuccggcaucggccgcgacaaguuccagcacgacguccagacccuccuccucacccgccagcgcaaggucuacggcgacgagaccgacacccucuucuccccccucauggaggcccuccagaacaaggacaucgagaagguccucuccgccggcucccgccgcuucccccagaacgccuucaucugccaggcccucgcccgccacuucuacaucaaggagaaggacuucaacaccgcccucgacugggcccgccaggccaagaugaaggcccccaagaacuccuacaucuccgacacccucggccaggucuacaaguccgagaucaagugguggcucgacggcaacaagaacugccgcuccaucaccgucaacgaccucacccaccuccucgaggccgccgagaaggccucccgcgccuucaaggagucccagcgccagaccgacuccaagaacuacgagaccgagaacugguccccccagaagucccagcgccgcuacgacauguacaacaccgccugcuuccucggcgagaucgaggucggccucuacaccauccagauccuccagcucacccccuucuuccacaaggagaacgagcucuccaagaagcacaugguccaguuccucuccggcaaguggaccaucccccccgacccccgcaacgagugcuaccucgcccucuccaaguucaccucccaccucaagaaccuccaguccgaccucaagcgcugcuucgacuucuucaucgacuacaugguccuccucaagaugcgcuacacccagaaggagaucgccgagaucaugcucuccaagaaggucucccgcugcuuccgcaaguacaccgagcucuucugccaccucgaccccugccuccuccaguccaaggagucccagcuccuccaggaggagaacugccgcaagaagcucgaggcccuccgcgccgaccgcuucgccggccuccucgaguaccucaaccccaacuacaaggacgccaccaccauggaguccaucgucaacgaguacgccuuccuccuccagcagaacuccaagaagcccaugaccaacgagaagcagaacuccauccucgccaacaucauccucuccugccucaagcccaacuccaagcucauccagccccucaccacccucaagaagcagcuccgcgagguccuccaguucgucggccucucccaccaguaccccggccccuacuuccucgccugccuccucuucuggcccgagaaccaggagcucgaccaggacuccaagcucaucgagaaguacgucuccucccucaaccgcuccuuccgcggccaguacaagcgcaugugccgcuccaagcaggccuccacccucuucuaccucggcaagcgcaagggccucaacuccaucguccacaaggccaagaucgagcaguacuucgacaaggcccagaacaccaacucccucuggcacuccggcgacgucuggaagaagaacgaggucaaggaccuccuccgccgccucaccggccaggccgagggcaagcucaucuccgucgaguacggcaccgaggagaagaucaagauccccgucaucuccgucuacuccggcccccuccgcuccggccgcaacaucgagcgcgucuccuucuaccucggcuucuccaucgagggcccccucgccuacgacaucgaggucaucuga

SEQ ID NO: 49097 - RNA, 1881 nt, Artificial Sequence
  derived and/or modified sequence opt2 from SAMHD1__Homo_sapiens__NP_056289
augcagcgcgccgacuccgagcagcccuccaagcgcccccgcugcgacgacuccccccgcacccccuccaacacccccuccgccgaggccgacuggucccccggccucgagcuccaccccgacuacaagaccuggggccccgagcaggucugcuccuuccuccgccgcggcggcuucgaggagcccguccuccucaagaacauccgcgagaacgagaucaccggcgcccuccuccccugccucgacgagucccgcuucgagaaccucggcgucuccucccucggcgagcgcaagaagcuccucuccuacauccagcgccucguccagauccacgucgacaccaugaaggucaucaacgaccccauccacggccacaucgagcuccacccccuccucguccgcaucaucgacaccccccaguuccagcgccuccgcuacaucaagcagcucggcggcggcuacuacgucuuccccggcgccucccacaaccgcuucgagcacucccucggcgucggcuaccucgccggcugccucguccacgcccucggcgagaagcagcccgagcuccagaucuccgagcgcgacguccucugcguccagaucgccggccucugccacgaccucggccacggccccuucucccacauguucgacggccgcuucaucccccucgcccgccccgaggucaaguggacccacgagcagggcuccgucaugauguucgagcaccucaucaacuccaacggcaucaagcccgucauggagcaguacggccucauccccgaggaggacaucugcuucaucaaggagcagaucgucggcccccucgagucccccgucgaggacucccucuggcccuacaagggccgccccgagaacaaguccuuccucuacgagaucgucuccaacaagcgcaacggcaucgacgucgacaagugggacuacuucgcccgcgacugccaccaccucggcauccagaacaacuucgacuacaagcgcuucaucaaguucgcccgcgucugcgaggucgacaacgagcuccgcaucugcgcccgcgacaaggaggucggcaaccucuacgacauguuccacacccgcaacucccuccaccgccgcgccuaccagcacaaggucggcaacaucaucgacaccaugaucaccgacgccuuccucaaggccgacgacuacaucgagaucaccggcgccggcggcaagaaguaccgcaucuccaccgccaucgacgacauggaggccuacaccaagcucaccgacaacaucuuccucgagauccucuacuccaccgaccccaagcucaaggacgcccgcgagauccucaagcagaucgaguaccgcaaccucuucaaguacgucggcgagacccagcccaccggccagaucaagaucaagcgcgaggacuacgagucccuccccaaggaggucgccuccgccaagcccaagguccuccucgacgucaagcucaaggccgaggacuucaucgucgacgucaucaacauggacuacggcaugcaggagaagaaccccaucgaccacgucuccuucuacugcaagaccgcccccaaccgcgccauccgcaucaccaagaaccaggucucccagcuccuccccgagaaguucgccgagcagcucauccgcgucuacugcaagaaggucgaccgcaagucccucuacgccgcccgccaguacuucguccaguggugcgccgaccgcaacuucaccaagccccaggacggcgacgucaucgccccccucaucaccccccagaagaaggaguggaacgacuccaccuccguccagaaccccacccgccuccgcgaggccuccaagucccgcguccagcucuucaaggacgaccccauguga

SEQ ID NO: 49098 - RNA, 1410 nt, Artificial Sequence
  derived and/or modified sequence opt2 from SAMM50__Homo_sapiens__NP_056195
augggcaccguccacgcccgcucccucgagccccuccccuccuccggccccgacuucggcggccucggcgaggaggccgaguucgucgaggucgagcccgaggccaagcaggagauccucgagaacaaggacgucgucguccagcacguccacuucgacggccucggccgcaccaaggacgacaucaucaucugcgagaucggcgacgucuucaaggccaagaaccucaucgaggucaugcgcaagucccacgaggcccgcgagaagcuccuccgccucggcaucuuccgccaggucgacguccucaucgacaccugccagggcgacgacgcccuccccaacggccucgacgucaccuucgaggucaccgagcuccgccgccucaccggcuccuacaacaccauggucggcaacaacgagggcuccaugguccucggccucaagcuccccaaccuccucggccgcgccgagaaggucaccuuccaguucuccuacggcaccaaggagaccuccuacggccucuccuucuucaagccccgccccggcaacuucgagcgcaacuucuccgucaaccucuacaaggucaccggccaguuccccugguccucccuccgcgagaccgaccgcggcauguccgccgaguacuccuuccccaucuggaagaccucccacaccgucaagugggagggcgucuggcgcgagcucggcugccucucccgcaccgccuccuucgccguccgcaaggaguccggccacucccucaaguccucccucucccacgccauggucaucgacucccgcaacuccuccauccucccccgccgcggcgcccuccucaaggucaaccaggagcucgccggcuacaccggcggcgacgucuccuucaucaaggaggacuucgagcuccagcucaacaagcagcucaucuucgacuccgucuucuccgccuccuucuggggcggcaugcucguccccaucggcgacaagcccuccuccaucgccgaccgcuucuaccucggcggccccaccuccauccgcggcuucuccaugcacuccaucggcccccaguccgagggcgacuaccucggcggcgaggccuacugggccggcggccuccaccucuacaccccccuccccuuccgccccggccagggcggcuucggcgagcucuuccgcacccacuucuuccucaacgccggcaaccucugcaaccucaacuacggcgagggccccaaggcccacauccgcaagcucgccgagugcauccgcugguccuacggcgccggcaucguccuccgccucggcaacaucgcccgccucgagcucaacuacugcguccccaugggcguccagaccggcgaccgcaucugcgacggcguccaguucggcgccggcauccgcuuccucuga

SEQ ID NO: 49099 - RNA, 1326 nt, Artificial Sequence
  derived and/or modified sequence opt2 from SAMSN1__Homo_sapiens__NP_001243299
auggagauccgccucgacacccucuccgccucccucggccgcuccuccacccucaacaacugcaaccucgaggacaagcucgccugguacgagggcgaggccuacauguggcaccacuggaagcccuuccccgagaacccccucuggaccugccucgacuuccagaucgcccaggucggccccugggaccacugcuccuccugcauccgccacacccgccucaaguccuccugcuccgacauggaccuccuccacuccuggcgcuccuccuccuucggcaacuucgaccgcuuccgcaacaacucccucuccaagcccgacgacuccaccgaggcccacgagggcgaccccaccaacggcuccggcgagcaguccaagaccuccaacaacggcggcggccucggcaagaagaugcgcgccaucuccuggaccaugaagaagaaggucggcaagaaguacaucaaggcccucuccgaggagaaggacgaggaggacggcgagaacgcccaccccuaccgcaacuccgaccccgucaucggcacccacaccgagaaggucucccucaaggccuccgacuccauggacucccucuacuccggccaguccuccuccuccggcaucaccuccugcuccgacggcaccuccaaccgcgacuccuuccgccucgacgacgacggccccuacuccggccccuucugcggccgcgcccgcguccacaccgacuucacccccucccccuacgacaccgacucccucaagaucaagaagggcgacaucaucgacaucaucugcaagacccccaugggcauguggaccggcaugcucaacaacaaggucggcaacuucaaguucaucuacgucgacgucaucuccgaggaggaggccgcccccaagaagaucaaggccaaccgccgcuccaacuccaagaaguccaagacccuccaggaguuccucgagcgcauccaccuccaggaguacaccuccacccuccuccucaacggcuacgagacccucgaggaccucaaggacaucaaggagucccaccucaucgagcucaacaucgagaaccccgacgaccgccgccgccuccucuccgccgccgagaacuuccucgaggaggagaucauccaggagcaggagaacgagcccgagccccucucccucuccuccgacaucucccucaacaagucccagcucgacgacugcccccgcgacuccggcugcuacaucuccuccggcaacuccgacaacggcaaggaggaccucgaguccgagaaccucuccgacaugguccacaagaucaucaucaccgagcccuccgacuga

SEQ ID NO: 49100 - RNA, 879 nt, Artificial Sequence
  derived and/or modified sequence opt2 from SAP30BP__Homo_sapiens__NP_001288768
auggccggcaagaagaacguccucuccucccucgccgucuacgccgaggacuccgagcccgaguccgacggcgaggccggcaucgaggccgucggcuccgccgccgaggagaagggcggccucgucuccgacgccuacggcgaggacgacuucucccgccucggcggcgacgaggacggcuacgaggaggaggaggacgagaacucccgccaguccgacaacaccgaggccgagaagcgcgacccccaggagcucgucgccuccuucuccgagcgcguccgcaacaugucccccgacgagaucaagaucccccccgagccccccggccgcugcuccaaccaccuccaggacaagauccagaagcucuacgagcgcaagaucaaggagggcauggacaugaacuacaucauccagcgcaagaaggaguuccgcaaccccuccaucuacgagaagcucauccaguucugcgccaucgacgagcucggcaccaacuaccccaaggacauguucgacccccacggcugguccgaggacuccuacuacgaggcccucgccaaggcccagaagaucgagauggacaagcucgagaaggccaagaaggagcgcaccaagaucgaguucgucaccggcaccaagaagggcaccaccaccaacgccaccuccaccaccaccaccaccgccuccaccgccgucgccgacgcccagaagcgcaaguccaagugggacuccgccauccccgucaccaccaucgcccagcccaccauccucaccaccaccgccacccuccccgccgucgucaccgucaccaccuccgccuccggcuccaagaccaccgucaucuccgccgucggcaccaucgucaagaaggccaagcaguga

SEQ ID NO: 49101 - RNA, 429 nt, Artificial Sequence
  derived and/or modified sequence opt2 from SAP30L__Homo_sapiens__NP_001124534
augaacggcuucuccaccgaggaggacucccgcgagggcccccccgccgcccccgccgccgccgcccccggcuacggccaguccugcugccucaucgaggacggcgagcgcugcguccgccccgccggcaacgccuccuucuccaagcgcguccagaaguccaucucccagaagaagcucaagcucgacaucgacaaguccgucgaccucuuccagcuccaggucaacacccuccgccgcuacaagcgccacuacaagcuccagacccgccccggcuucaacaaggcccagcucgccgagaccgucucccgccacuuccgcaacauccccgucaacgagaaggagacccucgccuacuucaucuacauggucaaguccaacaagucccgccucgaccagaaguccgagggcggcaagcagcucgaguga

SEQ ID NO: 49102 - RNA, 537 nt, Artificial Sequence
  derived and/or modified sequence opt2 from SAPCD1__Homo_sapiens__NP_001034740
augggcucccagggcuccggcggcgucccccucguccaggcccccuacaccguccuccuccucccccucggcaccucccgccaggaccccggcgcccaguccuucuuccucuggcuccgccgcaugcaggcccucgagcgcgagcaggacgcccucuggcagggccucgagcuccuccagcacggccaggccugguucgaggaccaccuccgcgaggcccagcgccagcagcuccaccucggcgcccucggcgagaacuuccucaccgaccuccacuccgagcccggccgccccccccucgcccagauccagaaggucaacaucugccuccagaaccucauccacgagaaguucucccccuccccccucaacaaggccuccuccugcaccacccaggacuccaaggagcgccgccgcgagcagaaccucuggcagcagcaggagcucucccgccagcagaagggcgucacccagcccaaggaggagauggcccagcgcggcugcaccaagggcccccgcggccccacccgcgucuga

SEQ ID NO: 49103 - RNA, 1185 nt, Artificial Sequence
  derived and/or modified sequence opt2 from SAPCD2__Homo_sapiens__NP_848543
auggccggcgccgccauggccgagcgcggccgcguccccccccccgcccccgcccccuccaccgagggccucccccgcgccuuccuccagucccuccgcacccucuucgacauccucgacgaccgccgccgcggcugcguccaccuccgcgagaucgagucccgcuggcagggcaccgacgcccgcgagcucccccgcggcguccucgagggccuccgccaggucgcccccgccuccggcuaccucaccuucgagcgcuucgucgccggccuccgcaccucccuccucuccgccgacggcggcccccgcgaccccacccgcgcccccgcccgccccggcgaccagccccccccccccccccagcgccucgucuucgcccccgccgacgagccccgcaccguccucgagcgcaagccccucccccucggcguccgcgccccccucgccggccccuccgccgccgcccgcucccccgagcagcucugcgcccccgccgaggccgcccccugccccgccgagcccgagcgcucccaguccgccgcccucgagcccuccuccuccgccgacgccggcgccgucgccugccgcgcccucgaggccgacuccggcgacgcccgccgcgccccccgcgcccgcggcgagcgccgccgccacaccaucgccuccggcgucgacugcggccuccucaagcagaugaaggagcucgagcaggagaaggagguccuccuccagggccucgagaugauggcccgcggccgcgacugguaccagcagcagcuccagcgcguccaggagcgccagcgccgccucggccagucccgcgccuccgccgacuucggcgccgccggcuccccccgcccccucggccgccuccuccccaagguccaggaggucgcccgcugccucggcgagcuccucgccgccgccugcgccucccgcgcccucccccccuccuccuccggcccccccugccccgcccucaccuccaccuccccccccgucuggcagcagcagaccauccucaugcucaaggagcagaaccgccuccucacccaggaggucaccgagaaguccgagcgcaucacccagcucgagcaggagaaguccgcccucaucaagcagcucuucgaggcccgcgcccucucccagcaggacggcggcccccucgacuccaccuucaucuga

SEQ ID NO: 49104 - RNA, 597 nt, Artificial Sequence
  derived and/or modified sequence opt2 from SAR1A__Homo_sapiens__NP_001136120
auguccuucaucuucgaguggaucuacaacggcuucuccuccguccuccaguuccucggccucuacaagaaguccggcaagcucgucuuccucggccucgacaacgccggcaagaccacccuccuccacaugcucaaggacgaccgccucggccagcacguccccacccuccaccccaccuccgaggagcucaccaucgccggcaugaccuucaccaccuucgaccucggcggccacgagcaggcccgccgcgucuggaagaacuaccuccccgccaucaacggcaucgucuuccucgucgacugcgccgaccacucccgccucgucgaguccaaggucgagcucaacgcccucaugaccgacgagaccaucuccaacguccccauccucauccucggcaacaagaucgaccgcaccgacgccaucuccgaggagaagcuccgcgagaucuucggccucuacggccagaccaccggcaagggcaacgucacccucaaggagcucaacgcccgccccauggaggucuucaugugcuccguccucaagcgccagggcuacggcgagggcuuccgcuggcucucccaguacaucgacuga

SEQ ID NO: 49105 - RNA, 597 nt, Artificial Sequence
  derived and/or modified sequence opt2 from SAR1B__Homo_sapiens__NP_001028675
auguccuucaucuucgacuggaucuacuccggcuucuccuccguccuccaguuccucggccucuacaagaagaccggcaagcucgucuuccucggccucgacaacgccggcaagaccacccuccuccacaugcucaaggacgaccgccucggccagcacguccccacccuccaccccaccuccgaggagcucaccaucgccggcaugaccuucaccaccuucgaccucggcggccacguccaggcccgccgcgucuggaagaacuaccuccccgccaucaacggcaucgucuuccucgucgacugcgccgaccacgagcgccuccucgaguccaaggaggagcucgacucccucaugaccgacgagaccaucgccaacguccccauccucauccucggcaacaagaucgaccgccccgaggccaucuccgaggagcgccuccgcgagauguucggccucuacggccagaccaccggcaagggcuccaucucccucaaggagcucaacgcccgcccccucgaggucuucaugugcuccguccucaagcgccagggcuacggcgagggcuuccgcuggauggcccaguacaucgacuga

SEQ ID NO: 49106 - RNA, 2757 nt, Artificial Sequence
  derived and/or modified sequence opt2 from SARDH__Homo_sapiens__NP_001128179
auggccucccucucccgcgcccuccgcgucgccgccgcccacccccgccagucccccacccgcggcaugggccccugcaaccucuccuccgccgccggccccaccgccgagaaguccguccccuaccagcgcacccucaaggagggccagggcaccuccgucgucgcccagggccccucccgcccccuccccuccaccgccaacgucgucgucaucggcggcggcucccucggcugccagacccucuaccaccucgccaagcucggcauguccggcgccguccuccucgagcgcgagcgccucaccuccggcaccaccuggcacaccgccggccuccucuggcagcuccgccccuccgacgucgaggucgagcuccucgcccacacccgccgcgucgucucccgcgagcucgaggaggagaccggccuccacaccggcuggauccagaacggcggccucuucaucgccuccaaccgccagcgccucgacgaguacaagcgccucaugucccucggcaaggccuacggcgucgagucccacguccucucccccgccgagaccaagacccucuacccccucaugaacgucgacgaccucuacggcacccucuacgucccccacgacggcaccauggaccccgccggcaccugcaccacccucgcccgcgccgccuccgcccgcggcgcccaggucaucgagaacugccccgucaccggcauccgcgucuggaccgacgacuucggcguccgccgcgucgccggcgucgagacccagcacggcuccauccagacccccugcgucgucaacugcgccggcgucugggccuccgccgucggccgcauggccggcgucaaggucccccucgucgccaugcaccacgccuacgucgucaccgagcgcaucgagggcauccagaacaugcccaacguccgcgaccacgacgccuccgucuaccuccgccuccagggcgacgcccucuccgucggcggcuacgaggccaaccccaucuucugggaggaggucuccgacaaguucgccuucggccucuucgaccucgacugggaggucuucacccagcacaucgagggcgccaucaaccgcguccccguccucgagaagaccggcaucaaguccaccgucugcggccccgaguccuucacccccgaccacaagccccucaugggcgaggcccccgagcuccgcggcuucuuccucggcugcggcuucaacuccgccggcaugaugcucggcggcggcugcggccaggagcucgcccacuggaucauccacggccgccccgagaaggacaugcacggcuacgacauccgccgcuuccaccacucccucaccgaccacccccgcuggauccgcgagcgcucccacgaguccuacgccaagaacuacuccgucgucuucccccacgacgagccccucgccggccgcaacaugcgccgcgacccccuccacgaggagcuccucggccagggcugcgucuuccaggagcgccacggcugggagcgccccggcugguuccacccccgcggccccgcccccguccucgaguacgacuacuacggcgccuacggcucccgcgcccacgaggacuacgccuaccgccgccuccucgccgacgaguacaccuucgccuuccccccccaccacgacaccaucaagaaggagugccucgccugccgcggcgccgccgccgucuucgacauguccuacuucggcaaguucuaccucgucggccucgacgcccgcaaggccgccgacuggcucuucuccgccgacgucucccgcccccccggcuccaccgucuacaccugcaugcucaaccaccgcggcggcaccgaguccgaccucaccgucucccgccucgcccccucccaccaggccuccccccucgcccccgccuucgagggcgacggcuacuaccucgccaugggcggcgccgucgcccagcacaacuggucccacaucaccaccguccuccaggaccagaagucccagugccagcucaucgacuccuccgaggaccucggcaugaucuccauccagggccccgccucccgcgccauccuccaggagguccucgacgccgaccucuccaacgaggccuuccccuucuccacccacaagcuccuccgcgccgccggccaccucguccgcgccaugcgccucuccuucgucggcgagcucggcugggagcuccacauccccaaggccuccugcguccccgucuaccgcgccgucauggccgccggcgccaagcacggccucaucaacgccggcuaccgcgccaucgacucccucuccaucgagaagggcuaccgccacuggcacgccgaccuccgccccgacgacuccccccucgaggccggccucgccuucaccugcaagcucaagucccccguccccuuccucggccgcgaggcccucgagcagcagcgcgccgccggccuccgccgccgccucgucugcuucaccauggaggacaagguccccauguucggccucgaggccaucuggcgcaacggccaggucgucggccacguccgccgcgccgacuucggcuucgccaucgacaagaccaucgccuacggcuacauccacgaccccuccggcggccccgucucccucgacuucgucaaguccggcgacuacgcccucgagcgcaugggcgucaccuacggcgcccaggcccaccucaagucccccuucgaccccaacaacaagcgcgucaagggcaucuacuga

SEQ ID NO: 49107 - RNA, 2175 nt, Artificial Sequence
  derived and/or modified sequence opt2 from SARM1__Homo_sapiens__NP_055892
augguccucacccuccuccucuccgccuacaagcucugccgcuucuucgccauguccggcccccgccccggcgccgagcgccucgccguccccggccccgacggcggcggcggcaccggccccuggugggccgccggcggccgcggcccccgcgaggucucccccggcgccggcaccgagguccaggacgcccucgagcgcgcccuccccgagcuccagcaggcccucuccgcccucaagcaggccggcggcgcccgcgccgucggcgccggccucgccgaggucuuccagcucgucgaggaggccuggcuccuccccgccgucggccgcgaggucgcccagggccucugcgacgccauccgccucgacggcggccucgaccuccuccuccgccuccuccaggcccccgagcucgagacccgcguccaggccgcccgccuccucgagcagauccucgucgccgagaaccgcgaccgcgucgcccgcaucggccucggcgucauccucaaccucgccaaggagcgcgagcccgucgagcucgcccgcuccgucgccggcauccucgagcacauguucaagcacuccgaggagaccugccagcgccucgucgccgccggcggccucgacgccguccucuacuggugccgccgcaccgaccccgcccuccuccgccacugcgcccucgcccucggcaacugcgcccuccacggcggccaggccguccagcgccgcauggucgagaagcgcgccgccgaguggcucuucccccucgccuucuccaaggaggacgagcuccuccgccuccacgccugccucgccgucgccguccucgccaccaacaaggaggucgagcgcgaggucgagcgcuccggcacccucgcccucgucgagccccucgucgccucccucgaccccggccgcuucgcccgcugccucgucgacgccuccgacaccucccagggccgcggccccgacgaccuccagcgccucgucccccuccucgacuccaaccgccucgaggcccagugcaucggcgccuucuaccucugcgccgaggccgccaucaagucccuccagggcaagaccaaggucuucuccgacaucggcgccauccagucccucaagcgccucgucuccuacuccaccaacggcaccaaguccgcccucgccaagcgcgcccuccgccuccucggcgaggaggucccccgccccauccuccccuccguccccuccuggaaggaggccgagguccagaccuggcuccagcagaucggcuucuccaaguacugcgaguccuuccgcgagcagcaggucgacggcgaccuccuccuccgccucaccgaggaggagcuccagaccgaccucggcaugaaguccggcaucacccgcaagcgcuucuuccgcgagcucaccgagcucaagaccuucgccaacuacuccaccugcgaccgcuccaaccucgccgacuggcucggcucccucgacccccgcuuccgccaguacaccuacggccucgucuccugcggccucgaccgcucccuccuccaccgcgucuccgagcagcagcuccucgaggacugcggcauccaccucggcguccaccgcgcccgcauccucaccgccgcccgcgagaugcuccacuccccccuccccugcaccggcggcaagcccuccggcgacacccccgacgucuucaucuccuaccgccgcaacuccggcucccagcucgccucccuccucaagguccaccuccagcuccacggcuucuccgucuucaucgacgucgagaagcucgaggccggcaaguucgaggacaagcucauccaguccgucaugggcgcccgcaacuucguccucguccucucccccggcgcccucgacaagugcaugcaggaccacgacugcaaggacuggguccacaaggagaucgucaccgcccucuccugcggcaagaacaucguccccaucaucgacggcuucgaguggcccgagccccagguccuccccgaggacaugcaggccguccucaccuucaacggcaucaaguggucccacgaguaccaggaggccaccaucgagaagaucauccgcuuccuccagggccgcuccucccgcgacuccuccgccggcuccgacaccucccucgagggcgccgcccccaugggccccaccuga

SEQ ID NO: 49108 - RNA, 633 nt, Artificial Sequence
  derived and/or modified sequence opt2 from SARNP__Homo_sapiens__NP_149073
auggccaccgagaccgucgagcuccacaagcucaagcucgccgagcucaagcaggagugccucgcccgcggccucgagaccaagggcaucaagcaggaccucauccaccgccuccaggccuaccucgaggagcacgccgaggaggaggccaacgaggaggacguccucggcgacgagaccgaggaggaggagaccaagcccaucgagcuccccgucaaggaggaggagccccccgagaagaccgucgacgucgccgccgagaagaaggucgucaagaucaccuccgagaucccccagaccgagcgcaugcagaagcgcgccgagcgcuucaacguccccgucucccucgaguccaagaaggccgcccgcgccgcccgcuucggcaucuccuccguccccaccaagggccucuccuccgacaacaagcccauggucaaccucgacaagcucaaggagcgcgcccagcgcuucggccucaacgucuccuccaucucccgcaaguccgaggacgacgagaagcucaagaagcgcaaggagcgcuucggcaucgucaccuccuccgccggcaccggcaccaccgaggacaccgaggccaagaagcgcaagcgcgccgagcgcuucggcaucgccuga

SEQ ID NO: 49109 - RNA, 1563 nt, Artificial Sequence
  derived and/or modified sequence opt2 from SARS2__Homo_sapiens__NP_001139373
auggccgccuccauggcccgccgccucuggccccuccucacccgccgcggcuuccgcccccgcggcggcugcaucuccaacgacuccccccgccgcuccuucaccaccgagaagcgcaaccgcaaccuccucuacgaguacgcccgcgagggcuacuccgcccucccccagcucgacaucgagcgcuucugcgccugccccgaggaggccgcccacgcccucgagcuccgcaagggcgagcuccgcuccgccgaccuccccgccaucaucuccaccuggcaggagcuccgccagcuccaggagcagauccgcucccucgaggaggagaaggccgccgucaccgaggccguccgcgcccuccucgccaaccaggacuccggcgagguccagcagguccgccucgaccccggcgccggcuccaucuucggccccaccuuccuccccuuccccggccagcucucccuccucgucgaggcccagcucgaggagcaguucuaccuccaggcccucaagcuccccaaccagacccaccccgacguccccgucggcgacgagucccaggcccgcguccuccacauggucggcgacaagcccgucuucuccuuccagccccgcggccaccucgagaucggcgagaagcucgacaucauccgccagaagcgccucucccacgucuccggccaccgcuccuacuaccuccgcggcgccggcgcccuccuccagcacggccucgucaacuucaccuucaacaagcuccuccgccgcggcuucacccccaugaccguccccgaccuccuccgcggcgccgucuucgagggcugcggcaugacccccaacgccaaccccucccagaucuacaacaucgaccccgcccgcuucaaggaccucaaccucgccggcaccgccgaggucggccucgccggcuacuucauggaccacaccgucgccuuccgcgaccuccccguccgcauggucugcuccuccaccugcuaccgcgccgagaccaacaccggccaggagccccgcggccucuaccgcguccaccacuucaccaaggucgagauguucggcgucaccggccccggccucgagcaguccucccagcuccucgaggaguuccucucccuccagauggagauccucaccgagcucggccuccacuuccgcguccucgacaugcccacccaggagcucggccuccccgccuaccgcaaguucgacaucgaggccuggaugcccggccgcggccgcuucggcgaggucaccuccgccuccaacugcaccgacuuccagucccgccgccuccacaucauguuccagaccgaggccggcgagcuccaguucgcccacaccgucaacgccaccgccugcgccgucccccgccuccucaucgcccuccucgaguccaaccagcagaaggacggcuccguccucgucccccccgcccuccaguccuaccucggcaccgaccgcaucaccgcccccacccacgucccccuccaguacaucggccccaaccagccccgcaagcccggccuccccggccagcccgccgucuccuga

SEQ ID NO: 49110 - RNA, 2403 nt, Artificial Sequence
  derived and/or modified sequence opt2 from SART1__Homo_sapiens__NP_005137
augggcuccuccaagaagcaccgcggcgagaaggaggccgccggcaccaccgccgccgccggcaccggcggcgccaccgagcagcccccccgccaccgcgagcacaagaagcacaagcaccgcuccggcggcuccggcggcuccggcggcgagcgccgcaagcgcucccgcgagcgcggcggcgagcgcggcuccggccgccgcggcgccgaggccgaggcccgcuccuccacccacggccgcgagcgcucccaggccgagcccuccgagcgccgcgucaagcgcgagaagcgcgacgacggcuacgaggccgccgccuccuccaagaccuccuccggcgacgccuccucccucuccaucgaggagaccaacaagcuccgcgccaagcucggccucaagccccucgaggucaacgccaucaagaaggaggccggcaccaaggaggagcccgucaccgccgacgucaucaaccccauggcccuccgccagcgcgaggagcuccgcgagaagcucgccgccgccaaggagaagcgccuccucaaccagaagcucggcaagaucaagacccucggcgaggacgaccccuggcucgacgacaccgccgccuggaucgagcgcucccgccagcuccagaaggagaaggaccucgccgagaagcgcgccaagcuccucgaggagauggaccaggaguucggcgucuccacccucgucgaggaggaguucggccagcgccgccaggaccucuacuccgcccgcgaccuccagggccucaccgucgagcacgccaucgacuccuuccgcgagggcgagaccaugauccucacccucaaggacaagggcguccuccaggaggaggaggacguccucgucaacgucaaccucgucgacaaggagcgcgccgagaagaacgucgagcuccgcaagaagaagcccgacuaccuccccuacgccgaggacgaguccgucgacgaccucgcccagcagaagccccgcuccauccucuccaaguacgacgaggagcucgagggcgagcgcccccacuccuuccgccucgagcagggcggcaccgccgacggccuccgcgagcgcgagcucgaggagauccgcgccaagcuccgccuccaggcccagucccucuccaccgucggcccccgccucgccuccgaguaccucacccccgaggagauggucaccuucaagaagaccaagcgccgcgucaagaagauccgcaagaaggagaaggaggucgucguccgcgccgacgaccuccucccccucggcgaccagacccaggacggcgacuucggcucccgccuccgcggccgcggccgccgccgcgucuccgaggucgaggaggagaaggagcccgucccccagccccuccccuccgacgacacccgcgucgagaacauggacaucuccgacgaggaggagggcggcgcccccccccccggcuccccccagguccucgaggaggacgaggccgagcucgagcuccagaagcagcucgagaagggccgccgccuccgccagcuccagcagcuccagcagcuccgcgacuccggcgagaaggucgucgagaucgucaagaagcucgagucccgccagcgcggcugggaggaggacgaggaccccgagcgcaagggcgccaucgucuucaacgccaccuccgaguucugccgcacccucggcgagauccccaccuacggccucgccggcaaccgcgaggagcaggaggagcucauggacuucgagcgcgacgaggagcgcuccgccaacggcggcuccgaguccgacggcgaggagaacaucggcugguccaccgucaaccucgacgaggagaagcagcagcaggacuucuccgccuccuccaccaccauccucgacgaggagcccaucgucaaccgcggccucgccgccgcccuccuccucugccagaacaagggccuccucgagaccaccguccagaaggucgcccgcgucaaggcccccaacaagucccuccccuccgccgucuacugcaucgaggacaagauggccaucgacgacaaguacucccgccgcgaggaguaccgcggcuucacccaggacuucaaggagaaggacggcuacaagcccgacgucaagaucgaguacgucgacgagaccggccgcaagcucacccccaaggaggccuuccgccagcucucccaccgcuuccacggcaagggcuccggcaagaugaagaccgagcgccgcaugaagaagcucgacgaggaggcccuccucaagaagauguccuccuccgacaccccccucggcaccgucgcccuccuccaggagaagcagaaggcccagaagacccccuacaucguccucuccggcuccggcaaguccaugaacgccaacaccaucaccaaguga

SEQ ID NO: 49111 - RNA, 2892 nt, Artificial Sequence
  derived and/or modified sequence opt2 from SART3__Homo_sapiens__NP_055521
auggccaccgccgccgagaccuccgccuccgagcccgaggccgaguccaaggccggccccaaggccgacggcgaggaggacgaggucaaggccgcccgcacccgccgcaagguccucucccgcgccgucgccgccgccaccuacaagaccaugggccccgccugggaccagcaggaggagggcgucuccgaguccgacggcgacgaguacgccauggccuccuccgccgaguccucccccggcgaguacgagugggaguacgacgaggaggaggagaagaaccagcucgagaucgagcgccucgaggagcagcucuccaucaacgucuacgacuacaacugccacgucgaccucauccgccuccuccgccucgagggcgagcucaccaagguccgcauggcccgccagaagauguccgagaucuucccccucaccgaggagcucuggcucgaguggcuccacgacgagaucuccauggcccaggacggccucgaccgcgagcacgucuacgaccucuucgagaaggccgucaaggacuacaucugccccaacaucuggcucgaguacggccaguacuccgucggcggcaucggccagaagggcggccucgagaagguccgcuccgucuucgagcgcgcccucuccuccgucggccuccacaugaccaagggccucgcccucugggaggccuaccgcgaguucgaguccgccaucgucgaggccgcccgccucgagaagguccacucccucuuccgccgccagcucgccaucccccucuacgacauggaggccaccuucgccgaguacgaggagugguccgaggaccccauccccgaguccgucauccagaacuacaacaaggcccuccagcagcucgagaaguacaagcccuacgaggaggcccuccuccaggccgaggccccccgccucgccgaguaccaggccuacaucgacuucgagaugaagaucggcgaccccgcccgcauccagcucaucuucgagcgcgcccucgucgagaacugccucguccccgaccucuggauccgcuacucccaguaccucgaccgccagcucaaggucaaggaccucguccucuccguccacaaccgcgccauccgcaacugccccuggaccgucgcccucuggucccgcuaccuccucgccauggagcgccacggcgucgaccaccaggucaucuccgucaccuucgagaaggcccucaacgccggcuucauccaggccaccgacuacgucgagaucuggcaggccuaccucgacuaccuccgccgccgcgucgacuucaagcaggacuccuccaaggagcucgaggagcuccgcgccgccuucacccgcgcccucgaguaccucaagcaggaggucgaggagcgcuucaacgaguccggcgaccccuccugcgucaucaugcagaacugggcccgcaucgaggcccgccucugcaacaacaugcagaaggcccgcgagcucugggacuccaucaugacccgcggcaacgccaaguacgccaacauguggcucgaguacuacaaccucgagcgcgcccacggcgacacccagcacugccgcaaggcccuccaccgcgccguccagugcaccuccgacuaccccgagcacgucugcgagguccuccucaccauggagcgcaccgagggcucccucgaggacugggacaucgccguccagaagaccgagacccgccucgcccgcgucaacgagcagcgcaugaaggccgccgagaaggaggccgcccucguccagcaggaggaggagaaggccgagcagcgcaagcgcgcccgcgccgagaagaaggcccucaagaagaagaagaagauccgcggccccgagaagcgcggcgccgacgaggacgacgagaaggaguggggcgacgacgaggaggagcagcccuccaagcgccgccgcgucgagaacuccauccccgccgccggcgagacccagaacgucgaggucgccgccggccccgccggcaagugcgccgccgucgacgucgagccccccuccaagcagaaggagaaggccgccucccucaagcgcgacaugcccaagguccuccacgacuccuccaaggacuccaucaccgucuucgucuccaaccuccccuacuccaugcaggagcccgacaccaagcuccgcccccucuucgaggccugcggcgaggucguccagauccgccccaucuucuccaaccgcggcgacuuccgcggcuacugcuacgucgaguucaaggaggagaaguccgcccuccaggcccucgagauggaccgcaaguccgucgagggccgccccauguucgucucccccugcgucgacaaguccaagaaccccgacuucaaggucuuccgcuacuccaccucccucgagaagcacaagcucuucaucuccggccuccccuucuccugcaccaaggaggagcucgaggagaucugcaaggcccacggcaccgucaaggaccuccgccucgucaccaaccgcgccggcaagcccaagggccucgccuacgucgaguacgagaacgagucccaggccucccaggccgucaugaagauggacggcaugaccaucaaggagaacaucaucaaggucgccaucuccaaccccccccagcgcaagguccccgagaagcccgagacccgcaaggcccccggcggccccaugcuccucccccagaccuacggcgcccgcggcaagggccgcacccagcucucccuccucccccgcgcccuccagcgccccuccgccgccgccccccaggccgagaacggccccgccgccgcccccgccgucgccgcccccgccgccaccgaggcccccaagauguccaacgccgacuucgccaagcucuuccuccgcaaguga

SEQ ID NO: 49112 - RNA, 3744 nt, Artificial Sequence
  derived and/or modified sequence opt2 from SASH1__Homo_sapiens__NP_056093
auggaggacgccggcgccgccggccccggccccgagcccgagcccgagcccgagcccgagcccgagcccgcccccgagcccgagcccgagcccaagcccggcgccggcaccuccgaggccuucucccgccucuggaccgacgucaugggcauccucgacggcucccucggcaacaucgacgaccucgcccagcaguacgccgacuacuacaacaccugcuucuccgacgucugcgagcgcauggaggagcuccgcaagcgccgcgucucccaggaccucgaggucgagaagcccgacgccucccccaccucccuccagcuccgcucccagaucgaggagucccucggcuucugcuccgccgucuccacccccgaggucgagcgcaagaacccccuccacaaguccaacuccgaggacuccuccgucggcaagggcgacuggaagaagaagaacaaguacuucuggcagaacuuccgcaagaaccagaagggcaucaugcgccagaccuccaagggcgaggacgucggcuacgucgccuccgagaucaccauguccgacgaggagcgcauccagcucaugaugauggucaaggagaagaugaucaccaucgaggaggcccucgcccgccucaaggaguacgaggcccagcaccgccaguccgccgcccucgaccccgccgacuggcccgacggcuccuaccccaccuucgacggcuccuccaacugcaacucccgcgagcaguccgacgacgagaccgaggaguccgucaaguucaagcgccuccacaagcucgucaacuccacccgccgcguccgcaagaagcucauccgcgucgaggagaugaagaagcccuccaccgagggcggcgaggagcacgucuucgagaacucccccguccucgacgagcgcuccgcccucuacuccggcguccacaagaagccccucuucuucgacggcucccccgagaagccccccgaggacgacuccgacucccucaccaccucccccuccuccuccucccucgacaccuggggcgccggccgcaagcucgucaagaccuucuccaagggcgagucccgcggccucaucaagccccccaagaagaugggcaccuucuucuccuaccccgaggaggagaaggcccagaaggucucccgcucccucaccgagggcgagaugaagaagggccucggcucccucucccacggccgcaccugcuccuucggcggcuucgaccucaccaaccgcucccuccacgucggcuccaacaacuccgaccccaugggcaaggagggcgacuucgucuacaaggaggucaucaagucccccaccgccucccgcaucucccucggcaagaaggucaaguccgucaaggagaccaugcgcaagcgcauguccaagaaguacuccuccuccgucuccgagcaggacuccggccucgacggcaugcccggcucccccccccccucccagcccgaccccgagcaccucgacaagcccaagcucaaggccggcggcuccgucgagucccuccgcuccucccucuccggccaguccuccauguccggccagaccgucuccaccaccgacuccuccaccuccaaccgcgaguccgucaaguccgaggacggcgacgacgaggagccccccuaccgcggccccuucugcggccgcgcccgcguccacaccgacuucacccccucccccuacgacaccgacucccucaagcucaagaagggcgacaucaucgacaucaucuccaagccccccaugggcaccuggaugggccuccucaacaacaaggucggcaccuucaaguucaucuacgucgacguccucuccgaggacgaggagaagcccaagcgccccacccgccgccgccgcaagggccgccccccccagcccaaguccgucgaggaccuccucgaccgcaucaaccucaaggagcacaugcccaccuuccucuucaacggcuacgaggaccucgacaccuucaagcuccucgaggaggaggaccucgacgagcucaacauccgcgaccccgagcaccgcgccguccuccucaccgccgucgagcuccuccaggaguacgacuccaacuccgaccaguccggcucccaggagaagcuccucgucgacucccagggccucuccggcugcuccccccgcgacuccggcugcuacgaguccuccgagaaccucgagaacggcaagacccgcaaggccucccuccucuccgccaaguccuccaccgagcccucccucaaguccuucucccgcaaccagcucggcaacuaccccacccucccccucaugaaguccggcgacgcccucaagcagggccaggaggagggccgccucggcggcggccucgcccccgacaccuccaaguccugcgacccccccggcgucaccggccucaacaagaaccgccgcucccuccccgucuccaucugccgcuccugcgagacccucgagggcccccagaccgucgacaccuggccccgcucccacucccucgacgaccuccaggucgagcccggcgccgagcaggacguccccaccgaggucaccgagccccccccccagaucguccccgaggucccccagaagaccaccgccuccuccaccaaggcccagccccucgagcaggacuccgccgucgacaacgcccuccuccucacccaguccaagcgcuucuccgagccccagaagcucaccaccaagaagcucgagggcuccaucgccgccuccggccgcggccucucccccccccagugccucccccgcaacuacgacgcccagccccccggcgccaagcacggccucgcccgcaccccccucgagggccaccgcaagggccacgaguucgagggcacccaccacccccucggcaccaaggagggcgucgacgccgagcagcgcaugcagcccaagauccccucccagcccccccccguccccgccaagaagucccgcgagcgccucgccaacggccuccaccccguccccaugggccccuccggcgcccuccccucccccgacgcccccugccuccccgucaagcgcggcucccccgccucccccaccucccccuccgacugcccccccgcccucgccccccgcccccucuccggccaggcccccggcuccccccccuccacccgccccccccccuggcucuccgagcuccccgagaacaccucccuccaggagcacggcgucaagcucggccccgcccucacccgcaaggucuccugcgcccgcggcgucgaccucgagacccucaccgagaacaagcuccacgccgagggcaucgaccucaccgaggagcccuacuccgacaagcacggccgcugcggcauccccgaggcccucguccagcgcuacgccgaggaccucgaccagcccgagcgcgacgucgccgccaacauggaccagauccgcgucaagcagcuccgcaagcagcaccgcauggccauccccuccggcggccucaccgagaucugccgcaagcccgucucccccggcugcaucuccuccgucuccgacuggcucaucuccaucggccuccccauguacgccggcacccucuccaccgccggcuucuccacccucucccagguccccucccucucccacaccugccuccaggaggccggcaucaccgaggagcgccacauccgcaagcuccucuccgccgcccgccucuucaagcucccccccggccccgaggccauguga

SEQ ID NO: 49113 - RNA, 1143 nt, Artificial Sequence
  derived and/or modified sequence opt2 from SASH3__Homo_sapiens__NP_061863
augcuccgccgcaagcccuccaacgccuccgagaaggagcccacccagaagaagaagcucucccuccagcgcuccuccuccuucaaggacuucgccaaguccaagcccuccucccccgucgucuccgagaaggaguucaaccucgacgacaacauccccgaggacgacuccggcguccccacccccgaggacgccggcaaguccggcaagaagcucggcaagaaguggcgcgccgucaucucccgcaccaugaaccgcaagaugggcaagaugauggucaaggcccucuccgaggagauggccgacacccucgaggagggcuccgccucccccaccucccccgacuacucccucgacucccccggccccgagaagauggcccucgccuucuccgagcaggaggagcacgagcuccccguccucucccgccaggccuccaccggcuccgagcucugcucccccucccccggcuccggcuccuucggcgaggagccccccgccccccaguacaccggccccuucugcggccgcgcccgcguccacaccgacuucacccccucccccuacgaccacgacucccucaagcuccagaagggcgacgucauccagaucaucgagaagccccccgucggcaccuggcucggccuccucaacggcaaggucggcuccuucaaguucaucuacgucgacguccuccccgaggaggccgucggccacgcccgccccucccgccgccaguccaagggcaagcgccccaagcccaagacccuccacgagcuccucgagcgcaucggccucgaggagcacaccuccacccuccuccucaacggcuaccagacccucgaggacuucaaggagcuccgcgagacccaccucaacgagcucaacaucauggacccccagcaccgcgccaagcuccucaccgccgccgagcuccuccucgacuacgacaccggcuccgaggaggccgaggagggcgccgaguccucccaggagcccgucgcccacaccgucuccgagcccaaggucgacaucccccgcgacuccggcugcuucgagggcuccgaguccggccgcgacgacgccgagcucgccggcaccgaggagcagcuccagggccucucccucgccggcgcccccuga

SEQ ID NO: 49114 - RNA, 516 nt, Artificial Sequence
  derived and/or modified sequence opt2 from SAT1__Homo_sapiens__NP_002961
auggccaaguucgucauccgccccgccaccgccgccgacugcuccgacauccuccgccucaucaaggagcucgccaaguacgaguacauggaggagcaggucauccucaccgagaaggaccuccucgaggacggcuucggcgagcaccccuucuaccacugccucgucgccgagguccccaaggagcacuggacccccgagggccacuccaucgucggcuucgccauguacuacuucaccuacgaccccuggaucggcaagcuccucuaccucgaggacuucuucgucauguccgacuaccgcggcuucggcaucggcuccgagauccucaagaaccucucccaggucgccaugcgcugccgcugcuccuccaugcacuuccucgucgccgaguggaacgagcccuccaucaacuucuacaagcgccgcggcgccuccgaccucuccuccgaggagggcuggcgccucuucaagaucgacaaggaguaccuccucaagauggccaccgaggaguga

SEQ ID NO: 49115 - RNA, 513 nt, Artificial Sequence
  derived and/or modified sequence opt2 from SAT2__Homo_sapiens__NP_597998
auggccuccguccgcauccgcgaggccaaggagggcgacugcggcgacauccuccgccucauccgcgagcucgccgaguucgagaagcucuccgaccaggucaagaucuccgaggaggcccuccgcgccgacggcuucggcgacaaccccuucuaccacugccucgucgccgagauccuccccgcccccggcaagcuccucggccccugcgucgucggcuacggcaucuacuacuucaucuacuccaccuggaagggccgcaccaucuaccucgaggacaucuacgucaugcccgaguaccgcggccagggcaucggcuccaagaucaucaagaaggucgccgaggucgcccucgacaagggcugcucccaguuccgccucgccguccucgacuggaaccagcgcgccauggaccucuacaaggcccucggcgcccaggaccucaccgaggccgagggcuggcacuucuucugcuuccagggcgaggccacccgcaagcucgccggcaaguga

SEQ ID NO: 49116 - RNA, 2388 nt, Artificial Sequence
  derived and/or modified sequence opt2 from SATB1__Homo_sapiens__NP_001182399
auggaccaccucaacgaggccacccagggcaaggagcacuccgagauguccaacaacgucuccgaccccaagggcccccccgccaagaucgcccgccucgagcagaacggcuccccccucggccgcggccgccucggcuccaccggcgccaagaugcagggcgucccccucaagcacuccggccaccucaugaagaccaaccuccgcaagggcaccaugcuccccgucuucugcgucgucgagcacuacgagaacgccaucgaguacgacugcaaggaggagcacgccgaguucguccucguccgcaaggacaugcucuucaaccagcucaucgagauggcccuccucucccucggcuacucccacuccuccgccgcccaggccaagggccucauccaggucggcaaguggaaccccgucccccucuccuacgucaccgacgcccccgacgccaccgucgccgacaugcuccaggacgucuaccacgucgucacccucaagauccagcuccacuccugccccaagcucgaggaccucccccccgagcaguggucccacaccaccguccgcaacgcccucaaggaccuccucaaggacaugaaccaguccucccucgccaaggagugcccccucucccaguccaugaucuccuccaucgucaacuccaccuacuacgccaacgucuccgccgccaagugccaggaguucggccgcugguacaagcacuucaagaagaccaaggacaugauggucgagauggacucccucuccgagcucucccagcagggcgccaaccacgucaacuucggccagcagcccguccccggcaacaccgccgagcagccccccucccccgcccagcucucccacggcucccagcccuccguccgcaccccccuccccaaccuccaccccggccucgucuccacccccaucuccccccagcucgucaaccagcagcucgucauggcccagcuccucaaccagcaguacgccgucaaccgccuccucgcccagcagucccucaaccagcaguaccucaaccaccccccccccgucucccgcuccaugaacaagccccucgagcagcaggucuccaccaacaccgaggucuccuccgagaucuaccaguggguccgcgacgagcucaagcgcgccggcaucucccaggccgucuucgcccgcgucgccuucaaccgcacccagggccuccucuccgagauccuccgcaaggaggaggaccccaagaccgccucccagucccuccucgucaaccuccgcgccaugcagaacuuccuccagcuccccgaggccgagcgcgaccgcaucuaccaggacgagcgcgagcgcucccucaacgccgccuccgccaugggccccgccccccucaucuccaccccccccucccgccccccccaggucaagaccgccaccaucgccaccgagcgcaacggcaagcccgagaacaacaccaugaacaucaacgccuccaucuacgacgagauccagcaggagaugaagcgcgccaaggucucccaggcccucuucgccaaggucgccgccaccaagucccagggcuggcucugcgagcuccuccgcuggaaggaggaccccucccccgagaaccgcacccucugggagaaccucuccaugauccgccgcuuccucucccucccccagcccgagcgcgacgccaucuacgagcaggaguccaacgccguccaccaccacggcgaccgccccccccacaucauccacguccccgccgagcagauccagucccccucccccaccacccucggcaagggcgagucccgcggcgucuuccuccccggccuccccacccccgcccccuggcucggcgccgccccccagcagcagcagcagcagcagcagcagcagcagcagcagcagcaggcccccccccccccccagccccagcagcagccccagaccggcccccgccuccccccccgccagcccaccgucgccucccccgccgaguccgacgaggagaaccgccagaagacccgcccccgcaccaagaucuccgucgaggcccucggcauccuccaguccuucauccaggacgucggccucuaccccgacgaggaggccauccagacccucuccgcccagcucgaccuccccaaguacaccaucaucaaguucuuccagaaccagcgcuacuaccucaagcaccacggcaagcucaaggacaacuccggccucgaggucgacgucgccgaguacaaggaggaggagcuccucaaggaccucgaggaguccguccaggacaagaacaccaacacccucuucuccgucaagcucgaggaggagcucuccgucgagggcaacaccgacaucaacaccgaccucaaggacuga

SEQ ID NO: 49117 - RNA, 2028 nt, Artificial Sequence
  derived and/or modified sequence opt2 from SATB2__Homo_sapiens__XP_005246453
augauccccgucuucugcgucgucgagcagcucgacggcucccucgaguacgacaaccgcgaggagcacgccgaguucguccucguccgcaaggacguccucuucucccagcucgucgagaccgcccuccucgcccucggcuacucccacuccuccgccgcccaggcccagggcaucaucaagcucggccgcuggaacccccucccccucuccuacgucaccgacgcccccgacgccaccgucgccgacaugcuccaggacgucuaccacgucgucacccucaagauccagcuccaguccugcuccaagcucgaggaccuccccgccgagcaguggaaccacgccaccguccgcaacgcccucaaggagcuccucaaggagaugaaccaguccacccucgccaaggagugcccccucucccaguccaugaucuccuccaucgucaacuccaccuacuacgccaacgucuccgccaccaagugccaggaguucggccgcugguacaagaaguacaagaagaucaaggucgagcgcgucgagcgcgagaaccucuccgacuacugcguccucggccagcgccccaugcaccuccccaacaugaaccagcucgccucccucggcaagaccaacgagcaguccccccacucccagauccaccacuccacccccauccgcaaccagguccccgcccuccagcccaucaugucccccggccuccucuccccccagcucuccccccagcucguccgccagcagaucgccauggcccaccucaucaaccagcagaucgccgucucccgccuccucgcccaccagcacccccaggccaucaaccagcaguuccucaaccacccccccaucccccgcgccgucaagcccgagcccaccaacuccuccgucgaggucucccccgacaucuaccagcagguccgcgacgagcucaagcgcgccuccgucucccaggccgucuucgcccgcgucgccuucaaccgcacccagggccuccucuccgagauccuccgcaaggaggaggacccccgcaccgccucccagucccuccucgucaaccuccgcgccaugcagaacuuccucaaccuccccgaggucgagcgcgaccgcaucuaccaggacgagcgcgagcgcuccaugaaccccaacgucuccauggucuccuccgccuccuccucccccuccuccucccgcaccccccaggccaagaccuccacccccaccaccgaccuccccaucaaggucgacggcgccaacaucaacaucaccgccgccaucuacgacgagauccagcaggagaugaagcgcgccaaggucucccaggcccucuucgccaaggucgccgccaacaagucccagggcuggcucugcgagcuccuccgcuggaaggagaaccccucccccgagaaccgcacccucugggagaaccucugcaccauccgccgcuuccucaaccucccccagcacgagcgcgacgucaucuacgaggaggagucccgccaccaccacuccgagcgcaugcagcacgucguccagcucccccccgagcccguccagguccuccaccgccagcagucccagcccgccaaggaguccucccccccccgcgaggaggccccccccccccccccccccaccgaggacuccugcgccaagaagccccgcucccgcaccaagaucucccucgaggcccucggcauccuccaguccuucauccacgacgucggccucuaccccgaccaggaggccauccacacccucuccgcccagcucgaccuccccaagcacaccaucaucaaguucuuccagaaccagcgcuaccacgucaagcaccacggcaagcucaaggagcaccucggcuccgccgucgacgucgccgaguacaaggacgaggagcuccucaccgaguccgaggagaacgacuccgaggagggcuccgaggagauguacaaggucgaggccgaggaggagaacgccgacaaguccaaggccgcccccgccgagaucgaccagcgcuga

SEQ ID NO: 49118 - RNA, 1899 nt, Artificial Sequence
  derived and/or modified sequence opt2 from SATL1__Homo_sapiens__NP_001012998
augaaccaguccggcaccaaccaguccucccucuccgacuccaaccaggccggcaucaaccagcccuccaccaacucccucggcaugaaccagauggacaugaaccagggcuccgccucccucuacgagaugaaccaggucgacaugaagcagcccuccaugucccaggccggcaugcgccaguccggcaccaaccuccccgacaucaaccagcccgacaugaagcagcccgacaccuggcagcucggccgcucccagcccggcaugcuccagcaggagcucucccagcucguccucuccaaggccggcaucucccagcccgaccccucccagcccggccccucccaguccggccccucccagucccgcaugcgccagaucggcaccaaccaguccggcaugucccagcccgucaugcagcagcucgacucccaguccggcggcucccagcccuccaugcgccaggucggcaccucccagcucggcaccucccagaucggcaugucccagcccggcaccuggcagaccggccucucccagcccguccuccgccagcccaacauguccccccccggcauguggcagcccggcguccagcagcccggcaucucccagcagguccccucccaccccgacaugucccagcccggcaugucccagcagguccccucccagcccggcauccgccagcccgacaccucccaguccugcaagaaccagaccgacaugucccagcccgacgccaaccaguccucccucuccgacuccaaccagaccggcaucauccagcccucccccucccuccucggcaugaaccagauggacaugaaccagugguccgccucccucuacgagaugaaccaggucgacaugaagcagcccuccaugucccaggccggcaugcgccaguccggcaccaaccuccccgacaucaaccagcccggcaugaagcagcccggcaccuggcagcucggccgcucccagcccggcauguggccccagucccucuccgagcucguccucuccgaggccuccaucucccagcccggccccccccagcgcgcccccucccaguccggcccccgccaguccuccaccucccaggccggcaccaaccaguccggcaucucccagcccgucauguggcagcucgacaugcgccaguccggcggcucccagcccuccaugcgccaggucggcaccucccaguccggcaccucccagaucggcaugucccagcccggcaccuggcagaccggccucucccagcccgucccccgccagcccaacaaguccccccccggcauguggcagcgcggcauguggcagcccggcaugucccagcagguccccucccagcucggcaugcgccagcccggcaccucccaguccuccaagaaccagaccggcaugucccaccccggccgcggccagcccggcaucugggagcccggccccucccagcccggccucucccagcaggaccucaaccagcucguccucucccagcccggccucucccagcccggccgcucccagcccuccgucucccagaugggcaugcgccagaccuccauggacuacuuccagauccgccacgccgaggccggcgacugccccgagauccuccgccucaucaaggagcucgccgccugcgagaacaugcucgacgccauggagcucaccgccgccgaccuccuccgcgacggcuucggcgacaacccccucuucuacugccucaucgccgaggucaacgaccagcagaagcccuccggcaagcucaccgucggcuucgccauguacuacuucaccuacgacuccuggaccggcaagguccucuaccucgaggacuucuacgucacccaggccuaccaggacucccaccacaacuccauguga

SEQ ID NO: 49119 - RNA, 1152 nt, Artificial Sequence
  derived and/or modified sequence opt2 from SAV1__Homo_sapiens__NP_068590
augcucucccgcaagaagaccaagaacgaggucuccaagcccgccgagguccagggcaaguacgucaagaaggagaccuccccccuccuccgcaaccucaugcccuccuucauccgccacggccccaccaucccccgccgcaccgacaucugccuccccgacuccucccccaacgccuucuccaccuccggcgacgucgucucccgcaaccaguccuuccuccgcacccccauccagcgcaccccccacgagaucaugcgccgcgaguccaaccgccucuccgcccccuccuaccucgcccgcucccucgccgacgucccccgcgaguacggcuccucccaguccuucgucaccgaggucuccuucgccgucgagaacggcgacuccggcucccgcuacuacuacuccgacaacuucuucgacggccagcgcaagcgcccccucggcgaccgcgcccacgaggacuaccgcuacuacgaguacaaccacgaccucuuccagcgcaugccccagaaccagggccgccacgccuccggcaucggccgcgucgccgccaccucccucggcaaccucaccaaccacggcuccgaggaccucccccucccccccggcugguccgucgacuggaccaugcgcggccgcaaguacuacaucgaccacaacaccaacaccacccacuggucccacccccucgagcgcgagggccucccccccggcugggagcgcgucgaguccuccgaguucggcaccuacuacgucgaccacaccaacaagaaggcccaguaccgccaccccugcgcccccuccgucccccgcuacgaccagcccccccccgucaccuaccagccccagcagaccgagcgcaaccagucccuccucguccccgccaaccccuaccacaccgccgagauccccgacuggcuccaggucuacgcccgcgcccccgucaaguacgaccacauccucaagugggagcucuuccagcucgccgaccucgacaccuaccagggcaugcucaagcuccucuucaugaaggagcucgagcagaucgucaagauguacgaggccuaccgccaggcccuccucaccgagcucgagaaccgcaagcagcgccagcagugguacgcccagcagcacggcaagaacuucuga

SEQ ID NO: 49120 - RNA, 753 nt, Artificial Sequence
  derived and/or modified sequence opt2 from SBDS__Homo_sapiens__NP_057122
auguccaucuucacccccaccaaccagauccgccucaccaacgucgccgucguccgcaugaagcgcgccggcaagcgcuucgagaucgccugcuacaagaacaaggucgucggcuggcgcuccggcgucgagaaggaccucgacgagguccuccagacccacuccgucuucgucaacgucuccaagggccaggucgccaagaaggaggaccucaucuccgccuucggcaccgacgaccagaccgagaucugcaagcagauccucaccaagggcgagguccaggucuccgacaaggagcgccacacccagcucgagcagauguuccgcgacaucgccaccaucgucgccgacaagugcgucaaccccgagaccaagcgccccuacaccgucauccucaucgagcgcgccaugaaggacauccacuacuccgucaagaccaacaaguccaccaagcagcaggcccucgaggucaucaagcagcucaaggagaagaugaagaucgagcgcgcccacaugcgccuccgcuucauccuccccgucaacgagggcaagaagcucaaggagaagcucaagccccucaucaaggucaucgaguccgaggacuacggccagcagcucgagaucgucugccucaucgaccccggcugcuuccgcgagaucgacgagcucaucaagaaggagaccaagggcaagggcucccucgagguccucaaccucaaggacgucgaggagggcgacgagaaguucgaguga

SEQ ID NO: 49121 - RNA, 5682 nt, Artificial Sequence
  derived and/or modified sequence opt2 from SBF1__Homo_sapiens__NP_002963
auggcccgccucgccgacuacuucguccucgucgccuucggcccccacccccgcggcuccggcgagggccagggccagauccuccagcgcuuccccgagaaggacugggaggacaaccccuucccccagggcaucgagcucuucugccagcccuccggcuggcagcucugccccgagcgcaacccccccaccuucuucgucgccguccucaccgacaucaacuccgagcgccacuacugcgccugccucaccuucugggagcccgccgagcccucccaggagaccacccgcgucgaggacgccaccgagcgcgaggaggagggcgacgagggcggccagacccaccucucccccaccgcccccgcccccuccgcccagcucuucgcccccaagacccucguccucgucucccgccucgaccacaccgaggucuuccgcaacucccucggccucaucuacgccauccacgucgagggccucaacgucugccucgagaacgucaucggcaaccuccucaccugcaccgucccccucgccggcggcucccagcgcaccaucucccucggcgccggcgaccgccaggucauccagaccccccucgccgacucccuccccgucucccgcugcuccgucgcccuccucuuccgccagcucggcaucaccaacguccucucccucuucugcgccgcccucaccgagcacaagguccucuuccucucccgcuccuaccagcgccucgccgacgccugccgcggccuccucgcccuccucuucccccuccgcuacuccuucaccuacguccccauccuccccgcccagcuccucgagguccucuccacccccacccccuucaucaucggcgucaacgccgccuuccaggccgagacccaggagcuccucgacgucaucgucgccgaccucgacggcggcaccgucaccauccccgagugcguccacauccccccccuccccgagccccuccagucccagacccacuccguccucuccaugguccucgaccccgagcucgagcucgccgaccucgccuuccccccccccaccaccuccaccuccucccucaagaugcaggacaaggagcuccgcgccgucuuccuccgccucuucgcccagcuccuccagggcuaccgcuggugccuccacgucguccgcauccaccccgagcccgucauccgcuuccacaaggccgccuuccucggccagcgcggccucgucgaggacgacuuccucaugaagguccucgagggcauggccuucgccggcuucgucuccgagcgcggcguccccuaccgccccaccgaccucuucgacgagcucgucgcccacgaggucgcccgcaugcgcgccgacgagaaccacccccagcgcguccuccgccacguccaggagcucgccgagcagcucuacaagaacgagaaccccuaccccgccgucgccaugcacaagguccagcgccccggcgaguccucccaccuccgccgcgucccccgccccuucccccgccucgacgagggcaccguccaguggaucgucgaccaggccgccgccaagaugcagggcgccccccccgccgucaaggccgagcgccgcaccaccguccccuccggcccccccaugaccgccauccucgagcgcugcuccggccuccacgucaacuccgcccgccgccucgaggucguccgcaacugcaucuccuacgucuucgagggcaagaugcucgaggccaagaagcuccuccccgccguccuccgcgcccucaagggccgcgccgcccgccgcugccucgcccaggagcuccaccuccacguccagcagaaccgcgccguccucgaccaccagcaguucgacuucgucguccgcaugaugaacugcugccuccaggacugcaccucccucgacgagcacggcaucgccgccgcccuccucccccucgucaccgccuucugccgcaagcucucccccggcgucacccaguucgccuacuccugcguccaggagcacgucgucugguccaccccccaguucugggaggccauguucuacggcgacguccagacccacauccgcgcccucuaccucgagcccaccgaggaccucgcccccgcccaggaggucggcgaggcccccucccaggaggacgagcgcuccgcccucgacgucgccuccgagcagcgccgccucuggcccacccucucccgcgagaagcagcaggagcucguccagaaggaggaguccaccgucuucucccaggccauccacuacgccaaccgcauguccuaccuccuccucccccucgacuccuccaagucccgccuccuccgcgagcgcgccggccucggcgaccucgaguccgccuccaacucccucgucaccaacuccauggccggcuccgucgccgaguccuacgacaccgaguccggcuucgaggacgccgagaccugcgacgucgccggcgccgucguccgcuucaucaaccgcuucgucgacaaggucugcaccgaguccggcgucaccuccgaccaccucaagggccuccacgucaugguccccgacaucguccagaugcacaucgagacccucgaggccguccagcgcgagucccgccgccucccccccauccagaagcccaagcuccuccgcccccgccuccuccccggcgaggagugcguccucgacggccuccgcgucuaccuccuccccgacggccgcgaggagggcgccggcggcuccgccggcggccccgcccuccuccccgccgagggcgccgucuuccucaccaccuaccgcgucaucuucaccggcaugcccaccgacccccucgucggcgagcaggucgucguccgcuccuuccccgucgccgcccucaccaaggagaagcgcaucuccguccagacccccgucgaccagcuccuccaggacggccuccagcuccgcuccugcaccuuccagcuccucaagauggccuucgacgaggaggucggcuccgacuccgccgagcucuuccgcaagcagcuccacaagcuccgcuacccccccgacauccgcgccaccuucgccuucacccucggcuccgcccacacccccggccgccccccccgcgucaccaaggacaagggccccucccuccgcacccucucccgcaaccucgucaagaacgccaagaagaccaucggccgccagcacgucacccgcaagaaguacaacccccccuccugggagcaccgcggccagcccccccccgaggaccaggaggacgagaucuccgucuccgaggagcucgagcccuccacccucacccccuccuccgcccucaagcccuccgaccgcaugaccauguccucccucgucgagcgcgccugcugccgcgacuaccagcgccucggccucggcacccucuccuccucccucucccgcgccaaguccgagcccuuccgcaucucccccgucaaccgcauguacgccaucugccgcuccuaccccggccuccucaucgucccccaguccguccaggacaacgcccuccagcgcgucucccgcugcuaccgccagaaccgcuuccccgucgucugcuggcgcuccggccgcuccaaggccguccuccuccgcuccggcggccuccacggcaagggcgucgucggccucuucaaggcccagaacgcccccucccccggccagucccaggccgacuccuccucccucgagcaggagaaguaccuccaggccgucgucuccuccaugccccgcuacgccgacgccuccggccgcaacacccucuccggcuucuccuccgcccacaugggcucccacguccccuccccccgcgcccgcgucaccacccucuccaaccccauggccgccuccgccucccgccgcaccgccccccgcggcaaguggggcuccguccgcaccuccggccgcuccuccggccucggcaccgacgucggcucccgccucgccggccgcgacgcccucgcccccccccaggccaacggcggcccccccgaccccggcuuccuccgcccccagcgcgccgcccucuacauccucggcgacaaggcccagcucaagggcguccgcuccgacccccuccagcagugggagcucguccccaucgaggucuucgaggcccgccaggucaaggccuccuucaagaagcuccucaaggccugcguccccggcugccccgccgccgagcccucccccgccuccuuccuccgcucccucgaggacuccgaguggcucauccagauccacaagcuccuccaggucuccguccucgucgucgagcuccucgacuccggcuccuccguccucgucggccucgaggacggcugggacaucaccacccaggucgucucccucguccagcuccucuccgaccccuucuaccgcacccucgagggcuuccgccuccucgucgagaaggaguggcucuccuucggccaccgcuucucccaccgcggcgcccacacccucgccggccaguccuccggcuucacccccgucuuccuccaguuccucgacugcguccaccagguccaccuccaguuccccauggaguucgaguucucccaguucuaccucaaguuccucggcuaccaccacgucucccgccgcuuccgcaccuuccuccucgacuccgacuacgagcgcaucgagcucggccuccucuacgaggagaagggcgagcgccgcggccagguccccugccgcuccgucugggaguacgucgaccgccucuccaagcgcacccccgucuuccacaacuacauguacgcccccgaggacgccgagguccuccgccccuacuccaacgucuccaaccucaaggucugggacuucuacaccgaggagacccucgccgagggcccccccuacgacugggagcucgcccagggcccccccgagccccccgaggaggagcgcuccgacggcggcgccccccagucccgccgccgcgucgucuggcccugcuacgacuccugcccccgcgcccagcccgacgccaucucccgccuccucgaggagcuccagcgccucgagaccgagcucggccagcccgccgagcgcuggaaggacaccugggaccgcgucaaggccgcccagcgccucgagggccgccccgacggccgcggcacccccuccucccuccucgucuccaccgccccccaccaccgccgcucccucggcgucuaccuccaggagggccccgucggcuccacccucucccucucccucgacuccgaccaguccuccggcuccaccaccuccggcucccgccaggccgcccgccgcuccaccuccacccucuacucccaguuccagaccgccgaguccgagaaccgcuccuacgagggcacccucuacaagaagggcgccuucaugaagcccuggaaggcccgcugguucguccucgacaagaccaagcaccagcuccgcuacuacgaccaccgcgucgacaccgagugcaagggcgucaucgaccucgccgaggucgaggccgucgcccccggcacccccaccaugggcgcccccaagaccgucgacgagaaggccuucuucgacgucaagaccacccgccgcgucuacaacuucugcgcccaggacguccccuccgcccagcagugggucgaccgcauccaguccugccucuccgacgccuga

SEQ ID NO: 49122 - RNA, 5550 nt, Artificial Sequence
  derived and/or modified sequence opt2 from SBF2__Homo_sapiens__NP_112224
auggcccgccucgccgacuacuucaucgucgucggcuacgaccacgagaagcccggcuccggcgagggccucggcaagaucauccagcgcuucccccagaaggacugggacgacacccccuucccccagggcaucgagcucuucugccagcccggcggcuggcagcucucccgcgagcgcaagcagcccaccuucuucgucgucguccucaccgacaucgacuccgaccgccacuacugcuccugccucaccuucuacgaggccgagaucaaccuccagggcaccaagaaggaggagaucgagggcgaggccaaggucuccggccucauccagcccgccgaggucuucgcccccaagucccucguccucgucucccgccucuacuaccccgagaucuuccgcgccugccucggccucaucuacaccgucuacgucgacucccucaacgucucccucgagucccucaucgccaaccucugcgccugccucguccccgccgccggcggcucccagaagcucuucucccucggcgccggcgaccgccagcucauccagaccccccuccacgacucccuccccaucaccggcaccuccgucgcccuccucuuccagcagcucggcauccagaacguccucucccucuucugcgccguccucaccgagaacaagguccucuuccacuccgccuccuuccagcgccucuccgacgccugccgcgcccucgagucccucauguucccccucaaguacuccuaccccuacauccccauccuccccgcccagcuccucgagguccucuccucccccacccccuucaucaucggcguccacuccgucuucaagaccgacguccacgagcuccucgacgucaucaucgccgaccucgacggcggcaccaucaagauccccgagugcauccaccucuccucccuccccgagccccuccuccaccagacccaguccgcccucucccucauccuccaccccgaccucgaggucgccgaccacgccuucccccccccccgcaccgcccucucccacuccaagaugcucgacaaggagguccgcgccgucuuccuccgccucuucgcccagcucuuccagggcuaccgcuccugccuccagcucauccgcauccacgccgagcccgucauccacuuccacaagaccgccuuccucggccagcgcggccucgucgagaacgacuuccucaccaagguccucuccggcauggccuucgccggcuucgucuccgagcgcggcccccccuaccgcuccugcgaccucuucgacgagcucgucgccuucgaggucgagcgcaucaaggucgaggagaacaaccccgucaagaugaucaagcacguccgcgagcucgccgagcagcucuucaagaacgagaaccccaacccccacauggccuuccagaaggucccccgccccaccgagggcucccaccuccgcguccacauccuccccuuccccgagaucaacgaggcccgcguccaggagcucauccaggagaacgucgccaagaaccagaacgccccccccgccacccgcaucgagaagaagugcgucguccccgccggcccccccgucgucuccaucauggacaaggucaccaccgucuucaacuccgcccagcgccucgaggucguccgcaacugcaucuccuucaucuucgagaacaagauccucgagaccgagaagacccuccccgccgcccuccgcgcccucaagggcaaggccgcccgccagugccucaccgacgagcucggccuccacguccagcagaaccgcgccauccucgaccaccagcaguucgacuacaucauccgcaugaugaacugcacccuccaggacugcuccucccucgaggaguacaacaucgccgccgcccuccucccccucaccuccgccuucuaccgcaagcucgcccccggcgucucccaguucgccuacaccugcguccaggaccaccccaucuggaccaaccagcaguucugggagaccaccuucuacaacgccguccaggagcagguccgcucccucuaccucuccgccaaggaggacaaccacgccccccaccucaagcagaaggacaagcuccccgacgaccacuaccaggagaagaccgccauggaccucgccgccgagcagcuccgccucuggcccacccucuccaaguccacccagcaggagcucguccagcacgaggaguccaccgucuucucccaggccauccacuucgccaaccucauggucaaccuccucgucccccucgacaccuccaagaacaagcuccuccgcaccuccgcccccggcgacugggaguccggcuccaacuccaucgucaccaacuccaucgccggcuccgucgccgaguccuacgacaccgaguccggcuucgaggacuccgagaacaccgacaucgccaacuccgucguccgcuucaucacccgcuucaucgacaaggucugcaccgaguccggcgucacccaggaccacaucaagucccuccacugcaugauccccggcaucgucgccaugcacaucgagacccucgaggccguccaccgcgagucccgccgccucccccccauccagaagcccaagauccuccgccccgcccuccuccccggcgaggagaucgucugcgagggccuccgcguccuccucgaccccgacggccgcgaggaggccaccggcggccuccucggcggcccccagcuccuccccgccgagggcgcccucuuccucaccaccuaccgcauccucuuccgcggcaccccccacgaccagcucgucggcgagcagaccgucguccgcuccuuccccaucgccuccaucaccaaggagaagaagaucaccaugcagaaccagcuccagcagaacaugcaggagggccuccagaucaccuccgccuccuuccagcucaucaaggucgccuucgacgaggaggucucccccgaggucgucgagaucuucaagaagcagcucaugaaguuccgcuacccccaguccaucuucuccaccuucgccuucgccgccggccagaccaccccccagaucauccuccccaagcagaaggagaagaacaccuccuuccgcaccuucuccaagaccaucgucaagggcgccaagcgcgccggcaagaugaccaucggccgccaguaccuccucaagaagaagaccggcaccaucgucgaggagcgcgucaaccgccccggcuggaacgaggacgacgacgucuccgucuccgacgaguccgagcuccccaccuccaccacccucaaggccuccgagaaguccaccauggagcagcucgucgagaaggccugcuuccgcgacuaccagcgccucggccucggcaccaucuccggcuccuccucccgcucccgccccgaguacuuccgcaucaccgccuccaaccgcauguacucccucugccgcuccuaccccggccuccucgucgucccccaggccguccaggacuccucccucccccgcgucgcccgcugcuaccgccacaaccgccuccccgucgucugcuggaagaacucccgcuccggcacccuccuccuccgcuccggcggcuuccacggcaagggcgucgucggccucuucaagucccagaacuccccccaggccgcccccaccuccucccucgaguccuccuccuccaucgagcaggagaaguaccuccaggcccuccucaacgccgucuccguccaccagaagcuccgcggcaacuccacccucaccguccgccccgccuucgcccucucccccggcgucugggccucccuccgcuccuccacccgccucaucuccucccccaccuccuucaucgacgucggcgcccgccucgccggcaaggaccacuccgccuccuucuccaacuccuccuaccuccagaaccagcuccucaagcgccaggccgcccucuacaucuucggcgagaagucccagcuccgcaacuucaaggucgaguucgcccucaacugcgaguucguccccgucgaguuccacgagauccgccaggucaaggccuccuucaagaagcucaugcgcgccugcauccccuccaccauccccaccgacuccgaggucaccuuccucaaggcccucggcgacuccgagugguucccccagcuccaccgcaucaugcagcucgccgucgucgucuccgagguccucgagaacggcuccuccguccucgucugccucgaggagggcugggacaucaccgcccaggucaccucccucguccagcuccucuccgaccccuucuaccgcacccucgagggcuuccagaugcucgucgagaaggaguggcucuccuucggccacaaguucucccagcgcuccucccucacccucaacugccagggcuccggcuucgcccccgucuuccuccaguuccucgacugcguccaccagguccacaaccaguaccccaccgaguucgaguucaaccucuacuaccucaaguuccucgccuuccacuacgucuccaaccgcuucaagaccuuccuccucgacuccgacuacgagcgccucgagcacggcacccucuucgacgacaagggcgagaagcacgccaagaagggcgucugcaucugggagugcaucgaccgcaugcacaagcgcucccccaucuucuucaacuaccucuacuccccccucgagaucgaggcccucaagcccaacgucaacgucuccucccucaagaagugggacuacuacaucgaggagacccucuccaccggccccuccuacgacuggaugaugcucacccccaagcacuuccccuccgaggacuccgaccucgccggcgaggccggcccccgcucccagcgccgcaccgucuggcccugcuacgacgacgucuccugcacccagcccgacgcccucaccucccucuucuccgagaucgagaagcucgagcacaagcucaaccaggcccccgagaaguggcagcagcucugggagcgcgucaccgucgaccucaaggaggagccccgcaccgaccgcucccagcgccaccucucccgcucccccggcaucgucuccaccaaccuccccuccuaccagaagcgcucccuccuccaccuccccgacuccuccaugggcgaggagcagaacuccuccaucucccccuccaacggcgucgagcgccgcgccgccacccucuacucccaguacaccuccaagaacgacgagaaccgcuccuucgagggcacccucuacaagcgcggcgcccuccucaagggcuggaagccccgcugguucguccucgacgucaccaagcaccagcuccgcuacuacgacuccggcgaggacaccuccugcaagggccacaucgaccucgccgaggucgagauggucauccccgccggccccuccaugggcgcccccaagcacaccuccgacaaggccuucuucgaccucaagaccuccaagcgcgucuacaacuucugcgcccaggacggccaguccgcccagcaguggauggacaagauccaguccugcaucuccgacgccuga

SEQ ID NO: 49123 - RNA, 4182 nt, Artificial Sequence
  derived and/or modified sequence opt2 from SBNO1__Homo_sapiens__NP_001161328
auggucgagcccggccaggaccuccuccucgccgcccucuccgaguccggcaucucccccaacgaccucuucgacaucgacggcggcgacgccggccucgccacccccaugcccacccccuccguccagcaguccgucccccucuccgcccucgagcucggccucgagaccgaggccgccguccccgucaagcaggagcccgagaccguccccacccccgcccuccucaacguccgccagcagccccccuccaccaccaccuucguccucaaccagaucaaccaccuccccccccucggcuccaccaucgucaugaccaagaccccccccgucaccaccaaccgccagaccaucacccucaccaaguucauccagaccaccgccuccacccgccccuccgucuccgcccccaccguccgcaacgccaugaccuccgcccccuccaaggaccagguccagcucaaggaccuccucaagaacaacucccucaacgagcucaugaagcucaagccccccgccaacaucgcccagcccgucgccaccgccgccaccgacgucuccaacggcaccgucaagaaggaguccuccaacaaggagggcgcccgcauguggaucaacgacaugaagaugcgcuccuucucccccaccaugaagguccccgucgucaaggaggacgacgagcccgaggaggaggacgaggaggagaugggccacgccgagaccuacgccgaguacaugcccaucaagcucaagaucggccuccgccaccccgacgccgucgucgagaccuccucccucuccuccgucaccccccccgacgucugguacaagaccuccaucuccgaggagaccaucgacaacggcuggcucuccgcccuccagcucgaggccaucaccuacgccgcccagcagcacgagaccuuccuccccaacggcgaccgcgccggcuuccucaucggcgacggcgccggcgucggcaagggccgcaccaucgccggcaucaucuacgagaacuaccuccucucccgcaagcgcgcccucugguucuccgucuccaacgaccucaaguacgacgccgagcgcgaccuccgcgacaucggcgccaagaacauccucguccacucccucaacaaguucaaguacggcaagaucuccuccaagcacaacggcuccgucaagaagggcgucaucuucgccaccuacuccucccucaucggcgagucccaguccggcggcaaguacaagacccgccucaagcagcuccuccacuggugcggcgacgacuucgacggcgucaucgucuucgacgagugccacaaggccaagaaccucugccccgucggcuccuccaagcccaccaagaccggccucgccguccucgagcuccagaacaagcuccccaaggcccgcgucgucuacgccuccgccaccggcgccuccgagccccgcaacauggccuacaugaaccgccucggcaucuggggcgagggcacccccuuccgcgaguucuccgacuucauccaggccgucgagcgccgcggcgucggcgccauggagaucgucgccauggacaugaagcuccgcggcauguacaucgcccgccagcucuccuucaccggcgucaccuucaagaucgaggagguccuccucucccaguccuacgucaagauguacaacaaggccgucaagcucugggucaucgcccgcgagcgcuuccagcaggccgccgaccucaucgacgccgagcagcgcaugaagaaguccauguggggccaguucugguccgcccaccagcgcuucuucaaguaccucugcaucgccuccaaggucaagcgcgucguccagcucgcccgcgaggagaucaagaacggcaagugcgucgucaucggccuccaguccaccggcgaggcccgcacccucgaggcccucgaggagggcggcggcgagcucaacgacuucgucuccaccgccaagggcguccuccagucccucaucgagaagcacuuccccgcccccgaccgcaagaagcucuacucccuccucggcaucgaccucaccgcccccuccaacaacuccuccccccgcgacucccccugcaaggagaacaagaucaagaagcgcaagggcgaggagaucacccgcgaggccaagaaggcccgcaaggucggcggccucaccggcuccuccuccgacgacuccggcuccgaguccgacgccuccgacaacgaggaguccgacuacgaguccuccaagaacauguccuccggcgacgacgacgacuucaaccccuuccucgacgaguccaacgaggacgacgagaacgaccccuggcucauccgcaaggaccacaagaagaacaaggagaagaagaagaagaaguccaucgaccccgacuccauccaguccgcccuccucgccuccggccucggcuccaagcgccccuccuucuccuccacccccgucaucucccccgcccccaacuccacccccgccaacuccaacaccaacuccaacuccucccucaucaccucccaggacgccgucgagcgcgcccagcagaugaagaaggaccuccucgacaagcucgagaagcucgccgaggaccucccccccaacacccucgacgagcucaucgacgagcucggcggccccgagaacgucgccgagaugaccggccgcaagggccgcgucgucuccaacgacgacggcuccaucuccuacgagucccgcuccgagcucgacguccccgucgagauccucaacaucaccgagaagcagcgcuucauggacggcgacaagaacaucgccaucaucuccgaggccgccuccuccggcaucucccuccaggccgaccgccgcgccaagaaccagcgccgccgcguccacaugacccucgagcuccccugguccgccgaccgcgccauccagcaguucggccgcacccaccgcuccaaccaggucaccgcccccgaguacgucuuccucaucuccgagcucgccggcgagcagcgcuucgccuccaucgucgccaagcgccucgagucccucggcgcccucacccacggcgaccgccgcgccaccgagucccgcgaccucucccgcuucaacuucgacaacaaguacggccgcaacgcccucgagaucgucaugaaguccaucgucaaccucgacucccccauggucucccccccccccgacuaccccggcgaguucuucaaggacguccgccagggccucaucggcgucggccucaucaacgucgaggaccgcuccggcauccucacccucgacaaggacuacaacaacaucggcaaguuccucaaccgcauccucggcauggagguccaccagcagaacgcccucuuccaguacuucgccgacacccucaccgccgucguccagaacgccaagaagaacggccgcuacgacaugggcauccucgaccucggcuccggcgacgagaagguccgcaaguccgacgucaagaaguuccucacccccggcuacuccaccuccggccacgucgagcucuacaccaucuccgucgagcgcggcauguccugggaggaggccaccaagaucugggccgagcucaccggccccgacgacggcuucuaccucucccuccagauccgcaacaacaagaagaccgccauccucgucaaggaggucaaccccaagaagaagcucuuccucgucuaccgccccaacaccggcaagcagcucaagcucgagaucuacgccgaccucaagaagaaguacaagaaggucgucuccgacgacgcccucaugcacuggcucgaccaguacaacuccuccgccgacaccugcacccacgccuacuggcgcggcaacugcaagaaggccucccucggccucgucugcgagaucggccuccgcugccgcaccuacuacguccucugcggcuccguccucuccgucuggaccaaggucgagggcguccucgccuccgucuccggcaccaacgucaagaugcagaucguccgccuccgcaccgaggacggccagcgcaucgucggccucaucauccccgccaacugcgucuccccccucgucaaccuccucuccaccuccgaccagucccagcagcucgccguccagcagaagcagcucuggcagcagcaccacccccaguccaucaccaaccucuccaacgccuga

SEQ ID NO: 49124 - RNA, 3930 nt, Artificial Sequence
  derived and/or modified sequence opt2 from SBNO2__Homo_sapiens__NP_001093592
augcgcgagccccuccccggcuccgccuccuggggcacccccggcccccccuccgccggcaccaugucccagcuccagcucuggcuccaguucgaggcccucaacaaggacuccuccuacuucgaggacuucuccaacaucuccaucuucuccuccuccgucgacucccucuccgacaucgucgacacccccgacuuccuccccgccgacucccucaaccaggucuccaccaucugggacgacaaccccgcccccuccacccacgacaagcucuuccagcucucccgccccuucgccggcuucgaggacuuccuccccucccacuccaccccccuccucgucuccuaccaggagcaguccguccagucccagcccgaggaggaggacgaggccgaggaggaggaggccgaggagcucggccacaccgagaccuacgccgacuacguccccuccaaguccaagaucggcaagcagcaccccgaccgcgucgucgagaccuccacccucuccuccguccccccccccgacaucaccuacacccucgcccuccccuccgacuccggcgcccucuccgcccuccagcucgaggccaucaccuacgccugccagcagcacgagguccuccuccccuccggccagcgcgccggcuuccucaucggcgacggcgccggcgucggcaagggccgcaccgucgccggcgucauccucgagaaccaccuccgcggccgcaagaaggcccucugguucuccgucuccaacgaccucaaguacgacgccgagcgcgaccuccgcgacaucgaggccaccggcaucgccguccacgcccucuccaagaucaaguacggcgacaccaccaccuccgagggcguccucuucgccaccuacuccgcccucaucggcgagucccaggccggcggccagcaccgcacccgccuccgccagauccucgacuggugcggcgaggccuucgagggcgucaucgucuucgacgagugccacaaggccaagaacgccggcuccaccaagaugggcaaggccguccucgaccuccagaacaagcucccccucgcccgcgucgucuacgccuccgccaccggcgccuccgagccccgcaacaugaucuacaugucccgccucggcaucuggggcgagggcacccccuuccgcaacuucgaggaguuccuccacgccaucgagaagcgcggcgucggcgccauggagaucgucgccauggacaugaaggucuccggcauguacaucgcccgccagcucuccuucuccggcgucaccuuccgcaucgaggagaucccccucgcccccgccuucgagugcgucuacaaccgcgccgcccuccucugggccgaggcccucaacgucuuccagcaggccgccgacuggaucggccucgagucccgcaagucccucuggggccaguucugguccgcccaccagcgcuucuucaaguaccucugcaucgccgccaagguccgccgccucgucgagcucgcccgcgaggagcucgcccgcgacaagugcgucgucaucggccuccaguccaccggcgaggcccgcacccgcgagguccucggcgagaacgacggccaccucaacugcuucgucuccgccgccgagggcgucuuccucucccucauccagaagcacuuccccuccaccaagcgcaagcgcgaccgcggcgccggcuccaagcgcaagcgccgcccccgcggccgcggcgccaaggccccccgccucgccugcgagaccgccggcgucauccgcaucuccgacgacuccuccaccgaguccgaccccggccucgacuccgacuucaacuccucccccgagucccucgucgacgacgacgucgucaucgucgacgccgucggccuccccuccgacgaccgcggcccccucugccuccuccagcgcgacccccacggccccggcguccucgagcgcgucgagcgccucaagcaggaccuccucgacaagguccgccgccucggccgcgagcuccccgucaacacccucgacgagcucaucgaccagcucggcggcccccagcgcgucgccgagaugaccggccgcaagggccgcgucgucucccgccccgacggcaccgucgccuucgagucccgcgccgagcagggccucuccaucgaccacgucaaccuccgcgagaagcagcgcuucauguccggcgagaagcucgucgccaucaucuccgaggccuccuccuccggcgucucccuccaggccgaccgccgcguccagaaccagcgccgccgcguccacaugacccucgagcuccccugguccgccgaccgcgccauccagcaguucggccgcacccaccgcuccaaccaggucuccgcccccgaguacgucuuccucaucuccgagcucgccggcgagcgccgcuucgccuccaucgucgccaagcgccucgagucccucggcgcccucacccacggcgaccgccgcgccaccgagucccgcgaccucuccaaguacaacuucgagaacaaguacggcacccgcgcccuccacugcguccucaccaccauccucucccagaccgagaacaagguccccgucccccagggcuaccccggcggcguccccaccuucuuccgcgacaugaagcagggccuccucuccgucggcaucggcggccgcgagucccgcaacggcugccucgacgucgagaaggacugcuccaucaccaaguuccucaaccgcauccucggccucgagguccacaagcagaacgcccucuuccaguacuucuccgacaccuucgaccaccucaucgagauggacaagcgcgagggcaaguacgacaugggcauccucgaccucgcccccggcaucgaggagaucuacgaggagucccagcaggucuuccucgcccccggccacccccaggacggccaggucgucuucuacaagaucuccgucgaccgcggccucaagugggaggacgccuucgccaagucccucgcccucaccggccccuacgacggcuucuaccucuccuacaagguccgcggcaacaagcccuccugccuccucgccgagcagaaccgcggccaguucuucaccgucuacaagcccaacaucggccgccagucccagcucgaggcccucgacucccuccgccgcaaguuccaccgcgucaccgccgaggaggccaaggagcccugggaguccggcuacgcccucucccucacccacugcucccacuccgccuggaaccgccacugccgccucgcccaggagggcaaggacugccuccagggccuccgccuccgccaccacuacaugcucugcggcgcccuccuccgcgucuggggccgcaucgccgccgucauggccgacgucuccuccuccuccuaccuccagaucguccgccucaagaccaaggaccgcaagaagcaggucggcaucaagauccccgagggcugcguccgccgcguccuccaggagcuccgccucauggacgccgacgucaagcgccgccaggcccccgcccucggcugccccgccccccccgccccccgcccccucgcccuccccugcggccccggcgagguccucgaccucaccuacuccccccccgccgaggccuuccccccccccccccacuucuccuuccccgccccccucucccucgacgccggccccggcgucgucccccucggcacccccgacgcccaggccgaccccgccgcccucgcccaccagggcugcgacaucaacuucaaggagguccucgaggacaugcuccgcucccuccacgccggcccccccuccgagggcgcccucggcgagggcgccggcgccggcggcgccgccggcggcggccccgagcgccaguccgucauccaguucuccccccccuuccccggcgcccaggccccccucuga

SEQ ID NO: 49125 - RNA, 1773 nt, Artificial Sequence
  derived and/or modified sequence opt2 from SBSN__Homo_sapiens__NP_001159506
augcaccucgcccgccucgucggcuccugcucccuccuccuccuccucggcgcccucuccggcugggccgccuccgacgaccccaucgagaaggucaucgagggcaucaaccgcggccucuccaacgccgagcgcgaggucggcaaggcccucgacggcaucaacuccggcaucacccacgccggccgcgaggucgagaaggucuucaacggccucuccaacaugggcucccacaccggcaaggagcucgacaagggcguccagggccucaaccacggcauggacaaggucgcccacgagaucaaccacggcaucggccaggccggcaaggaggccgagaagcucggccacggcgucaacaacgccgccggccaggucggcaaggaggccgacaagcucauccaccacggcguccaccacggcgccaaccaggccggcuccgaggccggcaaguucggccagggcgucgacaacgccgccggccaggccggcaacgaggccggccgcuucggccagggcguccaccacgccgccggccaggccggcaacgaggccggccgcuucggccagggcguccaccacgccgccggccaggccggcaacgaggccggccgcuucggccagggcgcccaccacggccucuccgagggcuggaaggagaccgagaaguucggccagggcauccaccacgccgccggccaggucggcaaggaggccgagaaguucggccagggcgcccaccacgccgccggccaggccggcaacgaggccggccgcuucggccagggcguccaccacggccucuccgagggcuggaaggagaccgagaaguucggccagggcguccaccacaccgccggccaggucggcaaggaggccgagaaguucggccagggcgcccaccacgccgccggccaggccggcaacgaggccggccgcuucggccagggcgcccaccacgccgccggccaggccggcaacgaggccggccgcuucggccagggcguccaccacggccucuccgagggcuggaaggagaccgagaaguucggccagggcguccaccacgccgccucccaguucggcaaggagaccgagaagcucggccacggcguccaccacggcgucaacgaggccuggaaggaggccgagaaguucggccagggcguccaccacgccgccucccaggucggcaaggaggaggaccgcgucguccagggccuccaccacggcgucucccaggccggccgcgaggccggccaguucggccacgacauccaccacaccgccggccaggccggcaaggagggcgacaucgccguccacggcguccagcccggcguccacgaggccggcaaggaggccggccaguucggccagggcguccaccacacccucgagcaggccggcaaggaggccgacaaggccguccagggcuuccacaccggcguccaccaggccggcaaggaggccgagaagcucggccagggcgucaaccacgccgccgaccaggccggcaaggaggucgagaagcucggccagggcgcccaccacgccgccggccaggccggcaaggagcuccagaacgcccacaacggcgucaaccaggccuccaaggaggccaaccagcuccucaacggcaaccaccaguccggcuccuccucccaccagggcggcgccaccaccaccccccucgccuccggcgccuccgucaacacccccuucaucaaccuccccgcccucuggcgcuccgucgccaacaucaugcccuga

SEQ ID NO: 49126 - RNA, 900 nt, Artificial Sequence
  derived and/or modified sequence opt2 from SC5D__Homo_sapiens__NP_008849
auggaccucguccuccgcgucgccgacuacuacuucuucacccccuacgucuaccccgccaccuggcccgaggacgacaucuuccgccaggccaucucccuccucaucgucaccaacgucggcgccuacauccucuacuucuucugcgccacccucuccuacuacuucgucuucgaccacgcccucaugaagcacccccaguuccucaagaaccagguccgccgcgagaucaaguucaccguccaggcccuccccuggaucuccauccucaccgucgcccucuuccuccucgagauccgcggcuacuccaagcuccacgacgaccucggcgaguuccccuacggccucuucgagcucgucgucuccaucaucuccuuccucuucuucaccgacauguucaucuacuggauccaccgcggccuccaccaccgccucgucuacaagcgccuccacaagccccaccacaucuggaagauccccacccccuucgccucccacgccuuccaccccaucgacggcuuccuccagucccuccccuaccacaucuaccccuucaucuucccccuccacaaggucgucuaccucucccucuacauccucgucaacaucuggaccaucuccauccacgacggcgacuuccgcgucccccagauccuccagcccuucaucaacggcuccgcccaccacaccgaccaccacauguucuucgacuacaacuacggccaguacuucacccucugggaccgcaucggcggcuccuucaagaaccccuccuccuucgagggcaagggcccccucuccuacgucaaggagaugaccgagggcaagcgcuccucccacuccggcaacggcugcaagaacgagaagcucuucaacggcgaguucaccaagaccgaguga

SEQ ID NO: 49127 - RNA, 4392 nt, Artificial Sequence
  derived and/or modified sequence opt2 from SCAF11__Homo_sapiens__NP_004710
augaagaagaagaccgucugcacccucaacaugggcgacaagaaguacgaggacauggagggcgaggagaacggcgacaacaccaucuccaccggccuccucuacuccgaggccgaccgcugccccaucugccucaacugccuccucgagaaggaggucggcuuccccgaguccugcaaccacgucuucugcaugaccugcauccucaagugggccgagacccucgccuccugccccaucgaccgcaagcccuuccaggccgucuucaaguucuccgcccucgagggcuacgucaagguccaggucaagaagcagcuccgcgagaccaaggacaagaagaacgagaacuccuucgagaagcaggucuccugccacgagaacuccaaguccugcauccgccgcaaggccaucguccgcgaggaccuccucuccgccaaggucugcgaccucaaguggauccaccgcaacucccucuacuccgagaccggcggcaagaagaacgccgccaucaagaucaacaagccccagcgcuccaacugguccaccaaccagugcuuccgcaacuucuucuccaacauguucuccuccgucucccacuccggcgaguccuccuucaccuaccgcgccuacugcaccgaguucaucgaggccuccgagaucuccgcccucauccgccagaagcgccacgagcucgagcucuccugguuccccgacacccuccccggcaucggccgcaucggcuucauccccuggaacgucgagaccgagguccucccccucaucuccuccguccucccccgcaccaucuuccccaccuccaccaucuccuucgagcacuucggcaccuccugcaagggcuacgcccucgcccacacccaggagggcgaggagaagaagcagaccuccggcaccuccaacacccgcggcucccgccgcaagcccgccaugaccacccccacccgccgcuccacccgcaacacccgcgccgagaccgccucccagucccagcgcucccccaucuccgacaacuccggcugcgacgcccccggcaacuccaaccccucccucuccguccccuccuccgccgaguccgagaagcagacccgccaggcccccaagcgcaaguccguccgccgcggccgcaagcccccccuccucaagaagaagcuccgcuccuccgucgccgcccccgagaaguccuccuccaacgacuccgucgacgaggagaccgccgaguccgacaccucccccguccucgagaaggagcaccagcccgacgucgacuccuccaacaucugcaccguccagacccacgucgagaaccaguccgccaacugccucaaguccugcaacgagcagaucgaggaguccgagaagcacaccgccaacuacgacaccgaggagcgcgucggcuccuccuccuccgaguccugcgcccaggaccuccccguccucgucggcgaggagggcgaggucaagaagcucgagaacaccggcaucgaggccaacguccucugccucgaguccgagaucuccgagaacauccucgagaagggcggcgacccccucgagaagcaggaccagaucuccggccucucccaguccgaggucaagaccgacgucugcaccguccaccuccccaacgacuuccccaccugccucaccuccgaguccaaggucuaccagcccgucuccugcccccucuccgaccucuccgagaacgucgaguccgucgucaacgaggagaagaucaccgaguccucccucgucgagaucaccgagcacaaggacuucacccucaagaccgaggagcucaucgagucccccaagcucgaguccuccgagggcgagaucauccagaccgucgaccgccaguccgucaagucccccgagguccagcuccucggccacgucgagaccgaggacgucgagaucaucgccaccugcgacaccuucggcaacgaggacuucaacaacauccaggacuccgagaacaaccuccucaagaacaaccuccucaacaccaagcucgagaagucccucgaggagaagaacgagucccucaccgagcacccccgcuccaccgagcuccccaagacccacaucgagcagauccagaagcacuucuccgaggacaacaacgagaugauccccauggagugcgacuccuucugcuccgaccagaacgaguccgaggucgagcccuccgucaacgccgaccucaagcagaugaacgagaacuccgucacccacugcuccgagaacaacaugcccuccuccgaccucgccgacgagaaggucgagaccgucucccagcccuccgagucccccaaggacaccaucgacaagaccaagaagccccgcacccgccgcucccgcuuccacucccccuccaccaccuggucccccaacaaggacaccccccaggagaagaagcgcccccagucccccuccccccgccgcgagaccggcaaggagucccgcaagucccagucccccucccccaagaacgaguccgcccgcggccgcaagaagucccgcucccagucccccaagaaggacaucgcccgcgagcgccgccagucccagucccgcucccccaagcgcgacaccacccgcgagucccgccgcuccgagucccucuccccccgccgcgagaccucccgcgagaacaagcgcucccagccccgcgucaaggacuccucccccggcgagaagucccgcucccagucccgcgagcgcgaguccgaccgcgacggccagcgccgcgagcgcgagcgccgcacccgcaaguggucccgcucccgcucccacucccgcucccccucccgcugccgcaccaaguccaaguccuccuccuucggccgcaucgaccgcgacuccuacuccccccgcuggaagggccgcugggccaacgacggcuggcgcugcccccgcggcaacgaccgcuaccgcaagaacgaccccgagaagcagaacgagaacacccgcaaggagaagaacgacauccaccucgacgccgacgaccccaacuccgccgacaagcaccgcaacgacugccccaacuggaucaccgagaagaucaacuccggccccgacccccgcacccgcaaccccgagaagcucaaggagucccacugggaggagaaccgcaacgagaacuccggcaacuccuggaacaagaacuucggcuccggcugggucuccaaccgcggccgcggccgcggcaaccgcggccgcggcaccuaccgcuccuccuucgccuacaaggaccagaacgagaaccgcuggcagaaccgcaagccccucuccggcaacuccaacuccuccggcuccgaguccuucaaguucgucgagcagcaguccuacaagcgcaaguccgagcaggaguucuccuucgacacccccgccgaccgcuccggcuggaccuccgccuccuccugggccguccgcaagacccuccccgccgacguccagaacuacuacucccgccgcggccgcaacuccuccggcccccaguccggcuggaugaagcaggaggaggagaccuccggccaggacuccucccucaaggaccagaccaaccagcaggucgacggcucccagcuccccaucaacaugaugcagccccagaugaacgucaugcagcagcagaugaacgcccagcaccagcccaugaacaucuuccccuaccccgucggcguccacgccccccucaugaacauccagcgcaaccccuucaacauccacccccagcucccccuccaccuccacaccggcgucccccucaugcaggucgccacccccaccuccgucucccagggccuccccccccccccccccccccccccccccucccagcaggucaacuacaucgccucccagcccgacggcaagcagcuccagggcauccccuccuccucccacgucuccaacaacauguccacccccguccuccccgcccccaccgccgcccccggcaacaccggcaugguccagggccccuccuccggcaacaccuccuccuccucccacuccaaggccuccaacgccgccgucaagcucgccgaguccaaggucuccgucgccgucgaggccuccgccgacuccuccaagaccgacaagaagcuccagauccaggagaaggccgcccaggaggucaagcucgccaucaagcccuucuaccagaacaaggacaucaccaaggaggaguacaaggagaucguccgcaaggccgucgacaaggucugccacuccaaguccggcgaggucaacuccaccaaggucgccaaccucgucaaggccuacgucgacaaguacaaguacucccgcaagggcucccagaagaagacccucgaggagcccgucuccaccgagaagaacaucggcuga

SEQ ID NO: 49128 - RNA, 3939 nt, Artificial Sequence
  derived and/or modified sequence opt2 from SCAF1__Homo_sapiens__NP_067051
auggaggaggaggacgagucccgcggcaagaccgaggaguccggcgaggaccgcggcgacggcccccccgaccgcgaccccacccucucccccuccgccuucauccuccgcgccauccagcaggccgucggcuccucccuccagggcgaccuccccaacgacaaggacggcucccgcugccacggccuccgcuggcgccgcugccgcuccccccgcuccgagccccgcucccaggaguccggcggcaccgacaccgccaccguccucgacauggccaccgacuccuuccucgccggccucgucuccguccucgacccccccgacaccuggguccccucccgccucgaccuccgccccggcgaguccgaggacaugcucgagcucgucgccgagguccgcaucggcgaccgcgaccccaucccccuccccguccccucccuccucccccgccuccgcgccuggcgcaccggcaagaccgucuccccccaguccaacuccucccgccccaccugcgcccgccaccucacccucggcaccggcgacggcggccccgcccccccccccgcccccuccuccgccuccuccucccccucccccucccccuccuccuccucccccuccccccccccccccccccccccccccgccccccccgccccccccgccccccgcuucgacaucuacgaccccuuccaccccaccgacgaggccuacucccccccccccgcccccgagcagaaguacgaccccuucgagcccaccggcuccaaccccuccuccuccgccggcacccccucccccgaggaggaggaggaggaggaggaggaggaggaggaggaggaggaggacgaggaggaggaggagggccucucccaguccaucucccgcaucuccgagacccucgccggcaucuacgacgacaacucccucucccaggacuuccccggcgacgaguccccccgccccgacgcccagcccacccagcccacccccgcccccggcacccccccccaggucgacuccacccgcgccgacggcgccaugcgccgccgcgucuucgucgucggcaccgaggccgaggccugccgcgagggcaaggucuccgucgaggucgucaccgccggcggcgccgcccucccccccccccuccucccccccggcgacuccgagaucgaggagggcgagaucguccagcccgaggaggagccccgccucgcccucucccucuuccgccccggcggccgcgccgcccgccccacccccgccgccuccgccacccccaccgcccagccccucccccagccccccgccccccgcgcccccgagggcgacgacuuccucucccuccacgccgaguccgacggcgagggcgcccuccaggucgaccucggcgagcccgcccccgccccccccgccgccgacucccgcuggggcggccucgaccuccgccgcaagauccucacccagcgccgcgagcgcuaccgccagcgcucccccucccccgcccccgcccccgcccccgccgccgccgccggcccccccacccgcaagaagucccgccgcgagcgcaagcgcuccggcgaggccaaggaggccgccuccuccuccuccggcacccagcccgccccccccgcccccgccucccccugggacuccaagaagcaccgcucccgcgaccgcaagcccggcucccacgccuccuccuccgcccgccgccgcucccgcucccgcucccgcucccgcuccacccgccgccgcucccgcuccaccgaccgccgccgcggcggcucccgccgcucccgcucccgcgagaagcgccgccgccgccgccgcuccgccucccccccccccgccaccuccuccuccuccuccucccgccgcgagcgccaccgcggcaagcaccgcgacggcggcggcuccaagaagaagaagaagcgcucccgcucccgcggcgagaagcgcuccggcgacggcuccgagaaggcccccgcccccgcccccccccccuccggcuccaccuccugcggcgaccgcgacucccgccgccgcggcgccgucccccccuccauccaggaccucaccgaccacgaccucuucgccaucaagcgcaccaucaccgucggccgccucgacaaguccgacccccgcggccccucccccgcccccgccuccucccccaagcgcgagguccucuacgacuccgagggccucuccggcgaggagcgcggcggcaaguccucccagaaggaccgccgccgcuccggcgccgccuccuccuccuccuccucccgcgagaagggcucccgccgcaaggcccucgacggcggcgaccgcgaccgcgaccgcgaccgcgaccgcgaccgcgaccgcuccuccaagaaggcccgcccccccaaggaguccgcccccuccuccggccccccccccaagccccccgucuccuccggcuccggcuccuccuccuccuccuccuccugcuccucccgcaaggucaagcuccaguccaaggucgccguccucauccgcgagggcgucuccuccaccacccccgccaaggacgccgccuccgccggccucggcuccaucggcgucaaguucucccgcgaccgcgagucccgcucccccuuccucaagcccgacgagcgcgcccccaccgagauggccaaggccgcccccggcuccaccaagcccaagaagaccaaggucaaggccaaggccggcgccaagaagaccaagggcaccaagggcaagaccaagcccuccaagacccgcaagaagguccgcuccggcggcggcuccggcggcuccggcggccaggucucccucaagaaguccaaggccgacuccugcucccaggccgccggcaccaagggcgccgaggagaccuccugguccggcgaggagcgcgccgccaagguccccuccacccccccccccaaggccgccccccccccccccgcccucacccccgacucccagaccgucgacuccuccugcaagacccccgaggucuccuuccuccccgaggaggccaccgaggaggccggcguccgcggcggcgccgaggaggaggaggaggaggaggaggaggaggaggaggaggaggaggaggaggagcagcagcccgccaccaccaccgccaccuccaccgccgccgccgcccccuccaccgcccccuccgccggcuccaccgccggcgacuccggcgccgaggacggccccgccucccgcgucucccagcuccccacccuccccccccccaugcccuggaaccuccccgccggcgucgacugcaccaccuccggcguccucgcccucaccgcccuccucuucaagauggaggaggccaaccucgccucccgcgccaaggcccaggagcucauccaggccaccaaccagauccucucccaccgcaagccccccuccucccucggcaugacccccgcccccguccccaccucccucggccucccccccggccccuccuccuaccuccuccccggcucccucccccucggcggcugcggcuccaccccccccacccccaccggccucgccgccaccuccgacaagcgcgagggcuccuccuccuccgagggccgcggcgacaccgacaaguaccucaagaagcuccacacccaggagcgcgccgucgaggaggucaagcucgccaucaagcccuacuaccagaagaaggacaucaccaaggaggaguacaaggacauccuccgcaaggccguccacaagaucugccacuccaaguccggcgagaucaaccccgucaaggucuccaaccucguccgcgccuacguccagcgcuaccgcuacuuccgcaagcacggccgcaagcccggcgacccccccggccccccccgcccccccaaggagcccggcccccccgacaagggcggccccggccucccccuccccccccucuga

SEQ ID NO: 49129 - RNA, 3399 nt, Artificial Sequence
  derived and/or modified sequence opt2 from SCAF4__Homo_sapiens__NP_001138916
auggacgccgucaacgccuucaaccaggagcucuucucccucauggacaugaagccccccaucucccgcgccaagaugauccucaucaccaaggccgccaucaaggccaucaagugcaagcccgaguacaagguccccggccucuacgucaucgacuccaucguccgccagucccgccaccaguucggcaccgacaaggacgucuucggcccccgcuucuccaagaacaucaccgccaccuuccaguaccucuaccucugccccuccgaggacaaguccaagaucguccgcguccucaaccucuggcagaagaacggcgucuucaagaucgagaucauccagccccuccucgacauggccgccggcaccuccaacgccgcccccgucgccgagaacgucaccaacaacgagggcuccccccccccccccgucaaggucuccuccgagccccccacccaggccacccccaacuccguccccgccgucccccagcuccccuccuccgacgccuucgccgccgucgcccagcucuuccagaccacccagggccagcagcuccagcagauccuccagaccuuccagcagccccccaagccccagucccccgcccucgacaacgccgucauggcccagguccaggccaucaccgcccagcucaagaccacccccacccagcccuccgagcagaaggccgccuuccccccccccgagcagaagaccgccuucgacaagaagcuccucgaccgcuucgacuacgacgacgagcccgaggccgucgaggaguccaagaaggaggacaccaccgccgucaccaccaccgcccccgccgccgccgucccccccgcccccaccgccaccguccccgccgccgccgcccccgccgccgccucccccccccccccccaggcccccuucggcuuccccggcgacggcaugcagcagcccgccuacacccagcaccagaacauggaccaguuccagccccgcaugaugggcauccagcaggaccccaugcaccaccaggucccccucccccccaacggccagaugcccggcuucggccuccuccccaccccccccuucccccccauggcccagcccgucaucccccccaccccccccguccagcagcccuuccaggccuccuuccaggcccagaacgagccccucacccagaagccccaccagcaggagauggaggucgagcagcccugcauccaggaggucaagcgccacauguccgacaaccgcaagucccgcucccgcuccgccucccgcucccccaagcgccgccgcucccgcuccggcucccgcucccgccgcucccgccaccgccgcucccgcucccgcucccgcgaccgccgccgccacuccccccgcucccgcucccaggagcgccgcgaccgcgagaaggagcgcgagcgccgccagaagggccucccccaggucaagcccgagaccgccuccgucugcuccaccacccucugggucggccagcucgacaagcgcaccacccagcaggacgucgccucccuccucgaggaguucggccccaucgaguccaucaacaugauccccccccgcggcugcgccuacaucgucaugguccaccgccaggacgccuaccgcgcccuccagaagcucucccgcggcaacuacaaggucaaccagaaguccaucaagaucgccugggcccucaacaagggcaucaaggccgacuacaagcaguacugggacgucgagcucggcgucaccuacauccccugggacaaggucaagcccgaggagcucgaguccuucugcgagggcggcaugcucgacuccgacacccucaaccccgacuggaagggcauccccaagaagcccgagaacgaggucgcccagaacggcggcgccgagaccucccacaccgagcccgucucccccauccccaagccccuccccguccccgucccccccauccccguccccgcccccaucaccgucccccccccccagguccccccccaccagcccggcccccccgucgucggcgcccuccagccccccgccuucacccccccccucggcauccccccccccggcuucggccccggcgucccccccccccccccccccccccccuuccuccgccccggcuucaaccccaugcaccucccccccggcuuccucccccccggcccccccccccccaucaccccccccgucuccaucccccccccccacaccccccccaucuccauccccaacuccaccaucgccggcaucaacgaggacaccaccaaggaccucuccaucggcaaccccauccccaccgucgucuccggcgcccgcggcaacgccgaguccggcgacuccgucaagauguacggcuccgccgucccccccgccgcccccaccaaccuccccaccccccccgucacccagcccgucucccuccucggcacccagggcgucgcccccggccccgucaucggccuccaggcccccuccaccggccuccucggcgcccgccccggccucaucccccuccagcgcccccccggcaugccccccccccaccuccagcgcuucccccucaugcccccccgccccaugcccccccacaugaugcaccgcggccccccccccggccccggcggcuucgccaugccccccccccacggcaugaagggccccuuccccccccacggccccuucguccgccccggcggcaugcccggccucggcggccccggccccggccccggcggccccgaggaccgcgacggccgccagcagcccccccagcagccccagcagcagccccagccccaggccccccagcagccccagcagcagcagcagcagcagcccccccccucccagcagcccccccccacccagcagcagccccagcaguuccgcaacgacaaccgccagcaguucaacuccggccgcgaccaggagcgcuucggccgccgcuccuucggcaaccgcgucgagaacgaccgcgagcgcuacggcaaccgcaacgacgaccgcgacaacuccaaccgcgaccgccgcgaguggggccgccgcucccccgaccgcgaccgccaccgcgaccucgaggagcgcaaccgccgcuccuccggccaccgcgaccgcgagcgcgacucccgcgaccgcgagucccgccgcgagaaggaggaggcccgcggcaaggagaagcccgaggucaccgaccgcgccggcggcaacaagaccgucgagccccccaucucccaggucggcaacgucgacaccgccuccgagcucgagaagggcgucuccgaggccgccguccucaagcccuccgaggagcuccccgccgaggccaccuccuccgucgagcccgagaaggacuccggcuccgccgccgaggccccccgcuga

SEQ ID NO: 49130 - RNA, 4014 nt, Artificial Sequence
  derived and/or modified sequence opt2 from SCAF8__Homo_sapiens__NP_001273118
augccccagccccuccuccccgcccuccccccccucuccucccccuccggcgccggcuccugcggccccuccggcggcgagugcuccggccgccgccucuuccgccgccgcgcccgcggccuccgcuccgacaacauggaggccgucaagaccuucaacuccgaggacugcgccuccacccccgccugcaccgacugcuucuccuccuccauggacacccgcuccauccucuacucccucaacgacuacaagccccccaucuccaaggccaagaugacccagaucaccaaggccgccaucaaggccaucaaguucuacaagcacgucguccaguccgucgagaaguucauccagaagugcaagcccgaguacaagguccccggccucuacgucaucgacuccaucguccgccagucccgccaccaguucggccaggagaaggacgucuucgccccccgcuucuccaacaacaucaucuccaccuuccagaaccucuaccgcugccccggcgacgacaaguccaagaucguccgcguccucaaccucuggcagaagaacaacgucuucaaguccgagaucauccagccccuccucgacauggccgccggcauccccccccccgucgucacccccguccucgccuccaccaccaccgccauguccaacacccccggcacccccgucacccccgucacccccgccaacgucguccagggccuccccgaccccugggucucccagaucaccaacaccgacacccucgccgccgucgcccagauccuccaguccccccagggccagcagcuccagcagcucauccagacccuccagauccagcagcagaagccccagcccuccauccuccaggcccucgacgccggccucgucguccagcuccaggcccucaccgcccagcucaccgccgccgccgccgccgccaacacccucaccccccucgagcagggcgucuccuucaacaagaagcucauggaccgcuucgacuucggcgaggacuccgagcacuccgaggagcccaagaaggagauccccgccucccagcucucccacgucuccgaguccgucaacaacuccaucuuccaccagaucgccgagcagcuccagcagcagaaccucgagcaccuccgccagcagcuccucgagcagcagcagccccagaaggccaccccccaggacucccaggagggcaccuucggcuccgagcacuccgccucccccucccagggcuccucccagcagcacuuccucgagcccgaggucaaccucgacgacuccaucgacauccagcagcaggacauggacaucgacgagggccaggacggcgucgaggaggaggucuucgagcaggaggccaagaaggucgccguccgcucccgcucccgcacccacucccgcucccgcucccgcuccccccgcaagcgccgcucccgcucccgcuccggcucccgcaagcgcaagcaccgcaagcgcucccgcucccgcucccgcgagcgcaagcgcaaguccucccgcuccuacuccuccgagcgccgcgcccgcgagcgcgagaaggagcgccagaagaagggccucccccccauccgcuccaagacccucuccgucugcuccaccacccucugggucggccaggucgacaagaaggccacccagcaggaccucaccaaccucuucgaggaguucggccagaucgaguccaucaacaugauccccccccgcggcugcgccuacgucugcaugguccaccgccaggacgccuuccgcgcccuccagaagcucuccuccggcuccuacaagaucggcuccaaggucaucaagaucgccugggcccucaacaagggcgucaagaccgaguacaagcaguucugggacgucgaccucggcgucaccuacauccccugggagaaggucaaggucgacgaccucgagggcuucgccgagggcggcaugaucgaccaggagaccgucaacaccgagugggagaccgucaaguccuccgagcccgucaaggagaccguccagaccacccagucccccacccccgucgagaaggagaccgucgucaccacccaggccgaggucuuccccccccccgucgccaugcuccagauccccgucgcccccgccguccccaccgucucccucgucccccccgccuuccccgucuccaugcccguccccccccccggcuucucccccaucccccccccccccuuccuccgcgccuccuucaaccccucccagcccccccccggcuucaugcccccccccguccccccccccgucguccccccccccaccaucccccccgucguccccaccucccucguccagcccucccucuccaugacccccgagaccgucaaggacgucggcuucggcucccucgucauccccggcggcuccgucgccuccaaccucgccaccuccgcccuccccgccggcaacgucuucaacgcccccaccaagcaggccgagcccgaggagaaggucccccaccucaucgaccaccagaucuccuccggcgagaacacccgcuccgucauccccaacgacaucuccuccaacgccgccauccucggcggccagccccccaacgucaccuccaacuccggcauccucggcguccagcgccccaacgucuccuccaacuccgagauccucggcguccgccccuccaacgucuccuccuccuccggcaucaucgccgcccagccccccaacauccucaacaacuccggcauccucggcauccagccccccuccgucuccaacuccuccggccuccucggcguccucccccccaacauccccaacaacuccggccucgucggcguccagccccccaacguccccaacacccccggccuccucggcacccagccccccgccggcccccagaaccuccccccccucuccauccccaaccagcgcaugcccaccaugcccaugcucgacauccgccccggccucaucccccaggcccccggcccccgcuucccccucauccagcccggcauccccccccagcgcggcauccccccccccuccguccucgacuccgcccuccacccccccccccgcggccccuucccccccggcgacaucuucucccagcccgagcgccccuuccucgcccccggccgccaguccgucgacaacgucaccaaccccgagaagcgcaucccccucggcaacgacaacauccagcaggagggcgaccgcgacuaccgcuucccccccaucgagacccgcgaguccaucucccgccccccccccgucgacguccgcgacgucgucggccgccccaucgacccccgcgagggccccggccgccccccccucgacggccgcgaccacuucggccgcccccccgucgacauccgcgagaaccucguccgccccggcaucgaccaccucggccgccgcgaccacuucggcuucaaccccgagaagcccuggggccaccgcggcgacuucgacgagcgcgagcaccgcguccuccccgucuacggcggccccaagggccuccacgaggagcgcggccgcuuccgcuccggcaacuaccgcuucgacccccgcuccggccccuggaaccgcggcuucggccaggagguccaccgcgacuucgacgaccgccgccgccccugggagcgccagcgcgaccgcgacgaccgcgacuucgacuucugccgcgagaugaacggcaaccgccucggccgcgaccgcauccagaacaccugggucccccccccccacgcccgcgucuucgacuacuucgagggcgccaccucccagcgcaagggcgacaacgucccccaggucaacggcgagaacaccgagcgccacgcccagcccccccccauccccguccagaacgaccccgagcucuacgagaagcucaccuccuccaacgagaucaacaaggagaaguccgacaccgucgccgacaucgaguccgagcccgucgucgaguccaccgagaccgagggcaccuga

SEQ ID NO: 49131 - RNA, 1821 nt, Artificial Sequence
  derived and/or modified sequence opt2 from SCAI__Homo_sapiens__NP_001138349
augguccgcggcgcccgccagccccagcagccccgcucccgccucgccccccgccucaccggcaccgucgagaagcccccccgcaagcgccgcucccgcaccgaguucgcccucaaggagaucauguccuccggcggcgccgaggacgacaucccccagggcgagcgcaagaccgucaccgacuucugcuaccuccucgacaaguccaagcagcucuucaacggccuccgcgaccucccccaguacggccagaagcaguggcaguccuacuucggccgcaccuucgacgucuacaccaagcucuggaaguuccagcagcagcaccgccagguccucgacaaccgcuacggccucaagcgcuggcagaucggcgagaucgccuccaagaucggccagcucuacuaccacuacuaccuccgcaccuccgagaccuccuaccucaacgaggccuucuccuucuacuccgccauccgccagcgcuccuacuacucccaggucaacaaggaggaccgccccgagcucgucgucaagaagcuccgcuacuacgcccgcuucaucgucgucugccuccuccucaacaagauggacgucgucaaggaccucgucaaggagcucuccgacgagaucgaggacuacacccaccgcuucaacaccgaggaccaggucgaguggaaccucguccuccaggaggucgccgccuucaucgaggccgaccccgucaugguccucaacgacgacaacaccaucgucaucaccuccaaccgccucgccgagaccggcgccccccuccucgagcagggcaugaucgucggccagcucucccucgccgacgcccucaucaucggcaacugcaacaaccaggucaaguucuccgagcucaccgucgacauguuccgcaugcuccaggcccucgagcgcgagcccaugaaccucgccucccagaugaacaagcccggcaugcaggaguccgccgacaagcccacccgccgcgagaacccccacaaguaccuccucuacaagcccaccuucucccagcucuacaccuuccucgccgccuccuucaaggagcuccccgccaacuccguccuccucaucuaccucuccgccaccggcgucuuccccaccggccgcuccgacuccgagggccccuacgacuucggcggcguccucaccaacuccaaccgcgacaucaucaacggcgacgccauccacaagcgcaaccagucccacaaggagaugcacugccuccaccccggcgaccucuaccccuucacccgcaagccccucuucaucaucgucgacuccuccaacuccgucgccuacaagaacuucaccaaccucuucggccagccccucgucugccuccucucccccaccgccuaccccaaggcccuccaggaccagucccagcgcggcucccucuucacccucuuccucaacaacccccucauggccuuccucuucgucuccggccucuccuccaugcgccgcggccucugggagaagugccaggaguaccuccgcaagaucaaccgcgacaucgcccagcuccucacccacucccgcuccaucgaccaggccuuccuccaguucuucggcgacgaguuccuccgccuccuccucacccgcuucaucuucugcuccgccaccaugcgcaugcacaagaucuuccgcgagacccgcaacuaccccgaguccuacccccagcucccccgcgacgagaccgucgagaacccccaccuccagaagcacauccucgagcucgccuccauccucgacguccgcaacgucuucuucgagaacaccaucgacgacuacuga

SEQ ID NO: 49132 - RNA, 990 nt, Artificial Sequence
  derived and/or modified sequence opt2 from SCAMP2__Homo_sapiens__NP_005688
auguccgccuucgacaccaaccccuucgccgaccccgucgacgucaaccccuuccaggaccccuccgucacccagcucaccaacgccccccagggcggccucgccgaguucaaccccuucuccgagaccaacgccgccaccaccguccccgucacccagcuccccggcuccucccagcccgccguccuccagcccuccgucgagcccacccagcccaccccccaggccgucgucuccgccgcccaggccggccuccuccgccagcaggaggagcucgaccgcaaggccgccgagcucgagcgcaaggagcgcgagcuccagaacaccgucgccaaccuccacguccgccagaacaacuggcccccccuccccuccuggugccccgucaagcccugcuucuaccaggacuucuccaccgagauccccgccgacuaccagcgcaucugcaagaugcucuacuaccucuggaugcuccacuccgucacccucuuccucaaccuccucgccugccucgccugguucuccggcaacuccuccaagggcgucgacuucggccucuccauccucugguuccucaucuucacccccugcgccuuccucugcugguaccgccccaucuacaaggccuuccgcuccgacaacuccuucuccuucuucgucuucuucuucgucuucuucugccagaucggcaucuacaucauccagcucgucggcauccccggccucggcgacuccggcuggaucgccgcccucuccacccucgacaaccacucccucgccaucuccgucaucaugauggucgucgccggcuucuucacccucugcgccguccucuccgucuuccuccuccagcgcguccacucccucuaccgccgcaccggcgccuccuuccagcaggcccaggaggaguucucccagggcaucuucuccucccgcaccuuccaccgcgccgccuccuccgccgcccagggcgccuuccagggcaacuga

SEQ ID NO: 49133 - RNA, 762 nt, Artificial Sequence
  derived and/or modified sequence opt2 from SCAMP5__Homo_sapiens__XP_006720483
auggaguuccgcaccaagcgcugcggccaggccaccggccccgccggcaacaucauggccgagaaggucaacaacuuccccccccuccccaaguucaucccccucaagcccugcuucuaccaggacuucgaggccgacauccccccccagcacgucuccaugaccaagcgccucuacuaccucuggaugcucaacuccgucacccucgccgucaaccucgucggcugccucgccuggcucaucggcggcggcggcgccaccaacuucggccucgccuuccucuggcucauccucuucacccccugcuccuacgucugcugguuccgccccaucuacaaggccuucaagaccgacuccuccuucuccuucauggccuucuucuucaccuucauggcccagcucgucaucuccaucauccaggccgucggcauccccggcuggggcgucugcggcuggaucgccaccaucuccuucuucggcaccaacaucggcuccgccgucgucaugcucauccccaccgucauguucaccgucauggccgucuucuccuucaucgcccucuccaugguccacaaguucuaccgcggcuccggcggcuccuucuccaaggcccaggaggaguggaccaccggcgccuggaagaacccccacguccagcaggccgcccagaacgccgccaugggcgccgcccagggcgccaugaaccagccccagacccaguacuccgccacccccaacuacaccuacuccaacgagauguga

SEQ ID NO: 49134 - RNA, 3465 nt, Artificial Sequence
  derived and/or modified sequence opt2 from SCAPER__Homo_sapiens__NP_001139395
augaagaccaaguacaucuucugcaacaucaccgagcgcaaggacgccgagggcugggagaccguccagcgcggccgccccauccgcucccgcuccaccgccgucaugcccaaggucucccucgccaccgaggccacccgcuccaaggacgacuccgacaaggagaacgucugccuccuccccgacgaguccauccagaagggccaguucgucggcgacggcaccuccaacaccaucgagucccaccccaaggacucccuccacuccugcgaccacccccucgccgagaagacccaguucaccgucuccacccucgacgacgucaagaacuccggcuccauccgcgacaacuacguccgcaccuccgagaucuccgccguccacaucgacaccgagugcgucuccgucaugcuccaggccggcacccccccccuccaggucaacgaggagaaguuccccgccgagaaggcccgcaucgagaacgagauggaccccuccgacaucuccaacuccauggccgagguccucgccaagaaggaggagcucgccgaccgccucgagaaggccaacgaggaggccaucgccuccgccaucgccgaggaggagcagcucacccgcgagaucgaggccgaggagaacaacgacaucaacaucgagaccgacaacgacuccgacuucuccgccuccaugggcuccggcuccgucuccuucugcggcauguccauggacuggaacgacguccucgccgacuacgaggcccgcgaguccuggcgccagaacaccuccuggggcgacaucgucgaggaggagcccgcccgcccccccggccacggcauccacaugcacgagaagcucuccucccccucccgcaagcgcaccaucgccgaguccaagaagaagcacgaggagaagcagaugaaggcccagcagcuccgcgagaagcuccgcgaggagaagacccucaagcuccagaagcuccucgagcgcgagaaggacguccgcaaguggaaggaggagcuccucgaccagcgccgccgcaugauggaggagaagcuccuccacgccgaguucaagcgcgagguccagcuccaggccaucgucaagaaggcccaggaggaggaggccaaggucaacgagaucgccuucaucaacacccucgaggcccagaacaagcgccacgacguccucuccaagcucaaggaguacgagcagcgccucaacgagcuccaggaggagcgccagcgccgccaggaggagaagcaggcccgcgacgaggccguccaggagcgcaagcgcgcccucgaggccgagcgccaggcccgcgucgaggagcuccucaugaagcgcaaggagcaggaggcccgcaucgagcagcagcgccaggagaaggagaaggcccgcgaggacgccgcccgcgagcgcgcccgcgaccgcgaggagcgccucgccgcccucaccgccgcccagcaggaggccauggaggagcuccagaagaagauccagcucaagcacgacgaguccauccgccgccacauggagcagaucgagcagcgcaaggagaaggccgccgagcucuccuccggccgccacgccaacaccgacuacgcccccaagcucacccccuacgagcgcaagaagcagugcucccucugcaacguccucaucuccuccgaggucuaccucuucucccacgucaagggccgcaagcaccagcaggccguccgcgagaacaccuccauccagggccgcgagcucuccgacgaggaggucgagcaccucucccucaagaaguacaucaucgacaucgucgucgaguccaccgcccccgccgaggcccucaaggacggcgaggagcgccagaagaacaagaagaaggccaagaagaucaaggcccgcaugaacuuccgcgccaaggaguacgagucccucauggagaccaagaacuccggcuccgacucccccuacaaggccaagcuccagcgccucgccaaggaccuccucaagcagguccagguccaggacuccggcuccugggccaacaacaaggucuccgcccucgaccgcacccucggcgagaucacccgcauccucgagaaggagaacgucgccgaccagaucgccuuccaggccgccggcggccucaccgcccucgagcacauccuccaggccgucguccccgccaccaacgucaacaccguccuccgcaucccccccaagucccucugcaacgccaucaacgucuacaaccucaccugcaacaacugcuccgagaacugcuccgacguccucuucuccaacaagaucaccuuccucauggaccuccucauccaccagcucaccgucuacguccccgacgagaacaacaccauccucggccgcaacaccaacaagcaggucuucgagggccucaccaccggccuccucaaggucuccgccgucguccucggcugccucaucgccaaccgccccgacggcaacugccagcccgccacccccaagauccccacccaggagaugaagaacaagcccucccagggcgaccccuucaacaaccgcguccaggaccucaucuccuacgucgucaacaugggccucaucgacaagcucugcgccugcuuccucuccguccagggccccgucgacgagaaccccaagauggccaucuuccuccagcacgccgccggccuccuccacgccaugugcacccucugcuucgccgucaccggccgcuccuacuccaucuucgacaacaaccgccaggaccccaccggccucaccgccgcccuccaggccaccgaccucgccggcguccuccacaugcucuacugcguccucuuccacggcaccauccucgaccccuccaccgccucccccaaggagaacuacacccagaacaccauccaggucgccauccagucccuccgcuucuucaacuccuucgccgcccuccaccuccccgccuuccaguccaucgucggcgccgagggccucucccucgccuuccgccacauggccuccucccuccucggccacugcucccaggucuccugcgagucccuccuccacgaggucaucgucugcgucggcuacuucaccgucaaccaccccgacaaccaggucaucguccaguccggccgccaccccaccguccuccagaagcucugccagcuccccuuccaguacuucuccgacccccgccucaucaagguccucuuccccucccucaucgccgccugcuacaacaaccaccagaacaagaucauccucgagcaggagauguccugcguccuccucgccaccuucauccaggaccucgcccagacccccggccaggccgagaaccagcccuaccagcccaagggcaagugccucggcucccaggacuaccucgagcucgccaaccgcuucccccagcaggccugggaggaggcccgccaguucuuccucaagaaggagaagaaguga

SEQ ID NO: 49135 - RNA, 3840 nt, Artificial Sequence
  derived and/or modified sequence opt2 from SCAP__Homo_sapiens__NP_036367
augacccucaccgagcgccuccgcgagaagaucucccgcgccuucuacaaccacggccuccucugcgccuccuaccccauccccaucauccucuucaccggcuucugcauccucgccugcugcuacccccuccucaagcucccccuccccggcaccggccccgucgaguucaccacccccgucaaggacuacucccccccccccgucgacuccgaccgcaagcagggcgagcccaccgagcagcccgagugguacgucggcgcccccgucgccuacguccagcagaucuucgucaaguccuccgucuuccccuggcacaagaaccuccucgccgucgacgucuuccgcuccccccucucccgcgccuuccagcucgucgaggagauccgcaaccacguccuccgcgacuccuccggcauccgcucccucgaggagcucugccuccaggucaccgaccuccuccccggccuccgcaagcuccgcaaccuccuccccgagcacggcugccuccuccucucccccggcaacuucuggcagaacgacugggagcgcuuccacgccgaccccgacaucaucggcaccauccaccagcacgagcccaagacccuccagaccuccgccacccucaaggaccuccucuucggcguccccggcaaguacuccggcgucucccucuacacccgcaagcgcauggucuccuacaccaucacccucgucuuccagcacuaccacgccaaguuccucggcucccuccgcgcccgccucaugcuccuccaccccucccccaacugcucccuccgcgccgagucccucguccacguccacuucaaggaggagaucggcgucgccgagcucaucccccucgucaccaccuacaucauccucuucgccuacaucuacuucuccacccgcaagaucgacauggucaaguccaaguggggccucgcccucgccgccgucgucaccguccucuccucccuccucauguccgucggccucugcacccucuucggccucacccccacccucaacggcggcgagaucuuccccuaccucgucgucgucaucggccucgagaacguccucguccucaccaaguccgucgucuccacccccgucgaccucgaggucaagcuccgcaucgcccagggccucuccuccgaguccugguccaucaugaagaacauggccaccgagcucggcaucauccucaucggcuacuucacccucguccccgccauccaggaguucugccucuucgccgucgucggccucgucuccgacuucuuccuccagaugcucuucuucaccaccguccucuccaucgacauccgccgcauggagcucgccgaccucaacaagcgccucccccccgaggccugccuccccuccgccaagcccgucggccagcccacccgcuacgagcgccagcucgccguccgccccuccaccccccacaccaucacccuccagcccuccuccuuccgcaaccuccgccuccccaagcgccuccgcgucgucuacuuccucgcccgcacccgccucgcccagcgccucaucauggccggcaccgucgucuggaucggcauccucgucuacaccgaccccgccggccuccgcaacuaccucgccgcccaggucaccgagcaguccccccucggcgagggcgcccucgcccccaugcccguccccuccggcaugcucccccccucccaccccgaccccgccuucuccaucuucccccccgacgcccccaagcuccccgagaaccagaccucccccggcgagucccccgagcgcggcggccccgccgaggucguccacgacucccccguccccgaggucaccuggggccccgaggacgaggagcucuggcgcaagcucuccuuccgccacuggcccacccucuucuccuacuacaacaucacccucgccaagcgcuacaucucccuccuccccgucauccccgucacccuccgccucaacccccgcgaggcccucgagggccgccacccccaggacggccgcuccgccuggcccccccccggccccauccccgccggccacugggaggccggccccaagggccccggcggcguccaggcccacggcgacgucacccucuacaaggucgccgcccucggccucgccaccggcaucguccucguccuccuccuccucugccucuaccgcguccucugcccccgcaacuacggccagcucggcggcggccccggccgccgccgccgcggcgagcuccccugcgacgacuacggcuacgccccccccgagaccgagaucgucccccucguccuccgcggccaccucauggacaucgagugccucgccuccgacggcaugcuccucgucuccugcugccucgccggccacgucugcgucugggacgcccagaccggcgacugccucacccgcaucccccgccccggccgccagcgccgcgacuccggcgucggcuccggccucgaggcccaggaguccugggagcgccucuccgacggcggcaaggccggccccgaggagcccggcgacucccccccccuccgccaccgcccccgcggcccccccccccccucccucuucggcgaccagcccgaccucaccugccucaucgacaccaacuucuccgcccagccccgcuccucccagcccacccagcccgagccccgccaccgcgccgucugcggccgcucccgcgacucccccggcuacgacuucuccugccucguccagcgcgucuaccaggaggagggccucgccgccgucugcacccccgcccuccgcccccccucccccggccccguccucucccaggcccccgaggacgagggcggcucccccgagaagggcucccccucccucgccugggcccccuccgccgagggcuccaucuggucccucgagcuccagggcaaccucaucgucgucggccgcuccuccggccgccucgaggucugggacgccaucgagggcguccucugcugcuccuccgaggaggucuccuccggcaucaccgcccucgucuuccucgacaagcgcaucgucgccgcccgccucaacggcucccucgacuucuucucccucgagacccacaccgcccucuccccccuccaguuccgcggcacccccggccgcggcuccucccccgccucccccgucuacuccuccuccgacaccgucgccugccaccucacccacaccguccccugcgcccaccagaagcccaucaccgcccucaaggccgccgccggccgccucgucaccggcucccaggaccacacccuccgcgucuuccgccucgaggacuccugcugccucuucacccuccagggccacuccggcgccaucaccaccgucuacaucgaccagaccaugguccucgccuccggcggccaggacggcgccaucugccucugggacguccucaccggcucccgcgucucccacgucuucgcccaccgcggcgacgucaccucccucaccugcaccaccuccugcgucaucuccuccggccucgacgaccucaucuccaucugggaccgcuccaccggcaucaaguucuacuccauccagcaggaccucggcugcggcgccucccucggcgucaucuccgacaaccuccucgucaccggcggccagggcugcgucuccuucugggaccucaacuacggcgaccuccuccagaccgucuaccucggcaagaacuccgaggcccagcccgcccgccagauccucguccucgacaacgccgccaucgucugcaacuucggcuccgagcucucccucgucuacguccccuccguccucgagaagcucgacuga

SEQ ID NO: 49136 - RNA, 1821 nt, Artificial Sequence
  derived and/or modified sequence opt2 from SCARA3__Homo_sapiens__NP_057324
augaagguccgcuccgccggcggcgacggcgacgcccucugcgucaccgaggaggaccucgccggcgacgacgaggacaugcccaccuuccccugcacccagaagggccgccccggcccccgcugcucccgcugccagaagaaccucucccuccacaccuccguccgcauccucuaccucuuccucgcccuccuccucgucgccgucgccguccucgccucccucgucuuccgcaaggucgacucccucuccgaggacaucucccucacccaguccaucuacgacaagaagcucguccucaugcagaagaaccuccagggccucgaccccaaggcccucaacaacugcuccuucugccacgaggccggccagcucggccccgagauccgcaagcuccaggaggagcucgagggcauccagaagcuccuccucgcccaggagguccagcucgaccagacccuccaggcccaggagguccucuccaccaccucccgccagaucucccaggagaugggcuccugcuccuucuccauccaccaggucaaccagucccucggccucuuccucgcccagguccgcggcuggcaggccaccaccgccggccucgaccucucccucaaggaccucacccaggagugcuacgacgucaaggccgccguccaccagaucaacuucaccgucggccagaccuccgaguggauccacggcauccagcgcaagaccgacgaggagacccucacccuccagaagaucgucaccgacuggcagaacuacacccgccucuucuccggccuccgcaccaccuccaccaagaccggcgaggccgucaagaacauccaggccacccucggcgccuccucccagcgcaucucccagaacuccgaguccaugcacgaccucguccuccaggucaugggccuccagcuccagcucgacaacaucuccuccuuccucgacgaccacgaggagaacaugcacgaccuccaguaccacacccacuacgcccagaaccgcaccgucgagcgcuucgagucccucgagggccgcauggccucccacgagaucgagaucggcaccaucuucaccaacaucaacgccaccgacaaccacguccacuccaugcucaaguaccucgacgacguccgccucuccugcacccucggcuuccacacccacgccgaggagcucuacuaccucaacaaguccgucuccaucaugcucggcaccaccgaccuccuccgcgagcgcuucucccuccucuccgcccgccucgaccucaacguccgcaaccucuccaugaucgucgaggagaugaaggccgucgacacccagcacggcgagauccuccgcaacgucaccauccuccgcggcgcccccggcccccccggcccccgcggcuucaagggcgacaugggcgucaagggccccgucggcggccgcggccccaagggcgaccccggcucccucggcccccucggcccccagggcccccagggccagcccggcgaggccggccccgucggcgagcgcggccccgucggcccccgcggcuuccccggccucaagggcuccaagggcuccuucggcaccggcggcccccgcggccagcccggccccaagggcgacaucggcccccccggccccgagggcccccccggcucccccggccccuccggcccccagggcaagcccggcaucgccggcaagaccggcucccccggccagcgcggcgccaugggccccaagggcgagcccggcauccagggcccccccggccuccccggcccccccggcccccccggcucccaguccuucuacuga

SEQ ID NO: 49137 - RNA, 1488 nt, Artificial Sequence
  derived and/or modified sequence opt2 from SCARA5__Homo_sapiens__NP_776194
auggagaacaaggccauguaccuccacaccgucuccgacugcgacaccuccuccaucugcgaggacuccuucgacggccgcucccucuccaagcucaaccucugcgaggacggccccugccacaagcgccgcgccuccaucugcugcacccagcucggcucccucuccgcccucaagcacgccguccucggccucuaccuccucgucuuccucauccucgucggcaucuucauccucgccgucucccgcccccgcuccucccccgacgaccucaaggcccucacccgcaacgucaaccgccucaacgaguccuuccgcgaccuccagcuccgccuccuccaggccccccuccaggccgaccucaccgagcaggucuggaagguccaggacgcccuccagaaccaguccgacucccuccucgcccucgccggcgccguccagcgccucgagggcgcccucuggggccuccaggcccaggccguccagaccgagcaggccgucgcccuccuccgcgaccgcaccggccagcaguccgacaccgcccagcucgagcucuaccagcuccaggucgaguccaacuccucccagcuccuccuccgccgccacgccggccuccucgacggccucgcccgccgcgucggcauccucggcgaggagcucgccgacgucggcggcguccuccgcggccucaaccacucccucuccuacgacgucgcccuccaccgcacccgccuccaggaccuccgcguccucgucuccaacgccuccgaggacacccgccgccuccgccucgcccacgucggcauggagcuccagcucaagcaggagcucgccaugcucaacgccgucaccgaggaccuccgccucaaggacugggagcacuccaucgcccuccgcaacaucucccucgccaagggcccccccggccccaagggcgaccagggcgacgagggcaaggagggccgccccggcauccccggccuccccggccuccgcggccuccccggcgagcgcggcacccccggccuccccggccccaagggcgacgacggcaagcucggcgccaccggccccaugggcaugcgcggcuucaagggcgaccgcggccccaagggcgagaagggcgagaagggcgaccgcgccggcgacgccuccggcgucgaggcccccaugaugauccgccucgucaacggcuccggcccccacgagggccgcgucgaggucuaccacgaccgccgcuggggcaccgucugcgacgacggcugggacaagaaggacggcgacgucgucugccgcaugcucggcuuccgcggcgucgaggaggucuaccgcaccgcccgcuucggccagggcaccggccgcaucuggauggacgacgucgccugcaagggcaccgaggagaccaucuuccgcugcuccuucuccaaguggggcgucaccaacugcggccacgccgaggacgccuccgucaccugcaaccgccacuga

SEQ ID NO: 49138 - RNA, 1521 nt, Artificial Sequence
  derived and/or modified sequence opt2 from SCARB1__Homo_sapiens__NP_001076428
augggcugcuccgccaaggcccgcugggccgccggcgcccucggcgucgccggccuccucugcgccguccucggcgccgucaugaucgucaugguccccucccucaucaagcagcagguccucaagaacguccgcaucgaccccuccucccucuccuucaacauguggaaggagauccccauccccuucuaccucuccgucuacuucuucgacgucaugaaccccuccgagauccucaagggcgagaagccccagguccgcgagcgcggccccuacgucuaccgcgaguuccgccacaaguccaacaucaccuucaacaacaacgacaccgucuccuuccucgaguaccgcaccuuccaguuccagcccuccaagucccacggcuccgaguccgacuacaucgucaugcccaacauccucguccucggcgccgccgucaugauggagaacaagcccaugacccucaagcucaucaugacccucgccuucaccacccucggcgagcgcgccuucaugaaccgcaccgucggcgagaucauguggggcuacaaggacccccucgucaaccucaucaacaaguacuuccccggcauguuccccuucaaggacaaguucggccucuucgccgagcucaacaacuccgacuccggccucuucaccgucuucaccggcguccagaacaucucccgcauccaccucgucgacaaguggaacggccucuccaaggucgacuucuggcacuccgaccagugcaacaugaucaacggcaccuccggccagauguggccccccuucaugacccccgaguccucccucgaguucuacucccccgaggccugccgcuccaugaagcucauguacaaggaguccggcgucuucgagggcauccccaccuaccgcuucgucgcccccaagacccucuucgccaacggcuccaucuacccccccaacgagggcuucugccccugccucgaguccggcauccagaacgucuccaccugccgcuucuccgccccccucuuccucucccacccccacuuccucaacgccgaccccguccucgccgaggccgucaccggccuccaccccaaccaggaggcccacucccucuuccucgacauccaccccgucaccggcauccccaugaacugcuccgucaagcuccagcucucccucuacaugaaguccgucgccggcaucggccagaccggcaagaucgagcccgucguccucccccuccucugguucgccgaguccggcgccauggagggcgagacccuccacaccuucuacacccagcucguccucaugcccaaggucaugcacuacgcccaguacguccuccucgcccucggcugcguccuccuccucguccccgucaucugccagauccgcucccagggccccgaggacaccgucucccagcccggccucgccgccggccccgaccgcccccccucccccuacaccccccuccuccccgacucccccuccggccagccccccucccccaccgccuga

SEQ ID NO: 49139 - RNA, 1008 nt, Artificial Sequence
  derived and/or modified sequence opt2 from SCARB2__Homo_sapiens__NP_001191184
augggccgcugcugcuucuacaccgccggcacccucucccuccuccuccucgucaccuccgucacccuccucgucgcccgcgucuuccagaaggccgucgaccaguccaucgagaagaagaucguccuccgcaacggcaccgaggccuucgacuccugggagaagcccccccuccccgucuacacccaguucuacuucuucaacgucaccaaccccgaggagauccuccgcggcgagaccccccgcgucgaggaggucggccccuacaccuaccgcucccucgacugguggaucaccgacaagugcaacaugaucaacggcaccgacggcgacuccuuccacccccucaucaccaaggacgagguccucuacgucuuccccuccgacuucugccgcuccgucuacaucaccuucuccgacuacgaguccguccagggccuccccgccuuccgcuacaagguccccgccgagauccucgccaacaccuccgacaacgccggcuucugcauccccgagggcaacugccucggcuccggcguccucaacgucuccaucugcaagaacggcgcccccaucaucauguccuucccccacuucuaccaggccgacgagcgcuucgucuccgccaucgagggcaugcaccccaaccaggaggaccacgagaccuucgucgacaucaacccccucaccggcaucauccucaaggccgccaagcgcuuccagaucaacaucuacgucaagaagcucgacgacuucgucgagaccggcgacauccgcaccauggucuuccccgucauguaccucaacgaguccguccacaucgacaaggagaccgccucccgccucaaguccaugaucaacaccacccucaucaucaccaacauccccuacaucaucauggcccucggcgucuucuucggccucgucuucaccuggcucgccugcaagggccagggcuccauggacgagggcaccgccgacgagcgcgccccccucauccgcaccuga

SEQ ID NO: 49140 - RNA, 2616 nt, Artificial Sequence
  derived and/or modified sequence opt2 from SCARF2__Homo_sapiens__NP_699165
auggagggcgccggcccccgcggcgccggccccgcccgccgccgcggcgccggcggcccccccuccccccuccuccccucccuccuccuccuccuccuccucuggaugcuccccgacaccgucgccccccaggagcucaacccccgcggccgcaacgucugccgcgcccccggcucccagguccccaccugcugcgccggcuggcgccagcagggcgacgagugcggcaucgccgucugcgagggcaacuccaccugcuccgagaacgaggucugcguccgccccggcgagugccgcugccgccacggcuacuucggcgccaacugcgacaccaagugcccccgccaguucuggggccccgacugcaaggagcucugcuccugccacccccacggccagugcgaggacgucaccggccagugcaccugccacgcccgccgcuggggcgcccgcugcgagcacgccugccagugccagcacggcaccugccacccccgcuccggcgccugccgcugcgagcccggcugguggggcgcccagugcgccuccgccugcuacugcuccgccaccucccgcugcgacccccagaccggcgccugccucugccacgccggcugguggggccgcuccugcaacaaccagugcgccugcaacuccucccccugcgagcagcaguccggccgcugccagugccgcgagcgcaccuucggcgcccgcugcgaccgcuacugccagugcuuccgcggccgcugccaccccgucgacggcaccugcgccugcgagcccggcuaccgcggcaaguacugccgcgagcccugccccgccggcuucuacggccucggcugccgccgccgcugcggccagugcaagggccagcagcccugcaccgucgccgagggccgcugccucaccugcgagcccggcuggaacggcaccaagugcgaccagcccugcgccaccggcuucuacggcgagggcugcucccaccgcugcccccccugccgcgacggccacgccugcaaccacgucaccggcaagugcacccgcugcaacgccggcuggaucggcgaccgcugcgagaccaagugcuccaacggcaccuacggcgaggacugcgccuucgucugcgccgacugcggcuccggccacugcgacuuccaguccggccgcugccucugcucccccggcguccacggcccccacugcaacgucaccugcccccccggccuccacggcgccgacugcgcccaggccugcuccugccacgaggacaccugcgaccccgucaccggcgccugccaccucgagaccaaccagcgcaagggcgucaugggcgccggcgcccuccucguccuccucgucugccuccuccucucccuccucggcugcugcugcgccugccgcggcaaggaccccacccgccgcccccgcccccgccgcgagcucucccucggccgcaagaaggccccccaccgccucugcggccgcuucucccgcaucuccaugaagcucccccgcaucccccuccgccgccagaagcuccccaaggucgucgucgcccaccacgaccucgacaacacccucaacugcuccuuccucgagccccccuccggccucgagcagcccucccccuccugguccucccgcgccuccuucuccuccuucgacaccaccgacgagggccccgucuacugcgucccccacgaggaggcccccgccgagucccgcgaccccgagguccccaccguccccgccgaggcccccgcccccucccccgucccccucaccacccccgccuccgccgaggaggccaucccccuccccgccuccuccgacuccgagcgcuccgccuccuccgucgagggccccggcggcgcccucuacgcccgcgucgcccgccgcgaggcccgccccgcccgcgcccgcggcgagaucggcggccucucccucucccccucccccgagcgccgcaagccccccccccccgaccccgccaccaagcccaaggucuccuggauccacggcaagcacuccgccgccgccgccggccgcgcccccuccccccccccccccggcuccgaggccgcccccucccccuccaagcgcaagcgcacccccuccgacaaguccgcccacaccgucgagcacggcuccccccgcacccgcgaccccaccccccgcccccccggccuccccgaggaggccaccgcccucgccgcccccucccccccccgcgcccgcgcccgcggccgcggccccggccuccucgagcccaccgacgccggcggccccccccgcuccgcccccgaggccgccuccaugcucgccgccgagcuccgcggcaagacccgcucccucggccgcgccgaggucgcccucggcgcccagggcccccgcgagaagcccgcccccccccagaaggccaagcgcuccgucccccccgccucccccgcccgcgccccccccgccaccgagacccccggccccgagaaggccgccaccgaccuccccgcccccgagaccccccgcaagaagacccccauccagaagcccccccgcaagaagucccgcgaggccgccggcgagcucggccgcgccggcgcccccacccucuga

SEQ ID NO: 49141 - RNA, 1290 nt, Artificial Sequence
  derived and/or modified sequence opt2 from SCCPDH__Homo_sapiens__NP_057086
auggccaccgagcagcgccccuuccaccucgucgucuucggcgccuccggcuucaccggccaguucgucaccgaggaggucgcccgcgagcaggucgaccccgagcgcuccucccgccuccccugggccgucgccggccgcucccgcgagaagcuccagcgcguccucgagaaggccgcccucaagcucggccgccccacccucuccuccgaggucggcaucaucaucugcgacaucgccaaccccgccucccucgacgagauggccaagcaggccaccgucguccucaacugcgucggccccuaccgcuucuacggcgagcccgucaucaaggccugcaucgagaacggcgccuccugcaucgacaucuccggcgagccccaguuccucgagcucaugcagcucaaguaccacgagaaggccgccgacaagggcgucuacaucaucggcuccuccggcuucgacuccauccccgccgaccucggcgucaucuacacccgcaacaagaugaacggcacccucaccgccgucgaguccuuccucaccauccacuccggccccgagggccucuccauccacgacggcaccuggaaguccgccaucuacggcuucggcgaccaguccaaccuccgcaagcuccgcaacgucuccaaccucaagcccgucccccucaucggccccaagcucaagcgccgcuggcccaucuccuacugccgcgagcucaagggcuacuccauccccuucaugggcuccgacgucuccgucguccgccgcacccagcgcuaccucuacgagaaccucgaggagucccccguccaguacgccgccuacgucaccgucggcggcaucaccuccgucaucaagcucauguucgccggccucuucuuccucuucuucguccgcuucggcaucggccgccagcuccucaucaaguuccccugguucuucuccuucggcuacuucuccaagcagggccccacccagaagcagaucgacgccgccuccuucacccucaccuucuucggccagggcuacucccagggcaccggcaccgacaagaacaagcccaacaucaagaucugcacccaggucaagggccccgaggccggcuacgucgccacccccaucgccaugguccaggccgccaugacccuccucuccgacgccucccaccuccccaaggccggcggcgucuucacccccggcgccgccuucuccaagaccaagcucaucgaccgccucaacaagcacggcaucgaguucuccgucaucuccuccuccgaggucuga

SEQ ID NO: 49142 - RNA, 993 nt, Artificial Sequence
  derived and/or modified sequence opt2 from SCD5__Homo_sapiens__NP_001032671
augcccggccccgccaccgacgccggcaagauccccuucugcgacgccaaggaggagauccgcgccggccucgaguccuccgagggcggcggcggccccgagcgccccggcgcccgcggccagcgccagaacaucgucuggcgcaacgucguccucaugucccuccuccaccucggcgccgucuacucccucguccucauccccaaggccaagccccucacccuccucugggccuacuucugcuuccuccucgccgcccucggcgucaccgccggcgcccaccgccucuggucccaccgcuccuaccgcgccaagcucccccuccgcaucuuccucgccgucgccaacuccauggccuuccagaacgacaucuucgaguggucccgcgaccaccgcgcccaccacaaguacuccgagaccgacgccgacccccacaacgcccgccgcggcuucuucuucucccacaucggcuggcucuucguccgcaagcaccgcgacgucaucgagaagggccgcaagcucgacgucaccgaccuccucgccgaccccgucguccgcauccagcgcaaguacuacaagaucuccgucguccucaugugcuucgucguccccacccucguccccugguacaucuggggcgagucccucuggaacuccuacuuccucgccuccauccuccgcuacaccaucucccucaacaucuccuggcucgucaacuccgccgcccacauguacggcaaccgccccuacgacaagcacaucuccccccgccagaacccccucgucgcccucggcgccaucggcgagggcuuccacaacuaccaccacaccuuccccuucgacuacuccgccuccgaguucggccucaacuucaaccccaccaccugguucaucgacuucaugugcuggcucggccucgccaccgaccgcaagcgcgccaccaagcccaugaucgaggcccgcaaggcccgcaccggcgacuccuccgccuga

SEQ ID NO: 49143 - RNA, 1080 nt, Artificial Sequence
  derived and/or modified sequence opt2 from SCD__Homo_sapiens__NP_005054
augcccgcccaccuccuccaggacgacaucuccuccuccuacaccaccaccaccaccaucaccgccccccccucccgcguccuccagaacggcggcgacaagcucgagaccaugccccucuaccucgaggacgacauccgccccgacaucaaggacgacaucuacgaccccaccuacaaggacaaggagggccccucccccaaggucgaguacgucuggcgcaacaucauccucaugucccuccuccaccucggcgcccucuacggcaucacccucauccccaccugcaaguucuacaccuggcucuggggcgucuucuacuacuucgucuccgcccucggcaucaccgccggcgcccaccgccucuggucccaccgcuccuacaaggcccgccucccccuccgccucuuccucaucaucgccaacaccauggccuuccagaacgacgucuacgagugggcccgcgaccaccgcgcccaccacaaguucuccgagacccacgccgacccccacaacucccgccgcggcuucuucuucucccacgucggcuggcuccucguccgcaagcaccccgccgucaaggagaagggcuccacccucgaccucuccgaccucgaggccgagaagcucgucauguuccagcgccgcuacuacaagcccggccuccucaugaugugcuucauccuccccacccucguccccugguacuucuggggcgagaccuuccagaacuccgucuucgucgccaccuuccuccgcuacgccgucguccucaacgccaccuggcucgucaacuccgccgcccaccucuucggcuaccgccccuacgacaagaacaucuccccccgcgagaacauccucgucucccucggcgccgucggcgagggcuuccacaacuaccaccacuccuuccccuacgacuacuccgccuccgaguaccgcuggcacaucaacuucaccaccuucuucaucgacugcauggccgcccucggccucgccuacgaccgcaagaaggucuccaaggccgccauccucgcccgcaucaagcgcaccggcgacggcaacuacaaguccggcuga

SEQ ID NO: 49144 - RNA, 1653 nt, Artificial Sequence
  derived and/or modified sequence opt2 from SCFD1__Homo_sapiens__NP_001244305
augcccaccgaggagaacaucgaccgcaugugccaggaccuccgcaaccagcucuacgaguccuacuaccucaacuucaucuccgccaucucccgcuccaagcucgaggacaucgccaacgccgcccucgccgccuccgccgucacccaggucgccaaggucuucgaccaguaccucaacuucaucacccucgaggacgacauguucguccucugcaaccagaacaaggagcucgucuccuaccgcgccaucaaccgccccgacaucaccgacaccgagauggagaccgucauggacaccaucgucgacucccucuucugcuucuucgucacccucggcgccguccccaucauccgcugcucccgcggcaccgccgccgagauggucgccgucaagcucgacaagaagcuccgcgagaaccuccgcgacgcccgcaacucccucuucaccggcgacacccucggcgccggccaguucuccuuccagcgcccccuccucguccucgucgaccgcaacaucgaccucgccaccccccuccaccacaccuggaccuaccaggcccucguccacgacguccucgacuuccaccucaaccgcgucaaccucgaggaguccuccggcgucgagaacucccccgccggcgcccgccccaagcgcaagaacaagaaguccuacgaccucacccccgucgacaaguucuggcagaagcacaagggcucccccuuccccgaggucgccgaguccguccagcaggagcucgaguccuaccgcgcccaggaggacgaggucaagcgccucaaguccaucaugggccucgagggcgaggacgagggcgccaucuccaugcucuccgacaacaccgccaagcucaccuccgccgucuccucccuccccgagcuccucgagaagaagcgccucaucgaccuccacaccaacgucgccaccgccguccucgagcacaucaaggcccgcaagcucgacgucuacuucgaguacgaggagaagaucauguccaagaccacccucgacaagucccuccucgacaucaucuccgaccccgacgccggcacccccgaggacaagaugcgccucuuccucaucuacuacaucuccacccagcaggcccccuccgaggccgaccucgagcaguacaagaaggcccucaccgacgccggcugcaaccucaacccccuccaguacaucaagcaguggaaggccuucaccaagauggccuccgcccccgccuccuacggcuccaccaccaccaagcccaugggccuccucucccgcgucaugaacaccggcucccaguucgucauggagggcgucaagaaccucguccucaagcagcagaaccuccccgucacccgcauccucgacaaccucauggagaugaaguccaaccccgagaccgacgacuaccgcuacuucgaccccaagaugcuccgcggcaacgacuccuccgucccccgcaacaagaaccccuuccaggaggccaucgucuucgucgucggcggcggcaacuacaucgaguaccagaaccucgucgacuacaucaagggcaagcagggcaagcacauccucuacggcugcuccgagcucuucaacgccacccaguucaucaagcagcucucccagcucggccagaaguga

SEQ ID NO: 49145 - RNA, 2055 nt, Artificial Sequence
  derived and/or modified sequence opt2 from SCFD2__Homo_sapiens__NP_689753
auguccgccuccggcguccucuccuucacccagcagggcugggagcagguccucgccaaggucaagcgcgccgucgucuaccucgacgccgccugcgccgagucccuccacuggggcugcggcuccacccgccuccucgaggccgucggcggccccgacugccaccuccgcgaguucgagcccgacgccaucggcggcggcgccaagcagcccaaggccgucuucguccucuccugccuccucaagggccgcaccgucgagauccuccgcgacaucaucugccgcucccacuuccaguacugcgucgucgucaccaccgucucccacgccguccaccucaccgccaaccacguccccgccgccgccgccgccgagauggagggccagcagcccgucuucgagcagcucgaggagaagcucugcgaguggaugggcaacaugaacuacaccgccgaggucuuccacgucccccuccuccucgcccccgucgccccccacuucgcccucacccccgccuucgccucccucuucccccuccucccccaggacguccaccuccucaacuccgcccgccccgacaagcgcaagcucggcucccucggcgacgucgacuccaccacccucacccccgagcuccuccuccagauccgcugccucgucuccggccucuccucccucugcgagcaccucggcguccgcgaggagugcuucgccgucggcucccucucccaggucaucgccgccgaccucgccaacuacgcccccgccaagaaccgcaagaagaccgccgccggccgcgccuccgucgucuucgucgaccgcacccucgaccucaccggcgccgucggccaccacggcgacaaccucgucgagaagaucaucuccgcccucccccagcuccccggccacaccaacgacgucauggucaacaugaucgcccucaccgcccuccacaccgaggaggagaacuacaacgucgucgcccccggcugccucucccaguccuccgacaccaccgccaaggcccucugggaggcccuccucaacaccaagcacaaggaggccgucauggagguccgccgccaccucgucgaggccgccucccgcgagaaccuccccaucaagauguccaugggccgcgucacccccggccagcucauguccuacauccagcucuucaagaacaaccucaaggcccucaugaaccacugcggccuccuccagcucggccucgccaccgcccagacccucaagcacccccagaccgccaagugggacaacuuccucgccuucgagcgccuccuccuccaguccaucggcgaguccgccauguccgucguccucaaccagcuccuccccaugaucaagcccgucacccagcgcaccaacgaggacuacucccccgaggagcuccucauccuccucaucuacaucuacuccgucaccggcgagcucaccgucgacaaggaccucugcgaggccgaggagaaggucaagaaggcccucgcccaggucuucugcgaggaguccggccucuccccccuccuccagaagaucaccgacugggacuccuccaucaaccucaccuuccacaaguccaagaucgccgucgacgagcucuucaccucccuccgcgacaucgccggcgcccgcucccuccucaagcaguucaaguccgucuacguccccggcaaccacacccaccaggccuccuacaagccccuccucaagcaggucgucgaggagaucuuccaccccgagcgccccgacuccgucgacaucgagcacauguccuccggccucaccgaccuccucaagaccggcuucuccauguucaugaaggucucccgcccccaccccuccgacuacccccuccucauccucuucgucgucggcggcgucaccgucuccgaggucaagauggucaaggaccucgucgccucccucaagcccggcacccaggucaucguccucuccacccgccuccucaagccccucaacauccccgagcuccucuucgccaccgaccgccuccaccccgaccucggcuucuga

SEQ ID NO: 49146 - RNA, 1854 nt, Artificial Sequence
  derived and/or modified sequence opt2 from SCG2__Homo_sapiens__NP_003460
auggccgaggccaagacccacuggcucggcgccgcccucucccucaucccccucaucuuccucaucuccggcgccgaggccgccuccuuccagcgcaaccagcuccuccagaaggagcccgaccuccgccucgagaacguccagaaguuccccucccccgagaugauccgcgcccucgaguacaucgagaaccuccgccagcaggcccacaaggaggaguccucccccgacuacaaccccuaccagggcgucuccgucccccuccagcagaaggagaacggcgacgagucccaccuccccgagcgcgacucccucuccgaggaggacuggaugcgcaucauccucgaggcccuccgccaggccgagaacgagccccaguccgcccccaaggagaacaagcccuacgcccucaacuccgagaagaacuuccccauggacauguccgacgacuacgagacccagcaguggcccgagcgcaagcucaagcacaugcaguucccccccauguacgaggagaacucccgcgacaaccccuucaagcgcaccaacgagaucgucgaggagcaguacaccccccagucccucgccacccucgaguccgucuuccaggagcucggcaagcucaccggccccaacaaccagaagcgcgagcgcauggacgaggagcagaagcucuacaccgacgacgaggacgacaucuacaaggccaacaacaucgccuacgaggacgucgucggcggcgaggacuggaaccccgucgaggagaagaucgagucccagacccaggaggagguccgcgacuccaaggagaacaucgagaagaacgagcagaucaacgacgagaugaagcgcuccggccagcucggcauccaggaggaggaccuccgcaaggaguccaaggaccagcucuccgacgacgucuccaaggucaucgccuaccucaagcgccucgucaacgccgccggcuccggccgccuccagaacggccagaacggcgagcgcgccacccgccucuucgagaagccccucgacucccaguccaucuaccagcucaucgagaucucccgcaaccuccagaucccccccgaggaccucaucgagaugcucaagaccggcgagaagcccaacggcuccgucgagcccgagcgcgagcucgaccuccccgucgaccucgacgacaucuccgaggccgaccucgaccaccccgaccucuuccagaaccgcaugcucuccaaguccggcuaccccaagacccccggccgcgccggcaccgaggcccuccccgacggccucuccgucgaggacauccucaaccuccucggcauggaguccgccgccaaccagaagaccuccuacuuccccaaccccuacaaccaggagaagguccucccccgccuccccuacggcgccggccgcucccgcuccaaccagcuccccaaggccgccuggaucccccacgucgagaaccgccagauggccuacgagaaccucaacgacaaggaccaggagcucggcgaguaccucgcccgcaugcucgucaaguaccccgagaucaucaacuccaaccaggucaagcgcguccccggccagggcuccuccgaggacgaccuccaggaggaggagcagaucgagcaggccaucaaggagcaccucaaccagggcuccucccaggagaccgacaagcucgcccccgucuccaagcgcuuccccgucggcccccccaagaacgacgacacccccaaccgccaguacugggacgaggaccuccucaugaagguccucgaguaccucaaccaggagaaggccgagaagggccgcgagcacaucgccaagcgcgccauggagaacauguga

SEQ ID NO: 49147 - RNA, 711 nt, Artificial Sequence
  derived and/or modified sequence opt2 from SCG3__Homo_sapiens__NP_001158729
auggccgccauccaggacggccucgccaagggcgagaacgacgagaccgucuccaacacccucacccucaccaacggccucgagcgccgcaccaagaccuacuccgaggacaacuucgaggagcuccaguacuuccccaacuucuacgcccuccucaaguccaucgacuccgagaaggaggccaaggagaaggagacccucaucaccaucaugaagacccucaucgacuucgucaagaugauggucaaguacggcaccaucucccccgaggagggcgucuccuaccucgagaaccucgacgagaugaucgcccuccagaccaagaacaagcucgagaagaacgccaccgacaacaucuccaagcucuuccccgcccccuccgagaagucccacgaggagaccgacuccaccaaggaggaggccgccaagauggagaaggaguacggcucccucaaggacuccaccaaggacgacaacuccaaccccggcggcaagaccgacgagcccaagggcaagaccgaggccuaccucgaggccauccgcaagaacaucgaguggcucaagaagcacgacaagaagggcaacaaggaggacuacgaccucuccaagaugcgcgacuucaucaacaagcaggccgacgccuacgucgagaagggcauccucgacaaggaggaggccgaggccaucaagcgcaucuacuccucccucuga

SEQ ID NO: 49148 - RNA, 639 nt, Artificial Sequence
  derived and/or modified sequence opt2 from SCG5__Homo_sapiens__NP_001138229
auggucucccgcauggucuccaccaugcucuccggccuccucuucuggcucgccuccggcuggacccccgccuucgccuacuccccccgcacccccgaccgcgucuccgaggccgacauccagcgccuccuccacggcgucauggagcagcucggcaucgcccgcccccgcgucgaguaccccgcccaccaggccaugaaccucgucggcccccaguccaucgagggcggcgcccacgagggccuccagcaccucggccccuucggcaacauccccaacaucgucgccgagcucaccggcgacaacauccccaaggacuucuccgaggaccagggcuaccccgacccccccaaccccugccccgucggcaagaccgccgacgacggcugccucgagaacacccccgacaccgccgaguucucccgcgaguuccagcuccaccagcaccucuucgaccccgagcacgacuaccccggccucggcaaguggaacaagaagcuccucuacgagaagaugaagggcggcgagcgccgcaagcgccgcuccgucaaccccuaccuccagggccagcgccucgacaacgucgucgccaagaaguccgucccccacuucuccgacgaggacaaggaccccgaguga

SEQ ID NO: 49149 - RNA, 276 nt, Artificial Sequence
  derived and/or modified sequence opt2 from SCGB1A1__Homo_sapiens__NP_003348
augaagcucgccgucacccucacccucgucacccucgcccucugcugcuccuccgccuccgccgagaucugccccuccuuccagcgcgucaucgagacccuccucauggacacccccuccuccuacgaggccgccauggagcucuucucccccgaccaggacaugcgcgaggccggcgcccagcucaagaagcucgucgacacccucccccagaagccccgcgaguccaucaucaagcucauggagaagaucgcccaguccucccucugcaacuga

SEQ ID NO: 49150 - RNA, 273 nt, Artificial Sequence
  derived and/or modified sequence opt2 from SCGB1D1__Homo_sapiens__NP_006543
augcgccucuccgucugccuccuccuccucacccucgcccucugcugcuaccgcgccaacgccgucgucugccaggcccucggcuccgagaucaccggcuuccuccucgccggcaagcccgucuucaaguuccagcucgccaaguucaaggccccccucgaggccgucgccgccaagauggaggucaagaagugcgucgacaccauggccuacgagaagcgcguccucaucaccaagacccucggcaagaucgccgagaagugcgaccgcuga

SEQ ID NO: 49151 - RNA, 273 nt, Artificial Sequence
  derived and/or modified sequence opt2 from SCGB1D2__Homo_sapiens__NP_006542
augaagcucuccgucugccuccuccucgucacccucgcccucugcugcuaccaggccaacgccgaguucugccccgcccucgucuccgagcuccucgacuucuucuucaucuccgagccccucuucaagcucucccucgccaaguucgacgccccccccgaggccgucgccgccaagcucggcgucaagcgcugcaccgaccagaugucccuccagaagcgcucccucaucgccgagguccucgucaagauccucaagaagugcuccgucuga

SEQ ID NO: 49152 - RNA, 288 nt, Artificial Sequence
  derived and/or modified sequence opt2 from SCGB2A1__Homo_sapiens__NP_002398
augaagcuccucaugguccucaugcucgccgcccuccuccuccacugcuacgccgacuccggcugcaagcuccucgaggacauggucgagaagaccaucaacuccgacaucuccauccccgaguacaaggagcuccuccaggaguucaucgacuccgacgccgccgccgaggccaugggcaaguucaagcagugcuuccucaaccagucccaccgcacccucaagaacuucggccucaugaugcacaccgucuacgacuccaucuggugcaacaugaaguccaacuga

SEQ ID NO: 49153 - RNA, 282 nt, Artificial Sequence
  derived and/or modified sequence opt2 from SCGB2A2__Homo_sapiens__NP_002402
augaagcuccucaugguccucaugcucgccgcccucucccagcacugcuacgccggcuccggcugcccccuccucgagaacgucaucuccaagaccaucaacccccaggucuccaagaccgaguacaaggagcuccuccaggaguucaucgacgacaacgccaccaccaacgccaucgacgagcucaaggagugcuuccucaaccagaccgacgagacccucuccaacgucgaggucuucaugcagcucaucuacgacuccucccucugcgaccucuucuga

SEQ ID NO: 49154 - RNA, 291 nt, Artificial Sequence
  derived and/or modified sequence opt2 from SCGB2B2__Homo_sapiens__NP_001020762
augcgcgucaccuccgccaccugcgcccuccuccucgcccucaucugcuccguccagcucggcgacgccugccucgacaucgacaagcuccucgccaacgucgucuucgacgucucccaggaccuccucaaggaggagcucgcccgcuacaaccccuccccccucaccgaggaguccuuccucaacguccagcagugcuucgccaacgucuccgucaccgagcgcuucgcccacuccgucgucaucaagaagauccuccaguccaacgacugcaucgaggccgccuucuga

SEQ ID NO: 49155 - RNA, 315 nt, Artificial Sequence
  derived and/or modified sequence opt2 from SCGB3A1__Homo_sapiens__NP_443095
augaagcucgccgcccuccucggccucugcgucgcccucuccugcuccuccgccgccgccuuccucgucggcuccgccaagcccgucgcccagcccgucgccgcccucgaguccgccgccgaggccggcgccggcacccucgccaacccccucggcacccucaacccccucaagcuccuccucuccucccucggcauccccgucaaccaccucaucgagggcucccagaagugcgucgccgagcucggcccccaggccgucggcgccgucaaggcccucaaggcccuccucggcgcccucaccgucuucggcuga

SEQ ID NO: 49156 - RNA, 282 nt, Artificial Sequence
  derived and/or modified sequence opt2 from SCGB3A2__Homo_sapiens__NP_473364
augaagcucgucaccaucuuccuccucgucaccaucucccucugcuccuacuccgccaccgccuuccucaucaacaaggucccccuccccgucgacaagcucgccccccucccccucgacaacauccuccccuucauggacccccucaagcuccuccucaagacccucggcaucuccgucgagcaccucgucgagggccuccgcaagugcgucaacgagcucggccccgaggccuccgaggccgucaagaagcuccucgaggcccucucccaccucgucuga

SEQ ID NO: 49157 - RNA, 831 nt, Artificial Sequence
  derived and/or modified sequence opt2 from SCGN__Homo_sapiens__NP_008929
auggacuccucccgcgagcccacccucggccgccucgacgccgccggcuucuggcaggucuggcagcgcuucgacgccgacgagaagggcuacaucgaggagaaggagcucgacgccuucuuccuccacaugcucaugaagcucggcaccgacgacaccgucaugaaggccaaccuccacaaggucaagcagcaguucaugaccacccaggacgccuccaaggacggccgcauccgcaugaaggagcucgccggcauguuccucuccgaggacgagaacuuccuccuccucuuccgccgcgagaacccccucgacuccuccgucgaguucaugcagaucuggcgcaaguacgacgccgacuccuccggcuucaucuccgccgccgagcuccgcaacuuccuccgcgaccucuuccuccaccacaagaaggccaucuccgaggccaagcucgaggaguacaccggcaccaugaugaagaucuucgaccgcaacaaggacggccgccucgaccucaacgaccucgcccgcauccucgcccuccaggagaacuuccuccuccaguucaagauggacgccugcuccaccgaggagcgcaagcgcgacuucgagaagaucuucgccuacuacgacgucuccaagaccggcgcccucgagggccccgaggucgacggcuucgucaaggacaugauggagcucguccagcccuccaucuccggcgucgaccucgacaaguuccgcgagauccuccuccgccacugcgacgucaacaaggacggcaagauccagaaguccgagcucgcccucugccucggccucaagaucaaccccuga

SEQ ID NO: 49158 - RNA, 1425 nt, Artificial Sequence
  derived and/or modified sequence opt2 from SCHIP1__Homo_sapiens__NP_001184036
auggagcgcuccggccagcgcgucaccaccugggacugcgaccagggcaagcacuccgacuccgacuaccgcgaggacggcauggaccucggcuccgacgccggcuccuccuccuccuccucccgcgccuccucccaguccaacuccaccaaggucacccccugcuccgagugcaaguccuccuccucccccggcggcucccucgaccucgucuccgcccucgaggacuacgaggagcccuuccccgucuaccagaagaaggucaucgacgagugggcccccgaggaggacggcgaggaggaggaggaggaggacgagcgcgaccagcgcggcuaccgcgacgaccgcucccccgcccgcgagcccggcgacgucuccgcccgcacccgcuccggcggcggcggcggccgcuccgccaccaccgccaugcccccccccguccccaacggcaaccuccaccagcacgacccccaggaccuccgccacaacggcaacgucgucgucgccggccgccccuccugcucccgcggcccccgccgcgccauccagaagccccagcccgccggcggccgccgcuccggccgcggccccgccgccggcggccucugccuccagccccccgacggcggcaccugcguccccgaggagccccccgucccccccauggacugggaggcccucgagaagcaccucgccggccuccaguuccgcgagcaggaggcccagaagaacgagcgcgaguccauccgccagaagcucgcccucggcuccuucuucgacgacggccccggcaucuacaccuccugcuccaaguccggcaagcccucccucuccucccgccuccaguccggcaugaaccuccagaucugcuucgucaacgacuccggcuccgacaaggacuccgacgccgacgacuccaagaccgagaccucccucgacaccccccucucccccauguccaagcaguccuccuccuacuccgaccgcgacaccaccgaggaggaguccgagucccucgacgacauggacuuccucacccgccagaagaagcuccaggccgaggccaagauggcccucgccauggccaagcccauggccaagaugcaggucgaggucgagaagcagaaccgcaagaagucccccgucgccgaccuccucccccacaugccccacaucuccgagugccucaugaagcgcucccucaagcccaccgaccuccgcgacaugaccaucggccagcuccaggucaucgucaacgaccuccacucccagaucgagucccucaacgaggagcucguccagcuccuccucauccgcgacgagcuccacaccgagcaggacgccaugcucgucgacaucgaggaccucacccgccacgccgagucccagcagaagcacauggccgagaagaugcccgccaaguga

SEQ ID NO: 49159 - RNA, 2148 nt, Artificial Sequence
  derived and/or modified sequence opt2 from SCIN__Homo_sapiens__NP_001106177
auggcccgcgagcucuaccacgaggaguucgcccgcgccggcaagcaggccggccuccaggucuggcgcaucgagaagcucgagcucguccccgucccccaguccgcccacggcgacuucuacgucggcgacgccuaccucguccuccacaccgccaagaccucccgcggcuucaccuaccaccuccacuucuggcucggcaaggagugcucccaggacgaguccaccgccgccgccaucuucaccguccagauggacgacuaccucggcggcaagcccguccagaaccgcgagcuccagggcuacgaguccaacgacuucgucuccuacuucaagggcggccucaaguacaaggccggcggcgucgccuccggccucaaccacguccucaccaacgaccucaccgccaagcgccuccuccacgucaagggccgccgcgucguccgcgccaccgaggucccccucuccugggacuccuucaacaagggcgacugcuucaucaucgaccucggcaccgagaucuaccaguggugcggcuccuccugcaacaaguacgagcgccucaaggccaaccaggucgccaccggcauccgcuacaacgagcgcaagggccgcuccgagcucaucgucgucgaggagggcuccgagcccuccgagcucaucaagguccucggcgagaagcccgagcuccccgacggcggcgacgacgacgacaucaucgccgacaucuccaaccgcaagauggccaagcucuacauggucuccgacgccuccggcuccaugcgcgucaccgucgucgccgaggagaaccccuucuccauggccaugcuccucuccgaggagugcuucauccucgaccacggcgccgccaagcagaucuucgucuggaagggcaaggacgccaacccccaggagcgcaaggccgccaugaagaccgccgaggaguuccuccagcagaugaacuacuccaagaacacccagauccagguccuccccgagggcggcgagacccccaucuucaagcaguucuucaaggacuggcgcgacaaggaccaguccgacggcuucggcaaggucuacgucaccgagaaggucgcccagaucaagcagauccccuucgacgccuccaagcuccacuccuccccccagauggccgcccagcacaacauggucgacgacggcuccggcaaggucgagaucuggcgcgucgagaacaacggccgcauccaggucgaccagaacuccuacggcgaguucuacggcggcgacugcuacaucauccucuacaccuacccccgcggccagaucaucuacaccuggcagggcgccaacgccacccgcgacgagcucaccaccuccgccuuccucaccguccagcucgaccgcucccucggcggccaggccguccagauccgcgucucccagggcaaggagcccguccaccuccucucccucuucaaggacaagccccucaucaucuacaagaacggcaccuccaagaagggcggccaggcccccgccccccccacccgccucuuccagguccgccgcaaccucgccuccaucacccgcaucgucgaggucgacgucgacgccaacucccucaacuccaacgacgucuucguccucaagcucccccagaacuccggcuacaucugggucggcaagggcgccucccaggaggaggagaagggcgccgaguacgucgccuccguccucaagugcaagacccuccgcauccaggagggcgaggagcccgaggaguucuggaacucccucggcggcaagaaggacuaccagaccuccccccuccucgagacccaggccgaggaccaccccccccgccucuacggcugcuccaacaagaccggccgcuucgucaucgaggagauccccggcgaguucacccaggacgaccucgccgaggacgacgucaugcuccucgacgccugggagcagaucuucaucuggaucggcaaggacgccaacgaggucgagaagaaggagucccucaaguccgccaagauguaccucgagaccgaccccuccggccgcgacaagcgcacccccaucgucaucaucaagcagggccacgagccccccaccuucaccggcugguuccucggcugggacuccuccaagugguga

SEQ ID NO: 49160 - RNA, 240 nt, Artificial Sequence
  derived and/or modified sequence opt2 from SCLT1__Homo_sapiens__NP_001287826
auggccgccgagaucgacuuccuccgcgagcagaaccgccgccucaacgaggacuuccgccgcuaccagauggaguccuucuccaaguacuccuccguccagaaggccgucugccagggcgagggcgacgacaccuucgagaaccucgucuucgaccaguccuuccucgccccccucgucaccgaguacgacaagcaccucggcgagcucaacggccagcucaaguacuaccaggccuga

SEQ ID NO: 49161 - RNA, 1362 nt, Artificial Sequence
  derived and/or modified sequence opt2 from SCLY__Homo_sapiens__NP_057594
augcccggcuccuccggcgccggcauggaggccgccgucgcccccggccgcgacgcccccgcccccgccgccucccagcccuccggcugcggcaagcacaacucccccgagcgcaaggucuacauggacuacaacgccaccaccccccucgagcccgaggucauccaggccaugaccaaggccaugugggaggccuggggcaaccccuccucccccuacuccgccggccgcaaggccaaggacaucaucaacgccgcccgcgagucccucgccaagaugaucggcggcaagccccaggacaucaucuucaccuccggcggcaccgaguccaacaaccucgucauccacuccgucgucaagcacuuccacgccaaccagaccuccaagggccacaccggcggccaccacucccccgucaagggcgccaagccccacuucaucaccuccuccgucgagcacgacuccauccgccucccccucgagcaccucgucgaggagcaggucgccgccgucaccuucguccccgucuccaaggucuccggccaggccgaggucgacgacauccucgccgccguccgccccaccacccgccucgucaccaucaugcucgccaacaacgagaccggcaucgucaugcccguccccgagaucucccagcgcaucaaggcccucaaccaggagcgcgucgccgccggccucccccccauccucguccacaccgacgccgcccaggcccucggcaagcagcgcgucgacgucgaggaccucggcgucgacuuccucaccaucgucggccacaaguucuacggcccccgcaucggcgcccucuacauccgcggccucggcgaguucaccccccucuaccccaugcucuucggcggcggccaggagcgcaacuuccgccccggcaccgagaacacccccaugaucgccggccucggcaaggccgccgagcucgucacccagaacugcgaggccuacgaggcccacaugcgcgacguccgcgacuaccucgaggagcgccucgaggccgaguucggccagaagcgcauccaccucaacucccaguuccccggcacccagcgccuccccaacaccugcaacuucuccauccgcggcccccgccuccagggccacgucguccucgcccagugccgcguccucauggccuccgucggcgccgccugccacuccgaccacggcgaccagcccucccccguccuccucuccuacggcguccccuucgacgucgcccgcaacgcccuccgccucuccgucggccgcuccaccacccgcgccgaggucgaccucgucguccaggaccucaagcaggccgucgcccagcucgaggaccaggccuga

SEQ ID NO: 49162 - RNA, 2103 nt, Artificial Sequence
  derived and/or modified sequence opt2 from SCML2__Homo_sapiens__NP_006080
augggccagaccgucaacgaggacuccauggacgucaagaaggagaaccaggagaagaccccccaguccuccaccuccuccguccagcgcgacgacuuccacugggaggaguaccucaaggagaccggcuccaucuccgcccccuccgagugcuuccgccagucccagaucccccccgucaacgacuucaaggucggcaugaagcucgaggcccgcgacccccgcaacgccaccuccgucugcaucgccaccgucaucggcaucaccggcgcccgccuccgccuccgccucgacggcuccgacaaccgcaacgacuucuggcgccucgucgacucccccgacauccagcccgucggcaccugcgagaaggagggcgaccuccuccagcccccccucggcuaccagaugaacaccuccuccuggcccauguuccuccucaagacccucaacggcuccgagauggccuccgccacccucuucaagaaggagccccccaagcccccccucaacaacuucaaggucggcaugaagcucgaggccaucgacaagaagaaccccuaccucaucugccccgccaccaucggcgacgucaagggcgacgagguccacaucaccuucgacggcugguccggcgccuucgacuacuggugcaaguacgacucccgcgacaucuuccccgccggcuggugccgccucaccggcgacguccuccagccccccggcaccuccguccccaucgucaagaacaucgccaagaccgaguccucccccuccgaggccucccagcacuccaugcaguccccccagaagaccacccucauccuccccacccagcagguccgccgcuccucccgcaucaagccccccggccccaccgccguccccaagcgcuccuccuccgucaagaacaucaccccccgcaagaagggccccaacuccggcaagaaggagaagccccuccccgucaucugcuccaccuccgccgccucccucaagucccucacccgcgaccgcggcaugcucuacaaggacgucgccuccggccccugcaagaucgucauguccaccgucugcgucuacgucaacaagcacggcaacuucggcccccaccucgaccccaagcgcauccagcagcuccccgaccacuucggccccggccccgucaacgucguccuccgccgcaucguccaggccugcgucgacugcgcccucgagaccaagaccgucuucggcuaccucaagcccgacaaccgcggcggcgaggucaucaccgccuccuucgacggcgagacccacuccauccagcucccccccgucaacuccgccuccuucgcccuccgcuuccucgagaacuucugccacucccuccagugcgacaaccuccucuccucccagcccuucuccuccucccgcggccacacccacuccuccgccgagcacgacaagaaccaguccgccaaggaggacgucaccgagcgccaguccaccaagcgcuccccccagcagaccguccccuacgucgucccccucucccccaagcuccccaagaccaaggaguacgccuccgagggcgagccccucuucgccggcggcuccgccauccccaaggaggagaaccucuccgaggacuccaaguccuccucccucaacuccggcaacuaccucaaccccgccugccgcaaccccauguacauccacaccuccgucucccaggacuucucccgcuccguccccggcaccaccuccuccccccucgucggcgacaucucccccaaguccuccccccacgaggucaaguuccagaugcagcgcaaguccgaggcccccuccuacaucgccguccccgaccccuccguccucaagcagggcuucuccaaggaccccuccaccugguccgucgacgaggucauccaguucaugaagcacaccgacccccagaucuccggcccccucgccgaccucuuccgccagcacgagaucgacggcaaggcccucuuccuccucaaguccgacgucaugaugaaguacaugggccucaagcucggccccgcccucaagcucugcuacuacaucgagaagcucaaggagggcaaguacuccuga

SEQ ID NO: 49163 - RNA, 1245 nt, Artificial Sequence
  derived and/or modified sequence opt2 from SCML4__Homo_sapiens__NP_932347
augcagucccagcgcauccccggccgcaagcgcggccgccccucccuccacuccacccccaugaagauggccguccacaaccucuacuccgccuccgccggcucccuccccgccgucaagauccccaagaagcgcggccgcaagcccggcuacaagaucaagucccgcguccucaugaccccccucgcccucucccccccccgcuccacccccgagcccgaccucuccuccaucccccaggacgccgccaccguccccucccucgccgccccccaggcccucaccgucugccucuacaucaacaagcaggccaacgccggccccuaccucgagcgcaagaagguccagcagcuccccgagcacuucggccccgagcgccccuccgccguccuccagcaggccguccaggccugcaucgacugcgcccaccagcagaagcucgucuucucccucgucaagcagggcuacggcggcgagauggucuccgucuccgccuccuucgacggcaagcagcaccuccgcucccuccccgucgucaacuccaucggcuacguccuccgcuuccucgccaagcucugccgcucccuccucugcgacgaccucuucucccaccagcccuucccccgcggcugcuccgccuccgagaagguccaggagaaggaggagggccgcauggaguccgucaagaccgucaccaccgaggaguaccucgucaaccccgucggcaugaaccgcuacuccgucgacaccuccgccuccaccuucaaccaccgcggcucccuccaccccuccuccucccucuacugcaagcgccagaacuccggcgacucccaccucggcggcggccccgccgccaccgccggcggcccccgcaccucccccauguccuccggcggccccuccgcccccggccuccgcccccccgccuccucccccaagcgcaacaccaccucccucgagggcaaccgcugcgccuccucccccucccaggacgcccaggacgcccgccgcccccgcucccgcaaccccuccgccuggaccgucgaggacgucgucugguucgucaaggacgccgacccccaggcccucggcccccacgucgagcucuuccgcaagcacgagaucgacggcaacgcccuccuccuccucaaguccgacauggucaugaaguaccucggccucaagcucggccccgcccucaagcucugcuaccacaucgacaagcucaagcaggccaaguucuga

SEQ ID NO: 49164 - RNA, 5871 nt, Artificial Sequence
  derived and/or modified sequence opt2 from SCN10A__Homo_sapiens__NP_006505
auggaguuccccaucggcucccucgagaccaacaacuuccgccgcuucacccccgagucccucgucgagaucgagaagcagaucgccgccaagcagggcaccaagaaggcccgcgagaagcaccgcgagcagaaggaccaggaggagaagccccgcccccagcucgaccucaaggccugcaaccagcuccccaaguucuacggcgagcuccccgccgagcucaucggcgagccccucgaggaccucgaccccuucuacuccacccaccgcaccuucaugguccucaacaagggccgcaccaucucccgcuucuccgccacccgcgcccucuggcucuucucccccuucaaccucauccgccgcaccgccaucaaggucuccguccacuccugguucucccucuucaucaccgucaccauccucgucaacugcgucugcaugacccgcaccgaccuccccgagaagaucgaguacgucuucaccgucaucuacaccuucgaggcccucaucaagauccucgcccgcggcuucugccucaacgaguucaccuaccuccgcgaccccuggaacuggcucgacuucuccgucaucacccucgccuacgucggcaccgccaucgaccuccgcggcaucuccggccuccgcaccuuccgcguccuccgcgcccucaagaccgucuccgucauccccggccucaaggucaucgucggcgcccucauccacuccgucaagaagcucgccgacgucaccauccucaccaucuucugccucuccgucuucgcccucgucggccuccagcucuucaagggcaaccucaagaacaagugcgucaagaacgacauggccgucaacgagaccaccaacuacuccucccaccgcaagcccgacaucuacaucaacaagcgcggcaccuccgacccccuccucugcggcaacggcuccgacuccggccacugccccgacggcuacaucugccucaagaccuccgacaaccccgacuucaacuacaccuccuucgacuccuucgccugggccuuccucucccucuuccgccucaugacccaggacuccugggagcgccucuaccagcagacccuccgcaccuccggcaagaucuacaugaucuucuucguccucgucaucuuccucggcuccuucuaccucgucaaccucauccucgccgucgucaccauggccuacgaggagcagaaccaggccaccaccgacgagaucgaggccaaggagaagaaguuccaggaggcccucgagaugcuccgcaaggagcaggagguccucgccgcccucggcaucgacaccaccucccuccacucccacaacggcuccccccucaccuccaagaacgccuccgagcgccgccaccgcaucaagccccgcgucuccgagggcuccaccgaggacaacaaguccccccgcuccgaccccuacaaccagcgccgcauguccuuccucggccucgccuccggcaagcgccgcgccucccacggcuccgucuuccacuuccgcucccccggccgcgacaucucccuccccgagggcgucaccgacgacggcgucuuccccggcgaccacgagucccaccgcggcucccuccuccucggcggcggcgccggccagcagggcccccucccccgcuccccccucccccagcccuccaaccccgacucccgccacggcgaggacgagcaccagcccccccccaccuccgagcucgcccccggcgccgucgacgucuccgccuucgacgccggccagaagaagaccuuccucuccgccgaguaccucgacgagcccuuccgcgcccagcgcgccauguccgucgucuccaucaucaccuccguccucgaggagcucgaggaguccgagcagaagugcccccccugccucaccucccucucccagaaguaccucaucugggacugcugccccaugugggucaagcucaagaccauccucuucggccucgucaccgaccccuucgccgagcucaccaucacccucugcaucgucgucaacaccaucuucauggccauggagcaccacggcaugucccccaccuucgaggccaugcuccagaucggcaacaucgucuucaccaucuucuucaccgccgagauggucuucaagaucaucgccuucgaccccuacuacuacuuccagaagaaguggaacaucuucgacugcaucaucgucaccgucucccuccucgagcucggcgucgccaagaagggcucccucuccguccuccgcuccuuccgccuccuccgcgucuucaagcucgccaaguccuggcccacccucaacacccucaucaagaucaucggcaacuccgucggcgcccucggcaaccucaccaucauccucgccaucaucgucuucgucuucgcccucgucggcaagcagcuccucggcgagaacuaccgcaacaaccgcaagaacaucuccgccccccacgaggacuggccccgcuggcacaugcacgacuucuuccacuccuuccucaucgucuuccgcauccucugcggcgaguggaucgagaacaugugggccugcauggaggucggccagaaguccaucugccucauccucuuccucaccgucaugguccucggcaaccucgucguccucaaccucuucaucgcccuccuccucaacuccuucuccgccgacaaccucaccgcccccgaggacgacggcgaggucaacaaccuccaggucgcccucgcccgcauccaggucuucggccaccgcaccaagcaggcccucugcuccuucuucucccgcuccugccccuucccccagcccaaggccgagcccgagcucgucgucaagcucccccucuccuccuccaaggccgagaaccacaucgccgccaacaccgcccgcggcuccuccggcggccuccaggccccccgcggcccccgcgacgagcacuccgacuucaucgccaaccccaccgucugggucuccguccccaucgccgagggcgaguccgaccucgacgaccucgaggacgacggcggcgaggacgcccaguccuuccagcaggaggucauccccaagggccagcaggagcagcuccagcaggucgagcgcugcggcgaccaccucaccccccgcucccccggcaccggcaccuccuccgaggaccucgcccccucccucggcgagaccuggaaggacgaguccgucccccagguccccgccgagggcgucgacgacaccuccuccuccgagggcuccaccgucgacugccucgaccccgaggagauccuccgcaagauccccgagcucgccgacgaccucgaggagcccgacgacugcuucaccgagggcugcauccgccacugccccugcugcaagcucgacaccaccaagucccccugggacgucggcuggcagguccgcaagaccugcuaccgcaucgucgagcacuccugguucgaguccuucaucaucuucaugauccuccucuccuccggcucccucgccuucgaggacuacuaccucgaccagaagcccaccgucaaggcccuccucgaguacaccgaccgcgucuucaccuucaucuucgucuucgagaugcuccucaagugggucgccuacggcuucaagaaguacuucaccaacgccuggugcuggcucgacuuccucaucgucaacaucucccucaucucccucaccgccaagauccucgaguacuccgaggucgcccccaucaaggcccuccgcacccuccgcgcccuccgcccccuccgcgcccucucccgcuucgagggcaugcgcgucgucgucgacgcccucgucggcgccauccccuccaucaugaacguccuccucgucugccucaucuucuggcucaucuucuccaucaugggcgucaaccucuucgccggcaaguucuggcgcugcaucaacuacaccgacggcgaguucucccucgucccccucuccaucgucaacaacaaguccgacugcaagauccagaacuccaccggcuccuucuucugggucaacgucaaggucaacuucgacaacgucgccaugggcuaccucgcccuccuccaggucgccaccuucaagggcuggauggacaucauguacgccgccgucgacucccgcgaggucaacaugcagcccaagugggaggacaacgucuacauguaccucuacuucgucaucuucaucaucuucggcggcuucuucacccucaaccucuucgucggcgucaucaucgacaacuucaaccagcagaagaagaagcucggcggccaggacaucuucaugaccgaggagcagaagaaguacuacaacgccaugaagaagcucggcuccaagaagccccagaagcccaucccccgcccccucaacaaguuccagggcuucgucuucgacaucgucacccgccaggccuucgacaucaccaucaugguccucaucugccucaacaugaucaccaugauggucgagaccgacgaccaguccgaggagaagaccaagauccucggcaagaucaaccaguucuucgucgccgucuucaccggcgagugcgucaugaagauguucgcccuccgccaguacuacuucaccaacggcuggaacgucuucgacuucaucgucgucguccucuccaucgccucccucaucuucuccgccauccucaagucccuccaguccuacuucucccccacccucuuccgcgucauccgccucgcccgcaucggccgcauccuccgccucauccgcgccgccaagggcauccgcacccuccucuucgcccucaugaugucccuccccgcccucuucaacaucggccuccuccucuuccucgucauguucaucuacuccaucuucggcauguccuccuucccccacguccgcugggaggccggcaucgacgacauguucaacuuccagaccuucgccaacuccaugcucugccucuuccagaucaccaccuccgccggcugggacggccuccucucccccauccucaacaccggcccccccuacugcgaccccaaccuccccaacuccaacggcacccgcggcgacugcggcucccccgccgucggcaucaucuucuucaccaccuacaucaucaucuccuuccucaucgucgucaacauguacaucgccgucauccucgagaacuucaacgucgccaccgaggaguccaccgagccccucuccgaggacgacuucgacauguucuacgagaccugggagaaguucgaccccgaggccacccaguucaucaccuucuccgcccucuccgacuucgccgacacccucuccggcccccuccgcauccccaagcccaaccgcaacauccucauccagauggaccucccccucguccccggcgacaagauccacugccucgacauccucuucgccuucaccaagaacguccucggcgaguccggcgagcucgacucccucaaggccaacauggaggagaaguucauggccaccaaccucuccaaguccuccuacgagcccaucgccaccacccuccgcuggaagcaggaggacaucuccgccaccgucauccagaaggccuaccgcuccuacguccuccaccgcuccauggcccucuccaacacccccugcgucccccgcgccgaggaggaggccgccucccuccccgacgagggcuucgucgccuucaccgccaacgagaacugcguccuccccgacaaguccgagaccgccuccgccaccuccuucccccccuccuacgaguccgucacccgcggccucuccgaccgcgucaacaugcgcaccuccuccuccauccagaacgaggacgaggccaccuccauggagcucaucgcccccggccccuga

SEQ ID NO: 49165 - RNA, 5376 nt, Artificial Sequence
  derived and/or modified sequence opt2 from SCN11A__Homo_sapiens__XP_011531622
auggacgaccgcugcuaccccgucaucuuccccgacgagcgcaacuuccgccccuucaccuccgacucccucgccgccaucgagaagcgcaucgccauccagaaggagaagaagaaguccaaggaccagaccggcgaggucccccagccccgcccccagcucgaccucaaggccucccgcaagcuccccaagcucuacggcgacaucccccgcgagcucaucggcaagccccucgaggaccucgaccccuucuaccgcaaccacaagaccuucaugguccucaaccgcaagcgcaccaucuaccgcuucuccgccaagcacgcccucuucaucuucggccccuucaacuccauccgcucccucgccauccgcgucuccguccacucccucuucuccauguucaucaucggcaccgucaucaucaacugcgucuucauggccaccggccccgccaagaacuccaacuccaacaacaccgacaucgccgagugcgucuucaccggcaucuacaucuucgaggcccucaucaagauccucgcccgcggcuucauccucgacgaguucuccuuccuccgcgaccccuggaacuggcucgacuccaucgucaucggcaucgccaucgucuccuacauccccggcaucaccaucaagcuccucccccuccgcaccuuccgcgucuuccgcgcccucaaggccaucuccgucgucucccgccucaaggucaucgucggcgcccuccuccgcuccgucaagaagcucgucaacgucaucauccucaccuucuucugccucuccaucuucgcccucgucggccagcagcucuucaugggcucccucaaccucaagugcaucucccgcgacugcaagaacaucuccaaccccgaggccuacgaccacugcuucgagaagaaggagaacucccccgaguucaagaugugcggcaucuggaugggcaacuccgccugcuccauccaguacgagugcaagcacaccaagaucaaccccgacuacaacuacaccaacuucgacaacuucggcugguccuuccucgccauguuccgccucaugacccaggacuccugggagaagcucuaccagcagacccuccgcaccaccggccucuacuccgucuucuucuucaucgucgucaucuuccucggcuccuucuaccucaucaaccucacccucgccgucgucaccauggccuacgaggagcagaacaagaacgucgccgccgagaucgaggccaaggagaagauguuccaggaggcccagcagcuccucaaggaggagaaggaggcccucgucgccaugggcaucgaccgcuccucccucaccucccucgagaccuccuacuucacccccaagaagcgcaagcucuucggcaacaagaagcgcaaguccuucuuccuccgcgaguccggcaaggaccagccccccggcuccgacuccgacgaggacugccagaagaagccccagcuccucgagcagaccaagcgccucucccagaaccucucccucgaccacuucgacgagcacggcgacccccuccagcgccagcgcgcccucuccgccgucuccauccucaccaucaccaugaaggagcaggagaagucccaggagcccugccuccccugcggcgagaaccucgccuccaaguaccucgucuggaacugcugcccccaguggcucugcgucaagaagguccuccgcaccgucaugaccgaccccuucaccgagcucgccaucaccaucugcaucaucaucaacaccgucuuccucgccauggagcaccacaagauggaggccuccuucgagaagaugcucaacaucggcaaccucgucuucaccuccaucuucaucgccgagaugugccucaagaucaucgcccucgaccccuaccacuacuuccgccgcggcuggaacaucuucgacuccaucgucgcccuccucuccuucgccgacgucaugaacugcguccuccagaagcgcuccuggcccuuccuccgcuccuuccgcguccuccgcgucuucaagcucgccaaguccuggcccacccucaacacccucaucaagaucaucggcaacuccgucggcgcccucggcucccucaccgucguccucgucaucgucaucuucaucuucuccgucgucggcaugcagcucuucggccgcuccuucaacucccagaagucccccaagcucugcaaccccaccggccccaccgucuccugccuccgccacuggcacaugggcgacuucuggcacuccuuccucgucgucuuccgcauccucugcggcgaguggaucgagaacaugugggagugcaugcaggaggccaacgccuccuccucccucugcgucaucgucuucauccucaucaccgucaucggcaagcucgucguccucaaccucuucaucgcccuccuccucaacuccuucuccaacgaggagcgcaacggcaaccucgagggcgaggcccgcaagaccaagguccagcucgcccucgaccgcuuccgccgcgccuucugcuucguccgccacacccucgagcacuucugccacaaguggugccgcaagcagaaccucccccagcagaaggaggucgccggcggcugcgccgcccaguccaaggacaucaucccccucgucauggagaugaagcgcggcuccgagacccaggaggagcucggcauccucaccuccguccccaagacccucggcguccgccacgacuggaccuggcucgccccccucgccgaggaggaggacgacgucgaguucuccggcgaggacaacgcccagcgcaucacccagcccgagcccgagcagcaggccuacgagcuccaccaggagaacaagaagcccaccucccagcgcguccaguccgucgagaucgacauguucuccgaggacgagccccaccucaccauccaggacccccgcaagaaguccgacgucaccuccauccucuccgagugcuccaccaucgaccuccaggacggcuucggcuggcuccccgagaugguccccaagaagcagcccgagcgcugccuccccaagggcuucggcugcugcuuccccugcugcuccgucgacaagcgcaagccccccugggucaucugguggaaccuccgcaagaccugcuaccagaucgucaagcacuccugguucgaguccuucaucaucuucgucauccuccucuccuccggcgcccucaucuucgaggacguccaccucgagaaccagcccaagauccaggagcuccucaacugcaccgacaucaucuucacccacaucuucauccucgagaugguccucaagugggucgccuucggcuucggcaaguacuucaccuccgccuggugcugccucgacuucaucaucgucaucgucuccgucaccacccucaucaaccucauggagcucaaguccuuccgcacccuccgcgcccuccgcccccuccgcgcccucucccaguucgagggcaugaaggucgucgucaacgcccucaucggcgccauccccgccauccucaacguccuccucgucugccucaucuucuggcucgucuucugcauccucggcgucuacuucuucuccggcaaguucggcaagugcaucaacggcaccgacuccgucaucaacuacaccaucaucaccaacaagucccagugcgaguccggcaacuucuccuggaucaaccagaaggucaacuucgacaacgucggcaacgccuaccucgcccuccuccaggucgccaccuucaagggcuggauggacaucaucuacgccgccgucgacuccaccgagaaggagcagcagcccgaguucgaguccaacucccucggcuacaucuacuucgucgucuucaucaucuucggcuccuucuucacccucaaccucuucaucggcgucaucaucgacaacuucaaccagcagcagaagaagcucggcggccaggacaucuucaugaccgaggagcagaagaaguacuacaacgccaugaagaagcucggcuccaagaagccccagaagcccaucccccgcccccucaacaagugccagggccucgucuucgacaucgucaccucccagaucuucgacaucaucaucaucucccucaucauccucaacaugaucuccaugauggccgaguccuacaaccagcccaaggccaugaaguccauccucgaccaccucaacugggucuucgucgucaucuucacccucgagugccucaucaagaucuucgcccuccgccaguacuacuucaccaacggcuggaaccucuucgacugcgucgucguccuccucuccaucgucuccaccaugaucuccacccucgagaaccaggagcacauccccuucccccccacccucuuccgcaucguccgccucgcccgcaucggccgcauccuccgccucguccgcgccgcccgcggcauccgcacccuccucuucgcccucaugaugucccuccccucccucuucaacaucggccuccuccucuuccucaucauguucaucuacgccauccucggcaugaacugguucuccaaggucaaccccgaguccggcaucgacgacaucuucaacuucaagaccuucgccuccuccaugcucugccucuuccagaucuccaccuccgccggcugggacucccuccucucccccaugcuccgcuccaaggaguccugcaacuccuccuccgagaacugccaccuccccggcaucgccaccuccuacuucgucuccuacaucaucaucuccuuccucaucgucgucaacauguacaucgccgucauccucgagaacuucaacaccgccaccgaggaguccgaggacccccucggcgaggacgacuucgacaucuucuacgaggucugggagaaguucgaccccgaggccacccaguucaucaaguacuccgcccucuccgacuucgccgacgcccuccccgagccccuccgcgucgccaagcccaacaaguaccaguuccucgucauggaccuccccauggucuccgaggaccgccuccacugcauggacauccucuucgccuucaccgcccgcguccucggcggcuccgacggccucgacuccaugaaggccaugauggaggagaaguucauggaggccaacccccucaagaagcucuacgagcccaucgucaccaccaccaagcgcaaggaggaggagcgcggcgccgccaucauccagaaggccuuccgcaaguacaugaugaaggucaccaagggcgaccagggcgaccagaacgaccucgagaacggcccccacuccccccuccagacccucugcaacggcgaccucuccuccuucggcgucgccaagggcaagguccacugcgacuga

SEQ ID NO: 49166 - RNA, 6030 nt, Artificial Sequence
  derived and/or modified sequence opt2 from SCN1A__Homo_sapiens__NP_001159435
auggagcagaccguccucgucccccccggccccgacuccuucaacuucuucacccgcgagucccucgccgccaucgagcgccgcaucgccgaggagaaggccaagaaccccaagcccgacaagaaggacgacgacgagaacggccccaagcccaacuccgaccucgaggccggcaagaaccuccccuucaucuacggcgacaucccccccgagauggucuccgagccccucgaggaccucgaccccuacuacaucaacaagaagaccuucaucguccucaacaagggcaaggccaucuuccgcuucuccgccaccuccgcccucuacauccucacccccuucaacccccuccgcaagaucgccaucaagauccucguccacucccucuucuccaugcucaucaugugcaccauccucaccaacugcgucuucaugaccauguccaacccccccgacuggaccaagaacgucgaguacaccuucaccggcaucuacaccuucgagucccucaucaagaucaucgcccgcggcuucugccucgaggacuucaccuuccuccgcgaccccuggaacuggcucgacuucaccgucaucaccuucgccuacgucaccgaguucgucgaccucggcaacgucuccgcccuccgcaccuuccgcguccuccgcgcccucaagaccaucuccgucauccccggccucaagaccaucgucggcgcccucauccaguccgucaagaagcucuccgacgucaugauccucaccgucuucugccucuccgucuucgcccucaucggccuccagcucuucaugggcaaccuccgcaacaagugcauccaguggccccccaccaacgccucccucgaggagcacuccaucgagaagaacaucaccgucaacuacaacggcacccucaucaacgagaccgucuucgaguucgacuggaaguccuacauccaggacucccgcuaccacuacuuccucgagggcuuccucgacgcccuccucugcggcaacuccuccgacgccggccagugccccgagggcuacaugugcgucaaggccggccgcaaccccaacuacggcuacaccuccuucgacaccuucuccugggccuuccucucccucuuccgccucaugacccaggacuucugggagaaccucuaccagcucacccuccgcgccgccggcaagaccuacaugaucuucuucguccucgucaucuuccucggcuccuucuaccucaucaaccucauccucgccgucgucgccauggccuacgaggagcagaaccaggccacccucgaggaggccgagcagaaggaggccgaguuccagcagaugaucgagcagcucaagaagcagcaggaggccgcccagcaggccgccaccgccaccgccuccgagcacucccgcgagcccuccgccgccggccgccucuccgacuccuccuccgaggccuccaagcucuccuccaaguccgccaaggagcgccgcaaccgccgcaagaagcgcaagcagaaggagcaguccggcggcgaggagaaggacgaggacgaguuccagaaguccgaguccgaggacuccauccgccgcaagggcuuccgcuucuccaucgagggcaaccgccucaccuacgagaagcgcuacuccuccccccaccagucccuccucuccauccgcggcucccucuucuccccccgccgcaacucccgcaccucccucuucuccuuccgcggccgcgccaaggacgucggcuccgagaacgacuucgccgacgacgagcacuccaccuucgaggacaacgagucccgccgcgacucccucuucgucccccgccgccacggcgagcgccgcaacuccaaccucucccagaccucccgcuccucccgcaugcucgccgucuuccccgccaacggcaagaugcacuccaccgucgacugcaacggcgucgucucccucgucggcggccccuccguccccaccucccccgucggccagcuccuccccgaggucaucaucgacaagcccgccaccgacgacaacggcaccaccaccgagaccgagaugcgcaagcgccgcuccuccuccuuccacgucuccauggacuuccucgaggaccccucccagcgccagcgcgccauguccaucgccuccauccucaccaacaccgucgaggagcucgaggagucccgccagaagugcccccccugcugguacaaguucuccaacaucuuccucaucugggacugcucccccuacuggcucaaggucaagcacgucgucaaccucgucgucauggaccccuucgucgaccucgccaucaccaucugcaucguccucaacacccucuucauggccauggagcacuaccccaugaccgaccacuucaacaacguccucaccgucggcaaccucgucuucaccggcaucuucaccgccgagauguuccucaagaucaucgccauggaccccuacuacuacuuccaggagggcuggaacaucuucgacggcuucaucgucacccucucccucgucgagcucggccucgccaacgucgagggccucuccguccuccgcuccuuccgccuccuccgcgucuucaagcucgccaaguccuggcccacccucaacaugcucaucaagaucaucggcaacuccgucggcgcccucggcaaccucacccucguccucgccaucaucgucuucaucuucgccgucgucggcaugcagcucuucggcaaguccuacaaggacugcgucugcaagaucgccuccgacugccagcucccccgcuggcacaugaacgacuucuuccacuccuuccucaucgucuuccgcguccucugcggcgaguggaucgagaccaugugggacugcauggaggucgccggccaggccaugugccucaccgucuucaugauggucauggucaucggcaaccucgucguccucaaccucuuccucgcccuccuccucuccuccuucuccgccgacaaccucgccgccaccgacgacgacaacgagaugaacaaccuccagaucgccgucgaccgcaugcacaagggcgucgccuacgucaagcgcaagaucuacgaguucauccagcaguccuucauccgcaagcagaagauccucgacgagaucaagccccucgacgaccucaacaacaagaaggacuccugcauguccaaccacaccgccgagaucggcaaggaccucgacuaccucaaggacgucaacggcaccaccuccggcaucggcaccggcuccuccgucgagaaguacaucaucgacgaguccgacuacauguccuucaucaacaaccccucccucaccgucaccguccccaucgccgucggcgaguccgacuucgagaaccucaacaccgaggacuucuccuccgaguccgaccucgaggaguccaaggagaagcucaacgaguccuccuccuccuccgagggcuccaccgucgacaucggcgcccccgucgaggagcagcccgucgucgagcccgaggagacccucgagcccgaggccugcuucaccgagggcugcguccagcgcuucaagugcugccagaucaacgucgaggagggccgcggcaagcagugguggaaccuccgccgcaccugcuuccgcaucgucgagcacaacugguucgagaccuucaucgucuucaugauccuccucuccuccggcgcccucgccuucgaggacaucuacaucgaccagcgcaagaccaucaagaccaugcucgaguacgccgacaaggucuucaccuacaucuucauccucgagaugcuccucaagugggucgccuacggcuaccagaccuacuucaccaacgccuggugcuggcucgacuuccucaucgucgacgucucccucgucucccucaccgccaacgcccucggcuacuccgagcucggcgccaucaagucccuccgcacccuccgcgcccuccgcccccuccgcgcccucucccgcuucgagggcaugcgcgucgucgucaacgcccuccucggcgccauccccuccaucaugaacguccuccucgucugccucaucuucuggcucaucuucuccaucaugggcgucaaccucuucgccggcaaguucuaccacugcaucaacaccaccaccggcgaccgcuucgacaucgaggacgucaacaaccacaccgacugccucaagcucaucgagcgcaacgagaccgcccgcuggaagaacgucaaggucaacuucgacaacgucggcuucggcuaccucucccuccuccaggucgccaccuucaagggcuggauggacaucauguacgccgccgucgacucccgcaacgucgagcuccagcccaaguacgaggagucccucuacauguaccucuacuucgucaucuucaucaucuucggcuccuucuucacccucaaccucuucaucggcgucaucaucgacaacuucaaccagcagaagaagaaguucggcggccaggacaucuucaugaccgaggagcagaagaaguacuacaacgccaugaagaagcucggcuccaagaagccccagaagcccaucccccgccccggcaacaaguuccagggcauggucuucgacuucgucacccgccaggucuucgacaucuccaucaugauccucaucugccucaacauggucaccaugauggucgagaccgacgaccaguccgaguacgucaccaccauccucucccgcaucaaccucgucuucaucguccucuucaccggcgagugcguccucaagcucaucucccuccgccacuacuacuucaccaucggcuggaacaucuucgacuucgucgucgucauccucuccaucgucggcauguuccucgccgagcucaucgagaaguacuucgucucccccacccucuuccgcgucauccgccucgcccgcaucggccgcauccuccgccucaucaagggcgccaagggcauccgcacccuccucuucgcccucaugaugucccuccccgcccucuucaacaucggccuccuccucuuccucgucauguucaucuacgccaucuucggcauguccaacuucgccuacgucaagcgcgaggucggcaucgacgacauguucaacuucgagaccuucggcaacuccaugaucugccucuuccagaucaccaccuccgccggcugggacggccuccucgcccccauccucaacuccaagccccccgacugcgaccccaacaaggucaaccccggcuccuccgucaagggcgacugcggcaaccccuccgucggcaucuucuucuucgucuccuacaucaucaucuccuuccucgucgucgucaacauguacaucgccgucauccucgagaacuucuccgucgccaccgaggaguccgccgagccccucuccgaggacgacuucgagauguucuacgaggucugggagaaguucgaccccgacgccacccaguucauggaguucgagaagcucucccaguucgccgccgcccucgagcccccccucaaccucccccagcccaacaagcuccagcucaucgccauggaccuccccauggucuccggcgaccgcauccacugccucgacauccucuucgccuucaccaagcgcguccucggcgaguccggcgagauggacgcccuccgcauccagauggaggagcgcuucauggccuccaaccccuccaaggucuccuaccagcccaucaccaccacccucaagcgcaagcaggaggaggucuccgccgucaucauccagcgcgccuaccgccgccaccuccucaagcgcaccgucaagcaggccuccuucaccuacaacaagaacaagaucaagggcggcgccaaccuccucaucaaggaggacaugaucaucgaccgcaucaacgagaacuccaucaccgagaagaccgaccucaccauguccaccgccgccugcccccccuccuacgaccgcgucaccaagcccaucgucgagaagcacgagcaggagggcaaggacgagaaggccaagggcaaguga

SEQ ID NO: 49167 - RNA, 657 nt, Artificial Sequence
  derived and/or modified sequence opt2 from SCN1B__Homo_sapiens__NP_001028
augggccgccuccucgcccucgucgucggcgccgcccucgucuccuccgccugcggcggcugcgucgaggucgacuccgagaccgaggccgucuacggcaugaccuucaagauccucugcaucuccugcaagcgccgcuccgagaccaacgccgagaccuucaccgaguggaccuuccgccagaagggcaccgaggaguucgucaagauccuccgcuacgagaacgagguccuccagcucgaggaggacgagcgcuucgagggccgcgucgucuggaacggcucccgcggcaccaaggaccuccaggaccucuccaucuucaucaccaacgucaccuacaaccacuccggcgacuacgagugccacgucuaccgccuccucuucuucgagaacuacgagcacaacaccuccgucgucaagaagauccacaucgaggucgucgacaaggccaaccgcgacauggccuccaucgucuccgagaucaugauguacguccucaucgucguccucaccaucuggcucgucgccgagaugaucuacugcuacaagaagaucgccgccgccaccgagaccgccgcccaggagaacgccuccgaguaccucgccaucaccuccgaguccaaggagaacugcaccggcguccaggucgccgaguga

SEQ ID NO: 49168 - RNA, 6018 nt, Artificial Sequence
  derived and/or modified sequence opt2 from SCN2A__Homo_sapiens__XP_005246807
auggcccaguccguccucgucccccccggccccgacuccuuccgcuucuucacccgcgagucccucgccgccaucgagcagcgcaucgccgaggagaaggccaagcgccccaagcaggagcgcaaggacgaggacgacgagaacggccccaagcccaacuccgaccucgaggccggcaagucccuccccuucaucuacggcgacaucccccccgagauggucuccgucccccucgaggaccucgaccccuacuacaucaacaagaagaccuucaucguccucaacaagggcaaggccaucucccgcuucuccgccacccccgcccucuacauccucacccccuucaaccccauccgcaagcucgccaucaagauccucguccacucccucuucaacaugcucaucaugugcaccauccucaccaacugcgucuucaugaccauguccaacccccccgacuggaccaagaacgucgaguacaccuucaccggcaucuacaccuucgagucccucaucaagauccucgcccgcggcuucugccucgaggacuucaccuuccuccgcgaccccuggaacuggcucgacuucaccgucaucaccuucgccuacgucaccgaguucgucgaccucggcaacgucuccgcccuccgcaccuuccgcguccuccgcgcccucaagaccaucuccgucauccccggccucaagaccaucgucggcgcccucauccaguccgucaagaagcucuccgacgucaugauccucaccgucuucugccucuccgucuucgcccucaucggccuccagcucuucaugggcaaccuccgcaacaagugccuccaguggccccccgacaacuccuccuucgagaucaacaucaccuccuucuucaacaacucccucgacggcaacggcaccaccuucaaccgcaccgucuccaucuucaacugggacgaguacaucgaggacaagucccacuucuacuuccucgagggccagaacgacgcccuccucugcggcaacuccuccgacgccggccagugccccgagggcuacaucugcgucaaggccggccgcaaccccaacuacggcuacaccuccuucgacaccuucuccugggccuuccucucccucuuccgccucaugacccaggacuucugggagaaccucuaccagcucacccuccgcgccgccggcaagaccuacaugaucuucuucguccucgucaucuuccucggcuccuucuaccucaucaaccucauccucgccgucgucgccauggccuacgaggagcagaaccaggccacccucgaggaggccgagcagaaggaggccgaguuccagcagaugcucgagcagcucaagaagcagcaggaggaggcccaggccgccgccgccgccgccuccgccgagucccgcgacuucuccggcgccggcggcaucggcgucuucuccgaguccuccuccgucgccuccaagcucuccuccaaguccgagaaggagcucaagaaccgccgcaagaagaagaagcagaaggagcaguccggcgaggaggagaagaacgaccgcguccgcaaguccgaguccgaggacuccauccgccgcaagggcuuccgcuucucccucgagggcucccgccucaccuacgagaagcgcuucuccuccccccaccagucccuccucuccauccgcggcucccucuucuccccccgccgcaacucccgcgccucccucuucuccuuccgcggccgcgccaaggacaucggcuccgagaacgacuucgccgacgacgagcacuccaccuucgaggacaacgacucccgccgcgacucccucuucgucccccaccgccacggcgagcgccgccacuccaacgucucccaggccucccgcgccucccgcguccuccccauccuccccaugaacggcaagaugcacuccgccgucgacugcaacggcgucgucucccucgucggcggccccuccacccucaccuccgccggccagcuccuccccgagggcaccaccaccgagaccgagauccgcaagcgccgcuccuccuccuaccacgucuccauggaccuccucgaggaccccaccucccgccagcgcgccauguccaucgccuccauccucaccaacaccauggaggagcucgaggagucccgccagaagugcccccccugcugguacaaguucgccaacaugugccucaucugggacugcugcaagcccuggcucaaggucaagcaccucgucaaccucgucgucauggaccccuucgucgaccucgccaucaccaucugcaucguccucaacacccucuucauggccauggagcacuaccccaugaccgagcaguucuccuccguccucuccgucggcaaccucgucuucaccggcaucuucaccgccgagauguuccucaagaucaucgccauggaccccuacuacuacuuccaggagggcuggaacaucuucgacggcuucaucgucucccucucccucauggagcucggccucgccaacgucgagggccucuccguccuccgcuccuuccgccuccuccgcgucuucaagcucgccaaguccuggcccacccucaacaugcucaucaagaucaucggcaacuccgucggcgcccucggcaaccucacccucguccucgccaucaucgucuucaucuucgccgucgucggcaugcagcucuucggcaaguccuacaaggagugcgucugcaagaucuccaacgacugcgagcucccccgcuggcacaugcacgacuucuuccacuccuuccucaucgucuuccgcguccucugcggcgaguggaucgagaccaugugggacugcauggaggucgccggccagaccaugugccucaccgucuucaugauggucauggucaucggcaaccucgucguccucaaccucuuccucgcccuccuccucuccuccuucuccuccgacaaccucgccgccaccgacgacgacaacgagaugaacaaccuccagaucgccgucggccgcaugcagaagggcaucgacuucgucaagcgcaagauccgcgaguucauccagaaggccuucguccgcaagcagaaggcccucgacgagaucaagccccucgaggaccucaacaacaagaaggacuccugcaucuccaaccacaccaccaucgagaucggcaaggaccucaacuaccucaaggacggcaacggcaccaccuccggcaucggcuccuccgucgagaaguacgucgucgacgaguccgacuacauguccuucaucaacaaccccucccucaccgucaccguccccaucgccgucggcgaguccgacuucgagaaccucaacaccgaggaguucuccuccgaguccgacauggaggaguccaaggagaagcucaacgccaccuccuccuccgagggcuccaccgucgacaucggcgcccccgccgagggcgagcagcccgaggucgagcccgaggagucccucgagcccgaggccugcuucaccgaggacugcguccgcaaguucaagugcugccagaucuccaucgaggagggcaagggcaagcucugguggaaccuccgcaagaccugcuacaagaucgucgagcacaacugguucgagaccuucaucgucuucaugauccuccucuccuccggcgcccucgccuucgaggacaucuacaucgagcagcgcaagaccaucaagaccaugcucgaguacgccgacaaggucuucaccuacaucuucauccucgagaugcuccucaagugggucgccuacggcuuccaggucuacuucaccaacgccuggugcuggcucgacuuccucaucgucgacgucucccucgucucccucaccgccaacgcccucggcuacuccgagcucggcgccaucaagucccuccgcacccuccgcgcccuccgcccccuccgcgcccucucccgcuucgagggcaugcgcgucgucgucaacgcccuccucggcgccauccccuccaucaugaacguccuccucgucugccucaucuucuggcucaucuucuccaucaugggcgucaaccucuucgccggcaaguucuaccacugcaucaacuacaccaccggcgagauguucgacgucuccgucgucaacaacuacuccgagugcaaggcccucaucgaguccaaccagaccgcccgcuggaagaacgucaaggucaacuucgacaacgucggccucggcuaccucucccuccuccaggucgccaccuucaagggcuggauggacaucauguacgccgccgucgacucccgcaacgucgagcuccagcccaaguacgaggacaaccucuacauguaccucuacuucgucaucuucaucaucuucggcuccuucuucacccucaaccucuucaucggcgucaucaucgacaacuucaaccagcagaagaagaaguucggcggccaggacaucuucaugaccgaggagcagaagaaguacuacaacgccaugaagaagcucggcuccaagaagccccagaagcccaucccccgccccgccaacaaguuccagggcauggucuucgacuucgucaccaagcaggucuucgacaucuccaucaugauccucaucugccucaacauggucaccaugauggucgagaccgacgaccagucccaggagaugaccaacauccucuacuggaucaaccucgucuucaucguccucuucaccggcgagugcguccucaagcucaucucccuccgcuacuacuacuucaccaucggcuggaacaucuucgacuucgucgucgucauccucuccaucgucggcauguuccucgccgagcucaucgagaaguacuucgucucccccacccucuuccgcgucauccgccucgcccgcaucggccgcauccuccgccucaucaagggcgccaagggcauccgcacccuccucuucgcccucaugaugucccuccccgcccucuucaacaucggccuccuccucuuccucgucauguucaucuacgccaucuucggcauguccaacuucgccuacgucaagcgcgaggucggcaucgacgacauguucaacuucgagaccuucggcaacuccaugaucugccucuuccagaucaccaccuccgccggcugggacggccuccucgcccccauccucaacuccggcccccccgacugcgaccccgacaaggaccaccccggcuccuccgucaagggcgacugcggcaaccccuccgucggcaucuucuucuucgucuccuacaucaucaucuccuuccucgucgucgucaacauguacaucgccgucauccucgagaacuucuccgucgccaccgaggaguccgccgagccccucuccgaggacgacuucgagauguucuacgaggucugggagaaguucgaccccgacgccacccaguucaucgaguucgccaagcucuccgacuucgccgacgcccucgaccccccccuccucaucgccaagcccaacaagguccagcucaucgccauggaccuccccauggucuccggcgaccgcauccacugccucgacauccucuucgccuucaccaagcgcguccucggcgaguccggcgagauggacgcccuccgcauccagauggaggagcgcuucauggccuccaaccccuccaaggucuccuacgagcccaucaccaccacccucaagcgcaagcaggaggaggucuccgccaucaucauccagcgcgccuaccgccgcuaccuccucaagcagaaggucaagaaggucuccuccaucuacaagaaggacaagggcaaggagugcgacggcacccccaucaaggaggacacccucaucgacaagcucaacgagaacuccacccccgagaagaccgacaugacccccuccaccaccuccccccccuccuacgacuccgucaccaagcccgagaaggagaaguucgagaaggacaaguccgagaaggaggacaagggcaaggacauccgcgaguccaagaaguga

SEQ ID NO: 49169 - RNA, 648 nt, Artificial Sequence
  derived and/or modified sequence opt2 from SCN2B__Homo_sapiens__NP_004579
augcaccgcgacgccuggcucccccgccccgccuucucccucaccggccucucccucuucuucucccucgucccccccggccgcuccauggaggucaccguccccgccacccucaacguccucaacggcuccgacgcccgccuccccugcaccuucaacuccugcuacaccgucaaccacaagcaguucucccucaacuggaccuaccaggagugcaacaacugcuccgaggagauguuccuccaguuccgcaugaagaucaucaaccucaagcucgagcgcuuccaggaccgcgucgaguucuccggcaaccccuccaaguacgacgucuccgucaugcuccgcaacguccagcccgaggacgagggcaucuacaacugcuacaucaugaacccccccgaccgccaccgcggccacggcaagauccaccuccagguccucauggaggagccccccgagcgcgacuccaccgucgccgucaucgucggcgccuccgucggcggcuuccucgccgucgucauccucguccucauggucgucaagugcguccgccgcaagaaggagcagaagcucuccaccgacgaccucaagaccgaggaggagggcaagaccgacggcgagggcaaccccgacgacggcgccaaguga

SEQ ID NO: 49170 - RNA, 5856 nt, Artificial Sequence
  derived and/or modified sequence opt2 from SCN3A__Homo_sapiens__NP_001075145
auggcccaggcccuccucgucccccccggccccgaguccuuccgccucuucacccgcgagucccucgccgccaucgagaagcgcgccgccgaggagaaggccaagaagcccaagaaggagcaggacaacgacgacgagaacaagcccaagcccaacuccgaccucgaggccggcaagaaccuccccuucaucuacggcgacaucccccccgagauggucuccgagccccucgaggaccucgaccccuacuacaucaacaagaagaccuucaucgucaugaacaagggcaaggccaucuuccgcuucuccgccaccuccgcccucuacauccucaccccccucaaccccguccgcaagaucgccaucaagauccucguccacucccucuucuccaugcucaucaugugcaccauccucaccaacugcgucuucaugacccucuccaacccccccgacuggaccaagaacgucgaguacaccuucaccggcaucuacaccuucgagucccucaucaagauccucgcccgcggcuucugccucgaggacuucaccuuccuccgcgaccccuggaacuggcucgacuucuccgucaucgucauggccuacgucaccgaguucgucgaccucggcaacgucuccgcccuccgcaccuuccgcguccuccgcgcccucaagaccaucuccgucauccccggccucaagaccaucgucggcgcccucauccaguccgucaagaagcucuccgacgucaugauccucaccgucuucugccucuccgucuucgcccucaucggccuccagcucuucaugggcaaccuccgcaacaagugccuccaguggccccccuccgacuccgccuucgagaccaacaccaccuccuacuucaacggcaccauggacuccaacggcaccuucgucaacgucaccauguccaccuucaacuggaaggacuacaucggcgacgacucccacuucuacguccucgacggccagaaggacccccuccucugcggcaacggcuccgacgccggccagugccccgagggcuacaucugcgucaaggccggccgcaaccccaacuacggcuacaccuccuucgacaccuucuccugggccuuccucucccucuuccgccucaugacccaggacuacugggagaaccucuaccagcucacccuccgcgccgccggcaagaccuacaugaucuucuucguccucgucaucuuccucggcuccuucuaccucgucaaccucauccucgccgucgucgccauggccuacgaggagcagaaccaggccacccucgaggaggccgagcagaaggaggccgaguuccagcagaugcucgagcagcucaagaagcagcaggaggaggcccaggccgucgccgccgccuccgccgccucccgcgacuucuccggcaucggcggccucggcgagcuccucgaguccuccuccgaggccuccaagcucuccuccaaguccgccaaggaguggcgcaaccgccgcaagaagcgccgccagcgcgagcaccucgagggcaacaacaagggcgagcgcgacuccuuccccaaguccgaguccgaggacuccgucaagcgcuccuccuuccucuucuccauggacggcaaccgccucaccuccgacaagaaguucugcuccccccaccagucccuccucuccauccgcggcucccucuucuccccccgccgcaacuccaagaccuccaucuucuccuuccgcggccgcgccaaggacgucggcuccgagaacgacuucgccgacgacgagcacuccaccuucgaggacuccgagucccgccgcgacucccucuucgucccccaccgccacggcgagcgccgcaacuccaacggcaccaccaccgagaccgagguccgcaagcgccgccucuccuccuaccagaucuccauggagaugcucgaggacuccuccggccgccagcgcgccgucuccaucgccuccauccucaccaacaccauggaggagcucgaggagucccgccagaagugcccccccugcugguaccgcuucgccaacgucuuccucaucugggacugcugcgacgccuggcucaaggucaagcaccucgucaaccucaucgucauggaccccuucgucgaccucgccaucaccaucugcaucguccucaacacccucuucauggccauggagcacuaccccaugaccgagcaguucuccuccguccucaccgucggcaaccucgucuucaccggcaucuucaccgccgagaugguccucaagaucaucgccauggaccccuacuacuacuuccaggagggcuggaacaucuucgacggcaucaucgucucccucucccucauggagcucggccucuccaacgucgagggccucuccguccuccgcuccuuccgccuccuccgcgucuucaagcucgccaaguccuggcccacccucaacaugcucaucaagaucaucggcaacuccgucggcgcccucggcaaccucacccucguccucgccaucaucgucuucaucuucgccgucgucggcaugcagcucuucggcaaguccuacaaggagugcgucugcaagaucaacgacgacugcacccucccccgcuggcacaugaacgacuucuuccacuccuuccucaucgucuuccgcguccucugcggcgaguggaucgagaccaugugggacugcauggaggucgccggccagaccaugugccucaucgucuucaugcucgucauggucaucggcaaccucgucguccucaaccucuuccucgcccuccuccucuccuccuucuccuccgacaaccucgccgccaccgacgacgacaacgagaugaacaaccuccagaucgccgucggccgcaugcagaagggcaucgacuacgucaagaacaagaugcgcgagugcuuccagaaggccuucuuccgcaagcccaaggucaucgagauccacgagggcaacaagaucgacuccugcauguccaacaacaccggcaucgagaucuccaaggagcucaacuaccuccgcgacggcaacggcaccaccuccggcgucggcaccggcuccuccgucgagaaguacgucaucgacgagaacgacuacauguccuucaucaacaaccccucccucaccgucaccguccccaucgccgucggcgaguccgacuucgagaaccucaacaccgaggaguucuccuccgaguccgagcucgaggaguccaaggagaagcucaacgccaccuccuccuccgagggcuccaccgucgacgucguccucccccgcgagggcgagcaggccgagaccgagcccgaggaggaccucaagcccgaggccugcuucaccgagggcugcaucaagaaguuccccuucugccaggucuccaccgaggagggcaagggcaagaucugguggaaccuccgcaagaccugcuacuccaucgucgagcacaacugguucgagaccuucaucgucuucaugauccuccucuccuccggcgcccucgccuucgaggacaucuacaucgagcagcgcaagaccaucaagaccaugcucgaguacgccgacaaggucuucaccuacaucuucauccucgagaugcuccucaagugggucgccuacggcuuccagaccuacuucaccaacgccuggugcuggcucgacuuccucaucgucgacgucucccucgucucccucgucgccaacgcccucggcuacuccgagcucggcgccaucaagucccuccgcacccuccgcgcccuccgcccccuccgcgcccucucccgcuucgagggcaugcgcgucgucgucaacgcccucgucggcgccauccccuccaucaugaacguccuccucgucugccucaucuucuggcucaucuucuccaucaugggcgucaaccucuucgccggcaaguucuaccacugcgucaacaugaccaccggcaacauguucgacaucuccgacgucaacaaccucuccgacugccaggcccucggcaagcaggcccgcuggaagaacgucaaggucaacuucgacaacgucggcgccggcuaccucgcccuccuccaggucgccaccuucaagggcuggauggacaucauguacgccgccgucgacucccgcgacgucaagcuccagcccgucuacgaggagaaccucuacauguaccucuacuucgucaucuucaucaucuucggcuccuucuucacccucaaccucuucaucggcgucaucaucgacaacuucaaccagcagaagaagaaguucggcggccaggacaucuucaugaccgaggagcagaagaaguacuacaacgccaugaagaagcucggcuccaagaagccccagaagcccaucccccgccccgccaacaaguuccagggcauggucuucgacuucgucacccgccaggucuucgacaucuccaucaugauccucaucugccucaacauggucaccaugauggucgagaccgacgaccagggcaaguacaugacccucguccucucccgcaucaaccucgucuucaucguccucuucaccggcgaguucguccucaagcucgucucccuccgccacuacuacuucaccaucggcuggaacaucuucgacuucgucgucgucauccucuccaucgucggcauguuccucgccgagaugaucgagaaguacuucgucucccccacccucuuccgcgucauccgccucgcccgcaucggccgcauccuccgccucaucaagggcgccaagggcauccgcacccuccucuucgcccucaugaugucccuccccgcccucuucaacaucggccuccuccucuuccucgucauguucaucuacgccaucuucggcauguccaacuucgccuacgucaagaaggaggccggcaucgacgacauguucaacuucgagaccuucggcaacuccaugaucugccucuuccagaucaccaccuccgccggcugggacggccuccucgcccccauccucaacuccgccccccccgacugcgaccccgacaccauccaccccggcuccuccgucaagggcgacugcggcaaccccuccgucggcaucuucuucuucgucuccuacaucaucaucuccuuccucgucgucgucaacauguacaucgccgucauccucgagaacuucuccgucgccaccgaggaguccgccgagccccucuccgaggacgacuucgagauguucuacgaggucugggagaaguucgaccccgacgccacccaguucaucgaguucuccaagcucuccgacuucgccgccgcccucgaccccccccuccucaucgccaagcccaacaagguccagcucaucgccauggaccuccccauggucuccggcgaccgcauccacugccucgacauccucuucgccuucaccaagcgcguccucggcgaguccggcgagauggacgcccuccgcauccagauggaggaccgcuucauggccuccaaccccuccaaggucuccuacgagcccaucaccaccacccucaagcgcaagcaggaggaggucuccgccgccaucauccagcgcaacuuccgcugcuaccuccucaagcagcgccucaagaacaucuccuccaacuacaacaaggaggccaucaagggccgcaucgaccuccccaucaagcaggacaugaucaucgacaagcucaacggcaacuccacccccgagaagaccgacggcuccuccuccaccaccuccccccccuccuacgacuccgucaccaagcccgacaaggagaaguucgagaaggacaagcccgagaaggaguccaagggcaaggagguccgcgagaaccagaaguga

SEQ ID NO: 49171 - RNA, 648 nt, Artificial Sequence
  derived and/or modified sequence opt2 from SCN3B__Homo_sapiens__XP_011541199
augcccgccuucaaccgccucuucccccucgccucccucguccucaucuacugggucuccgucugcuuccccgucugcgucgagguccccuccgagaccgaggccguccagggcaaccccaugaagcuccgcugcaucuccugcaugaagcgcgaggaggucgaggccaccaccgucgucgagugguucuaccgccccgagggcggcaaggacuuccucaucuacgaguaccgcaacggccaccaggaggucgagucccccuuccagggccgccuccaguggaacggcuccaaggaccuccaggacgucuccaucaccguccucaacgucacccucaacgacuccggccucuacaccugcaacgucucccgcgaguucgaguucgaggcccaccgccccuucgucaagaccacccgccucaucccccuccgcgucaccgaggaggccggcgaggacuucaccuccgucgucuccgagaucaugauguacauccuccucgucuuccucacccucuggcuccucaucgagaugaucuacugcuaccgcaaggucuccaaggccgaggaggccgcccaggagaacgccuccgacuaccucgccauccccuccgagaacaaggagaacuccgccguccccgucgaggaguga

SEQ ID NO: 49172 - RNA, 5511 nt, Artificial Sequence
  derived and/or modified sequence opt2 from SCN4A__Homo_sapiens__NP_000325
auggcccgccccucccucugcacccucgucccccucggccccgagugccuccgccccuucacccgcgagucccucgccgccaucgagcagcgcgccgucgaggaggaggcccgccuccagcgcaacaagcagauggagaucgaggagcccgagcgcaagccccgcuccgaccucgaggccggcaagaaccuccccaugaucuacggcgaccccccccccgaggucaucggcaucccccucgaggaccucgaccccuacuacuccaacaagaagaccuucaucguccucaacaagggcaaggccaucuuccgcuucuccgccacccccgcccucuaccuccucucccccuucuccgucguccgccgcggcgccaucaagguccucauccacgcccucuucuccauguucaucaugaucaccauccucaccaacugcgucuucaugaccauguccgaccccccccccugguccaagaacgucgaguacaccuucaccggcaucuacaccuucgagucccucaucaagauccucgcccgcggcuucugcgucgacgacuucaccuuccuccgcgaccccuggaacuggcucgacuucuccgucaucaugauggccuaccucaccgaguucgucgaccucggcaacaucuccgcccuccgcaccuuccgcguccuccgcgcccucaagaccaucaccgucauccccggccucaagaccaucgucggcgcccucauccaguccgucaagaagcucuccgacgucaugauccucaccgucuucugccucuccgucuucgcccucgucggccuccagcucuucaugggcaaccuccgccagaagugcguccgcuggcccccccccuucaacgacaccaacaccaccugguacuccaacgacaccugguacggcaacgacaccugguacggcaacgagaugugguacggcaacgacuccugguacgccaacgacaccuggaacucccacgccuccugggccaccaacgacaccuucgacugggacgccuacaucuccgacgagggcaacuucuacuuccucgagggcuccaacgacgcccuccucugcggcaacuccuccgacgccggccacugccccgagggcuacgagugcaucaagaccggccgcaaccccaacuacggcuacaccuccuacgacaccuucuccugggccuuccucgcccucuuccgccucaugacccaggacuacugggagaaccucuuccagcucacccuccgcgccgccggcaagaccuacaugaucuucuucgucgucaucaucuuccucggcuccuucuaccucaucaaccucauccucgccgucgucgccauggccuacgccgagcagaacgaggccacccucgccgaggacaaggagaaggaggaggaguuccagcagaugcucgagaaguucaagaagcaccaggaggagcucgagaaggccaaggccgcccaggcccucgagggcggcgaggccgacggcgaccccgcccacggcaaggacugcaacggcucccucgacaccucccagggcgagaagggcgccccccgccaguccuccuccggcgacuccggcaucuccgacgccauggaggagcucgaggaggcccaccagaagugcccccccuggugguacaagugcgcccacaagguccucaucuggaacugcugcgcccccuggcucaaguucaagaacaucauccaccucaucgucauggaccccuucgucgaccucggcaucaccaucugcaucguccucaacacccucuucauggccauggagcacuaccccaugaccgagcacuucgacaacguccucaccgucggcaaccucgucuucaccggcaucuucaccgccgagaugguccucaagcucaucgccauggaccccuacgaguacuuccagcagggcuggaacaucuucgacuccaucaucgucacccucucccucgucgagcucggccucgccaacguccagggccucuccguccuccgcuccuuccgccuccuccgcgucuucaagcucgccaaguccuggcccacccucaacaugcucaucaagaucaucggcaacuccgucggcgcccucggcaaccucacccucguccucgccaucaucgucuucaucuucgccgucgucggcaugcagcucuucggcaaguccuacaaggagugcgucugcaagaucgcccucgacugcaaccucccccgcuggcacaugcacgacuucuuccacuccuuccucaucgucuuccgcauccucugcggcgaguggaucgagaccaugugggacugcauggaggucgccggccaggccaugugccucaccgucuuccucauggucauggucaucggcaaccucgucguccucaaccucuuccucgcccuccuccucuccuccuucuccgccgacucccucgccgccuccgacgaggacggcgagaugaacaaccuccagaucgccaucggccgcaucaagcucggcaucggcuucgccaaggccuuccuccucggccuccuccacggcaagauccucucccccaaggacaucaugcucucccucggcgaggccgacggcgccggcgaggccggcgaggccggcgagaccgcccccgaggacgagaagaaggagccccccgaggaggaccucaagaaggacaaccacauccucaaccacaugggccucgccgacggcccccccuccucccucgagcucgaccaccucaacuucaucaacaaccccuaccucaccauccagguccccaucgccuccgaggaguccgaccucgagaugcccaccgaggaggagaccgacaccuucuccgagcccgaggacuccaagaagcccccccagccccucuacgacggcaacuccuccgucugcuccaccgccgacuacaagccccccgaggaggaccccgaggagcaggccgaggagaaccccgagggcgagcagcccgaggagugcuucaccgaggccugcguccagcgcuggcccugccucuacgucgacaucucccagggccgcggcaagaagugguggacccuccgccgcgccugcuucaagaucgucgagcacaacugguucgagaccuucaucgucuucaugauccuccucuccuccggcgcccucgccuucgaggacaucuacaucgagcagcgccgcgucauccgcaccauccucgaguacgccgacaaggucuucaccuacaucuucaucauggagaugcuccucaagugggucgccuacggcuucaaggucuacuucaccaacgccuggugcuggcucgacuuccucaucgucgacgucuccaucaucucccucgucgccaacuggcucggcuacuccgagcucggccccaucaagucccuccgcacccuccgcgcccuccgcccccuccgcgcccucucccgcuucgagggcaugcgcgucgucgucaacgcccuccucggcgccauccccuccaucaugaacguccuccucgucugccucaucuucuggcucaucuucuccaucaugggcgucaaccucuucgccggcaaguucuacuacugcaucaacaccaccaccuccgagcgcuucgacaucuccgaggucaacaacaaguccgagugcgagucccucaugcacaccggccagguccgcuggcucaacgucaaggucaacuacgacaacgucggccucggcuaccucucccuccuccaggucgccaccuucaagggcuggauggacaucauguacgccgccgucgacucccgcgagaaggaggagcagccccaguacgaggucaaccucuacauguaccucuacuucgucaucuucaucaucuucggcuccuucuucacccucaaccucuucaucggcgucaucaucgacaacuucaaccagcagaagaagaagcucggcggcaaggacaucuucaugaccgaggagcagaagaaguacuacaacgccaugaagaagcucggcuccaagaagccccagaagcccaucccccgcccccagaacaagauccagggcauggucuacgaccucgucaccaagcaggccuucgacaucaccaucaugauccucaucugccucaacauggucaccaugauggucgagaccgacaaccagucccagcucaaggucgacauccucuacaacaucaacaugaucuucaucaucaucuucaccggcgagugcguccucaagaugcucgcccuccgccaguacuacuucaccgucggcuggaacaucuucgacuucgucgucgucauccucuccaucgucggccucgcccucuccgaccucauccagaaguacuucgucucccccacccucuuccgcgucauccgccucgcccgcaucggccgcguccuccgccucauccgcggcgccaagggcauccgcacccuccucuucgcccucaugaugucccuccccgcccucuucaacaucggccuccuccucuuccucgucauguucaucuacuccaucuucggcauguccaacuucgccuacgucaagaaggaguccggcaucgacgacauguucaacuucgagaccuucggcaacuccaucaucugccucuucgagaucaccaccuccgccggcugggacggccuccucaaccccauccucaacuccggcccccccgacugcgaccccaaccucgagaaccccggcaccuccgucaagggcgacugcggcaaccccuccaucggcaucugcuucuucugcuccuacaucaucaucuccuuccucaucgucgucaacauguacaucgccaucauccucgagaacuucaacgucgccaccgaggaguccuccgagccccucggcgaggacgacuucgagauguucuacgagaccugggagaaguucgaccccgacgccacccaguucaucgccuacucccgccucuccgacuucgucgacacccuccaggagccccuccgcaucgccaagcccaacaagaucaagcucaucacccucgaccuccccaugguccccggcgacaagauccacugccucgacauccucuucgcccucaccaaggagguccucggcgacuccggcgagauggacgcccucaagcagaccauggaggagaaguucauggccgccaaccccuccaaggucuccuacgagcccaucaccaccacccucaagcgcaagcacgaggaggucugcgccaucaagauccagcgcgccuaccgccgccaccuccuccagcgcuccaugaagcaggccuccuacauguaccgccacucccacgacggcuccggcgacgacgcccccgagaaggagggccuccucgccaacaccauguccaagauguacggccacgagaacggcaacuccuccucccccucccccgaggagaagggcgaggccggcgacgccggccccaccaugggccucaugcccaucucccccuccgacaccgccuggccccccgcccccccccccggccagaccguccgccccggcgucaaggagucccucgucuga

SEQ ID NO: 49173 - RNA, 285 nt, Artificial Sequence
  derived and/or modified sequence opt2 from SCN4B__Homo_sapiens__NP_001135820
augcccggcgccggcgacggcggcaaggcccccgcccgcuggcucggcaccggccuccucgucgaggaggucgacaacaccgucacccucaucauccucgccgucgucggcggcgucaucggccuccucauccucauccuccucaucaagaagcucaucaucuucauccucaagaagacccgcgagaagaagaaggagugccucgucuccuccuccggcaacgacaacaccgagaacggccuccccggcuccaaggccgaggagaagccccccuccaaggucuga

SEQ ID NO: 49174 - RNA, 6048 nt, Artificial Sequence
  derived and/or modified sequence opt2 from SCN5A__Homo_sapiens__NP_000326
auggccaacuuccuccucccccgcggcaccuccuccuuccgccgcuucacccgcgagucccucgccgccaucgagaagcgcauggccgagaagcaggcccgcggcuccaccacccuccaggagucccgcgagggccuccccgaggaggaggccccccgcccccagcucgaccuccaggccuccaagaagcuccccgaccucuacggcaaccccccccaggagcucaucggcgagccccucgaggaccucgaccccuucuacuccacccagaagaccuucaucguccucaacaagggcaagaccaucuuccgcuucuccgccaccaacgcccucuacguccucucccccuuccaccccauccgccgcgccgccgucaagauccucguccacucccucuucaacaugcucaucaugugcaccauccucaccaacugcgucuucauggcccagcacgaccccccccccuggaccaaguacgucgaguacaccuucaccgccaucuacaccuucgagucccucgucaagauccucgcccgcggcuucugccuccacgccuucaccuuccuccgcgaccccuggaacuggcucgacuucuccgucaucaucauggccuacaccaccgaguucgucgaccucggcaacgucuccgcccuccgcaccuuccgcguccuccgcgcccucaagaccaucuccgucaucuccggccucaagaccaucgucggcgcccucauccaguccgucaagaagcucgccgacgucaugguccucaccgucuucugccucuccgucuucgcccucaucggccuccagcucuucaugggcaaccuccgccacaagugcguccgcaacuucaccgcccucaacggcaccaacggcuccgucgaggccgacggccucgucugggagucccucgaccucuaccucuccgaccccgagaacuaccuccucaagaacggcaccuccgacguccuccucugcggcaacuccuccgacgccggcaccugccccgagggcuaccgcugccucaaggccggcgagaaccccgaccacggcuacaccuccuucgacuccuucgccugggccuuccucgcccucuuccgccucaugacccaggacugcugggagcgccucuaccagcagacccuccgcuccgccggcaagaucuacaugaucuucuucaugcucgucaucuuccucggcuccuucuaccucgucaaccucauccucgccgucgucgccauggccuacgaggagcagaaccaggccaccaucgccgagaccgaggagaaggagaagcgcuuccaggaggccauggagaugcucaagaaggagcacgaggcccucaccauccgcggcgucgacaccgucucccgcuccucccucgagauguccccccucgcccccgucaacucccacgagcgccgcuccaagcgccgcaagcgcauguccuccggcaccgaggagugcggcgaggaccgccuccccaaguccgacuccgaggacggcccccgcgccaugaaccaccucucccucacccgcggccucucccgcaccuccaugaagccccgcuccucccgcggcuccaucuucaccuuccgccgccgcgaccucggcuccgaggccgacuucgccgacgacgagaacuccaccgccggcgaguccgagucccaccacaccucccuccucguccccuggccccuccgccgcaccuccgcccagggccagcccucccccggcaccuccgcccccggccacgcccuccacggcaagaagaacuccaccgucgacugcaacggcgucgucucccuccucggcgccggcgaccccgaggccaccucccccggcucccaccuccuccgccccgucaugcucgagcacccccccgacaccaccacccccuccgaggagcccggcggcccccagaugcucaccucccaggcccccugcgucgacggcuucgaggagcccggcgcccgccagcgcgcccucuccgccgucuccguccucaccuccgcccucgaggagcucgaggagucccgccacaagugcccccccugcuggaaccgccucgcccagcgcuaccucaucugggagugcugcccccucuggauguccaucaagcagggcgucaagcucgucgucauggaccccuucaccgaccucaccaucaccaugugcaucguccucaacacccucuucauggcccucgagcacuacaacaugaccuccgaguucgaggagaugcuccaggucggcaaccucgucuucaccggcaucuucaccgccgagaugaccuucaagaucaucgcccucgaccccuacuacuacuuccagcagggcuggaacaucuucgacuccaucaucgucauccucucccucauggagcucggccucucccgcauguccaaccucuccguccuccgcuccuuccgccuccuccgcgucuucaagcucgccaaguccuggcccacccucaacacccucaucaagaucaucggcaacuccgucggcgcccucggcaaccucacccucguccucgccaucaucgucuucaucuucgccgucgucggcaugcagcucuucggcaagaacuacuccgagcuccgcgacuccgacuccggccuccucccccgcuggcacaugauggacuucuuccacgccuuccucaucaucuuccgcauccucugcggcgaguggaucgagaccaugugggacugcauggaggucuccggccagucccucugccuccucgucuuccuccucgucauggucaucggcaaccucgucguccucaaccucuuccucgcccuccuccucuccuccuucuccgccgacaaccucaccgcccccgacgaggaccgcgagaugaacaaccuccagcucgcccucgcccgcauccagcgcggccuccgcuucgucaagcgcaccaccugggacuucugcugcggccuccuccgccagcgcccccagaagcccgccgcccucgccgcccagggccagcuccccuccugcaucgccacccccuacuccccccccccccccgagaccgagaaggucccccccacccgcaaggagacccgcuucgaggagggcgagcagcccggccagggcacccccggcgaccccgagcccgucugcguccccaucgccgucgccgaguccgacaccgacgaccaggaggaggacgaggagaacucccucggcaccgaggaggaguccuccaagcaggagucccagcccgucuccggcggccccgaggccccccccgacucccgcaccuggucccaggucuccgccaccgccuccuccgaggccgaggccuccgccucccaggccgacuggcgccagcaguggaaggccgagccccaggcccccggcugcggcgagacccccgaggacuccugcuccgagggcuccaccgccgacaugaccaacaccgccgagcuccucgagcagauccccgaccucggccaggacgucaaggaccccgaggacugcuucaccgagggcugcguccgccgcugccccugcugcgccgucgacaccacccaggcccccggcaaggucugguggcgccuccgcaagaccugcuaccacaucgucgagcacuccugguucgagaccuucaucaucuucaugauccuccucuccuccggcgcccucgccuucgaggacaucuaccucgaggagcgcaagaccaucaagguccuccucgaguacgccgacaagauguucaccuacgucuucguccucgagaugcuccucaagugggucgccuacggcuucaagaaguacuucaccaacgccuggugcuggcucgacuuccucaucgucgacgucucccucgucucccucgucgccaacacccucggcuucgccgagaugggccccaucaagucccuccgcacccuccgcgcccuccgcccccuccgcgcccucucccgcuucgagggcaugcgcgucgucgucaacgcccucgucggcgccauccccuccaucaugaacguccuccucgucugccucaucuucuggcucaucuucuccaucaugggcgucaaccucuucgccggcaaguucggccgcugcaucaaccagaccgagggcgaccucccccucaacuacaccaucgucaacaacaagucccagugcgagucccucaaccucaccggcgagcucuacuggaccaaggucaaggucaacuucgacaacgucggcgccggcuaccucgcccuccuccaggucgccaccuucaagggcuggauggacaucauguacgccgccgucgacucccgcggcuacgaggagcagccccagugggaguacaaccucuacauguacaucuacuucgucaucuucaucaucuucggcuccuucuucacccucaaccucuucaucggcgucaucaucgacaacuucaaccagcagaagaagaagcucggcggccaggacaucuucaugaccgaggagcagaagaaguacuacaacgccaugaagaagcucggcuccaagaagccccagaagcccaucccccgcccccucaacaaguaccagggcuucaucuucgacaucgucaccaagcaggccuucgacgucaccaucauguuccucaucugccucaacauggucaccaugauggucgagaccgacgaccagucccccgagaagaucaacauccucgccaagaucaaccuccucuucgucgccaucuucaccggcgagugcaucgucaagcucgccgcccuccgccacuacuacuucaccaacuccuggaacaucuucgacuucgucgucgucauccucuccaucgucggcaccguccucuccgacaucauccagaaguacuucuucucccccacccucuuccgcgucauccgccucgcccgcaucggccgcauccuccgccucauccgcggcgccaagggcauccgcacccuccucuucgcccucaugaugucccuccccgcccucuucaacaucggccuccuccucuuccucgucauguucaucuacuccaucuucggcauggccaacuucgccuacgucaagugggaggccggcaucgacgacauguucaacuuccagaccuucgccaacuccaugcucugccucuuccagaucaccaccuccgccggcugggacggccuccucucccccauccucaacaccggcccccccuacugcgaccccacccuccccaacuccaacggcucccgcggcgacugcggcucccccgccgucggcauccucuucuucaccaccuacaucaucaucuccuuccucaucgucgucaacauguacaucgccaucauccucgagaacuucuccgucgccaccgaggaguccaccgagccccucuccgaggacgacuucgacauguucuacgagaucugggagaaguucgaccccgaggccacccaguucaucgaguacuccguccucuccgacuucgccgacgcccucuccgagccccuccgcaucgccaagcccaaccagaucucccucaucaacauggaccuccccauggucuccggcgaccgcauccacugcauggacauccucuucgccuucaccaagcgcguccucggcgaguccggcgagauggacgcccucaagauccagauggaggagaaguucauggccgccaaccccuccaagaucuccuacgagcccaucaccaccacccuccgccgcaagcacgaggaggucuccgccauggucauccagcgcgccuuccgccgccaccuccuccagcgcucccucaagcacgccuccuuccucuuccgccagcaggccggcuccggccucuccgaggaggacgcccccgagcgcgagggccucaucgccuacgucauguccgagaacuucucccgcccccucggcccccccuccuccuccuccaucuccuccaccuccuucccccccuccuacgacuccgucacccgcgccaccuccgacaaccuccagguccgcggcuccgacuacucccacuccgaggaccucgccgacuucccccccucccccgaccgcgaccgcgaguccaucgucuga

SEQ ID NO: 49175 - RNA, 5049 nt, Artificial Sequence
  derived and/or modified sequence opt2 from SCN7A__Homo_sapiens__NP_002967
augcucgccucccccgagcccaagggccucguccccuucaccaaggaguccuucgagcucaucaagcagcacaucgccaagacccacaacgaggaccacgaggaggaggaccucaagcccacccccgaccucgaggucggcaagaagcuccccuucaucuacggcaaccucucccagggcauggucuccgagccccucgaggacgucgaccccuacuacuacaagaagaagaacaccuucaucguccucaacaagaaccgcaccaucuuccgcuucaacgccgccuccauccucugcacccucucccccuucaacugcauccgccgcaccaccaucaagguccucguccaccccuucuuccagcucuucauccucaucuccguccucaucgacugcgucuucaugucccucaccaaccuccccaaguggcgccccguccucgagaacacccuccucggcaucuacaccuucgagauccucgucaagcucuucgcccgcggcgucugggccggcuccuucuccuuccucggcgaccccuggaacuggcucgacuucuccgucaccgucuucgaggucaucauccgcuacuccccccucgacuucauccccacccuccagaccgcccgcacccuccgcauccucaagaucaucccccucaaccagggccucaagucccucgucggcguccucauccacugccucaagcagcucaucggcgucaucauccucacccucuucuuccucuccaucuucucccucaucggcaugggccucuucaugggcaaccucaagcacaagugcuuccgcuggccccaggagaacgagaacgagacccuccacaaccgcaccggcaaccccuacuacauccgcgagaccgagaacuucuacuaccucgagggcgagcgcuacgcccuccucugcggcaaccgcaccgacgccggccagugccccgagggcuacgucugcgucaaggccggcaucaaccccgaccagggcuucaccaacuucgacuccuucggcugggcccucuucgcccucuuccgccucauggcccaggacuaccccgagguccucuaccaccagauccucuacgccuccggcaaggucuacaugaucuucuucgucgucgucuccuuccucuucuccuucuacauggccucccucuuccucggcauccucgccauggccuacgaggaggagaagcagcgcgucggcgagaucuccaagaagaucgagcccaaguuccagcagaccggcaaggagcuccaggagggcaacgagaccgacgaggccaagaccauccagaucgagaugaagaagcgcucccccaucuccaccgacaccucccucgacguccucgaggacgccacccuccgccacaaggaggagcucgagaaguccaagaagaucugcccccucuacugguacaaguucgccaagaccuuccucaucuggaacugcucccccugcuggcucaagcucaaggaguucguccaccgcaucaucauggcccccuucaccgaccucuuccucaucaucugcaucauccucaacgucugcuuccucacccucgagcacuaccccauguccaagcagaccaacacccuccucaacaucggcaaccucgucuucaucggcaucuucaccgccgagaugaucuucaagaucaucgccaugcaccccuacggcuacuuccaggucggcuggaacaucuucgacuccaugaucgucuuccacggccucaucgagcucugccucgccaacgucgccggcauggcccuccuccgccucuuccgcaugcuccgcaucuucaagcucggcaaguacuggcccaccuuccagauccucauguggucccucuccaacuccugggucgcccucaaggaccucguccuccuccucuucaccuucaucuucuucuccgccgccuucggcaugaagcucuucggcaagaacuacgaggaguucgucugccacaucgacaaggacugccagcucccccgcuggcacaugcacgacuucuuccacuccuuccucaacgucuuccgcauccucugcggcgagugggucgagacccucugggacugcauggaggucgccggccaguccuggugcauccccuucuaccucauggucauccucaucggcaaccuccucguccucuaccucuuccucgcccucgucuccuccuucuccuccugcaaggacgucaccgccgaggagaacaacgaggccaagaaccuccagcucgccgucgcccgcaucaagaagggcaucaacuacguccuccucaagauccucugcaagacccagaacguccccaaggacaccauggaccacgucaacgaggucuacgucaaggaggacaucuccgaccacacccucuccgagcucuccaacacccaggacuuccucaaggacaaggagaaguccuccggcaccgagaagaacgccaccgagaacgagucccagucccucauccccucccccuccgucuccgagaccguccccaucgccuccggcgaguccgacaucgagaaccucgacaacaaggagauccaguccaaguccggcgacggcggcuccaaggagaagaucaagcaguccuccuccuccgagugcuccaccgucgacaucgccaucuccgaggaggaggagauguucuacggcggcgagcgcuccaagcaccucaagaacggcugccgccgcggcuccucccucggccagaucuccggcgccuccaagaagggcaagaucuggcagaacauccgcaagaccugcugcaagaucgucgagaacaacugguucaagugcuucaucggccucgucacccuccucuccaccggcacccucgccuucgaggacaucuacauggaccagcgcaagaccaucaagauccuccucgaguacgccgacaugaucuucaccuacaucuucauccucgagaugcuccucaaguggauggccuacggcuucaaggccuacuucuccaacggcugguaccgccucgacuucgucgucgucaucgucuucugccucucccucaucggcaagacccgcgaggagcucaagccccucaucuccaugaaguuccuccgcccccuccgcguccucucccaguucgagcgcaugaaggucgucguccgcgcccucaucaagaccacccuccccacccucaacgucuuccucgucugccucaugaucuggcucaucuucuccaucaugggcgucgaccucuucgccggccgcuucuacgagugcaucgaccccaccuccggcgagcgcuuccccuccuccgaggucaugaacaagucccgcugcgagucccuccucuucaacgaguccaugcucugggagaacgccaagaugaacuucgacaacgucggcaacggcuuccucucccuccuccaggucgccaccuucaacggcuggaucaccaucaugaacuccgccaucgacuccgucgccgucaacauccagccccacuucgaggucaacaucuacauguacugcuacuucaucaacuucaucaucuucggcgucuuccucccccucuccaugcucaucaccgucaucaucgacaacuucaacaagcacaagaucaagcucggcggcuccaacaucuucaucaccgucaagcagcgcaagcaguaccgccgccucaagaagcucauguacgaggacucccagcgccccgucccccgcccccucaacaagcuccagggcuucaucuucgacgucgucaccucccaggccuucaacgucaucgucaugguccucaucugcuuccaggccaucgccaugaugaucgacaccgacguccagucccuccagauguccaucgcccucuacuggaucaacuccaucuucgucaugcucuacaccauggagugcauccucaagcucaucgccuuccgcugcuucuacuucaccaucgccuggaacaucuucgacuucauggucgucaucuucuccaucaccggccucugccuccccaugaccgucggcuccuaccucgucccccccucccucguccagcucauccuccucucccgcaucauccacaugcuccgccucggcaagggccccaaggucuuccacaaccucaugcucccccucaugcucucccuccccgcccuccucaacaucauccuccucaucuuccucgucauguucaucuacgccgucuucggcauguacaacuucgccuacgucaagaaggaggccggcaucaacgacgucuccaacuucgagaccuucggcaacuccaugcucugccucuuccaggucgccaucuucgccggcugggacggcaugcucgacgccaucuucaacuccaagugguccgacugcgaccccgacaagaucaaccccggcacccagguccgcggcgacugcggcaaccccuccgucggcaucuucuacuucgucuccuacauccucaucuccuggcucaucaucgucaacauguacaucgucgucgucauggaguuccucaacaucgccuccaagaagaagaacaagacccucuccgaggacgacuuccgcaaguucuuccaggucuggaagcgcuucgaccccgaccgcacccaguacaucgacuccuccaagcucuccgacuucgccgccgcccucgaccccccccucuucauggccaagcccaacaagggccagcucaucgcccucgaccuccccauggccgucggcgaccgcauccacugccucgacauccuccucgccuucaccaagcgcgucaugggccaggacguccgcauggagaaggucgucuccgagaucgaguccggcuuccuccucgccaaccccuucaagaucaccugcgagcccaucaccaccacccucaagcgcaagcaggaggccgucuccgccaccaucauccagcgcgccuacaagaacuaccgccuccgccgcaacgacaagaacaccuccgacauccacaugaucgacggcgaccgcgacguccacgccaccaaggagggcgccuacuucgacaaggccaaggagaagucccccauccagucccagaucuga

SEQ ID NO: 49176 - RNA, 5820 nt, Artificial Sequence
  derived and/or modified sequence opt2 from SCN8A__Homo_sapiens__NP_001171455
auggccgcccgccuccucgccccccccggccccgacuccuucaagcccuucacccccgagucccucgccaacaucgagcgccgcaucgccgaguccaagcucaagaagccccccaaggccgacggcucccaccgcgaggacgacgaggacuccaagcccaagcccaacuccgaccucgaggccggcaagucccuccccuucaucuacggcgacaucccccagggccucgucgccgucccccucgaggacuucgaccccuacuaccucacccagaagaccuucgucguccucaaccgcggcaagacccucuuccgcuucuccgccacccccgcccucuacauccucucccccuucaaccucauccgccgcaucgccaucaagauccucauccacuccgucuucuccaugaucaucaugugcaccauccucaccaacugcgucuucaugaccuucuccaacccccccgacugguccaagaacgucgaguacaccuucaccggcaucuacaccuucgagucccucgucaagaucaucgcccgcggcuucugcaucgacggcuucaccuuccuccgcgaccccuggaacuggcucgacuucuccgucaucaugauggccuacaucaccgaguucgucaaccucggcaacgucuccgcccuccgcaccuuccgcguccuccgcgcccucaagaccaucuccgucauccccggccucaagaccaucgucggcgcccucauccaguccgucaagaagcucuccgacgucaugauccucaccgucuucugccucuccgucuucgcccucaucggccuccagcucuucaugggcaaccuccgcaacaagugcgucgucuggcccaucaacuucaacgaguccuaccucgagaacggcaccaagggcuucgacugggaggaguacaucaacaacaagaccaacuucuacaccguccccggcaugcucgagccccuccucugcggcaacuccuccgacgccggccagugccccgagggcuaccagugcaugaaggccggccgcaaccccaacuacggcuacaccuccuucgacaccuucuccugggccuuccucgcccucuuccgccucaugacccaggacuacugggagaaccucuaccagcucacccuccgcgccgccggcaagaccuacaugaucuucuucguccucgucaucuucgucggcuccuucuaccucgucaaccucauccucgccgucgucgccauggccuacgaggagcagaaccaggccacccucgaggaggccgagcagaaggaggccgaguucaaggccaugcucgagcagcucaagaagcagcaggaggaggcccaggccgccgccauggccaccuccgccggcaccgucuccgaggacgccaucgaggaggagggcgaggagggcggcggcuccccccgcuccuccuccgagaucuccaagcucuccuccaaguccgccaaggagcgccgcaaccgccgcaagaagcgcaagcagaaggagcucuccgagggcgaggagaagggcgaccccgagaaggucuucaaguccgaguccgaggacggcaugcgccgcaaggccuuccgccuccccgacaaccgcaucggccgcaaguucuccaucaugaaccagucccuccucuccauccccggcucccccuuccucucccgccacaacuccaaguccuccaucuucuccuuccgcggccccggccgcuuccgcgaccccggcuccgagaacgaguucgccgacgacgagcacuccaccgucgaggaguccgagggccgccgcgacucccucuucauccccauccgcgcccgcgagcgccgcuccuccuacuccggcuacuccggcuacucccagggcucccgcuccucccgcaucuuccccucccuccgccgcuccgucaagcgcaacuccaccgucgacugcaacggcgucgucucccucaucggcggccccggcucccacaucggcggccgccuccuccccgaggccaccaccgaggucgagaucaagaagaagggccccggcucccuccucgucuccauggaccagcucgccuccuacggccgcaaggaccgcaucaacuccaucauguccgucgucaccaacacccucgucgaggagcucgaggagucccagcgcaagugcccccccugcugguacaaguucgccaacaccuuccucaucugggagugccaccccuacuggaucaagcucaaggagaucgucaaccucaucgucauggaccccuucgucgaccucgccaucaccaucugcaucguccucaacacccucuucauggccauggagcaccaccccaugaccccccaguucgagcacguccucgccgucggcaaccucgucuucaccggcaucuucaccgccgagauguuccucaagcucaucgccauggaccccuacuacuacuuccaggagggcuggaacaucuucgacggcuucaucgucucccucucccucauggagcucucccucgccgacgucgagggccucuccguccuccgcuccuuccgccuccuccgcgucuucaagcucgccaaguccuggcccacccucaacaugcucaucaagaucaucggcaacuccgucggcgcccucggcaaccucacccucguccucgccaucaucgucuucaucuucgccgucgucggcaugcagcucuucggcaaguccuacaaggagugcgucugcaagaucaaccaggacugcgagcucccccgcuggcacaugcacgacuucuuccacuccuuccucaucgucuuccgcguccucugcggcgaguggaucgagaccaugugggacugcauggaggucgccggccaggccaugugccucaucgucuucaugauggucauggucaucggcaaccucgucguccucaaccucuuccucgcccuccuccucuccuccuucuccgccgacaaccucgccgccaccgacgacgacggcgagaugaacaaccuccagaucuccgucauccgcaucaagaagggcgucgccuggaccaagcucaagguccacgccuucaugcaggcccacuucaagcagcgcgaggccgacgaggucaagccccucgacgagcucuacgagaagaaggccaacugcaucgccaaccacaccggcgccgacauccaccgcaacggcgacuuccagaagaacggcaacggcaccaccuccggcaucggcuccuccgucgagaaguacaucaucgacgaggaccacauguccuucaucaacaaccccaaccucaccguccgcguccccaucgccgucggcgaguccgacuucgagaaccucaacaccgaggacgucuccuccgaguccgaccccgagggcuccaaggacaagcucgacgacaccuccuccuccgagggcuccaccaucgacaucaagcccgaggucgaggagguccccgucgagcagcccgaggaguaccucgaccccgacgccugcuucaccgagggcugcguccagcgcuucaagugcugccaggucaacaucgaggagggccucggcaaguccugguggauccuccgcaagaccugcuuccucaucgucgagcacaacugguucgagaccuucaucaucuucaugauccuccucuccuccggcgcccucgccuucgaggacaucuacaucgagcagcgcaagaccauccgcaccauccucgaguacgccgacaaggucuucaccuacaucuucauccucgagaugcuccucaaguggaccgccuacggcuucgucaaguucuucaccaacgccuggugcuggcucgacuuccucaucgucgccgucgucgucaacgcccucgucggcgccauccccuccaucaugaacguccuccucgucugccucaucuucuggcucaucuucuccaucaugggcgucaaccucuucgccggcaaguaccacuacugcuucaacgagaccuccgagauccgcuucgagaucgaggacgucaacaacaagaccgagugcgagaagcucauggagggcaacaacaccgagauccgcuggaagaacgucaagaucaacuucgacaacgucggcgccggcuaccucgcccuccuccaggucgccaccuucaagggcuggauggacaucauguacgccgccgucgacucccgcaagcccgacgagcagcccaaguacgaggacaacaucuacauguacaucuacuucgucaucuucaucaucuucggcuccuucuucacccucaaccucuucaucggcgucaucaucgacaacuucaaccagcagaagaagaaguucggcggccaggacaucuucaugaccgaggagcagaagaaguacuacaacgccaugaagaagcucggcuccaagaagccccagaagcccaucccccgcccccucaacaagauccagggcaucgucuucgacuucgucacccagcaggccuucgacaucgucaucaugaugcucaucugccucaacauggucaccaugauggucgagaccgacacccaguccaagcagauggagaacauccucuacuggaucaaccucgucuucgucaucuucuucaccugcgagugcguccucaagauguucgcccuccgccacuacuacuucaccaucggcuggaacaucuucgacuucgucgucgucauccucuccaucgucggcauguuccucgccgacaucaucgagaaguacuucgucucccccacccucuuccgcgucauccgccucgcccgcaucggccgcauccuccgccucaucaagggcgccaagggcauccgcacccuccucuucgcccucaugaugucccuccccgcccucuucaacaucggccuccuccucuuccucgucauguucaucuucuccaucuucggcauguccaacuucgccuacgucaagcacgaggccggcaucgacgacauguucaacuucgagaccuucggcaacuccaugaucugccucuuccagaucaccaccuccgccggcugggacggccuccuccuccccauccucaaccgcccccccgacugcucccucgacaaggagcaccccggcuccggcuucaagggcgacugcggcaaccccuccgucggcaucuucuucuucgucuccuacaucaucaucuccuuccucaucgucgucaacauguacaucgccaucauccucgagaacuucuccgucgccaccgaggaguccgccgacccccucuccgaggacgacuucgagaccuucuacgagaucugggagaaguucgaccccgacgccacccaguucaucgaguacugcaagcucgccgacuucgccgacgcccucgagcacccccuccgcguccccaagcccaacaccaucgagcucaucgccauggaccuccccauggucuccggcgaccgcauccacugccucgacauccucuucgccuucaccaagcgcguccucggcgacuccggcgagcucgacauccuccgccagcagauggaggagcgcuucgucgccuccaaccccuccaaggucuccuacgagcccaucaccaccacccuccgccgcaagcaggaggaggucuccgccgucguccuccagcgcgccuaccgcggccaccucgcccgccgcggcuucaucugcaagaagaccaccuccaacaagcucgagaacggcggcacccaccgcgagaagaaggaguccacccccuccaccgccucccuccccuccuacgacuccgucaccaagcccgagaaggagaagcagcagcgcgccgaggagggccgccgcgagcgcgccaagcgccagaaggagguccgcgaguccaagugcuga

SEQ ID NO: 49177 - RNA, 5934 nt, Artificial Sequence
  derived and/or modified sequence opt2 from SCN9A__Homo_sapiens__NP_002968
auggccaugcuccccccccccggcccccaguccuucguccacuucaccaagcagucccucgcccucaucgagcagcgcaucgccgagcgcaaguccaaggagcccaaggaggagaagaaggacgacgacgaggaggcccccaagcccuccuccgaccucgaggccggcaagcagcuccccuucaucuacggcgacaucccccccggcauggucuccgagccccucgaggaccucgaccccuacuacgccgacaagaagaccuucaucguccucaacaagggcaagaccaucuuccgcuucaacgccacccccgcccucuacaugcucucccccuucuccccccuccgccgcaucuccaucaagauccucguccacucccucuucuccaugcucaucaugugcaccauccucaccaacugcaucuucaugaccaugaacaacccccccgacuggaccaagaacgucgaguacaccuucaccggcaucuacaccuucgagucccucgucaagauccucgcccgcggcuucugcgucggcgaguucaccuuccuccgcgaccccuggaacuggcucgacuucgucgucaucgucuucgccuaccucaccgaguucgucaaccucggcaacgucuccgcccuccgcaccuuccgcguccuccgcgcccucaagaccaucuccgucauccccggccucaagaccaucgucggcgcccucauccaguccgucaagaagcucuccgacgucaugauccucaccgucuucugccucuccgucuucgcccucaucggccuccagcucuucaugggcaaccucaagcacaagugcuuccgcaacucccucgagaacaacgagacccucgaguccaucaugaacacccucgaguccgaggaggacuuccgcaaguacuucuacuaccucgagggcuccaaggacgcccuccucugcggcuucuccaccgacuccggccagugccccgagggcuacaccugcgucaagaucggccgcaaccccgacuacggcuacaccuccuucgacaccuucuccugggccuuccucgcccucuuccgccucaugacccaggacuacugggagaaccucuaccagcagacccuccgcgccgccggcaagaccuacaugaucuucuucgucgucgucaucuuccucggcuccuucuaccucaucaaccucauccucgccgucgucgccauggccuacgaggagcagaaccaggccaacaucgaggaggccaagcagaaggagcucgaguuccagcagaugcucgaccgccucaagaaggagcaggaggaggccgaggccaucgccgccgccgccgccgaguacaccuccauccgccgcucccgcaucaugggccucuccgaguccuccuccgagaccuccaagcucuccuccaaguccgccaaggagcgccgcaaccgccgcaagaagaagaaccagaagaagcucuccuccggcgaggagaagggcgacgccgagaagcucuccaaguccgaguccgaggacuccauccgccgcaaguccuuccaccucggcgucgagggccaccgccgcgcccacgagaagcgccucuccacccccaaccaguccccccucuccauccgcggcucccucuucuccgcccgccgcuccucccgcaccucccucuucuccuucaagggccgcggccgcgacaucggcuccgagaccgaguucgccgacgacgagcacuccaucuucggcgacaacgagucccgccgcggcucccucuucgucccccaccgcccccaggagcgccgcuccuccaacaucucccaggccucccgcuccccccccaugcuccccgucaacggcaagaugcacuccgccgucgacugcaacggcgucgucucccucgucgacggccgcuccgcccucaugcuccccaacggccagcuccuccccgagggcaccaccaaccagauccacaagaagcgccgcugcuccuccuaccuccucuccgaggacaugcucaacgaccccaaccuccgccagcgcgccaugucccgcgccuccauccucaccaacaccgucgaggagcucgaggagucccgccagaagugcccccccuggugguaccgcuucgcccacaaguuccucaucuggaacugcucccccuacuggaucaaguucaagaagugcaucuacuucaucgucauggaccccuucgucgaccucgccaucaccaucugcaucguccucaacacccucuucauggccauggagcaccaccccaugaccgaggaguucaagaacguccucgccaucggcaaccucgucuucaccggcaucuucgccgccgagaugguccucaagcucaucgccauggaccccuacgaguacuuccaggucggcuggaacaucuucgacucccucaucgucacccucucccucgucgagcucuuccucgccgacgucgagggccucuccguccuccgcuccuuccgccuccuccgcgucuucaagcucgccaaguccuggcccacccucaacaugcucaucaagaucaucggcaacuccgucggcgcccucggcaaccucacccucguccucgccaucaucgucuucaucuucgccgucgucggcaugcagcucuucggcaaguccuacaaggagugcgucugcaagaucaacgacgacugcacccucccccgcuggcacaugaacgacuucuuccacuccuuccucaucgucuuccgcguccucugcggcgaguggaucgagaccaugugggacugcauggaggucgccggccaggccaugugccucaucgucuacaugauggucauggucaucggcaaccucgucguccucaaccucuuccucgcccuccuccucuccuccuucuccuccgacaaccucaccgccaucgaggaggaccccgacgccaacaaccuccagaucgccgucacccgcaucaagaagggcaucaacuacgucaagcagacccuccgcgaguucauccucaaggccuucuccaagaagcccaagaucucccgcgagauccgccaggccgaggaccucaacaccaagaaggagaacuacaucuccaaccacacccucgccgagauguccaagggccacaacuuccucaaggagaaggacaagaucuccggcuucggcuccuccgucgacaagcaccucauggaggacuccgacggccaguccuucauccacaaccccucccucaccgucaccguccccaucgcccccggcgaguccgaccucgagaacaugaacgccgaggagcucuccuccgacuccgacuccgaguacuccaagguccgccucaaccgcuccuccuccuccgagugcuccaccgucgacaacccccuccccggcgagggcgaggaggccgaggccgagcccaugaacuccgacgagcccgaggccugcuucaccgacggcugcguccgccgcuucuccugcugccaggucaacaucgaguccggcaagggcaagaucugguggaacauccgcaagaccugcuacaagaucgucgagcacuccugguucgaguccuucaucguccucaugauccuccucuccuccggcgcccucgccuucgaggacaucuacaucgagcgcaagaagaccaucaagaucauccucgaguacgccgacaagaucuucaccuacaucuucauccucgagaugcuccucaaguggaucgccuacggcuacaagaccuacuucaccaacgccuggugcuggcucgacuuccucaucgucgacgucucccucgucacccucgucgccaacacccucggcuacuccgaccucggccccaucaagucccuccgcacccuccgcgcccuccgcccccuccgcgcccucucccgcuucgagggcaugcgcgucgucgucaacgcccucaucggcgccauccccuccaucaugaacguccuccucgucugccucaucuucuggcucaucuucuccaucaugggcgucaaccucuucgccggcaaguucuacgagugcaucaacaccaccgacggcucccgcuuccccgccucccagguccccaaccgcuccgagugcuucgcccucaugaacgucucccagaacguccgcuggaagaaccucaaggucaacuucgacaacgucggccucggcuaccucucccuccuccaggucgccaccuucaagggcuggaccaucaucauguacgccgccgucgacuccgucaacgucgacaagcagcccaaguacgaguacucccucuacauguacaucuacuucgucgucuucaucaucuucggcuccuucuucacccucaaccucuucaucggcgucaucaucgacaacuucaaccagcagaagaagaagcucggcggccaggacaucuucaugaccgaggagcagaagaaguacuacaacgccaugaagaagcucggcuccaagaagccccagaagcccaucccccgccccggcaacaagauccagggcugcaucuucgaccucgucaccaaccaggccuucgacaucuccaucaugguccucaucugccucaacauggucaccaugauggucgagaaggagggccagucccagcacaugaccgagguccucuacuggaucaacgucgucuucaucauccucuucaccggcgagugcguccucaagcucaucucccuccgccacuacuacuucaccgucggcuggaacaucuucgacuucgucgucgucaucaucuccaucgucggcauguuccucgccgaccucaucgagaccuacuucgucucccccacccucuuccgcgucauccgccucgcccgcaucggccgcauccuccgccucgucaagggcgccaagggcauccgcacccuccucuucgcccucaugaugucccuccccgcccucuucaacaucggccuccuccucuuccucgucauguucaucuacgccaucuucggcauguccaacuucgccuacgucaagaaggaggacggcaucaacgacauguucaacuucgagaccuucggcaacuccaugaucugccucuuccagaucaccaccuccgccggcugggacggccuccucgcccccauccucaacuccaagccccccgacugcgaccccaagaagguccaccccggcuccuccgucgagggcgacugcggcaaccccuccgucggcaucuucuacuucgucuccuacaucaucaucuccuuccucgucgucgucaacauguacaucgccgucauccucgagaacuucuccgucgccaccgaggaguccaccgagccccucuccgaggacgacuucgagauguucuacgaggucugggagaaguucgaccccgacgccacccaguucaucgaguucuccaagcucuccgacuucgccgccgcccucgaccccccccuccucaucgccaagcccaacaagguccagcucaucgccauggaccuccccauggucuccggcgaccgcauccacugccucgacauccucuucgccuucaccaagcgcguccucggcgaguccggcgagauggacucccuccgcucccagauggaggagcgcuucauguccgccaaccccuccaaggucuccuacgagcccaucaccaccacccucaagcgcaagcaggaggacgucuccgccaccgucauccagcgcgccuaccgccgcuaccgccuccgccagaacgucaagaacaucuccuccaucuacaucaaggacggcgaccgcgacgacgaccuccucaacaagaaggacauggccuucgacaacgucaacgagaacuccucccccgagaagaccgacgccaccuccuccaccaccuccccccccuccuacgacuccgucaccaagcccgacaaggagaaguacgagcaggaccgcaccgagaaggaggacaagggcaaggacuccaaggaguccaagaaguga

SEQ ID NO: 49178 - RNA, 588 nt, Artificial Sequence
  derived and/or modified sequence opt2 from SCNM1__Homo_sapiens__NP_001191785
augcuccgcgacggccgcuucgccugcgccaucugcccccaccgccccguccucgacacccucgccaugcucaccgcccaccgcgccggcaagaagcaccucuccucccuccagcucuucuacggcaagaagcagcccggcaaggagcgcaagcagaaccccaagcaccagaacgagcuccgccgcgaggagaccaaggccgaggccccccuccucacccagacccgccucaucacccaguccgcccuccaccgcgccccccacuacaacuccugcugccgccgcaaguaccgccccgaggcccccggccccuccgucucccucucccccaugccccccuccgaggucaagcuccaguccggcaagaucucccgcgagcccgagcccgccgccggcccccaggccgaggaguccgccaccgucuccgcccccgcccccaugucccccacccgccgccgcgcccucgaccacuaccucacccuccgcuccuccggcuggauccccgacggccgcggccgcugggucaaggacgagaacgucgaguucgacuccgacgaggaggagccccccgaccucccccucgacuga

SEQ ID NO: 49179 - RNA, 2010 nt, Artificial Sequence
  derived and/or modified sequence opt2 from SCNN1A__Homo_sapiens__NP_001029
auggagggcaacaagcucgaggagcaggacuccucccccccccaguccacccccggccucaugaagggcaacaagcgcgaggagcagggccucggccccgagcccgccgccccccagcagcccaccgccgaggaggaggcccucaucgaguuccaccgcuccuaccgcgagcucuucgaguucuucugcaacaacaccaccauccacggcgccauccgccucgucugcucccagcacaaccgcaugaagaccgccuucugggccguccucuggcucugcaccuucggcaugauguacuggcaguucggccuccucuucggcgaguacuucuccuaccccgucucccucaacaucaaccucaacuccgacaagcucgucuuccccgccgucaccaucugcacccucaaccccuaccgcuaccccgagaucaaggaggagcucgaggagcucgaccgcaucaccgagcagacccucuucgaccucuacaaguacuccuccuucaccacccucgucgccggcucccgcucccgccgcgaccuccgcggcacccucccccacccccuccagcgccuccgcguccccccccccccccacggcgcccgccgcgcccgcuccgucgccuccucccuccgcgacaacaacccccaggucgacuggaaggacuggaagaucggcuuccagcucugcaaccagaacaaguccgacugcuucuaccagaccuacuccuccggcgucgacgccguccgcgagugguaccgcuuccacuacaucaacauccucucccgccuccccgagacccuccccucccucgaggaggacacccucggcaacuucaucuucgccugccgcuucaaccaggucuccugcaaccaggccaacuacucccacuuccaccaccccauguacggcaacugcuacaccuucaacgacaagaacaacuccaaccucuggauguccuccaugcccggcaucaacaacggccucucccucaugcuccgcgccgagcagaacgacuucaucccccuccucuccaccgucaccggcgcccgcgucaugguccacggccaggacgagcccgccuucauggacgacggcggcuucaaccuccgccccggcgucgagaccuccaucuccaugcgcaaggagacccucgaccgccucggcggcgacuacggcgacugcaccaagaacggcuccgacguccccgucgagaaccucuaccccuccaaguacacccagcaggucugcauccacuccugcuuccaggaguccaugaucaaggagugcggcugcgccuacaucuucuacccccgcccccagaacgucgaguacugcgacuaccgcaagcacuccuccuggggcuacugcuacuacaagcuccaggucgacuucuccuccgaccaccucggcugcuucaccaagugccgcaagcccugcuccgucaccuccuaccagcucuccgccggcuacucccgcuggcccuccgucaccucccaggagugggucuuccagaugcucucccgccagaacaacuacaccgucaacaacaagcgcaacggcgucgccaaggucaacaucuucuucaaggagcucaacuacaagaccaacuccgagucccccuccgucaccauggucacccuccucuccaaccucggcucccaguggucccucugguucggcuccuccguccucuccgucgucgagauggccgagcucgucuucgaccuccucgucaucauguuccucaugcuccuccgccgcuuccgcucccgcuacuggucccccggccgcggcggccgcggcgcccaggaggucgccuccacccucgccuccuccccccccucccacuucugcccccaccccaugucccucucccucucccagcccggccccgcccccucccccgcccucaccgcccccccccccgccuacgccacccucggcccccgccccucccccggcggcuccgccggcgccuccuccuccaccugcccccucggcggccccuga

SEQ ID NO: 49180 - RNA, 1923 nt, Artificial Sequence
  derived and/or modified sequence opt2 from SCNN1B__Homo_sapiens__NP_000327
augcacgucaagaaguaccuccucaagggccuccaccgccuccagaagggccccggcuacaccuacaaggagcuccucgucugguacugcgacaacaccaacacccacggccccaagcgcaucaucugcgagggccccaagaagaaggccaugugguuccuccucacccuccucuucgccgcccucgucugcuggcaguggggcaucuucauccgcaccuaccucuccugggaggucuccgucucccucuccgucggcuucaagaccauggacuuccccgccgucaccaucugcaacgccucccccuucaaguacuccaagaucaagcaccuccucaaggaccucgacgagcucauggaggccguccucgagcgcauccucgcccccgagcucucccacgccaacgccacccgcaaccucaacuucuccaucuggaaccacaccccccucguccucaucgacgagcgcaacccccaccaccccaugguccucgaccucuucggcgacaaccacaacggccucaccuccuccuccgccuccgagaagaucugcaacgcccacggcugcaagauggccaugcgccucugcucccucaaccgcacccagugcaccuuccgcaacuucaccuccgccacccaggcccucaccgagugguacauccuccaggccaccaacaucuucgcccaggucccccagcaggagcucgucgagauguccuaccccggcgagcagaugauccucgccugccucuucggcgccgagcccugcaacuaccgcaacuucaccuccaucuucuacccccacuacggcaacugcuacaucuucaacuggggcaugaccgagaaggcccuccccuccgccaaccccggcaccgaguucggccucaagcucauccucgacaucggccaggaggacuacguccccuuccucgccuccaccgccggcguccgccucaugcuccacgagcagcgcuccuaccccuucauccgcgacgagggcaucuacgccauguccggcaccgagaccuccaucggcguccucgucgacaagcuccagcgcaugggcgagcccuacucccccugcaccgucaacggcuccgagguccccguccagaacuucuacuccgacuacaacaccaccuacuccauccaggccugccuccgcuccugcuuccaggaccacaugauccgcaacugcaacugcggccacuaccucuacccccucccccgcggcgagaaguacugcaacaaccgcgacuuccccgacugggcccacugcuacuccgaccuccagauguccgucgcccagcgcgagaccugcaucggcaugugcaaggaguccugcaacgacacccaguacaagaugaccaucuccauggccgacuggcccuccgaggccuccgaggacuggaucuuccacguccucucccaggagcgcgaccaguccaccaacaucacccucucccgcaagggcaucgucaagcucaacaucuacuuccaggaguucaacuaccgcaccaucgaggaguccgccgccaacaacaucgucuggcuccucuccaaccucggcggccaguucggcuucuggaugggcggcuccguccucugccucaucgaguucggcgagaucaucaucgacuucgucuggaucaccaucaucaagcucgucgcccucgccaagucccuccgccagcgccgcgcccaggccuccuacgccggccccccccccaccgucgccgagcucgucgaggcccacaccaacuucggcuuccagcccgacaccgccccccgcucccccaacaccggccccuaccccuccgagcaggcccuccccauccccggcacccccccccccaacuacgacucccuccgccuccagccccucgacgucaucgaguccgacuccgagggcgacgccaucuga

SEQ ID NO: 49181 - RNA, 2688 nt, Artificial Sequence
  derived and/or modified sequence opt2 from SCNN1D__Homo_sapiens__XP_011540201
augcccggcgccugccaccuccagggcuccgccgucaccgaggacaacaccgcccccucccuccccgucgcccgccccccccagcgccccaaggaggucuccucccagcccugcuccgucaacggcgccuggcccuccuuccucggcgagucccgcggcaugggccccaagggcgcccgcgacgccugccccucccuccucuccuuccgccucaccugguccuggugcuccgaccaccgcacccccaccugccgcgagcucggcuccccccaccccacccccugcaccggccccgcccgcggcuggccccgccgcggcggcggccccugcggcuucaccuccgccggccacguccucugcggcuacccccucugccuccucuccggccccauccagggcugcggcaccggcgccgcccacgcccaguccugccccgacgucgucggcgagaagccccaggccugcgccgucuccggcggccccgccgccgaccucuggggccucugcgacaucuccaagccccccgccgccucccucgagcgccaccccucccccaucuggcacucccgcaaguccgcccagcgcggccgccaccgcuggcagcuccuccccucccgcgccggccgccaggaggcccgcggcuccauccuccuccaguccugccagcuccccccccaguggcucuccaccgaggccuggaccggcgaguggaagcagccccacggcggcgcccucaccucccgcucccccggccccgucgccccccagcgccccugccaccucaagggcuggcagcaccgccccacccagcacaacgccgccugcaagcagggccaggccgccgcccagacccccccccgccccggcccccccuccgcccccccccccccccccaaggagggccaccaggagggccucgucgagcuccccgccuccuuccgcgagcuccucaccuucuucugcaccaacgccaccauccacggcgccauccgccucgucugcucccgcggcaaccgccucaagaccaccuccuggggccuccucucccucggcgcccucgucgcccucugcuggcagcucggccuccucuucgagcgccacuggcaccgccccguccucauggccgucuccguccacuccgagcgcaagcuccucccccucgucacccucugcgacggcaacccccgccgccccucccccguccuccgccaccucgagcuccucgacgaguucgcccgcgagaacaucgacucccucuacaacgucaaccucuccaagggccgcgccgcccucuccgccaccgucccccgccacgagccccccuuccaccucgaccgcgagauccgccuccagcgccucucccacuccggcucccgcguccgcgucggcuuccgccucugcaacuccaccggcggcgacugcuucuaccgcggcuacaccuccggcgucgccgccguccaggacugguaccacuuccacuacgucgacauccucgcccuccuccccgccgccugggaggacucccacggcucccaggacggccacuucguccucuccugcuccuacgacggccucgacugccaggcccgccaguuccgcaccuuccaccaccccaccuacggcuccugcuacaccgucgacggcgucuggaccgcccagcgccccggcaucacccacggcgucggccucguccuccgcgucgagcagcagccccaccucccccuccucuccacccucgccggcauccgcgucaugguccacggccgcaaccacacccccuuccucggccaccacuccuucuccguccgccccggcaccgaggccaccaucuccauccgcgaggacgagguccaccgccucggcucccccuacggccacugcaccgccggcggcgagggcgucgaggucgagcuccuccacaacaccuccuacacccgccaggccugccucgucuccugcuuccagcagcucauggucgagaccugcuccugcggcuacuaccuccacccccuccccgccggcgccgaguacugcuccuccgcccgccaccccgccuggggccacugcuucuaccgccucuaccaggaccucgagacccaccgccuccccugcaccucccgcugcccccgccccugccgcgaguccgccuucaagcucuccaccggcaccucccgcuggcccuccgccaaguccgccggcuggacccucgccacccucggcgagcagggccucccccaccagucccaccgccagcgcuccucccucgccaagaucaacaucgucuaccaggagcucaacuaccgcuccgucgaggaggcccccgucuacuccgucccccagcuccucuccgccaugggcucccucugcucccucugguucggcgccuccguccucucccuccucgagcuccucgagcuccuccucgacgccuccgcccucacccucguccucggcggccgccgccuccgccgcgccugguucuccuggccccgcgccucccccgccuccggcgccuccuccaucaagcccgaggccucccagaugcccccccccgccggcggcaccuccgacgaccccgagcccuccggcccccaccucccccgcgucaugcuccccggcguccucgccggcgucuccgccgaggaguccugggccggcccccagccccucgagacccucgacaccuga

SEQ ID NO: 49182 - RNA, 1950 nt, Artificial Sequence
  derived and/or modified sequence opt2 from SCNN1G__Homo_sapiens__NP_001030
auggcccccggcgagaagaucaaggccaagaucaagaagaaccuccccgucaccggcccccaggcccccaccaucaaggagcucaugcgcugguacugccucaacaccaacacccacggcugccgccgcaucgucgucucccgcggccgccuccgccgccuccucuggaucggcuucacccucaccgccgucgcccucauccucuggcagugcgcccuccucgucuucuccuucuacaccgucuccgucuccaucaagguccacuuccgcaagcucgacuuccccgccgucaccaucugcaacaucaaccccuacaaguacuccaccguccgccaccuccucgccgaccucgagcaggagacccgcgaggcccucaagucccucuacggcuuccccgagucccgcaagcgccgcgaggccgaguccuggaacuccgucuccgagggcaagcagccccgcuucucccaccgcaucccccuccucaucuucgaccaggacgagaagggcaaggcccgcgacuucuucaccggccgcaagcgcaaggucggcggcuccaucauccacaaggccuccaacgucaugcacaucgaguccaagcaggucgucggcuuccagcucugcuccaacgacaccuccgacugcgccaccuacaccuucuccuccggcaucaacgccauccaggagugguacaagcuccacuacaugaacaucauggcccaggucccccucgagaagaagaucaacauguccuacuccgccgaggagcuccucgucaccugcuucuucgacggcgucuccugcgacgcccgcaacuucacccucuuccaccaccccaugcacggcaacugcuacaccuucaacaaccgcgagaacgagaccauccucuccaccuccaugggcggcuccgaguacggccuccaggucauccucuacaucaacgaggaggaguacaaccccuuccucgucuccuccaccggcgccaaggucaucauccaccgccaggacgaguaccccuucgucgaggacgucggcaccgagaucgagaccgccauggucaccuccaucggcaugcaccucaccgaguccuucaagcucuccgagcccuacucccagugcaccgaggacggcuccgacguccccauccgcaacaucuacaacgccgccuacucccuccagaucugccuccacuccugcuuccagaccaagauggucgagaagugcggcugcgcccaguacucccagccccucccccccgccgccaacuacugcaacuaccagcagcaccccaacuggauguacugcuacuaccagcuccaccgcgccuucguccaggaggagcucggcugccaguccgucugcaaggaggccugcuccuucaaggaguggacccucaccaccucccucgcccaguggcccuccgucgucuccgagaaguggcuccuccccguccucaccugggaccagggccgccaggucaacaagaagcucaacaagaccgaccucgccaagcuccucaucuucuacaaggaccucaaccagcgcuccaucauggagucccccgccaacuccaucgagaugcuccucuccaacuucggcggccagcucggccucuggauguccugcuccgucgucugcgucaucgagaucaucgaggucuucuucaucgacuucuucuccaucaucgcccgccgccaguggcagaaggccaaggaguggugggccuggaagcaggccccccccugccccgaggccccccgcuccccccagggccaggacaaccccgcccucgacaucgacgacgaccuccccaccuucaacuccgcccuccaccucccccccgcccucggcacccagguccccggcacccccccccccaaguacaacacccuccgccucgagcgcgccuucuccaaccagcucaccgacacccagaugcucgacgagcucuga

SEQ ID NO: 49183 - RNA, 906 nt, Artificial Sequence
  derived and/or modified sequence opt2 from SCO1__Homo_sapiens__NP_004580
auggccaugcucguccucguccccggccgcgucaugcgcccccucggcggccagcucuggcgcuuccucccccgcggccucgaguucuggggccccgccgagggcaccgcccgcguccuccuccgccaguucugcgcccgccaggccgaggccuggcgcgccuccggccgccccggcuacugccucggcacccgcccccucuccaccgcccgcccccccccccccuggucccagaagggccccggcgacuccacccgccccuccaagcccggccccgucuccuggaagucccucgccaucaccuucgccaucggcggcgcccuccucgccggcaugaagcacgucaagaaggagaaggccgagaagcucgagaaggagcgccagcgccacaucggcaagccccuccucggcggccccuucucccucaccacccacaccggcgagcgcaagaccgacaaggacuaccucggccaguggcuccucaucuacuucggcuucacccacugccccgacgucugccccgaggagcucgagaagaugauccaggucgucgacgagaucgacuccaucaccacccuccccgaccucaccccccucuucaucuccaucgaccccgagcgcgacaccaaggaggccaucgccaacuacgucaaggaguucucccccaagcucgucggccucaccggcacccgcgaggaggucgaccaggucgcccgcgccuaccgcgucuacuacucccccggccccaaggacgaggacgaggacuacaucgucgaccacaccaucaucauguaccucaucggccccgacggcgaguuccucgacuacuucggccagaacaagcgcaagggcgagaucgccgccuccaucgccacccacaugcgccccuaccgcaagaaguccuga

SEQ ID NO: 49184 - RNA, 801 nt, Artificial Sequence
  derived and/or modified sequence opt2 from SCO2__Homo_sapiens__NP_001162582
augcuccuccucacccgcucccccaccgccuggcaccgccucucccagcucaagccccgcguccuccccggcacccucggcggccaggcccuccaccuccgcuccuggcuccucucccgccagggccccgccgagaccggcggccagggccagccccagggccccggccuccgcacccgccuccucaucaccggccucuucggcgccggccucggcggcgccuggcucgcccuccgcgccgagaaggagcgccuccagcagcagaagcgcaccgaggcccuccgccaggccgccgucggccagggcgacuuccaccuccucgaccaccgcggccgcgcccgcugcaaggccgacuuccgcggccaguggguccucauguacuucggcuucacccacugccccgacaucugccccgacgagcucgagaagcucguccaggucguccgccagcucgaggccgagcccggccucccccccguccagcccgucuucaucaccgucgaccccgagcgcgacgacgucgaggccauggcccgcuacguccaggacuuccacccccgccuccucggccucaccggcuccaccaagcaggucgcccaggccucccacuccuaccgcgucuacuacaacgccggccccaaggacgaggaccaggacuacaucgucgaccacuccaucgccaucuaccuccucaaccccgacggccucuucaccgacuacuacggccgcucccgcuccgccgagcagaucuccgacuccguccgccgccacauggccgccuuccgcuccguccucuccuga

SEQ ID NO: 49185 - RNA, 471 nt, Artificial Sequence
  derived and/or modified sequence opt2 from SCP2D1__Homo_sapiens__NP_848578
auguggaagcgcuccgaccaccagcccaagaucaaggccgaggacggcccccucgucggccaguucgagguccucggcuccguccccgagcccgccaugccccacccccucgagcucuccgaguucgaguccuuccccgucuuccaggacauccgccuccacauccgcgaggucggcgcccagcucgucaagaaggucaacgccgucuuccagcucgacaucaccaagaacggcaagaccauccuccgcuggaccaucgaccucaagaacggcuccggcgacauguaccccggccccgcccgccuccccgccgacaccgucuucaccauccccgaguccgucuucauggagcucguccucggcaagaugaacccccagaaggccuuccucgccggcaaguucaaggucuccggcaagguccuccucuccuggaagcucgagcgcgucuucaaggacugggccaaguucuga

SEQ ID NO: 49186 - RNA, 1359 nt, Artificial Sequence
  derived and/or modified sequence opt2 from SCPEP1__Homo_sapiens__NP_067639
auggagcucgcccuccgccgcucccccgucccccgcuggcuccuccuccucccccuccuccucggccucaacgccggcgccgucaucgacuggcccaccgaggagggcaaggaggucugggacuacgucaccguccgcaaggacgccuacauguucugguggcucuacuacgccaccaacuccugcaagaacuucuccgagcucccccucgucauguggcuccagggcggccccggcggcuccuccaccggcuucggcaacuucgaggagaucggcccccucgacuccgaccucaagccccgcaagaccaccuggcuccaggccgccucccuccucuucgucgacaaccccgucggcaccggcuucuccuacgucaacggcuccggcgccuacgccaaggaccucgccauggucgccuccgacaugaugguccuccucaagaccuucuucuccugccacaaggaguuccagaccguccccuucuacaucuucuccgaguccuacggcggcaagauggccgccggcaucggccucgagcucuacaaggccauccagcgcggcaccaucaagugcaacuucgccggcgucgcccucggcgacuccuggaucucccccgucgacuccguccucuccuggggccccuaccucuacuccaugucccuccucgaggacaagggccucgccgaggucuccaaggucgccgagcagguccucaacgccgucaacaagggccucuaccgcgaggccaccgagcucuggggcaaggccgagaugaucaucgagcagaacaccgacggcgucaacuucuacaacauccucaccaaguccacccccaccuccaccauggaguccucccucgaguucacccagucccaccucgucugccucugccagcgccacguccgccaccuccagcgcgacgcccucucccagcucaugaacggccccauccgcaagaagcucaagaucauccccgaggaccaguccuggggcggccaggccaccaacgucuucgucaacauggaggaggacuucaugaagcccgucaucuccaucgucgacgagcuccucgaggccggcaucaacgucaccgucuacaacggccagcucgaccucaucgucgacaccaugggccaggaggccuggguccgcaagcucaaguggcccgagcuccccaaguucucccagcucaaguggaaggcccucuacuccgaccccaagucccucgagaccuccgccuucgucaaguccuacaagaaccucgccuucuacuggauccucaaggccggccacaugguccccuccgaccagggcgacauggcccucaagaugaugcgccucgucacccagcaggaguga

SEQ ID NO: 49187 - RNA, 4893 nt, Artificial Sequence
  derived and/or modified sequence opt2 from SCRIB__Homo_sapiens__NP_056171
augcucaagugcaucccccucuggcgcugcaaccgccacgucgaguccgucgacaagcgccacugcucccuccaggccguccccgaggagaucuaccgcuacucccgcucccucgaggagcuccuccucgacgccaaccagcuccgcgagcuccccaagcccuucuuccgccuccucaaccuccgcaagcucggccucuccgacaacgagauccagcgccucccccccgaggucgccaacuucaugcagcucgucgagcucgacgucucccgcaacgacauccccgagauccccgaguccaucaaguucugcaaggcccucgagaucgccgacuucuccggcaacccccucucccgccuccccgacggcuucacccagcuccgcucccucgcccaccucgcccucaacgacgucucccuccaggcccuccccggcgacgucggcaaccucgccaaccucgucacccucgagcuccgcgagaaccuccucaagucccuccccgccucccucuccuuccucgucaagcucgagcagcucgaccucggcggcaacgaccucgagguccuccccgacacccucggcgcccuccccaaccuccgcgagcucuggcucgaccgcaaccagcucuccgcccucccccccgagcucggcaaccuccgccgccucgucugccucgacgucuccgagaaccgccucgaggagcuccccgccgagcucggcggccucguccuccucaccgaccuccuccucucccagaaccuccuccgccgccuccccgacggcaucggccagcucaagcagcucuccauccucaaggucgaccagaaccgccucugcgaggucaccgaggccaucggcgacugcgagaaccucuccgagcucauccucaccgagaaccuccucauggcccucccccgcucccucggcaagcucaccaagcucaccaaccucaacgucgaccgcaaccaccucgaggcccucccccccgagaucggcggcugcgucgcccucuccguccucucccuccgcgacaaccgccucgccguccucccccccgagcucgcccacaccaccgagcuccacguccucgacgucgccggcaaccgccuccagucccuccccuucgcccucacccaccucaaccucaaggcccucuggcucgccgagaaccaggcccagcccaugcuccgcuuccagaccgaggacgacgcccgcaccggcgagaagguccucaccugcuaccuccucccccagcagcccccccccucccucgaggacgccggccagcagggcucccucuccgagaccugguccgacgccccccccucccgcgucuccgucauccaguuccucgaggcccccaucggcgacgaggacgccgaggaggccgccgccgagaagcgcggccuccagcgccgcgccaccccccaccccuccgagcucaaggucaugaagcgcuccaucgagggccgccgcuccgaggccugccccugccagcccgacuccggcuccccccuccccgccgaggaggagaagcgccucuccgccgaguccggccucuccgaggacucccgccccuccgccuccaccgucuccgaggccgagcccgagggccccuccgccgaggcccagggcggcucccagcaggaggccaccaccgccggcggcgaggaggacgccgaggaggacuaccaggagcccaccguccacuucgccgaggacgcccuccuccccggcgacgaccgcgagaucgaggagggccagcccgaggcccccuggacccuccccggcggccgccagcgccucauccgcaaggacaccccccacuacaagaagcacuucaagaucuccaagcucccccagcccgaggccgucgucgcccuccuccagggcaugcagcccgacggcgagggccccgucgcccccggcggcuggcacaacggcccccacgcccccugggccccccgcgcccagaaggaggaggaggaggaggaggagggcuccccccaggaggaggaggaggaggaggaggaggagaaccgcgccgaggaggaggaggccuccaccgaggaggaggacaaggagggcgccgucgucuccgcccccuccgucaagggcgucuccuucgaccaggccaacaaccuccucaucgagcccgcccgcaucgaggaggaggagcucacccucaccauccuccgccagaccggcggccucggcaucuccaucgccggcggcaagggcuccacccccuacaagggcgacgacgagggcaucuucaucucccgcgucuccgaggagggccccgccgcccgcgccggcguccgcgucggcgacaagcuccucgaggucaacggcgucgcccuccagggcgccgagcaccacgaggccgucgaggcccuccgcggcgccggcaccgccguccagaugcgcgucuggcgcgagcgcauggucgagcccgagaacgccgucaccaucaccccccuccgccccgaggacgacuacuccccccgcgagcgccgcggcggcggccuccgccucccccuccucccccccgagucccccggcccccuccgccagcgccacgucgccugccucgcccgcuccgagcgcggccucggcuucuccaucgccggcggcaagggcuccacccccuaccgcgccggcgacgccggcaucuucgucucccgcaucgccgagggcggcgccgcccaccgcgccggcacccuccaggucggcgaccgcguccucuccaucaacggcgucgacgucaccgaggcccgccacgaccacgccgucucccuccucaccgccgccucccccaccaucgcccuccuccucgagcgcgaggccggcggcccccucccccccuccccccucccccacuccuccccccccaccgccgccgucgccaccaccuccaucaccaccgccacccccggcguccccggccuccccucccucgcccccucccuccucgccgccgcccucgagggccccuaccccgucgaggagauccgccucccccgcgccggcggcccccucggccucuccaucgucggcggcuccgaccacuccucccaccccuucggcguccaggagcccggcgucuucaucuccaagguccucccccgcggccucgccgcccgcuccggccuccgcgucggcgaccgcauccucgccgucaacggccaggacguccgcgacgccacccaccaggaggccgucuccgcccuccuccgccccugccucgagcucucccuccucguccgccgcgaccccgccccccccggccuccgcgagcucugcauccagaaggcccccggcgagcgccucggcaucuccauccgcggcggcgcccgcggccacgccggcaacccccgcgaccccaccgacgagggcaucuucaucuccaaggucucccccaccggcgccgccggccgcgacggccgccuccgcgucggccuccgccuccucgaggucaaccagcagucccuccucggccucacccacggcgaggccguccagcuccuccgcuccgucggcgacacccucaccguccucgucugcgacggcuucgaggccuccaccgacgccgcccucgaggucucccccggcgucaucgccaaccccuucgccgccggcaucggccaccgcaacucccucgaguccaucuccuccaucgaccgcgagcucucccccgagggccccggcaaggagaaggagcuccccggccagacccuccacuggggccccgaggccaccgaggccgccggccgcggccuccagccccucaagcucgacuaccgcgcccucgccgccguccccuccgccggcuccguccagcgcguccccuccggcgccgccggcggcaagauggccgagucccccugcucccccuccggccagcagccccccuccccccccucccccgacgagcuccccgccaacgucaagcaggccuaccgcgccuucgccgccguccccaccucccacccccccgaggacgcccccgcccagccccccacccccggccccgccgccucccccgagcagcucuccuuccgcgagcgccagaaguacuucgagcucgagguccgcgucccccaggccgagggcccccccaagcgcgucucccucgucggcgccgacgaccuccgcaagaugcaggaggaggaggcccgcaagcuccagcagaagcgcgcccagaugcuccgcgaggccgccgaggccggcgccgaggcccgccucgcccucgacggcgagacccucggcgaggaggagcaggaggacgagcagccccccugggccucccccucccccaccucccgccagucccccgccuccccccccccccucggcggcggcgcccccguccgcaccgccaaggccgagcgccgccaccaggagcgccuccgcguccagucccccgagccccccgcccccgagcgcgcccucucccccgccgagcuccgcgcccucgaggccgagaagcgcgcccucuggcgcgccgcccgcaugaagucccucgagcaggacgcccuccgcgcccagaugguccucucccgcucccaggagggccgcggcacccgcggcccccucgagcgccucgccgaggcccccucccccgcccccacccccucccccacccccgucgaggaccucggcccccagaccuccaccucccccggccgccucucccccgacuucgccgaggagcuccgcucccucgagcccucccccucccccggcccccaggaggaggacggcgaggucgcccucguccuccucggccgccccucccccggcgccgucggccccgaggacgucgcccucugcuccucccgccgccccguccgccccggccgccgcggccucggccccguccccuccuga

SEQ ID NO: 49188 - RNA, 1305 nt, Artificial Sequence
  derived and/or modified sequence opt2 from SCRN1__Homo_sapiens__NP_001138986
augguccaggacggcaccuucaagacccgcgacuccaccuggaccugcgaguccacccgcauggccgccgccccccccuccuacugcuucgucgccuuccccccccgcgccaaggacggccucgucgucuucggcaagaacuccgcccgcccccgcgacgagguccaggaggucgucuacuucuccgccgccgaccacgagcccgaguccaaggucgagugcaccuacaucuccaucgaccaggucccccgcaccuacgccaucaugaucucccgccccgccuggcucuggggcgccgagaugggcgccaacgagcacggcgucugcaucgccaacgaggccaucaacacccgcgagcccgccgccgagaucgaggcccuccucggcauggaccucguccgccucggccucgagcgcggcgagaccgccaaggaggcccucgacgucaucgucucccuccucgaggagcacggccagggcggcaacuacuucgaggacgccaacuccugccacuccuuccaguccgccuaccucaucgucgaccgcgacgaggccuggguccucgagaccaucggcaaguacugggccgccgagaaggucaccgagggcguccgcugcaucugcucccagcucucccucaccaccaagauggacgccgagcaccccgagcuccgcuccuacgcccagucccagggcugguggaccggcgagggcgaguucaacuucuccgaggucuucucccccgucgaggaccaccucgacugcggcgccggcaaggacucccucgagaagcaggaggaguccaucaccguccagaccaugaugaacacccuccgcgacaaggccuccggcgucugcaucgacuccgaguucuuccucaccaccgccuccggcgucuccguccucccccagaaccgcuccucccccugcauccacuacuucaccggcacccccgaccccucccgcuccaucuucaagcccuucaucuucgucgacgacgucaagcucguccccaagacccagucccccugcuucggcgacgacgaccccgccaagaaggagccccgcuuccaggagaagcccgaccgccgccacgagcucuacaaggcccacgagugggcccgcgccaucaucgaguccgaccaggagcagggccgcaagcuccgcuccaccaugcucgagcucgagaagcagggccucgaggccauggaggagauccucaccuccuccgagccccucgaccccgccgaggucggcgaccucuucuacgacugcgucgacaccgagaucaaguucuucaaguga

SEQ ID NO: 49189 - RNA, 366 nt, Artificial Sequence
  derived and/or modified sequence opt2 from SCT__Homo_sapiens__XP_011518583
auggccccccgcccccuccuccuccuccuccuccuccucggcggcuccgccgcccgccccgcccccccccgcgcccgccgccacuccgacggcaccuucaccuccgagcucucccgccuccgcgagggcgcccgccuccagcgccuccuccagggccucgucggcaagcgcuccgagcaggacgccgagaacuccauggccuggacccgccucuccgccggccuccucugccccuccggcuccaacaugcccauccuccaggccuggaugccccucgacggcaccuggucccccuggcucccccccggccccauggucuccgagcccgccggcgccgccgccgagggcacccuccgcccccgcuga

SEQ ID NO: 49190 - RNA, 1323 nt, Artificial Sequence
  derived and/or modified sequence opt2 from SCTR__Homo_sapiens__NP_002971
augcgcccccaccucucccccccccuccagcagcuccuccuccccguccuccucgccugcgccgcccacuccaccggcgcccucccccgccucugcgacguccuccagguccucugggaggagcaggaccagugccuccaggagcucucccgcgagcagaccggcgaccucggcaccgagcagcccguccccggcugcgagggcaugugggacaacaucuccugcuggcccuccuccguccccggccgcauggucgaggucgagugcccccgcuuccuccgcaugcucaccucccgcaacggcucccucuuccgcaacugcacccaggacggcugguccgagaccuucccccgccccaaccucgccugcggcgucaacgucaacgacuccuccaacgagaagcgccacuccuaccuccucaagcucaaggucauguacaccgucggcuacuccuccucccucgucaugcuccucgucgcccucggcauccucugcgccuuccgccgccuccacugcacccgcaacuacauccacaugcaccucuucgucuccuucauccuccgcgcccucuccaacuucaucaaggacgccguccucuucuccuccgacgacgucaccuacugcgacgcccaccgcgccggcugcaagcucgucaugguccucuuccaguacugcaucauggccaacuacuccuggcuccucgucgagggccucuaccuccacacccuccucgccaucuccuucuucuccgagcgcaaguaccuccagggcuucgucgccuucggcuggggcucccccgccaucuucgucgcccucugggccaucgcccgccacuuccucgaggacgucggcugcugggacaucaacgccaacgccuccaucugguggaucauccgcggccccgucauccucuccauccucaucaacuucauccucuucaucaacauccuccgcauccucaugcgcaagcuccgcacccaggagacccgcggcaacgaggucucccacuacaagcgccucgcccgcuccacccuccuccucaucccccucuucggcauccacuacaucgucuucgccuucucccccgaggacgccauggagauccagcucuucuucgagcucgcccucggcuccuuccagggccucgucgucgccguccucuacugcuuccucaacggcgagguccagcucgagguccagaagaaguggcagcaguggcaccuccgcgaguucccccuccaccccgucgccuccuucuccaacuccaccaaggccucccaccucgagcagucccagggcaccugccgcaccuccaucaucuga

SEQ ID NO: 49191 - RNA, 2967 nt, Artificial Sequence
  derived and/or modified sequence opt2 from SCUBE1__Homo_sapiens__NP_766638
augggcgccgccgccguccgcuggcaccucugcguccuccucgcccucggcacccgcggccgccucgccggcggcuccggccuccccggcuccgucgacgucgacgagugcuccgagggcaccgacgacugccacaucgacgccaucugccagaacacccccaaguccuacaagugccucugcaagcccggcuacaagggcgagggcaagcagugcgaggacaucgacgagugcgagaacgacuacuacaacggcggcugcguccacgagugcaucaacauccccggcaacuaccgcugcaccugcuucgacggcuucaugcucgcccacgacggccacaacugccucgacgucgacgagugccaggacaacaacggcggcugccagcagaucugcgucaacgccaugggcuccuacgagugccagugccacuccggcuucuuccucuccgacaaccagcacaccugcauccaccgcuccaacgagggcaugaacugcaugaacaaggaccacggcugcgcccacaucugccgcgagacccccaagggcggcgucgccugcgacugccgccccggcuucgaccucgcccagaaccagaaggacugcacccucaccugcaacuacggcaacggcggcugccagcacuccugcgaggacaccgacaccggccccaccugcggcugccaccagaaguacgcccuccacuccgacggccgcaccugcaucgagaccugcgccgucaacaacggcggcugcgaccgcaccugcaaggacaccgccaccggcguccgcugcuccugccccgucggcuucacccuccagcccgacggcaagaccugcaaggacaucaacgagugccucgucaacaacggcggcugcgaccacuucugccgcaacaccgucggcuccuucgagugcggcugccgcaagggcuacaagcuccucaccgacgagcgcaccugccaggacaucgacgagugcuccuucgagcgcaccugcgaccacaucugcaucaacucccccggcuccuuccagugccucugccaccgcggcuacauccucuacggcaccacccacugcggcgacgucgacgagugcuccauguccaacggcuccugcgaccagggcugcgucaacaccaagggcuccuacgagugcgucugcccccccggccgccgccuccacuggaacggcaaggacugcgucgagaccggcaagugccucucccgcgccaagaccuccccccgcgcccagcucuccugcuccaaggccggcggcgucgaguccugcuuccucuccugccccgcccacacccucuucguccccgacuccgagaacuccuacguccucuccugcggcguccccggcccccagggcaaggcccuccagaagcgcaacggcaccuccuccggccucggccccuccugcuccgacgcccccaccacccccaucaagcagaaggcccgcuucaagauccgcgacgccaagugccaccuccgcccccacucccaggcccgcgccaaggagaccgcccgccagccccuccucgaccacugccacgucaccuucgucacccucaagugcgacuccuccaagaagcgccgccgcggccgcaagucccccuccaaggaggucucccacaucaccgccgaguucgagaucgagaccaagauggaggaggccuccgacaccugcgaggccgacugccuccgcaagcgcgccgagcagucccuccaggccgccaucaagacccuccgcaaguccaucggccgccagcaguucuacguccaggucuccggcaccgaguacgaggucgcccagcgccccgccaaggcccucgagggccagggcgccugcggcgccggccagguccuccaggacuccaagugcgucgccugcggccccggcacccacuucggcggcgagcucggccagugcgucuccugcaugcccggcaccuaccaggacauggagggccagcucuccugcacccccugccccuccuccgacggccucggccuccccggcgcccgcaacgucuccgagugcggcggccagugcucccccggcuucuucuccgccgacggcuucaagcccugccaggccugccccgucggcaccuaccagcccgagcccggccgcaccggcugcuuccccugcggcggcggccuccucaccaagcacgagggcaccaccuccuuccaggacugcgaggccaagguccacugcucccccggccaccacuacaacaccaccacccaccgcugcauccgcugccccgucggcaccuaccagcccgaguucggccagaaccacugcaucaccugccccggcaacaccuccaccgacuucgacggcuccaccaacgucacccacugcaagaaccagcacugcggcggcgagcucggcgacuacaccggcuacaucgagucccccaacuaccccggcgacuaccccgccaacgccgagugcgucuggcacaucgcccccccccccaagcgccgcauccucaucgucguccccgagaucuuccuccccaucgaggacgagugcggcgacguccucgucaugcgcaaguccgccucccccaccuccaucaccaccuacgagaccugccagaccuacgagcgccccaucgccuucaccucccgcucccgcaagcucuggauccaguucaaguccaacgagggcaacuccggcaagggcuuccagguccccuacgucaccuacgacgaggacuaccagcagcucaucgaggacaucguccgcgacggccgccucuacgccuccgagaaccaccaggagauccucaaggacaagaagcucaucaaggcccucuucgacguccucgcccacccccagaacuacuucaaguacaccgcccaggaguccaaggagauguucccccgcuccuucaucaagcuccuccgcuccaaggucucccgcuuccuccgccccuacaaguga

SEQ ID NO: 49192 - RNA, 2424 nt, Artificial Sequence
  derived and/or modified sequence opt2 from SCUBE2__Homo_sapiens__NP_001164161
augggcgucgccggccgcaaccgccccggcgccgccugggccguccuccuccuccuccuccuccuccccccccuccuccuccucgccggcgccgucccccccggccgcggccgcgccgccggcccccaggaggacgucgacgagugcgcccagggccucgacgacugccacgccgacgcccucugccagaacacccccaccuccuacaagugcuccugcaagcccggcuaccagggcgagggccgccagugcgaggacaucgacgagugcggcaacgagcucaacggcggcugcguccacgacugccucaacauccccggcaacuaccgcugcaccugcuucgacggcuucaugcucgcccacgacggccacaacugccucgacgucgacgagugccucgagaacaacggcggcugccagcacaccugcgucaacgucaugggcuccuacgagugcugcugcaaggagggcuucuuccucuccgacaaccagcacaccugcauccaccgcuccgaggagggccucuccugcaugaacaaggaccacggcugcucccacaucugcaaggaggccccccgcggcuccgucgccugcgagugccgccccggcuucgagcucgccaagaaccagcgcgacugcauccucaccugcaaccacggcaacggcggcugccagcacuccugcgacgacaccgccgacggccccgagugcuccugccacccccaguacaagaugcacaccgacggccgcuccugccucgagcgcgaggacaccguccucgaggucaccgaguccaacaccaccuccgucgucgacggcgacaagcgcgucaagcgccgccuccucauggagaccugcgccgucaacaacggcggcugcgaccgcaccugcaaggacaccuccaccggcguccacugcuccugccccgucggcuucacccuccagcucgacggcaagaccugcaaggacaucgacgagugccagacccgcaacggcggcugcgaccacuucugcaagaacaucgucggcuccuucgacugcggcugcaagaagggcuucaagcuccucaccgacgagaaguccugccaggacgucgacgagugcucccucgaccgcaccugcgaccacuccugcaucaaccaccccggcaccuucgccugcgccugcaaccgcggcuacacccucuacggcuucacccacugcggcgacaccaacgagugcuccaucaacaacggcggcugccagcaggucugcgucaacaccgucggcuccuacgagugccagugccaccccggcuacaagcuccacuggaacaagaaggacugcgucgccuccugcgaccucuccugcaucgucaagcgcaccgagaagcgccuccgcaaggccauccgcacccuccgcaaggccguccaccgcgagcaguuccaccuccagcucuccggcaugaaccucgacgucgccaagaagcccccccgcaccuccgagcgccaggccgaguccugcggcgucggccagggccacgccgagaaccagugcgucuccugccgcgccggcaccuacuacgacggcgcccgcgagcgcugcauccucugccccaacggcaccuuccagaacgaggagggccagaugaccugcgagcccugcccccgccccggcaacuccggcgcccucaagacccccgaggccuggaacauguccgagugcggcggccucugccagcccggcgaguacuccgccgacggcuucgcccccugccagcucugcgcccucggcaccuuccagcccgaggccggccgcaccuccugcuuccccugcggcggcggccucgccaccaagcaccagggcgccaccuccuuccaggacugcgagacccgcguccagugcucccccggccacuucuacaacaccaccacccaccgcugcauccgcugccccgucggcaccuaccagcccgaguucggcaagaacaacugcgucuccugccccggcaacaccaccaccgacuucgacggcuccaccaacaucacccagugcaagaccuccuccaacuccgucaccaccuacgagaccugccagaccuacgagcgccccaucgccuucaccucccgcuccaagaagcucuggauccaguucaaguccaacgagggcaacuccgcccgcggcuuccagguccccuacgucaccuacgacgaggacuaccaggagcucaucgaggacaucguccgcgacggccgccucuacgccuccgagaaccaccaggagauccucaaggacaagaagcucaucaaggcccucuucgacguccucgcccacccccagaacuacuucaaguacaccgcccaggagucccgcgagauguucccccgcuccuucauccgccuccuccgcuccaaggucucccgcuuccuccgccccuacaaguga

SEQ ID NO: 49193 - RNA, 2982 nt, Artificial Sequence
  derived and/or modified sequence opt2 from SCUBE3__Homo_sapiens__NP_689966
augggcuccggccgcguccccggccucugccuccucguccuccucguccacgcccgcgccgcccaguacuccaaggccgcccaggacgucgacgagugcgucgagggcaccgacaacugccacaucgacgccaucugccagaacaccccccgcuccuacaagugcaucugcaaguccggcuacaccggcgacggcaagcacugcaaggacgucgacgagugcgagcgcgaggacaacgccggcugcguccacgacugcgucaacauccccggcaacuaccgcugcaccugcuacgacggcuuccaccucgcccacgacggccacaacugccucgacgucgacgagugcgccgagggcaacggcggcugccagcaguccugcgucaacaugaugggcuccuacgagugccacugccgcgagggcuucuuccucuccgacaaccagcacaccugcauccagcgccccgaggagggcaugaacugcaugaacaagaaccacggcugcgcccacaucugccgcgagacccccaagggcggcaucgccugcgagugccgccccggcuucgagcucaccaagaaccagcgcgacugcaagcucaccugcaacuacggcaacggcggcugccagcacaccugcgacgacaccgagcagggcccccgcugcggcugccacaucaaguucguccuccacaccgacggcaagaccugcaucgagaccugcgccgucaacaacggcggcugcgacuccaagugccacgacgccgccaccggcguccacugcaccugccccgucggcuucaugcuccagcccgaccgcaagaccugcaaggacaucgacgagugccgccucaacaacggcggcugcgaccacaucugccgcaacaccgucggcuccuucgagugcuccugcaagaagggcuacaagcuccucaucaacgagcgcaacugccaggacaucgacgagugcuccuucgaccgcaccugcgaccacaucugcgucaacacccccggcuccuuccagugccucugccaccgcggcuaccuccucuacggcaucacccacugcggcgacgucgacgagugcuccaucaaccgcggcggcugccgcuucggcugcaucaacacccccggcuccuaccagugcaccugccccgccggccagggccgccuccacuggaacggcaaggacugcaccgagccccucaagugccagggcucccccggcgccuccaaggccaugcucuccugcaaccgcuccggcaagaaggacaccugcgcccucaccugccccucccgcgcccgcuuccuccccgaguccgagaacggcuucaccgucuccugcggcacccccuccccccgcgccgcccccgcccgcgccggccacaacggcaacuccaccaacuccaaccacugccacgaggccgccguccucuccaucaagcagcgcgccuccuucaagaucaaggacgccaagugccgccuccaccuccgcaacaagggcaagaccgaggaggccggccgcaucaccggccccggcggcgcccccugcuccgagugccaggucaccuucauccaccucaagugcgacuccucccgcaagggcaagggccgccgcgcccgcaccccccccggcaaggaggucacccgccucacccucgagcucgaggccgagguccgcgccgaggagaccaccgccuccugcggccuccccugccuccgccagcgcauggagcgccgccucaagggcucccucaagaugcuccgcaaguccaucaaccaggaccgcuuccuccuccgccucgccggccucgacuacgagcucgcccacaagcccggccucgucgccggcgagcgcgccgagcccauggaguccugccgccccggccagcaccgcgccggcaccaagugcgucuccugcccccagggcaccuacuaccacggccagaccgagcagugcguccccugccccgccggcaccuuccaggagcgcgagggccagcucuccugcgaccucugccccggcuccgacgcccacggcccccucggcgccaccaacgucaccaccugcgccggccagugcccccccggccagcacuccgucgacggcuucaagcccugccagcccugcccccgcggcaccuaccagcccgaggccggccgcacccucugcuuccccugcggcggcggccucaccaccaagcacgagggcgccaucuccuuccaggacugcgacaccaagguccagugcucccccggccacuacuacaacaccuccauccaccgcugcauccgcugcgccaugggcuccuaccagcccgacuuccgccagaacuucugcucccgcugccccggcaacaccuccaccgacuucgacggcuccaccuccgucgcccagugcaagaaccgccagugcggcggcgagcucggcgaguucaccggcuacaucgagucccccaacuaccccggcaacuaccccgccggcgucgagugcaucuggaacaucaaccccccccccaagcgcaagauccucaucgucguccccgagaucuuccuccccuccgaggacgagugcggcgacguccucgucaugcgcaagaacuccucccccuccuccaucaccaccuacgagaccugccagaccuacgagcgccccaucgccuucaccgcccgcucccgcaagcucuggaucaacuucaagaccuccgaggccaacuccgcccgcggcuuccagauccccuacgucaccuacgacgaggacuacgagcagcucgucgaggacaucguccgcgacggccgccucuacgccuccgagaaccaccaggagauccucaaggacaagaagcucaucaaggccuucuucgagguccucgcccacccccagaacuacuucaaguacaccgagaagcacaaggagaugcuccccaaguccuucaucaagcuccuccgcuccaaggucuccuccuuccuccgccccuacaaguga

SEQ ID NO: 49194 - RNA, 2376 nt, Artificial Sequence
  derived and/or modified sequence opt2 from SCYL1__Homo_sapiens__NP_001041683
augugguucuucgcccgcgaccccguccgcgacuuccccuucgagcucauccccgagccccccgagggcggccuccccggccccugggcccuccaccgcggccgcaagaaggccaccggcucccccgucuccaucuucgucuacgacgucaagcccggcgccgaggagcagacccaggucgccaaggccgccuucaagcgcuucaagacccuccgccaccccaacauccucgccuacaucgacggccucgagaccgagaagugccuccacgucgucaccgaggccgucaccccccucggcaucuaccucaaggcccgcgucgaggccggcggccucaaggagcucgagaucuccuggggccuccaccagaucgucaaggcccucuccuuccucgucaacgacugcucccucauccacaacaacgucugcauggccgccgucuucgucgaccgcgccggcgaguggaagcucggcggccucgacuacauguacuccgcccagggcaacggcggcggccccccccgcaagggcauccccgagcucgagcaguacgacccccccgagcucgccgacuccuccggccgcgucguccgcgagaagugguccgccgacauguggcgccucggcugccucaucugggaggucuucaacggcccccucccccgcgccgccgcccuccgcaaccccggcaagauccccaagacccucgucccccacuacugcgagcucgucggcgccaaccccaagguccgccccaaccccgcccgcuuccuccagaacugccgcgcccccggcggcuucauguccaaccgcuucgucgagaccaaccucuuccucgaggagauccagaucaaggagcccgccgagaagcagaaguucuuccaggagcucuccaagucccucgacgccuuccccgaggacuucugccgccacaagguccucccccagcuccucaccgccuucgaguucggcaacgccggcgccgucguccucaccccccucuucaaggucggcaaguuccucuccgccgaggaguaccagcagaagaucauccccgucgucgucaagauguucuccuccaccgaccgcgccaugcgcauccgccuccuccagcagauggagcaguucauccaguaccucgacgagcccaccgucaacacccagaucuucccccacgucguccacggcuuccucgacaccaaccccgccauccgcgagcagaccgucaaguccaugcuccuccucgcccccaagcucaacgaggccaaccucaacgucgagcucaugaagcacuucgcccgccuccaggccaaggacgagcagggccccauccgcugcaacaccaccgucugccucggcaagaucggcuccuaccucuccgccuccacccgccaccgcguccucaccuccgccuucucccgcgccacccgcgaccccuucgcccccucccgcgucgccggcguccucggcuucgccgccacccacaaccucuacuccaugaacgacugcgcccagaagauccuccccguccucugcggccucaccgucgaccccgagaaguccguccgcgaccaggccuucaaggccauccgcuccuuccucuccaagcucgaguccgucuccgaggaccccacccagcucgaggaggucgagaaggacguccacgccgccuccucccccggcaugggcggcgccgccgccuccugggccggcugggccgucaccggcgucuccucccucaccuccaagcucauccgcucccaccccaccaccgcccccaccgagaccaacaucccccagcgccccacccccgagggccacugggagacccaggaggaggacaaggacaccgccgaggacuccuccaccgccgaccgcugggacgacgaggacuggggcucccucgagcaggaggccgaguccguccucgcccagcaggacgacugguccaccggcggccaggucucccgcgccucccaggucuccaacuccgaccacaaguccuccaagucccccgaguccgacugguccuccugggaggccgagggcuccugggagcagggcuggcaggagcccuccucccaggagcccccccccgacggcacccgccucgccuccgaguacaacuggggcggccccgaguccuccgacaagggcgaccccuucgccacccucuccgcccgccccuccacccagccccgccccgacuccuggggcgaggacaacugggagggccucgagaccgacucccgccaggucaaggccgagcucgcccgcaagaagcgcgaggagcgccgccgcgagauggaggccaagcgcgccgagcgcaaggucgccaagggccccaugaagcucggcgcccgcaagcucgacuga

SEQ ID NO: 49195 - RNA, 2067 nt, Artificial Sequence
  derived and/or modified sequence opt2 from SCYL3__Homo_sapiens__NP_065156
augggcuccgagaacuccgcccucaaguccuacacccuccgcgagccccccuucacccuccccuccggccucgccgucuaccccgccguccuccaggacggcaaguucgccuccgucuucgucuacaagcgcgagaacgaggacaaggucaacaaggccgccaagcaccucaagacccuccgccaccccugccuccuccgcuuccucuccugcaccgucgaggccgacggcauccaccucgucaccgagcgcguccagccccucgaggucgcccucgagacccucuccuccgccgaggucugcgccggcaucuacgacauccuccucgcccucaucuuccuccacgaccgcggccaccucacccacaacaacgucugccucuccuccgucuucgucuccgaggacggccacuggaagcucggcggcauggagaccgucugcaaggucucccaggccacccccgaguuccuccgcuccauccaguccauccgcgaccccgccuccaucccccccgaggagaugucccccgaguucaccacccuccccgagugccacggccacgcccgcgacgccuucuccuucggcacccucgucgagucccuccucaccauccucaacgagcaggucuccgccgacguccucuccuccuuccagcagacccuccacuccacccuccucaaccccauccccaagugccgccccgcccucugcacccuccucucccacgacuucuuccgcaacgacuuccucgaggucgucaacuuccucaagucccucacccucaaguccgaggaggagaagaccgaguucuucaaguuccuccucgaccgcgucuccugccucuccgaggagcucaucgccucccgccucgucccccuccuccucaaccagcucgucuucgccgagcccgucgccgucaaguccuuccuccccuaccuccucggccccaagaaggaccacgcccagggcgagacccccugccuccucucccccgcccucuuccagucccgcgucauccccguccuccuccagcucuucgagguccacgaggagcacguccgcaugguccuccucucccacaucgaggccuacgucgagcacuucacccaggagcagcucaagaaggucauccucccccagguccuccucggccuccgcgacaccuccgacuccaucgucgccaucacccuccacucccucgccguccucgucucccuccucggccccgaggucgucgucggcggcgagcgcaccaagaucuucaagcgcaccgcccccuccuucaccaagaacaccgaccucucccucgagggcgaccccuucucccagcccaucaaguuccccaucaacggccucuccgacgucaagaacaccuccgaggacuccgagaacuuccccuccuccuccaagaaguccgaggaguggcccgacugguccgagcccgaggagcccgagaaccagaccgucaacauccagaucuggccccgcgagcccugcgacgacgucaagucccagugcaccacccucgacgucgaggaguccuccugggacgacugcgagcccuccucccucgacaccaaggucaaccccggcggcggcaucaccgccaccaagcccgucaccuccggcgagcagaagcccauccccgcccuccucucccucaccgaggaguccaugcccuggaaguccucccucccccagaagaucucccucguccagcgcggcgacgacgccgaccagaucgagccccccaaggucuccucccaggagcgcccccucaagguccccuccgagcucggccucggcgaggaguucaccauccaggucaagaagaagcccgucaaggaccccgagauggacugguucgccgacaugauccccgagaucaagcccuccgccgccuuccucauccuccccgagcuccgcaccgagaugguccccaagaaggacgacgucucccccgucaugcaguucuccuccaaguucgccgccgccgagaucaccgagggcgaggccgagggcugggaggaggagggcgagcucaacugggaggacaacaacugguga

SEQ ID NO: 49196 - RNA, 933 nt, Artificial Sequence
  derived and/or modified sequence opt2 from SDC1__Homo_sapiens__NP_001006947
augcgccgcgccgcccucuggcucuggcucugcgcccucgcccucucccuccagcccgcccucccccagaucgucgccaccaaccucccccccgaggaccaggacggcuccggcgacgacuccgacaacuucuccggcuccggcgccggcgcccuccaggacaucacccucucccagcagacccccuccaccuggaaggacacccagcuccucaccgccauccccaccucccccgagcccaccggccucgaggccaccgccgccuccaccuccacccuccccgccggcgagggccccaaggagggcgaggccgucguccuccccgaggucgagcccggccucaccgcccgcgagcaggaggccaccccccgcccccgcgagaccacccagcuccccaccacccaccaggccuccaccaccaccgccaccaccgcccaggagcccgccaccucccacccccaccgcgacaugcagcccggccaccacgagaccuccacccccgccggccccucccaggccgaccuccacaccccccacaccgaggacggcggccccuccgccaccgagcgcgccgccgaggacggcgccuccucccagcuccccgccgccgagggcuccggcgagcaggacuucaccuucgagaccuccggcgagaacaccgccgucgucgccgucgagcccgaccgccgcaaccagucccccgucgaccagggcgccaccggcgccucccagggccuccucgaccgcaaggagguccucggcggcgucaucgccggcggccucgucggccucaucuucgccgucugccucgucggcuucaugcucuaccgcaugaagaagaaggacgagggcuccuacucccucgaggagcccaagcaggccaacggcggcgccuaccagaagcccaccaagcaggaggaguucuacgccuga

SEQ ID NO: 49197 - RNA, 606 nt, Artificial Sequence
  derived and/or modified sequence opt2 from SDC2__Homo_sapiens__NP_002989
augcgccgcgccuggauccuccucacccucggccucgucgccugcgucuccgccgagucccgcgccgagcucaccuccgacaaggacauguaccucgacaacuccuccaucgaggaggccuccggcgucuaccccaucgacgacgacgacuacgccuccgccuccggcuccggcgccgacgaggacgucgagucccccgagcucaccaccucccgcccccuccccaagauccuccucaccuccgccgcccccaaggucgagaccaccacccucaacauccagaacaagauccccgcccagaccaagucccccgaggagaccgacaaggagaagguccaccucuccgacuccgagcgcaagauggaccccgccgaggaggacaccaacgucuacaccgagaagcacuccgacucccucuucaagcgcaccgagguccucgccgccgucaucgccggcggcgucaucggcuuccucuucgccaucuuccucauccuccuccucgucuaccgcaugcgcaagaaggacgagggcuccuacgaccucggcgagcgcaagcccuccuccgccgccuaccagaaggcccccaccaaggaguucuacgccuga

SEQ ID NO: 49198 - RNA, 1332 nt, Artificial Sequence
  derived and/or modified sequence opt2 from SDC3__Homo_sapiens__XP_011540764
augcccacccagaugcucuucccccuccacggccucuuccucuacuccuccgucaacuccuacaccuccuccaagacccagcaccgcugccuccuccucugggaguccaacaacgaccccuccuaccagccccccuccaccgcccagcgcuggcgcuccgagaacuucgagcgccccgucgaccucgagggcuccggcgacgacgacuccuuccccgacgacgagcucgacgaccucuacuccggcuccggcuccggcuacuucgagcaggaguccggcaucgagaccgccaugcgcuucucccccgacgucgcccucgccgucuccaccacccccgccguccuccccaccaccaacauccagcccgucggcacccccuucgaggagcuccccuccgagcgccccacccucgagcccgccaccuccccccucgucgucaccgagguccccgaggagcccucccagcgcgccaccaccgucuccaccaccauggccaccaccgccgccaccuccaccggcgaccccaccgucgccaccguccccgccaccgucgccaccgccacccccuccacccccgccgccccccccuucaccgccaccaccgccgucauccgcaccaccggcguccgccgccuccucccccucccccucaccaccgucgccaccgcccgcgccaccacccccgaggcccccuccccccccaccaccgccgccguccucgacaccgaggcccccaccccccgccucgucuccaccgccaccucccgcccccgcgcccucccccgccccgccaccacccaggagcccgacauccccgagcgcuccacccucccccucggcaccaccgcccccggccccaccgaggucgcccagacccccacccccgagaccuuccucaccaccauccgcgacgagcccgagguccccgucuccggcggccccuccggcgacuucgagcuccccgaggaggagaccacccagcccgacaccgccaacgaggucgucgccgucggcggcgccgccgccaaggccuccuccccccccggcacccuccccaagggcgcccgccccggccccggccuccucgacaacgccaucgacuccggcuccuccgccgcccagcucccccagaaguccauccucgagcgcaaggagguccucgucgccgucaucgucggcggcgucgucggcgcccucuucgccgccuuccucgucacccuccucaucuaccgcaugaagaagaaggacgagggcuccuacacccucgaggagcccaagcaggccuccgucaccuaccagaagcccgacaagcaggaggaguucuacgccuga

SEQ ID NO: 49199 - RNA, 597 nt, Artificial Sequence
  derived and/or modified sequence opt2 from SDC4__Homo_sapiens__NP_002990
auggcccccgcccgccucuucgcccuccuccucuucuucgucggcggcgucgccgaguccauccgcgagaccgaggucaucgacccccaggaccuccucgagggccgcuacuucuccggcgcccuccccgacgacgaggacgucgucggccccggccaggaguccgacgacuucgagcucuccggcuccggcgaccucgacgaccucgaggacuccaugaucggccccgaggucguccacccccucgucccccucgacaaccacauccccgagcgcgccggcuccggcucccagguccccaccgagcccaagaagcucgaggagaacgaggucauccccaagcgcaucucccccgucgaggaguccgaggacgucuccaacaaggucuccauguccuccaccguccagggcuccaacaucuucgagcgcaccgagguccucgccgcccucaucgucggcggcaucgucggcauccucuucgccgucuuccucauccuccuccucauguaccgcaugaagaagaaggacgagggcuccuacgaccucggcaagaagcccaucuacaagaaggcccccaccaacgaguucuacgccuga

SEQ ID NO: 49200 - RNA, 879 nt, Artificial Sequence
  derived and/or modified sequence opt2 from SDCBP2__Homo_sapiens__NP_001186713
auguccucccucuaccccucccucgaggaccucaaggucgaccaggccauccaggcccagguccgcgccucccccaagaugcccgcccuccccguccaggccaccgccaucucccccccccccguccucuaccccaaccucgccgagcucgagaacuacaugggccucucccucuccucccaggagguccaggagucccuccuccagauccccgagggcgacuccaccgccgucuccggccccggccccggccagauggucgcccccgucaccggcuacucccucggcguccgccgcgccgagaucaagcccggcguccgcgagauccaccucugcaaggacgagcgcggcaagaccggccuccgccuccgcaaggucgaccagggccucuucguccagcucguccaggccaacacccccgccucccucgucggccuccgcuucggcgaccagcuccuccagaucgacggccgcgacugcgccggcugguccucccacaaggcccaccaggucgucaagaaggccuccggcgacaagaucgucgucgucguccgcgaccgccccuuccagcgcaccgucaccaugcacaaggacuccaugggccacgucggcuucgucaucaagaagggcaagaucgucucccucgucaagggcuccuccgccgcccgcaacggccuccucaccaaccacuacgucugcgaggucgacggccagaacgucaucggccucaaggacaagaagaucauggagauccucgccaccgccggcaacgucgucacccucaccaucauccccuccgucaucuacgagcacauggucaagaagcucccccccguccuccuccaccacaccauggaccacuccauccccgacgccuga

SEQ ID NO: 49201 - RNA, 879 nt, Artificial Sequence
  derived and/or modified sequence opt2 from SDCBP__Homo_sapiens__NP_001007069
augucccucuaccccucccucgaggaccucaaggcccagaccgccuucuccgccaaccccgccaaccccgccauccucuccgaggccuccgcccccaucccccacgacggcaaccucuacccccgccucuaccccgagcucucccaguacaugggccucucccucaacgaggaggagauccgcgccaacgucgccgucgucuccggcgccccccuccagggccagcucgucgcccgccccuccuccaucaacuacauggucgcccccgucaccggcaacgacgucggcauccgccgcgccgagaucaagcagggcauccgcgaggucauccucugcaaggaccaggacggcaagaucggccuccgccucaaguccaucgacaacggcaucuucguccagcucguccaggccaacucccccgccucccucgucggccuccgcuucggcgaccagguccuccagaucaacggcgagaacugcgccggcugguccuccgacaaggcccacaagguccucaagcaggccuucggcgagaagaucaccaugaccauccgcgaccgccccuucgagcgcaccaucaccaugcacaaggacuccaccggccacgucggcuucaucuucaagaacggcaagaucaccuccaucgucaaggacuccuccgccgcccgcaacggccuccucaccgagcacaacaucugcgagaucaacggccagaacgucaucggccucaaggacucccagaucgccgacauccucuccaccuccggcaccgucgucaccaucaccaucaugcccgccuucaucuucgagcacaucaucaagcgcauggcccccuccaucaugaagucccucauggaccacaccauccccgaggucuga

SEQ ID NO: 49202 - RNA, 1308 nt, Artificial Sequence
  derived and/or modified sequence opt2 from SDCCAG3__Homo_sapiens__NP_001034796
auguccggcuaccagcgccgccccggcgccaccccccucucccgcgcccgcucccucgccauccccgacgcccccgccuucuacgagcgccgcuccugccucccccagcucaacugcgagcgcccccacggccgcgaccucgacucccccuucuucggcauccgccccgccuucaugugcuacguccccucccccguccucgccuccgucggcgacaccgacuucggcuacggcaagggcaagugcuccaagcagucccccuccggcgcccacggcacccacuucggcgacgaccgcuucgaggaccucgaggaggccaaccccuucuccuuccgcgaguuccucaagaccaagaaccucggccucuccaaggaggaccccgccucccgcaucuacgccaaggaggccucccgccacucccucggccucgaccacaacuccccccccucccagaccggcggcuacggccucgaguaccagcagcccuucuucgaggaccccaccggcgccggcgaccuccucgacgaggaggaggacgaggacaccggcugguccggcgccuaccuccccuccgccaucgagcagacccaccccgagcgcguccccgccggcaccucccccugcuccaccuaccucuccuucuucuccacccccuccgagcucgccggccccgagucccuccccuccugggcccucuccgacaccgacucccgcgucucccccgccucccccgccggcucccccuccgccgacuucgccguccacggcgagucccucggcgaccgccaccuccgcacccuccagaucuccuacgacgcccucaaggacgagaacuccaagcuccgccgcaagcucaacgagguccaguccuucuccgaggcccagaccgagaugguccgcacccucgagcgcaagcucgaggccaagaugaucaaggaggaguccgacuaccacgaccucgaguccgucguccagcaggucgagcagaaccucgagcucaugaccaagcgcgccgucaaggccgagaaccacgucgucaagcucaagcaggagaucucccuccuccaggcccaggucuccaacuuccagcgcgagaacgaggcccuccgcugcggccagggcgccucccucaccgucgucaagcagaacgccgacgucgcccuccagaaccuccgcgucgucaugaacuccgcccaggccuccaucaagcagcucgucuccggcgccgagacccucaaccucgucgccgagauccucaaguccaucgaccgcaucuccgaggucaaggacgaggaggaggacuccuga

SEQ ID NO: 49203 - RNA, 2142 nt, Artificial Sequence
  derived and/or modified sequence opt2 from SDCCAG8__Homo_sapiens__NP_006633
auggccaagucccccgagaacuccacccucgaggagauccucggccaguaccagcgcucccuccgcgagcacgccucccgcuccauccaccagcucaccugcgcccucaaggagggcgacgucaccaucggcgaggacgcccccaaccucuccuucuccaccuccgucggcaacgaggacgcccgcaccgccuggcccgagcuccagcagucccacgccgucaaccagcucaaggaccuccuccgccagcaggccgacaaggaguccgaggucucccccucccgccgccgcaagauguccccccuccgcucccucgagcacgaggagaccaacaugcccaccaugcacgaccucguccacaccaucaacgaccagucccaguacauccaccaccucgaggccgaggucaaguucugcaaggaggagcucuccggcaugaagaacaagauccaggucgucguccucgagaacgagggccuccagcagcagcucaagucccagcgccaggaggagacccuccgcgagcagacccuccucgacgccuccggcaacaugcacaacuccuggaucaccaccggcgaggacuccggcgucggcgagaccuccaagcgccccuucucccacgacaacgccgacuucggcaaggccgccuccgccggcgagcagcucgagcucgagaagcucaagcucaccuacgaggagaagugcgagaucgaggagucccagcucaaguuccuccgcaacgaccucgccgaguaccagcgcaccugcgaggaccucaaggagcagcucaagcacaaggaguuccuccucgccgccaacaccugcaaccgcgucggcggccucugccucaagugcgcccagcacgaggccguccucucccagacccacaccaacguccacaugcagaccaucgagcgccucgucaaggagcgcgacgaccucauguccgcccucgucuccguccgcuccucccucgccgacacccagcagcgcgaggccuccgccuacgagcaggucaagcagguccuccagaucuccgaggaggccaacuucgagaagaccaaggcccucauccagugcgaccagcuccgcaaggagcucgagcgccaggccgagcgccucgagaaggagcucgccucccagcaggagaagcgcgccaucgagaaggacaugaugaagaaggagaucaccaaggagcgcgaguacaugggcuccaagaugcucauccucucccagaacaucgcccagcucgaggcccaggucgagaaggucaccaaggagaagaucuccgccaucaaccagcucgaggagauccagucccagcucgccucccgcgagauggacgucaccaaggucugcggcgagaugcgcuaccagcucaacaagaccaacauggagaaggacgaggccgagaaggagcaccgcgaguuccgcgccaagaccaaccgcgaccucgagaucaaggaccaggagaucgagaagcuccgcaucgagcucgacgaguccaagcagcaccucgagcaggagcagcagaaggccgcccucgcccgcgaggagugccuccgccucaccgagcuccucggcgaguccgagcaccagcuccaccucacccgccaggagaaggacuccauccagcaguccuucuccaaggaggccaaggcccaggcccuccaggcccagcagcgcgagcaggagcucacccagaagauccagcagauggaggcccagcacgacaagaccgagaacgagcaguaccuccuccucaccucccagaacaccuuccucaccaagcucaaggaggagugcugcacccucgccaagaagcucgagcagaucucccagaagacccgcuccgagaucgcccagcucucccaggagaagcgcuacaccuacgacaagcucggcaagcuccagcgccgcaacgaggagcucgaggagcagugcguccagcacggccgcguccacgagaccaugaagcagcgccuccgccagcucgacaagcacucccaggccaccgcccagcagcucguccagcuccucuccaagcagaaccagcuccuccucgagcgccagucccucuccgaggaggucgaccgccuccgcacccagcuccccuccaugccccaguccgacugcuga

SEQ ID NO: 49204 - RNA, 636 nt, Artificial Sequence
  derived and/or modified sequence opt2 from SDF2__Homo_sapiens__NP_008854
auggccgucgucccccuccuccuccucggcggccucugguccgccgucggcgccuccucccucggcgucgucaccugcggcuccgucgucaagcuccucaacacccgccacaacguccgccuccacucccacgacguccgcuacggcuccggcuccggccagcaguccgucaccggcgucaccuccgucgacgacuccaacuccuacuggcgcauccgcggcaaguccgccaccgucugcgagcgcggcacccccaucaagugcggccagcccauccgccucacccacgucaacaccggccgcaaccuccacucccaccacuucaccuccccccucuccggcaaccaggaggucuccgccuucggcgaggagggcgagggcgacuaccucgacgacuggaccguccucugcaacggccccuacuggguccgcgacggcgagguccgcuucaagcacuccuccaccgagguccuccucuccgucaccggcgagcaguacggccgccccaucuccggccagaaggagguccacggcauggcccagcccucccagaacaacuacuggaaggccauggagggcaucuucaugaagcccuccgagcuccucaaggccgaggcccaccacgccgagcucuga

SEQ ID NO: 49205 - RNA, 666 nt, Artificial Sequence
  derived and/or modified sequence opt2 from SDF2L1__Homo_sapiens__NP_071327
augugguccgccggccgcggcggcgccgccuggcccguccuccucggccuccuccucgcccuccucguccccggcggcggcgccgccaagaccggcgccgagcucgucaccugcggcuccguccucaagcuccucaacacccaccaccgcguccgccuccacucccacgacaucaaguacggcuccggcuccggccagcaguccgucaccggcgucgaggccuccgacgacgccaacuccuacuggcgcauccgcggcggcuccgagggcggcugcccccgcggcucccccguccgcugcggccaggccguccgccucacccacguccucaccggcaagaaccuccacacccaccacuuccccuccccccucuccaacaaccaggaggucuccgccuucggcgaggacggcgagggcgacgaccucgaccucuggaccguccgcugcuccggccagcacugggagcgcgaggccgccguccgcuuccagcacgucggcaccuccgucuuccucuccgucaccggcgagcaguacggcucccccauccgcggccagcacgagguccacggcaugcccuccgccaacacccacaacaccuggaaggccauggagggcaucuucaucaagcccuccgucgagcccuccgccggccacgacgagcucuga

SEQ ID NO: 49206 - RNA, 609 nt, Artificial Sequence
  derived and/or modified sequence opt2 from SDF4__Homo_sapiens__XP_011539858
auggucuggcccugggucgccauggccucccgcuggggcccccucaucggccucgcccccugcugccucuggcuccucggcgccguccuccucauggacgccuccgcccgccccgccaaccacuccuccacccgcgagcgcgucgccaaccgcgaggagaacgagauccucccccccgaccaccucaacggcgucaagcucgagauggacggccaccucaaccgcggcuuccaccaggaggucuuccucggcaaggaccucggcggcuucgacgaggacgccgagccccgccgcucccgccgcaagcucauggucaucuucuccaaggucgacgucaacaccgaccgcaagaucuccgccaaggagaugcagcgcuggaucauggagaagaccgccgagcacuuccaggaggccauggaggaguccaagacccacuuccgcgccgucgaccccgacggcgacggccacgucuccugggacgaguacaaggucaaguuccucgccuccaagggccacuccgagaaggaggucgccgacgccauccgccucaacgaggagcucaaggucgacgaggagcgccacggcccccccggcccccgcgcccucuga

SEQ ID NO: 49207 - RNA, 348 nt, Artificial Sequence
  derived and/or modified sequence opt2 from SDHAF1__Homo_sapiens__NP_001036096
augucccgccacucccgccuccagcgccagguccucucccucuaccgcgaccuccuccgcgccggccgcggcaagcccggcgccgaggcccgcguccgcgccgaguuccgccagcacgccggccucccccgcuccgacguccuccgcaucgaguaccucuaccgccgcggccgccgccagcuccagcuccuccgcuccggccacgccaccgccaugggcgccuucguccgcccccgcgcccccaccggcgagcccggcggcgucggcucccagcccgacgacggcgacuccccccgcaacccccacgacuccaccggcgcccccgagacccgccccgacggccgcuga

SEQ ID NO: 49208 - RNA, 501 nt, Artificial Sequence
  derived and/or modified sequence opt2 from SDHAF2__Homo_sapiens__NP_060311
auggccgucuccaccgucuucuccaccuccucccucaugcucgcccucucccgccacucccuccucuccccccuccucuccgucaccuccuuccgccgcuucuaccgcggcgacucccccaccgacucccagaaggacaugaucgagaucccccucccccccuggcaggagcgcaccgacgaguccaucgagaccaagcgcgcccgccuccucuacgagucccgcaagcgcggcaugcucgagaacugcauccuccucucccucuucgccaaggagcaccuccagcacaugaccgagaagcagcucaaccucuacgaccgccucaucaacgagcccuccaacgacugggacaucuacuacugggccaccgaggccaagcccgcccccgagaucuucgagaacgaggucauggcccuccuccgcgacuucgccaagaacaagaacaaggagcagcgccuccgcgcccccgaccucgaguaccucuucgagaagccccgcuga

SEQ ID NO: 49209 - RNA, 327 nt, Artificial Sequence
  derived and/or modified sequence opt2 from SDHAF4__Homo_sapiens__NP_660310
augacccccucccgccuccccuggcuccucuccugggucuccgccaccgccuggcgcgccgcccgcuccccccuccucugccacucccuccgcaagaccuccuccucccagggcggcaaguccgagcucgucaagcagucccucaagaagcccaagcuccccgagggccgcuucgacgcccccgaggacucccaccucgagaaggagccccucgagaaguuccccgacgacgucaaccccgucaccaaggagaagggcggcccccgcggccccgagcccacccgcuacggcgacugggagcgcaagggccgcugcaucgacuucuga

SEQ ID NO: 49210 - RNA, 1851 nt, Artificial Sequence
  derived and/or modified sequence opt2 from SDHA__Homo_sapiens__NP_001281261
auguccggcguccgcggccucucccgccuccucuccgcccgccgccucgcccucgccaaggccuggcccaccguccuccagaccggcacccgcggcuuccacuucaccgucgacggcaacaagcgcgccuccgccaaggucuccgacuccaucuccgcccaguaccccgucgucgaccacgaguucgacgccgucgucgucggcgccggcggcgccggccuccgcgccgccuucggccucuccgaggccggcuucaacaccgccugcgucaccaagcucuuccccacccgcucccacaccgucgccgcccagcucgagaacuacggcaugcccuucucccgcaccgaggacggcaagaucuaccagcgcgccuucggcggccagucccucaaguucggcaagggcggccaggcccaccgcugcugcugcgucgccgaccgcaccggccacucccuccuccacacccucuacggccgcucccuccgcuacgacaccuccuacuucgucgaguacuucgcccucgaccuccucauggagaacggcgagugccgcggcgucaucgcccucugcaucgaggacggcuccauccaccgcauccgcgccaagaacaccgucgucgccaccggcggcuacggccgcaccuacuucuccugcaccuccgcccacaccuccaccggcgacggcaccgccaugaucacccgcgccggccuccccugccaggaccucgaguucguccaguuccaccccaccggcaucuacggcgccggcugccucaucaccgagggcugccgcggcgagggcggcauccucaucaacucccagggcgagcgcuucauggagcgcuacgcccccgucgccaaggaccucgccucccgcgacgucgucucccgcuccaugacccucgagauccgcgagggccgcggcugcggccccgagaaggaccacgucuaccuccagcuccaccaccucccccccgagcagcucgccacccgccuccccggcaucuccgagaccgccaugaucuucgccggcgucgacgucaccaaggagcccauccccguccuccccaccguccacuacaacaugggcggcauccccaccaacuacaagggccagguccuccgccacgucaacggccaggaccagaucguccccggccucuacgccugcggcgaggccgccugcgccuccguccacggcgccaaccgccucggcgccaacucccuccucgaccucgucgucuucggccgcgccugcgcccucuccaucgaggaguccugccgccccggcgacaaggucccccccaucaagcccaacgccggcgaggaguccgucaugaaccucgacaagcuccgcuucgccgacggcuccauccgcaccuccgagcuccgccucuccaugcagaaguccaugcagaaccacgccgccgucuuccgcgucggcuccguccuccaggagggcugcggcaagaucuccaagcucuacggcgaccucaagcaccucaagaccuucgaccgcggcauggucuggaacaccgaccucgucgagacccucgagcuccagaaccucaugcucugcgcccuccagaccaucuacggcgccgaggcccgcaaggagucccgcggcgcccacgcccgcgaggacuacaagguccgcaucgacgaguacgacuacuccaagcccauccagggccagcagaagaagcccuucgaggagcacuggcgcaagcacacccucuccuacgucgacgucggcaccggcaaggucacccucgaguaccgccccgucaucgacaagacccucaacgaggccgacugcgccaccgucccccccgccauccgcuccuacuga

SEQ ID NO: 49211 - RNA, 453 nt, Artificial Sequence
  derived and/or modified sequence opt2 from SDHC__Homo_sapiens__NP_001030588
auggccgcccuccuccuccgccacgucggccgccacugccuccgcgcccacuucuccccccagcucugcauccgcaacgccgucccccucggcaccaccgccaaggaggagauggagcgcuucuggaacaagaacaucggcuccaaccgcccccucuccccccacaucaccaucuacuccuggucccuccccauggccauguccaucugccaccgcggcaccggcaucgcccucuccgccgacgucggcccccgcaagcgccccgaggacucccccgccauccccgucugguccggcugccccggcuccuacugcgucguccucuacggcgccggcucccacgucaagaagggcggcucccagcaccaccuccccacccacuacuacauccaccccuccuucugccucuccuuccucucccccgccugggagaaguucucccucuucgucuga

SEQ ID NO: 49212 - RNA, 480 nt, Artificial Sequence
  derived and/or modified sequence opt2 from SDHD__Homo_sapiens__NP_002993
auggccguccucuggcgccucuccgccgucugcggcgcccucggcggccgcgcccuccuccuccgcacccccgucguccgccccgcccacaucuccgccuuccuccaggaccgccccauccccgaguggugcggcguccagcacauccaccucucccccucccaccacuccggcuccaaggccgccucccuccacuggaccuccgagcgcgucgucuccguccuccuccucggccuccuccccgccgccuaccucaaccccugcuccgccauggacuacucccucgccgccgcccucacccuccacggccacuggggccucggccaggucgucaccgacuacguccacggcgacgcccuccagaaggccgccaaggccggccuccucgcccucuccgcccucaccuucgccggccucugcuacuucaacuaccacgacgucggcaucugcaaggccgucgccaugcucuggaagcucuga

SEQ ID NO: 49213 - RNA, 6642 nt, Artificial Sequence
  derived and/or modified sequence opt2 from SDK1__Homo_sapiens__NP_689957
auggcccgcggcgcccgccccuccgccgccggcggcggcggcggcggcgccgagccccccgagcgcgccggccccggccgcccccgcggcuccccccccggccgcgcccgccccucccucgccccccgccccggccccgagcccucccgcccccgcgccgcccccgagaccuccggcggcgacaccgccggcgccggccgcugcggcggccgccgcgccgccaagcucggccccggccgccgcggcuggugggcccuccucgcccuccagcuccaccuccuccgcgcccucgcccaggacgacgucgcccccuacuucaagaccgagcccggccucccccagauccaccucgagggcaaccgccucguccucaccugccucgccgagggcuccuggccccucgaguucaaguggaugcgcgacgacuccgagcucaccaccuacuccuccgaguacaaguacaucauccccucccuccagaagcucgacgccggcuucuaccgcugcgucguccgcaaccgcaugggcgcccuccuccagcgcaaguccgagguccaggucgccuacaugggcuccuucauggacaccgaccagcgcaagaccgucucccagggccgcgccgccauccucaaccuccuccccaucaccuccuacccccgcccccaggucaccugguuccgcgagggccacaagaucauccccuccaaccgcaucgccaucacccucgagaaccagcucgucauccucgccaccaccaccuccgacgccggcgccuacuacguccaggccgucaacgagaagaacggcgagaacaagaccucccccuucauccaccucuccaucgcccgcgacgucggcacccccgagaccauggcccccaccaucgucgucccccccggcaaccgcuccgucgucgccggcuccuccgagaccacccucgagugcaucgccuccgcccgccccgucgaggaccucuccgucaccuggaagcgcaacggcguccgcaucaccuccggccuccacuccuucggccgccgccucaccaucuccaaccccaccuccgccgacaccggccccuacgucugcgaggccgcccuccccggcuccgccuucgagcccgcccgcgccaccgccuuccucuucaucaucgagccccccuacuucaccgccgagcccgagucccgcaucuccgccgaggucgaggagaccgucgacaucggcugccaggccaugggcgucccccuccccacccuccagugguacaaggacgccaucuccaucucccgccuccagaacccccgcuacaagguccucgccuccggcggccuccgcauccagaagcuccgccccgaggacuccggcaucuuccagugcuucgccuccaacgagggcggcgagauccagacccacaccuaccucgacgucaccaacaucgcccccgucuucacccagcgccccgucgacaccaccgucaccgacggcaugaccgccauccuccgcugcgaggucuccggcgcccccaagcccgccaucaccuggaagcgcgagaaccacauccucgccuccggcuccguccgcaucccccgcuucaugcuccucgaguccggcggccuccagaucgcccccgucuucauccaggacgccggcaacuacaccugcuacgccgccaacaccgagggcucccucaacgccuccgccacccucaccgucuggaaccgcaccuccaucguccacccccccgaggaccacgucgucaucaagggcaccaccgccacccuccacugcggcgccacccacgacccccgcgucucccuccgcuacgucuggaagaaggacaacgucgcccucacccccuccuccaccucccgcaucgucgucgagaaggacggcucccuccucaucucccagaccugguccggcgacaucggcgacuacuccugcgagaucgucuccgagggcggcaacgacucccgcauggcccgccucgaggucaucgagcucccccacuccccccagaaccuccucgucucccccaacuccucccacucccacgccgucguccucuccuggguccgccccuucgacggcaacucccccauccucuacuacaucgucgagcucuccgagaacaacucccccuggaagguccaccucuccaacgucggccccgagaugaccggcgucaccgucuccggccucacccccgcccgcaccuaccaguuccgcgucugcgccgucaacgaggucggccgcggccaguacuccgccgagaccucccgccucaugcuccccgaggagccccccuccgccccccccaagaacaucgucgccuccggccgcaccaaccaguccaucaugguccaguggcagcccccccccgagaccgagcacaacggcguccuccgcggcuacauccuccgcuaccgccucgccggccuccccggcgaguaccagcagcgcaacaucaccucccccgaggucaacuacugccucgucaccgaccucaucaucuggacccaguacgagauccaggucgccgccuacaacggcgccggccucggcgucuucucccgcgccgucaccgaguacacccuccagggcguccccaccgcccccccccagaacguccagaccgaggccgucaacuccaccaccauccaguuccucuggaacccccccccccagcaguucaucaacggcaucaaccagggcuacaagcuccucgccuggcccgccgacgcccccgaggccgucaccgucgucaccaucgcccccgacuuccacggcguccaccacggccacaucaccaaccucaagaaguucaccgccuacuucaccuccguccucugcuucaccacccccggcgacggcccccccuccaccccccagcucgucuggacccaggaggacaagcccggcgccgucggccaccucuccuucaccgagauccucgacaccucccucaaggucuccuggcaggagccccucgagaagaacggcaucaucaccggcuaccagaucuccugggaggucuacggccgcaacgacucccgccucacccacacccucaacuccaccacccacgaguacaagauccagggccucuccucccucaccaccuacaccaucgacgucgccgccgucaccgccgucggcaccggccucgucaccuccuccaccaucuccuccggcgucccccccgaccuccccggcgcccccuccaaccucgucaucuccaacaucuccccccgcuccgccacccuccaguuccgccccggcuacgacggcaagaccuccaucucccgcuggaucgucgagggccaggucggcgccaucggcgacgaggaggagugggucacccucuacgaggaggagaacgagcccgacgcccagaugcucgagauccccaaccucacccccuacacccacuaccgcuuccgcaugaagcaggucaacaucgucggccccucccccuacucccccuccucccgcgucauccagacccuccaggccccccccgacgucgcccccaccuccgucaccguccgcaccgccuccgagaccucccuccgccuccgcugggucccccuccccgacucccaguacaacggcaaccccgaguccgucggcuaccgcaucaaguacuggcgcuccgaccuccaguccuccgccgucgcccaggucgucuccgaccgccucgagcgcgaguucaccaucgaggagcucgaggaguggauggaguacgagcuccagaugcaggccuucaacgccgucggcgccggccccugguccgaggucguccgcggccgcacccgcgaguccguccccuccgccgcccccgagaacgucuccgccgaggccgucuccuccacccagauccuccucaccuggaccuccguccccgagcaggaccagaacggccucauccucggcuacaagauccucuuccgcgccaaggaccucgaccccgagccccgcucccacaucguccgcggcaaccacacccaguccgcccuccucgccggccuccgcaaguucguccucuacgagcuccagguccucgccuucacccgcaucggcaacggcguccccuccaccccccucauccucgagcgcaccaaggacgacgcccccggcccccccguccgccucgucuuccccgagguccgccucaccuccguccgcaucgucuggcagccccccgaggagcccaacggcaucauccucggcuaccagaucgccuaccgccucgccuccuccuccccccacaccuucaccaccgucgaggucggcgccaccguccgccaguucaccgccaccgaccucgcccccgaguccgccuacaucuuccgccucuccgccaagacccgccagggcuggggcgagccccucgaggccaccgucaucaccaccgagaagcgcgagcgccccgcccccccccgcgagcuccucgucccccaggccgaggucaccgcccgcucccuccgccuccaguggguccccggcuccgacggcgccucccccauccgcuacuucaccaugcagguccgcgagcucccccgcggcgaguggcagaccuacuccuccuccaucucccacgaggccaccgccugcgucgucgaccgccuccgccccuucaccuccuacaagcuccgccucaaggccaccaacgacaucggcgacuccgacuucuccuccgagaccgaggccgucaccacccuccaggacguccccggcgagccccccggcuccgucuccgccaccccccacaccaccuccuccguccucauccaguggcagcccccccgcgacgagucccucaacggccuccuccagggcuaccgcaucuacuaccgcgagcucgaguacgaggccggcuccggcaccgaggccaagacccucaagaaccccaucgcccuccacgccgagcucaccgcccaguccuccuucaagaccgucaacuccuccuccaccuccaccaugugcgagcucacccaccucaagaaguaccgccgcuacgaggucaucaugaccgccuacaacaucaucggcgagucccccgccuccgcccccgucgaggucuucgucggcgaggccgcccccgccauggccccccagaacguccaggucaccccccucaccgccucccagcucgaggucaccugggacccccccccccccgagucccagaacggcaacauccagggcuacaagaucuacuacugggaggccgacucccagaacgagaccgagaagaugaagguccucuuccuccccgagcccgucguccgccucaagaaccucaccucccacaccaaguaccucgucuccaucuccgccuucaacgccgccggcgacggccccaaguccgacccccagcagggccgcacccaccaggccgcccccggcgcccccuccuuccucgccuucuccgagaucaccuccaccacccucaacgucuccuggggcgagcccgccgccgccaacggcauccuccagggcuaccgcgucgucuacgagccccucgcccccguccagggcgucuccaaggucgucaccgucgagguccgcggcaacuggcagcgcuggcucaagguccgcgaccucaccaagggcgucaccuacuucuuccgcguccaggcccgcaccaucaccuacggccccgagcuccaggccaacaucaccgccggccccgccgagggcucccccggcuccccccgcgacguccucgucaccaaguccgccuccgagcucacccuccaguggaccgagggccacuccggcgacacccccaccaccggcuacgucaucgaggcccgccccuccgacgagggccucugggacauguucgucaaggacaucccccgcuccgccaccuccuacacccucucccucgacaagcuccgccagggcgucaccuacgaguuccgcgucgucgccgucaacgaggccggcuacggcgagcccuccaaccccuccaccgccgucuccgcccaggucgaggcccccuucuacgaggaguggugguuccuccucgucauggcccucuccucccucaucgucauccuccucgucgucuucgcccucguccuccacggccagaacaagaaguacaagaacugcuccaccggcaagggcaucuccaccauggaggaguccgucacccucgacaacggcggcuucgccgcccucgagcucuccucccgccaccucaacgucaaguccaccuucuccaagaagaacggcacccgcucccccccccgccccucccccggcggccuccacuacuccgacgaggacaucugcaacaaguacaacggcgccguccucaccgaguccgucucccucaaggagaaguccgccgacgccuccgaguccgaggccaccgacuccgacuacgaggacgcccuccccaagcacuccuucgucaaccacuacauguccgaccccaccuacuacaacuccuggaagcgccgcgcccagggccgcgcccccgccccccaccgcuacgaggccgucgccggcuccgaggccggcgcccagcuccaccccgucaucaccacccaguccgccggcggcgucuacacccccgccggccccggcgcccgcaccccccucaccggcuucuccuccuucgucuga

SEQ ID NO: 49214 - RNA, 6519 nt, Artificial Sequence
  derived and/or modified sequence opt2 from SDK2__Homo_sapiens__NP_001138424
auguggggccuccucaucuggacccuccucgcccuccaccagauccgcgccgcccgcgcccaggacgacgucucccccuacuucaagaccgagcccguccgcacccagguccaccucgagggcaaccgccucguccucaccugcauggccgagggcuccuggccccucgaguucaaguggcuccacaacaaccgcgagcucaccaaguucucccucgaguaccgcuacaugaucaccucccucgaccgcacccacgccggcuucuaccgcugcaucguccgcaaccgcaugggcgcccuccuccagcgccagaccgagguccaggucgccuacaugggcuccuucgaggagggcgagaagcaccaguccgucucccacggcgaggccgccgucauccgcgccccccgcaucgccuccuucccccagccccaggucaccugguuccgcgacggccgcaagaucccccccuccucccgcaucgccaucacccucgagaacacccucgucauccucuccaccgucgcccccgacgccggccgcuacuacguccaggccgucaacgacaagaacggcgacaacaagaccucccagcccaucacccucaccgucgagaacgucggcggccccgccgaccccaucgcccccaccaucaucaucccccccaagaacaccuccgucgucgccggcaccuccgaggucacccucgagugcgucgccaacgcccgcccccucaucaagcuccacaucaucuggaagaaggacggcguccuccucuccggcggcaucuccgaccacaaccgccgccucaccauccccaaccccaccggcuccgacgccggcuacuacgagugcgaggccguccuccgcuccuccuccguccccuccgucguccgcggcgccuaccucuccguccucgagcccccccaguucgucaaggagcccgagcgccacaucaccgccgagauggagaaggucgucgacauccccugccaggccaagggcguccccccccccuccaucaccugguacaaggacgccgccgucgucgaggucgagaagcucacccgcuuccgccagcgcaacgacggcggccuccagaucuccggccucguccccgacgacaccggcauguuccagugcuucgcccgcaacgccgccggcgagguccagaccuccaccuaccucgccgucaccuccaucgcccccaacaucacccgcggcccccucgacuccaccgucaucgacggcauguccgucguccucgccugcgagaccuccggcgccccccgccccgccaucaccuggcagaagggcgagcgcauccucgccuccggcuccguccagcucccccgcuucaccccccucgaguccggcucccuccucaucucccccacccacaucuccgacgccggcaccuacaccugccucgccaccaacucccgcggcgucgacgaggccuccgccgaccucgucgucugggcccgcacccgcaucaccaagcccccccaggaccaguccgucaucaagggcacccaggccuccauggucugcggcgucacccacgacccccgcgucaccauccgcuacaucugggagaaggacggcgccacccucggcaccgagucccacccccgcauccgccucgaccgcaacggcucccuccacaucucccagaccugguccggcgacaucggcaccuacaccugccgcgucaucuccgccggcggcaacgacucccgcuccgcccaccuccgcguccgccagcucccccacgcccccgagcaccccgucgccacccucuccaccgucgagcgccgcgccaucaaccucaccuggaccaagcccuucgacggcaacuccccccucauccgcuacauccucgagauguccgagaacaacgcccccuggaccguccuccucgccuccgucgaccccaaggccaccuccgucaccgucaagggccucguccccgcccgcuccuaccaguuccgccucugcgccgucaacgacgucggcaagggccaguucuccaaggacaccgagcgcgucucccuccccgaggagccccccaccgcccccccccagaacgucaucgccuccggccgcaccaaccaguccaucaugauccaguggcagcccccccccgagucccaccagaacggcauccucaagggcuacaucauccgcuacugccucgccggccuccccgucggcuaccaguucaagaacaucaccgacgccgacgucaacaaccuccuccucgaggaccucaucaucuggaccaacuacgagaucgaggucgccgccuacaacuccgccggccucggcgucuacuccuccaaggucaccgaguggacccuccagggcguccccaccgucccccccggcaacguccacgccgaggccaccaacuccaccaccauccgcuucaccuggaacgcccccuccccccaguucaucaacggcaucaaccagggcuacaagcucaucgccugggagcccgagcaggaggaggaggucaccauggucaccgcccgccccaacuuccaggacuccauccacgucggcuucgucuccggccucaagaaguucaccgaguacuucaccuccguccucugcuucaccacccccggcgacggcccccgcuccaccccccagcucguccgcacccacgaggacguccccggccccgucggccaccucuccuucuccgagauccucgacaccucccucaaggucuccuggcaggagcccggcgagaagaacggcauccucaccggcuaccgcaucuccugggaggaguacaaccgcaccaacacccgcgucacccacuaccuccccaacgucacccucgaguaccgcgucaccggccucaccgcccucaccaccuacaccaucgaggucgccgccaugaccuccaagggccagggccaggucuccgccuccaccaucuccuccggcgucccccccgagcuccccggcccccccaccaaccucggcaucuccaacaucggcccccgcuccgucacccuccaguuccgccccggcuacgacggcaagaccuccaucucccgcuggcucgucgaggcccaggucggcgucgucggcgagggcgaggaguggcuccucauccaccagcucuccaacgagcccgacgcccgcuccauggagguccccgaccucaaccccuucaccugcuacuccuuccgcaugcgccaggucaacaucgucggcaccuccccccccucccagcccucccgcaagauccagacccuccaggccccccccgacauggcccccgccaacgucucccuccgcaccgccuccgagaccucccucuggcuccgcuggaugccccuccccgagauggaguacaacggcaaccccgaguccgucggcuacaagaucaaguacucccgcuccgacggccacggcaagacccucucccacgucguccaggaccgcgucgagcgcgacuacaccaucgaggaccucgaggaguggaccgaguaccgcguccagguccaggccuucaacgccaucggcuccggccccuggucccagaccgucgucggccgcacccgcgaguccguccccuccuccggccccaccaacgucuccgcccucgccaccaccuccuccuccaugcucguccgcugguccgagguccccgaggccgaccgcaacggccucguccucggcuacaaggucauguacaaggagaaggacuccgacacccagccccgcuucuggcucgucgagggcaacuccucccgcuccgcccagcucaccggccucggcaaguacguccucuacgagguccagguccucgccuucacccgcaucggcgacggcucccccucccacccccccauccucgagcgcacccucgacgacguccccggcccccccaugggcauccucuuccccgagguccgcaccaccuccguccgccucaucuggcagccccccgccgcccccaacggcaucauccucgccuaccagaucacccaccgccucaacaccaccaccgccaacaccgccaccgucgagguccucgcccccuccgcccgccaguacaccgccaccggccucaagcccgaguccgucuaccucuuccgcaucaccgcccagacccgcaagggcuggggcgaggccgccgaggcccucgucgucaccaccgagaagcgcgaccgcccccagccccccucccgccccaugguccagcaggaggacguccgcgcccgcuccguccuccucuccugggagcccggcuccgacggccucucccccguccgcuacuacaccauccagacccgcgagcuccccuccggccgcugggcccuccacuccgccuccgucucccacaacgccuccuccuucaucgucgaccgccucaagcccuucaccuccuacaaguuccgcgucaaggccaccaacgacaucggcgacuccgaguucuccgaggaguccgagucccucaccacccuccaggccgcccccgacgaggcccccaccauccucuccgucaccccccacaccaccaccuccguccucauccgcuggcagccccccgccgaggacaagaucaacggcauccuccucggcuuccgcauccgcuaccgcgagcuccucuacgagggccuccgcggcuucacccuccgcggcaucaacaaccccggcgccaccugggccgagcucaccuccauguacuccaugcgcaaccucucccgccccucccucacccaguacgagcucgacaaccucaacaagcaccgccgcuacgagauccgcauguccgucuacaacgccgucggcgagggccccuccucccccccccaggaggucuucgucggcgaggccguccccaccgccgccccccgcaacgucgucguccacggcgccaccgccacccagcucgacgucaccugggagccccccccccucgacucccagaacggcgacauccagggcuacaagaucuacuucugggaggcccagcgcggcaaccucaccgagcgcgucaagacccucuuccucgccgagaacuccgucaagcucaagaaccucaccggcuacaccgccuacauggucuccgucgccgccuucaacgccgccggcgacggcccccgcuccacccccacccagggccagacccagcaggccgcccccuccgcccccuccuccgucaaguucuccgagcucaccaccaccuccgucaacgucuccugggaggccccccaguuccccaacggcauccucgagggcuaccgccucgucuacgagcccugcucccccgucgacggcgucuccaagaucgucaccgucgacgucaagggcaacuccccccucuggcucaaggucaaggaccucgccgagggcgucaccuaccgcuuccgcauccgcgccaagaccuucaccuacggccccgagaucgaggccaacgucaccaccggccccggcgagggcgcccccggcccccccggcguccccaucaucguccgcuacuccuccgccaucgccauccacugguccuccggcgaccccggcaagggccccaucacccgcuacgucaucgaggcccgccccuccgacgagggccucugggacauccucaucaaggacauccccaaggaggucuccuccuacaccuucuccauggacauccucaagcccggcgucuccuacgacuuccgcgucaucgccgucaacgacuacggcuucggcacccccuccucccccucccaguccguccccgcccagaaggccaaccccuucuacgaggaguggugguuccucgucgucaucgcccucgucggccucaucuucauccuccuccucgucuucguccucaucauccgcggccaguccaagaaguacgccaagaagaccgacuccggcaacuccgccaaguccggcgcccucggccacuccgagaugaugucccucgacgaguccuccuuccccgcccucgagcucaacaaccgccgccucuccgucaagaacuccuucugccgcaagaacggccucuacacccgcucccccccccgccccucccccggcucccuccacuacuccgacgaggacgucaccaaguacaacgaccucauccccgccgaguccuccucccucaccgagaagcccuccgagaucuccgacucccagggcuccgacuccgaguacgaggucgacuccaaccaccagaaggcccacuccuucgucaaccacuacaucuccgaccccaccuacuacaacuccuggcgccgccagcagaagggcaucucccgcgcccaggccuacuccuacaccgaguccgacuccggcgagcccgaccacaccaccgucaccaacuccaccuccacccagcagggcucccucuuccgccccaaggccucccgcacccccaccccccagaacccccccaacccccccucccagcaguccacccucuaccgcccccccuccucccucgcccccggcucccgcgcccccaucgccggcuucuccuccuucgucuga

SEQ ID NO: 49215 - RNA, 1278 nt, Artificial Sequence
  derived and/or modified sequence opt2 from SDPR__Homo_sapiens__NP_004648
augggcgaggacgccgcccaggccgagaaguuccagcaccccggcuccgacaugcgccaggagaagcccuccucccccucccccaugcccuccuccacccccucccccucccucaaccucggcaacaccgaggaggccauccgcgacaacucccaggucaacgccgucaccguccucacccuccucgacaagcucgucaacaugcucgacgccguccaggagaaccagcacaagauggagcagcgccagaucucccucgagggcuccgucaagggcauccagaacgaccucaccaagcucuccaaguaccaggccuccaccuccaacaccgucuccaagcuccucgagaagucccgcaaggucuccgcccacacccgcgccgucaaggagcgcauggaccgccagugcgcccaggucaagcgccucgagaacaaccacgcccagcuccuccgccgcaaccacuucaagguccucaucuuccaggaggagaacgagauccccgccuccgucuucgucaagcagcccgucuccggcgccgucgagggcaaggaggagcuccccgacgagaacaagucccucgaggagacccuccacaccgucgaccucuccuccgacgacgaccucccccacgacgaggaggcccucgaggacuccgccgaggagaaggucgaggagucccgcgccgagaagaucaagcgcuccucccucaagaaggucgacucccucaagaaggccuucucccgccagaacaucgagaagaagaugaacaagcucggcaccaagaucgucuccgucgagcgccgcgagaagaucaagaagucccucaccuccaaccaccagaagaucuccuccggcaaguccucccccuucaaggucuccccccucaccuucggccgcaagaagguccgcgagggcgagucccacgccgagaacgagaccaaguccgaggaccuccccuccuccgagcagaugcccaacgaccaggaggaggaguccuucgccgagggccacuccgaggccucccucgccuccgcccucgucgagggcgagaucgccgaggaggccgccgagaaggccaccucccgcggcuccaacuccggcauggacuccaacaucgaccucaccaucgucgaggacgaggaggaggaguccgucgcccucgagcaggcccagaagguccgcuacgagggcuccuacgcccucaccuccgaggaggccgagcgcuccgacggcgaccccguccagcccgccguccuccagguccaccagaccuccuga

SEQ ID NO: 49216 - RNA, 1182 nt, Artificial Sequence
  derived and/or modified sequence opt2 from SDR42E1__Homo_sapiens__XP_011521772
auggaccccaagcgcucccagaaggaguccguccucaucaccggcggcuccggcuacuucggcuuccgccucggcugcgcccucaaccagaacggcguccacgucauccucuucgacaucuccucccccgcccagaccauccccgagggcaucaaguucauccagggcgacauccgccaccucuccgacgucgagaaggccuuccaggacgccgacgucaccugcgucuuccacaucgccuccuacggcauguccggccgcgagcagcucaaccgcaaccucaucaaggaggucaacguccgcggcaccgacaacauccuccaggucugccagcgccgccgcgucccccgccucgucuacaccuccaccuucaacgucaucuucggcggccaggucauccgcaacggcgacgagucccuccccuaccucccccuccaccuccaccccgaccacuacucccgcaccaaguccaucgccgagcagaagguccucgaggccaacgccaccccccucgaccgcggcgacggcguccuccgcaccugcgcccuccgccccgccggcaucuacggccccggcgagcagcgccaccucccccgcaucgucuccuacaucgagaagggccucuucaaguucgucuacggcgacccccgcucccucgucgaguucguccacgucgacaaccucguccaggcccacauccucgccuccgaggcccuccgcgccgacaagggccacaucgccuccggccagcccuacuucaucuccgacggccgccccgucaacaacuucgaguucuuccgcccccucgucgagggccucggcuacaccuuccccuccacccgccucccccucacccucgucuacugcuucgccuuccucaccgagaugguccacuucauccucggccgccucuacaacuuccagcccuuccucacccgcaccgaggucuacaagaccggcgucacccacuacuucucccucgagaaggccaagaaggagcucggcuacaaggcccagcccuucgaccuccaggaggccgucgagugguucaaggcccacggccacggccgcuccuccggcucccgcgacuccgagugcuucgucugggacggccuccucgucuuccuccucaucaucgccguccucauguggcuccccuccuccgucauccucucccucuga

SEQ ID NO: 49217 - RNA, 942 nt, Artificial Sequence
  derived and/or modified sequence opt2 from SDR9C7__Homo_sapiens__NP_683695
auggccgcccucaccgaccucuccuucauguaccgcugguucaagaacugcaaccucgucggcaaccucuccgagaaguacgucuucaucaccggcugcgacuccggcuucggcaaccuccucgccaagcagcucgucgaccgcggcaugcagguccucgccgccugcuucaccgaggagggcucccagaagcuccagcgcgacaccuccuaccgccuccagaccacccuccucgacgucaccaaguccgaguccaucaaggccgccgcccaguggguccgcgacaaggucggcgagcagggccucugggcccucgucaacaacgccggcgucggccuccccuccggccccaacgaguggcucaccaaggacgacuucgucaaggucaucaacgucaaccucgucggccucaucgaggucacccuccacaugcuccccauggucaagcgcgcccgcggccgcgucgucaacauguccuccuccggcggccgcgucgccgucaucggcggcggcuacugcgucuccaaguucggcgucgaggccuucuccgacuccauccgccgcgagcucuacuacuucggcgucaaggucugcaucaucgagcccggcaacuaccgcaccgccauccucggcaaggagaaccucgagucccgcaugcgcaagcucugggagcgccucccccaggagacccgcgacuccuacggcgaggacuacuuccgcaucuacaccgacaagcucaagaacaucaugcaggucgccgagccccgcguccgcgacgucaucaacuccauggagcacgccaucgucucccgcuccccccgcauccgcuacaaccccggccucgacgccaagcuccucuacaucccccucgccaagcuccccacccccgucaccgacuucauccucucccgcuaccucccccgccccgccgacuccgucuga

SEQ ID NO: 49218 - RNA, 987 nt, Artificial Sequence
  derived and/or modified sequence opt2 from SDS__Homo_sapiens__NP_006834
augauguccggcgagccccuccacgucaagacccccauccgcgacuccauggcccucuccaagauggccggcaccuccgucuaccucaagauggacuccgcccagcccuccggcuccuucaagauccgcggcaucggccacuucugcaagcgcugggccaagcagggcugcgcccacuucgucugcuccuccgccggcaacgccggcauggccgccgccuacgccgcccgccagcucggcguccccgccaccaucgucguccccuccaccacccccgcccucaccaucgagcgccucaagaacgagggcgccaccgucaaggucgucggcgagcuccucgacgaggccuucgagcucgccaaggcccucgccaagaacaaccccggcugggucuacaucccccccuucgacgacccccucaucugggagggccacgccuccaucgucaaggagcucaaggagacccucugggagaagcccggcgccaucgcccucuccgucggcggcggcggccuccucugcggcgucguccagggccuccaggaggucggcuggggcgacguccccgucaucgccauggagaccuucggcgcccacuccuuccacgccgccaccaccgccggcaagcucgucucccuccccaagaucaccuccgucgccaaggcccucggcgucaagaccgucggcgcccaggcccucaagcucuuccaggagcaccccaucuucuccgaggucaucuccgaccaggaggccgucgccgccaucgagaaguucgucgacgacgagaagauccucgucgagcccgccugcggcgccgcccucgccgccgucuacucccacgucauccagaagcuccagcucgagggcaaccuccgcaccccccuccccucccucgucgucaucgucugcggcggcuccaacaucucccucgcccagcuccgcgcccucaaggagcagcucggcaugaccaaccgccuccccaaguga

SEQ ID NO: 49219 - RNA, 462 nt, Artificial Sequence
  derived and/or modified sequence opt2 from SEC11A__Homo_sapiens__NP_001258847
augaucgucuccuccgcccucaugaucuggaagggccucauggucaucaccggcuccgagucccccaucgucgucguccucuccggcuccauggagcccgccuuccaccgcggcgaccuccucuuccucaccaaccgcgucgaggaccccauccgcgucggcgagaucgucgucuuccgcaucgagggccgcgagauccccaucguccaccgcguccucaagauccacgagaagcagaacggccacaucaaguuccucaccaagggcgacaacaacgccgucgacgaccgcggccucuacaagcagggccagcacuggcucgagaagaaggacgucgucggccgcgcccgcggcuucguccccuacaucggcaucgucaccauccucaugaacgacuaccccaaguucaaguacgccguccucuuccuccucggccucuucguccucguccaccgcgaguga

SEQ ID NO: 49220 - RNA, 579 nt, Artificial Sequence
  derived and/or modified sequence opt2 from SEC11C__Homo_sapiens__NP_150596
augguccgcgccggcgccgucggcgcccaccuccccgccuccggccucgacaucuucggcgaccucaagaagaugaacaagcgccagcucuacuaccagguccucaacuucgccaugaucgucuccuccgcccucaugaucuggaagggccucaucguccucaccggcuccgagucccccaucgucgucguccucuccggcuccauggagcccgccuuccaccgcggcgaccuccucuuccucaccaacuuccgcgaggaccccauccgcgccggcgagaucgucgucuucaaggucgagggccgcgacauccccaucguccaccgcgucaucaagguccacgagaaggacaacggcgacaucaaguuccucaccaagggcgacaacaacgaggucgacgaccgcggccucuacaaggagggccagaacuggcucgagaagaaggacgucgucggccgcgcccgcggcuuccuccccuacgucggcauggucaccaucaucaugaacgacuaccccaaguucaaguacgcccuccucgccgucaugggcgccuacguccuccucaagcgcgaguccuga

SEQ ID NO: 49221 - RNA, 1107 nt, Artificial Sequence
  derived and/or modified sequence opt2 from SEC13__Homo_sapiens__NP_001129498
augcgcgagcccguccucaccuggugcgucccccucgagcuccucugcucccacccccucccccucuccgccuuccucaagucccaggucaagcucuacaccuaccgcgccugcgccggcaaggacgagaugggcaagauggucuccgucaucaacaccgucgacaccucccacgaggacaugauccacgacgcccagauggacuacuacggcacccgccucgccaccugcuccuccgaccgcuccgucaagaucuucgacguccgcaacggcggccagauccucaucgccgaccuccgcggccacgagggccccgucuggcaggucgccugggcccaccccauguacggcaacauccucgccuccugcuccuacgaccgcaaggucaucaucuggcgcgaggagaacggcaccugggagaagucccacgagcacgccggccacgacuccuccgucaacuccgucugcugggccccccacgacuacggccucauccucgccugcggcuccuccgacggcgccaucucccuccucaccuacaccggcgagggccagugggaggucaagaagaucaacaacgcccacaccaucggcugcaacgccgucuccugggcccccgccgucguccccggcucccucaucgaccaccccuccggccagaagcccaacuacaucaagcgcuucgccuccggcggcugcgacaaccucaucaagcucuggaaggaggaggaggacggccaguggaaggaggagcagaagcucgaggcccacuccgacuggguccgcgacgucgccugggcccccuccaucggccuccccaccuccaccaucgccuccugcucccaggacggccgcgucuucaucuggaccugcgacgacgccuccuccaacaccuggucccccaagcuccuccacaaguucaacgacgucgucuggcacgucuccugguccaucaccgccaacauccucgccgucuccggcggcgacaacaaggucacccucuggaaggaguccgucgacggccagugggucugcaucuccgacgucaacaagggccagggcuccgucuccgccuccgucaccgagggccagcagaacgagcaguga

SEQ ID NO: 49222 - RNA, 2148 nt, Artificial Sequence
  derived and/or modified sequence opt2 from SEC14L1__Homo_sapiens__NP_001137470
augguccagaaguaccagucccccguccgcgucuacaaguaccccuucgagcucaucauggccgccuacgagcgccgcuuccccaccugcccccucauccccauguucgucggcuccgacaccgucaacgaguucaaguccgaggacggcgccauccacgucaucgagcgccgcugcaagcucgacgucgacgccccccgccuccucaagaagaucgccggcgucgacuacgucuacuucguccagaagaacucccucaacucccgcgagcgcacccuccacaucgaggccuacaacgagaccuucuccaaccgcgucaucaucaacgagcacugcugcuacaccguccaccccgagaacgaggacuggaccugcuucgagcaguccgccucccucgacaucaaguccuucuucggcuucgaguccaccgucgagaagaucgccaugaagcaguacaccuccaacaucaagaagggcaaggagaucaucgaguacuaccuccgccagcucgaggaggagggcaucaccuucgucccccgcugguccccccccuccaucacccccuccuccgagaccuccuccuccuccuccaagaagcaggccgccuccauggccgucgucauccccgaggccgcccucaaggagggccucuccggcgacgcccucuccucccccuccgcccccgagcccgucgucggcacccccgacgacaagcucgacgccgacuacaucaagcgcuaccucggcgaccucaccccccuccaggaguccugccucauccgccuccgccaguggcuccaggagacccacaagggcaagauccccaaggacgagcacauccuccgcuuccuccgcgcccgcgacuucaacaucgacaaggcccgcgagaucaugugccagucccucaccuggcgcaagcagcaccaggucgacuacauccucgagaccuggacccccccccagguccuccaggacuacuacgccggcggcuggcaccaccacgacaaggacggccgcccccucuacguccuccgccucggccagauggacaccaagggccucguccgcgcccucggcgaggaggcccuccuccgcuacguccucuccaucaacgaggagggccuccgccgcugcgaggagaacaccaaggucuucggccgccccaucuccuccuggaccugccucgucgaccucgagggccucaacaugcgccaccucuggcgccccggcgucaaggcccuccuccgcaucaucgaggucgucgaggccaacuaccccgagacccucggccgccuccucauccuccgcgccccccgcgucuuccccguccucuggacccucgucucccccuucaucgacgacaacacccgccgcaaguuccucaucuacgccggcaacgacuaccagggccccggcggccuccucgacuacaucgacaaggagaucauccccgacuuccucuccggcgagugcaugugcgagguccccgagggcggccucguccccaagucccucuaccgcaccgccgaggagcucgagaacgaggaccucaagcucuggaccgagaccaucuaccaguccgccuccgucuucaagggcgccccccacgagauccucauccagaucgucgacgccuccuccgucaucaccugggacuucgacgucugcaagggcgacaucgucuucaacaucuaccacuccaagcgcuccccccagccccccaagaaggacucccucggcgcccacuccaucaccucccccggcggcaacaacguccagcucaucgacaaggucuggcagcucggccgcgacuacuccauggucgaguccccccucaucugcaaggagggcgaguccguccagggcucccacgucacccgcuggcccggcuucuacauccuccaguggaaguuccacuccaugcccgccugcgccgccuccucccucccccgcgucgacgacguccucgccucccuccaggucuccucccacaagugcaaggucauguacuacaccgaggucaucggcuccgaggacuuccgcggcuccaugaccucccucgaguccucccacuccggcuucucccagcucuccgccgccaccaccuccuccucccagucccacuccuccuccaugaucucccgcuga

SEQ ID NO: 49223 - RNA, 963 nt, Artificial Sequence
  derived and/or modified sequence opt2 from SEC14L2__Homo_sapiens__NP_001191133
auguccggccgcgucggcgaccucuccccccgccagaaggaggcccucgccaaguuccgcgagaacguccaggacguccuccccgcccuccccaaccccgacgacuacuuccuccuccgcuggcuccgcgcccgcuccuucgaccuccagaaguccgaggccaugcuccgcaagcucggccgcaaggucgagaccaucaccaucaucuacgacugcgagggccucggccucaagcaccucuggaagcccgccgucgaggccuacggcgaguuccucugcauguucgaggagaacuaccccgagacccucaagcgccucuucgucgucaaggcccccaagcucuuccccgucgccuacaaccucaucaagcccuuccucuccgaggacacccgcaagaagaucaugguccucggcgccaacuggaaggagguccuccucaagcacaucucccccgaccagguccccgucgaguacggcggcaccaugaccgaccccgacggcaaccccaagugcaaguccaagaucaacuacggcggcgacaucccccgcaaguacuacguccgcgaccaggucaagcagcaguacgagcacuccguccagaucucccgcggcuccucccaccaggucgaguacgagauccucuuccccggcugcguccuccgcuggcaguucauguccgacggcgccgacgucggcuucggcaucuuccucaagaccaagaugggcgagcgccagcgcgccggcgagaugaccgagguccuccccaaccagcgcuacaacucccaccucguccccgaggacggcacccucaccugcuccgaccccggcaucuacguccuccgcuucgacaacaccuacuccuucauccacgccaagaaggucaacuucaccgucgagguccuccuccccgacaaggccuccgaggagaagaugaagcagcucggcgccggcacccccaaguga

SEQ ID NO: 49224 - RNA, 972 nt, Artificial Sequence
  derived and/or modified sequence opt2 from SEC14L3__Homo_sapiens__NP_001244307
auggucauccagaaguacaugcccggcggccucugcggcuacgaccgcgacggcugccccgucugguacgacaucaucggcccccucgaccccaagggccuccucuucuccgucaccaagcaggaccuccucaagaccaagaugcgcgacugcgagcgcauccuccacgagugcgaccuccagaccgagcgccucggcaagaagaucgagaccaucgucaugaucuucgacugcgagggccucggccucaagcacuucuggaagccccucgucgaggucuaccaggaguucuucggccuccucgaggagaacuaccccgagacccucaaguucaugcucaucgucaaggccaccaagcucuuccccgucggcuacaaccucaugaagcccuuccucuccgaggacacccgccgcaagaucaucguccucggcaacaacuggaaggagggccuccucaagcucaucucccccgaggagcuccccgcccaguucggcggcacccucaccgaccccgacggcaaccccaagugccucaccaagaucaacuacggcggcgagauccccaaguccauguacguccgcgaccaggucaagacccaguacgagcacuccguccagaucaaccgcggcuccucccaccaggucgaguacgagauccucuuccccggcugcguccuccgcuggcaguucuccuccgacggcgccgacaucggcuucggcgucuuccucaagaccaagaugggcgagcgccagcgcgccggcgagaugaccgacguccuccccucccagcgcuacaacgcccacaugguccccgaggacggcaaccucaccugcuccgaggccggcgucuacguccuccgcuucgacaacaccuacuccuucguccacgccaagaaggucuccuucaccgucgagguccuccuccccgacgagggcaugcagaaguacgacaaggagcucacccccgucuga

SEQ ID NO: 49225 - RNA, 3183 nt, Artificial Sequence
  derived and/or modified sequence opt2 from SEC16B__Homo_sapiens__NP_149118
auggagcucugggccccccagcgccucccccagacccgcggcaaggccaccgcccccuccaaggaccccgaccgcggcuuccgccgcgacggccaccaccgccccgucccccacuccuggcacaacggcgagcgcuuccaccaguggcaggacaaccgcggcuccccccagccccagcaggagccccgcgccgaccaccagcagcagccccacuacgccucccgccccggcgacuggcaccagcccgucuccggcgucgacuacuacgagggcggcuaccgcaaccagcucuacucccgccccggcuacgagaacuccuaccaguccuaccagucccccaccaugcgcgaggaguacgccuacggcuccuacuacuaccacggccacccccaguggcuccaggaggagcgcgucccccgccagcgcucccccuacaucuggcacgaggacuaccgcgagcagaaguaccucgacgagcaccacuacgagaaccagcacucccccuucggcaccaacuccgagacccacuuccaguccaacucccgcaaccccugcaaggacucccccgccuccaacuccggccaggaguggcccggcgagcucuuccccggcucccuccucgccgaggcccagaagaacaagcccucccucgccuccgaguccaaccuccuccagcagcgcgaguccggccucuccuccuccuccuacgagcucucccaguacauccgcgacgcccccgagcgcgacgacccccccgccuccgccgccuggucccccguccaggccgacgucuccuccgccggccccaaggcccccaugaaguucuacaucccccacguccccgucuccuucggccccggcggccagcucguccacgucggccccuccucccccaccgacggccaggccgcccucgucgagcuccacuccauggaggucauccucaacgacuccgaggagcaggaggagaugcgcuccuucuccggcccccucauccgcgaggacguccacaaggucgacaucaugaccuucugccagcagaaggccgcccaguccugcaaguccgagacccucggcucccgcgacuccgcccuccucuggcagcuccucguccuccucugccgccagaacggcuccauggucggcuccgacaucgccgagcuccucaugcaggacugcaagaagcucgagaaguacaagcgccagccccccgucgccaaccucaucaaccucaccgacgaggacuggcccguccucuccuccggcacccccaaccuccucaccggcgagaucccccccuccgucgagacccccgcccagaucgucgagaaguucacccgccuccucuacuacggccgcaagaaggaggcccucgagugggccaugaagaaccaccucuggggccacgcccucuuccucuccuccaagauggacccccagaccuacuccugggucauguccggcuucaccuccacccucgcccucaacgacccccuccagacccucuuccagcucauguccggccgcaucccccaggccgccaccugcugcggcgagaagcaguggggcgacuggcgcccccaccucgccgucauccucuccaaccaggccggcgaccccgagcucuaccagcgcgccaucgucgccaucggcgacacccucgccggcaagggccucgucgaggccgcccacuucugcuaccucauggcccacguccccuucggccacuacaccgucaagaccgaccaccucguccuccucggcuccucccacucccaggaguuccucaaguucgccaccaccgaggccauccagcgcaccgagaucuucgaguacugccagaugcucggccgccccaaguccuucauccccuccuuccaggucuacaagcuccucuacgccucccgccucgccgacuacggccucgucucccaggcccuccacuacugcgaggccaucggcgccgccguccucucccagggcgaguccucccaccccguccuccucgucgagcucaucaagcucgccgagaagcucaagcucuccgacccccucguccucgagcgccgcuccggcgaccgcgaccucgagcccgacuggcucgcccagcuccgccgccagcucgagcagaaggucgccggcgacaucggcgacccccaccccacccgcuccgacaucuccggcgccggcggcaccaccaccgagaacaccuucuaccaggacuucuccggcugccagggcuacuccgaggcccccggcuaccgcuccgcccucuggcucacccccgagcagaccugccuccuccagcccuccccccagcagcccuucccccuccagcccggcuccuaccccgccggcggcggcgccggccagaccggcaccccccgccccuucuacuccguccccgagacccaccuccccggcaccggcuccuccgucgccgucaccgaggccaccggcggcaccgucugggaggagaugcuccagacccaccucggccccggcgagaacaccgucucccaggagaccucccagccccccgacggccaggaggucaucuccaagccccagaccccccucgccgcccgcccccgcuccaucuccgaguccuccgccuccuccgccaaggaggacgagaaggaguccuccgacgaggccgacaagaacuccccccgcaacaccgcccagcgcggcaagcucggcgacggcaaggagcacaccaaguccuccggcuucggcugguucuccugguuccgcuccaagcccaccaagaacgccucccccgccggcgacgaggacuccuccgacucccccgacuccgaggagaccccccgcgccuccuccccccaccaggccggccucggccucucccucacccccucccccgagucccccccccuccccgacgucuccgccuucucccgcggccgcggcggcggcgagggccgcggcuccgccuccuccggcggcgccgccgccggcgccggcgucggcggccucuccggccccgaguccgucuccuucgagcucugcuccaaccccggcguccuccuccccccccccgcccucaagggcgccgucccccucuacaaccccucccaggucccccagcuccccaccgccaccucccucaaccgccccaaccgccucgcccagcgccgcuaccccacccagcccugcuga

SEQ ID NO: 49226 - RNA, 2298 nt, Artificial Sequence
  derived and/or modified sequence opt2 from SEC23A__Homo_sapiens__NP_006355
augaccaccuaccucgaguucauccagcagaacgaggagcgcgacggcguccgcuucuccuggaacgucuggcccuccucccgccucgaggccacccgcauggucguccccgucgccgcccucuucaccccccucaaggagcgccccgaccucccccccauccaguacgagcccguccucugcucccgcaccaccugccgcgccguccucaacccccucugccaggucgacuaccgcgccaagcucugggccugcaacuucugcuaccagcgcaaccaguucccccccuccuacgccggcaucuccgagcucaaccagcccgccgagcuccucccccaguucuccuccaucgaguacgucguccuccgcggcccccagaugccccucaucuuccucuacgucgucgacaccugcauggaggacgaggaccuccaggcccucaaggaguccaugcagaugucccucucccuccucccccccaccgcccucgucggccucaucaccuucggccgcaugguccagguccacgagcucggcugcgagggcaucuccaaguccuacgucuuccgcggcaccaaggaccucuccgccaagcagcuccaggagaugcucggccucuccaaggucccccucacccaggccacccgcggcccccagguccagcagcccccccccuccaaccgcuuccuccagcccguccagaagaucgacaugaaccucaccgaccuccucggcgagcuccagcgcgaccccuggcccgucccccagggcaagcgcccccuccgcuccuccggcgucgcccucuccaucgccgucggccuccucgagugcaccuuccccaacaccggcgcccgcaucaugauguucaucggcggccccgccacccagggccccggcauggucgucggcgacgagcucaagacccccauccgcuccuggcacgacaucgacaaggacaacgccaaguacgucaagaagggcaccaagcacuucgaggcccucgccaaccgcgccgccaccaccggccacgucaucgacaucuacgccugcgcccucgaccagaccggccuccucgagaugaagugcugccccaaccucaccggcggcuacauggucaugggcgacuccuucaacaccucccucuucaagcagaccuuccagcgcgucuucaccaaggacaugcacggccaguucaagaugggcuucggcggcacccucgagaucaagaccucccgcgagaucaagaucuccggcgccaucggccccugcgucucccucaacuccaagggccccugcgucuccgagaacgagaucggcaccggcggcaccugccaguggaagaucugcggccucucccccaccaccacccucgccaucuacuucgaggucgucaaccagcacaacgcccccaucccccagggcggccgcggcgccauccaguucgucacccaguaccagcacuccuccggccagcgccgcauccgcgucaccaccaucgcccgcaacugggccgacgcccagacccagauccagaacaucgccgccuccuucgaccaggaggccgccgccauccucauggcccgccucgccaucuaccgcgccgagaccgaggagggccccgacguccuccgcuggcucgaccgccagcucauccgccucugccagaaguucggcgaguaccacaaggacgaccccuccuccuuccgcuucuccgagaccuucucccucuacccccaguucauguuccaccuccgccgcuccuccuuccuccaggucuucaacaacucccccgacgaguccuccuacuaccgccaccacuucaugcgccaggaccucacccagucccucaucaugauccagcccauccucuacgccuacuccuucuccggcccccccgagcccguccuccucgacuccuccuccauccucgccgaccgcauccuccucauggacaccuucuuccagauccucaucuaccacggcgagaccaucgcccaguggcgcaaguccggcuaccaggacaugcccgaguacgagaacuuccgccaccuccuccaggcccccgucgacgacgcccaggagauccuccacucccgcuuccccaugccccgcuacaucgacaccgagcacggcggcucccaggcccgcuuccuccucuccaaggucaaccccucccagacccacaacaacauguacgccuggggccaggaguccggcgcccccauccucaccgacgacgucucccuccaggucuucauggaccaccucaagaagcucgccgucuccuccgccgccuga

SEQ ID NO: 49227 - RNA, 2250 nt, Artificial Sequence
  derived and/or modified sequence opt2 from SEC23B__Homo_sapiens__NP_001166217
auggccaccuaccucgaguucauccagcagaacgaggagcgcgacggcguccgcuucuccuggaacgucuggcccuccucccgccucgaggccacccgcauggucgucccccucgccugccuccucaccccccucaaggagcgccccgaccucccccccguccaguacgagcccguccucugcucccgccccaccugcaaggccguccucaacccccucugccaggucgacuaccgcgccaagcucugggccugcaacuucugcuuccagcgcaaccaguucccccccgccuacggcggcaucuccgaggucaaccagcccgccgagcucaugccccaguucuccaccaucgaguacgucauccaggaggacgaccuccaggcccucaaggagucccuccagaugucccucucccuccucccccccgacgcccucgucggccucaucaccuucggccgcaugguccagguccacgagcucuccugcgagggcaucuccaaguccuacgucuuccgcggcaccaaggaccucaccgccaagcagauccaggacaugcucggccucaccaagcccgccaugcccaugcagcaggcccgccccgcccagccccaggagcaccccuucgccuccucccgcuuccuccagcccguccacaagaucgacaugaaccucaccgaccuccucggcgagcuccagcgcgaccccuggcccgucacccagggcaagcgcccccuccgcuccaccggcgucgcccucuccaucgccgucggccuccucgagggcaccuuccccaacaccggcgcccgcaucaugcucuucaccggcggcccccccacccagggccccggcauggucgucggcgacgagcucaagauccccauccgcuccuggcacgacaucgagaaggacaacgcccgcuucaugaagaaggccaccaagcacuacgagaugcucgccaaccgcaccgccgccaacggccacugcaucgacaucuacgccugcgcccucgaccagaccggccuccucgagaugaagugcugcgccaaccucaccggcggcuacauggucaugggcgacuccuucaacaccucccucuucaagcagaccuuccagcgcaucuucaccaaggacuucaacggcgacuuccgcauggccuucggcgccacccucgacgucaagaccucccgcgagcucaagaucgccggcgccaucggccccugcgucucccucaacgucaagggccccugcgucuccgagaacgagcucggcgucggcggcaccucccaguggaagaucugcggccucgaccccaccuccacccucggcaucuacuucgaggucgucaaccagcacaacacccccaucccccagggcggccgcggcgccauccaguucgucacccacuaccagcacuccuccacccagcgccgcauccgcgucaccaccaucgcccgcaacugggccgacguccagucccagcuccgccacaucgaggccgccuucgaccaggaggccgccgccguccucauggcccgccucggcgucuuccgcgccgaguccgaggagggccccgacguccuccgcuggcucgaccgccagcucauccgccucugccagaaguucggccaguacaacaaggaggaccccaccuccuuccgccucuccgacuccuucucccucuacccccaguucauguuccaccuccgccgcucccccuuccuccaggucuucaacaacucccccgacgaguccuccuacuaccgccaccacuucgcccgccaggaccucacccagucccucaucaugauccagcccauccucuacuccuacuccuuccacggcccccccgagcccguccuccucgacuccuccuccauccucgccgaccgcauccuccucauggacaccuucuuccagaucgucaucuaccucggcgagaccaucgcccaguggcgcaaggccggcuaccaggacaugcccgaguacgagaacuucaagcaccuccuccaggccccccucgacgacgcccaggagauccuccaggcccgcuuccccaugccccgcuacaucaacaccgagcacggcggcucccaggcccgcuuccuccucuccaaggucaaccccucccagacccacaacaaccucuacgccuggggccaggagaccggcgcccccauccucaccgacgacgucucccuccaggucuucauggaccaccucaagaagcucgccgucuccuccgccugcuga

SEQ ID NO: 49228 - RNA, 3003 nt, Artificial Sequence
  derived and/or modified sequence opt2 from SEC23IP__Homo_sapiens__NP_009121
auggccgagcgcaagcccaacggcggcuccggcggcgccuccaccuccuccuccggcaccaaccuccucuucuccuccuccgccaccgaguucuccuucaacguccccuucauccccgucacccaggccuccgccucccccgccucccuccuccuccccggcgaggacuccaccgacgucggcgaggaggacuccuuccucggccagaccuccauccacaccuccgccccccagaccuucuccuacuucucccaggucuccuccuccuccgaccccuucggcaacaucggccaguccccccucaccaccgccgccaccuccgucggccaguccggcuuccccaagccccucaccgcccuccccuucaccaccggcucccaggacgucuccaacgccuucucccccuccaucuccaaggcccagcccggcgccccccccuccucccucaugggcaucaacuccuaccuccccucccagcccuccucccucccccccuccuacuucggcaaccagccccagggcaucccccagcccggcuacaaccccuaccgccacacccccggcuccucccgcgccaaccccuacaucgcccccccccagcuccagcagugccagacccccggcccccccgcccaccccccccccuccggcccccccguccagauguaccagaugccccccggcucccucccccccguccccuccuccguccagucccccgcccagcagcagguccccgcccgccccggcgcccccuccguccagguccccucccccuuccuccuccagaaccaguacgagcccguccagccccacugguucuacugcaaggaggucgaguacaagcagcucuggaugcccuucuccgucuucgacucccucaaccucgaggagaucuacaacuccguccagcccgaccccgaguccgucguccucggcaccgacggcggccgcuacgacgucuaccucuacgaccgcauccgcaaggccgccuacugggaggaggagcccgccgagguccgccgcugcaccugguucuacaagggcgacaccgacucccgcuucauccccuacaccgaggaguucuccgagaagcucgaggccgaguacaagaaggccgucaccaccaaccaguggcaccgccgccucgaguuccccuccggcgagaccaucgucaugcacaaccccaaggucaucguccaguuccagcccuccuccguccccgacgaguggggcaccacccaggacggccagacccgcccccgcgucgucaagcgcggcaucgacgacaaccucgacgagauccccgacggcgagaugccccaggucgaccaccucgucuucgucguccacggcaucggccccgucugcgaccuccgcuuccgcuccaucaucgagugcgucgacgacuuccgcgucgucucccucaagcuccuccgcacccacuucaagaagucccucgacgacggcaaggucucccgcgucgaguuccuccccguccacuggcacuccucccucggcggcgacgccaccggcgucgaccgcaacaucaagaagaucacccuccccuccaucggccgcuuccgccacuucaccaacgagacccuccucgacauccucuucuacaacucccccaccuacugccagaccaucgucgagaaggucggcauggagaucaaccaccuccacgcccucuucaugucccgcaaccccgacuucaagggcggcgucuccgucgccggccacucccucggcucccucauccucuucgacauccucuccaaccagaaggaccucaaccucuccaagugccccggcccccucgccgucgccaacggcgucgucaagcagcuccacuuccaggagaagcagaugcccgaggagcccaagcucacccucgacgaguccuacgaccucgucgucgagaacaaggagguccucacccuccaggagacccucgaggcccucucccucuccgaguacuucuccaccuucgagaaggagaagaucgacauggagucccuccucaugugcaccgucgacgaccucaaggagaugggcaucccccucggcccccgcaagaagaucgccaacuucgucgagcacaaggccgccaagcucaagaaggccgccuccgagaagaaggccgucgccgccaccuccaccaagggccaggagcaguccgcccagaagaccaaggacauggccucccuccccuccgaguccaacgagcccaagcgcaagcuccccgucggcgccugcgucuccuccgucugcgucaacuacgaguccuucgaggucggcgccggccaggucuccgucgccuacaacucccucgacuucgagcccgagaucuucuucgcccucggcucccccaucgccauguuccucaccauccgcggcgucgaccgcaucgacgagaacuacucccuccccaccugcaagggcuucuucaacaucuaccacccccucgaccccgucgccuaccgccucgagcccaugaucguccccgaccucgaccucaaggccguccucaucccccaccacaagggccgcaagcgccuccaccucgagcucaaggagucccucucccgcaugggcuccgaccucaagcagggcuucaucuccucccucaaguccgccuggcagacccucaacgaguucgcccgcgcccacaccuccuccacccagcuccaggaggagcucgagaaggucgccaaccagaucaaggaggaggaggagaagcaggucgucgaggccgagaaggucgucgagucccccgacuucuccaaggacgaggacuaccucggcaaggucggcaugcucaacggcggccgccgcaucgacuacguccuccaggagaagcccaucgaguccuucaacgaguaccucuucgcccuccagucccaccucugcuacugggaguccgaggacaccgcccuccuccuccucaaggagaucuaccgcaccaugaacaucucccccgagcagccccagcacuga

SEQ ID NO: 49229 - RNA, 1842 nt, Artificial Sequence
  derived and/or modified sequence opt2 from SEC24A__Homo_sapiens__NP_001239160
augucccagcccggcauccccgccuccggcggcgcccccgccucccuccaggcccagaacggcgccgcccucgccuccggcucccccuacaccaacggccccguccagaacgcccuccucuccucccaggaguccgucucccagggcuacaacuuccagcuccccggcuccuacccccaccccauccccgccaagacccucaaccccgucuccggccaguccaacuacggcggcucccagggcuccggccagacccucaaccgcccccccgucgccuccaaccccgucacccccucccuccacuccggccccgccccccgcaugccccuccccgccucccagaaccccgccaccacccccaugcccuccuccuccuuccuccccgaggccaaccucccccccccccucaacuggcaguacaacuaccccuccaccgccucccagaccaaccacugcccccgcgccuccucccagcccaccgucuccggcaacaccucccucaccaccaaccaccaguacgucuccuccggcuaccccucccuccagaacuccuucaucaaguccggccccuccguccccccccucgucaaccccccccuccccaccaccuuccagcccggcgccccccacggccccccccccgccggcggccccccccccguccgcgcccucaccccccucaccuccuccuaccgcgacgucccccagccccucuucaacuccgccgucaaccaggagggcaucaccuccaacaccaacaacggcuccauggucguccacuccuccuacgacgagaucgagggcggcggccuccucgccaccccccagcucaccaacaagaaccccaagaugucccgcuccgucggcuacuccuaccccucccucccccccggcuaccagaacaccaccccccccggcgccaccggcgucccccccuccucccucaacuaccccuccggcccccaggccuucacccagaccccccucggcgccaaccaccucaccaccuccauguccggccucucccuccagcccgagggccuccgcgucgucaaccuccuccaggagcgcaacaugcuccccuccaccccccucaagccccccguccccaaccuccacgaggacauccagaagcucaacugcaaccccgagcucuuccgcugcacccucaccuccaucccccagacccaggcccuccucaacaaggccaagcucccccucggccuccuccuccaccccuucaaggaccucguccagcuccccgucgucaccuccuccaccaucguccgcugccgcuccugccgcaccuacaucaaccccuucgucuccuuccucgaccagcgccgcuggaagugcaaccucugcuaccgcgucaacgacguccccgaggaguuccucuacaacccccucacccgcgucuacggcgagccccaccgccgccccgagguccagaacgccaccaucgaguucauggcccccuccgaguacaugcuccgccccccccagccccccgucuaccucuucgucuucgacgucucccacaacgccgucgagaccggcuaccucaacuccgucugccagucccuccucgacaaccucgaccuccuccccggcaacacccgcaccaagaucggcuucaucaccuucgacuccaccauccacuucuacggccuccaggagucccucucccagccccagaugcucaucgucuccgacaucgaggacgucuucauccccaugcccgagaaccuccucgucaaccucaacgaguccaaggaguccgucaucggcgucuccuccgaggagacccucaucaccugccucgagaucgccaugcgcuga

SEQ ID NO: 49230 - RNA, 3702 nt, Artificial Sequence
  derived and/or modified sequence opt2 from SEC24B__Homo_sapiens__NP_001036199
auguccgcccccgccggcuccucccaccccgccgccuccgcccgcaucccccccaaguucggcggcgccgccgucuccggcgccgccgcccccgccggccccggcgccggccccgccccccaccagcagaacggccccgcccagaaccagaugcagguccccuccggcuacggccuccaccaccagaacuacaucgcccccuccggccacuacucccagggccccggcaagaugaccucccucccccucgacacccagugcggcgacuacuacuccgcccucuacaccguccccacccagaacgucacccccaacaccgucaaccagcagcccggcgcccagcagcucuacucccgcggcccccccgccccccacaucgucggcuccacccucggcuccuuccagggcgccgccuccuccgccucccaccuccacaccuccgccucccagcccuacuccuccuucgucaaccacuacaacucccccgccauguacuccgccuccuccuccgucgccucccagggcuuccccuccaccugcggccacuacgccauguccaccgucuccaacgccgccuaccccuccgucuccuaccccucccuccccgccggcgacaccuacggccagauguucaccucccagaacgcccccaccguccgccccgucaaggacaacuccuucuccggccagaacaccgccaucucccaccccuccccccuccccccccuccccucccagcagcaccaccagcagcagucccucuccggcuacuccacccucaccugguccucccccggccuccccuccacccaggacaaccucauccgcaaccacaccggcucccucgccgucgccaacaacaaccccaccaucaccgucgccgacucccucuccugccccgucaugcagaacguccagccccccaaguccucccccgucgucuccaccguccucuccggcuccuccggcuccuccuccacccgcaccccccccaccgccaaccaccccgucgagcccgucaccuccgucacccagcccuccgagcuccuccagcagaagggcgucgacuccuccuccaccaccuccuccgccucccccaugcccaacuccuacgacgcccucgagggcggcuccuaccccgacaugcucuccuccuccgccuccucccccgcccccgaccccgcccccgagcccgaccccgccuccgcccccgcccccgccuccgcccccgcccccgucgucccccagcccuccaagauggccaagcccuucggcuacggcuaccccacccuccagcccggcuaccagaacgccaccgccccccucaucuccggcguccagcccuccaaccccgucuacuccggcuuccagcaguacccccagcaguaccccggcgucaaccagcucuccuccuccaucggcggccucucccuccaguccuccccccagcccgagucccuccgccccgucaaccucacccaggagcgcaacauccuccccaugacccccgucugggcccccguccccaaccucaacgccgaccucaagaagcucaacugcucccccgacuccuuccgcugcacccucaccaacaucccccagacccaggcccuccucaacaaggccaagcucccccucggccuccuccuccaccccuuccgcgaccucacccagcuccccgucaucaccuccaacaccaucguccgcugccgcuccugccgcaccuacaucaaccccuucgucuccuucaucgaccagcgccgcuggaagugcaaccucugcuaccgcgucaacgacguccccgaggaguucauguacaacccccucacccgcuccuacggcgagccccacaagcgccccgagguccagaacuccaccgucgaguucaucgccuccuccgacuacaugcuccgccccccccagcccgccgucuaccucuucguccucgacgucucccacaacgccgucgaggccggcuaccucaccauccucugccagucccuccucgagaaccucgacaagcuccccggcgacucccgcacccgcaucggcuucaugaccuucgacuccaccauccacuucuacaaccuccaggagggccucucccagccccagaugcucaucgucuccgacaucgacgacgucuuccuccccacccccgacucccuccucgucaaccucuacgaguccaaggagcucaucaaggaccuccucaacgcccuccccaacauguucaccaacacccgcgagacccacuccgcccucggccccgcccuccaggccgccuucaagcucaugucccccaccggcggccgcgucuccgucuuccagacccagcuccccucccucggcgccggccuccuccagucccgcgaggaccccaaccagcgcuccuccaccaaggucguccagcaccucggccccgccaccgacuucuacaagaagcucgcccucgacugcuccggccagcagaccgccgucgaccucuuccuccucuccucccaguacuccgaccucgccucccucgccugcauguccaaguacuccgccggcugcaucuacuacuaccccuccuuccacuacacccacaaccccucccaggccgagaagcuccagaaggaccucaagcgcuaccucacccgcaagaucggcuucgaggccgucaugcgcauccgcugcaccaagggccucuccaugcacaccuuccacggcaacuucuucguccgcuccaccgaccuccucucccucgccaacaucaaccccgacgccggcuucgccguccagcucuccaucgaggagucccucaccgacaccucccucgucugcuuccagaccgcccuccucuacaccuccuccaagggcgagcgccgcauccgcguccacacccucugccuccccgucgucuccucccucgccgacgucuacgccggcgucgacguccaggccgccaucugccuccucgccaacauggccgucgaccgcuccgucuccuccucccucuccgacgcccgcgacgcccucgucaacgccgucgucgacucccucuccgccuacggcuccaccgucuccaaccuccagcacuccgcccucauggcccccuccucccucaagcucuucccccucuacguccucgcccuccucaagcagaaggccuuccgcaccggcaccuccacccgccucgacgaccgcgucuacgccaugugccagaucaagucccagccccucguccaccucaugaagaugauccaccccaaccucuaccgcaucgaccgccucaccgacgagggcgccguccacgucaacgaccgcaucgucccccagcccccccuccagaagcucuccgccgagaagcucacccgcgagggcgccuuccucauggacugcggcuccgucuucuacaucugggucggcaagggcugcgacaacaacuucaucgaggacguccucggcuacaccaacuucgccuccaucccccagaagaugacccaccuccccgagcucgacacccucuccuccgagcgcgcccgcuccuucaucaccuggcuccgcgacucccgcccccucucccccauccuccacaucgucaaggacgagucccccgccaaggccgaguucuuccagcaccucaucgaggaccgcaccgaggccgccuucuccuacuacgaguuccuccuccacguccagcagcagaucugcaaguga

SEQ ID NO: 49231 - RNA, 3285 nt, Artificial Sequence
  derived and/or modified sequence opt2 from SEC24C__Homo_sapiens__NP_940999
augaacgucaaccaguccgucccccccgucccccccuucggccagccccagcccaucuaccccggcuaccaccaguccuccuacggcggccaguccggcuccaccgcccccgccauccccuacggcgccuacaacggccccguccccggcuaccagcagacccccccccagggcaugucccgcgccccccccuccuccggcgccccccccgccuccaccgcccaggcccccugcggccaggccgccuacggccaguucggccagggcgacguccagaacggccccuccuccaccguccagaugcagcgccuccccggcucccagcccuucggcuccccccucgcccccgucggcaaccagccccccguccuccagcccuacggccccccccccaccuccgcccaggucgccacccagcucuccggcaugcagaucuccggcgccgucgcccccgccccccccuccuccggccucggcuucggcccccccaccucccucgccuccgccuccggcuccuuccccaacuccggccucuacggcuccuacccccagggccaggcccccccccucucccaggcccagggccaccccggcauccagaccccccagcgcuccgcccccucccaggccuccuccuucaccccccccgccuccggcggcccccgccuccccuccaugaccggcccccuccuccccggccaguccuucggcggccccuccgucucccagcccaaccacgucuccucccccccccaggcccucccccccggcacccagaugaccggcccccucggcccccucccccccaugcacuccccccagcagcccggcuaccagccccagcagaacggcuccuucggccccgcccgcggcccccaguccaacuacggcggccccuaccccgccgcccccaccuucggcucccagcccggccccccccagccccucccccccaagcgccucgaccccgacgccauccccucccccauccaggucaucgaggacgaccgcaacaaccgcggcaccgagcccuucgucaccggcguccgcggccagguccccccccucgucaccaccaacuuccucgucaaggaccagggcaacgccuccccccgcuacauccgcugcaccuccuacaacauccccugcaccuccgacauggccaagcaggcccaggucccccucgccgccgucaucaagccccucgcccgccucccccccgaggaggccucccccuacgucgucgaccacggcgaguccggcccccuccgcugcaaccgcugcaaggccuacaugugccccuucaugcaguucaucgagggcggccgccgcuuccagugcugcuucugcuccugcaucaacgacguccccccccaguacuuccagcaccucgaccacaccggcaagcgcgucgacgccuacgaccgccccgagcucucccucggcuccuacgaguuccucgccaccgucgacuacugcaagaacaacaaguuccccuccccccccgccuucaucuucaugaucgacgucuccuacaacgccauccgcaccggccucguccgccuccucugcgaggagcucaagucccuccucgacuuccucccccgcgagggcggcgccgaggaguccgccauccgcgucggcuucgucaccuacaacaagguccuccacuucuacaacgucaaguccucccucgcccagccccagaugauggucgucuccgacgucgccgacauguucgucccccuccucgacggcuuccucgucaacgucaacgagucccgcgccgucaucaccucccuccucgaccagauccccgagauguucgccgacacccgcgagaccgagaccgucuucguccccgucauccaggccggcauggaggcccucaaggccgccgagugcgccggcaagcucuuccucuuccacaccucccuccccaucgccgaggcccccggcaagcucaagaaccgcgacgaccgcaagcucaucaacaccgacaaggagaagacccucuuccagccccagaccggcgccuaccagacccucgccaaggagugcgucgcccagggcugcugcgucgaccucuuccucuuccccaaccaguacgucgacgucgccacccucuccgucgucccccagcucaccggcggcuccgucuacaaguacgccuccuuccaggucgagaacgaccaggagcgcuuccucuccgaccuccgccgcgacguccagaaggucgucggcuucgacgccgucaugcgcguccgcaccuccaccggcauccgcgccgucgacuucuucggcgccuucuacauguccaacaccaccgacgucgagcucgccggccucgacggcgacaagaccgucaccgucgaguucaagcacgacgaccgccucaacgaggaguccggcgcccuccuccagugcgcccuccucuacaccuccugcgccggccagcgccgccuccgcauccacaaccucgcccucaacugcugcacccagcucgccgaccucuaccgcaacugcgagaccgacacccucaucaacuacauggccaaguucgccuaccgcggcguccucaacucccccgucaaggccguccgcgacacccucaucacccagugcgcccagauccucgccugcuaccgcaagaacugcgccucccccuccuccgccggccagcucauccuccccgagugcaugaagcuccuccccgucuaccucaacugcguccucaaguccgacguccuccagcccggcgccgaggucaccaccgacgaccgcgccuacguccgccagcucgucaccuccauggacgucaccgagaccaacgucuucuucuacccccgccuccucccccucaccaagucccccgucgaguccaccaccgagccccccgccguccgcgccuccgaggagcgccucuccaacggcgacaucuaccuccucgagaacggccucaaccucuuccucugggucggcgccuccguccagcagggcgucguccagucccucuucuccgucuccuccuucucccagaucaccuccggccucuccguccuccccguccucgacaacccccucuccaagaagguccgcggccucaucgacucccuccgcgcccagcgcucccgcuacaugaagcucaccgucgucaagcaggaggacaagauggagaugcucuucaagcacuuccucgucgaggacaagucccucuccggcggcgccuccuacgucgacuuccucugccacaugcacaaggagauccgccagcuccucuccuga

SEQ ID NO: 49232 - RNA, 3321 nt, Artificial Sequence
  derived and/or modified sequence opt2 from SEC31A__Homo_sapiens__NP_001070674
augaagcucaaggaggucgaccgcaccgccaugcaggccuggucccccgcccagaaccaccccaucuaccucgccaccggcaccuccgcccagcagcucgacgccaccuucuccaccaacgccucccucgagaucuucgagcucgaccucuccgaccccucccucgacaugaaguccugcgccaccuucuccuccucccaccgcuaccacaagcucaucuggggccccuacaagauggacuccaagggcgacgucuccggcguccucaucgccggcggcgagaacggcaacaucauccucuacgaccccuccaagaucaucgccggcgacaaggaggucgucaucgcccagaacgacaagcacaccggccccguccgcgcccucgacgucaacaucuuccagaccaaccucgucgccuccggcgccaacgaguccgagaucuacaucugggaccucaacaacuucgccacccccaugacccccggcgccaagacccagccccccgaggacaucuccugcaucgccuggaaccgccagguccagcacauccucgccuccgccucccccuccggccgcgccaccgucugggaccuccgcaagaacgagcccaucaucaaggucuccgaccacuccaaccgcaugcacugcuccggccucgccuggcaccccgacgucgccacccagaugguccucgccuccgaggacgaccgccuccccgucauccagaugugggaccuccgcuucgccuccuccccccuccgcguccucgagaaccacgcccgcggcauccucgccaucgccugguccauggccgaccccgagcuccuccucuccugcggcaaggacgccaagauccucugcuccaaccccaacaccggcgagguccucuacgagcuccccaccaacacccaguggugcuucgacauccaguggugcccccgcaaccccgccguccucuccgccgccuccuucgacggccgcaucuccgucuacuccaucaugggcggcuccaccgacggccuccgccagaagcaggucgacaagcucuccuccuccuucggcaaccucgaccccuucggcaccggccagccccuccccccccuccagaucccccagcagaccgcccagcacuccaucguccucccccucaagaagccccccaaguggauccgccgccccgucggcgccuccuucuccuucggcggcaagcucgucaccuucgagaacguccgcaugcccucccaccagggcgccgagcagcagcagcagcagcaccacgucuucaucucccaggucgucaccgagaaggaguuccucucccgcuccgaccagcuccagcaggccguccagucccagggcuucaucaacuacugccagaagaagaucgacgccucccagaccgaguucgagaagaacgucugguccuuccucaaggucaacuucgaggacgacucccgcggcaaguaccucgagcuccucggcuaccgcaaggaggaccucggcaagaagaucgcccucgcccucaacaaggucgacggcgccaacgucgcccucaaggacuccgaccaggucgcccaguccgacggcgaggagucccccgccgccgaggagcagcuccucggcgagcacaucaaggaggagaaggaggaguccgaguuccuccccuccuccggcggcaccuucaacaucuccgucuccggcgacaucgacggccucaucacccaggcccuccucaccggcaacuucgaguccgccgucgaccucugccuccacgacaaccgcauggccgacgccaucauccucgccaucgccggcggccaggagcuccucgcccgcacccagaagaaguacuucgccaagucccaguccaagaucacccgccucaucaccgccgucgucaugaagaacuggaaggagaucgucgaguccugcgaccucaagaacuggcgcgaggcccucgccgccguccucaccuacgccaagcccgacgaguucuccgcccucugcgaccuccucggcacccgccucgagaacgagggcgacucccuccuccagacccaggccugccucugcuacaucugcgccggcaacgucgagaagcucgucgccugcuggaccaaggcccaggacggcucccacccccucucccuccaggaccucaucgagaaggucgucauccuccgcaaggccguccagcucacccaggccauggacaccuccaccgucggcguccuccucgccgccaagaugucccaguacgccaaccuccucgccgcccagggcuccaucgccgccgcccucgccuuccuccccgacaacaccaaccagcccaacaucaugcagcuccgcgaccgccucugccgcgcccagggcgagcccgucgccggccacgagucccccaagauccccuacgagaagcagcagcuccccaagggccgccccggccccgucgccggccaccaccagaugccccgcguccagacccagcaguacuacccccacggcgagaacccccccccccccggcuucaucaugcacggcaacgucaaccccaacgccgccggccagcuccccaccucccccggccacaugcacacccaggucccccccuacccccagccccagcgcccccagaacggcuggaacgacccccccgcccucaaccgcguccccaagaagaagaagaugcccgagaacuucaugccccccguccccaucaccucccccaucaugaacccccucggcgacccccagucccagaugcuccagcagcagcccuccgcccccgucccccucuccucccaguccuccuucccccagccccaccuccccggcggccagcccuuccacggcguccagcagccccucggccagaccggcaugccccccuccuucuccaagcccaacaucgagggcgcccccggcgcccccaucggcaacaccuuccagcacguccagucccuccccaccaagaagaucaccaagaagcccauccccgacgagcaccucauccucaagaccaccuucgaggaccucauccagcgcugccucuccuccgccaccgacccccagaccaagcgcaagcucgacgacgccuccaagcgccucgaguuccucuacgacaagcuccgcgagcagacccucucccccaccaucaccuccggccuccacaacaucgcccgcuccaucgagacccgcaacuacuccgagggccucaccaugcacacccacaucgucuccaccuccaacuucuccgagaccuccgccuucaugcccguccucaaggucguccucacccaggccaacaagcucggcgucuga

SEQ ID NO: 49233 - RNA, 1431 nt, Artificial Sequence
  derived and/or modified sequence opt2 from SEC61A1__Homo_sapiens__NP_037468
auggccaucaaguuccucgaggucaucaagcccuucugcgucauccuccccgagauccagaagcccgagcgcaagauccaguucaaggagaagguccucuggaccgccaucacccucuucaucuuccucgucugcugccagaucccccucuucggcaucauguccuccgacuccgccgaccccuucuacuggaugcgcgucauccucgccuccaaccgcggcacccucauggagcucggcaucucccccaucgucaccuccggccucaucaugcagcuccucgccggcgccaagaucaucgaggucggcgacacccccaaggaccgcgcccucuucaacggcgcccagaagcucuucggcaugaucaucaccaucggccaguccaucgucuacgucaugaccggcauguacggcgaccccuccgagaugggcgccggcaucugccuccucaucaccauccagcucuucgucgccggccucaucguccuccuccucgacgagcuccuccagaagggcuacggccucggcuccggcaucucccucuucaucgccaccaacaucugcgagaccaucgucuggaaggccuucucccccaccaccgucaacaccggccgcggcauggaguucgagggcgccaucaucgcccucuuccaccuccucgccacccgcaccgacaagguccgcgcccuccgcgaggccuucuaccgccagaaccuccccaaccucaugaaccucaucgccaccaucuucgucuucgccgucgucaucuacuuccagggcuuccgcgucgaccuccccaucaaguccgcccgcuaccgcggccaguacaacaccuaccccaucaagcucuucuacaccuccaacauccccaucauccuccaguccgcccucgucuccaaccucuacgucaucucccagaugcucuccgcccgcuucuccggcaaccuccucgucucccuccucggcaccugguccgacaccuccuccggcggccccgcccgcgccuaccccgucggcggccucugcuacuaccucuccccccccgaguccuucggcuccguccucgaggaccccguccacgccgucgucuacaucgucuucaugcucggcuccugcgccuucuucuccaagaccuggaucgaggucuccggcuccuccgccaaggacgucgccaagcagcucaaggagcagcagauggucaugcgcggccaccgcgagaccuccaugguccacgagcucaaccgcuacauccccaccgccgccgccuucggcggccucugcaucggcgcccucuccguccucgccgacuuccucggcgccaucggcuccggcaccggcauccuccucgccgucaccaucaucuaccaguacuucgagaucuucgucaaggagcaguccgaggucggcuccaugggcgcccuccucuucuga

SEQ ID NO: 49234 - RNA, 207 nt, Artificial Sequence
  derived and/or modified sequence opt2 from SEC61G__Homo_sapiens__NP_055117
auggaccaggucaugcaguucgucgagcccucccgccaguucgucaaggacuccauccgccucgucaagcgcugcaccaagcccgaccgcaaggaguuccagaagaucgccauggccaccgccaucggcuucgccaucaugggcuucaucggcuucuucgucaagcucauccacauccccaucaacaacaucaucgucggcggcuga

SEQ ID NO: 49235 - RNA, 1200 nt, Artificial Sequence
  derived and/or modified sequence opt2 from SEC62__Homo_sapiens__NP_003253
auggccgagcgccgccgccacaagaagcgcauccaggaggucggcgagcccuccaaggaggagaaggccgucgccaaguaccuccgcuucaacugccccaccaaguccaccaacaugaugggccaccgcgucgacuacuucaucgccuccaaggccgucgacugccuccucgacuccaagugggccaaggccaagaagggcgaggaggcccucuucaccacccgcgaguccgucgucgacuacugcaaccgccuccucaagaagcaguucuuccaccgcgcccucaaggucaugaagaugaaguacgacaaggacaucaagaaggagaaggacaagggcaaggccgaguccggcaaggaggaggacaagaaguccaagaaggagaacaucaaggacgagaagaccaagaaggagaaggagaagaagaaggacggcgagaaggaggaguccaagaaggaggagacccccggcacccccaagaagaaggagaccaagaagaaguucaagcucgagccccacgacgaccaggucuuccucgacggcaacgaggucuacgucuggaucuacgaccccguccacuucaagaccuucgucaugggccucauccucgucaucgccgucaucgccgccacccucuucccccucuggcccgccgagaugcgcgucggcgucuacuaccucuccgucggcgccggcugcuucgucgccuccauccuccuccucgccgucgcccgcugcauccucuuccucaucaucuggcucaucaccggcggccgccaccacuucugguuccuccccaaccucaccgccgacgucggcuucaucgacuccuuccgcccccucuacacccacgaguacaagggccccaaggccgaccucaagaaggacgagaaguccgagaccaagaagcagcagaaguccgacuccgaggagaaguccgacuccgagaagaaggaggacgaggagggcaaggucggccccggcaaccacggcaccgagggcuccggcggcgagcgccacuccgacaccgacuccgaccgccgcgaggacgaccgcucccagcacuccuccggcaacggcaacgacuucgagaugaucaccaaggaggagcucgagcagcagaccgacggcgacugcgaggaggacgaggaggaggagaacgacggcgagacccccaaguccucccacgagaaguccuga

SEQ ID NO: 49236 - RNA, 2283 nt, Artificial Sequence
  derived and/or modified sequence opt2 from SEC63__Homo_sapiens__NP_009145
auggccggccagcaguuccaguacgacgacuccggcaacaccuucuucuacuuccucaccuccuucgucggccucaucgucauccccgccaccuacuaccucuggccccgcgaccagaacgccgagcagauccgccucaagaacauccgcaaggucuacggccgcugcaugugguaccgccuccgccuccucaagccccagcccaacaucauccccaccgucaagaagaucguccuccucgccggcugggcccucuuccucuuccucgccuacaaggucuccaagaccgaccgcgaguaccaggaguacaaccccuacgagguccucaaccucgaccccggcgccaccgucgccgagaucaagaagcaguaccgccuccucucccucaaguaccaccccgacaagggcggcgacgaggucauguucaugcgcaucgccaaggccuacgccgcccucaccgacgaggagucccgcaagaacugggaggaguucggcaaccccgacggcccccaggccaccuccuucggcaucgcccuccccgccuggaucgucgaccagaagaacuccauccucguccuccucgucuacggccucgccuucauggucauccuccccgucgucgucggcuccuggugguaccgcuccauccgcuacuccggcgaccagauccucauccgcaccacccagaucuacaccuacuucgucuacaagacccgcaacauggacaugaagcgccucaucaugguccucgccggcgccuccgaguucgacccccaguacaacaaggacgccaccucccgccccaccgacaacauccucaucccccagcucauccgcgagaucggcuccaucaaccucaagaagaacgagcccccccucaccugccccuacucccucaaggcccgcguccuccuccucucccaccucgcccgcaugaagauccccgagacccucgaggaggaccagcaguucaugcucaagaagugccccgcccuccuccaggagauggucaacgucaucugccagcucaucgucauggcccgcaaccgcgaggagcgcgaguuccgcgcccccacccucgccucccucgagaacugcaugaagcucucccagauggccguccagggccuccagcaguucaaguccccccuccuccagcucccccacaucgaggaggacaaccuccgccgcgucuccaaccacaagaaguacaagaucaagaccauccaggaccucgucucccucaaggaguccgaccgccacacccuccuccacuuccucgaggacgagaaguacgaggaggucauggccguccucggcuccuuccccuacgucaccauggacaucaagucccagguccucgacgacgaggacuccaacaacaucaccgucggcucccucgucaccguccucgucaagcucacccgccagaccauggccgaggucuucgagaaggagcaguccaucugcgccgccgaggagcagcccgccgaggacggccagggcgagaccaacaagaaccgcaccaagggcggcuggcagcagaaguccaagggccccaagaagaccgccaaguccaagaagaagaagccccucaagaagaagcccacccccguccuccucccccaguccaagcagcagaagcagaagcaggccaacggcgucgucggcaacgaggccgccgucaaggaggacgaggaggaggucuccgacaagggcuccgacuccgaggaggaggagaccaaccgcgacucccaguccgagaaggacgacggcuccgaccgcgacuccgaccgcgagcaggacgagaagcagaacaaggacgacgaggccgaguggcaggagcuccagcaguccauccagcgcaaggagcgcgcccuccucgagaccaaguccaagaucacccaccccgucuacucccucuacuuccccgaggagaagcaggaguggugguggcucuacaucgccgaccgcaaggagcagacccucaucuccaugcccuaccacgucugcacccucaaggacaccgaggaggucgagcucaaguuccccgcccccggcaagcccggcaacuaccaguacaccgucuuccuccgcuccgacuccuacaugggccucgaccagaucaagccccucaagcucgagguccacgaggccaagcccguccccgagaaccacccccagugggacaccgccaucgagggcgacgaggaccaggaggacuccgagggcuucgaggacuccuucgaggaggaggaggaggaggaggaggacgacgacuga

SEQ ID NO: 49237 - RNA, 2565 nt, Artificial Sequence
  derived and/or modified sequence opt2 from SECISBP2__Homo_sapiens__NP_076982
auggccuccgagggcccccgcgagcccgaguccgagggcaucaagcucuccgccgacgucaagcccuucgucccccgcuucgccggccucaacgucgccuggcucgaguccuccgaggccugcgucuuccccuccuccgccgccaccuacuaccccuucguccaggagccccccgucaccgagcagaagaucuacaccgaggacauggccuucggcgccuccaccuuccccccccaguaccucuccuccgagaucacccuccaccccuacgccuacucccccuacacccucgacuccacccagaacgucuacuccguccccggcucccaguaccucuacaaccagcccuccugcuaccgcggcuuccagaccgucaagcaccgcaacgagaacaccugcccccucccccaggagaugaaggcccucuucaagaagaagaccuacgacgagaagaagaccuacgaccagcagaaguucgacuccgagcgcgccgacggcaccaucuccuccgagaucaaguccgcccgcggcucccaccaccucuccaucuacgccgagaacucccucaaguccgacggcuaccacaagcgcaccgaccgcaagucccgcaucaucgccaagaacgucuccaccuccaagcccgaguucgaguucaccacccucgacuuccccgagcuccagggcgccgagaacaacauguccgagauccagaagcagcccaaguggggccccguccacuccgucuccaccgacaucucccuccuccgcgaggucgucaagcccgccgccguccucuccaagggcgagaucgucgucaagaacaaccccaacgaguccgucaccgccaacgccgccaccaacucccccuccugcacccgcgagcucuccuggacccccaugggcuacgucguccgccagacccucuccaccgagcucuccgccgcccccaagaacgucaccuccaugaucaaccucaagaccaucgccuccuccgccgaccccaagaacgucuccauccccuccuccgaggcccucuccuccgaccccuccuacaacaaggagaagcacaucauccaccccacccagaaguccaaggccucccagggcuccgaccucgagcagaacgaggccucccgcaagaacaagaagaagaaggagaaguccaccuccaaguacgagguccucaccguccaggagcccccccgcaucgaggacgccgaggaguuccccaaccucgccgucgccuccgagcgccgcgaccgcaucgagacccccaaguuccaguccaagcagcagccccaggacaacuucaagaacaacgucaagaagucccagcuccccguccagcucgaccucggcggcaugcucaccgcccucgagaagaagcagcacucccagcacgccaagcaguccuccaagcccgucgucgucuccgucggcgccguccccguccucuccaaggagugcgccuccggcgagcgcggccgccgcaugucccagaugaagaccccccacaacccccucgacuccuccgccccccucaugaagaagggcaagcagcgcgagauccccaaggccaagaagcccaccucccucaagaagaucauccucaaggagcgccaggagcgcaagcagcgccuccaggagaacgccgucucccccgccuucaccuccgacgacacccaggacggcgaguccggcggcgacgaccaguuccccgagcaggccgagcucuccggccccgagggcauggacgagcucaucuccacccccuccgucgaggacaaguccgaggagccccccggcaccgagcuccagcgcgacaccgaggccucccaccucgcccccaaccacaccaccuuccccaagauccacucccgccgcuuccgcgacuacugcucccagaugcucuccaaggaggucgacgccugcgucaccgaccuccucaaggagcucguccgcuuccaggaccgcauguaccagaaggaccccgucaaggccaagaccaagcgccgccucguccucggccuccgcgagguccucaagcaccucaagcucaagaagcucaagugcgucaucaucucccccaacugcgagaagauccaguccaagggcggccucgacgacacccuccacaccaucaucgacuacgccugcgagcagaacauccccuucgucuucgcccucaaccgcaaggcccucggccgcucccucaacaaggccguccccgucuccgucgucggcaucuucuccuacgacggcgcccaggaccaguuccacaagauggucgagcucaccgucgccgcccgccaggccuacaagaccaugcucgagaacguccagcaggagcucgucggcgagccccgcccccaggccccccccucccuccccacccagggccccuccugccccgccgaggacggcccccccgcccucaaggagaaggaggagccccacuacaucgagaucuggaagaagcaccucgaggccuacuccggcugcacccucgagcucgaggagucccucgaggccuccaccucccagaugaugaaccucaaccucuga

SEQ ID NO: 49238 - RNA, 3306 nt, Artificial Sequence
  derived and/or modified sequence opt2 from SECISBP2L__Homo_sapiens__NP_001180418
auggaccgcgcccccaccgagcagaacgucaagcucuccgccgaggucgagcccuucaucccccagaagaagucccccgacaccuucaugauccccauggcccuccccaacgacaacggcuccgucuccggcgucgagcccacccccauccccuccuaccucaucaccugcuaccccuucguccaggagaaccaguccaaccgccaguucccccucuacaacaacgacauccgcuggcagcagcccaaccccaaccccaccggccccuacuucgccuaccccaucaucuccgcccagccccccgucuccaccgaguacaccuacuaccagcucaugcccgcccccugcgcccaggucaugggcuucuaccaccccuuccccacccccuacuccaacaccuuccaggccgccaacaccgucaacgccaucaccaccgagugcaccgagcgccccucccagcucggccaggucuucccccucuccucccaccgcucccgcaacuccaaccgcggcuccgucguccccaagcagcagcuccuccagcagcacaucaaguccaagcgcccccucgucaagaacgucgccacccagaaggagaccaacgccgccggccccgacucccgcuccaagaucguccuccucgucgacgccucccagcagaccgacuuccccuccgacaucgccaacaagucccucuccgagaccaccgccaccaugcucuggaaguccaagggccgccgccgccgcgccucccaccccaccgccgaguccuccuccgagcagggcgccuccgaggccgacaucgacuccgacuccggcuacugcucccccaagcacuccaacaaccagcccgccgccggcgcccuccgcaaccccgacuccggcaccaugaaccacgucgaguccuccaugugcgccggcggcgucaacugguccaacgucaccugccaggccacccagaagaagcccuggauggagaagaaccagaccuucucccgcggcggccgccagaccgagcagcgcaacaacucccaggucggcuuccgcugccgcggccacuccaccuccuccgagcgccgccagaaccuccagaagcgccccgacaacaagcaccucuccuccucccagucccaccgcuccgaccccaacuccgagucccucuacuucgaggacgaggacggcuuccaggagcucaacgagaacggcaacgccaaggacgagaacauccagcagaagcucuccuccaagguccucgacgaccuccccgagaacucccccaucaacaucguccagacccccauccccaucaccaccuccguccccaagcgcgccaagucccagaagaagaaggcccucgccgccgcccucgccaccgcccaggaguacuccgagaucuccauggagcagaagaagcuccaggaggcccucuccaaggccgccggcaagaagaacaagacccccguccagcucgaccucggcgacaugcucgccgcccucgagaagcagcagcaggccaugaaggcccgccagaucaccaacacccgcccccucuccuacaccgucgucaccgccgccuccuuccacaccaaggacuccaccaaccgcaagccccucaccaagucccagcccugccucaccuccuucaacuccgucgacaucgccuccuccaaggccaagaagggcaaggagaaggagaucgccaagcucaagcgccccaccgcccucaagaaggucauccucaaggagcgcgaggagaagaagggccgccucaccgucgaccacaaccuccucggcuccgaggagcccaccgagaugcaccucgacuucaucgacgaccucccccaggagaucgucucccaggaggacaccggccucuccaugcccuccgacaccucccucucccccgccucccagaacucccccuacugcaugacccccgucucccagggcucccccgccuccuccggcaucggcucccccauggccuccuccaccaucaccaagauccacuccaagcgcuuccgcgaguacugcaaccagguccucugcaaggagaucgacgagugcgucacccuccuccuccaggagcucgucuccuuccaggagcgcaucuaccagaaggaccccguccgcgccaaggcccgccgccgccucgucaugggccuccgcgaggucaccaagcacaugaagcucaacaagaucaagugcgucaucaucucccccaacugcgagaagauccaguccaagggcggccucgacgaggcccucuacaacgucaucgccauggcccgcgagcaggagauccccuucgucuucgcccucggccgcaaggcccucggccgcugcgucaacaagcucguccccgucuccgucgucggcaucuucaacuacuucggcgccgagucccucuucaacaagcucgucgagcucaccgaggaggcccgcaaggccuacaaggacauggucgccgccauggagcaggagcaggccgaggaggcccucaagaacgucaagaaggucccccaccacaugggccacucccgcaaccccuccgccgccuccgccaucuccuucugcuccgucaucuccgagcccaucuccgaggucaacgagaaggaguacgagaccaacuggcgcaacauggucgagaccuccgacggccucgaggccuccgagaacgagaaggaggucuccugcaagcacuccaccuccgagaagcccuccaagcuccccuucgacaccccccccaucggcaagcagcccucccucgucgccaccggcuccaccaccuccgccaccuccgccggcaaguccaccgccuccgacaaggaggaggucaagcccgacgaccucgagugggccucccagcaguccaccgagaccggcucccucgacggcuccugccgcgaccuccucaacuccuccaucaccuccaccaccuccacccucguccccggcaugcucgaggaggaggaggacgaggacgaggaggaggaggaggacuacacccacgagcccaucuccgucgagguccagcucaacucccgcaucgaguccugggucuccgagacccagcgcaccauggagacccuccagcucggcaagacccucaacggcuccgaggaggacaacgucgagcaguccggcgaggaggaggccgaggcccccgagguccucgagcccggcauggacuccgaggccuggaccgccgaccagcaggccucccccggccagcagaaguccuccaacugcuccucccucaacaaggagcacuccgacuccaacuacaccacccagaccaccuga

SEQ ID NO: 49239 - RNA, 747 nt, Artificial Sequence
  derived and/or modified sequence opt2 from SECTM1__Homo_sapiens__NP_002995
augcagaccugcccccucgccuuccccggccacgucucccaggcccucggcacccuccucuuccucgccgccucccucuccgcccagaacgagggcugggacucccccaucugcaccgagggcgucgucuccgucuccuggggcgagaacaccgucauguccugcaacaucuccaacgccuucucccacgucaacaucaagcuccgcgcccacggccaggaguccgccaucuucaacgaggucgcccccggcuacuucucccgcgacggcuggcagcuccagguccagggcggcgucgcccagcucgucaucaagggcgcccgcgacucccacgccggccucuacauguggcaccucgucggccaccagcgcaacaaccgccaggucacccucgaggucuccggcgccgagccccaguccgcccccgacaccggcuucuggcccguccccgccgucgucaccgccgucuucauccuccucgucgcccucgucauguucgccugguaccgcugccgcugcucccagcagcgccgcgagaagaaguucuuccuccucgagccccagaugaaggucgccgcccuccgcgccggcgcccagcagggccucucccgcgccuccgccgagcucuggacccccgacuccgagcccaccccccgcccccucgcccucgucuucaagcccuccccccucggcgcccucgagcuccucuccccccagccccucuuccccuacgccgccgaccccuga

SEQ ID NO: 49240 - RNA, 906 nt, Artificial Sequence
  derived and/or modified sequence opt2 from SEL1L__Homo_sapiens__NP_001231913
augcgcguccgcaucggccucacccuccuccucugcgccguccuccucucccucgccuccgccuccuccgacgaggagggcucccaggacgagucccucgacuccaagaccacccucaccuccgacgaguccgucaaggaccacaccaccgccggccgcgucgucgccggccagaucuuccucgacuccgaggaguccgagcucgaguccuccauccaggaggaggaggacucccucaagucccaggagggcgaguccgucaccgaggacaucuccuuccucgagucccccaaccccgagaacaaggacuacgaggagcccaagaagguccgcaagcccgcccucaccgccaucgagggcaccgcccacggcgagcccugccacuuccccuuccucuuccucgacaaggaguacgacgagugcaccuccgacggccgcgaggacggccgccucuggugcgccaccaccuacgacuacaaggccgacgagaaguggggcuucugcgagaccgaggaggaggccgccaagcgccgccagaugcaggaggccgagaugauguaccagaccggcaugaagauccucaacggcuccaacaagaagucccagaagcgcgaggccuaccgcuaccuccagaaggccgccuccaugaaccacaccaaggcccucgagcgcgucuccuacgcccuccucuucggcgacuaccucccccagaacauccaggccgcccgcgagauguucgagaagcucaccgaggagggcucccccaagggccagaccgcccucggcuuccucuacgccuccggccucggcgucaacuccucccaggccaaggcccucgucuacuacaccuucggcgcccucggcggcaaccucaucgcccacaugguccucgucucccgccucuga

SEQ ID NO: 49241 - RNA, 1833 nt, Artificial Sequence
  derived and/or modified sequence opt2 from SELE__Homo_sapiens__NP_000441
augaucgccucccaguuccucuccgcccucacccucguccuccucaucaaggaguccggcgccugguccuacaacaccuccaccgaggccaugaccuacgacgaggccuccgccuacugccagcagcgcuacacccaccucgucgccauccagaacaaggaggagaucgaguaccucaacuccauccucuccuacucccccuccuacuacuggaucggcauccgcaaggucaacaacgucugggucugggucggcacccagaagccccucaccgaggaggccaagaacugggcccccggcgagcccaacaaccgccagaaggacgaggacugcgucgagaucuacaucaagcgcgagaaggacgucggcauguggaacgacgagcgcugcuccaagaagaagcucgcccucugcuacaccgccgccugcaccaacaccuccugcuccggccacggcgagugcgucgagaccaucaacaacuacaccugcaagugcgaccccggcuucuccggccucaagugcgagcagaucgucaacugcaccgcccucgagucccccgagcacggcucccucgucugcucccacccccucggcaacuucuccuacaacuccuccugcuccaucuccugcgaccgcggcuaccuccccuccuccauggagaccaugcagugcauguccuccggcgagugguccgcccccauccccgccugcaacgucgucgagugcgacgccgucaccaaccccgccaacggcuucgucgagugcuuccagaaccccggcuccuuccccuggaacaccaccugcaccuucgacugcgaggagggcuucgagcucaugggcgcccagucccuccagugcaccuccuccggcaacugggacaacgagaagcccaccugcaaggccgucaccugccgcgccguccgccagccccagaacggcuccguccgcugcucccacucccccgccggcgaguucaccuucaaguccuccugcaacuucaccugcgaggagggcuucaugcuccagggccccgcccaggucgagugcaccacccagggccaguggacccagcagauccccgucugcgaggccuuccagugcaccgcccucuccaaccccgagcgcggcuacaugaacugccuccccuccgccuccggcuccuuccgcuacggcuccuccugcgaguucuccugcgagcagggcuucguccucaagggcuccaagcgccuccagugcggccccaccggcgagugggacaacgagaagcccaccugcgaggccguccgcugcgacgccguccaccagccccccaagggccucguccgcugcgcccacucccccaucggcgaguucaccuacaaguccuccugcgccuucuccugcgaggagggcuucgagcuccacggcuccacccagcucgagugcaccucccagggccaguggaccgaggagguccccuccugccaggucgucaagugcuccucccucgccguccccggcaagaucaacauguccugcuccggcgagcccgucuucggcaccgucugcaaguucgccugccccgagggcuggacccucaacggcuccgccgcccgcaccugcggcgccaccggccacugguccggccuccuccccaccugcgaggcccccaccgaguccaacaucccccucgucgccggccucuccgccgccggccucucccuccucacccucgcccccuuccuccucuggcuccgcaagugccuccgcaaggccaagaaguucguccccgccuccuccugccagucccucgaguccgacggcuccuaccagaagcccuccuacauccucuga

SEQ ID NO: 49242 - RNA, 1233 nt, Artificial Sequence
  derived and/or modified sequence opt2 from SELENBP1__Homo_sapiens__NP_001245217
auggccaccaagugcggcaacugcggccccggcuacuccaccccccucgaggccaugaagggcccccgcgaggagaucgucuaccuccccugcaucuaccgcaacaccggcaccgaggcccccgacuaccucgccaccgucgacgucgaccccaaguccccccaguacugccaggucaucgagcccaaggacauccacgccaagugcgagcucgccuuccuccacaccucccacugccucgccuccggcgaggucaugaucuccucccucggcgacgucaagggcaacggcaagggcggcuucguccuccucgacggcgagaccuucgaggucaagggcaccugggagcgccccggcggcgccgccccccucggcuacgacuucugguaccagccccgccacaacgucaugaucuccaccgagugggccgcccccaacguccuccgcgacggcuucaaccccgccgacgucgaggccggccucuacggcucccaccucuacgucugggacuggcagcgccacgagaucguccagacccucucccucaaggacggccucaucccccucgagauccgcuuccuccacaaccccgacgccgcccagggcuucgucggcugcgcccucuccuccaccauccagcgcuucuacaagaacgagggcggcaccugguccgucgagaaggucauccaggucccccccaagaaggucaagggcuggcuccuccccgagaugcccggccucaucaccgacauccuccucucccucgacgaccgcuuccucuacuucuccaacuggcuccacggcgaccuccgccaguacgacaucuccgacccccagcgcccccgccucaccggccagcucuuccucggcggcuccaucgucaagggcggccccguccagguccucgaggacgaggagcucaagucccagcccgagccccucgucgucaagggcaagcgcgucgccggcggcccccagaugauccagcucucccucgacggcaagcgccucuacaucaccaccucccucuacuccgccugggacaagcaguucuaccccgaccucauccgcgagggcuccgucaugcuccaggucgacgucgacaccgucaagggcggccucaagcucaaccccaacuuccucgucgacuucggcaaggagccccucggccccgcccucgcccacgagcuccgcuaccccggcggcgacugcuccuccgacaucuggaucuga

SEQ ID NO: 49243 - RNA, 1158 nt, Artificial Sequence
  derived and/or modified sequence opt2 from SELL__Homo_sapiens__NP_000646
augggcugccgccgcacccgcgagggccccuccaaggccaugaucuuccccuggaagugccaguccacccagcgcgaccucuggaacaucuucaagcucuggggcuggaccaugcucugcugcgacuuccucgcccaccacggcaccgacugcuggaccuaccacuacuccgagaagcccaugaacuggcagcgcgcccgccgcuucugccgcgacaacuacaccgaccucgucgccauccagaacaaggccgagaucgaguaccucgagaagacccuccccuucucccgcuccuacuacuggaucggcauccgcaagaucggcggcaucuggaccugggucggcaccaacaagucccucaccgaggaggccgagaacuggggcgacggcgagcccaacaacaagaagaacaaggaggacugcgucgagaucuacaucaagcgcaacaaggacgccggcaaguggaacgacgacgccugccacaagcucaaggccgcccucugcuacaccgccuccugccagcccugguccugcuccggccacggcgagugcgucgagaucaucaacaacuacaccugcaacugcgacgucggcuacuacggcccccagugccaguucgucauccagugcgagccccucgaggcccccgagcucggcaccauggacugcacccacccccucggcaacuucuccuucuccucccagugcgccuucuccugcuccgagggcaccaaccucaccggcaucgaggagaccaccugcggccccuucggcaacugguccucccccgagcccaccugccaggucauccagugcgagccccucuccgcccccgaccucggcaucaugaacugcucccacccccucgccuccuucuccuucaccuccgccugcaccuucaucugcuccgagggcaccgagcucaucggcaagaagaagaccaucugcgaguccuccggcaucugguccaaccccucccccaucugccagaagcucgacaaguccuucuccaugaucaaggagggcgacuacaacccccucuucauccccgucgccgucauggucaccgccuucuccggccucgccuucaucaucuggcucgcccgccgccucaagaagggcaagaaguccaagcgcuccaugaacgaccccuacuga

SEQ ID NO: 49244 - RNA, 2493 nt, Artificial Sequence
  derived and/or modified sequence opt2 from SELP__Homo_sapiens__NP_002996
auggccaacugccagaucgccauccucuaccagcgcuuccagcgcgucgucuucggcaucucccagcuccucugcuucuccgcccucaucuccgagcucaccaaccagaaggaggucgccgccuggaccuaccacuacuccaccaaggccuacuccuggaacaucucccgcaaguacugccagaaccgcuacaccgaccucgucgccauccagaacaagaacgagaucgacuaccucaacaagguccuccccuacuacuccuccuacuacuggaucggcauccgcaagaacaacaagaccuggaccugggucggcaccaagaaggcccucaccaacgaggccgagaacugggccgacaacgagcccaacaacaagcgcaacaacgaggacugcgucgagaucuacaucaagucccccuccgcccccggcaaguggaacgacgagcacugccucaagaagaagcacgcccucugcuacaccgccuccugccaggacauguccugcuccaagcagggcgagugccucgagaccaucggcaacuacaccugcuccugcuaccccggcuucuacggccccgagugcgaguacguccgcgagugcggcgagcucgagcucccccagcacguccucaugaacugcucccacccccucggcaacuucuccuucaacucccagugcuccuuccacugcaccgacggcuaccaggucaacggccccuccaagcucgagugccucgccuccggcaucuggaccaacaagcccccccagugccucgccgcccagugccccccccucaagauccccgagcgcggcaacaugaccugccuccacuccgccaaggccuuccagcaccaguccuccugcuccuucuccugcgaggagggcuucgcccucgucggccccgaggucguccagugcaccgccuccggcgucuggaccgcccccgcccccgucugcaaggccguccagugccagcaccucgaggcccccuccgagggcaccauggacugcguccacccccucaccgccuucgccuacggcuccuccugcaaguucgagugccagcccggcuaccgcguccgcggccucgacaugcuccgcugcaucgacuccggccacugguccgccccccuccccaccugcgaggccaucuccugcgagccccucgagucccccguccacggcuccauggacugcucccccucccuccgcgccuuccaguacgacaccaacugcuccuuccgcugcgccgagggcuucaugcuccgcggcgccgacaucguccgcugcgacaaccucggccaguggaccgcccccgcccccgucugccaggcccuccagugccaggaccuccccguccccaacgaggcccgcgucaacugcucccaccccuucggcgccuuccgcuaccaguccgucugcuccuucaccugcaacgagggccuccuccucgucggcgccuccguccuccagugccucgccaccggcaacuggaacuccgucccccccgagugccaggccauccccugcaccccccuccucuccccccagaacggcaccaugaccugcguccagccccucggcuccuccuccuacaaguccaccugccaguucaucugcgacgagggcuacucccucuccggccccgagcgccucgacugcacccgcuccggccgcuggaccgacuccccccccaugugcgaggccaucaagugccccgagcucuucgcccccgagcagggcucccucgacugcuccgacacccgcggcgaguucaacgucggcuccaccugccacuucuccugcgacaacggcuucaagcucgagggccccaacaacgucgagugcaccaccuccggccgcugguccgccaccccccccaccugcaagggcaucgccucccuccccacccccggcguccagugccccgcccucaccacccccggccagggcaccauguacugccgccaccaccccggcaccuucggcuucaacaccaccugcuacuucggcugcaacgccggcuucacccucaucggcgacuccacccucuccugccgccccuccggccaguggaccgccgucacccccgccugccgcgccgucaagugcuccgagcuccacgucaacaagcccaucgccaugaacugcuccaaccucuggggcaacuucuccuacggcuccaucugcuccuuccacugccucgagggccagcuccucaacggcuccgcccagaccgccugccaggagaacggccacugguccaccaccguccccaccugccaggccggcccccucaccauccaggaggcccucaccuacuucggcggcgccgucgccuccaccaucggccucaucaugggcggcacccuccucgcccuccuccgcaagcgcuuccgccagaaggacgacggcaagugcccccucaacccccacucccaccucggcaccuacggcgucuucaccaacgccgccuucgaccccucccccuga

SEQ ID NO: 49245 - RNA, 1287 nt, Artificial Sequence
  derived and/or modified sequence opt2 from SELPLG__Homo_sapiens__NP_001193538
auggccgucggcgccuccggccucgagggcgacaagauggccggcgccaugccccuccagcuccuccuccuccucauccuccucggccccggcaacucccuccagcucugggacaccugggccgacgaggccgagaaggcccucggcccccuccucgcccgcgaccgccgccaggccaccgaguacgaguaccucgacuacgacuuccuccccgagaccgagccccccgagaugcuccgcaacuccaccgacaccaccccccucaccggccccggcacccccgaguccaccaccgucgagcccgccgcccgccgcuccaccggccucgacgccggcggcgccgucaccgagcucaccaccgagcucgccaacaugggcaaccucuccaccgacuccgccgccauggagauccagaccacccagcccgccgccaccgaggcccagaccacccagcccguccccaccgaggcccagaccaccccccucgccgccaccgaggcccagaccacccgccucaccgccaccgaggcccagaccaccccccucgccgccaccgaggcccagaccaccccccccgccgccaccgaggcccagaccacccagcccaccggccucgaggcccagaccaccgcccccgccgccauggaggcccagaccaccgcccccgccgccauggaggcccagaccaccccccccgccgccauggaggcccagaccacccagaccaccgccauggaggcccagaccaccgcccccgaggccaccgaggcccagaccacccagcccaccgccaccgaggcccagaccaccccccucgccgccauggaggcccucuccaccgagcccuccgccaccgaggcccucuccauggagcccaccaccaagcgcggccucuucauccccuucuccgucuccuccgucacccacaagggcauccccauggccgccuccaaccucuccgucaacuaccccgucggcgcccccgaccacaucuccgucaagcagugccuccucgccauccucauccucgcccucgucgccaccaucuucuucgucugcaccgucguccucgccguccgccucucccgcaagggccacauguaccccguccgcaacuacucccccaccgagauggucugcaucuccucccuccuccccgacggcggcgagggccccuccgccaccgccaacggcggccucuccaaggccaagucccccggccucacccccgagccccgcgaggaccgcgagggcgacgaccucacccuccacuccuuccuccccuga

SEQ ID NO: 49246 - RNA, 2316 nt, Artificial Sequence
  derived and/or modified sequence opt2 from SEMA3A__Homo_sapiens__XP_006715902
augggcuggcucacccgcaucgucugccucuucuggggcguccuccucaccgcccgcgccaacuaccagaacggcaagaacaacgucccccgccucaagcucuccuacaaggagaugcucgaguccaacaacgucaucaccuucaacggccucgccaacuccuccuccuaccacaccuuccuccucgacgaggagcgcucccgccucuacgucggcgccaaggaccacaucuucuccuucgaccucgucaacaucaaggacuuccagaagaucgucuggcccgucuccuacacccgccgcgacgagugcaagugggccggcaaggacauccucaaggagugcgccaacuucaucaagguccucaaggccuacaaccagacccaccucuacgccugcggcaccggcgccuuccaccccaucugcaccuacaucgagaucggccaccaccccgaggacaacaucuucaagcucgagaacucccacuucgagaacggccgcggcaagucccccuacgaccccaagcuccucaccgccucccuccucaucgacggcgagcucuacuccggcaccgccgccgacuucaugggccgcgacuucgccaucuuccgcacccucggccaccaccaccccauccgcaccgagcagcacgacucccgcuggcucaacgaccccaaguucaucuccgcccaccucaucuccgaguccgacaaccccgaggacgacaaggucuacuucuucuuccgcgagaacgccaucgacggcgagcacuccggcaaggccacccacgcccgcaucggccagaucugcaagaacgacuucggcggccaccgcucccucgucaacaaguggaccaccuuccucaaggcccgccucaucugcuccguccccggccccaacggcaucgacacccacuucgacgagcuccaggacgucuuccucaugaacuucaaggaccccaagaaccccgucgucuacggcgucuucaccaccuccuccaacaucuucaagggcuccgccgucugcauguacuccauguccgacguccgccgcgucuuccucggccccuacgcccaccgcgacggccccaacuaccaguggguccccuaccagggccgcguccccuacccccgccccggcaccugccccuccaagaccuucggcggcuucgacuccaccaaggaccuccccgacgacgucaucaccuucgcccgcucccaccccgccauguacaaccccgucuuccccaugaacaaccgccccaucgucaucaagaccgacgucaacuaccaguucacccagaucgucgucgaccgcgucgacgccgaggacggccaguacgacgucauguucaucggcaccgacgucggcaccguccucaaggucgucuccauccccaaggagaccugguacgaccucgaggagguccuccucgaggagaugaccgucuuccgcgagcccaccgccaucuccgccauggagcucuccaccaagcagcagcagcucuacaucggcuccaccgccggcgucgcccagcucccccuccaccgcugcgacaucuacggcaaggccugcgccgagugcugccucgcccgcgaccccuacugcgccugggacggcuccgccugcucccgcuacuuccccaccgccaagcgccgcacccgccgccaggacauccgcaacggcgacccccucacccacugcuccgaccuccaccacgacaaccaccacggccacucccccgaggagcgcaucaucuacggcgucgagaacuccuccaccuuccucgagugcucccccaagucccagcgcgcccucgucuacuggcaguuccagcgccgcaacgaggagcgcaaggaggagauccgcgucgacgaccacaucauccgcaccgaccagggccuccuccuccgcucccuccagcagaaggacuccggcaacuaccucugccacgccgucgagcacggcuucauccagacccuccucaaggucacccucgaggucaucgacaccgagcaccucgaggagcuccuccacaaggacgacgacggcgacggcuccaagaccaaggagauguccaacuccaugacccccucccagaaggucugguaccgcgacuucaugcagcucaucaaccaccccaaccucaacaccauggacgaguucugcgagcaggucuggaagcgcgaccgcaagcagcgccgccagcgccccggccacacccccggcaacuccaacaaguggaagcaccuccaggagaacaagaagggccgcaaccgccgcacccacgaguucgagcgcgccccccgcuccgucuga

SEQ ID NO: 49247 - RNA, 2250 nt, Artificial Sequence
  derived and/or modified sequence opt2 from SEMA3B__Homo_sapiens__NP_001276989
augggccgcgccggcgccgccgccgucauccccggccucgcccuccucugggccgucggccucggcuccgccgcccccucccccccccgccuccgccucuccuuccaggagcuccaggccuggcacggccuccagaccuucucccucgagcgcaccugcugcuaccaggcccuccucgucgacgaggagcgcggccgccucuucgucggcgccgagaaccacgucgccucccucaaccucgacaacaucuccaagcgcgccaagaagcucgccuggcccgcccccgucgaguggcgcgaggagugcaacugggccggcaaggacaucggcaccgagugcaugaacuucgucaagcuccuccacgccuacaaccgcacccaccuccucgccugcggcaccggcgccuuccaccccaccugcgccuucgucgaggucggccaccgcgccgaggagcccguccuccgccucgaccccggccgcaucgaggacggcaagggcaagucccccuacgacccccgccaccgcgccgccuccguccucgucggcgaggagcucuacuccggcgucgccgccgaccucaugggccgcgacuucaccaucuuccgcucccucggccagcgccccucccuccgcaccgagccccacgacucccgcuggcucaacgagcccaaguucgucaaggucuucuggauccccgaguccgagaaccccgacgacgacaagaucuacuucuucuuccgcgagaccgccgucgaggccgcccccgcccucggccgccucuccgucucccgcgucggccagaucugccgcaacgacgucggcggccagcgcucccucgucaacaaguggaccaccuuccucaaggcccgccucgucugcuccguccccggcgucgagggcgacacccacuucgaccagcuccaggacgucuuccuccucuccucccgcgaccaccgcaccccccuccucuacgccgucuucuccaccuccuccuccaucuuccagggcuccgccgucugcgucuacuccaugaacgacguccgccgcgccuuccucggccccuucgcccacaaggagggccccaugcaccagugggucuccuaccagggccgcguccccuacccccgccccggcaugugccccuccaagaccuucggcaccuucuccuccaccaaggacuuccccgacgacgucauccaguucgcccgcaaccacccccucauguacaacuccguccuccccaccggcggccgcccccucuuccuccaggucggcgccaacuacaccuucacccagaucgccgccgaccgcgucgccgccgccgacggccacuacgacguccucuucaucggcaccgacgucggcaccguccucaaggucaucuccguccccaagggcucccgccccuccgccgagggccuccuccucgaggagcuccacgucuucgaggacuccgccgccgucaccuccaugcagaucuccuccaagcgccaccagcucuacgucgccucccgcuccgccgucgcccagaucgcccuccaccgcugcgccgcccacggccgcgucugcaccgagugcugccucgcccgcgaccccuacugcgccugggacggcgucgccugcacccgcuuccagcccuccgccaagcgccgcuuccgccgccaggacguccgcaacggcgaccccuccacccucugcuccggcgacuccucccgccccgcccuccucgagcacaaggucuucggcgucgagggcuccuccgccuuccucgagugcgagccccgcucccuccaggcccgcgucgaguggaccuuccagcgcgccggcgucaccgcccacacccagguccucgccgaggagcgcaccgagcgcaccgcccgcggccuccuccuccgccgccuccgccgccgcgacuccggcgucuaccucugcgccgccgucgagcagggcuucacccagccccuccgccgccucucccuccacguccucuccgccacccaggccgagcgccucgcccgcgccgaggaggccgcccccgccgccccccccggccccaagcucugguaccgcgacuuccuccagcucgucgagcccggcggcggcggcuccgccaacucccuccgcaugugccgcccccagcccgcccuccagucccucccccucgagucccgccgcaagggccgcaaccgccgcacccacgcccccgagccccgcgccgagcgcggcccccgcuccgccacccacugguga

SEQ ID NO: 49248 - RNA, 2256 nt, Artificial Sequence
  derived and/or modified sequence opt2 from SEMA3C__Homo_sapiens__NP_006370
auggccuuccgcaccaucugcguccucgucggcgucuucaucugcuccaucugcgucaagggcuccucccagccccaggcccgcgucuaccucaccuucgacgagcuccgcgagaccaagaccuccgaguacuucucccucucccaccacccccucgacuaccgcauccuccucauggacgaggaccaggaccgcaucuacgucggcuccaaggaccacauccucucccucaacaucaacaacaucucccaggaggcccucuccgucuucuggcccgccuccaccaucaaggucgaggagugcaagauggccggcaaggaccccacccacggcugcggcaacuucguccgcgucauccagaccuucaaccgcacccaccucuacgucugcggcuccggcgccuucucccccgucugcaccuaccucaaccgcggccgccgcuccgaggaccaggucuucaugaucgacuccaagugcgaguccggcaagggccgcugcuccuucaaccccaacgucaacaccgucuccgucaugaucaacgaggagcucuucuccggcauguacaucgacuucaugggcaccgacgccgccaucuuccgcucccucaccaagcgcaacgccguccgcaccgaccagcacaacuccaaguggcucuccgagcccauguucgucgacgcccacgucauccccgacggcaccgaccccaacgacgccaaggucuacuucuucuucaaggagaagcucaccgacaacaaccgcuccaccaagcagauccacuccaugaucgcccgcaucugccccaacgacaccggcggccuccgcucccucgucaacaaguggaccaccuuccucaaggcccgccucgucugcuccgucaccgacgaggacggccccgagacccacuucgacgagcucgaggacgucuuccuccucgagaccgacaacccccgcaccacccucgucuacggcaucuucaccaccuccuccuccgucuucaagggcuccgccgucugcgucuaccaccucuccgacauccagaccgucuucaacggccccuucgcccacaaggagggccccaaccaccagcucaucuccuaccagggccgcauccccuacccccgccccggcaccugccccggcggcgccuucacccccaacaugcgcaccaccaaggaguuccccgacgacgucgucaccuucauccgcaaccacccccucauguacaacuccaucuaccccauccacaagcgcccccucaucguccgcaucggcaccgacuacaaguacaccaagaucgccgucgaccgcgucaacgccgccgacggccgcuaccacguccucuuccucggcaccgaccgcggcaccguccagaaggucgucguccuccccaccaacaacuccgucuccggcgagcucauccucgaggagcucgaggucuucaagaaccacgcccccaucaccaccaugaagaucuccuccaagaagcagcagcucuacgucuccuccaacgagggcgucucccaggucucccuccaccgcugccacaucuacggcaccgccugcgccgacugcugccucgcccgcgaccccuacugcgccugggacggccacuccugcucccgcuucuaccccaccggcaagcgccgcucccgccgccaggacguccgccacggcaacccccucacccagugccgcggcuucaaccucaaggccuaccgcaacgccgccgagaucguccaguacggcgucaagaacaacaccaccuuccucgagugcgcccccaaguccccccaggccuccaucaaguggcuccuccagaaggacaaggaccgccgcaaggaggucaagcucaacgagcgcaucaucgccaccucccagggccuccucauccgcuccguccagggcuccgaccagggccucuaccacugcaucgccaccgagaacuccuucaagcagaccaucgccaagaucaacuucaagguccucgacuccgagauggucgccgucgucaccgacaaguggucccccuggaccugggccuccuccguccgcgcccuccccuuccaccccaaggacaucaugggcgccuucucccacuccgagaugcagaugaucaaccaguacugcaaggacacccgccagcagcaccagcagggcgacgagucccagaagaugcgcggcgacuacggcaagcucaaggcccucaucaacucccgcaagucccgcaaccgccgcaaccagcuccccgaguccuga

SEQ ID NO: 49249 - RNA, 2334 nt, Artificial Sequence
  derived and/or modified sequence opt2 from SEMA3D__Homo_sapiens__NP_689967
augaacgccaacaaggacgagcgccucaaggcccgcucccaggacuuccaccucuuccccgcccucaugaugcucuccaugaccaugcucuuccuccccgucaccggcacccucaagcagaacaucccccgccucaagcucaccuacaaggaccuccuccucuccaacuccugcauccccuuccucggcuccuccgagggccucgacuuccagacccuccuccucgacgaggagcgcggccgccuccuccucggcgccaaggaccacaucuuccuccucucccucgucgaccucaacaagaacuucaagaagaucuacuggcccgccgccaaggagcgcgucgagcucugcaagcucgccggcaaggacgccaacaccgagugcgccaacuucauccgcguccuccagcccuacaacaagacccacaucuacgucugcggcaccggcgccuuccaccccaucugcggcuacaucgaccucggcgucuacaaggaggacaucaucuucaagcucgacacccacaaccucgaguccggccgccucaagugccccuucgacccccagcagcccuucgccuccgucaugaccgacgaguaccucuacuccggcaccgccuccgacuuccucggcaaggacaccgccuucacccgcucccucggccccacccacgaccaccacuacauccgcaccgacaucuccgagcacuacuggcucaacggcgccaaguucaucggcaccuucuucauccccgacaccuacaaccccgacgacgacaagaucuacuucuucuuccgcgaguccucccaggagggcuccaccuccgacaagaccauccucucccgcgucggccgcgucugcaagaacgacgucggcggccagcgcucccucaucaacaaguggaccaccuuccucaaggcccgccucaucugcuccauccccggcuccgacggcgccgacaccuacuucgacgagcuccaggacaucuaccuccuccccacccgcgacgagcgcaaccccgucgucuacggcgucuucaccaccaccuccuccaucuucaagggcuccgccgucugcgucuacuccauggccgacauccgcgccgucuucaacggccccuacgcccacaaggaguccgccgaccaccgcuggguccaguacgacggccgcauccccuacccccgccccggcaccugccccuccaagaccuacgacccccucaucaaguccacccgcgacuuccccgacgacgucaucuccuucaucaagcgccacuccgucauguacaaguccgucuaccccgucgccggcggccccaccuucaagcgcaucaacgucgacuaccgccucacccagaucgucgucgaccacgucaucgccgaggacggccaguacgacgucauguuccucggcaccgacaucggcaccguccucaaggucgucuccaucuccaaggagaaguggaacauggaggaggucguccucgaggagcuccagaucuucaagcacuccuccaucauccucaacauggagcucucccucaagcagcagcagcucuacaucggcucccgcgacggccucguccagcucucccuccaccgcugcgacaccuacggcaaggccugcgccgacugcugccucgcccgcgaccccuacugcgccugggacggcaacgccugcucccgcuacgcccccaccuccaagcgccgcgcccgccgccaggacgucaaguacggcgaccccaucacccagugcugggacaucgaggacuccaucucccacgagaccgccgacgagaaggucaucuucggcaucgaguucaacuccaccuuccucgagugcauccccaagucccagcaggccaccaucaagugguacauccagcgcuccggcgacgagcaccgcgaggagcucaagcccgacgagcgcaucaucaagaccgaguacggccuccucauccgcucccuccagaagaaggacuccggcauguacuacugcaaggcccaggagcacaccuucauccacaccaucgucaagcucacccucaacgucaucgagaacgagcagauggagaacacccagcgcgccgagcacgaggagggcaaggucaaggaccuccucgccgagucccgccuccgcuacaaggacuacauccagauccucuccucccccaacuucucccucgaccaguacugcgagcagauguggcaccgcgagaagcgccgccagcgcaacaagggcggccccaaguggaagcacaugcaggagaugaagaagaagcgcaaccgccgccaccaccgcgaccucgacgagcucccccgcgccgucgccaccuga

SEQ ID NO: 49250 - RNA, 2148 nt, Artificial Sequence
  derived and/or modified sequence opt2 from SEMA3E__Homo_sapiens__NP_001171600
augcuccucgacgaguaccaggagcgccucuucgucggcggccgcgaccucgucuacucccucucccucgagcgcaucuccgacggcuacaaggagauccacuggcccuccaccgcccucaagauggaggagugcaucaugaagggcaaggacgccggcgagugcgccaacuacguccgcguccuccaccacuacaaccgcacccaccuccucaccugcggcaccggcgccuucgaccccgucugcgccuucauccgcgucggcuaccaccucgaggacccccucuuccaccucgaguccccccgcuccgagcgcggccgcggccgcugccccuucgaccccuccuccuccuucaucuccacccucaucggcuccgagcucuucgccggccucuacuccgacuacuggucccgcgacgccgccaucuuccgcuccaugggccgccucgcccacauccgcaccgagcacgacgacgagcgccuccucaaggagcccaaguucgucggcuccuacaugauccccgacaacgaggaccgcgacgacaacaaggucuacuucuucuucaccgagaaggcccucgaggccgagaacaacgcccacgccaucuacacccgcgucggccgccucugcgucaacgacgucggcggccagcgcauccucgucaacaagugguccaccuuccucaaggcccgccucgucugcuccguccccggcaugaacggcaucgacaccuacuucgacgagcucgaggacgucuuccuccuccccacccgcgaccacaagaaccccgucaucuucggccucuucaacaccaccuccaacaucuuccgcggccacgccaucugcgucuaccacauguccuccauccgcgccgccuucaacggccccuacgcccacaaggagggccccgaguaccacugguccgucuacgagggcaagguccccuacccccgccccggcuccugcgccuccaaggucaacggcggccgcuacggcaccaccaaggacuaccccgacgacgccauccgcuucgcccgcucccacccccucauguaccaggccaucaagcccgcccacaagaagcccauccucgucaagaccgacggcaaguacaaccucaagcagaucgccgucgaccgcgucgaggccgaggacggccaguacgacguccucuucaucggcaccgacaacggcaucguccucaaggucaucaccaucuacaaccaggagauggaguccauggaggaggucauccucgaggagcuccagaucuucaaggaccccguccccaucaucuccauggagaucuccuccaagcgccagcagcucuacaucggcuccgccuccgccgucgcccagguccgcuuccaccacugcgacauguacggcuccgccugcgccgacugcugccucgcccgcgaccccuacugcgccugggacggcaucuccugcucccgcuacuaccccaccggcacccacgccaagcgccgcuuccgccgccaggacguccgccacggcaacgccgcccagcagugcuucggccagcaguucgucggcgacgcccucgacaagaccgaggagcaccucgccuacggcaucgagaacaacuccacccuccucgagugcaccccccgcucccuccaggccaaggucaucugguucguccagaagggccgcgagacccgcaaggaggaggucaagaccgacgaccgcgucgucaagauggaccucggccuccucuuccuccgccuccacaaguccgacgccggcaccuacuucugccagaccgucgagcacuccuucguccacaccguccgcaagaucacccucgaggucgucgaggaggagaaggucgaggacauguucaacaaggacgacgaggaggaccgccaccaccgcaugcccugccccgcccaguccuccaucucccagggcgccaagcccugguacaaggaguuccuccagcucaucggcuacuccaacuuccagcgcgucgaggaguacugcgagaaggucuggugcaccgaccgcaagcgcaagaagcucaagaugucccccuccaaguggaaguacgccaacccccaggagaagaagcuccgcuccaagcccgagcacuaccgccucccccgccacacccucgacuccuga

SEQ ID NO: 49251 - RNA, 2358 nt, Artificial Sequence
  derived and/or modified sequence opt2 from SEMA3F__Homo_sapiens__NP_004177
augcucgucgccggccuccuccucugggccucccuccucaccggcgccuggcccuccuuccccacccaggaccaccuccccgccaccccccgcguccgccucuccuucaaggagcucaaggccaccggcaccgcccacuucuucaacuuccuccucaacaccaccgacuaccgcauccuccucaaggacgaggaccacgaccgcauguacgucggcuccaaggacuacguccucucccucgaccuccacgacaucaaccgcgagccccucaucauccacugggccgccuccccccagcgcaucgaggagugcguccucuccggcaaggacgucaacggcgagugcggcaacuucguccgccucauccagcccuggaaccgcacccaccucuacgucugcggcaccggcgccuacaaccccaugugcaccuacgucaaccgcggccgccgcgcccaggccacccccuggacccagacccaggccguccgcggccgcggcucccgcgccaccgacggcgcccuccgccccaugcccaccgccccccgccaggacuacaucuucuaccucgagcccgagcgccucgaguccggcaagggcaagugccccuacgaccccaagcucgacaccgccuccgcccucaucaacgaggagcucuacgccggcgucuacaucgacuucaugggcaccgacgccgccaucuuccgcacccucggcaagcagaccgccaugcgcaccgaccaguacaacucccgcuggcucaacgaccccuccuucauccacgccgagcucauccccgacuccgccgagcgcaacgacgacaagcucuacuucuucuuccgcgagcgcuccgccgaggccccccagucccccgccgucuacgcccgcaucggccgcaucugccucaacgacgacggcggccacugcugccucgucaacaagugguccaccuuccucaaggcccgccucgucugcuccguccccggcgaggacggcaucgagacccacuucgacgagcuccaggacgucuucguccagcagacccaggacguccgcaaccccgucaucuacgccgucuucaccuccuccggcuccgucuuccgcggcuccgccgucugcgucuacuccauggccgacauccgcauggucuucaacggccccuucgcccacaaggagggccccaacuaccaguggaugcccuucuccggcaagaugcccuacccccgccccggcaccugccccggcggcaccuucacccccuccaugaaguccaccaaggacuaccccgacgaggucaucaacuucaugcgcucccacccccucauguaccaggccgucuacccccuccagcgccgcccccucgucguccgcaccggcgcccccuaccgccucaccaccaucgccgucgaccaggucgacgccgccgacggccgcuacgagguccucuuccucggcaccgaccgcggcaccguccagaaggucaucguccuccccaaggacgaccaggagcucgaggagcucaugcucgaggaggucgaggucuucaaggaccccgcccccgucaagaccaugaccaucuccuccaagcgccagcagcucuacgucgccuccgccgucggcgucacccaccucucccuccaccgcugccaggccuacggcgccgccugcgccgacugcugccucgcccgcgaccccuacugcgccugggacggccaggccugcucccgcuacaccgccuccuccaagcgccgcucccgccgccaggacguccgccacggcaaccccauccgccagugccgcggcuucaacuccaacgccaacaagaacgccgucgaguccguccaguacggcgucgccggcuccgccgccuuccucgagugccagccccgcuccccccaggccaccgucaaguggcucuuccagcgcgaccccggcgaccgccgccgcgagauccgcgccgaggaccgcuuccuccgcaccgagcagggccuccuccuccgcgcccuccagcucuccgaccgcggccucuacuccugcaccgccaccgagaacaacuucaagcacgucgucacccgcguccagcuccacguccucggccgcgacgccguccacgccgcccucuuccccccccucuccauguccgccccccccccccccggcgccggcccccccaccccccccuaccaggagcucgcccagcuccucgcccagcccgaggucggccucauccaccaguacugccagggcuacuggcgccacgucccccccuccccccgcgaggcccccggcgccccccgcucccccgagccccaggaccagaagaagccccgcaaccgccgccaccacccccccgacaccuga

SEQ ID NO: 49252 - RNA, 2349 nt, Artificial Sequence
  derived and/or modified sequence opt2 from SEMA3G__Homo_sapiens__NP_064548
auggcccccuccgccugggccaucugcuggcuccucggcggccuccuccuccacggcggcuccuccggccccucccccggccccuccgucccccgccuccgccucuccuaccgcgaccuccucuccgccaaccgcuccgccaucuuccucggcccccagggcucccucaaccuccaggccauguaccucgacgaguaccgcgaccgccucuuccucggcggccucgacgcccucuacucccuccgccucgaccaggccuggcccgacccccgcgagguccucuggcccccccagcccggccagcgcgaggagugcguccgcaagggccgcgacccccucaccgagugcgccaacuucguccgcguccuccagccccacaaccgcacccaccuccucgccugcggcaccggcgccuuccagcccaccugcgcccucaucaccgucggccaccgcggcgagcacguccuccaccucgagcccggcuccgucgaguccggccgcggccgcugcccccacgagcccucccgccccuucgccuccaccuucaucgacggcgagcucuacaccggccucaccgccgacuuccucggccgcgaggccaugaucuuccgcuccggcggcccccgccccgcccuccgcuccgacuccgaccagucccuccuccacgacccccgcuucgucauggccgcccgcauccccgagaacuccgaccaggacaacgacaaggucuacuucuucuucuccgagaccguccccucccccgacggcggcuccaaccacgucaccgucucccgcgucggccgcgucugcgucaacgacgccggcggccagcgcguccucgucaacaagugguccaccuuccucaaggcccgccucgucugcuccguccccggccccggcggcgccgagacccacuucgaccagcucgaggacgucuuccuccucuggcccaaggccggcaagucccucgaggucuacgcccucuucuccaccgucuccgccgucuuccagggcuucgccgucugcgucuaccacauggccgacaucugggaggucuucaacggccccuucgcccaccgcgacggcccccagcaccaguggggccccuacggcggcaagguccccuucccccgccccggcgucugccccuccaagaugaccgcccagcccggccgccccuucggcuccaccaaggacuaccccgacgagguccuccaguucgcccgcgcccacccccucauguucuggcccguccgcccccgccacggccgccccguccucgucaagacccaccucgcccagcagcuccaccagaucgucgucgaccgcgucgaggccgaggacggcaccuacgacgucaucuuccucggcaccgacuccggcuccguccucaaggucaucgcccuccaggccggcggcuccgccgagcccgaggaggucguccucgaggagcuccaggucuucaagguccccacccccaucaccgagauggagaucuccgucaagcgccagaugcucuacgucggcucccgccucggcgucgcccagcuccgccuccaccagugcgagaccuacggcaccgccugcgccgagugcugccucgcccgcgaccccuacugcgccugggacggcgccuccugcacccacuaccgccccucccucggcaagcgccgcuuccgccgccaggacauccgccacggcaaccccgcccuccagugccucggccagucccaggaggaggaggccgucggccucgucgccgccaccauggucuacggcaccgagcacaacuccaccuuccucgagugccuccccaaguccccccaggccgccguccgcuggcuccuccagcgccccggcgacgagggccccgaccaggucaagaccgacgagcgcguccuccacaccgagcgcggccuccucuuccgccgccucucccgcuucgacgccggcaccuacaccugcaccacccucgagcacggcuucucccagaccgucguccgccucgcccucgucgucaucgucgccucccagcucgacaaccucuucccccccgagcccaagcccgaggagccccccgcccgcggcggccucgccuccaccccccccaaggccugguacaaggacauccuccagcucaucggcuucgccaaccucccccgcgucgacgaguacugcgagcgcgucuggugccgcggcaccaccgagugcuccggcugcuuccgcucccgcucccgcggcaagcaggcccgcggcaaguccugggccggccucgagcucggcaagaagaugaagucccgcguccacgccgagcacaaccgcaccccccgcgaggucgaggccaccuga

SEQ ID NO: 49253 - RNA, 1890 nt, Artificial Sequence
  derived and/or modified sequence opt2 from SEMA4A__Homo_sapiens__NP_001180231
augauccccuggcccgccuccgaccgcaagaaguccgagugcgccuucaagaagaaguccaacgaggagcuccaggacuccuaccuccuccccaucuccgaggacaaggucauggagggcaagggccagucccccuucgaccccgcccacaagcacaccgccguccucgucgacggcaugcucuacuccggcaccaugaacaacuuccucggcuccgagcccauccucaugcgcacccucggcucccagcccguccucaagaccgacaacuuccuccgcuggcuccaccacgacgccuccuucgucgccgccauccccuccacccaggucgucuacuucuucuucgaggagaccgccuccgaguucgacuucuucgagcgccuccacaccucccgcgucgcccgcgucugcaagaacgacgucggcggcgagaagcuccuccagaagaaguggaccaccuuccucaaggcccagcuccucugcacccagcccggccagcuccccuucaacgucauccgccacgccguccuccuccccgccgacucccccaccgccccccacaucuacgccgucuucaccucccaguggcaggucggcggcacccgcuccuccgccgucugcgccuucucccuccucgacaucgagcgcgucuucaagggcaaguacaaggagcucaacaaggagaccucccgcuggaccaccuaccgcggccccgagaccaacccccgccccggcuccugcuccgucggccccuccuccgacaaggcccucaccuucaugaaggaccacuuccucauggacgagcaggucgucggcaccccccuccucgucaaguccggcgucgaguacacccgccucgccgucgagaccgcccagggccucgacggccacucccaccucgucauguaccucggcaccaccaccggcucccuccacaaggccgucgucuccggcgacuccuccgcccaccucgucgaggagauccagcucuuccccgaccccgagcccguccgcaaccuccagcucgcccccacccagggcgccgucuucgucggcuucuccggcggcgucuggcgcgucccccgcgccaacugcuccgucuacgaguccugcgucgacugcguccucgcccgcgacccccacugcgccugggaccccgagucccgcaccugcugccuccucuccgcccccaaccucaacuccuggaagcaggacauggagcgcggcaaccccgagugggccugcgccuccggccccaugucccgcucccuccgcccccagucccgcccccagaucaucaaggagguccucgccguccccaacuccauccucgagcuccccugcccccaccucuccgcccucgccuccuacuacuggucccacggccccgccgccguccccgaggccuccuccaccgucuacaacggcucccuccuccucaucguccaggacggcgucggcggccucuaccagugcugggccaccgagaacggcuucuccuaccccgucaucuccuacugggucgacucccaggaccagacccucgcccucgaccccgagcucgccggcaucccccgcgagcacgucaaggucccccucacccgcgucuccggcggcgccgcccucgccgcccagcaguccuacuggccccacuucgucaccgucaccguccucuucgcccucguccucuccggcgcccucaucauccucgucgccuccccccuccgcgcccuccgcgcccgcggcaagguccagggcugcgagacccuccgccccggcgagaaggccccccucucccgcgagcagcaccuccagucccccaaggagugccgcaccuccgccuccgacgucgacgccgacaacaacugccucggcaccgaggucgccuga

SEQ ID NO: 49254 - RNA, 2514 nt, Artificial Sequence
  derived and/or modified sequence opt2 from SEMA4B__Homo_sapiens__NP_064595
augcuccgcaccgccaugggccuccgcuccuggcucgccgcccccuggggcgcccuccccccccgccccccccuccuccuccuccuccuccuccuccuccuccuccagccccccccccccaccugggcccucuccccccgcaucucccucccccucggcuccgaggagcgccccuuccuccgcuucgaggccgagcacaucuccaacuacaccgcccuccuccucucccgcgacggccgcacccucuacgucggcgcccgcgaggcccucuucgcccucuccuccaaccucuccuuccuccccggcggcgaguaccaggagcuccucuggggcgccgacgccgagaagaagcagcagugcuccuucaagggcaaggacccccagcgcgacugccagaacuacaucaagauccuccucccccucuccggcucccaccucuucaccugcggcaccgccgccuucucccccaugugcaccuacaucaacauggagaacuucacccucgcccgcgacgagaagggcaacguccuccucgaggacggcaagggccgcugccccuucgaccccaacuucaaguccaccgcccucgucgucgacggcgagcucuacaccggcaccgucuccuccuuccagggcaacgaccccgccaucucccgcucccagucccuccgccccaccaagaccgaguccucccucaacuggcuccaggaccccgccuucgucgccuccgccuacauccccgagucccucggcucccuccagggcgacgacgacaagaucuacuucuucuucuccgagaccggccaggaguucgaguucuucgagaacaccaucgucucccgcaucgcccgcaucugcaagggcgacgagggcggcgagcgcguccuccagcagcgcuggaccuccuuccucaaggcccagcuccucugcucccgccccgacgacggcuuccccuucaacguccuccaggacgucuucacccucucccccuccccccaggacuggcgcgacacccucuucuacggcgucuucaccucccaguggcaccgcggcaccaccgagggcuccgccgucugcgucuucaccaugaaggacguccagcgcgucuucuccggccucuacaaggaggucaaccgcgagacccagcagugguacaccgucacccaccccguccccaccccccgccccggcgccugcaucaccaacuccgcccgcgagcgcaagaucaacuccucccuccagcuccccgaccgcguccucaacuuccucaaggaccacuuccucauggacggccagguccgcucccgcaugcuccuccuccagccccaggcccgcuaccagcgcgucgccguccaccgcguccccggccuccaccacaccuacgacguccucuuccucggcaccggcgacggccgccuccacaaggccgucuccgucggcccccgcguccacaucaucgaggagcuccagaucuucuccuccggccagcccguccagaaccuccuccucgacacccaccgcggccuccucuacgccgccucccacuccggcgucguccagguccccauggccaacugcucccucuaccgcuccugcggcgacugccuccucgcccgcgaccccuacugcgccugguccggcuccuccugcaagcacgucucccucuaccagccccagcucgccacccgccccuggauccaggacaucgagggcgccuccgccaaggaccucugcuccgccuccuccgucgucucccccuccuucguccccaccggcgagaagcccugcgagcagguccaguuccagcccaacaccgucaacacccucgccugcccccuccucuccaaccucgccacccgccucuggcuccgcaacggcgcccccgucaacgccuccgccuccugccacguccuccccaccggcgaccuccuccucgucggcacccagcagcucggcgaguuccagugcuggucccucgaggagggcuuccagcagcucgucgccuccuacugccccgaggucgucgaggacggcgucgccgaccagaccgacgagggcggcuccguccccgucaucaucuccaccucccgcgucuccgcccccgccggcggcaaggccuccuggggcgccgaccgcuccuacuggaaggaguuccucgucaugugcacccucuucguccucgccguccuccuccccguccucuuccuccucuaccgccaccgcaacuccaugaaggucuuccucaagcagggcgagugcgccuccguccaccccaagaccugccccgucguccucccccccgagacccgcccccucaacggccucggcccccccuccaccccccucgaccaccgcggcuaccagucccucuccgacuccccccccggcucccgcgucuucaccgaguccgagaagcgcccccucuccauccaggacuccuucgucgaggucucccccgucugcccccgcccccgcguccgccucggcuccgagauccgcgacuccgucgucuga

SEQ ID NO: 49255 - RNA, 2589 nt, Artificial Sequence
  derived and/or modified sequence opt2 from SEMA4D__Homo_sapiens__XP_005251711
augcgcaugugcacccccauccgcggccuccucauggcccucgccgucauguucggcaccgccauggccuucgcccccaucccccgcaucaccugggagcaccgcgagguccaccucguccaguuccacgagcccgacaucuacaacuacuccgcccuccuccucuccgaggacaaggacacccucuacaucggcgcccgcgaggccgucuucgccgucaacgcccucaacaucuccgagaagcagcacgaggucuacuggaaggucuccgaggacaagaaggccaagugcgccgagaagggcaaguccaagcagaccgagugccucaacuacauccgcguccuccagccccucuccgccaccucccucuacgucugcggcaccaacgccuuccagcccgccugcgaccaccucaaccucaccuccuucaaguuccucggcaagaacgaggacggcaagggccgcugccccuucgaccccgcccacuccuacaccuccgucauggucgacggcgagcucuacuccggcaccuccuacaacuuccucggcuccgagcccaucaucucccgcaacuccucccacuccccccuccgcaccgaguacgccauccccuggcucaacgagcccuccuucgucuucgccgacgucauccgcaagucccccgacucccccgacggcgaggacgaccgcgucuacuucuucuucaccgaggucuccgucgaguacgaguucgucuuccgcguccucaucccccgcaucgcccgcgucugcaagggcgaccagggcggccuccgcacccuccagaagaaguggaccuccuuccucaaggcccgccucaucugcucccgccccgacuccggccucgucuucaacguccuccgcgacgucuucguccuccgcucccccggccucaagguccccgucuucuacgcccucuucaccccccagcucaacaacgucggccucuccgccgucugcgccuacaaccucuccaccgccgaggaggucuucucccacggcaaguacaugcaguccaccaccgucgagcagucccacaccaaguggguccgcuacaacggccccguccccaagccccgccccggcgccugcaucgacuccgaggcccgcgccgccaacuacaccuccucccucaaccuccccgacaagacccuccaguucgucaaggaccacccccucauggacgacuccgucacccccaucgacaaccgcccccgccucaucaagaaggacgucaacuacacccagaucgucgucgaccgcacccaggcccucgacggcaccgucuacgacgucauguucgucuccaccgaccgcggcgcccuccacaaggccaucucccucgagcacgccguccacaucaucgaggagacccagcucuuccaggacuucgagcccguccagacccuccuccucuccuccaagaagggcaaccgcuucgucuacgccggcuccaacuccggcgucguccaggccccccucgccuucugcggcaagcacggcaccugcgaggacugcguccucgcccgcgaccccuacugcgccugguccccccccaccgccaccugcgucgcccuccaccagaccgagucccccucccgcggccucauccaggagauguccggcgacgccuccgucugccccgacaaguccaagggcuccuaccgccagcacuucuucaagcacggcggcaccgccgagcucaagugcucccagaaguccaaccucgcccgcgucuucuggaaguuccagaacggcguccucaaggccgagucccccaaguacggccucaugggccgcaagaaccuccucaucuucaaccucuccgagggcgacuccggcgucuaccagugccucuccgaggagcgcgucaagaacaagaccgucuuccaggucgucgccaagcacguccucgaggucaaggucguccccaagcccgucgucgcccccacccucuccgucguccagaccgagggcucccgcaucgccaccaagguccucgucgccuccacccagggcuccuccccccccacccccgccguccaggccaccuccuccggcgccaucacccucccccccaagcccgcccccaccggcaccuccugcgagcccaagaucgucaucaacaccgucccccagcuccacuccgagaagaccauguaccucaaguccuccgacaaccgccuccucaugucccucuuccucuucuucuucguccucuuccucugccucuucuucuacaacugcuacaagggcuaccucccccgccagugccucaaguuccgcuccgcccuccucaucggcaagaagaagcccaaguccgacuucugcgaccgcgagcagucccucaaggagacccucgucgagcccggcuccuucucccagcagaacggcgagcaccccaagcccgcccucgacaccggcuacgagaccgagcaggacaccaucaccuccaagguccccaccgaccgcgaggacucccagcgcaucgacgaccucuccgcccgcgacaagcccuucgacgucaagugcgagcucaaguucgccgacuccgacgccgacggcgacuga

SEQ ID NO: 49256 - RNA, 1848 nt, Artificial Sequence
  derived and/or modified sequence opt2 from SEMA4F__Homo_sapiens__NP_001258590
augcccgccuccgccgcccgcccccgccccggccccggccagcccaccgccucccccuucccccuccuccuccucgccguccucuccggccccgucuccggccgcgucccccgcuccgucccccgcaccucccuccccaucuccgaggccgacuccugccucacccgcuucgccgucccccacaccuacaacuacuccguccuccucgucgaccccgccucccacacccucuacgucggcgcccgcgacaccaucuucgcccucucccuccccuucuccggcgagcgcccccgccgcaucgacuggaugguccccgaggcccaccgccagaacugccgcaagaagggcaagaaggagggcgaccucggcggccgcaagacccuccagcagcgcuggaccaccuuccucaaggccgaccuccucugccccggccccgagcacggccgcgccuccuccguccuccaggacgucgccguccuccgccccgagcucggcgccggcacccccaucuucuacggcaucuucuccucccagugggagggcgccaccaucuccgccgucugcgccuuccgcccccaggacauccgcaccguccucaacggccccuuccgcgagcucaagcacgacugcaaccgcggccuccccgucgucgacaacgacgucccccagccccgccccggcgagugcaucaccaacaacaugaagcuccgccacuucggcuccucccucucccuccccgaccgcguccucaccuucauccgcgaccacccccucauggaccgccccgucuuccccgccgacggccacccccuccucgucaccaccgacaccgccuaccuccgcgucgucgcccaccgcgucaccucccucuccggcaaggaguacgacguccucuaccucggcaccgaggacggccaccuccaccgcgccguccgcaucggcgcccagcucuccguccucgaggaccucgcccucuuccccgagccccagcccgucgagaacaugaagcucuaccacuccuggcuccucgucggcucccgcaccgaggucacccaggucaacaccaccaacugcggccgccuccaguccugcuccgagugcauccucgcccaggaccccgucugcgccugguccuuccgccucgacgagugcgucgcccacgccggcgagcaccgcggccucguccaggacaucgaguccgccgacgucuccucccucugccccaaggagcccggcgagcgccccgucgucuucgagguccccgucgccaccgccgcccacgucguccuccccugcucccccuccuccgccugggccuccugcgucuggcaccagcccuccggcgucaccgcccucaccccccgccgcgacggccucgaggucgucgucacccccggcgccaugggcgccuacgccugcgagugccaggagggcggcgccgcccacgucgucgccgccuacucccucgucuggggcucccagcgcgacgcccccucccgcgcccacaccgucggcgccggccucgccggcuucuuccucggcauccucgccgccucccucacccucauccucaucggccgccgccagcagcgccgccgccagcgcgagcuccucgcccgcgacaaggucggccucgaccucggcgccccccccuccggcaccaccuccuacucccaggacccccccucccccucccccgaggacgagcgccucccccucgcccucgccaagcgcggcuccggcuucggcggcuucuccccccccuuccuccucgaccccugccccucccccgcccacauccgccucaccggcgccccccucgccaccugcgacgagaccuccaucuga

SEQ ID NO: 49257 - RNA, 2109 nt, Artificial Sequence
  derived and/or modified sequence opt2 from SEMA4G__Homo_sapiens__NP_001190173
auguggggccgccucuggccccuccuccucuccauccucaccgccaccgccguccccggccccucccuccgccgccccucccgcgagcucgacgccaccccccgcaugaccauccccuacgaggagcucuccggcacccgccacuucaagggccaggcccagaacuacuccacccuccuccucgaggaggccuccgcccgccuccucgucggcgcccgcggcgcccucuucucccucuccgccaacgacaucggcgacggcgcccacaaggagauccacugggaggccucccccgagaugcaguccaagugccaccagaagggcaagaacaaccagaccgagugcuucaaccacguccgcuuccuccagcgccucaacuccacccaccucuacgccugcggcacccacgccuuccagccccucugcgccgccaucgacgccgaggccuucacccuccccaccuccuucgaggagggcaaggagaagugccccuacgaccccgcccgcggcuucaccggccucaucaucgacggcggccucuacaccgccacccgcuacgaguuccgcuccauccccgacauccgccgcucccgccacccccacucccuccgcaccgaggagacccccaugcacuggcucaacgacgccgaguucgucuucuccguccucguccgcgaguccaaggccuccgccgucggcgacgacgacaaggucuacuacuucuucaccgagcgcgccaccgaggagggcuccggcuccuucacccagucccgcuccucccaccgcgucgcccgcgucgcccgcgucugcaagggcgaccucggcggcaagaagauccuccagaagaaguggaccuccuuccucaaggcccgccucaucugccacaucccccucuacgagacccuccgcggcgucugcucccucgacgccgagaccuccucccgcacccacuucuacgccgccuucacccucuccacccaguggaagacccucgaggccuccgccaucugccgcuacgaccucgccgagauccaggccgucuucgccggccccuacauggaguaccaggacggcucccgccgcuggggccgcuacgagggcggcguccccgagccccgccccggcuccugcaucaccgacucccuccgcucccagggcuacaacuccucccaggaccuccccucccucguccucgacuucgucaagcuccacccccucauggcccgccccgucguccccacccgcggccgcccccuccuccucaagcgcaacauccgcuacacccaccucaccggcacccccgucaccacccccgccggccccaccuacgaccuccucuuccucggcaccgccgacggcuggauccacaaggccgucguccucggcuccggcaugcacaucaucgaggagacccaggucuuccgcgagucccaguccgucgagaaccucgucaucucccuccuccagcacucccucuacgucggcgcccccuccggcgucauccagcucccccucuccuccugcucccgcuaccgcuccugcuacgacugcauccucgcccgcgaccccuacugcggcugggaccccggcacccacgccugcgccgccgccaccaccaucgccaaccgcucccagggcucccgcaccgcccucauccaggacaucgagcgcggcaaccgcggcugcgaguccucccgcgacaccggccgcgcccuccagguccacaugggcuccauguccccccccuccgccuggcccugcguccucgacggccccgagacccgccaggaccucugccagccccccaagcccugcguccacucccacgcccacauggaggagugccucuccgccggccuccagugcccccacccccaccuccuccucguccacuccugcuucauccccgccuccggccucggcguccccucccagcucccccaccccaucugguccuccucccccgcccccugcggcgaccucuucgucaagucccucggcaccggccagcccggcgagguccgccuccaccacucccccccccuccccuccugcgucgcccucgucaaccagcccccccacucccccugguccuucucccgcgucuga

SEQ ID NO: 49258 - RNA, 3225 nt, Artificial Sequence
  derived and/or modified sequence opt2 from SEMA5A__Homo_sapiens__NP_003957
augaagggcaccugcgucaucgccuggcucuucuccucccucggccucuggcgccucgcccaccccgaggcccagggcaccacccagugccagcgcaccgagcaccccgucaucuccuacaaggagaucggccccuggcuccgcgaguuccgcgccaagaacgccgucgacuucucccagcucaccuucgaccccggccagaaggagcucgucgucggcgcccgcaacuaccucuuccgccuccagcucgaggaccucucccucauccaggccgucgagugggagugcgacgaggccaccaagaaggccugcuacuccaagggcaaguccaaggaggagugccagaacuacauccgcguccuccucgucggcggcgaccgccucuucaccugcggcaccaacgccuucacccccgucugcaccaaccgcucccucuccaaccucaccgagauccacgaccagaucuccggcauggcccgcugccccuacuccccccagcacaacuccaccgcccuccucaccgccggcggcgagcucuacgccgccaccgccauggacuuccccggccgcgaccccgccaucuaccgcucccucggcauccuccccccccuccgcaccgcccaguacaacuccaaguggcucaacgagcccaacuucgucuccuccuacgacaucggcaacuucaccuacuucuucuuccgcgagaacgccgucgagcacgacugcggcaagaccgucuucucccgcgccgcccgcgucugcaagaacgacaucggcggccgcuuccuccucgaggacaccuggaccaccuucaugaaggcccgccucaacugcucccgccccggcgagguccccuucuacuacaacgagcuccaguccaccuucuuccuccccgagcucgaccucaucuacggcaucuucaccaccaacgucaacuccaucgccgccuccgccgucugcgucuucaaccucuccgccaucgcccaggccuucuccggccccuucaaguaccaggagaacucccgcuccgccuggcuccccuaccccaaccccaacccccacuuccagugcggcaccgucgaccagggccucuacgucaaccucaccgagcgcaaccuccaggacgcccagaaguucauccucaugcacgaggucguccagcccgucaccaccguccccuccuucauggaggacaacucccgcuucucccacgucgccgucgacgucguccagggccgcgaggcccucguccacaucaucuaccucgccaccgacuacggcaccaucaagaagguccgcgucccccucaaccagaccuccuccuccugccuccucgaggagaucgagcucuuccccgagcgccgccgcgagcccauccgcucccuccagauccuccacucccaguccguccucuucgucggccuccgcgagcacgucgucaagaucccccucaagcgcugccaguucuaccgcacccgcuccaccugcaucggcgcccaggaccccuacugcggcugggacgucgucaugaagaagugcaccucccucgaggagucccucuccaugacccagugggagcaguccaucuccgccugccccacccgcaaccucaccgucgacggccacuucggcgucuggucccccuggacccccugcacccacaccgacggcuccgccgucggcuccugccucugccgcacccgcuccugcgacucccccgccccccagugcggcggcuggcagugcgagggccccggcauggagaucgccaacugcucccgcaacggcggcuggacccccuggaccuccuggucccccugcuccaccaccugcggcaucggcuuccagguccgccagcgcuccugcuccaaccccaccccccgccacggcggccgcgucugcgucggccagaaccgcgaggagcgcuacugcaacgagcaccuccucugccccccccacauguucuggaccggcuggggccccugggagcgcugcaccgcccagugcggcggcggcauccaggcccgccgccgcaucugcgagaacggccccgacugcgccggcugcaacgucgaguaccaguccugcaacaccaaccccugccccgagcucaagaagaccacccccuggacccccuggacccccgucaacaucuccgacaacggcggccacuacgagcagcgcuuccgcuacaccugcaaggcccgccucgccgaccccaaccuccucgaggucggccgccagcgcaucgagaugcgcuacugcuccuccgacggcaccuccggcugcuccaccgacggccucuccggcgacuuccuccgcgccggccgcuacuccgcccacaccgucaacggcgccugguccgccuggaccuccuggucccagugcucccgcgacugcucccgcggcauccgcaaccgcaagcgcgucugcaacaaccccgagcccaaguacggcggcaugcccugccucggccccucccucgaguaccaggagugcaacauccuccccugccccgucgacggcgucugguccugcuggucccccuggaccaagugcuccgccaccugcggcggcggccacuacaugcgcacccgcuccugcuccaaccccgcccccgccuacggcggcgacaucugccucggccuccacaccgaggaggcccucugcaacacccagcccugccccgaguccugguccgagugguccgacugguccgagugcgaggccuccggcguccagguccgcgcccgccagugcauccuccucuuccccaugggcucccagugcuccggcaacaccaccgagucccgccccugcgucuucgacuccaacuucauccccgaggucuccgucgcccgcuccuccuccgucgaggagaagcgcugcggcgaguucaacauguuccacaugaucgccgucggccucuccuccuccauccucggcugccuccucacccuccucgucuacaccuacugccagcgcuaccagcagcagucccacgacgccaccgucauccaccccgucucccccgccccccucaacaccuccaucaccaaccacaucaacaagcucgacaaguacgacuccgucgaggccaucaaggccuucaacaagaacaaccucauccucgaggagcgcaacaaguacuucaacccccaccucaccggcaagaccuacuccaacgccuacuucaccgaccucaacaacuacgacgaguacuga

SEQ ID NO: 49259 - RNA, 3456 nt, Artificial Sequence
  derived and/or modified sequence opt2 from SEMA5B__Homo_sapiens__NP_001026872
augcccugcggcuucucccccucccccgucgcccaccaccucguccccggcccccccgacacccccgcccagcagcuccgcugcggcuggaccgucggcggcuggcuccucucccucguccgcggccuccuccccugccucccccccggcgcccgcaccgccgagggccccaucaugguccucgccggcccccucgccgucucccuccuccuccccucccucacccuccucgucucccaccucuccuccucccaggacgucuccuccgagcccuccuccgagcagcagcucugcgcccucuccaagcaccccaccgucgccuucgaggaccuccagcccugggucuccaacuucaccuaccccggcgcccgcgacuucucccagcucgcccucgaccccuccggcaaccagcucaucgucggcgcccgcaacuaccucuuccgccucucccucgccaacgucucccuccuccaggccaccgagugggccuccuccgaggacacccgccgcuccugccaguccaagggcaagaccgaggaggagugccagaacuacguccgcguccucaucgucgccggccgcaaggucuucaugugcggcaccaacgccuucucccccaugugcaccucccgccaggucggcaaccucucccgcaccaucgagaagaucaacggcgucgcccgcugccccuacgacccccgccacaacuccaccgccgucaucuccucccagggcgagcucuacgccgccaccgucaucgacuucuccggccgcgaccccgccaucuaccgcucccucggcuccggccccccccuccgcaccgcccaguacaacuccaaguggcucaacgagcccaacuucgucgccgccuacgacaucggccucuucgccuacuucuuccuccgcgagaacgccgucgagcacgacugcggccgcaccgucuacucccgcgucgcccgcgucugcaagaacgacgucggcggccgcuuccuccucgaggacaccuggaccaccuucaugaaggcccgccucaacugcucccgccccggcgagguccccuucuacuacaacgagcuccaguccgccuuccaccuccccgagcaggaccucaucuacggcgucuucaccaccaacgucaacuccaucgccgccuccgccgucugcgccuucaaccucuccgccaucucccaggccuucaacggccccuuccgcuaccaggagaacccccgcgccgccuggcuccccaucgccaaccccauccccaacuuccagugcggcacccuccccgagaccggccccaacgagaaccucaccgagcgcucccuccaggacgcccagcgccucuuccucauguccgaggccguccagcccgucacccccgagcccugcgucacccaggacuccguccgcuucucccaccucgucgucgaccucguccaggccaaggacacccucuaccacguccucuacaucggcaccgaguccggcaccauccucaaggcccucuccaccgccucccgcucccuccacggcugcuaccucgaggagcuccacguccucccccccggccgccgcgagccccuccgcucccuccgcauccuccacuccgcccgcgcccucuucgucggccuccgcgacggcguccuccgcgucccccucgagcgcugcgccgccuaccgcucccagggcgccugccucggcgcccgcgaccccuacugcggcugggacggcaagcagcagcgcugcuccacccucgaggacuccuccaacaugucccucuggacccagaacaucaccgccugccccguccgcaacgucacccgcgacggcggcuucggccccuggucccccuggcagcccugcgagcaccucgacggcgacaacuccggcuccugccucugccgcgcccgcuccugcgacuccccccgcccccgcugcggcggccucgacugccucggccccgccauccacaucgccaacugcucccgcaacggcgccuggacccccugguccuccugggcccucugcuccaccuccugcggcaucggcuuccagguccgccagcgcuccugcuccaaccccgccccccgccacggcggccgcaucugcgucggcaagucccgcgaggagcgcuucugcaacgagaacacccccugccccguccccaucuucugggccuccuggggcuccugguccaagugcuccuccaacugcggcggcggcaugcagucccgccgccgcgccugcgagaacggcaacuccugccucggcugcggcgucgaguucaagaccugcaaccccgagggcugccccgagguccgccgcaacacccccuggacccccuggcuccccgucaacgucacccagggcggcgcccgccaggagcagcgcuuccgcuucaccugccgcgccccccucgccgacccccacggccuccaguucggccgccgccgcaccgagacccgcaccugccccgccgacggcuccggcuccugcgacaccgacgcccucgucgagguccuccuccgcuccggcuccaccuccccccacaccgucuccggcggcugggccgccuggggccccugguccuccugcucccgcgacugcgagcucggcuuccgcguccgcaagcgcaccugcaccaaccccgagccccgcaacggcggccuccccugcgucggcgacgccgccgaguaccaggacugcaacccccaggccugccccguccgcggcgccugguccugcuggaccuccuggucccccugcuccgccuccugcggcggcggccacuaccagcgcacccgcuccugcaccucccccgcccccucccccggcgaggacaucugccucggccuccacaccgaggaggcccucugcgccacccaggccugccccgagggcuggucccccugguccgagugguccaagugcaccgacgacggcgcccagucccgcucccgccacugcgaggagcuccuccccggcuccuccgccugcgccggcaacuccucccagucccgccccugccccuacuccgagauccccgucauccuccccgccuccuccauggaggaggccaccgacugcgccggcuucaaccucauccaccucgucgccaccggcaucuccugcuuccucggcuccggccuccucacccucgccgucuaccucuccugccagcacugccagcgccagucccaggaguccacccucguccaccccgccacccccaaccaccuccacuacaagggcggcggcacccccaagaacgagaaguacacccccauggaguucaagacccucaacaagaacaaccucauccccgacgaccgcgccaacuucuacccccuccagcagaccaacgucuacaccaccaccuacuaccccuccccccucaacaagcacuccuuccgccccgaggccucccccggccagcgcugcuuccccaacuccuga

SEQ ID NO: 49260 - RNA, 3144 nt, Artificial Sequence
  derived and/or modified sequence opt2 from SEMA6A__Homo_sapiens__NP_001287709
augcgcuccgaggcccuccuccucuacuucacccuccuccacuucgccggcgccggcuuccccgaggacuccgagcccaucuccaucucccacggcaacuacaccaagcaguaccccgucuucgucggccacaagcccggccgcaacaccacccagcgccaccgccucgacauccagaugaucaugaucaugaacggcacccucuacaucgccgcccgcgaccacaucuacaccgucgacaucgacaccucccacaccgaggagaucuacugcuccaagaagcucaccuggaagucccgccaggccgacgucgacaccugccgcaugaagggcaagcacaaggacgagugccacaacuucaucaagguccuccucaagaagaacgacgacgcccucuucgucugcggcaccaacgccuucaaccccuccugccgcaacuacaagauggacacccucgagcccuucggcgacgaguucuccggcauggcccgcugccccuacgacgccaagcacgccaacgucgcccucuucgccgacggcaagcucuacuccgccaccgucaccgacuuccucgccaucgacgccgucaucuaccgcucccucggcgagucccccacccuccgcaccgucaagcacgacuccaaguggcucaaggagcccuacuucguccaggccgucgacuacggcgacuacaucuacuucuucuuccgcgagaucgccgucgaguacaacaccaugggcaaggucgucuucccccgcgucgcccaggucugcaagaacgacaugggcggcucccagcgcguccucgagaagcaguggaccuccuuccucaaggcccgccucaacugcuccguccccggcgacucccacuucuacuucaacauccuccaggccgucaccgacgucauccgcaucaacggccgcgacgucguccucgccaccuucuccacccccuacaacuccauccccggcuccgccgucugcgccuacgacaugcucgacaucgccuccgucuucaccggccgcuucaaggagcagaagucccccgacuccaccuggacccccguccccgacgagcgcguccccaagccccgccccggcugcugcgccggcuccuccucccucgagcgcuacgccaccuccaacgaguuccccgacgacacccucaacuucaucaagacccacccccucauggacgaggccguccccuccaucuucaaccgccccugguuccuccgcaccaugguccgcuaccgccucaccaagaucgccgucgacaccgccgccggccccuaccagaaccacaccgucgucuuccucggcuccgagaagggcaucauccucaaguuccucgcccgcaucggcaacuccggcuuccucaacgacucccucuuccucgaggagauguccgucuacaacuccgagaagugcuccuacgacggcgucgaggacaagcgcaucaugggcaugcagcucgaccgcgccuccuccucccucuacgucgccuucuccaccugcgucaucaaggucccccucggccgcugcgagcgccacggcaagugcaagaagaccugcaucgccucccgcgaccccuacugcggcuggaucaaggagggcggcgccugcucccaccucucccccaacucccgccucaccuucgagcaggacaucgagcgcggcaacaccgacggccucggcgacugccacaacuccuucgucgcccucaacgacaucuccaccccccuccccgacaacgagauguccuacaacaccgucuacggccacuccuccucccuccuccccuccaccaccaccuccgacuccaccgcccaggagggcuacgagucccgcggcggcaugcucgacuggaagcaccuccucgacucccccgacuccaccgacccccucggcgccgucuccucccacaaccaccaggacaagaagggcgucauccgcgaguccuaccucaagggccacgaccagcucguccccgucacccuccucgccaucgccgucauccucgccuucgucaugggcgccgucuucuccggcaucaccgucuacugcgucugcgaccaccgccgcaaggacgucgccgucguccagcgcaaggagaaggagcucacccacucccgccgcggcuccauguccuccgucaccaagcucuccggccucuucggcgacacccaguccaaggaccccaagcccgaggccauccucaccccccucaugcacaacggcaagcucgccacccccggcaacaccgccaagaugcucaucaaggccgaccagcaccaccucgaccucaccgcccuccccacccccgaguccacccccacccuccagcagaagcgcaagcccucccgcggcucccgcgagugggagcgcaaccagaaccucaucaacgccugcaccaaggacaugccccccaugggcucccccgucauccccaccgaccucccccuccgcgccucccccucccacauccccuccgucgucguccuccccaucacccagcagggcuaccagcacgaguacgucgaccagcccaagauguccgaggucgcccagauggcccucgaggaccaggccgccacccucgaguacaagaccaucaaggagcaccucuccuccaagucccccaaccacggcgucaaccucgucgagaaccucgacucccucccccccaaggucccccagcgcgaggccucccucggcccccccggcgccucccucucccagaccggccucuccaagcgccucgagaugcaccacuccuccuccuacggcgucgacuacaagcgcuccuaccccaccaacucccucacccgcucccaccaggccaccacccucaagcgcaacaacaccaacuccuccaacuccucccaccucucccgcaaccaguccuucggccgcggcgacaaccccccccccgccccccagcgcgucgacuccauccagguccacuccucccagcccuccggccaggccgucaccgucucccgccagcccucccucaacgccuacaacucccucacccgcuccggccucaagcgcacccccucccucaagcccgacgucccccccaagcccuccuucgccccccucuccaccuccaugaagcccaacgacgccugcaccuga

SEQ ID NO: 49261 - RNA, 2667 nt, Artificial Sequence
  derived and/or modified sequence opt2 from SEMA6B__Homo_sapiens__NP_115484
augcagaccccccgcgccucccccccccgccccgcccuccuccuccuccuccuccuccucggcggcgcccacggccucuuccccgaggagccccccccccucuccgucgccccccgcgacuaccucaaccacuaccccgucuucgucggcuccggccccggccgccucacccccgccgagggcgccgacgaccucaacauccagcgcguccuccgcgucaaccgcacccucuucaucggcgaccgcgacaaccucuaccgcgucgagcucgagccccccaccuccaccgagcuccgcuaccagcgcaagcucaccuggcgcuccaaccccuccgacaucaacgucugccgcaugaagggcaagcaggagggcgagugccgcaacuucgucaagguccuccuccuccgcgacgaguccacccucuucgucugcggcuccaacgccuucaaccccgucugcgccaacuacuccaucgacacccuccagcccgucggcgacaacaucuccggcauggcccgcugccccuacgaccccaagcacgccaacgucgcccucuucuccgacggcaugcucuucaccgccaccgucaccgacuuccucgccaucgacgccgucaucuaccgcucccucggcgaccgccccacccuccgcaccgucaagcacgacuccaagugguucaaggagcccuacuucguccacgccgucgaguggggcucccacgucuacuucuucuuccgcgagaucgccauggaguucaacuaccucgagaaggucgucgucucccgcgucgcccgcgucugcaagaacgacgucggcggcuccccccgcguccucgagaagcaguggaccuccuuccucaaggcccgccucaacugcuccguccccggcgacucccacuucuacuucaacguccuccaggccgucaccggcgucgucucccucggcggccgccccgucguccucgccgucuucuccacccccuccaacuccauccccggcuccgccgucugcgccuucgaccucacccaggucgccgccgucuucgagggccgcuuccgcgagcagaagucccccgaguccaucuggacccccguccccgaggaccaggucccccgcccccgccccggcugcugcgccgcccccggcaugcaguacaacgccuccuccgcccuccccgacgacauccucaacuucgucaagacccacccccucauggacgaggccguccccucccucggccacgcccccuggauccuccgcacccucaugcgccaccagcucacccgcgucgccgucgacgucggcgccggccccuggggcaaccagaccgucgucuuccucggcuccgaggccggcaccguccucaaguuccucguccgccccaacgccuccaccuccggcaccuccggccucuccgucuuccucgaggaguucgagaccuaccgccccgaccgcugcggccgccccggcggcggcgagaccggccagcgccuccucucccucgagcucgacgccgccuccggcggccuccucgccgccuucccccgcugcgucguccgcguccccgucgcccgcugccagcaguacuccggcugcaugaagaacugcaucggcucccaggaccccuacugcggcugggcccccgacggcuccugcaucuuccucucccccggcacccgcgccgccuucgagcaggacgucuccggcgccuccaccuccggccucggcgacugcaccggccuccuccgcgccucccucuccgaggaccgcgccggccucgucuccgucaaccuccucgucaccuccuccgucgccgccuucgucgucggcgccgucgucuccggcuucuccgucggcugguucgucggccuccgcgagcgccgcgagcucgcccgccgcaaggacaaggaggccauccucgcccacggcgccggcgaggccguccucuccgucucccgccucggcgagcgccgcgcccagggccccggcggccgcggcggcggcggcggcggcggcgccggcgucccccccgaggcccuccucgccccccucaugcagaacggcugggccaaggccacccuccuccagggcggcccccacgaccucgacuccggccuccuccccacccccgagcagaccccccucccccagaagcgccuccccaccccccacccccacccccacgcccucggcccccgcgccugggaccacggccacccccuccuccccgccuccgccuccuccucccuccuccuccucgcccccgcccgcgcccccgagcagccccccgcccccggcgagcccacccccgacggccgccucuacgccgcccgccccggccgcgccucccacggcgacuucccccucaccccccacgccucccccgaccgccgccgcgucgucuccgcccccaccggcccccucgaccccgccuccgccgccgacggccucccccgccccuggucccccccccccaccggcucccuccgccgcccccucggcccccacgccccccccgccgccacccuccgccgcacccacaccuucaacuccggcgaggcccgccccggcgaccgccaccgcggcugccacgcccgccccggcaccgaccucgcccaccuccuccccuacggcggcgccgaccgcaccgccccccccguccccuga

SEQ ID NO: 49262 - RNA, 3036 nt, Artificial Sequence
  derived and/or modified sequence opt2 from SEMA6D__Homo_sapiens__NP_001185928
augcgcgucuuccuccucugcgccuacauccuccuccucauggucucccagcuccgcgccgucuccuuccccgaggacgacgagccccucaacaccgucgacuaccacuacucccgccaguaccccgucuuccgcggccgccccuccggcaacgagucccagcaccgccucgacuuccagcucaugcucaagauccgcgacacccucuacaucgccggccgcgaccaggucuacaccgucaaccucaacgagaugcccaagaccgaggucauccccaacaagaagcucaccuggcgcucccgccagcaggaccgcgagaacugcgccaugaagggcaagcacaaggacgagugccacaacuucaucaaggucuucgucccccgcaacgacgagauggucuucgucugcggcaccaacgccuucaaccccaugugccgcuacuaccgccucuccacccucgaguacgacggcgaggagaucuccggccucgcccgcugccccuucgacgcccgccagaccaacgucgcccucuucgccgacggcaagcucuacuccgccaccgucgccgacuuccucgccuccgacgccgucaucuaccgcuccaugggcgacggcuccgcccuccgcaccaucaaguacgacuccaaguggaucaaggagccccacuuccuccacgccaucgaguacggcaacuacgucuacuucuucuuccgcgagaucgccgucgagcacaacaaccucggcaaggccgucuacucccgcgucgcccgcaucugcaagaacgacaugggcggcucccagcgcguccucgagaagcacuggaccuccuuccucaaggcccgccucaacugcuccguccccggcgacuccuucuucuacuucgacguccuccaguccaucaccgacaucauccagaucaacggcauccccaccgucgucggcgucuucaccacccagcucaacuccauccccggcuccgccgucugcgccuucuccauggacgacaucgagaaggucuucaagggccgcuucaaggagcagaagacccccgacuccgucuggaccgccguccccgaggacaagguccccaagccccgccccggcugcugcgccaagcacggccucgccgaggccuacaagaccuccaucgacuuccccgacgagacccucuccuucaucaagucccacccccucauggacuccgccgucccccccaucgccgacgagcccugguucaccaagacccgcguccgcuaccgccucaccgccaucuccgucgaccacuccgccggccccuaccagaacuacaccgucaucuucgucggcuccgaggccggcaugguccucaagguccucgccaagaccucccccuucucccucaacgacuccguccuccucgaggagaucgaggccuacaaccacgccaagugcuccgccgagaacgaggaggacaagaaggucaucucccuccagcucgacaaggaccaccacgcccucuacgucgccuucuccuccugcaucauccgcaucccccucucccgcugcgagcgcuacggcuccugcaagaaguccugcaucgccucccgcgaccccuacugcggcuggcucucccagggcuccugcggccgcgucacccccggcaugcuccuccucaccgaggacuucuucgccuuccacaaccacuccgccgagggcuacgagcaggacaccgaguucggcaacaccgcccaccucggcgacugccacggcguccgcugggagguccaguccggcgaguccaaccagaugguccacaugaacguccucaucaccugcgucuucgccgccuucguccucggcgccuucaucgccggcgucgccgucuacugcuaccgcgacauguucguccgcaagaaccgcaagauccacaaggacgccgaguccgcccaguccugcaccgacuccuccggcuccuucgccaagcucaacggccucuucgacucccccgucaaggaguaccagcagaacaucgacucccccaagcucuacuccaaccuccucaccucccgcaaggagcucccccccaacggcgacaccaaguccauggucauggaccaccgcggccagccccccgagcucgccgcccuccccacccccgaguccacccccguccuccaccagaagacccuccaggccaugaagucccacuccgagaaggcccacggccacggcgccucccgcaaggagaccccccaguucuuccccuccuccccccccccccacuccccccucucccacggccacauccccuccgccaucguccuccccaacgccacccacgacuacaacaccuccuucuccaacuccaacgcccacaaggccgagaagaagcuccagaacaucgaccacccccucaccaaguccuccuccaagcgcgaccaccgccgcuccgucgacucccgcaacacccucaacgaccuccucaagcaccucaacgaccccaacuccaaccccaaggccaucaugggcgacauccagauggcccaccagaaccucaugcucgaccccaugggcuccauguccgaggucccccccaagguccccaaccgcgaggccucccucuacuccccccccuccacccucccccgcaacucccccaccaagcgcgucgacguccccaccacccccggcguccccaugaccucccucgagcgccagcgcggcuaccacaagaacuccucccagcgccacuccaucuccgccaugcccaagaaccucaacucccccaacggcguccuccucucccgccagcccuccaugaaccgcggcggcuacaugcccacccccaccggcgccaaggucgacuacauccagggcacccccgucuccguccaccuccagcccucccucucccgccaguccuccuacaccuccaacggcacccucccccgcaccggccucaagcgcacccccucccucaagcccgacgucccccccaagcccuccuucgucccccagacccccuccguccgcccccucaacaaguacaccuacuga

SEQ ID NO: 49263 - RNA, 1959 nt, Artificial Sequence
  derived and/or modified sequence opt2 from SEMA7A__Homo_sapiens__NP_001139501
augaccccccccccccccggccgcgccgcccccuccgccccccgcgcccgcguccccggcccccccgcccgccucggccucccccuccgccuccgccuccuccuccuccucugggccgccgccgccuccgcccagggccaccuccgcuccggcccccgcaucuucgccgucuggaagggccacgucggccaggaccgcgucgacuucggccagaccgagccccacaccguccucuuccacgagcccggcuccuccuccgucugggucggcggccgcggcaaggucuaccucuucgacuuccccgagggcaagaacgccuccguccgcaccgacugcgagaacuacaucacccuccucgagcgccgcuccgagggccuccucgccugcggcaccaacgcccgccaccccuccugcuggaaccucgucaacggcaccgucgucccccucggcgagaugcgcggcuacgcccccuucucccccgacgagaacucccucguccucuucgagggcgacgaggucuacuccaccauccgcaagcaggaguacaacggcaagaucccccgcuuccgccgcauccgcggcgaguccgagcucuacaccuccgacaccgucaugcagaacccccaguucaucaaggccaccaucguccaccaggaccaggccuacgacgacaagaucuacuacuucuuccgcgaggacaaccccgacaagaaccccgaggccccccucaacgucucccgcgucgcccagcucugccgcggcgaccagggcggcgaguccucccucuccgucuccaaguggaacaccuuccucaaggccaugcucgucugcuccgacgccgccaccaacaagaacuucaaccgccuccaggacgucuuccuccuccccgaccccuccggccaguggcgcgacacccgcgucuacggcgucuucuccaaccccuggaacuacuccgccgucugcgucuacucccucggcgacaucgacaaggucuuccgcaccuccucccucaagggcuaccacuccucccuccccaacccccgccccggcaagugccuccccgaccagcagcccauccccaccgagaccuuccaggucgccgaccgccaccccgaggucgcccagcgcgucgagcccaugggcccccucaagaccccccucuuccacuccaaguaccacuaccagaaggucgccguccaccgcaugcaggccucccacggcgagaccuuccacguccucuaccucaccaccgaccgcggcaccauccacaaggucgucgagcccggcgagcaggagcacuccuucgccuucaacaucauggagauccagcccuuccgccgcgccgccgccauccagaccaugucccucgacgccgagcgccgcaagcucuacgucuccucccagugggaggucucccaggucccccucgaccucugcgaggucuacggcggcggcugccacggcugccucaugucccgcgaccccuacugcggcugggaccagggccgcugcaucuccaucuacuccuccgagcgcuccguccuccaguccaucaaccccgccgagccccacaaggagugccccaaccccaagcccgacaaggccccccuccagaaggucucccucgcccccaacucccgcuacuaccucuccugccccauggagucccgccacgccaccuacuccuggcgccacaaggagaacgucgagcaguccugcgagcccggccaccagucccccaacugcauccucuucaucgagaaccucaccgcccagcaguacggccacuacuucugcgaggcccaggagggcuccuacuuccgcgaggcccagcacuggcagcuccuccccgaggacggcaucauggccgagcaccuccucggccacgccugcgcccucgccgccucccucuggcucggcguccuccccacccucacccucggccuccucguccacuga

SEQ ID NO: 49264 - RNA, 1389 nt, Artificial Sequence
  derived and/or modified sequence opt2 from SEMG1__Homo_sapiens__NP_002998
augaagcccaacaucaucuucguccucucccuccuccucauccucgagaagcaggccgccgucaugggccagaagggcggcuccaagggccgccuccccuccgaguucucccaguucccccacggccagaagggccagcacuacuccggccagaagggcaagcagcagaccgaguccaagggcuccuucuccauccaguacaccuaccacgucgacgccaacgaccacgaccagucccgcaagucccagcaguacgaccucaacgcccuccacaagaccaccaagucccagcgccaccucggcggcucccagcagcuccuccacaacaagcaggagggccgcgaccacgacaaguccaagggccacuuccaccgcgucgucauccaccacaagggcggcaaggcccaccgcggcacccagaaccccucccaggaccagggcaacucccccuccggcaagggcaucuccucccaguacuccaacaccgaggagcgccucuggguccacggccucuccaaggagcagaccuccgucuccggcgcccagaagggccgcaagcagggcggcucccaguccuccuacguccuccagaccgaggagcucgucgccaacaagcagcagcgcgagaccaagaacucccaccagaacaagggccacuaccagaacgucgucgagguccgcgaggagcacuccuccaagguccagaccucccucugccccgcccaccaggacaagcuccagcacggcuccaaggacaucuucuccacccaggacgagcuccucgucuacaacaagaaccagcaccagaccaagaaccucaaccaggaccagcagcacggccgcaaggccaacaagaucuccuaccaguccuccuccaccgaggagcgccgccuccacuacggcgagaacggcguccagaaggacgucucccaguccuccaucuacucccagaccgaggagaaggcccagggcaagucccagaagcagaucaccauccccucccaggagcaggagcacucccagaaggccaacaagaucuccuaccaguccuccuccaccgaggagcgccgccuccacuacggcgagaacggcguccagaaggacgucucccagcgcuccaucuacucccagaccgagaagcucgucgccggcaagucccagauccaggcccccaaccccaagcaggagcccuggcacggcgagaacgccaagggcgaguccggccaguccaccaaccgcgagcaggaccuccucucccacgagcagaagggccgccaccagcacggcucccacggcggccucgacaucgucaucaucgagcaggaggacgacuccgaccgccaccucgcccagcaccucaacaacgaccgcaacccccucuucaccuga

SEQ ID NO: 49265 - RNA, 1749 nt, Artificial Sequence
  derived and/or modified sequence opt2 from SEMG2__Homo_sapiens__NP_002999
augaaguccaucauccucuucguccucucccuccuccucauccucgagaagcaggccgccgucaugggccagaagggcggcuccaagggccagcuccccuccggcuccucccaguucccccacggccagaagggccagcacuacuucggccagaaggaccagcagcacaccaaguccaagggcuccuucuccauccagcacaccuaccacgucgacaucaacgaccacgacuggacccgcaagucccagcaguacgaccucaacgcccuccacaaggccaccaaguccaagcagcaccucggcggcucccagcagcuccucaacuacaagcaggagggccgcgaccacgacaaguccaagggccacuuccacaugaucgucauccaccacaagggcggccaggcccaccacggcacccagaaccccucccaggaccagggcaacucccccuccggcaagggccucuccucccagugcuccaacaccgagaagcgccucuggguccacggccucuccaaggagcaggccuccgccuccggcgcccagaagggccgcacccagggcggcucccaguccuccuacguccuccagaccgaggagcucgucgucaacaagcagcagcgcgagaccaagaacucccaccagaacaagggccacuaccagaacgucgucgacguccgcgaggagcacuccuccaagcuccagaccucccuccaccccgcccaccaggaccgccuccagcacggccccaaggacaucuucaccacccaggacgagcuccucgucuacaacaagaaccagcaccagaccaagaaccucucccaggaccaggagcacggccgcaaggcccacaagaucuccuaccccuccucccgcaccgaggagcgccagcuccaccacggcgagaaguccguccagaaggacgucuccaagggcuccaucuccauccagaccgaggagaagauccacggcaagucccagaaccaggucaccauccacucccaggaccaggagcacggccacaaggagaacaagaucuccuaccaguccuccuccaccgaggagcgccaccucaacugcggcgagaagggcauccagaagggcgucuccaagggcuccaucuccauccagaccgaggagcagauccacggcaagucccagaaccagguccgcauccccucccaggcccaggaguacggccacaaggagaacaagaucuccuaccaguccuccuccaccgaggagcgccgccucaacuccggcgagaaggacguccagaagggcgucuccaagggcuccaucuccauccagaccgaggagaagauccacggcaagucccagaaccaggucaccauccccucccaggaccaggagcacggccacaaggagaacaagauguccuaccaguccuccuccaccgaggagcgccgccucaacuacggcggcaaguccacccagaaggacgucucccaguccuccaucuccuuccagaucgagaagcucgucgagggcaagucccagauccagacccccaaccccaaccaggaccagugguccggccagaacgccaagggcaaguccggccaguccgccgacuccaagcaggaccuccucucccacgagcagaagggccgcuacaagcaggaguccuccgagucccacaacaucgucaucaccgagcacgaggucgcccaggacgaccaccucacccagcaguacaacgaggaccgcaaccccaucuccaccuga

SEQ ID NO: 49266 - RNA, 1935 nt, Artificial Sequence
  derived and/or modified sequence opt2 from SENP1__Homo_sapiens__NP_001254524
auggacgacaucgccgaccgcaugcgcauggacgccggcgaggucacccucgucaaccacaacuccgucuucaagacccaccuccucccccagaccggcuuccccgaggaccagcucucccucuccgaccagcagauccucuccucccgccagggccaccucgaccgcuccuucaccugcuccacccgcuccgccgccuacaaccccuccuacuacuccgacaaccccuccuccgacuccuuccucggcuccggcgaccuccgcaccuucggccaguccgccaacggccaguggcgcaacuccacccccuccuccuccuccucccuccagaagucccgcaacucccgcucccucuaccucgagacccgcaagaccuccuccggccucuccaacuccuucgccggcaaguccaaccaccacugccacgucuccgccuacgagaaguccuuccccaucaagcccguccccucccccuccugguccggcuccugccgccgcucccuccucucccccaagaagacccagcgccgccacgucuccaccgccgaggagaccguccaggaggaggagcgcgagaucuaccgccagcuccuccagauggucaccggcaagcaguucaccaucgccaagcccaccacccacuucccccuccaccucucccgcugccucuccuccuccaagaacacccucaaggacucccucuucaagaacggcaacuccugcgccucccagaucaucggcuccgacaccuccuccuccggcuccgccuccauccucaccaaccaggagcagcucucccacuccgucuacucccucuccuccuacacccccgacgucgccuucggcuccaaggacuccggcacccuccaccacccccaccaccaccacuccgucccccaccagcccgacaaccucgccgccuccaacacccaguccgagggcuccgacuccgucauccuccucaaggucaaggacucccagacccccacccccuccuccaccuucuuccaggccgagcucuggaucaaggagcucaccuccgucuacgacucccgcgcccgcgagcgccuccgccagaucgaggagcagaaggcccucgcccuccagcuccagaaccagcgccuccaggagcgcgagcacuccguccacgacuccgucgagcuccaccuccgcgucccccucgagaaggagauccccgucaccgucguccaggagacccagaagaagggccacaagcucaccgacuccgaggacgaguuccccgagaucaccgaggagauggagaaggagaucaagaacgucuuccgcaacggcaaccaggacgagguccucuccgaggccuuccgccucaccaucacccgcaaggacauccagacccucaaccaccucaacuggcucaacgacgagaucaucaacuucuacaugaacaugcucauggagcgcuccaaggagaagggccuccccuccguccacgccuucaacaccuucuucuucaccaagcucaagaccgccggcuaccaggccgucaagcgcuggaccaagaaggucgacgucuucuccgucgacauccuccucguccccauccaccucggcguccacuggugccucgccgucgucgacuuccgcaagaagaacaucaccuacuacgacuccaugggcggcaucaacaacgaggccugccgcauccuccuccaguaccucaagcaggaguccaucgacaagaagcgcaaggaguucgacaccaacggcuggcagcucuucuccaagaagucccaggagaucccccagcagaugaacggcuccgacugcggcauguucgccugcaaguacgccgacugcaucaccaaggaccgccccaucaacuucacccagcagcacaugcccuacuuccgcaagcgcauggucugggagauccuccaccgcaagcuccucuga

SEQ ID NO: 49267 - RNA, 1770 nt, Artificial Sequence
  derived and/or modified sequence opt2 from SENP2__Homo_sapiens__NP_067640
auguaccgcuggcucguccgcauccucggcaccaucuuccgcuucugcgaccgcuccgucccccccgcccgcgcccuccucaagcgccgccgcuccgacuccacccucuucuccaccgucgacaccgacgagauccccgccaagcgcccccgccucgacugcuucauccaccaggucaagaacucccucuacaacgccgccucccucuucggcuuccccuuccagcucaccaccaagcccauggucaccuccgccugcaacggcacccgcaacgucgcccccuccggcgaggucuucuccaacuccuccuccugcgagcucaccggcuccggcuccuggaacaacaugcucaagcucggcaacaagucccccaacggcaucuccgacuaccccaagauccgcgucaccgucacccgcgaccagccccgccgcguccuccccuccuucggcuucacccucaacuccgagggcugcaaccgccgccccggcggccgccgccacuccaagggcaaccccgaguccucccucauguggaagccccaggagcaggccgucaccgagaugaucuccgaggaguccggcaagggccuccgccgcccccacugcaccgucgaggagggcguccagaaggaggagcgcgagaaguaccgcaagcuccucgagcgccucaaggaguccggccacggcaacuccgucugccccgucaccuccaacuaccacuccucccagcgcucccagauggacacccucaagaccaagggcuggggcgaggagcagaaccacggcgucaagaccacccaguucguccccaagcaguaccgccucgucgagacccgcggcccccucugcucccuccgcuccgagaagcgcugcuccaagggcaagaucaccgacaccgagaccauggucggcauccgcuucgagaacgagucccgccgcggcuaccagcucgagcccgaccucuccgaggaggucuccgcccgccuccgccucggcuccggcuccaacggccuccuccgccgcaaggucuccaucaucgagaccaaggagaagaacugcuccggcaaggagcgcgaccgccgcaccgacgaccuccucgagcucaccgaggacauggagaaggagaucuccaacgcccucggccacggcccccaggacgagauccucuccuccgccuucaagcuccgcaucacccgcggcgacauccagacccucaagaacuaccacuggcucaacgacgaggucaucaacuucuacaugaaccuccucgucgagcgcaacaagaagcagggcuaccccgcccuccacgucuucuccaccuucuucuaccccaagcucaaguccggcggcuaccaggccgucaagcgcuggaccaagggcgucaaccucuucgagcaggagaucauccucguccccauccaccgcaagguccacuggucccucgucgucaucgaccuccgcaagaagugccucaaguaccucgacuccaugggccagaagggccaccgcaucugcgagauccuccuccaguaccuccaggacgaguccaagaccaagcgcaacuccgaccucaaccuccucgaguggacccaccacuccaugaagccccacgagaucccccagcagcucaacggcuccgacugcggcauguucaccugcaaguacgccgacuacaucucccgcgacaagcccaucaccuucacccagcaccagaugccccucuuccgcaagaagauggucugggagauccuccaccagcagcuccucuga

SEQ ID NO: 49268 - RNA, 1725 nt, Artificial Sequence
  derived and/or modified sequence opt2 from SENP3__Homo_sapiens__NP_056485
augaaggagaccauccagggcaccggcuccuggggccccgagccccccggccccggcaucccccccgccuacuccuccccccgccgcgagcgccuccgcuggccccccccccccaagccccgccucaaguccggcggcggcuucggccccgaccccggcuccggcaccaccguccccgcccgccgccuccccgucccccgccccuccuucgacgccuccgccuccgaggaggaggaggaggaggaggaggaggaggacgaggacgaggaggaggaggucgccgccuggcgccuccccccccgcuggucccagcucggcaccucccagcgcccccgccccucccgccccacccaccgcaagaccugcucccagcgccgccgccgcgccaugcgcgccuuccgcaugcuccucuacuccaaguccaccucccucaccuuccacuggaagcucuggggccgccaccgcggccgccgccgcggccucgcccaccccaagaaccaccucuccccccagcagggcggcgccaccccccagguccccucccccugcugccgcuucgacuccccccgcggccccccccccccccgccucggccuccucggcgcccucauggccgaggacggcguccgcggcuccccccccguccccuccggcccccccauggaggaggacggccuccgcuggacccccaaguccccccucgaccccgacuccggccuccucuccugcacccuccccaacggcuucggcggccaguccggccccgagggcgagcgcucccucgccccccccgacgccuccauccucaucuccaacgucugcuccaucggcgaccacgucgcccaggagcucuuccagggcuccgaccucggcauggccgaggaggccgagcgccccggcgagaaggccggccagcacuccccccuccgcgaggagcacgucaccugcguccaguccauccucgacgaguuccuccagaccuacggcucccucaucccccucuccaccgacgaggucgucgagaagcucgaggacaucuuccagcaggaguucuccacccccucccgcaagggccucguccuccagcucauccaguccuaccagcgcaugcccggcaacgccaugguccgcggcuuccgcgucgccuacaagcgccacguccucaccauggacgaccucggcacccucuacggccagaacuggcucaacgaccaggucaugaacauguacggcgaccucgucauggacaccguccccgagaagguccacuucuucaacuccuucuucuacgacaagcuccgcaccaagggcuacgacggcgucaagcgcuggaccaagaacgucgacaucuucaacaaggagcuccuccucauccccauccaccucgagguccacuggucccucaucuccgucgacguccgccgccgcaccaucaccuacuucgacucccagcgcacccucaaccgccgcugccccaagcacaucgccaaguaccuccaggccgaggccgucaagaaggaccgccucgacuuccaccagggcuggaagggcuacuucaagaugaacgucgcccgccagaacaacgacuccgacugcggcgccuucguccuccaguacugcaagcaccucgcccucucccagcccuucuccuucacccagcaggacaugcccaagcuccgccgccagaucuacaaggagcucugccacugcaagcucaccgucuga

SEQ ID NO: 49269 - RNA, 2268 nt, Artificial Sequence
  derived and/or modified sequence opt2 from SENP5__Homo_sapiens__NP_689912
augaagaagcagcgcaagauccucuggcgcaagggcauccaccucgccuucuccgagaaguggaacaccggcuucggcggcuucaagaaguucuacuuccaccagcaccucugcauccucaaggccaagcucggccgccccgucaccuggaaccgccagcuccgccacuuccagggccgcaagaaggcccuccagauccagaagaccuggaucaaggacgagccccucugcgccaagaccaaguucaacgucgccacccagaacgucuccacccucuccuccaaggucaagcgcaaggacgccaagcacuucaucuccuccuccaagacccuccuccgccuccaggccgagaagcuccucuccuccgccaagaacuccgaccacgaguacugccgcgagaagaaccuccucaaggccgucaccgacuuccccuccaacuccgcccucggccaggccaacggccaccgcccccgcaccgacccccagcccuccgacuuccccaugaaguucaacggcgagucccagucccccggcgaguccggcaccaucgucgucacccucaacaaccacaagcgcaagggcuucugcuacggcugcugccagggccccgagcaccaccgcaacggcggcccccucauccccaagaaguuccagcucaaccagcaccgccgcaucaagcucuccccccucaugauguacgagaagcucuccaugauccgcuuccgcuaccgcauccuccgcucccagcacuuccgcaccaaguccaaggucugcaagcuccgcaaggcccagcgcuccuggguccagaaggucaccggcgaccaccaggagacccgccgcgagaacggcgagggcggcuccugcucccccuuccccucccccgagcccaaggaccccuccugccgccaccagcccuacuuccccgacauggacuccuccgccgucgucaagggcaccaacucccacguccccgacugccacaccaagggcuccuccuuccucggcaaggagcucucccucgacgaggccuuccccgaccagcagaacggcuccgccaccaacgccugggaccaguccuccugcuccucccccaagugggagugcaccgagcucauccacgacaucccccuccccgagcaccgcuccaacaccauguucaucuccgagaccgagcgcgagaucaugacccucggccaggagaaccagaccuccuccgucuccgacgaccgcgucaagcucuccgucuccggcgccgacaccuccgucuccuccgucgacggccccgucucccagaaggccguccagaacgagaacuccuaccagauggaggaggacggcucccucaagcaguccauccucuccuccgagcuccucgaccaccccuacugcaaguccccccucgaggccccccucgucugcuccggccucaagcucgagaaccaggucggcggcggcaagaacucccagaaggccucccccgucgacgacgagcagcucuccgucugccucuccggcuuccucgacgaggucaugaagaaguacggcucccucgucccccucuccgagaaggagguccucggccgccucaaggacgucuucaacgaggacuucuccaaccgcaagcccuucaucaaccgcgagaucaccaacuaccgcgcccgccaccagaagugcaacuuccgcaucuucuacaacaagcacaugcucgacauggacgaccucgccacccucgacggccagaacuggcucaacgaccaggucaucaacauguacggcgagcucaucauggacgccguccccgacaagguccacuucuucaacuccuucuuccaccgccagcucgucaccaagggcuacaacggcgucaagcgcuggaccaagaaggucgaccucuucaagaagucccuccuccucauccccauccaccucgagguccacuggucccucaucaccgucacccucuccaaccgcaucaucuccuucuacgacucccagggcauccacuucaaguucugcgucgagaacauccgcaaguaccuccucaccgaggcccgcgagaagaaccgccccgaguuccuccagggcuggcagaccgccgucaccaagugcaucccccagcagaagaacgacuccgacugcggcgucuucguccuccaguacugcaagugccucgcccucgagcagcccuuccaguucucccaggaggacaugccccgcguccgcaagcgcaucuacaaggagcucugcgagugccgccucauggacuga

SEQ ID NO: 49270 - RNA, 3318 nt, Artificial Sequence
  derived and/or modified sequence opt2 from SENP6__Homo_sapiens__NP_001093879
auggccgccggcaaguccggcggcuccgccggcgagaucaccuuccucgaggcccucgcccgcuccgaguccaagcgcgacggcggcuucaagaacaacugguccuucgaccacgaggaggaguccgagggcgacaccgacaaggacggcaccaaccuccucuccgucgacgaggacgaggacuccgagaccuccaagggcaagaagcucaaccgccgcuccgagaucgucgccaacuccuccggcgaguucauccucaagaccuacguccgccgcaacaaguccgaguccuucaagacccucaagggcaaccccaucggccucaacaugcucuccaacaacaagaagcucuccgagaacacccagaacaccucccucugcuccggcaccgucguccacggccgccgcuuccaccacgcccacgcccagauccccgucgucaagaccgccgcccagcgcaaggaguaccccccccacguccagaaggucgagaucaaccccguccgccucucccgccuccagggcgucgagcgcaucaugaagaagaccgaggaguccgagucccaggucgagcccgagaucaagcgcaagguccagcagaagcgccacugcuccaccuaccagcccacccccccccucucccccgccuccaagaagugccucacccaccucgaggaccuccagcgcaacugccgccaggccaucacccucaacgaguccaccggcccccuccuccgcaccuccauccaccagaacuccggcggccagaagucccagaacaccggccucaccaccaagaaguucuacggcaacaacgucgagaagguccccaucgacaucaucgucaacugcgacgacuccaagcacaccuaccuccagaccaacggcaaggucauccuccccggcgccaagauccccaagaucaccaaccucaaggagcgcaagaccucccucuccgaccucaacgaccccaucauccucuccuccgacgacgacgacgacaacgaccgcaccaaccgccgcgaguccaucuccccccagcccgccgacuccgccugcuccucccccgcccccuccaccggcaaggucgaggccgcccucaacgagaacaccugccgcgccgagcgcgagcuccgcuccauccccgaggacuccgagcucaacaccgucacccucccccgcaaggcccgcaugaaggaccaguucggcaacuccaucaucaacaccccccucaagcgccgcaaggucuucucccaggagccccccgacgcccucgcccucuccugccaguccuccuucgacuccgucauccucaacugccgcuccauccgcgucggcacccucuuccgccuccucaucgagcccgucaucuucugccucgacuucaucaagauccagcucgacgagcccgaccacgaccccgucgagaucauccucaacaccuccgaccucaccaagugcgaguggugcaacguccgcaagcuccccgucgucuuccuccaggccauccccgccgucuaccagaagcucuccauccagcuccagaugaacaaggaggacaaggucuggaacgacugcaagggcgucaacaagcucaccaaccucgaggagcaguacaucauccucaucuuccagaacggccucgacccccccgccaacauggucuucgaguccaucaucaacgagaucggcaucaagaacaacaucuccaacuucuucgccaagauccccuucgaggaggccaacggccgccucgucgccugcacccgcaccuacgaggaguccaucaagggcuccugcggccagaaggagaacaagaucaagaccgucuccuucgaguccaagauccagcuccgcuccaagcaggaguuccaguucuucgacgaggaggaggagaccggcgagaaccacaccaucuucaucggccccgucgagaagcucaucgucuacccccccccccccgccaagggcggcaucuccgucaccaacgaggaccuccacugccucaacgagggcgaguuccucaacgacgucaucaucgacuucuaccucaaguaccucguccucgagaagcucaagaaggaggacgccgaccgcauccacaucuucuccuccuucuucuacaagcgccucaaccagcgcgagcgccgcaaccacgagaccaccaaccucuccauccagcagaagcgccacggccgcgucaagaccuggacccgccacgucgacaucuucgagaaggacuucaucuucgucccccucaacgaggccgcccacugguuccucgccgucgucugcuuccccggccucgagaagcccaaguacgagcccaacccccacuaccacgagaacgccgucauccagaagugcuccaccgucgaggacuccugcaucuccuccuccgccuccgagauggaguccugcucccagaacuccuccgccaagcccgucaucaagaagaugcucaacaagaagcacugcaucgccgucaucgacuccaaccccggccaggaggaguccgacccccgcuacaagcgcaacaucugcuccgucaaguacuccgucaagaagaucaaccacaccgccuccgagaacgaggaguucaacaagggcgaguccaccucccagaaggucgccgaccgcaccaaguccgagaacggccuccagaacgagucccucuccuccacccaccacaccgacggccucuccaagauccgccucaacuacuccgacgagucccccgaggccggcaagaugcucgaggacgagcucgucgacuucuccgaggaccaggacaaccaggacgacuccuccgacgacggcuuccucgccgacgacaacugcuccuccgagaucggccaguggcaccucaagcccaccaucugcaagcagcccugcauccuccucauggacucccuccgcggccccucccgcuccaacgucgucaagauccuccgcgaguaccucgaggucgagugggaggucaagaagggcuccaagcgcuccuucuccaaggacgucaugaagggcuccaaccccaaggucccccagcagaacaacuucuccgacugcggcgucuacguccuccaguacgucgaguccuucuucgagaaccccauccucuccuucgagcuccccaugaaccucgccaacugguucccccccccccgcaugcgcaccaagcgcgaggagauccgcaacaucauccucaagcuccaggaggaccaguccaaggagaagcgcaagcacaaggacaccuacuccaccgaggccccccucggcgagggcaccgagcaguacgucaacuccaucuccgacuga

SEQ ID NO: 49271 - RNA, 639 nt, Artificial Sequence
  derived and/or modified sequence opt2 from SENP8__Homo_sapiens__NP_001165580
auggaccccgucguccucuccuacauggacucccuccuccgccaguccgacgucucccuccucgacccccccuccuggcucaacgaccacaucaucggcuucgccuucgaguacuucgccaacucccaguuccacgacugcuccgaccacgucuccuucaucucccccgaggucacccaguucaucaagugcaccuccaaccccgccgagaucgccauguuccucgagccccucgaccuccccaacaagcgcgucgucuuccucgccaucaacgacaacuccaaccaggccgccggcggcacccacuggucccuccucgucuaccuccaggacaagaacuccuucuuccacuacgacucccacucccgcuccaacuccguccacgccaagcaggucgccgagaagcucgaggccuuccucggccgcaagggcgacaagcucgccuucgucgaggagaaggcccccgcccagcagaacuccuacgacugcggcauguacgucaucugcaacaccgaggcccucugccagaacuucuuccgccagcagaccgagucccuccuccagcuccucacccccgccuacaucaccaagaagcgcggcgaguggaaggaccucaucaccacccucgccaagaaguga

SEQ ID NO: 49272 - RNA, 978 nt, Artificial Sequence
  derived and/or modified sequence opt2 from SEPHS1__Homo_sapiens__NP_001182531
auggacaccugcgucaucccccuccgccacggcggccucucccucguccagaccaccgacuacaucuaccccaucgucgacgaccccuacaugaugggccgcaucgccugcgccaacguccucuccgaccucuacgccaugggcgucaccgagugcgacaacaugcucaugcuccucggcgucuccaacaagaugaccgaccgcgagcgcgacaaggucaugccccucaucauccagggcuucaaggacgccgccgaggaggccggcaccuccgucaccggcggccagaccguccucaaccccuggaucguccucggcggcgucgccaccaccgucugccagcccaacgaguucaucaugcccgacaacgccguccccggcgacguccucguccucaccaagccccucggcacccaggucgccgucgccguccaccaguggcucgacauccccgagaaguggaacaagaucaagcucgucgucacccaggaggacgucgagcucgccuaccaggaggccaugaugaacauggcccgccucaaccgcaccgccgccggccucaugcacaccuucaacgcccacgccgccaccgacaucaccggcuucggcauccucggccacgcccagaaccucgccaagcagcagcgcaacgaggucuccuucgucauccacaaccuccccguccucgccaagauggccgccgucuccaaggccugcggcaacauguucggccucaugcacggcaccugccccgagaccuccggcggccuccucaucugccucccccgcgagcaggccgcccgcuucugcgccgagaucaagucccccaaguacggcgagggccaccaggccuggaucaucggcaucgucgagaagggcaaccgcaccgcccgcaucaucgacaagccccgcaucaucgaggucgccccccaggucgccacccagaacgucaaccccacccccggcgccaccuccuga

SEQ ID NO: 49273 - RNA, 1506 nt, Artificial Sequence
  derived and/or modified sequence opt2 from SEPSECS__Homo_sapiens__NP_058651
augaaccgcgaguccuucgccgccggcgagcgccucgucucccccgccuacguccgccagggcugcgaggcccgccgcucccacgagcaccucauccgccuccuccucgagaagggcaagugccccgagaacggcugggacgaguccacccucgagcucuuccuccacgagcucgccaucauggacuccaacaacuuccucggcaacugcggcgucggcgagcgcgagggccgcgucgccuccgcccucgucgcccgccgccacuaccgcuucauccacggcaucggccgcuccggcgacaucuccgccguccagcccaaggccgccggcuccucccuccucaacaagaucaccaacucccucguccucgacaucaucaagcucgccggcguccacaccgucgccaacugcuucgucguccccauggccaccggcaugucccucacccucugcuuccucacccuccgccacaagcgccccaaggccaaguacaucaucuggccccgcaucgaccagaaguccugcuucaaguccaugaucaccgccggcuucgagcccgucgucaucgagaacguccucgagggcgacgagcuccgcaccgaccucaaggccgucgaggccaagguccaggagcucggccccgacugcauccucugcauccacuccaccaccuccugcuucgccccccgcguccccgaccgccucgaggagcucgccgucaucugcgccaacuacgacaucccccacaucgucaacaacgccuacggcguccaguccuccaagugcaugcaccucauccagcagggcgcccgcgucggccgcaucgacgccuucguccagucccucgacaagaacuucaugguccccgucggcggcgccaucaucgccggcuucaacgacuccuucauccaggagaucuccaagauguaccccggccgcgccuccgccucccccucccucgacguccucaucacccuccucucccucggcuccaacggcuacaagaagcuccucaaggagcgcaaggagauguucuccuaccucuccaaccagaucaagaagcucuccgaggccuacaacgagcgccuccuccacaccccccacaaccccaucucccucgccaugacccucaagacccucgacgagcaccgcgacaaggccgucacccagcucggcuccaugcucuucacccgccaggucuccggcgcccgcgucgucccccucggcuccaugcagaccgucuccggcuacaccuuccgcggcuucaugucccacaccaacaacuaccccugcgccuaccucaacgccgccuccgccaucggcaugaagaugcaggacgucgaccucuucaucaagcgccucgaccgcugccucaaggccguccgcaaggagcgcuccaaggaguccgacgacaacuacgacaagaccgaggacgucgacaucgaggagauggcccucaagcucgacaacguccuccucgacaccuaccaggacgccuccuccuga

SEQ ID NO: 49274 - RNA, 1965 nt, Artificial Sequence
  derived and/or modified sequence opt2 from SERAC1__Homo_sapiens__NP_116250
augucccucgccgccuacugcgucaucugcugccgccgcaucggcaccuccaccuccccccccaaguccggcacccacuggcgcgacauccgcaacaucaucaaguucaccggcucccucauccucggcggcucccucuuccucaccuacgagguccucgcccucaagaaggccgucacccucgacacccaggucgucgagcgcgagaagaugaaguccuacaucuacguccacaccgucucccucgacaagggcgagaaccacggcaucgccuggcaggcccgcaaggagcuccacaaggccguccgcaagguccucgccaccuccgccaagauccuccgcaaccccuucgccgaccccuucuccaccgucgacaucgaggaccacgagugcgccgucuggcuccuccuccgcaaguccaaguccgacgacaagaccacccgccucgaggccguccgcgagauguccgagacccaccacuggcacgacuaccaguaccgcaucaucgcccaggccugcgaccccaagacccucaucggccucgcccgcuccgaggaguccgaccuccgcuucuuccuccucccccccccccuccccucccucaaggaggacuccuccaccgaggaggagcuccgccagcuccucgccucccucccccagaccgagcucgacgagugcauccaguacuucaccucccucgcccucuccgaguccucccagucccucgccgcccagaagggcggccucuggugcuucggcggcaacggccuccccuacgccgaguccuucggcgagguccccuccgccaccgucgagauguucugccucgaggccaucgucaagcacuccgagaucuccacccacugcgacaagaucgaggccaacggcggccuccagcuccuccagcgccucuaccgccuccacaaggacugccccaagguccagcgcaacaucaugcgcgucaucggcaacauggcccucaacgagcaccuccacuccuccaucguccgcuccggcugggucuccaucauggccgaggccaugaaguccccccacaucauggaguccucccacgccgcccgcauccucgccaaccucgaccgcgagaccguccaggagaaguaccaggacggcgucuacguccuccacccccaguaccgcaccucccagcccaucaaggccgacguccucuucauccacggccucaugggcgccgccuucaagaccuggcgccagcaggacuccgagcaggccgucaucgagaagcccauggaggacgaggaccgcuacaccaccugcuggcccaagaccuggcucgccaaggacugccccgcccuccgcaucaucuccgucgaguacgacaccucccucuccgacuggcgcgcccgcugccccauggagcgcaaguccaucgccuuccgcuccaacgagcuccuccgcaagcuccgcgccgccggcgucggcgaccgccccgucgucuggaucucccacuccaugggcggccuccucgucaagaagaugcuccucgaggccuccaccaagcccgagauguccaccgucaucaacaacacccgcggcaucaucuucuacuccgucccccaccacggcucccgccucgccgaguacuccgucaacauccgcuaccuccucuuccccucccucgaggucaaggagcucuccaaggacucccccgcccucaagacccuccaggacgacuuccucgaguucgccaaggacaagaacuuccagguccucaacuucgucgagacccuccccaccuacaucggcuccaugaucaagcuccacgucguccccgucgaguccgccgaccucggcaucggcgaccucauccccgucgacgucaaccaccucaacaucugcaagcccaagaagaaggacgccuuccucuaccagcgcacccuccaguucauccgcgaggcccucgccaaggaccucgagaacuga

SEQ ID NO: 49275 - RNA, 333 nt, Artificial Sequence
  derived and/or modified sequence opt2 from SERF1A__Homo_sapiens__NP_068802
auggcccgcggcaaccagcgcgagcucgcccgccagaagaacaugaagaagacccaggagaucuccaagggcaagcgcaaggaggacucccucaccgccucccagcgcaagcaguccuccggcggccagaaguccgaguccaagauguccgccggcccccaccucccccucaaggccccccgcgagaaccccugcuucccccuccccgccgccggcggcucccgcuacuaccucgccuacggcuccaucacccccaucuccgccuucgucuucgucgucuucuucuccgucuucuuccccuccuucuacgaggacuucugcugcuggaucuga

SEQ ID NO: 49276 - RNA, 1377 nt, Artificial Sequence
  derived and/or modified sequence opt2 from SERGEF__Homo_sapiens__NP_036271
auggagcgcgagcccuccgccuccgaggccgcccccgccgccgccgcccucuucgccuggggcgccaacuccuacggccagcucggccucggccacaaggaggacguccuccucccccagcagcucaacgacuucugcaagccccgcuccguccgccgcaucaccggcggcggcggccacuccgccgucgucaccgacggcggcgaccucuucgucugcggccucaacaaggacggccagcucggccucggccacaccgaggacauccccuacuucacccccugcaagucccucuucggcugccccauccagcaggucgccugcggcugggacuucaccaucaugcucaccgagaacggccagguccucuccugcggcuccaacuccuucggccagcucggcgucccccacggcccccgccgcugcgucgucccccaggccaucgagcuccacaaggagaaggucgucugcaucgccgccggccuccgccacgccgucgccgccaccgccuccggcaucgucuuccaguggggcaccggccucgccuccugcggccgccgccucugccccggccagacccucccccucuucuucaccgccaaggagcccucccgcgucaccggccucgagaacuccaaggccaugugcguccucgccggcuccgaccacuccgccucccucaccgacgccggcgaggucuacgucuggggcuccaacaagcacggccagcucgccaacgaggccgccuuccuccccgucccccagaagaucgaggcccacugcuuccagaacgagaaggucaccgccaucugguccggcuggacccaccucgucgcccagaccgagaccggcaagauguucaccuggggccgcgccgacuacggccagcucggccgcaagcucgagaccuacgagggcuggaagcucgagaagcaggacuccuuccuccccugcucccgcccccccaacuccaugcccuccuccccccacugccucaccggcgccaccgaggucuccugcggcuccgagcacaaccucgccaucaucggcggcgucugcuacuccuggggcuggaacgagcacggcaugugcggcgacggcaccgaggccaacgucugggcccccaagcccguccaggcccuccucuccuccuccggccuccucgucggcugcggcgccggccacucccucgcccucugccagcuccccgcccaccccgcccucguccaggaccccaaggucaccuaccucucccccgacgccaucgaggacaccgagucccagaaggccauggacaaggagcgcaacuggaaggagcgccaguccgagaccuccacccagucccaguccgacuggucccgcaacggcggccucuga

SEQ ID NO: 49277 - RNA, 1362 nt, Artificial Sequence
  derived and/or modified sequence opt2 from SERINC1__Homo_sapiens__NP_065806
augggcuccguccucggccucugcuccauggccuccuggauccccugccucugcggcuccgcccccugccuccucugccgcugcugccccuccggcaacaacuccaccgucacccgccucaucuacgcccucuuccuccucgucggcgucugcgucgccugcgucaugcucauccccggcauggaggagcagcucaacaagauccccggcuucugcgagaacgagaagggcgucguccccugcaacauccucgucggcuacaaggccgucuaccgccucugcuucggccucgccauguucuaccuccuccucucccuccucaugaucaaggucaaguccuccuccgacccccgcgccgccguccacaacggcuucugguucuucaaguucgccgccgccaucgccaucaucaucggcgccuucuucauccccgagggcaccuucaccaccgucugguucuacgucggcauggccggcgccuucugcuucauccucauccagcucguccuccucaucgacuucgcccacuccuggaacgaguccugggucgagaagauggaggagggcaacucccgcugcugguacgccgcccuccucuccgccaccgcccucaacuaccuccucucccucgucgccaucguccucuucuucgucuacuacacccaccccgccuccugcuccgagaacaaggccuucaucuccgucaacaugcuccucugcgucggcgccuccgucauguccauccuccccaagauccaggagucccagccccgcuccggccuccuccaguccuccgucaucaccgucuacaccauguaccucaccugguccgccaugaccaacgagcccgagaccaacugcaaccccucccuccucuccaucaucggcuacaacaccaccuccaccguccccaaggagggccaguccguccagugguggcacgcccagggcaucaucggccucauccucuuccuccucugcgucuucuacuccuccauccgcaccuccaacaacucccaggucaacaagcucacccucaccuccgacgaguccacccucaucgaggacggcggcgcccgcuccgacggcucccucgaggacggcgacgacguccaccgcgccgucgacaacgagcgcgacggcgucaccuacuccuacuccuucuuccacuucaugcucuuccucgccucccucuacaucaugaugacccucaccaacugguaccgcuacgagcccucccgcgagaugaagucccaguggaccgccgucugggucaagaucuccuccuccuggaucggcaucguccucuacgucuggacccucgucgccccccucguccucaccaaccgcgacuucgacuga

SEQ ID NO: 49278 - RNA, 1422 nt, Artificial Sequence
  derived and/or modified sequence opt2 from SERINC3__Homo_sapiens__NP_006802
augggcgccguccucggcgucuucucccucgccuccuggguccccugccucugcuccggcgccuccugccuccucugcuccugcugccccaacuccaagaacuccaccgucacccgccucaucuacgccuucauccuccuccucuccaccgucgucuccuacaucaugcagcgcaaggagauggagaccuaccucaagaagauccccggcuucugcgagggcggcuucaagauccacgaggccgacaucaacgccgacaaggacugcgacguccucgucggcuacaaggccgucuaccgcaucuccuucgccauggccaucuucuucuucgucuucucccuccucauguucaaggucaagaccuccaaggaccuccgcgccgccguccacaacggcuucugguucuucaagaucgccgcccucaucggcaucauggucggcuccuucuacauccccggcggcuacuucuccuccgucugguucgucgucggcaugaucggcgccgcccucuucauccucauccagcucguccuccucgucgacuucgcccacuccuggaacgaguccugggucaaccgcauggaggagggcaacccccgccucugguacgccgcccuccucuccuucaccuccgccuucuacauccucuccaucaucugcgucggccuccucuacaccuacuacaccaagcccgacggcugcaccgagaacaaguucuucaucuccaucaaccucauccucugcgucgucgccuccaucaucuccauccaccccaagauccaggagcaccagccccgcuccggccuccuccaguccucccucaucacccucuacaccauguaccucaccugguccgccauguccaacgagcccgaccgcuccugcaaccccaaccucauguccuucaucacccgcaucaccgcccccacccucgcccccggcaacuccaccgccgucguccccacccccaccccccccuccaaguccggcucccuccucgacuccgacaacuucaucggccucuucgucuucguccucugccuccucuacuccuccauccgcaccuccaccaacucccaggucgacaagcucacccucuccggcuccgacuccgucauccucggcgacaccaccaccuccggcgccuccgacgaggaggacggccagccccgccgcgccgucgacaacgagaaggagggcguccaguacuccuacucccucuuccaccucaugcucugccucgccucccucuacaucaugaugacccucaccuccugguacucccccgacgccaaguuccaguccaugaccuccaaguggcccgccgucugggucaagaucuccuccuccugggucugccuccuccucuacgucuggacccucgucgccccccucguccucaccucccgcgacuucuccuga

SEQ ID NO: 49279 - RNA, 1263 nt, Artificial Sequence
  derived and/or modified sequence opt2 from SERINC5__Homo_sapiens__NP_001167542
auguccgcccagugcugcgccggccagcucgccugcugcugcggcuccgccggcugcucccucugcugcgacugcugcccccgcauccgccagucccucuccacccgcuucauguacgcccucuacuucauccucgucgucguccucugcugcaucaugauguccaccaccgucgcccacaagaugaaggagcacauccccuucuucgaggacaugugcaagggcaucaaggccggcgacaccugcgagaagcucgucggcuacuccgccgucuaccgcgucugcuucggcauggccugcuucuucuucaucuucugccuccucacccucaagaucaacaacuccaaguccugccgcgcccacauccacaacggcuucugguucuucaagcuccuccuccucggcgccaugugcuccggcgccuucuucauccccgaccaggacaccuuccucaacgccuggcgcuacgucggcgccgucggcggcuuccucuucaucggcauccagcuccuccuccucgucgaguucgcccacaaguggaacaagaacuggaccgccggcaccgccuccaacaagcucugguacgccucccucgcccucgucacccucaucauguacuccaucgccaccggcggccucguccucauggccgucuucuacacccagaaggacuccugcauggagaacaagauccuccucggcgucaacggcggccucugccuccucaucucccucgucgccaucucccccuggguccagaaccgccagccccacuccggccuccuccaguccggcgucaucuccugcuacgucaccuaccucaccuucuccgcccucuccuccaagcccgccgaggucguccucgacgagcacggcaagaacgucaccaucugcguccccgacuucggccaggaccucuaccgcgacgagaaccucgucaccauccucggcaccucccuccucaucggcugcauccucuacuccugccucaccuccaccacccgcuccuccuccgacgcccuccagggccgcuacgccgcccccgagcucgagaucgcccgcugcugcuucugcuucucccccggcggcgaggacaccgaggagcagcagcccggcaaggagggcccccgcgucaucuacgacgagaagaagggcaccgucuacaucuacuccuacuuccacuucgucuucuuccucgccucccucuacgucaugaugaccgucaccaacugguucaaguccgccuuccaccuccuccccuga

SEQ ID NO: 49280 - RNA, 201 nt, Artificial Sequence
  derived and/or modified sequence opt2 from SERP1__Homo_sapiens__NP_055260
auggucgccaagcagcgcauccgcauggccaacgagaagcacuccaagaacaucacccagcgcggcaacgucgccaagaccucccgcaacgcccccgaggagaaggccuccgucggccccuggcuccucgcccucuucaucuucgucgucugcggcuccgccaucuuccagaucauccaguccauccgcaugggcauguga

SEQ ID NO: 49281 - RNA, 198 nt, Artificial Sequence
  derived and/or modified sequence opt2 from SERP2__Homo_sapiens__NP_001010897
auggucgccaagcagcgcauccgcauggccaacgagaagcacuccaagaacaucacccagcgcggcaacgucgccaagacccuccgcccccaggaggagaaguaccccgucggccccuggcuccucgcccucuucgucuucgucgucugcggcuccgccaucuuccagaucauccaguccauccgcaugggcauguga

SEQ ID NO: 49282 - RNA, 1335 nt, Artificial Sequence
  derived and/or modified sequence opt2 from SERPINA10__Homo_sapiens__NP_001094077
augaaggucguccccucccuccuccucuccguccuccucgcccaggucuggcucguccccggccucgcccccuccccccagucccccgagacccccgccccccagaaccagaccucccgcgucguccaggcccccaaggaggaggaggaggacgagcaggaggccuccgaggagaaggccuccgaggaggagaaggccuggcucauggccucccgccagcagcucgccaaggagaccuccaacuucggcuucucccuccuccgcaagaucuccaugcgccacgacggcaacauggucuucucccccuucggcaugucccucgccaugaccggccucaugcucggcgccaccggccccaccgagacccagaucaagcgcggccuccaccuccaggcccucaagcccaccaagcccggccuccuccccucccucuucaagggccuccgcgagacccucucccgcaaccucgagcucggccucacccagggcuccuucgccuucauccacaaggacuucgacgucaaggagaccuucuucaaccucuccaagcgcuacuucgacaccgagugcguccccaugaacuuccgcaacgccucccaggccaagcgccucaugaaccacuacaucaacaaggagacccgcggcaagauccccaagcucuucgacgagaucaaccccgagaccaagcucauccucgucgacuacauccucuucaagggcaaguggcucacccccuucgaccccgucuucaccgaggucgacaccuuccaccucgacaaguacaagaccaucaagguccccaugauguacggcgccggcaaguucgccuccaccuucgacaagaacuuccgcugccacguccucaagcuccccuaccagggcaacgccaccaugcucgucguccucauggagaagaugggcgaccaccucgcccucgaggacuaccucaccaccgaccucgucgagaccuggcuccgcaacaugaagacccgcaacauggaggucuucuuccccaaguucaagcucgaccagaaguacgagaugcacgagcuccuccgccagaugggcauccgccgcaucuucucccccuucgccgaccucuccgagcucuccgccaccggccgcaaccuccaggucucccgcguccuccagcgcaccgucaucgaggucgacgagcgcggcaccgaggccgucgccggcauccucuccgagaucaccgccuacuccaugccccccgucaucaaggucgaccgccccuuccacuucaugaucuacgaggagaccuccggcaugcuccucuuccucggccgcgucgucaaccccacccuccucuga

SEQ ID NO: 49283 - RNA, 1269 nt, Artificial Sequence
  derived and/or modified sequence opt2 from SERPINA11__Homo_sapiens__NP_001073920
augggccccgccuggcucuggcuccucggcaccggcauccucgccuccguccacugccagccccuccucgcccacggcgacaagucccuccagggcccccagcccccccgccaccagcucuccgagcccgcccccgccuaccaccgcaucacccccaccaucaccaacuucgcccuccgccucuacaaggagcucgccgccgacgcccccggcaacaucuucuucucccccgucuccaucuccaccacccucgcccuccucucccucggcgcccaggccaacaccuccgcccucauccucgagggccucggcuucaaccucaccgagacccccgaggccgacauccaccagggcuuccgcucccuccuccacacccucgcccuccccucccccaagcucgagcucaaggucggcaacucccucuuccucgacaagcgccucaagccccgccagcacuaccucgacuccaucaaggagcucuacggcgccuucgccuucuccgccaacuucaccgacuccgucaccaccggccgccagaucaacgacuaccuccgccgccagaccuacggccaggucgucgacugccuccccgaguucucccaggacaccuucaugguccucgccaacuacaucuucuucaaggccaaguggaagcaccccuucucccgcuaccagacccagaagcaggaguccuucuucgucgacgagcgcaccucccuccagguccccaugaugcaccagaaggagaugcaccgcuuccucuacgaccaggaccucgccugcaccguccuccagaucgaguaccgcggcaacgcccucgcccuccucguccuccccgaccccggcaagaugaagcaggucgaggccgcccuccagccccagacccuccgcaaguggggccagcuccuccuccccucccuccucgaccuccaccucccccgcuucuccaucuccggcaccuacaaccucgaggacauccucccccagaucggccucaccaacauccucaaccucgaggccgacuucuccggcgucaccggccagcucaacaagaccaucuccaaggucucccacaaggccauggucgacauguccgagaagggcaccgaggccggcgccgccuccggccuccucucccagccccccucccucaacaccauguccgacccccacgcccacuucaaccgccccuuccuccuccuccucugggaggucaccacccagucccuccucuuccucggcaaggucgucaaccccgucgccggcuga

SEQ ID NO: 49284 - RNA, 1245 nt, Artificial Sequence
  derived and/or modified sequence opt2 from SERPINA12__Homo_sapiens__NP_001291390
augaaccccacccucggccucgccaucuuccucgccguccuccucaccgucaagggccuccucaagcccuccuucuccccccgcaacuacaaggcccucuccgagguccagggcuggaagcagcgcauggccgccaaggagcucgcccgccagaacauggaccucggcuucaagcuccucaagaagcucgccuucuacaaccccggccgcaacaucuuccucuccccccucuccaucuccaccgccuucuccaugcucugccucggcgcccaggacuccacccucgacgagaucaagcagggcuucaacuuccgcaagaugcccgagaaggaccuccacgagggcuuccacuacaucauccacgagcucacccagaagacccaggaccucaagcucuccaucggcaacacccucuucaucgaccagcgccuccagccccagcgcaaguuccucgaggacgccaagaacuucuacuccgccgagaccauccucaccaacuuccagaaccucgagauggcccagaagcagaucaacgacuucaucucccagaagacccacggcaagaucaacaaccucaucgagaacaucgaccccggcaccgucaugcuccucgccaacuacaucuucuuccgcgcccgcuggaagcacgaguucgaccccaacgucaccaaggaggaggacuucuuccucgagaagaacuccuccgucaagguccccaugauguuccgcuccggcaucuaccaggucggcuacgacgacaagcucuccugcaccauccucgagauccccuaccagaagaacaucaccgccaucuucauccuccccgacgagggcaagcucaagcaccucgagaagggccuccaggucgacaccuucucccgcuggaagacccuccucucccgccgcgucgucgacgucuccgucccccgccuccacaugaccggcaccuucgaccucaagaagacccucuccuacaucggcgucuccaagaucuucgaggagcacggcgaccucaccaagaucgccccccaccgcucccucaaggucggcgaggccguccacaaggccgagcucaagauggacgagcgcggcaccgagggcgccgccggcaccggcgcccagacccuccccauggagaccccccucgucgucaagaucgacaagcccuaccuccuccucaucuacuccgagaagauccccuccguccucuuccucggcaagaucgucaaccccaucggcaaguga

SEQ ID NO: 49285 - RNA, 1257 nt, Artificial Sequence
  derived and/or modified sequence opt2 from SERPINA1__Homo_sapiens__NP_001121179
augcccuccuccgucuccuggggcauccuccuccucgccggccucugcugccucguccccgucucccucgccgaggacccccagggcgacgccgcccagaagaccgacaccucccaccacgaccaggaccaccccaccuucaacaagaucacccccaaccucgccgaguucgccuucucccucuaccgccagcucgcccaccaguccaacuccaccaacaucuucuucucccccgucuccaucgccaccgccuucgccaugcucucccucggcaccaaggccgacacccacgacgagauccucgagggccucaacuucaaccucaccgagauccccgaggcccagauccacgagggcuuccaggagcuccuccgcacccucaaccagcccgacucccagcuccagcucaccaccggcaacggccucuuccucuccgagggccucaagcucgucgacaaguuccucgaggacgucaagaagcucuaccacuccgaggccuucaccgucaacuucggcgacaccgaggaggccaagaagcagaucaacgacuacgucgagaagggcacccagggcaagaucgucgaccucgucaaggagcucgaccgcgacaccgucuucgcccucgucaacuacaucuucuucaagggcaagugggagcgccccuucgaggucaaggacaccgaggaggaggacuuccacgucgaccaggucaccaccgucaagguccccaugaugaagcgccucggcauguucaacauccagcacugcaagaagcucuccuccuggguccuccucaugaaguaccucggcaacgccaccgccaucuucuuccuccccgacgagggcaagcuccagcaccucgagaacgagcucacccacgacaucaucaccaaguuccucgagaacgaggaccgccgcuccgccucccuccaccuccccaagcucuccaucaccggcaccuacgaccucaaguccguccucggccagcucggcaucaccaaggucuucuccaacggcgccgaccucuccggcgucaccgaggaggccccccucaagcucuccaaggccguccacaaggccguccucaccaucgacgagaagggcaccgaggccgccggcgccauguuccucgaggccauccccauguccaucccccccgaggucaaguucaacaagcccuucgucuuccucaugaucgagcagaacaccaaguccccccucuucaugggcaaggucgucaaccccacccagaaguga

SEQ ID NO: 49286 - RNA, 1272 nt, Artificial Sequence
  derived and/or modified sequence opt2 from SERPINA3__Homo_sapiens__NP_001076
auggagcgcaugcucccccuccucgcccucggccuccucgccgccggcuucugccccgccguccucugccaccccaacuccccccucgacgaggagaaccucacccaggagaaccaggaccgcggcacccacgucgaccucggccucgccuccgccaacgucgacuucgccuucucccucuacaagcagcucguccucaaggcccccgacaagaacgucaucuucuccccccucuccaucuccaccgcccucgccuuccucucccucggcgcccacaacaccacccucaccgagauccucaagggccucaaguucaaccucaccgagaccuccgaggccgagauccaccaguccuuccagcaccuccuccgcacccucaaccaguccuccgacgagcuccagcucuccaugggcaacgccauguucgucaaggagcagcucucccuccucgaccgcuucaccgaggacgccaagcgccucuacggcuccgaggccuucgccaccgacuuccaggacuccgccgccgccaagaagcucaucaacgacuacgucaagaacggcacccgcggcaagaucaccgaccucaucaaggaccucgacucccagaccaugaugguccucgucaacuacaucuucuucaaggccaagugggagaugcccuucgacccccaggacacccaccagucccgcuucuaccucuccaagaagaagugggucaugguccccaugaugucccuccaccaccucaccauccccuacuuccgcgacgaggagcucuccugcaccgucgucgagcucaaguacaccggcaacgccuccgcccucuucauccuccccgaccaggacaagauggaggaggucgaggccaugcuccuccccgagacccucaagcgcuggcgcgacucccucgaguuccgcgagaucggcgagcucuaccuccccaaguucuccaucucccgcgacuacaaccucaacgacauccuccuccagcucggcaucgaggaggccuucaccuccaaggccgaccucuccggcaucaccggcgcccgcaaccucgccgucucccaggucguccacaaggccguccucgacgucuucgaggagggcaccgaggccuccgccgccaccgccgucaagaucacccuccucuccgcccucgucgagacccgcaccaucguccgcuucaaccgccccuuccucaugaucaucguccccaccgacacccagaacaucuucuucauguccaaggucaccaaccccaagcaggccuga

SEQ ID NO: 49287 - RNA, 1395 nt, Artificial Sequence
  derived and/or modified sequence opt2 from SERPINA4__Homo_sapiens__NP_001275961
augcccggcgaccccgagaagcccccccccggcacccacuccugguaccgcgccgcccucaccgagggccagggccuccucgccgccaaccccggccuccgcguccagcgcaugcaccucaucgacuaccuccuccuccuccucgucggccuccucgcccucucccacggccagcuccacgucgagcacgacggcgaguccugcuccaacuccucccaccagcagauccucgagaccggcgagggcucccccucccucaagaucgcccccgccaacgccgacuucgccuuccgcuucuacuaccucaucgccuccgagacccccggcaagaacaucuucuucuccccccucuccaucuccgccgccuacgccaugcucucccucggcgccugcucccacucccgcucccagauccucgagggccucggcuucaaccucaccgagcucuccgaguccgacguccaccgcggcuuccagcaccuccuccacacccucaaccuccccggccacggccucgagacccgcgucggcuccgcccucuuccucucccacaaccucaaguuccucgccaaguuccucaacgacaccauggccgucuacgaggccaagcucuuccacaccaacuucuacgacaccgucggcaccauccagcucaucaacgaccacgucaagaaggagacccgcggcaagaucgucgaccucgucuccgagcucaagaaggacguccucaugguccucgucaacuacaucuacuucaaggcccucugggagaagcccuucaucuccucccgcaccacccccaaggacuucuacgucgacgagaacaccaccguccgcguccccaugaugcuccaggaccaggagcaccacugguaccuccacgaccgcuaccuccccugcuccguccuccgcauggacuacaagggcgacgccaccgucuucuucauccuccccaaccagggcaagaugcgcgagaucgaggagguccucacccccgagaugcucaugcgcuggaacaaccuccuccgcaagcgcaacuucuacaagaagcucgagcuccaccuccccaaguucuccaucuccggcuccuacguccucgaccagauccucccccgccucggcuucaccgaccucuucuccaagugggccgaccucuccggcaucaccaagcagcagaagcucgaggccuccaaguccuuccacaaggccacccucgacgucgacgaggccggcaccgaggccgccgccgccaccuccuucgccaucaaguucuucuccgcccagaccaaccgccacauccuccgcuucaaccgccccuuccucgucgucaucuucuccaccuccacccaguccguccucuuccucggcaaggucgucgaccccaccaagcccuga

SEQ ID NO: 49288 - RNA, 1221 nt, Artificial Sequence
  derived and/or modified sequence opt2 from SERPINA5__Homo_sapiens__NP_000615
augcagcucuuccuccuccucugccucguccuccucuccccccagggcgccucccuccaccgccaccacccccgcgagaugaagaagcgcgucgaggaccuccacgucggcgccaccgucgcccccuccucccgccgcgacuucaccuucgaccucuaccgcgcccucgccuccgccgcccccucccaguccaucuucuucucccccgucuccaucuccaugucccucgccaugcucucccucggcgccggcuccuccaccaagaugcagauccucgagggccucggccucaaccuccagaaguccuccgagaaggagcuccaccgcggcuuccagcagcuccuccaggagcucaaccagccccgcgacggcuuccagcucucccucggcaacgcccucuucaccgaccucgucgucgaccuccaggacaccuucgucuccgccaugaagacccucuaccucgccgacaccuuccccaccaacuuccgcgacuccgccggcgccaugaagcagaucaacgacuacgucgccaagcagaccaagggcaagaucgucgaccuccucaagaaccucgacuccaacgccgucgucaucauggucaacuacaucuucuucaaggccaagugggagaccuccuucaaccacaagggcacccaggagcaggacuucuacgucaccuccgagaccgucguccgcguccccaugaugucccgcgaggaccaguaccacuaccuccucgaccgcaaccucuccugccgcgucgucggcguccccuaccagggcaacgccaccgcccucuucauccuccccuccgagggcaagaugcagcaggucgagaacggccucuccgagaagacccuccgcaaguggcucaagauguucaagaagcgccagcucgagcucuaccuccccaaguucuccaucgagggcuccuaccagcucgagaagguccuccccucccucggcaucuccaacgucuucaccucccacgccgaccucuccggcaucuccaaccacuccaacauccaggucuccgagaugguccacaaggccgucgucgaggucgacgaguccggcacccgcgccgccgccgccaccggcaccaucuucaccuuccgcuccgcccgccucaacucccagcgccucgucuucaaccgccccuuccucauguucaucgucgacaacaacauccucuuccucggcaaggucaaccgccccuga

SEQ ID NO: 49289 - RNA, 1218 nt, Artificial Sequence
  derived and/or modified sequence opt2 from SERPINA6__Homo_sapiens__NP_001747
augccccuccuccucuacaccugccuccucuggcuccccaccuccggccucuggaccguccaggccauggaccccaacgccgccuacgucaacauguccaaccaccaccgcggccucgccuccgccaacgucgacuucgccuucucccucuacaagcaccucgucgcccucucccccaagaagaacaucuucaucucccccgucuccaucuccauggcccucgccaugcucucccucggcaccugcggccacacccgcgcccagcuccuccagggccucggcuucaaccucaccgagcgcuccgagaccgagauccaccagggcuuccagcaccuccaccagcucuucgccaaguccgacaccucccucgagaugaccaugggcaacgcccucuuccucgacggcucccucgagcuccucgaguccuucuccgccgacaucaagcacuacuacgaguccgagguccucgccaugaacuuccaggacugggccaccgccucccgccagaucaacuccuacgucaagaacaagacccagggcaagaucgucgaccucuucuccggccucgacucccccgccauccucguccucgucaacuacaucuucuucaagggcaccuggacccagcccuucgaccucgccuccacccgcgaggagaacuucuacgucgacgagaccaccgucgucaagguccccaugaugcuccaguccuccaccaucuccuaccuccacgacgccgagcuccccugccagcucguccagaugaacuacgucggcaacggcaccgucuucuucauccuccccgacaagggcaagaugaacaccgucaucgccgcccucucccgcgacaccaucaaccgcugguccgccggccucaccuccucccaggucgaccucuacauccccaaggucaccaucuccggcgucuacgaccucggcgacguccucgaggagaugggcaucgccgaccucuucaccaaccaggccaacuucucccgcaucacccaggacgcccagcucaaguccuccaaggucguccacaaggccguccuccagcucaacgaggagggcgucgacaccgccggcuccaccggcgucacccucaaccucaccuccaagcccaucauccuccgcuucaaccagcccuucaucaucaugaucuucgaccacuucaccugguccucccucuuccucgcccgcgucaugaaccccgucuga

SEQ ID NO: 49290 - RNA, 1248 nt, Artificial Sequence
  derived and/or modified sequence opt2 from SERPINA7__Homo_sapiens__NP_000345
augucccccuuccucuaccucguccuccucguccucggccuccacgccaccauccacugcgccucccccgagggcaaggucaccgccugccacuccucccagcccaacgccacccucuacaagauguccuccaucaacgccgacuucgccuucaaccucuaccgccgcuucaccgucgagacccccgacaagaacaucuucuucucccccgucuccaucuccgccgcccucgucaugcucuccuucggcgccugcugcuccacccagaccgagaucgucgagacccucggcuucaaccucaccgacacccccauggucgagauccagcacggcuuccagcaccucaucugcucccucaacuuccccaagaaggagcucgagcuccagaucggcaacgcccucuucaucggcaagcaccucaagccccucgccaaguuccucaacgacgucaagacccucuacgagaccgaggucuucuccaccgacuucuccaacaucuccgccgccaagcaggagaucaacucccacgucgagaugcagaccaagggcaaggucgucggccucauccaggaccucaagcccaacaccaucaugguccucgucaacuacauccacuucaaggcccagugggccaaccccuucgaccccuccaagaccgaggacuccuccuccuuccucaucgacaagaccaccaccguccagguccccaugaugcaccagauggagcaguacuaccaccucgucgacauggagcucaacugcaccguccuccagauggacuacuccaagaacgcccucgcccucuucguccuccccaaggagggccagauggaguccgucgaggccgccauguccuccaagacccucaagaaguggaaccgccuccuccagaagggcugggucgaccucuucguccccaaguucuccaucuccgccaccuacgaccucggcgccacccuccucaagaugggcauccagcacgccuacuccgagaacgccgacuucuccggccucaccgaggacaacggccucaagcucuccaacgccgcccacaaggccguccuccacaucggcgagaagggcaccgaggccgccgccguccccgaggucgagcucuccgaccagcccgagaacaccuuccuccaccccaucauccagaucgaccgcuccuucaugcuccucauccucgagcgcuccacccgcuccauccucuuccucggcaaggucgucaaccccaccgaggccuga

SEQ ID NO: 49291 - RNA, 1008 nt, Artificial Sequence
  derived and/or modified sequence opt2 from SERPINA9__Homo_sapiens__NP_001035983
augcagggccagggccgccgccgcggcaccugcaaggacaucuucugcuccaagauggccuccuaccucuacggcguccucuucgccgucggccucugcgcccccaucuacugcgucucccccgccaacgcccccuccgccuacccccgccccuccuccaccaaguccacccccgccucccaggucuacucccucaacaccgacuucgccuuccgccucuaccgccgccucguccucgagacccccucccagaacaucuucuucucccccgcccgcaucaacucccacgucaagaagaagacccagggcaaggucgucgacaucauccagggccucgaccuccucaccgccaugguccucgucaaccacaucuucuucaaggccaagugggagaagcccuuccaccccgaguacacccgcaagaacuuccccuuccucgucggcgagcaggucaccguccacguccccaugaugcaccagaaggagcaguucgccuucggcgucgacaccgagcucaacugcuucguccuccagauggacuacaagggcgacgccgucgccuucuucguccuccccuccaagggcaagaugcgccagcucgagcaggcccucuccgcccgcacccuccgcaaguggucccacucccuccagaagcgcuggaucgaggucuucaucccccgcuucuccaucuccgccuccuacaaccucgagaccauccuccccaagaugggcauccagaacgucuucgacaagaacgccgacuucuccggcaucgccaagcgcgacucccuccaggucuccaaggccacccacaaggccguccucgacgucuccgaggagggcaccgaggccaccgccgccaccaccaccaaguucaucguccgcuccaaggacggccccuccuacuucaccgucuccuucaaccgcaccuuccucaugaugaucaccaacaaggccaccgacggcauccucuuccucggcaaggucgagaaccccaccaaguccuga

SEQ ID NO: 49292 - RNA, 1194 nt, Artificial Sequence
  derived and/or modified sequence opt2 from SERPINB10__Homo_sapiens__NP_005015
auggacucccucgccaccuccaucaaccaguucgcccucgagcucuccaagaagcucgccgaguccgcccagggcaagaacaucuucuucuccuccugguccaucuccaccucccucaccaucgucuaccucggcgccaagggcaccaccgccgcccagauggcccagguccuccaguucaaccgcgaccagggcgucaagugcgaccccgaguccgagaagaagcgcaagauggaguucaaccucuccaacuccgaggagauccacuccgacuuccagacccucaucuccgagauccucaagcccaacgacgacuaccuccucaagaccgccaacgccaucuacggcgagaagaccuacgccuuccacaacaaguaccucgaggacaugaagaccuacuucggcgccgagccccagcccgucaacuucgucgaggccuccgaccagauccgcaaggacaucaacuccugggucgagcgccagaccgagggcaagauccagaaccuccuccccgacgacuccgucgacuccaccacccgcaugauccucgucaacgcccucuacuucaagggcaucugggagcaccaguuccucguccagaacaccaccgagaagcccuuccgcaucaacgagaccaccuccaagcccguccagaugauguucaugaagaagaagcuccacaucuuccacaucgagaagcccaaggccgucggccuccagcucuacuacaagucccgcgaccucucccuccucauccuccuccccgaggacaucaacggccucgagcagcucgagaaggccaucaccuacgagaagcucaacgaguggaccuccgccgacaugauggagcucuacgagguccagcuccaccuccccaaguucaagcucgaggacuccuacgaccucaaguccacccucuccuccaugggcauguccgacgccuucucccaguccaaggccgacuucuccggcauguccuccgcccgcaaccucuuccucuccaacgucuuccacaaggccuucgucgagaucaacgagcagggcaccgaggccgccgccggcuccggcuccgagaucgacauccgcauccgcguccccuccaucgaguucaacgccaaccaccccuuccucuucuucauccgccacaacaagaccaacaccauccucuucuacggccgccucugcucccccuga

SEQ ID NO: 49293 - RNA, 1176 nt, Artificial Sequence
  derived and/or modified sequence opt2 from SERPINB13__Homo_sapiens__NP_036529
auggacucccucggcgccgucuccacccgccucggcuucgaccucuucaaggagcucaagaagaccaacgacggcaacaucuucuucucccccgucggcauccucaccgccaucggcaugguccuccucggcacccgcggcgccaccgccucccagcucgaggaggucuuccacuccgagaaggagaccaaguccucccgcaucaaggccgaggagaaggaggucaucgagaacaccgaggccguccaccagcaguuccagaaguuccucaccgagaucuccaagcucaccaacgacuacgagcucaacaucaccaaccgccucuucggcgagaagaccuaccucuuccuccagaaguaccucgacuacgucgagaaguacuaccacgccucccucgagcccgucgacuucgucaacgccgccgacgagucccgcaagaagaucaacuccugggucgaguccaagaccaacgagaagaucaaggaccucuuccccgacggcuccaucuccuccuccaccaagcucguccucgucaacauggucuacuucaagggccagugggaccgcgaguucaagaaggagaacaccaaggaggagaaguucuggaugaacaaguccaccuccaaguccguccagaugaugacccagucccacuccuucuccuucaccuuccucgaggaccuccaggccaagauccucggcauccccuacaagaacaacgaccucuccauguucguccuccuccccaacgacaucgacggccucgagaagaucaucgacaagaucucccccgagaagcucgucgaguggaccucccccggccacauggaggagcgcaaggucaaccuccaccucccccgcuucgaggucgaggacggcuacgaccucgaggccguccucgccgccaugggcaugggcgacgccuucuccgagcacaaggccgacuacuccggcauguccuccggcuccggccucuacgcccagaaguuccuccacuccuccuucgucgccgucaccgaggagggcaccgaggccgccgccgccaccggcaucggcuucaccgucaccuccgcccccggccacgagaacguccacugcaaccaccccuuccucuucuucauccgccacaacgaguccaacuccauccucuucuucggccgcuucuccucccccuga

SEQ ID NO: 49294 - RNA, 1140 nt, Artificial Sequence
  derived and/or modified sequence opt2 from SERPINB1__Homo_sapiens__NP_109591
auggagcagcucuccuccgccaacacccgcuucgcccucgaccucuuccucgcccucuccgagaacaaccccgccggcaacaucuucaucucccccuucuccaucuccuccgccauggccauggucuuccucggcacccgcggcaacaccgccgcccagcucuccaagaccuuccacuucaacaccgucgaggagguccacucccgcuuccagucccucaacgccgacaucaacaagcgcggcgccuccuacauccucaagcucgccaaccgccucuacggcgagaagaccuacaacuuccuccccgaguuccucgucuccacccagaagaccuacggcgccgaccucgccuccgucgacuuccagcacgccuccgaggacgcccgcaagaccaucaaccagugggucaagggccagaccgagggcaagauccccgagcuccucgccuccggcauggucgacaacaugaccaagcucguccucgucaacgccaucuacuucaagggcaacuggaaggacaaguucaugaaggaggccaccaccaacgcccccuuccgccucaacaagaaggaccgcaagaccgucaagaugauguaccagaagaagaaguucgccuacggcuacaucgaggaccucaagugccgcguccucgagcuccccuaccagggcgaggagcucuccauggucauccuccuccccgacgacaucgaggacgaguccaccggccucaagaagaucgaggagcagcucacccucgagaagcuccacgaguggaccaagcccgagaaccucgacuucaucgaggucaacgucucccucccccgcuucaagcucgaggaguccuacacccucaacuccgaccucgcccgccucggcguccaggaccucuucaacuccuccaaggccgaccucuccggcauguccggcgcccgcgacaucuucaucuccaagaucguccacaaguccuucgucgaggucaacgaggagggcaccgaggccgccgccgccaccgccggcaucgccaccuucugcaugcucaugcccgaggagaacuucaccgccgaccaccccuuccucuucuucauccgccacaacuccuccggcuccauccucuuccucggccgcuucuccucccccuga

SEQ ID NO: 49295 - RNA, 1248 nt, Artificial Sequence
  derived and/or modified sequence opt2 from SERPINB2__Homo_sapiens__NP_001137290
auggaggaccucugcgucgccaacacccucuucgcccucaaccucuucaagcaccucgccaaggccucccccacccagaaccucuuccucucccccugguccaucuccuccaccauggccauggucuacaugggcucccgcggcuccaccgaggaccagauggccaagguccuccaguucaacgaggucggcgccaacgccgucacccccaugacccccgagaacuucaccuccugcggcuucaugcagcagauccagaagggcuccuaccccgacgccauccuccaggcccaggccgccgacaagauccacuccuccuuccgcucccucuccuccgccaucaacgccuccaccggcaacuaccuccucgaguccgucaacaagcucuucggcgagaaguccgccuccuuccgcgaggaguacauccgccucugccagaaguacuacuccuccgagccccaggccgucgacuuccucgagugcgccgaggaggcccgcaagaagaucaacuccugggucaagacccagaccaagggcaagauccccaaccuccuccccgagggcuccgucgacggcgacacccgcaugguccucgucaacgccgucuacuucaagggcaaguggaagacccccuucgagaagaagcucaacggccucuaccccuuccgcgucaacuccgcccagcgcacccccguccagaugauguaccuccgcgagaagcucaacaucggcuacaucgaggaccucaaggcccagauccucgagcuccccuacgccggcgacgucuccauguuccuccuccuccccgacgagaucgccgacgucuccaccggccucgagcuccucgaguccgagaucaccuacgacaagcucaacaaguggaccuccaaggacaagauggccgaggacgaggucgaggucuacaucccccaguucaagcucgaggagcacuacgagcuccgcuccauccuccgcuccaugggcauggaggacgccuucaacaagggccgcgccaacuucuccggcauguccgagcgcaacgaccucuuccucuccgaggucuuccaccaggccauggucgacgucaacgaggagggcaccgaggccgccgccggcaccggcggcgucaugaccggccgcaccggccacggcggcccccaguucgucgccgaccaccccuuccucuuccucaucaugcacaagaucaccaacugcauccucuucuucggccgcuucuccucccccuga

SEQ ID NO: 49296 - RNA, 1173 nt, Artificial Sequence
  derived and/or modified sequence opt2 from SERPINB3__Homo_sapiens__NP_008850
augaacucccucuccgaggccaacaccaaguucauguucgaccucuuccagcaguuccgcaaguccaaggagaacaacaucuucuacucccccaucuccaucaccuccgcccucggcaugguccuccucggcgccaaggacaacaccgcccagcagaucaagaagguccuccacuucgaccaggucaccgagaacaccaccggcaaggccgccaccuaccacgucgaccgcuccggcaacguccaccaccaguuccagaagcuccucaccgaguucaacaaguccaccgacgccuacgagcucaagaucgccaacaagcucuucggcgagaagaccuaccucuuccuccaggaguaccucgacgccaucaagaaguucuaccagaccuccgucgaguccgucgacuucgccaacgcccccgaggagucccgcaagaagaucaacuccugggucgagucccagaccaacgagaagaucaagaaccucauccccgagggcaacaucggcuccaacaccacccucguccucgucaacgccaucuacuucaagggccagugggagaagaaguucaacaaggaggacaccaaggaggagaaguucuggcccaacaagaacaccuacaaguccauccagaugaugcgccaguacaccuccuuccacuucgccucccucgaggacguccaggccaagguccucgagauccccuacaagggcaaggaccucuccaugaucguccuccuccccaacgagaucgacggccuccagaagcucgaggagaagcucaccgccgagaagcucauggaguggaccucccuccagaacaugcgcgagacccgcgucgaccuccaccucccccgcuucaaggucgaggaguccuacgaccucaaggacacccuccgcaccaugggcauggucgacaucuucaacggcgacgccgaccucuccggcaugaccggcucccgcggccucguccucuccggcguccuccacaaggccuucgucgaggucaccgaggagggcgccgaggccgccgccgccaccgccgucgucggcuucggcuccucccccaccuccaccaacgaggaguuccacugcaaccaccccuuccucuucuucauccgccagaacaagaccaacuccauccucuucuacggccgcuucuccucccccuga

SEQ ID NO: 49297 - RNA, 1110 nt, Artificial Sequence
  derived and/or modified sequence opt2 from SERPINB4__Homo_sapiens__NP_778206
augaacucccucuccgaggccaacaccaaguucauguucgaccucuuccagcaguuccgcaaguccaaggagaacaacaucuucuacucccccaucuccaucaccuccgcccucggcaugguccuccucggcgccaaggacaacaccgcccagcagaucuccaagguccuccacuucgaccaggucaccgagaacaccaccgagaaggccgccaccuaccacgucgaccgcuccggcaacguccaccaccaguuccagaagcuccucaccgaguucaacaaguccaccgacgccuacgagcucaagaucgccaacaagcucuucggcgagaagaccuaccaguuccuccaggaguaccucgacgccaucaagaaguucuaccagaccuccgucgaguccaccgacuucgccaacgcccccgaggagucccgcaagaagaucaacuccugggucgagucccagaccaacgagaagaucaagaaccucuuccccgacggcaccaucggcaacgacaccacccucguccucgucaacgccaucuacuucaagggccagugggagaacaaguucaagaaggagaacaccaaggaggagaaguucuggcccaacaaggacguccaggccaagguccucgagauccccuacaagggcaaggaccucuccaugaucguccuccuccccaacgagaucgacggccuccagaagcucgaggagaagcucaccgccgagaagcucauggaguggaccucccuccagaacaugcgcgagaccugcgucgaccuccaccucccccgcuucaagauggaggaguccuacgaccucaaggacacccuccgcaccaugggcauggucaacaucuucaacggcgacgccgaccucuccggcaugaccuggucccacggccucuccgucuccaagguccuccacaaggccuucgucgaggucaccgaggagggcgucgaggccgccgccgccaccgccgucgucgucgucgagcucuccucccccuccaccaacgaggaguucugcugcaaccaccccuuccucuucuucauccgccagaacaagaccaacuccauccucuucuacggccgcuucuccucccccuga

SEQ ID NO: 49298 - RNA, 1128 nt, Artificial Sequence
  derived and/or modified sequence opt2 from SERPINB5__Homo_sapiens__NP_002630
auggacgcccuccagcucgccaacuccgccuucgccgucgaccucuucaagcagcucugcgagaaggagccccucggcaacguccucuucucccccaucugccucuccaccucccucucccucgcccaggucggcgccaagggcgacaccgccaacgagaucggccagguccuccacuucgagaacgucaaggacguccccuucggcuuccagaccgucaccuccgacgucaacaagcucuccuccuucuacucccucaagcucaucaagcgccucuacgucgacaagucccucaaccucuccaccgaguucaucuccuccaccaagcgccccuacgccaaggagcucgagaccgucgacuucaaggacaagcucgaggagaccaagggccagaucaacaacuccaucaaggaccucaccgacggccacuucgagaacauccucgccgacaacuccgucaacgaccagaccaagauccucgucgucaacgccgccuacuucgucggcaaguggaugaagaaguucuccgaguccgagaccaaggagugccccuuccgcgucaacaagaccgacaccaagcccguccagaugaugaacauggaggccaccuucugcaugggcaacaucgacuccaucaacugcaagaucaucgagcuccccuuccagaacaagcaccucuccauguucauccuccuccccaaggacgucgaggacgaguccaccggccucgagaagaucgagaagcagcucaacuccgagucccucucccaguggaccaaccccuccaccauggccaacgccaaggucaagcucuccauccccaaguucaaggucgagaagaugaucgaccccaaggccugccucgagaaccucggccucaagcacaucuucuccgaggacaccuccgacuucuccggcauguccgagaccaagggcgucgcccucuccaacgucauccacaaggucugccucgagaucaccgaggacggcggcgacuccaucgagguccccggcgcccgcauccuccagcacaaggacgagcucaacgccgaccaccccuucaucuacaucauccgccacaacaagacccgcaacaucaucuucuucggcaaguucugcucccccuga

SEQ ID NO: 49299 - RNA, 1143 nt, Artificial Sequence
  derived and/or modified sequence opt2 from SERPINB6__Homo_sapiens__NP_001182220
auguccgccaucauggacguccucgccgaggccaacggcaccuucgcccucaaccuccucaagacccucggcaaggacaacuccaagaacgucuucuucucccccauguccauguccugcgcccucgccauggucuacaugggcgccaagggcaacaccgccgcccagauggcccagauccucuccuucaacaaguccggcggcggcggcgacauccaccagggcuuccagucccuccucaccgaggucaacaagaccggcacccaguaccuccuccgcauggccaaccgccucuucggcgagaaguccugcgacuuccucuccuccuuccgcgacuccugccagaaguucuaccaggccgagauggaggagcucgacuucaucuccgccgucgagaagucccgcaagcacaucaacaccugggucgccgagaagaccgagggcaagaucgccgagcuccucucccccggcuccgucgacccccucacccgccucguccucgucaacgccgucuacuuccgcggcaacugggacgagcaguucgacaaggagaacaccgaggagcgccucuucaaggucuccaagaacgaggagaagcccguccagaugauguucaagcaguccaccuucaagaagaccuacaucggcgagaucuucacccagauccucguccuccccuacgucggcaaggagcucaacaugaucaucaugcuccccgacgagaccaccgaccuccgcaccgucgagaaggagcucaccuacgagaaguucgucgaguggacccgccucgacaugauggacgaggaggaggucgaggucucccucccccgcuucaagcucgaggaguccuacgacauggaguccguccuccgcaaccucggcaugaccgacgccuucgagcucggcaaggccgacuucuccggcaugucccagaccgaccucucccucuccaaggucguccacaaguccuucgucgaggucaacgaggagggcaccgaggccgccgccgccaccgccgccaucaugaugaugcgcugcgcccgcuucgucccccgcuucugcgccgaccaccccuuccucuucuucauccagcacuccaagaccaacggcauccucuucugcggccgcuucuccucccccuga

SEQ ID NO: 49300 - RNA, 1092 nt, Artificial Sequence
  derived and/or modified sequence opt2 from SERPINB7__Homo_sapiens__NP_001248760
auggccucccucgccgccgccaacgccgaguucugcuucaaccucuuccgcgagauggacgacaaccagggcaacggcaacgucuucuucuccucccucucccucuucgccgcccucgcccucguccgccucggcgcccaggacgacucccucucccagaucgacaaguccggccuccagucccagcucaagcgcgucuucuccgacaucaacgccucccacaaggacuacgaccucuccaucgucaacggccucuucgccgagaaggucuacggcuuccacaaggacuacaucgagugcgccgagaagcucuacgacgccaaggucgagcgcgucgacuucaccaaccaccucgaggacacccgccgcaacaucaacaagugggucgagaacgagacccacggcaagaucaagaacgucaucggcgagggcggcaucuccuccuccgccgucaugguccucgucaacgccgucuacuucaagggcaaguggcaguccgccuucaccaaguccgagaccaucaacugccacuucaagucccccaagugcuccggcaaggccgucgccaugaugcaccaggagcgcaaguucaaccucuccgucaucgaggaccccuccaugaagauccucgagcuccgcuacaacggcggcaucaacauguacguccuccuccccgagaacgaccucuccgagaucgagaacaagcucaccuuccagaaccucauggaguggaccaacccccgccgcaugaccuccaaguacgucgaggucuucuucccccaguucaagaucgagaagaacuacgagaugaagcaguaccuccgcgcccucggccucaaggacaucuucgacgaguccaaggccgaccucuccggcaucgccuccggcggccgccucuacaucucccgcaugaugcacaaguccuacaucgaggucaccgaggagggcaccgaggccaccgccgccaccggcuccaacaucgucgagaagcagcucccccaguccacccucuuccgcgccgaccaccccuuccucuucgucauccgcaaggacgacaucauccucuucuccggcaaggucuccugccccuga

SEQ ID NO: 49301 - RNA, 729 nt, Artificial Sequence
  derived and/or modified sequence opt2 from SERPINB8__Homo_sapiens__NP_001027018
auggacgaccucugcgaggccaacggcaccuucgccaucucccucuucaagauccucggcgaggaggacaacucccgcaacgucuucuucucccccauguccaucuccuccgcccucgccauggucuucaugggcgccaagggcuccaccgccgcccagaugucccaggcccucugccucuacaaggacggcgacauccaccgcggcuuccagucccuccucuccgaggucaaccgcaccggcacccaguaccuccuccgcaccgccaaccgccucuucggcgagaagaccugcgacuuccuccccgacuucaaggaguacugccagaaguucuaccaggccgagcucgaggagcucuccuucgccgaggacaccgaggagugccgcaagcacaucaacgacugggucgccgagaagaccgagggcaagaucuccgagguccucgacgccggcaccgucgacccccucaccaagcucguccucgucaacgccaucuacuucaagggcaaguggaacgagcaguucgaccgcaaguacacccgcggcaugcucuucaagaccaacgaggagaagaagaccguccagaugauguucaaggaggccaaguucaagaugggcuacgccgacgagguccacacccagguccucgagcuccccuacgucgaggaggagcucuccauggucauccuccuccccgacgacaacaccgaccucgccgucaaggaguga

SEQ ID NO: 49302 - RNA, 1131 nt, Artificial Sequence
  derived and/or modified sequence opt2 from SERPINB9__Homo_sapiens__XP_005249241
auggagacccucuccaacgccuccggcaccuucgccauccgccuccucaagauccucugccaggacaaccccucccacaacgucuucugcucccccgucuccaucuccuccgcccucgccaugguccuccucggcgccaagggcaacaccgccacccagauggcccaggcccucucccucaacaccgaggaggacauccaccgcgccuuccagucccuccucaccgaggucaacaaggccggcacccaguaccuccuccgcaccgccaaccgccucuucggcgagaagaccugccaguuccucuccaccuucaaggaguccugccuccaguucuaccacgccgagcucaaggagcucuccuucauccgcgccgccgaggagucccgcaagcacaucaacaccugggucuccaagaagaccgagggcaagaucgaggagcuccuccccggcuccuccaucgacgccgagacccgccucguccucgucaacgccaucuacuucaagggcaaguggaacgagcccuucgacgagaccuacacccgcgagaugcccuucaagaucaaccaggaggagcagcgccccguccagaugauguaccaggaggccaccuucaagcucgcccacgucggcgagguccgcgcccagcuccucgagcuccccuacgcccgcaaggagcucucccuccucguccuccuccccgacgacggcgucgagcucuccaccgucgagaagucccucaccuucgagaagcucaccgccuggaccaagcccgacugcaugaaguccaccgaggucgagguccuccuccccaaguucaagcuccaggaggacuacgacauggaguccguccuccgccaccucggcaucgucgacgccuuccagcagggcaaggccgaccucuccgccauguccgccgagcgcgaccucugccucuccaaguucguccacaaguccuucgucgaggucaacgaggagggcaccgaggccgccgccgccuccuccugcuucgucgucgccgagugcugcauggaguccggcccccgcuucugcgccgaccaccccuuccucuucuucauccgccacaaccgcgccaacuccauccucuucugcggccgcuucuccucccccuga

SEQ ID NO: 49303 - RNA, 1395 nt, Artificial Sequence
  derived and/or modified sequence opt2 from SERPINC1__Homo_sapiens__NP_000479
auguacuccaacgucaucggcaccgucaccuccggcaagcgcaaggucuaccuccucucccuccuccucaucggcuucugggacugcgucaccugccacggcucccccgucgacaucugcaccgccaagccccgcgacauccccaugaaccccaugugcaucuaccgcucccccgagaagaaggccaccgaggacgagggcuccgagcagaagauccccgaggccaccaaccgccgcgucugggagcucuccaaggccaacucccgcuucgccaccaccuucuaccagcaccucgccgacuccaagaacgacaacgacaacaucuuccucuccccccucuccaucuccaccgccuucgccaugaccaagcucggcgccugcaacgacacccuccagcagcucauggaggucuucaaguucgacaccaucuccgagaagaccuccgaccagauccacuucuucuucgccaagcucaacugccgccucuaccgcaaggccaacaaguccuccaagcucgucuccgccaaccgccucuucggcgacaagucccucaccuucaacgagaccuaccaggacaucuccgagcucgucuacggcgccaagcuccagccccucgacuucaaggagaacgccgagcagucccgcgccgccaucaacaagugggucuccaacaagaccgagggccgcaucaccgacgucauccccuccgaggccaucaacgagcucaccguccucguccucgucaacaccaucuacuucaagggccucuggaaguccaaguucucccccgagaacacccgcaaggagcucuucuacaaggccgacggcgaguccugcuccgccuccaugauguaccaggagggcaaguuccgcuaccgccgcgucgccgagggcacccagguccucgagcuccccuucaagggcgacgacaucaccaugguccucauccuccccaagcccgagaagucccucgccaaggucgagaaggagcucacccccgagguccuccaggaguggcucgacgagcucgaggagaugaugcucgucguccacaugccccgcuuccgcaucgaggacggcuucucccucaaggagcagcuccaggacaugggccucgucgaccucuucucccccgagaaguccaagcuccccggcaucgucgccgagggccgcgacgaccucuacgucuccgacgccuuccacaaggccuuccucgaggucaacgaggagggcuccgaggccgccgccuccaccgccgucgucaucgccggccgcucccucaaccccaaccgcgucaccuucaaggccaaccgccccuuccucgucuucauccgcgaggucccccucaacaccaucaucuucaugggccgcgucgccaaccccugcgucaaguga

SEQ ID NO: 49304 - RNA, 1500 nt, Artificial Sequence
  derived and/or modified sequence opt2 from SERPIND1__Homo_sapiens__NP_000176
augaagcacucccucaacgcccuccucaucuuccucaucaucaccuccgccuggggcggcuccaagggcccccucgaccagcucgagaagggcggcgagaccgcccaguccgccgacccccagugggagcagcucaacaacaagaaccucuccaugccccuccuccccgccgacuuccacaaggagaacaccgucaccaacgacuggauccccgagggcgaggaggacgacgacuaccucgaccucgagaagaucuucuccgaggacgacgacuacaucgacaucgucgacucccucuccgucucccccaccgacuccgacgucuccgccggcaacauccuccagcucuuccacggcaagucccgcauccagcgccucaacauccucaacgccaaguucgccuucaaccucuaccgcguccucaaggaccaggucaacaccuucgacaacaucuucaucgcccccgucggcaucuccaccgccaugggcaugaucucccucggccucaagggcgagacccacgagcagguccacuccauccuccacuucaaggacuucgucaacgccuccuccaaguacgagaucaccaccauccacaaccucuuccgcaagcucacccaccgccucuuccgccgcaacuucggcuacacccuccgcuccgucaacgaccucuacauccagaagcaguuccccauccuccucgacuucaagaccaagguccgcgaguacuacuucgccgaggcccagaucgccgacuucuccgaccccgccuucaucuccaagaccaacaaccacaucaugaagcucaccaagggccucaucaaggacgcccucgagaacaucgaccccgccacccagaugaugauccucaacugcaucuacuucaagggcuccugggucaacaaguuccccgucgagaugacccacaaccacaacuuccgccucaacgagcgcgaggucgucaaggucuccaugaugcagaccaagggcaacuuccucgccgccaacgaccaggagcucgacugcgacauccuccagcucgaguacgucggcggcaucuccaugcucaucgucgucccccacaagauguccggcaugaagacccucgaggcccagcucaccccccgcgucgucgagcgcuggcagaaguccaugaccaaccgcacccgcgagguccuccuccccaaguucaagcucgagaagaacuacaaccucgucgagucccucaagcucaugggcauccgcaugcucuucgacaagaacggcaacauggccggcaucuccgaccagcgcaucgccaucgaccucuucaagcaccagggcaccaucaccgucaacgaggagggcacccaggccaccaccgucaccaccgucggcuucaugccccucuccacccagguccgcuucaccgucgaccgccccuuccucuuccucaucuacgagcaccgcaccuccugccuccucuucaugggccgcgucgccaaccccucccgcuccuga

SEQ ID NO: 49305 - RNA, 1209 nt, Artificial Sequence
  derived and/or modified sequence opt2 from SERPINE1__Homo_sapiens__NP_000593
augcagaugucccccgcccucaccugccucguccucggccucgcccucgucuucggcgagggcuccgccguccaccacccccccuccuacgucgcccaccucgccuccgacuucggcguccgcgucuuccagcaggucgcccaggccuccaaggaccgcaacgucgucuucucccccuacggcgucgccuccguccucgccaugcuccagcucaccaccggcggcgagacccagcagcagauccaggccgccaugggcuucaagaucgacgacaagggcauggcccccgcccuccgccaccucuacaaggagcucaugggccccuggaacaaggacgagaucuccaccaccgacgccaucuucguccagcgcgaccucaagcucguccagggcuucaugccccacuucuuccgccucuuccgcuccaccgucaagcaggucgacuucuccgaggucgagcgcgcccgcuucaucaucaacgacugggucaagacccacaccaagggcaugaucuccaaccuccucggcaagggcgccgucgaccagcucacccgccucguccucgucaacgcccucuacuucaacggccaguggaagacccccuuccccgacuccuccacccaccgccgccucuuccacaaguccgacggcuccaccgucuccguccccaugauggcccagaccaacaaguucaacuacaccgaguucaccacccccgacggccacuacuacgacauccucgagcuccccuaccacggcgacacccucuccauguucaucgccgcccccuacgagaaggaggucccccucuccgcccucaccaacauccucuccgcccagcucaucucccacuggaagggcaacaugacccgccucccccgccuccucguccuccccaaguucucccucgagaccgaggucgaccuccgcaagccccucgagaaccucggcaugaccgacauguuccgccaguuccaggccgacuucaccucccucuccgaccaggagccccuccacgucgcccaggcccuccagaaggucaagaucgaggucaacgaguccggcaccgucgccuccuccuccaccgccgucaucgucuccgcccgcauggcccccgaggagaucaucauggaccgccccuuccucuucgucguccgccacaaccccaccggcaccguccucuucaugggccaggucauggagcccuga

SEQ ID NO: 49306 - RNA, 1194 nt, Artificial Sequence
  derived and/or modified sequence opt2 from SERPINE2__Homo_sapiens__NP_001130000
augaacuggcaccucccccucuuccuccucgccuccgucacccuccccuccaucugcucccacuucaacccccucucccucgaggagcucggcuccaacaccggcauccaggucuucaaccagaucgucaagucccgcccccacgacaacaucgucaucuccccccacggcaucgccuccguccucggcaugcuccagcucggcgccgacggccgcaccaagaagcagcucgccauggucaugcgcuacggcgucaacggcgucggcaagauccucaagaagaucaacaaggccaucgucuccaagaagaacaaggacaucgucaccgucgccaacgccgucuucgucaagaacgccuccgagaucgagguccccuucgucacccgcaacaaggacgucuuccagugcgagguccgcaacgucaacuucgaggaccccgccuccgccugcgacuccaucaacgccugggucaagaacgagacccgcgacaugaucgacaaccuccucucccccgaccucaucgacggcguccucacccgccucguccucgucaacgccgucuacuucaagggccucuggaagucccgcuuccagcccgagaacaccaagaagcgcaccuucgucgccgccgacggcaaguccuaccagguccccaugcucgcccagcucuccgucuuccgcugcggcuccaccuccgcccccaacgaccucugguacaacuucaucgagcuccccuaccacggcgaguccaucuccaugcucaucgcccuccccaccgaguccuccaccccccucuccgccaucaucccccacaucuccaccaagaccaucgacuccuggauguccaucaugguccccaagcgcguccaggucauccuccccaaguucaccgccgucgcccagaccgaccucaaggagccccucaagguccucggcaucaccgacauguucgacuccuccaaggccaacuucgccaagaucacccgcuccgagaaccuccacgucucccacauccuccagaaggccaagaucgaggucuccgaggacggcaccaaggccuccgccgccaccaccgccauccucaucgcccgcuccuccccccccugguucaucgucgaccgccccuuccucuucuucauccgccacaaccccaccggcgccguccucuucaugggccagaucaacaagcccuga

SEQ ID NO: 49307 - RNA, 1275 nt, Artificial Sequence
  derived and/or modified sequence opt2 from SERPINE3__Homo_sapiens__NP_001094790
augccccccuuccucaucacccucuuccucuuccacuccugcugccuccgcgccaacggccaccuccgcgagggcaugacccuccucaagaccgaguucgcccuccaccucuaccaguccgucgccgccugccgcaacgagaccaacuucgucaucucccccgccggcgucucccucccccucgagauccuccaguucggcgccgagggcuccaccggccagcagcucgccgacgcccucggcuacaccguccacgacaagcgcgucaaggacuuccuccacgccgucuacgccacccuccccaccuccucccagggcaccgagauggagcucgccugcucccucuucguccaggucggcaccccccucucccccugcuucgucgagcacgucuccuggugggccaacuccucccucgagcccgccgaccucuccgagcccaacuccaccgccauccagaccuccgagggcgccucccgcgagaccgccggcggcggccccuccgagggccccggcggcuggcccugggagcaggucuccgccgccuucgcccagcucguccucgucuccaccauguccuuccagggcaccuggcgcaagcgcuucuccuccaccgacacccagauccuccccuucaccugcgccuacggccucguccuccagguccccaugaugcaccagaccaccgaggucaacuacggccaguuccaggacaccgccggccaccaggucggcguccucgagcuccccuaccucggcuccgccgucucccucuuccucguccucccccgcgacaaggacaccccccucucccacaucgagccccaccucaccgccuccaccauccaccucuggaccaccucccuccgccgcgcccgcauggacgucuuccucccccgcuuccgcauccagaaccaguucaaccucaaguccauccucaacuccuggggcgucaccgaccucuucgacccccucaaggccaaccucaagggcaucuccggccaggacggcuucuacgucuccgaggccauccacaaggccaagaucgagguccucgaggagggcaccaaggccuccggcgccaccgcccuccuccuccucaagcgcucccgcauccccaucuucaaggccgaccgccccuucaucuacuuccuccgcgagcccaacaccggcaucaccgucuucuucgaccgcauccagaucaucuaccagugccucuccuccaacaagggcuccuucguccacuacccccucaagaacaagcacuccuucuga

SEQ ID NO: 49308 - RNA, 1257 nt, Artificial Sequence
  derived and/or modified sequence opt2 from SERPINF1__Homo_sapiens__NP_002606
augcaggcccucguccuccuccucugcaucggcgcccuccucggccacuccuccugccagaaccccgccuccccccccgaggagggcucccccgaccccgacuccaccggcgcccucgucgaggaggaggaccccuucuucaagguccccgucaacaagcucgccgccgccgucuccaacuucggcuacgaccucuaccgcguccgcuccuccaccucccccaccaccaacguccuccucuccccccucuccgucgccaccgcccucuccgcccucucccucggcgccgagcagcgcaccgaguccaucauccaccgcgcccucuacuacgaccucaucuccucccccgacauccacggcaccuacaaggagcuccucgacaccgucaccgccccccagaagaaccucaaguccgccucccgcaucgucuucgagaagaagcuccgcaucaaguccuccuucgucgccccccucgagaaguccuacggcacccgcccccgcguccucaccggcaacccccgccucgaccuccaggagaucaacaacuggguccaggcccagaugaagggcaagcucgcccgcuccaccaaggagauccccgacgagaucuccauccuccuccucggcgucgcccacuucaagggccagugggucaccaaguucgacucccgcaagaccucccucgaggacuucuaccucgacgaggagcgcaccguccgcguccccaugauguccgaccccaaggccguccuccgcuacggccucgacuccgaccucuccugcaagaucgcccagcucccccucaccggcuccauguccaucaucuucuuccucccccucaaggucacccagaaccucacccucaucgaggagucccucaccuccgaguucauccacgacaucgaccgcgagcucaagaccguccaggccguccucaccguccccaagcucaagcucuccuacgagggcgaggucaccaagucccuccaggagaugaagcuccagucccucuucgacucccccgacuucuccaagaucaccggcaagcccaucaagcucacccaggucgagcaccgcgccggcuucgaguggaacgaggacggcgccggcaccacccccucccccggccuccagcccgcccaccucaccuucccccucgacuaccaccucaaccagcccuucaucuucguccuccgcgacaccgacaccggcgcccuccucuucaucggcaagauccucgacccccgcggccccuga

SEQ ID NO: 49309 - RNA, 1476 nt, Artificial Sequence
  derived and/or modified sequence opt2 from SERPINF2__Homo_sapiens__NP_001159392
auggcccuccucuggggccuccucguccucuccugguccugccuccagggccccugcuccgucuucucccccgucuccgccauggagccccucggccgccagcucaccuccggccccaaccaggagcaggucuccccccucacccuccucaagcucggcaaccaggagcccggcggccagaccgcccucaaguccccccccggcgucugcucccgcgaccccacccccgagcagacccaccgccucgcccgcgccaugauggccuucaccgccgaccucuucucccucgucgcccagaccuccaccugccccaaccucauccucuccccccucuccgucgcccucgcccucucccaccucgcccucggcgcccagaaccacacccuccagcgccuccagcagguccuccacgccggcuccggccccugccucccccaccuccucucccgccucugccaggaccucggccccggcgccuuccgccucgccgcccgcauguaccuccagaagggcuuccccaucaaggaggacuuccucgagcaguccgagcagcucuucggcgccaagcccgucucccucaccggcaagcaggaggacgaccucgccaacaucaaccagugggucaaggaggccaccgagggcaagauccaggaguuccucuccggccuccccgaggacaccguccuccuccuccucaacgccauccacuuccagggcuucuggcgcaacaaguucgaccccucccucacccagcgcgacuccuuccaccucgacgagcaguucaccguccccgucgagaugaugcaggcccgcaccuacccccuccgcugguuccuccucgagcagcccgagauccaggucgcccacuuccccuucaagaacaacauguccuucgucguccucguccccacccacuucgaguggaacgucucccagguccucgccaaccucuccugggacacccuccaccccccccucgucugggagcgccccaccaagguccgccuccccaagcucuaccucaagcaccagauggaccucgucgccacccucucccagcucggccuccaggagcucuuccaggcccccgaccuccgcggcaucuccgagcagucccucgucgucuccggcguccagcaccaguccacccucgagcucuccgaggucggcgucgaggccgccgccgccaccuccaucgccaugucccgcaugucccucuccuccuucuccgucaaccgccccuuccucuucuucaucuucgaggacaccaccggccucccccucuucgucggcuccguccgcaaccccaaccccuccgccccccgcgagcucaaggagcagcaggacucccccggcaacaaggacuuccuccagucccucaagggcuucccccgcggcgacaagcucuucggccccgaccucaagcucgucccccccauggaggaggacuacccccaguucggcucccccaaguga

SEQ ID NO: 49310 - RNA, 1503 nt, Artificial Sequence
  derived and/or modified sequence opt2 from SERPING1__Homo_sapiens__NP_000053
auggccucccgccucacccuccucacccuccuccuccuccuccucgccggcgaccgcgccuccuccaaccccaacgccaccuccuccuccucccaggaccccgagucccuccaggaccgcggcgagggcaaggucgccaccaccgucaucuccaagaugcucuucgucgagcccauccucgaggucuccucccuccccaccaccaacuccaccaccaacuccgccaccaagaucaccgccaacaccaccgacgagcccaccacccagcccaccaccgagcccaccacccagcccaccauccagcccacccagcccaccacccagcuccccaccgacucccccacccagcccaccaccggcuccuucugccccggccccgucacccucugcuccgaccucgagucccacuccaccgaggccguccucggcgacgcccucgucgacuucucccucaagcucuaccacgccuucuccgccaugaagaaggucgagaccaacauggccuucucccccuucuccaucgccucccuccucacccagguccuccucggcgccggcgagaacaccaagaccaaccucgaguccauccucuccuaccccaaggacuucaccugcguccaccaggcccucaagggcuucaccaccaagggcgucaccuccgucucccagaucuuccacucccccgaccucgccauccgcgacaccuucgucaacgccucccgcacccucuacuccuccuccccccgcguccucuccaacaacuccgacgccaaccucgagcucaucaacaccugggucgccaagaacaccaacaacaagaucucccgccuccucgacucccuccccuccgacacccgccucguccuccucaacgccaucuaccucuccgccaaguggaagaccaccuucgaccccaagaagacccgcauggagcccuuccacuucaagaacuccgucaucaagguccccaugaugaacuccaagaaguaccccgucgcccacuucaucgaccagacccucaaggccaaggucggccagcuccagcucucccacaaccucucccucgucauccucgucccccagaaccucaagcaccgccucgaggacauggagcaggcccucucccccuccgucuucaaggccaucauggagaagcucgagauguccaaguuccagcccacccuccucacccucccccgcaucaaggucaccaccucccaggacaugcucuccaucauggagaagcucgaguucuucgacuucuccuacgaccucaaccucugcggccucaccgaggaccccgaccuccaggucuccgccaugcagcaccagaccguccucgagcucaccgagaccggcgucgaggccgccgccgccuccgccaucuccgucgcccgcacccuccucgucuucgagguccagcagcccuuccucuucguccucugggaccagcagcacaaguuccccgucuucaugggccgcgucuacgacccccgcgccuga

SEQ ID NO: 49311 - RNA, 1257 nt, Artificial Sequence
  derived and/or modified sequence opt2 from SERPINH1__Homo_sapiens__XP_011543629
augcgcucccuccuccuccucuccgccuucugccuccucgaggccgcccucgccgccgaggucaagaagcccgccgccgccgccgcccccggcaccgccgagaagcucucccccaaggccgccacccucgccgagcgcuccgccggccucgccuucucccucuaccaggccauggccaaggaccaggccgucgagaacauccucgucucccccgucgucgucgccuccucccucggccucgucucccucggcggcaaggccaccaccgccucccaggccaaggccguccucuccgccgagcagcuccgcgacgaggagguccacgccggccucggcgagcuccuccgcucccucuccaacuccaccgcccgcaacgucaccuggaagcucggcucccgccucuacggccccuccuccgucuccuucgccgacgacuucguccgcuccuccaagcagcacuacaacugcgagcacuccaagaucaacuuccgcgacaagcgcuccgcccuccaguccaucaacgagugggccgcccagaccaccgacggcaagcuccccgaggucaccaaggacgucgagcgcaccgacggcgcccuccucgucaacgccauguucuucaagccccacugggacgagaaguuccaccacaagauggucgacaaccgcggcuucauggucacccgcuccuacaccgucggcgucaugaugaugcaccgcaccggccucuacaacuacuacgacgacgagaaggagaagcuccagaucgucgagaugccccucgcccacaagcucuccucccucaucauccucaugccccaccacgucgagccccucgagcgccucgagaagcuccucaccaaggagcagcucaagaucuggaugggcaagaugcagaagaaggccgucgccaucucccuccccaagggcgucgucgaggucacccacgaccuccagaagcaccucgccggccucggccucaccgaggccaucgacaagaacaaggccgaccucucccgcauguccggcaagaaggaccucuaccucgccuccgucuuccacgccaccgccuucgagcucgacaccgacggcaaccccuucgaccaggacaucuacggccgcgaggagcuccgcucccccaagcucuucuacgccgaccaccccuucaucuuccucguccgcgacacccaguccggcucccuccucuucaucggccgccucguccgccccaagggcgacaagaugcgcgacgagcucuga

SEQ ID NO: 49312 - RNA, 1233 nt, Artificial Sequence
  derived and/or modified sequence opt2 from SERPINI1__Homo_sapiens__NP_005016
auggccuuccucggccucuucucccuccucguccuccaguccauggccaccggcgccaccuuccccgaggaggccaucgccgaccucuccgucaacauguacaaccgccuccgcgccaccggcgaggacgagaacauccucuucuccccccucuccaucgcccucgccaugggcaugauggagcucggcgcccagggcuccacccagaaggagauccgccacuccaugggcuacgacucccucaagaacggcgaggaguucuccuuccucaaggaguucuccaacauggucaccgccaaggagucccaguacgucaugaagaucgccaacucccucuucguccagaacggcuuccacgucaacgaggaguuccuccagaugaugaagaaguacuucaacgccgccgucaaccacgucgacuucucccagaacgucgccgucgccaacuacaucaacaagugggucgagaacaacaccaacaaccucgucaaggaccucgucuccccccgcgacuucgacgccgccaccuaccucgcccucaucaacgccgucuacuucaagggcaacuggaagucccaguuccgccccgagaacacccgcaccuucuccuucaccaaggacgacgaguccgagguccagauccccaugauguaccagcagggcgaguucuacuacggcgaguucuccgacggcuccaacgaggccggcggcaucuaccagguccucgagauccccuacgagggcgacgagaucuccaugaugcucguccucucccgccaggaggucccccucgccacccucgagccccucgucaaggcccagcucgucgaggagugggccaacuccgucaagaagcagaaggucgaggucuaccucccccgcuucaccgucgagcaggagaucgaccucaaggacguccucaaggcccucggcaucaccgagaucuucaucaaggacgccaaccucaccggccucuccgacaacaaggagaucuuccucuccaaggccauccacaaguccuuccucgaggucaacgaggagggcuccgaggccgccgccgucuccggcaugaucgccaucucccgcauggccguccucuacccccaggucaucgucgaccaccccuucuucuuccucauccgcaaccgccgcaccggcaccauccucuucaugggccgcgucaugcaccccgagaccaugaacaccuccggccacgacuucgaggagcucuga

SEQ ID NO: 49313 - RNA, 1248 nt, Artificial Sequence
  derived and/or modified sequence opt2 from SERPINI2__Homo_sapiens__NP_001012303
augauccagaaccucaugcgcgaggucaagauggacaccaucuuccucuggucccuccuccuccucuucuucggcucccaggccucccgcugcuccgcccagaagaacaccgaguucgccgucgaccucuaccaggaggucucccucucccacaaggacaacaucaucuucuccccccucggcaucacccucguccucgagaugguccagcucggcgccaagggcaaggcccagcagcagauccgccagacccucaagcagcaggagaccuccgccggcgaggaguucuucguccucaaguccuucuucuccgccaucuccgagaagaagcaggaguucaccuucaaccucgccaacgcccucuaccuccaggagggcuucaccgucaaggagcaguaccuccacggcaacaaggaguucuuccaguccgccaucaagcucgucgacuuccaggacgccaaggccugcgccgagaugaucuccaccugggucgagcgcaagaccgacggcaagaucaaggacauguucuccggcgaggaguucggcccccucacccgccucguccucgucaacgccaucuacuucaagggcgacuggaagcagaaguuccgcaaggaggacacccagcucaucaacuucaccaagaagaacggcuccaccgucaagauccccaugaugaaggcccuccuccgcaccaaguacggcuacuucuccgaguccucccucaacuaccagguccucgagcucuccuacaagggcgacgaguucucccucaucaucauccuccccgccgagggcauggacaucgaggaggucgagaagcucaucaccgcccagcagauccucaaguggcucuccgagaugcaggaggaggaggucgagaucucccucccccgcuucaaggucgagcagaaggucgacuucaaggacguccucuacucccucaacaucaccgagaucuucuccggcggcugcgaccucuccggcaucaccgacuccuccgaggucuacgucucccaggucacccagaaggucuucuucgagaucaacgaggacggcuccgaggccgccaccuccaccggcauccacauccccgucaucaugucccucgcccagucccaguucaucgccaaccaccccuuccucuucaucaugaagcacaaccccaccgaguccauccucuucaugggccgcgucaccaaccccgacacccaggagaucaagggccgcgaccucgacucccucuga

SEQ ID NO: 49314 - RNA, 711 nt, Artificial Sequence
  derived and/or modified sequence opt2 from SERTAD1__Homo_sapiens__NP_037508
augcucuccaagggccucaagcgcaagcgcgaggaggaggaggagaaggagccccucgccgucgacuccugguggcucgaccccggccacaccgccgucgcccaggccccccccgccgucgccuccuccucccucuucgaccucuccguccucaagcuccaccacucccuccagcaguccgagcccgaccuccgccaccucguccucgucgucaacacccuccgccgcauccaggccuccauggcccccgccgccgcccucccccccguccccuccccccccgccgcccccuccgucgccgacaaccuccucgccuccuccgacgccgcccucuccgccuccauggccucccuccucgaggaccucucccacaucgagggccucucccaggccccccagccccucgccgacgagggcccccccggccgcuccaucggcggcgccgcccccucccucggcgcccucgaccuccucggccccgccaccggcugccuccucgacgacggccucgagggccucuucgaggacaucgacaccuccauguacgacaacgagcucugggcccccgccuccgagggccucaagcccggccccgaggacggccccggcaaggaggaggcccccgagcucgacgaggccgagcucgacuaccucauggacguccucgucggcacccaggcccucgagcgcccccccggccccggccgcuga

SEQ ID NO: 49315 - RNA, 966 nt, Artificial Sequence
  derived and/or modified sequence opt2 from SERTAD2__Homo_sapiens__XP_011531506
augcuccccgucauccaguacaugcucggcaagggcggcaagcgcaaguucgacgagcacgaggacggccucgagggcaagaucgucucccccugcgacggccccuccaaggucuccuacacccuccagcgccagaccaucuucaacaucucccucaugaagcucuacaaccaccgcccccucaccgagcccucccuccagaagaccguccucaucaacaacaugcuccgccgcauccaggaggagcucaagcaggagggcucccuccgccccauguucacccccuccucccagcccaccaccgagcccuccgacuccuaccgcgaggccccccccgccuucucccaccucgccucccccuccucccaccccugcgaccucggcuccaccaccccccucgaggccugccucacccccgccucccuccucgaggacgacgacgacaccuucugcaccucccaggccaugcagcccaccgcccccaccaagcucuccccccccgcccuccuccccgagaaggacuccuucuccuccgcccucgacgagaucgaggagcucugccccaccuccaccuccaccgaggccgccaccgccgccaccgacuccgucaagggcaccuccuccgaggccggcacccagaagcucgacggcccccaggagucccgcgccgacgacuccaagcucauggacucccuccccggcaacuucgagaucaccaccuccaccggcuuccucaccgaccucacccucgacgacauccucuucgccgacaucgacaccuccauguacgacuucgaccccugcaccuccuccuccggcaccgccuccaagauggcccccgucuccgccgacgaccuccucaagacccucgcccccuacuccucccagcccgucacccccucccagcccuucaagauggaccucaccgagcucgaccacaucauggagguccucgucggcuccuga

SEQ ID NO: 49316 - RNA, 1479 nt, Artificial Sequence
  derived and/or modified sequence opt2 from SESN1__Homo_sapiens__NP_001186862
augcgccucgccgccgccgccaacgaggccuacaccgccccccucgccgucuccggccuccucggcugcaagcagugcggcggcggccgcgaccaggacgaggagcucggcauccgcaucccccgcccccucggccagggccccucccgcuucauccccgagaaggagauccuccaggucggcuccgaggacgcccagaugcacgcccucuucgccgacuccuucgccgcccucggccgccucgacaacaucacccucgucauggucuuccacccccaguaccucgaguccuuccucaagacccagcacuaccuccuccagauggacggcccccucccccuccacuaccgccacuacaucggcaucauggccgccgcccgccaccagugcuccuaccucgucaaccuccacgucaacgacuuccuccacgucggcggcgaccccaaguggcucaacggccucgagaacgccccccagaagcuccagaaccucggcgagcucaacaagguccucgcccaccgccccuggcucaucaccaaggagcacaucgagggccuccucaaggccgaggagcacuccuggucccucgccgagcucguccacgccgucguccuccucacccacuaccacucccucgccuccuucaccuucggcugcggcaucucccccgagauccacugcgacggcggccacaccuuccgcccccccuccgucuccaacuacugcaucugcgacaucaccaacggcaaccacuccgucgacgagaugcccgucaacuccgccgagaacgucuccgucuccgacuccuucuucgaggucgaggcccucauggagaagaugcgccagcuccaggagugccgcgacgaggaggaggccucccaggaggagauggccucccgcuucgagaucgagaagcgcgaguccauguucgucuucuccuccgacgacgaggaggucacccccgcccgcgccgucucccgccacuucgaggacaccuccuacggcuacaaggacuucucccgccacggcaugcacguccccaccuuccgcguccaggacuacugcugggaggaccacggcuacucccucgucaaccgccucuaccccgacgucggccagcucaucgacgagaaguuccacaucgccuacaaccucaccuacaacaccauggccaugcacaaggacgucgacaccuccaugcuccgccgcgccaucuggaacuacauccacugcauguucggcauccgcuacgacgacuacgacuacggcgagaucaaccagcuccucgaccgcuccuucaaggucuacaucaagaccgucgucugcacccccgagaaggucaccaagcgcauguacgacuccuucuggcgccaguucaagcacuccgagaagguccacgucaaccuccuccucaucgaggcccgcaugcaggccgagcuccucuacgcccuccgcgccaucacccgcuacaugaccuga

SEQ ID NO: 49317 - RNA, 1062 nt, Artificial Sequence
  derived and/or modified sequence opt2 from SESN3__Homo_sapiens__NP_001258523
augucccuccacacccaguaccucgaguccuuccuccgcucccaguucuacaugcuccgcauggacggcccccucccccuccccuaccgccacuacaucgccaucaugaagcucgucaagaccggcgagaacaacuggucccuccccgagcucguccacgccgucguccuccucgcccacuaccacgcccucgccuccuucgucuucggcuccggcaucaaccccgagcgcgaccccgagaucuccaacggcuuccgccucaucuccgucaacaacuucugcgucugcgaccucgccaacgacaacaacaucgagaacgccucccucuccggcuccaacuucggcaucgucgacucccucuccgagcucgaggcccucauggagcgcaugaagcgccuccaggaggagcgcgaggacgaggaggccucccaggaggagauguccacccgcuucgagaaggagaagaaggagucccucuucgucgucuccggcgacaccuuccacuccuucccccacuccgacuucgaggacgacaugaucaucaccuccgacgucucccgcuacaucgaggaccccggcuucggcuacgaggacuucgcccgccgcggcgaggagcaccuccccaccuuccgcgcccaggacuacaccugggagaaccacggcuucucccucgucaaccgccucuacuccgacaucggccaccuccucgacgagaaguuccgcauggucuacaaccucaccuacaacaccauggccacccacgaggacgucgacaccaccaugcuccgccgcgcccucuucaacuacguccacugcauguucggcauccgcuacgacgacuacgacuacggcgaggucaaccagcuccucgagcgcucccucaaggucuacaucaagaccgucaccugcuaccccgagcgcaccaccaagcgcauguacgacuccuacuggcgccaguucaagcacuccgagaagguccacgucaaccuccuccucauggaggcccgcaugcaggccgagcuccucuacgcccuccgcgccaucacccgccaccucaccuga

SEQ ID NO: 49318 - RNA, 729 nt, Artificial Sequence
  derived and/or modified sequence opt2 from SETBP1__Homo_sapiens__NP_001123582
auggagucccgcgagacccucuccuccucccgccagcgcggcggcgaguccgacuuccuccccgucuccuccgccaagccccccgccgcccccggcugcgccggcgagccccuccucuccacccccggccccggcaagggcauccccgucggcggcgagcgcauggagcccgaggaggaggacgagcucggcuccggccgcgacgucgacuccaacuccaacgccgacuccgagaagugggucgccggcgacggccucgaggagcaggaguucuccaucaaggaggccaacuucaccgagggcucccucaagcucaagauccagaccaccaagcgcgccaagaagccccccaagaaccucgagaacuacaucugcccccccgagaucaagaucaccaucaagcaguccggcgaccagaaggucucccgcgccggcaagaacuccaaggccaccaaggaggaggagcgcucccacuccaagaagaagcuccucaccgccuccgaccucgccgccuccgaccucaagggcuuccagccccagaucaaggacuccuccaaggaggaggucuggaagcgccgcggcggccagggcauccccuucaagaagcaguuccucucccaggagcgcgccaugugcuucuccugcccccgcaaccccuuccccgccaagcccggcucccucacccuccccuuccacuccgagcccgccgucugggcccaggaggucuga

SEQ ID NO: 49319 - RNA, 5124 nt, Artificial Sequence
  derived and/or modified sequence opt2 from SETD1A__Homo_sapiens__NP_055527
auggaccaggagggcggcggcgacggccagaaggcccccuccuuccaguggcgcaacuacaagcucaucgucgaccccgcccucgaccccgcccuccgccgccccucccagaaggucuaccgcuacgacggcguccacuucuccgucaacgacuccaaguacauccccgucgaggaccuccaggacccccgcugccacguccgcuccaagaaccgcgacuucucccuccccguccccaaguucaagcucgacgaguucuacaucggccagaucccccucaaggaggucaccuucgcccgccucaacgacaacguccgcgagaccuuccucaaggacaugugccgcaaguacggcgaggucgaggaggucgagauccuccuccacccccgcacccgcaagcaccucggccucgcccgcguccucuucaccuccacccgcggcgccaaggagaccgucaagaaccuccaccucaccuccgucaugggcaacaucauccacgcccagcucgacaucaagggccagcagcgcaugaaguacuacgagcucaucgucaacggcuccuacaccccccagaccguccccaccggcggcaaggcccucuccgagaaguuccagggcuccggcgccgccaccgagaccgccgagucccgccgccgcuccuccuccgacaccgccgccuaccccgccggcaccaccgccgucggcacccccggcaacggcacccccugcucccaggacaccuccuucuccuccucccgccaggacacccccuccuccuucggccaguucaccccccaguccucccagggcacccccuacaccucccgcggcuccacccccuacucccaggacuccgccuacuccuccuccaccaccuccaccuccuucaagccccgccgcuccgagaacuccuaccaggacgccuucucccgccgccacuucuccgccuccuccgccuccaccaccgccuccaccgccaucgccgccaccaccgccgccaccgccuccuccuccgccuccuccuccucccucuccuccuccuccuccuccuccuccuccuccuccuccucccaguuccgcuccuccgacgccaacuaccccgccuacuacgaguccuggaaccgcuaccagcgccacaccuccuaccccccccgccgcgccacccgcgaggagccccccggcgcccccuucgccgagaacaccgccgagcgcuucccccccuccuacaccuccuaccucccccccgagcccucccgccccaccgaccaggacuaccgcccccccgccuccgaggcccccccccccgagccccccgagcccggcggcggcggcggcggcggcggccccucccccgagcgcgaggagguccgcaccuccccccgccccgccucccccgcccgcuccggcucccccgcccccgagaccaccaacgaguccguccccuucgcccagcacuccucccucgacucccgcaucgagaugcuccucaaggagcagcgcuccaaguucuccuuccucgccuccgacaccgaggaggaggaggagaacuccuccaugguccucggcgcccgcgacaccggcuccgagguccccuccggcuccggccacggccccugcacccccccccccgcccccgccaacuucgaggacgucgcccccaccggcuccggcgagcccggcgccacccgcgagucccccaaggccaacggccagaaccaggccucccccugcuccuccggcgacgacauggagaucuccgacgacgaccgcggcggcucccccccccccgcccccacccccccccagcagcccccccccccccccccccccccccccccccccccccccuaccucgccucccucccccucggcuaccccccccaccagcccgccuaccuccuccccccccgccccgacggcccccccccccccgaguaccccccccccccccccccccccccccacaucuacgacuucgucaacucccucgagcucauggaccgccucggcgcccaguggggcggcaugcccauguccuuccagaugcagacccagaugcucacccgccuccaccagcuccgccagggcaagggccucaucgccgccuccgccggcccccccggcggcgccuucggcgaggccuuccuccccuucccccccccccaggaggccgccuacggccuccccuacgcccucuacgcccagggccaggagggccgcggcgccuacucccgcgaggccuaccaccuccccaugcccauggccgccgagccccuccccuccuccuccgucuccggcgaggaggcccgccuccccccccgcgaggaggccgagcucgccgagggcaagacccuccccaccgccggcaccgucggccgcguccucgccaugcucguccaggagaugaaguccaucaugcagcgcgaccucaaccgcaagauggucgagaacgucgccuucggcgccuucgaccaguggugggaguccaaggaggagaaggccaagcccuuccagaacgccgccaagcagcaggccaaggaggaggacaaggagaagaccaagcucaaggagcccggccuccucucccucgucgacugggccaaguccggcggcaccaccggcaucgaggccuucgccuucggcuccggccuccgcggcgcccuccgccuccccuccuucaaggucaagcgcaaggagcccuccgagaucuccgaggccuccgaggagaagcgcccccgccccuccacccccgccgaggaggacgaggacgaccccgagcaggagaaggaggccggcgagcccggccgccccggcaccaagccccccaagcgcgacgaggagcgcggcaagacccagggcaagcaccgcaaguccuucgcccucgacuccgagggcgaggaggccucccaggaguccuccuccgagaaggacgaggaggacgacgaggaggacgaggaggacgaggaccgcgaggaggccgucgacaccaccaagaaggagaccgaggucuccgacggcgaggacgaggaguccgacuccuccuccaagugcucccucuacgccgacuccgacggcgagaacgacuccaccuccgacuccgaguccuccuccuccuccuccuccuccuccuccuccuccuccuccuccuccuccuccuccuccuccuccuccuccgaguccuccuccgaggacgaggaggaggaggagcgccccgccgcccuccccuccgccuccccccccccccgcgagguccccguccccacccccgcccccgucgagguccccguccccgagcgcgucgccggcucccccgucaccccccuccccgagcaggaggccucccccgcccgccccgccggccccaccgaggaguccccccccuccgccccccuccgcccccccgagccccccgccggcccccccgcccccgccccccgccccgacgagcgccccuccucccccaucccccuccuccccccccccaagaagcgccgcaagaccgucuccuucuccgccaucgaggucguccccgcccccgagcccccccccgccacccccccccaggccaaguuccccggccccgccucccgcaaggccccccgcggcgucgagcgcaccauccgcaaccucccccucgaccacgccucccucgucaaguccuggcccgaggaggucucccgcggcggccgcucccgcgccggcggccgcggccgccucaccgaggaggaggaggccgagcccggcaccgaggucgaccucgccguccucgccgaccucgcccucacccccgcccgccgcggccuccccgcccuccccgccgucgaggacuccgaggccaccgagaccuccgacgaggccgagcgcccccgcccccuccucucccacauccuccucgagcacaacuacgcccucgccgucaagcccaccccccccgcccccgcccuccgcccccccgagcccguccccgcccccgccgcccucuucuccucccccgccgacgagguccucgaggcccccgaggucgucgucgccgaggccgaggagcccaagccccagcagcuccagcagcagcgcgaggagggcgaggaggagggcgaggaggagggcgaggaggaggaggaggaguccuccgacuccuccuccuccuccgacggcgagggcgcccuccgccgccgcucccuccgcucccacgcccgccgccgccgccccccccccccccccccccccccccccccccgcgccuacgagccccgcuccgaguucgagcagaugaccauccucuacgacaucuggaacuccggccucgacuccgaggacauguccuaccuccgccucaccuacgagcgccuccuccagcagaccuccggcgccgacuggcucaacgacacccacuggguccaccacaccaucaccaaccucaccacccccaagcgcaagcgccgcccccaggacggcccccgcgagcaccagaccggcuccgcccgcuccgagggcuacuaccccaucuccaagaaggagaaggacaaguaccucgacgucugccccgucuccgcccgccagcucgagggcgucgacacccagggcaccaaccgcguccucuccgagcgccgcuccgagcagcgccgccuccucuccgccaucggcaccuccgccaucauggacuccgaccuccucaagcucaaccagcucaaguuccgcaagaagaagcuccgcuucggccgcucccgcauccacgaguggggccucuucgccauggagcccaucgccgccgacgagauggucaucgaguacgucggccagaacauccgccagauggucgccgacaugcgcgagaagcgcuacguccaggagggcaucggcuccuccuaccucuuccgcgucgaccacgacaccaucaucgacgccaccaagugcggcaaccucgcccgcuucaucaaccacugcugcacccccaacugcuacgccaaggucaucaccaucgagucccagaagaagaucgucaucuacuccaagcagcccaucggcgucgacgaggagaucaccuacgacuacaaguucccccucgaggacaacaagauccccugccucugcggcaccgaguccugccgcggcucccucaacuga

SEQ ID NO: 49320 - RNA, 5772 nt, Artificial Sequence
  derived and/or modified sequence opt2 from SETD1B__Homo_sapiens__NP_055863
auggagaacucccaccccccccaccaccaccaccagcagccccccccccagcccggccccuccggcgagcgccgcaaccaccacuggcgcuccuacaagcucaugaucgaccccgcccucaagaagggccaccacaagcucuaccgcuacgacggccagcacuucucccucgccauguccuccaaccgccccgucgagaucgucgaggacccccgcgucgucggcaucuggaccaagaacaaggagcucgagcucuccguccccaaguucaagaucgacgaguucuacgucggccccgucccccccaagcaggucaccuucgccaagcucaacgacaacauccgcgagaacuuccuccgcgacaugugcaagaaguacggcgaggucgaggaggucgagauccucuacaaccccaagaccaagaagcaccucggcaucgccaaggucgucuucgccaccguccgcggcgccaaggacgccguccagcaccuccacuccaccuccgucaugggcaacaucauccacgucgagcucgacaccaagggcgagacccgcaugcgcuucuacgagcuccucgucaccggccgcuacaccccccagacccuccccgucggcgagcucgacgccgucucccccaucgucaacgagacccuccagcucuccgacgcccucaagcgccucaaggacggcggccucuccgccggcugcggcuccggcuccuccuccgucacccccaacuccggcggcacccccuucucccaggacaccgccuacuccuccugccgccucgacacccccaacuccuacggccagggcaccccccucaccccccgccucggcacccccuucucccaggacuccuccuacuccucccgccagcccacccccuccuaccucuucucccaggaccccgccgucaccuucaaggcccgccgccacgaguccaaguucaccgacgccuacaaccgccgccacgagcaccacuacguccacaacucccccgccgucaccgccgucgccggcgccaccgccgccuuccgcggcuccuccgaccuccccuucggcgccgucggcggcaccggcggcuccuccggcccccccuucaaggcccagccccaggacuccgccaccuucgcccacacccccccccccgcccaggccacccccgcccccggcuucaaguccgccuucucccccuaccagacccccgucgcccacuucccccccccccccgaggagcccaccgccaccgccgccuucggcgcccgcgacuccggcgaguuccgccgcgcccccgccccccccccccucccccccgccgagccccucgccaaggagaagcccggcaccccccccggcccccccccccccgacaccaacuccauggagcucggcggccgccccaccuucggcuggucccccgagcccugcgacucccccggcacccccacccucgaguccucccccgccggccccgagaagccccacgacucccucgacucccgcaucgagaugcuccucaaggagcagcgcaccaagcuccucuuccuccgcgagcccgacuccgacaccgagcuccagauggagggcucccccaucuccuccuccuccucccagcucuccccccucgcccccuucggcaccaacucccagcccggcuuccgcggccccaccccccccuccucccgccccuccuccaccggccucgaggacaucucccccaccccccuccccgacuccgacgaggacgaggagcucgaccucggccucggcccccgccccccccccgagcccggcccccccgaccccgccggccuccucucccagaccgccgaggucgcccucgaccucgucggcgaccgcacccccaccuccgagaagauggacgagggccagcaguccuccggcgaggacauggagaucuccgacgacgagaugcccuccgcccccaucaccuccgccgacugccccaagcccauggucgucacccccggcgccgccgccgucgccgcccccuccguccucgcccccacccucccccucccccccccccccggcuuccccccccucccccccccccccccccccccccccccccagcccggcuuccccaugccccccccccuccccccccccccccccccccccccccccgcccaccccgccgucaccguccccccccccccccuccccgccccccccggcgucccccccccccccauccuccccccccucccccccuucccccccggccucuuccccgucaugcaggucgacaugucccacguccucggcggccaguggggcggcaugcccauguccuuccagaugcagacccagguccucucccgccucaugaccggccagggcgccugccccuacccccccuucauggccgccgccgccgccgccgccuccgccggccuccaguucgucaaccucccccccuaccgcggccccuucucccucuccaacuccggccccggccgcggccagcacuggcccccccuccccaaguucgaccccuccguccccccccccggcuacaugccccgccaggaggacccccacaaggccaccgucgacggcguccuccucgucguccucaaggagcucaaggccaucaugaagcgcgaccucaaccgcaagauggucgaggucgucgccuuccgcgccuucgacgaguggugggacaagaaggagcgcauggccaaggccucccucacccccgucaaguccggcgagcacaaggacgaggaccgccccaagcccaaggaccgcaucgccuccugccuccucgaguccuggggcaagggcgagggccucggcuacgagggccucggccucggcaucggccuccgcggcgccauccgccuccccuccuucaaggucaagcgcaaggagccccccgacaccaccuccuccggcgaccagaagcgccuccgccccuccaccuccgucgacgaggaggacgaggaguccgagcgcgagcgcgaccgcgacauggccgacacccccugcgagcucgccaagcgcgaccccaagggcgucggcguccgccgccgccccgcccgcccccucgagcucgacuccggcggcgaggaggacgagaaggagucccucuccgaggagcaggaguccaccgaggaggaggaggaggccgaggaggaggaggaggaggaggacgacgacgacgacgacuccgacgaccgcgacgaguccgagaacgacgacgaggacaccgcccucuccgaggccuccgagaaggacgagggcgacuccgacgaggaggagaccgucuccaucgucaccuccaaggccgaggccaccuccuccuccgaguccuccgaguccuccgaguucgaguccuccuccgaguccucccccuccuccuccgaggacgaggaggaggucgucgcccgcgaggaggaggaggaggaggaggaggaggagauggucgccgaggaguccauggccuccgccggccccgaggacuucgagcaggacggcgaggaggccgcccucgcccccggcgcccccgccgucgacucccucggcauggaggaggaggucgacaucgagaccgaggccgucgcccccgaggagcgccccuccaugcucgacgagcccccccuccccgucggcgucgaggagcccgccgacucccgcgagccccccgaggagcccggccucucccaggagggcgccaugcuccucucccccgagccccccgccaaggaggucgaggcccgccccccccucucccccgagcgcgcccccgagcacgaccucgaggucgagcccgagccccccaugaugcucccccucccccuccagcccccccucccccccccccgccccccccgcccccccucccccccccccgagcccgagaccaccgacgccucccaccccuccgucccccccgagccccucgccgaggaccaccccccccacacccccggccucugcggcucccucgccaagucccaguccaccgagaccguccccgccacccccggcggcgagcccccccucuccggcggcuccuccggccucucccucuccuccccccagguccccggcucccccuucuccuaccccgcccccucccccucccucuccuccggcggccucccccgcacccccggccgcgacuucuccuucacccccaccuucuccgagcccuccggcccccuccuccuccccgucugcccccuccccaccggccgccgcgacgagcgcuccggcccccucgccucccccguccuccucgagaccggccucccccucccccucccccucccccucccccucccccucgcccuccccgccguccuccgcgcccaggcccgcgcccccaccccccuccccccccuccuccccgccccccucgccuccugccccccccccaugaagcgcaagcccggccgcccccgccgcuccccccccuccaugcucucccucgacggcccccucguccgcccccccgccggcgccgcccucggccgcgagcuccuccuccuccccggccagccccagacccccgucuuccccuccacccacgacccccgcaccgucacccucgacuuccgcaacgccggcauccccgcccccccccccccccuccccccccagcccccccccccccccccccccccccccgucgagcccaccaagcuccccuucaaggagcucgacaaccaguggcccuccgaggccaucccccccggcccccgcggccgcgacgaggucaccgaggaguacauggagcucgccaagucccgcggccccuggcgccgcccccccaagaagcgccacgaggaccucgucccccccgccggcucccccgagcucucccccccccagccccucuuccgcccccgcuccgaguucgaggagaugaccauccucuacgacaucuggaacggcggcaucgacgaggaggacauccgcuuccucugcgucaccuacgagcgccuccuccagcaggacaacggcauggacuggcucaacgacacccucugggucuaccaccccuccaccucccucuccuccgccaagaagaagaagcgcgacgacggcauccgcgagcacgucaccggcugcgcccgcuccgagggcuucuacaccaucgacaagaaggacaagcuccgcuaccucaacuccucccgcgccuccaccgacgagccccccgccgacacccagggcauguccauccccgcccagccccacgccuccacccgcgccggcuccgagcgccgcuccgagcagcgccgccuccucuccuccuucaccggcuccugcgacuccgaccuccucaaguucaaccagcucaaguuccgcaagaagaagcucaaguucugcaagucccacauccacgacuggggccucuucgccauggagcccaucgccgccgacgagauggucaucgaguacgucggccagaacauccgccaggucaucgccgacaugcgcgagaagcgcuacgaggacgagggcaucggcuccuccuacauguuccgcgucgaccacgacaccaucaucgacgccaccaagugcggcaacuucgcccgcuucaucaaccacuccugcaaccccaacugcuacgccaaggucaucaccgucgagucccagaagaagaucgucaucuacuccaagcagcacaucaacgucaacgaggagaucaccuacgacuacaaguuccccaucgaggacgucaagauccccugccucugcggcuccgagaacugccgcggcacccucaacuga

SEQ ID NO: 49321 - RNA, 7695 nt, Artificial Sequence
  derived and/or modified sequence opt2 from SETD2__Homo_sapiens__NP_054878
augaagcagcuccagccccagcccccccccaagaugggcgacuucuacgaccccgagcaccccacccccgaggaggaggagaacgaggccaagaucgagaacguccagaagaccggcuucaucaagggccccauguucaagggcgucgccuccucccgcuuccuccccaagggcaccaagaccaaggucaaccucgaggagcagggccgccagaaggucuccuucuccuucucccucaccaagaagacccuccagaaccgcuuccucaccgcccucggcaacgagaagcaguccgacacccccaacccccccgccgucccccuccaggucgacuccacccccaagaugaagauggagaucggcgacacccucuccaccgccgaggaguccuccccccccaagucccgcgucgagcucggcaagauccacuucaagaagcaccuccuccacgucaccucccgcccccuccucgccaccaccaccgccgucgccuccccccccacccacgccgccccccuccccgccgucaucgccgaguccaccaccgucgacuccccccccuccucccccccccccccccccccccccgcccaggccaccacccucuccucccccgcccccgucaccgagcccgucgcccucccccacacccccaucaccguccucauggccgcccccgucccccuccccgucgacgucgccguccgcucccucaaggagccccccaucaucaucguccccgagucccucgaggccgacaccaagcaggacaccaucuccaacucccucgaggagcacgucacccagauccucaacgagcaggccgacaucuccuccaagaaggaggacucccacaucggcaaggacgaggagauccccgacuccuccaagaucucccucuccugcaagaagaccggcuccaagaagaaguccucccaguccgagggcaucuuccucggcuccgaguccgacgaggacuccguccgcaccuccuccucccagcgcucccacgaccucaaguucuccgccuccaucgagaaggagcgcgacuucaagaaguccuccgccccccucaaguccgaggaccucggcaagcccucccgcuccaagaccgaccgcgacgacaaguacuucuccuacuccaagcucgagcgcgacacccgcuacgucuccucccgcugccgcuccgagcgcgagcgccgccgcucccgcucccacucccgcuccgagcgcggcucccgcaccaaccucuccuacucccgcuccgagcgcucccacuacuacgacuccgaccgccgcuaccaccgcuccucccccuaccgcgagcgcacccgcuacucccgccccuacaccgacaaccgcgcccgcgaguccuccgacuccgaggaggaguacaagaagaccuacucccgccgcaccuccucccacuccuccuccuaccgcgaccuccgcaccuccuccuacuccaaguccgaccgcgacugcaagaccgagaccuccuaccucgagauggagcgccgcggcaaguacuccuccaagcucgagcgcgaguccaagcgcaccuccgagaacgaggccaucaagcgcugcugcuccccccccaacgagcucggcuuccgccgcggcuccuccuacuccaagcacgacuccuccgccucccgcuacaaguccacccucuccaagcccauccccaaguccgacaaguucaagaacuccuucugcugcaccgagcucaacgaggagaucaagcagucccacuccuucucccuccagacccccugcuccaagggcuccgagcuccgcaugaucaacaagaaccccgagcgcgagaaggccggcucccccgcccccuccaaccgccucaacgacucccccacccucaagaagcucgacgagcuccccaucuucaaguccgaguucaucacccacgacucccacgacuccaucaaggagcucgacucccucuccaaggucaagaacgaccagcuccgcuccuucugccccaucgagcucaacaucaacggcucccccggcgccgaguccgaccucgccaccuucugcaccuccaagaccgacgccguccucaugaccuccgacgacuccgucaccggcuccgagcucuccccccucgucaaggccugcaugcucuccuccaacggcuuccagaacaucucccgcugcaaggagaaggaccucgacgacaccugcaugcuccacaagaaguccgagucccccuuccgcgagaccgagccccucgucuccccccaccaggacaagcucauguccaugcccgucaugaccgucgacuacuccaagaccgucgucaaggagcccgucgacacccgcgucuccugcugcaagaccaaggacuccgacaucuacugcacccucaacgacuccaaccccucccucugcaacuccgaggccgagaacaucgagcccuccgucaugaagaucuccuccaacuccuucaugaacguccaccucgaguccaagcccgucaucugcgacucccgcaaccucaccgaccacuccaaguucgccugcgaggaguacaagcaguccaucggcuccaccuccuccgccuccgucaaccacuucgacgaccucuaccagcccaucggcuccuccggcaucgccuccucccuccagucccucccccccggcaucaaggucgacucccucacccuccucaagugcggcgagaacaccucccccguccucgacgccguccucaaguccaagaaguccuccgaguuccucaagcacgccggcaaggagaccaucgucgaggucggcuccgaccuccccgacuccggcaagggcuucgccucccgcgagaaccgccgcaacaacggccucuccggcaagugccuccaggaggcccaggaggagggcaacuccauccuccccgagcgccgcggccgccccgagaucucccucgacgagcgcggcgagggcggccacguccacaccuccgacgacuccgaggucgucuucuccuccugcgaccucaaccucaccauggaggacuccgacggcgucaccuacgcccucaagugcgacuccuccggccacgcccccgagaucgucuccaccguccacgaggacuacuccggcuccuccgaguccuccaacgacgaguccgacuccgaggacaccgacuccgacgacuccuccaucccccgcaaccgccuccaguccgucgucgucguccccaagaacuccacccuccccauggaggagaccucccccugcuccucccgcuccucccaguccuaccgccacuacuccgaccacugggaggacgagcgccucgagucccgccgccaccucuacgaggagaaguucgaguccaucgccuccaaggccugcccccagaccgacaaguucuuccuccacaagggcaccgagaagaaccccgagaucuccuucacccaguccucccgcaagcagaucgacaaccgccuccccgagcucucccacccccaguccgacggcgucgacuccaccucccacaccgacgucaaguccgacccccucggccaccccaacuccgaggagaccgucaaggccaagauccccucccgccagcaggaggagcuccccaucuacuccuccgacuucgaggacguccccaacaaguccuggcagcagaccaccuuccagaaccgccccgacucccgccucggcaagaccgagcucuccuucuccuccuccugcgagaucccccacgucgacggccuccacuccuccgaggagcuccgcaaccucggcugggacuucucccaggagaagcccuccaccaccuaccagcagcccgacuccuccuacggcgccugcggcggccacaaguaccagcagaacgccgagcaguacggcggcacccgcgacuacuggcagggcaacggcuacugggacccccgcuccggccgcccccccggcaccggcgucgucuacgaccgcacccagggccagguccccgacucccucaccgacgaccgcgaggaggaggagaacugggaccagcaggacggcucccacuucuccgaccaguccgacaaguuccuccucucccuccagaaggacaagggcuccguccaggcccccgagaucuccuccaacuccaucaaggacacccucgccgucaacgagaagaaggacuucuccaagaaccucgagaagaacgacaucaaggaccgcggcccccucaagaagcgccgccaggagaucgaguccgacuccgaguccgacggcgagcuccaggaccgcaagaagguccgcgucgaggucgagcagggcgagaccuccgucccccccggcuccgcccucgucggccccuccugcgucauggacgacuuccgcgacccccagcgcuggaaggagugcgccaagcagggcaagaugcccugcuacuucgaccucaucgaggagaacgucuaccucaccgagcgcaagaagaacaagucccaccgcgacaucaagcgcaugcagugcgagugcaccccccucuccaaggacgagcgcgcccagggcgagaucgccugcggcgaggacugccucaaccgccuccucaugaucgagugcuccucccgcugccccaacggcgacuacugcuccaaccgccgcuuccagcgcaagcagcacgccgacgucgaggucauccucaccgagaagaagggcuggggccuccgcgccgccaaggaccuccccuccaacaccuucguccucgaguacugcggcgagguccucgaccacaaggaguucaaggcccgcgucaaggaguacgcccgcaacaagaacauccacuacuacuucauggcccucaagaacgacgagaucaucgacgccacccagaagggcaacugcucccgcuucaugaaccacuccugcgagcccaacugcgagacccagaaguggaccgucaacggccagcuccgcgucggcuucuucaccaccaagcucguccccuccggcuccgagcucaccuucgacuaccaguuccagcgcuacggcaaggaggcccagaagugcuucugcggcuccgccaacugccgcggcuaccucggcggcgagaaccgcgucuccauccgcgccgccggcggcaagaugaagaaggagcgcucccgcaagaaggacuccgucgacggcgagcucgaggcccucauggagaacggcgagggccucuccgacaagaaccagguccucucccucucccgccucaugguccgcaucgagacccucgagcagaagcucaccugccucgagcucauccagaacacccacucccaguccugccucaaguccuuccucgagcgccacggccucucccuccucuggaucuggauggccgagcucggcgacggccgcgaguccaaccagaagcuccaggaggagaucaucaagacccucgagcaccuccccauccccaccaagaacaugcucgaggaguccaagguccuccccaucauccagcgcuggucccagaccaagaccgccguccccccccucuccgagggcgacggcuacuccuccgagaacaccucccgcgcccacaccccccucaacacccccgaccccuccaccaagcucuccaccgaggccgacaccgacacccccaagaagcucauguuccgccgccucaagaucaucuccgagaacuccauggacuccgccaucuccgacgccaccuccgagcucgagggcaaggacggcaaggaggaccucgaccagcucgagaacguccccgucgaggaggaggaggagcuccagucccagcagcuccucccccagcagcuccccgagugcaaggucgacuccgagaccaacaucgaggccuccaagcuccccaccuccgagcccgaggccgacgccgagaucgagcccaaggaguccaacggcaccaagcucgaggagcccaucaacgaggagacccccucccaggacgaggaggagggcgucuccgacgucgaguccgagcgcucccaggagcagcccgacaagaccgucgacaucuccgaccucgccaccaagcuccucgacuccuggaaggaccucaaggaggucuaccgcauccccaagaagucccagaccgagaaggagaacaccaccaccgagcgcggccgcgacgccgucggcuuccgcgaccagacccccgcccccaagacccccaaccgcucccgcgagcgcgaccccgacaagcagacccagaacaaggagaagcgcaagcgccgcuccucccucuccccccccuccuccgccuacgagcgcggcaccaagcgccccgacgaccgcuacgacacccccaccuccaagaagaagguccgcaucaaggaccgcaacaagcucuccaccgaggagcgccgcaagcucuucgagcaggaggucgcccagcgcgaggcccagaagcagcagcagcagaugcagaaccucggcaugaccuccccccuccccuacgacucccucggcuacaacgccccccaccaccccuucgccggcuacccccccggcuaccccaugcaggccuacgucgaccccuccaaccccaacgccggcaagguccuccuccccacccccuccauggaccccgucugcucccccgcccccuacgaccacgcccagccccucgucggccacuccaccgagccccucuccgcccccccccccguccccgucgucccccacgucgccgcccccgucgaggucuccuccucccaguacgucgcccaguccgacggcgucguccaccaggacuccuccgucgccguccuccccguccccgcccccggccccguccagggccagaacuacuccgucugggacuccaaccagcaguccgucuccguccagcagcaguacucccccgcccagucccaggccaccaucuacuaccagggccagaccugccccaccgucuacggcgucaccucccccuacucccagaccaccccccccaucguccaguccuacgcccagcccucccuccaguacauccagggccagcagaucuucaccgcccacccccagggcgucgucguccagcccgccgccgccgucaccaccaucgucgcccccggccagccccagccccuccagcccuccgagauggucgucaccaacaaccuccucgaccuccccccccccuccccccccaagcccaagaccaucguccucccccccaacuggaagaccgcccgcgaccccgagggcaagaucuacuacuaccacgucaucacccgccagacccagugggacccccccaccugggagucccccggcgacgacgccucccucgagcacgaggccgagauggaccucggcacccccaccuacgacgagaaccccaugaaggccuccaagaagcccaagaccgccgaggccgacaccuccuccgagcucgccaagaaguccaaggaggucuuccgcaaggagaugucccaguucaucguccagugccucaaccccuaccgcaagcccgacugcaaggucggccgcaucaccaccaccgaggacuucaagcaccucgcccgcaagcucacccacggcgucaugaacaaggagcucaaguacugcaagaaccccgaggaccucgagugcaacgagaacgucaagcacaagaccaaggaguacaucaagaaguacaugcagaaguucggcgccgucuacaagcccaaggaggacaccgagcucgaguga

SEQ ID NO: 49322 - RNA, 1950 nt, Artificial Sequence
  derived and/or modified sequence opt2 from SETD3__Homo_sapiens__XP_011535533
auggagugccgcggccccaccuccucccgcugcguccuccgccgccaccaggccaccggcggcgccgagcgcgucggcugccucuccaccaacggcaagaaggccgagcucuccaaggaggagcgcgccgccgcccuccuccccgcccgccccgccguccgcaagaugggcaagaagucccgcgucaagacccagaaguccggcaccggcgccaccgccaccgucucccccaaggagauccucaaccucaccuccgagcuccuccagaagugcuccucccccgcccccggccccggcaaggagugggaggaguacguccagauccgcacccucgucgagaagauccgcaagaagcagaagggccucuccgucaccuucgacggcaagcgcgaggacuacuuccccgaccucaugaagugggccuccgagaacggcgccuccgucgagggcuucgagauggucaacuucaaggaggagggcuucggccuccgcgccacccgcgacaucaaggccgaggagcucuuccucugggucccccgcaagcuccucaugaccgucgaguccgccaagaacuccguccucggcccccucuacucccaggaccgcauccuccaggccaugggcaacaucgcccucgccuuccaccuccucugcgagcgcgccucccccaacuccuucuggcagcccuacauccagacccuccccuccgaguacgacaccccccucuacuucgaggaggacgagguccgcuaccuccaguccacccaggccauccacgacgucuucucccaguacaagaacaccgcccgccaguacgccuacuucuacaaggucauccagacccacccccacgccaacaagcucccccucaaggacuccuucaccuacgaggacuaccgcugggccgucuccuccgucaugacccgccagaaccagauccccaccgaggacggcucccgcgucacccucgcccucaucccccucugggacaugugcaaccacaccaacggccucaucaccaccggcuacaaccucgaggacgaccgcugcgagugcgucgcccuccaggacuuccgcgccggcgagcagaucuacaucuucuacggcacccgcuccaacgccgaguucgucauccacuccggcuucuucuucgacaacaacucccacgaccgcgucaagaucaagcucggcgucuccaaguccgaccgccucuacgccaugaaggccgagguccucgcccgcgccggcauccccaccuccuccgucuucgcccuccacuucaccgagccccccaucuccgcccagcuccucgccuuccuccgcgucuucugcaugaccgaggaggagcucaaggagcaccuccucggcgacuccgccaucgaccgcaucuucacccucggcaacuccgaguuccccgucuccugggacaacgaggucaagcucuggaccuuccucgaggaccgcgccucccuccuccucaagaccuacaagaccaccaucgaggaggacaaguccguccucaagaaccacgaccucuccguccgcgccaagauggccaucaagcuccgccucggcgagaaggagauccucgagaaggccgucaaguccgccgccgucaaccgcgaguacuaccgccagcagauggaggagaaggccccccuccccaaguacgaggaguccaaccucggccuccucgaguccuccgucggcgacucccgccucccccucguccuccgcaaccucgaggaggaggccggcguccaggacgcccucaacauccgcgaggccaucuccaaggccaaggccaccgagaacggccucgucaacggcgagaacuccauccccaacggcacccgcuccgagaacgagucccucaaccaggaguccaagcgcgccgucgaggacgccaagggcuccuccuccgacuccaccgccggcgucaaggaguga

SEQ ID NO: 49323 - RNA, 4329 nt, Artificial Sequence
  derived and/or modified sequence opt2 from SETD5__Homo_sapiens__NP_001073986
auguccaucgccaucccccucggcgucaccaccuccgacaccuccuacuccgacauggccgccggcuccgaccccgaguccgucgaggccucccccgccgucaacgagaaguccgucuacuccacccacaacuacggcaccacccagcgccacggcugccgcggccuccccuacgccaccaucaucccccgcuccgaccucaacggccuccccucccccgucgaggagcgcugcggcgacucccccaacuccgagggcgagaccguccccaccuggugccccugcggccucucccaggacggcuuccuccucaacugcgacaagugccgcggcaugucccgcggcaaggucauccgccuccaccgccgcaagcaggacaacaucuccggcggcgacuccuccgccaccgaguccugggacgaggagcucucccccuccaccguccucuacaccgccacccagcacacccccaccuccaucacccucaccguccgccgcaccaagcccaagaagcgcaagaagucccccgagaagggccgcgccgcccccaagaccaagaagaucaagaacucccccuccgaggcccagaaccucgacgagaacaccaccgagggcugggagaaccgcauccgccucuggaccgaccaguacgaggaggccuucaccaaccaguacuccgccgacguccagaacgcccucgagcagcaccuccacuccuccaaggaguucgucggcaagcccaccauccucgacaccaucaacaagaccgagcucgccugcaacaacaccgucaucggcucccagaugcagcuccagcucggccgcgucacccgcguccagaagcaccgcaagauccuccgcgccgcccgcgaccucgcccucgacacccucaucaucgaguaccgcggcaaggucaugcuccgccagcaguucgaggucaacggccacuucuucaagaagcccuaccccuucguccucuucuacuccaaguucaacggcgucgagaugugcgucgacgcccgcaccuucggcaacgacgcccgcuucauccgccgcuccugcacccccaacgccgagguccgccacaugaucgccgacggcaugauccaccucugcaucuacgccgucuccgccaucaccaaggacgccgaggucaccaucgccuucgacuacgaguacuccaacugcaacuacaaggucgacugcgccugccacaagggcaaccgcaacugccccauccagaagcgcaaccccaacgccaccgagcucccccuccucccccccccccccucccuccccaccaucggcgccgagacccgccgccgcaaggcccgccgcaaggagcucgagauggagcagcagaacgaggccuccgaggagaacaacgaccagcagucccaggagguccccgagaaggucaccgucuccuccgaccacgaggaggucgacaaccccgaggagaagcccgaggaggagaaggaggaggucaucgacgaccaggagaaccucgcccacucccgccgcacccgcgaggaccgcaaggucgaggccaucaugcacgccuucgagaaccucgagaagcgcaagaagcgccgcgaccagccccucgagcaguccaacuccgacgucgagaucaccaccaccaccuccgagacccccgucggcgaggagaccaagaccgaggcccccgaguccgaggucuccaacuccgucuccaacgucaccauccccuccaccccccaguccgucggcgucaacacccgccgcuccucccaggccggcgacaucgccgccgagaagcucguccccaagcccccccccgccaagcccucccgcccccgccccaagucccgcaucucccgcuaccgcaccuccuccgcccagcgccucaagcgccagaagcaggccaacgcccagcaggccgagcucucccaggccgcccucgaggagggcggcuccaacucccucgucacccccaccgaggccggcucccucgacuccuccggcgagaaccgcccccucaccggcuccgaccccaccgucgucuccaucaccggcucccacgucaaccgcgccgccuccaaguaccccaagaccaagaaguaccucgucaccgaguggcucaacgacaaggccgagaagcaggagugccccgucgagugcccccuccgcaucaccaccgaccccaccguccucgccaccacccucaacaugcuccccggccucauccacuccccccucaucugcaccacccccaagcacuacauccgcuucggcucccccuucauccccgagcgccgccgccgcccccuccuccccgacggcaccuucuccuccugcaagaagcgcuggaucaagcaggcccucgaggagggcaugacccagaccuccuccgucccccaggagacccgcacccagcaccucuaccaguccaacgagaacuccuccuccuccuccaucugcaaggacaacgccgaccuccucuccccccucaagaaguggaagucccgcuaccucauggagcagaacgucaccaagcuccuccgcccccucucccccgucaccccccccccccccaacuccggcuccaaguccccccagcucgccacccccggcuccucccaccccggcgaggaggagugccgcaacggcuacucccucauguucucccccgucaccucccucaccaccgccucccgcugcaacaccccccuccaguucgagcucugccaccgcaaggaccucgaccucgccaaggucggcuaccucgacuccaacaccaacuccugcgccgaccgccccucccuccucaacuccggccacuccgaccucgccccccaccccucccucggccccaccuccgagaccggcuuccccucccgcuccggcgacggccaccagacccucguccgcaacuccgaccaggccuuccgcaccgaguucaaccucauguacgccuacuccccccucaacgccaugccccgcgccgacggccucuaccgcggcuccccccucgucggcgaccgcaagccccuccaccucgacggcggcuacugcucccccgccgagggcuucuccucccgcuacgagcacggccucaugaaggaccucucccgcggcucccucucccccggcggcgagcgcgccugcgagggcguccccuccgccccccagaaccccccccagcgcaagaaggucucccuccucgaguaccgcaagcgcaagcaggaggccaaggagaacuccgccggcggcggcggcgacuccgcccaguccaaguccaaguccgccggcgccggccagggcuccuccaacuccgucuccgacaccggcgcccacggcguccagggcuccuccgcccgcacccccuccuccccccacaagaaguucucccccucccacuccuccaugucccaccucgaggccgucucccccuccgacucccgcggcaccuccuccucccacugccgcccccaggagaacaucuccucccgcuggaugguccccaccuccgucgagcgccuccgcgagggcggcuccauccccaagguccuccgcuccuccguccgcgucgcccagaagggcgagcccucccccaccugggaguccaacaucaccgagaaggacuccgaccccgccgacggcgagggccccgagacccucuccuccgcccucuccaagggcgccaccgucuacucccccucccgcuacuccuaccagcuccuccagugcgacuccccccgcaccgagucccagucccuccuccagcaguccuccucccccuuccgcggccaccccacccagucccccggcuacuccuaccgcaccaccgcccuccgccccggcaacccccccucccacggcuccuccgaguccucccucuccuccaccuccuacuccucccccgcccaccccgucuccaccgacucccucgcccccuucaccggcacccccggcuacuucuccucccagccccacuccggcaacuccaccggcuccaaccucccccgccgcuccugccccuccuccgccgccucccccacccuccagggccccuccgacucccccaccuccgacuccgucucccaguccuccaccggcacccucuccuccaccuccuucccccagaacucccgcuccucccuccccuccgaccuccgcaccaucucccuccccuccgccggccaguccgccgucuaccaggccucccgcgucuccgccgucuccaacucccagcacuacccccaccgcggcuccggcggcguccaccaguaccgccuccagccccuccagggcuccggcgucaagacccagaccggccucuccuga

SEQ ID NO: 49324 - RNA, 1101 nt, Artificial Sequence
  derived and/or modified sequence opt2 from SETD7__Homo_sapiens__NP_085151
auggacuccgacgacgagauggucgaggaggccgucgagggccaccucgacgacgacggccucccccacggcuucugcaccgucaccuacuccuccaccgaccgcuucgagggcaacuucguccacggcgagaagaacggccgcggcaaguucuucuucuucgacggcuccacccucgagggcuacuacgucgacgacgcccuccagggccagggcgucuacaccuacgaggacggcggcguccuccagggcaccuacgucgacggcgagcucaacggccccgcccaggaguacgacaccgacggccgccucaucuucaagggccaguacaaggacaacauccgccacggcgucugcuggaucuacuaccccgacggcggcucccucgucggcgaggucaacgaggacggcgagaugaccggcgagaagaucgccuacgucuaccccgacgagcgcaccgcccucuacggcaaguucaucgacggcgagaugaucgagggcaagcucgccacccucauguccaccgaggagggccgcccccacuucgagcucaugcccggcaacuccgucuaccacuucgacaaguccaccuccuccugcaucuccaccaacgcccuccuccccgaccccuacgaguccgagcgcgucuacgucgccgagucccucaucuccuccgccggcgagggccucuucuccaaggucgccgucggccccaacaccgucauguccuucuacaacggcguccgcaucacccaccaggaggucgacucccgcgacugggcccucaacggcaacacccucucccucgacgaggagaccgucaucgacguccccgagcccuacaaccacgucuccaaguacugcgccucccucggccacaaggccaaccacuccuucacccccaacugcaucuacgacauguucguccacccccgcuucggccccaucaagugcauccgcacccuccgcgccgucgaggccgacgaggagcucaccgucgccuacggcuacgaccacuccccccccggcaaguccggccccgaggcccccgagugguaccaggucgagcucaaggccuuccaggccacccagcagaaguga

SEQ ID NO: 49325 - RNA, 1059 nt, Artificial Sequence
  derived and/or modified sequence opt2 from SETD8__Homo_sapiens__NP_065115
auggcccgcggccgcaagauguccaagccccgcgccgucgaggccgccgccgccgccgccgccgucgccgccaccgcccccggccccgagauggucgagcgccgcggccccggccgcccccgcaccgacggcgagaacgucuucaccggccaguccaagaucuacuccuacaugucccccaacaagugcuccggcaugcgcuucccccuccaggaggagaacuccgucacccaccacgaggucaagugccagggcaagccccucgccggcaucuaccgcaagcgcgaggagaagcgcaacgccggcaacgccguccgcuccgccaugaaguccgaggagcagaagaucaaggacgcccgcaagggcccccucguccccuuccccaaccagaaguccgaggccgccgagccccccaagaccccccccuccuccugcgacuccaccaacgccgccaucgccaagcaggcccucaagaagcccaucaagggcaagcaggccccccgcaagaaggcccagggcaagacccagcagaaccgcaagcucaccgacuucuaccccguccgccgcuccucccgcaaguccaaggccgagcuccaguccgaggagcgcaagcgcaucgacgagcucaucgaguccggcaaggaggagggcaugaagaucgaccucaucgacggcaagggccgcggcgucaucgccaccaagcaguucucccgcggcgacuucgucgucgaguaccacggcgaccucaucgagaucaccgacgccaagaagcgcgaggcccucuacgcccaggaccccuccaccggcugcuacauguacuacuuccaguaccucuccaagaccuacugcgucgacgccacccgcgagaccaaccgccucggccgccucaucaaccacuccaagugcggcaacugccagaccaagcuccacgacaucgacggcgucccccaccucauccucaucgccucccgcgacaucgccgccggcgaggagcuccucuacgacuacggcgaccgcuccaaggccuccaucgaggcccaccccuggcucaagcacuga

SEQ ID NO: 49326 - RNA, 2124 nt, Artificial Sequence
  derived and/or modified sequence opt2 from SETDB2__Homo_sapiens__NP_001153780
augggcgagaagaacggcgacgccaagaccuucuggauggagcucgaggacgacggcaaggucgacuucaucuucgagcagguccagaacguccuccagucccucaagcagaagaucaaggacggcuccgccaccaacaaggaguacauccaggccaugauccucgucaacgaggccaccaucaucaacuccuccaccuccaucaaggaccccaugcccgucacccagaaggagcaggagaacaaguccaacgccuuccccuccaccuccugcgagaacuccuuccccgaggacugcaccuuccucaccaccgagaacaaggagauccucucccucgaggacaaggucgucgacuuccgcgagaaggacuccuccuccaaccucuccuaccagucccacgacugcuccggcgccugccucaugaagaugccccucaaccucaagggcgagaacccccuccagcuccccaucaagugccacuuccagcgccgccacgccaagaccaacucccacuccuccgcccuccacgucuccuacaagacccccugcggccgcucccuccgcaacgucgaggaggucuuccgcuaccuccucgagaccgagugcaacuuccucuucaccgacaacuucuccuucaacaccuacguccagcucgcccgcaacuaccccaagcagaaggaggucgucuccgacgucgacaucuccaacggcgucgaguccguccccaucuccuucugcaacgagaucgacucccgcaagcucccccaguucaaguaccgcaagaccgucuggccccgcgccuacaaccucaccaacuucuccuccauguucaccgacuccugcgacugcuccgagggcugcaucgacaucaccaagugcgccugccuccagcucaccgcccgcaacgccaagaccuccccccucuccuccgacaagaucaccaccggcuacaaguacaagcgccuccagcgccagauccccaccggcaucuacgagugcucccuccucugcaagugcaaccgccagcucugccagaaccgcgucguccagcacggcccccagguccgccuccaggucuucaagaccgagcagaagggcuggggcguccgcugccucgacgacaucgaccgcggcaccuucgucugcaucuacuccggccgccuccucucccgcgccaacaccgagaaguccuacggcaucgacgagaacggccgcgacgagaacaccaugaagaacaucuucuccaagaagcgcaagcucgaggucgccugcuccgacugcgaggucgagguccucccccucggccucgagacccacccccgcaccgccaagaccgagaagugcccccccaaguucuccaacaaccccaaggagcucaccgucgagaccaaguacgacaacaucucccgcauccaguaccacuccgucauccgcgaccccgaguccaagaccgccaucuuccagcacaacggcaagaagauggaguucgucuccuccgaguccgucacccccgaggacaacgacggcuucaagcccccccgcgagcaccucaacuccaagaccaagggcgcccagaaggacuccuccuccaaccacgucgacgaguucgaggacaaccuccucaucgaguccgacgucaucgacaucaccaaguaccgcgaggagacccccccccgcucccgcugcaaccaggccaccacccucgacaaccagaacaucaagaaggccaucgagguccagauccagaagccccaggagggccgcuccaccgccugccagcgccagcaggucuucugcgacgaggagcuccucuccgagaccaagaacaccuccuccgacucccucaccaaguucaacaagggcaacgucuuccuccucgacgccaccaaggagggcaacgucggccgcuuccucaaccacuccugcugccccaaccuccucguccagaacgucuucgucgagacccacaaccgcaacuucccccucgucgccuucuucaccaaccgcuacgucaaggcccgcaccgagcucaccugggacuacggcuacgaggccggcaccguccccgagaaggagaucuucugccagugcggcgucaacaagugccgcaagaagauccucuga

SEQ ID NO: 49327 - RNA, 807 nt, Artificial Sequence
  derived and/or modified sequence opt2 from SET__Homo_sapiens__NP_001234929
augggcugccgcgaccuccuccccucccucaagcccacccuccucgagaaggagcagcaggaggccaucgagcacaucgacgagguccagaacgagaucgaccgccucaacgagcaggccuccgaggagauccucaaggucgagcagaaguacaacaagcuccgccagcccuucuuccagaagcgcuccgagcucaucgccaagauccccaacuucugggucaccaccuucgucaaccacccccaggucuccgcccuccucggcgaggaggacgaggaggcccuccacuaccucacccgcgucgaggucaccgaguucgaggacaucaaguccggcuaccgcaucgacuucuacuucgacgagaaccccuacuucgagaacaagguccucuccaaggaguuccaccucaacgaguccggcgaccccuccuccaaguccaccgagaucaaguggaaguccggcaaggaccucaccaagcgcuccucccagacccagaacaaggccucccgcaagcgccagcacgaggagcccgaguccuucuucaccugguucaccgaccacuccgacgccggcgccgacgagcucggcgaggucaucaaggacgacaucuggcccaacccccuccaguacuaccucguccccgacauggacgacgaggagggcgagggcgaggaggacgacgacgacgacgaggaggaggagggccucgaggacaucgacgaggagggcgacgaggacgagggcgaggaggacgaggacgacgacgagggcgaggagggcgaggaggacgagggcgaggacgacuga

SEQ ID NO: 49328 - RNA, 1098 nt, Artificial Sequence
  derived and/or modified sequence opt2 from SETMAR__Homo_sapiens__NP_001263254
auguucgccgaggccgccaagaccacccgccccugcggcauggccgaguucaaggagaagcccgaggcccccaccgagcagcucgacgucgccugcggccaggagaaccuccccgucggcgccuggccccccggcgccgcccccgcccccuuccaguacacccccgaccacgucgucggccccggcgccgacaucgaccccacccagaucaccuuccccggcugcaucugcgucaagacccccugccuccccggcaccugcuccugccuccgccacggcgagaacuacgacgacaacuccugccuccgcgacaucggcuccggcggcaaguacgccgagcccgucuucgagugcaacguccucugccgcugcuccgaccacugccgcaaccgcgucguccagaagggccuccaguuccacuuccaggucuucaagacccacaagaagggcuggggccuccgcacccucgaguucauccccaagggccgcuucgucugcgaguacgccggcgagguccucggcuucuccgagguccagcgccgcauccaccuccagaccaaguccgacuccaacuacaucaucgccauccgcgagcacgucuacaacggccaggucauggagaccuucgucgaccccaccuacaucggcaacaucggccgcuuccucaaccacuccugcgagcccaaccuccucaugauccccguccgcaucgacuccaugguccccaagcucgcccucuucgccgccaaggacaucguccccgaggaggagcucuccuacgacuacuccggccgcuaccucaaccucaccgucuccgaggacaaggagcgccucgaccacggcaagcuccgcaagcccugcuacugcggcgccaaguccugcaccgccuuccuccccuucgacuccucccucuacugccccgucgagaaguccaacaucuccugcggcaacgagaaggagcccuccaugugcggcuccgcccccuccgucuuccccuccugcaagcgccucacccucgaggucucccucuucuccgacaagcagcucgccccccccuacuccggccgccaguggcucgccuccuucaccuccgccuga

SEQ ID NO: 49329 - RNA, 8034 nt, Artificial Sequence
  derived and/or modified sequence opt2 from SETX__Homo_sapiens__NP_055861
auguccaccugcugcuggugcacccccggcggcgccuccaccaucgacuuccucaagcgcuacgccuccaacacccccuccggcgaguuccagaccgccgacgaggaccucugcuacugccucgagugcgucgccgaguaccacaaggcccgcgacgagcuccccuuccuccacgagguccucugggagcucgagacccuccgccucaucaaccacuucgagaaguccaugaaggccgagaucggcgacgacgacgagcucuacaucgucgacaacaacggcgagaugccccucuucgacaucaccggccaggacuucgagaacaagcuccgcgucccccuccucgagauccucaaguaccccuaccuccuccuccacgagcgcgucaacgagcucugcgucgaggcccucugccgcauggagcaggccaacugcuccuuccaggucuucgacaagcaccccggcaucuaccucuuccucguccaccccaacgagaugguccgccgcugggccauccucaccgcccgcaaccucggcaaggucgaccgcgacgacuacuacgaccuccaggagguccuccucugccucuucaaggucaucgagcucggccuccucgagucccccgacaucuacaccuccuccguccucgagaagggcaagcucauccuccuccccucccacauguacgacaccaccaacuacaaguccuacuggcucggcaucugcaugcuccucaccauccucgaggagcaggccauggacucccuccuccucggcuccgacaagcagaacgacuucaugcaguccauccuccacaccauggagcgcgaggccgacgacgacuccgucgaccccuucuggcccgcccuccacugcuucauggucauccucgaccgccucggcuccaaggucuggggccagcucauggaccccaucgucgccuuccagaccaucaucaacaacgccuccuacaaccgcgagauccgccacauccgcaacuccuccguccgcaccaagcucgagcccgaguccuaccucgacgacauggucaccugcucccagaucgucuacaacuacaaccccgagaagaccaagaaggacuccggcuggcgcaccgccaucugccccgacuacugccccaacauguacgaggagauggagacccucgccuccguccuccaguccgacaucggccaggacaugcgcguccacaacuccaccuuccucugguucauccccuucguccagucccucauggaccucaaggaccucggcgucgccuacaucgcccaggucgucaaccaccucuacuccgaggucaaggagguccucaaccagaccgacgccgucugcgacaaggucaccgaguucuuccuccucauccucgucuccgucaucgagcuccaccgcaacaagaagugccuccaccuccucugggucuccucccagcagugggucgaggccgucgucaagugcgccaagcuccccaccaccgccuucacccgcuccuccgagaaguccuccggcaacugcuccaagggcaccgccaugaucuccucccucucccuccacuccaugcccuccaacuccguccagcucgccuacguccagcucauccgcucccuccucaaggagggcuaccagcucggccagcagucccucugcaagcgcuucugggacaagcucaaccucuuccuccgcggcaaccucucccucggcuggcagcucaccucccaggagacccacgagcuccaguccugccucaagcagaucauccgcaacaucaaguucaaggccccccccugcaacaccuucgucgaccucaccuccgccugcaagaucucccccgccuccuacaacaaggaggaguccgagcagaugggcaagaccucccgcaaggacaugcacugccucgaggccuccucccccaccuucuccaaggagcccaugaagguccaggacuccguccucaucaaggccgacaacaccaucgagggcgacaacaacgagcagaacuacaucaaggacgucaagcucgaggaccaccuccucgccggcuccugccucaagcaguccuccaagaacaucuucaccgagcgcgccgaggaccagaucaagaucuccacccgcaagcagaaguccgucaaggagaucuccuccuacacccccaaggacugcaccucccgcaacggccccgagcgcggcugcgaccgcggcaucaucgucuccacccgccuccucaccgacuccuccaccgacgcccucgagaaggucuccaccuccaacgaggacuucucccucaaggacgacgcccucgccaagaccuccaagcgcaagaccaagguccagaaggacgagaucugcgccaagcucucccacgucaucaagaagcagcaccgcaaguccacccucgucgacaacaccaucaaccucgacgagaaccucaccgucuccaacaucgaguccuucuacucccgcaaggacaccggcguccagaagggcgacggcuucauccacaaccucucccucgaccccuccggcguccucgacgacaagaacggcgagcagaagucccagaacaacguccuccccaaggagaagcagcucaagaacgaggagcucgucaucuucuccuuccacgagaacaacugcaagauccaggaguuccacgucgacggcaaggagcucauccccuucaccgagaugaccaacgccuccgagaagaaguccucccccuucaaggaccucaugaccguccccgagucccgcgacgaggagauguccaacuccaccuccgucaucuacuccaaccucacccgcgagcaggcccccgacaucucccccaaguccgacacccucaccgacucccagaucgaccgcgaccuccacaagcucucccuccucgcccaggccuccgucaucaccuuccccuccgacuccccccagaacuccucccagcuccagcgcaaggucaaggaggacaagcgcugcuucaccgccaaccagaacaacgucggcgacaccucccgcggccaggucaucaucaucuccgacuccgacgacgacgacgacgagcgcauccucucccucgagaagcucaccaagcaggacaagaucugccucgagcgcgagcaccccgagcagcacgucuccaccgucaacuccaaggaggagaagaaccccgucaaggaggagaagaccgagacccucuuccaguucgaggaguccgacucccagugcuucgaguucgaguccuccuccgaggucuucuccgucuggcaggaccaccccgacgacaacaacuccguccaggacggcgagaagaagugccucgcccccaucgccaacaccaccaacggccagggcugcaccgacuacgucuccgaggucgucaagaagggcgccgagggcaucgaggagcacacccgcccccgcuccaucuccgucgaggaguucugcgagaucgaggucaagaagcccaagcgcaagcgcuccgagaagcccauggccgaggaccccguccgccccuccuccuccguccgcaacgagggccaguccgacaccaacaagcgcgaccucgucggcaacgacuucaaguccaucgaccgccgcaccuccacccccaacucccgcauccagcgcgccaccaccgucucccagaagaaguccuccaagcucugcaccugcaccgagcccauccgcaagguccccgucuccaagacccccaagaagacccacuccgacgccaagaagggccagaaccgcuccuccaacuaccucuccugccgcaccacccccgccaucgucccccccaagaaguuccgccagugccccgagcccaccuccaccgccgagaagcucggccucaagaagggcccccgcaaggccuacgagcucucccagcgcucccucgacuacgucgcccagcuccgcgaccacggcaagaccgucggcgucgucgacacccgcaagaagaccaagcucaucuccccccagaaccucuccguccgcaacaacaagaagcuccucaccucccaggagcuccagaugcagcgccagauccgccccaagucccagaagaaccgccgccgccucuccgacugcgaguccaccgacgucaagcgcgccggcucccacaccgcccagaacuccgacaucuucguccccgaguccgaccgcuccgacuacaacugcaccggcggcaccgagguccucgccaacuccaaccgcaagcagcucaucaagugcaugcccuccgagcccgagaccaucaaggccaagcacggcucccccgccaccgacgacgccugcccccucaaccagugcgacuccgucguccucaacggcaccguccccaccaacgaggucaucgucuccaccuccgaggacccccucggcggcggcgaccccaccgcccgccacaucgagauggccgcccucaaggagggcgagcccgacuccuccuccgacgccgaggaggacaaccucuuccucacccagaacgaccccgaggacauggaccucugcucccagauggagaacgacaacuacaagcucaucgagcucauccacggcaaggacaccgucgaggucgaggaggacuccgucucccgcccccagcucgagucccucuccggcaccaagugcaaguacaaggacugccucgagaccaccaagaaccagggcgaguacugccccaagcacuccgaggucaaggccgccgacgaggacgucuuccgcaagcccggccuccccccccccgccuccaagccccuccgccccaccaccaagaucuucuccuccaaguccaccucccgcaucgccggccucuccaagucccucgagaccuccuccgcccucucccccucccucaagaacaaguccaagggcauccaguccauccucaaggucccccagcccgucccccucaucgcccagaagcccgucggcgagaugaagaacuccugcaacguccuccacccccagucccccaacaacuccaaccgccagggcugcaagguccccuucggcgaguccaaguacuuccccuccuccucccccgucaacauccuccucuccucccaguccgucuccgacaccuucgucaaggagguccucaaguggaaguacgagauguuccucaacuucggccagugcggcccccccgccucccucugccaguccaucucccgccccguccccguccgcuuccacaacuacggcgacuacuucaacgucuucuucccccucaugguccucaacaccuucgagaccgucgcccaggaguggcucaacucccccaaccgcgagaacuucuaccagcuccagguccgcaaguuccccgccgacuacaucaaguacugggaguucgccgucuaccucgaggagugcgagcucgccaagcagcucuaccccaaggagaacgaccucgucuuccucgcccccgagcgcaucaacgaggagaagaaggacaccgagcgcaacgacauccaggaccuccacgaguaccacuccggcuacguccacaaguuccgccgcaccuccgucaugcgcaacggcaagaccgagugcuaccucuccauccagacccaggagaacuuccccgccaaccucaacgagcucgucaacugcaucgucaucuccucccucgucaccacccagcgcaagcucaaggccaugucccuccucggcucccgcaaccagcucgcccgcgccguccucaaccccaaccccauggacuucugcaccaaggaccuccucaccaccaccuccgagcgcaucaucgccuaccuccgcgacuucaacgaggaccagaagaaggccaucgagaccgccuacgccauggucaagcacucccccuccgucgccaagaucugccucauccacggcccccccggcaccggcaaguccaagaccaucgucggccuccucuaccgccuccucaccgagaaccagcgcaagggccacuccgacgagaacuccaacgccaagaucaagcagaaccgcguccucgucugcgcccccuccaacgccgccgucgacgagcucaugaagaagaucauccucgaguucaaggagaagugcaaggacaagaagaacccccucggcaacugcggcgacaucaaccucguccgccucggccccgagaaguccaucaacuccgagguccucaaguucucccucgacucccaggucaaccaccgcaugaagaaggagcuccccucccacguccaggccaugcacaagcgcaaggaguuccucgacuaccagcucgacgagcucucccgccagcgcgcccucugccgcggcggccgcgagauccagcgccaggagcucgacgagaacaucuccaaggucuccaaggagcgccaggagcucgccuccaagaucaaggagguccagggccgcccccagaagacccaguccaucaucauccucgagucccacaucaucugcugcacccucuccaccuccggcggccuccuccucgaguccgccuuccgcggccagggcggcguccccuucuccugcgucaucgucgacgaggccggccaguccugcgagaucgagacccucaccccccucauccaccgcugcaacaagcucauccucgucggcgaccccaagcagcucccccccaccgucaucuccaugaaggcccaggaguacggcuacgaccaguccaugauggcccgcuucugccgccuccucgaggagaacgucgagcacaacaugaucucccgccuccccauccuccagcucaccguccaguaccgcaugcaccccgacaucugccucuuccccuccaacuacgucuacaaccgcaaccucaagaccaaccgccagaccgaggccauccgcugcuccuccgacuggcccuuccagcccuaccucgucuucgacgucggcgacggcuccgagcgccgcgacaacgacuccuacaucaacguccaggagaucaagcucgucauggagaucaucaagcucaucaaggacaagcgcaaggacgucuccuuccgcaacaucggcaucaucacccacuacaaggcccagaagaccaugauccagaaggaccucgacaaggaguucgaccgcaagggccccgccgaggucgacaccgucgacgccuuccagggccgccagaaggacugcgucaucgucaccugcguccgcgccaacuccauccagggcuccaucggcuuccucgccucccuccagcgccucaacgucaccaucacccgcgccaaguacucccucuucauccucggccaccuccgcacccucauggagaaccagcacuggaaccagcucauccaggacgcccagaagcgcggcgccaucaucaagaccugcgacaagaacuaccgccacgacgccgucaagauccucaagcucaagcccguccuccagcgcucccucacccacccccccaccaucgcccccgagggcucccgcccccagggcggccuccccuccuccaagcucgacuccggcuucgccaagaccuccgucgccgccucccucuaccacacccccuccgacuccaaggagaucacccucaccgucaccuccaaggaccccgagcgcccccccguccacgaccagcuccaggacccccgccuccucaagcgcaugggcaucgaggucaagggcggcaucuuccucugggacccccagcccuccuccccccagcaccccggcgccaccccccccaccggcgagcccggcuuccccgucguccaccaggaccucucccacauccagcagcccgccgccgucgucgccgcccucuccucccacaagccccccguccgcggcgagccccccgccgccucccccgaggccuccaccugccaguccaagugcgacgaccccgaggaggagcucugccaccgccgcgaggcccgcgccuucuccgagggcgagcaggagaagugcggcuccgagacccaccacacccgccgcaacucccgcugggacaagcgcacccucgagcaggaggacuccuccuccaagaagcgcaagcuccucuga

SEQ ID NO: 49330 - RNA, 2982 nt, Artificial Sequence
  derived and/or modified sequence opt2 from SEZ6__Homo_sapiens__NP_001092105
augcgccccgucgcccuccuccuccuccccucccuccucgcccuccucgcccacggccucucccucgaggcccccaccgucggcaagggccaggcccccggcaucgaggagaccgacggcgagcucaccgccgcccccacccccgagcagcccgagcgcggcguccacuucgucaccaccgcccccacccucaagcuccucaaccaccacccccuccucgaggaguuccuccaggagggccucgagaagggcgacgaggagcuccgccccgcccuccccuuccagcccgacccccccgcccccuucacccccuccccccucccccgccucgccaaccaggacucccgccccgucuucaccucccccacccccgccauggccgccguccccacccagccccaguccaaggagggccccuggucccccgaguccgagucccccaugcuccgcaucaccgccccccucccccccggccccuccauggccguccccacccucggccccggcgagaucgccuccaccaccccccccucccgcgccuggacccccacccaggagggccccggcgacaugggccgccccugggucgccgaggucgucucccagggcgccggcaucggcauccagggcaccaucaccuccuccaccgccuccggcgacgacgaggagaccaccaccaccaccaccaucaucaccaccaccaucaccaccguccagacccccggccccugcuccuggaacuucuccggccccgagggcucccucgacucccccaccgaccucuccucccccaccgacgucggccucgacugcuucuucuacaucuccgucuaccccggcuacggcgucgagaucaagguccagaacaucucccuccgcgagggcgagaccgucaccgucgagggccucggcggccccgacccccucccccucgccaaccaguccuuccuccuccgcggccaggucauccgcucccccacccaccaggccgcccuccgcuuccagucccuccccccccccgccggccccggcaccuuccacuuccacuaccaggccuaccuccucuccugccacuucccccgccgccccgccuacggcgacgucaccgucaccucccuccaccccggcggcuccgcccgcuuccacugcgccaccggcuaccagcucaagggcgcccgccaccucaccugccucaacgccacccagcccuucugggacuccaaggagcccgucugcaucgccgccugcggcggcgucauccgcaacgccaccaccggccgcaucgucucccccggcuuccccggcaacuacuccaacaaccucaccugccacuggcuccucgaggcccccgagggccagcgccuccaccuccacuucgagaaggucucccucgccgaggacgacgaccgccucaucauccgcaacggcgacaacgucgaggccccccccgucuacgacuccuacgaggucgaguaccuccccaucgagggccuccucuccuccggcaagcacuucuucgucgagcucuccaccgacuccuccggcgccgccgccggcauggcccuccgcuacgaggccuuccagcagggccacugcuacgagcccuucgucaaguacggcaacuucuccuccuccacccccaccuaccccgucggcaccaccgucgaguucuccugcgaccccggcuacacccucgagcagggcuccaucaucaucgagugcgucgacccccacgacccccaguggaacgagaccgagcccgccugccgcgccgucugcuccggcgagaucaccgacuccgccggcgucguccucucccccaacuggcccgagcccuacggccgcggccaggacugcaucuggggcguccacgucgaggaggacaagcgcaucaugcucgacauccgcguccuccgcaucggccccggcgacguccucaccuucuacgacggcgacgaccucaccgcccgcguccucggccaguacuccggcccccgcucccacuucaagcucuucaccuccauggccgacgucaccauccaguuccaguccgaccccggcaccuccguccucggcuaccagcagggcuucgucauccacuucuucgaggucccccgcaacgacaccugccccgagcuccccgagauccccaacggcuggaagucccccucccagcccgagcucguccacggcaccgucgucaccuaccagugcuaccccggcuaccaggucgucggcuccuccguccucaugugccagugggaccucaccugguccgaggaccuccccuccugccagcgcgucaccuccugccacgaccccggcgacgucgagcacucccgccgccucaucuccucccccaaguuccccgucggcgccaccguccaguacaucugcgaccagggcuucguccucaugggcuccuccauccucaccugccacgaccgccaggccggcucccccaagugguccgaccgcgcccccaagugccuccucgagcagcucaagcccugccacggccucuccgcccccgagaacggcgcccgcucccccgagaagcagcuccaccccgccggcgccaccauccacuucuccugcgcccccggcuacguccucaagggccaggccuccaucaagugcguccccggccaccccucccacugguccgaccccccccccaucugccgcgccgccucccucgacggcuucuacaacucccgcucccucgacgucgccaaggcccccgccgccuccuccacccucgacgccgcccacaucgccgccgccaucuuccucccccucgucgccaugguccuccucgucggcggcgucuacuucuacuucucccgccuccagggcaaguccucccuccagcucccccgcccccgcccccgccccuacaaccgcaucaccaucgaguccgccuucgacaaccccaccuacgagaccggcgagacccgcgaguacgaggucuccaucuga

SEQ ID NO: 49331 - RNA, 2430 nt, Artificial Sequence
  derived and/or modified sequence opt2 from SEZ6L2__Homo_sapiens__NP_001107572
augggcaccccccgcgcccagcaccccccccccccccagcuccucuuccucauccuccucuccugccccuggauccagggccucccccucaaggaggaggagauccuccccgagcccggcuccgagacccccaccgucgccuccgaggcccucgccgagcuccuccacggcgcccuccuccgccgcggccccgagaugggcuaccuccccggcuccgaccgcgaccccacccucgccaccccccccgccggccagacccucgccguccccucccucccccgcgccaccgagcccggcaccggcccccucaccaccgccgucacccccaacggcguccgcggcgccggccccaccgcccccgagcuccucacccccccccccggcaccaccgccccccccccccccucccccgccucccccggccccccccucggccccgagggcggcgaggaggagaccaccaccaccaucaucaccaccaccaccgucaccaccaccgucaccucccccgccuaccuccucuccugcggcuuccccccccgccccgcccacggcgacgucuccgucaccgaccuccaccccggcggcaccgccaccuuccacugcgacuccggcuaccagcuccagggcgaggagacccucaucugccucaacggcacccgccccuccuggaacggcgagacccccuccugcauggccuccugcggcggcaccauccacaacgccacccucggccgcaucgucucccccgagcccggcggcgccgucggccccaaccucaccugccgcugggucaucgaggccgccgagggccgccgccuccaccuccacuucgagcgcgucucccucgacgaggacaacgaccgccucaugguccgcuccggcggcuccccccucucccccgucaucuacgacuccgacauggacgacguccccgagcgcggccucaucuccgacgcccagucccucuacgucgagcuccucuccgagacccccgccaacccccuccuccucucccuccgcuucgaggccuucgaggaggaccgcugcuucgcccccuuccucgcccacggcaacgucaccaccaccgaccccgaguaccgccccggcgcccucgccaccuucuccugccuccccggcuacgcccucgagccccccggcccccccaacgccaucgagugcgucgaccccaccgagccccacuggaacgacaccgagcccgccugcaaggccaugugcggcggcgagcucuccgagcccgccggcgucguccucucccccgacuggccccaguccuacucccccggccaggacugcgucuggggcguccacguccaggaggagaagcgcauccuccuccaggucgagauccucaacguccgcgagggcgacaugcucacccucuucgacggcgacggccccuccgcccgcguccucgcccagcuccgcggcccccagccccgccgccgccuccucuccuccggccccgaccucacccuccaguuccaggccccccccggcccccccaaccccggccucggccagggcuucguccuccacuucaaggaggucccccgcaacgacaccugccccgagcuccccccccccgaguggggcuggcgcaccgccucccacggcgaccucauccgcggcaccguccucaccuaccagugcgagcccggcuacgagcuccucggcuccgacauccucaccugccagugggaccucuccugguccgccgccccccccgccugccagaagaucaugaccugcgccgaccccggcgagaucgccaacggccaccgcaccgccuccgacgccggcuuccccgucggcucccacguccaguaccgcugccuccccggcuacucccucgagggcgccgccaugcucaccugcuacucccgcgacaccggcacccccaagugguccgaccgcguccccaagugcgcccucaaguacgagcccugccucaaccccggcguccccgagaacggcuaccagacccucuacaagcaccacuaccaggccggcgagucccuccgcuucuucugcuacgagggcuucgagcucaucggcgaggucaccaucaccugcguccccggccaccccucccaguggaccucccagcccccccucugcaaggucgccuacgaggagcuccucgacaaccgcaagcucgaggucacccagaccaccgaccccucccgccagcucgagggcggcaaccucgcccucgccauccuccucccccucggccucgucaucguccucggcuccggcgucuacaucuacuacaccaagcuccagggcaagucccucuucggcuucuccggcucccacuccuacucccccaucaccgucgaguccgacuucuccaacccccucuacgaggccggcgacacccgcgaguacgaggucuccaucuga

SEQ ID NO: 49332 - RNA, 3072 nt, Artificial Sequence
  derived and/or modified sequence opt2 from SEZ6L__Homo_sapiens__NP_001171702
augcccgccgcccgcccccccgccgccggccuccgcggcaucucccucuuccucgcccuccuccucggcucccccgccgccgcccucgagcgcgacgcccuccccgagggcgacgccuccccccucggccccuaccuccuccccuccggcgcccccgagcgcggcucccccggcaaggagcaccccgaggagcgcgucgucaccgccccccccuccuccucccaguccgccgagguccucggcgagcucguccucgacggcaccgcccccuccgcccaccacgacauccccgcccucuccccccuccuccccgaggaggcccgccccaagcacgcccucccccccaagaagaagcuccccucccucaagcaggucaacuccgcccgcaagcagcuccgccccaaggccaccuccgccgccaccguccagcgcgccggcucccagcccgccucccagggccucgaccuccucuccuccuccaccgagaagcccggcccccccggcgaccccgaccccaucgucgccuccgaggaggccuccgaggucccccucuggcucgaccgcaaggaguccgccguccccaccacccccgccccccuccagaucucccccuucaccucccagcccuacgucgcccacacccucccccagcgccccgagcccggcgagcccggccccgacauggcccaggaggccccccaggaggacaccucccccauggcccucauggacaagggcgagaacgagcucaccggcuccgccuccgaggagucccaggagaccaccaccuccaccaucaucaccaccaccgucaucaccaccgagcaggcccccgcccucugcuccgucuccuucuccaaccccgagggcuacaucgacuccuccgacuacccccuccucccccucaacaacuuccucgagugcaccuacaacgucaccgucuacaccggcuacggcgucgagcuccaggucaaguccgucaaccucuccgacggcgagcuccucuccauccgcggcgucgacggccccacccucaccguccucgccaaccagacccuccucgucgagggccaggucauccgcucccccaccaacaccaucuccgucuacuuccgcaccuuccaggacgacggccucggcaccuuccagcuccacuaccaggccuucaugcucuccugcaacuucccccgccgccccgacuccggcgacgucaccgucauggaccuccacuccggcggcgucgcccacuuccacugccaccucggcuacgagcuccagggcgccaagaugcucaccugcaucaacgccuccaagccccacugguccucccaggagcccaucugcuccgcccccugcggcggcgccguccacaacgccaccaucggccgcguccucucccccuccuaccccgagaacaccaacggcucccaguucugcaucuggaccaucgaggcccccgagggccagaagcuccaccuccacuucgagcgccuccuccuccacgacaaggaccgcaugaccguccacuccggccagaccaacaaguccgcccuccucuacgacucccuccagaccgaguccguccccuucgagggccuccucuccgagggcaacaccauccgcaucgaguucaccuccgaccaggcccgcgccgccuccaccuucaacauccgcuucgaggccuucgagaagggccacugcuacgagcccuacauccagaacggcaacuucaccaccuccgaccccaccuacaacaucggcaccaucgucgaguucaccugcgaccccggccacucccucgagcagggccccgccaucaucgagugcaucaacguccgcgaccccuacuggaacgacaccgagccccucugccgcgccaugugcggcggcgagcucuccgccgucgccggcgucguccucucccccaacuggcccgagcccuacgucgagggcgaggacugcaucuggaagauccacgucggcgaggagaagcgcaucuuccucgacauccaguuccucaaccucuccaacuccgacauccucaccaucuacgacggcgacgaggucaugccccacauccucggccaguaccucggcaacuccggcccccagaagcucuacuccuccacccccgaccucaccauccaguuccacuccgaccccgccggccucaucuucggcaagggccagggcuucaucaugaacuacaucgaggucucccgcaacgacuccugcuccgaccuccccgagauccagaacggcuggaagaccaccucccacaccgagcucguccgcggcgcccgcaucaccuaccagugcgaccccggcuacgacaucgucggcuccgacacccucaccugccagugggaccucuccugguccuccgacccccccuucugcgagaagaucauguacugcaccgaccccggcgaggucgaccacuccacccgccucaucuccgaccccguccuccucgucggcaccaccauccaguacaccugcaaccccggcuucguccucgagggcuccucccuccucaccugcuacucccgcgagaccggcacccccaucuggaccucccgccucccccacugcgucuccgaggagucccucgccugcgacaaccccggccuccccgagaacggcuaccagauccucuacaagcgccucuaccuccccggcgagucccucaccuucaugugcuacgagggcuucgagcucaugggcgaggucaccauccgcugcauccucggccagcccucccacuggaacggcccccuccccgucugcaaggucaaccaggacuccuucgagcacgcccucgaggccgaggccgccgccgagaccucccucgagggcggcaacauggcccucgccaucuucauccccguccucaucaucucccuccuccucggcggcgccuacaucuacaucacccgcugccgcuacuacuccaaccuccgccucccccucauguacucccaccccuacucccagaucaccgucgagaccgaguucgacaaccccaucuacgagaccggcgagacccgcgaguacgaggucuccaucuga

SEQ ID NO: 49333 - RNA, 2022 nt, Artificial Sequence
  derived and/or modified sequence opt2 from SF1__Homo_sapiens__NP_001171501
auggccaccggcgccaacgccaccccccucggcaagcucggcccccccggccuccccccccuccccggccccaagggcggcuucgagcccggccccccccccgcccccggccccggcgccggccuccucgcccccggcccccccccccccccccccgucggcuccaugggcgcccucaccgccgccuuccccuucgccgcccuccccccccccccccccccccccccccccccccccccccagcagccccccccccccccccccccccccucccccggcgccuccuacccccccccccagcccccccccccccccccccucuaccagcgcgucucccccccccagcccccccccccccagcccccccgcaaggaccagcagcccggccccgccggcggcggcggcgacuuccccuccaagaagcgcaagcgcucccgcuggaaccaggacaccauggagcagaagaccgucauccccggcaugcccaccgucaucccccccggccucacccgcgagcaggagcgcgccuacaucguccagcuccagaucgaggaccucacccgcaagcuccgcaccggcgaccucggcaucccccccaaccccgaggaccgcucccccucccccgagcccaucuacaacuccgagggcaagcgccucaacacccgcgaguuccgcacccgcaagaagcucgaggaggagcgccacaaccucaucaccgagauggucgcccucaaccccgacuucaagccccccgccgacuacaagccccccgccacccgcgucuccgacaaggucaugaucccccaggacgaguaccccgagaucaacuucgucggccuccucaucggcccccgcggcaacacccucaagaacaucgagaaggagugcaacgccaagaucaugauccgcggcaagggcuccgucaaggagggcaaggucggccgcaaggacggccagaugcuccccggcgaggacgagccccuccacgcccucgucaccgccaacaccauggagaacgucaagaaggccgucgagcagauccgcaacauccucaagcagggcaucgagacccccgaggaccagaacgaccuccgcaagaugcagcuccgcgagcucgcccgccucaacggcacccuccgcgaggacgacaaccgcauccuccgccccuggcaguccuccgagacccgcuccaucaccaacaccaccgucugcaccaagugcggcggcgccggccacaucgccuccgacugcaaguuccagcgccccggcgacccccaguccgcccaggacaaggcccgcauggacaaggaguaccucucccucauggccgagcucggcgaggcccccguccccgccuccgucggcuccaccuccggccccgccaccaccccccucgccuccgccccccgccccgccgcccccgccaacaacccccccccccccucccucauguccaccacccagucccgcccccccuggaugaacuccggccccuccgagucccgccccuaccacggcaugcacggcggcggccccggcggccccggcggcggcccccacuccuucccccacccccuccccucccucaccggcggccacggcggccaccccaugcagcacaaccccaacggcccccccccccccuggaugcagcccccccccccccccaugaaccagggcccccacccccccggccaccacggccccccccccauggaccaguaccucggcuccacccccgucggcuccggcgucuaccgccuccaccagggcaagggcaugaugccccccccccccaugggcaugaugcccccccccccccccccccccuccggccagcccccccccccccccuccggcccccucccccccuggcagcagcagcagcagcagcccccccccccccccccccccuccuccuccauggccuccuccaccccccuccccuggcagcagcgcucccuccccgccgccgccauggcccgcgccaugcgcguccgcaccuuccgcgcccacugguga

SEQ ID NO: 49334 - RNA, 2382 nt, Artificial Sequence
  derived and/or modified sequence opt2 from SF3A1__Homo_sapiens__NP_005868
augcccgccggccccguccaggccguccccccccccccccccguccccaccgagcccaagcagcccaccgaggaggaggccuccuccaaggaggacuccgcccccuccaagcccgucgucggcaucaucuaccccccccccgagguccgcaacaucgucgacaagaccgccuccuucgucgcccgcaacggccccgaguucgaggcccgcauccgccagaacgagaucaacaaccccaaguucaacuuccucaaccccaacgaccccuaccacgccuacuaccgccacaaggucuccgaguucaaggagggcaaggcccaggagcccuccgccgccauccccaaggucaugcagcagcagcagcagaccacccagcagcagcucccccagaagguccaggcccaggucauccaggagaccaucguccccaaggagcccccccccgaguucgaguucaucgccgacccccccuccaucuccgccuucgaccucgacgucgucaagcucaccgcccaguucgucgcccgcaacggccgccaguuccucacccagcucaugcagaaggagcagcgcaacuaccaguucgacuuccuccgcccccagcacucccucuucaacuacuucaccaagcucgucgagcaguacaccaagauccucaucccccccaagggccucuucuccaagcucaagaaggaggccgagaacccccgcgagguccucgaccaggucugcuaccgcgucgagugggccaaguuccaggagcgcgagcgcaagaaggaggaggaggagaaggagaaggagcgcgucgccuacgcccagaucgacuggcacgacuucgucgucgucgagaccgucgacuuccagcccaacgagcagggcaacuuccccccccccaccacccccgaggagcucggcgcccgcauccucauccaggagcgcuacgagaaguucggcgaguccgaggaggucgagauggaggucgaguccgacgaggaggacgacaagcaggagaaggccgaggagccccccucccagcucgaccaggacacccagguccaggacauggacgagggcuccgacgacgaggaggagggccagaaggucccccccccccccgagacccccaugccccccccccucccccccacccccgaccaggucaucguccgcaaggacuacgaccccaaggccuccaagccccucccccccgcccccgcccccgacgaguaccucgucucccccaucaccggcgagaagauccccgccuccaagaugcaggagcacaugcgcaucggccuccucgacccccgcuggcucgagcagcgcgaccgcuccauccgcgagaagcaguccgacgacgaggucuacgcccccggccucgacaucgaguccucccucaagcagcucgccgagcgccgcaccgacaucuucggcgucgaggagaccgccaucggcaagaagaucggcgaggaggagauccagaagcccgaggagaaggucaccugggacggccacuccggcuccauggcccgcacccagcaggccgcccaggccaacaucacccuccaggagcagaucgaggccauccacaaggccaagggccucguccccgaggacgacaccaaggagaagaucggccccuccaagcccaacgagaucccccagcagccccccccccccuccuccgccaccaacauccccuccuccgccccccccaucaccuccgucccccgcccccccaccaugcccccccccguccgcaccaccgucgucuccgccguccccgucaugccccgcccccccauggccuccgucguccgccucccccccggcuccgucaucgcccccaugccccccaucauccacgccccccgcaucaacgucguccccaugccccccuccgccccccccaucauggccccccgccccccccccaugaucguccccaccgccuucguccccgccccccccgucgcccccguccccgcccccgcccccaugccccccguccacccccccccccccauggaggacgagcccaccuccaagaagcucaagaccgaggacucccucaugcccgaggaggaguuccuccgccgcaacaagggccccgucuccaucaagguccagguccccaacaugcaggacaagaccgaguggaagcucaacggccagguccucgucuucacccucccccucaccgaccaggucuccgucaucaaggucaagauccacgaggccaccggcaugcccgccggcaagcagaagcuccaguacgagggcaucuucaucaaggacuccaacucccucgccuacuacaacauggccaacggcgccgucauccaccucgcccucaaggagcgcggcggccgcaagaaguga

SEQ ID NO: 49335 - RNA, 435 nt, Artificial Sequence
  derived and/or modified sequence opt2 from SF3B1__Homo_sapiens__NP_001005526
auggccaagaucgccaagacccacgaggacaucgaggcccagauccgcgagauccagggcaagaaggccgcccucgacgaggcccagggcgucggccucgacuccaccggcuacuacgaccaggagaucuacggcggcuccgacucccgcuucgccggcuacgucaccuccaucgccgccaccgagcucgaggacgacgacgacgacuacuccuccuccaccucccuccucggccagaagaagcccggcuaccacgcccccgucgcccuccucaacgacaucccccaguccaccgagcaguacgaccccuucgccgagcaccgcccccccaagaucgccgaccgcgaggacgaguacaagaagcaccgccgcaccaugaucaucucccccgagcgccucgaccccuucgccgacggcuucuacuccgccgccuga

SEQ ID NO: 49336 - RNA, 2688 nt, Artificial Sequence
  derived and/or modified sequence opt2 from SF3B2__Homo_sapiens__NP_006833
auggccaccgagcaccccgagccccccaaggccgagcuccagcucccccccccccccccccccggccacuacggcgccugggccgcccaggagcuccaggccaagcucgccgagaucggcgcccccauccagggcaaccgcgaggagcucgucgagcgccuccaguccuacacccgccagaccggcaucguccucaaccgccccguccuccgcggcgaggacggcgacaaggccgcccccccccccauguccgcccagcuccccggcauccccaugcccccccccccccucggccuccccccccuccagccccccccccccccccccccccccccccccggccucggccucggcuuccccauggcccacccccccaaccucggccccccccccccccuccgcgucggcgagcccgucgcccucuccgaggaggagcgccucaagcucgcccagcagcaggccgcccuccucaugcagcaggaggagcgcgccaagcagcagggcgaccacucccucaaggagcacgagcuccucgagcagcagaagcgcgccgccguccuccucgagcaggagcgccagcaggagaucgccaagaugggcacccccgucccccgccccccccaggacaugggccagaucggcguccgcaccccccucggcccccgcgucgccgcccccgucggccccgucggccccacccccaccguccuccccaugggcgcccccgucccccgcccccgcggccccccccccccccccggcgacgagaaccgcgagauggacgaccccuccgucggccccaagaucccccaggcccucgagaagauccuccagcucaaggagucccgccaggaggagaugaacucccagcaggaggaggaggagauggagaccgacgcccgcuccucccucggccaguccgccuccgagaccgaggaggacaccgucuccgucuccaagaaggagaagaaccgcaagcgccgcaaccgcaagaagaagaagaagccccagcgcguccgcggcgucuccuccgaguccuccggcgaccgcgagaaggacuccacccgcucccgcggcuccgacucccccgccgccgacgucgagaucgaguacgucaccgaggagcccgagaucuacgagcccaacuucaucuucuucaagcgcaucuucgaggccuucaagcucaccgacgacgucaagaaggagaaggagaaggagcccgagaagcucgacaagcucgagaacuccgccgcccccaagaagaagggcuucgaggaggagcacaaggacuccgacgacgacuccuccgacgacgagcaggagaagaagcccgaggcccccaagcucuccaagaagaagcuccgccgcaugaaccgcuucaccgucgccgagcucaagcagcucgucgcccgccccgacgucgucgagaugcacgacgucaccgcccaggaccccaagcuccucguccaccucaaggccacccgcaacuccguccccgucccccgccacuggugcuucaagcgcaaguaccuccagggcaagcgcggcaucgagaagccccccuucgagcuccccgacuucaucaagcgcaccggcauccaggagaugcgcgaggcccuccaggagaaggaggagcagaagaccaugaaguccaagaugcgcgagaagguccgccccaagaugggcaagaucgacaucgacuaccagaagcuccacgacgccuucuucaaguggcagaccaagcccaagcucaccauccacggcgaccucuacuacgagggcaaggaguucgagacccgccucaaggagaagaagcccggcgaccucuccgacgagcuccgcaucucccucggcaugcccgucggccccaacgcccacaagguccccccccccuggcucaucgccaugcagcgcuacggccccccccccuccuaccccaaccucaagauccccggccucaacucccccauccccgaguccugcuccuucggcuaccacgccggcggcuggggcaagccccccgucgacgagaccggcaagccccucuacggcgacgucuucggcaccaacgccgccgaguuccagaccaagaccgaggaggaggagaucgaccgcacccccuggggcgagcucgagcccuccgacgaggaguccuccgaggaggaggaggaggaggaguccgacgaggacaagcccgacgagaccggcuucaucacccccgccgacuccggccucaucacccccggcggcuucuccuccguccccgccggcauggagacccccgagcucaucgagcuccgcaagaagaagaucgaggaggccauggacggcuccgagaccccccagcucuucaccguccuccccgagaagcgcaccgccaccgucggcggcgccaugaugggcuccacccacaucuacgacauguccaccgucaugucccgcaagggccccgcccccgagcuccagggcgucgaggucgcccucgcccccgaggagcucgagcucgaccccauggccaugacccagaaguacgaggagcacguccgcgagcagcaggcccaggucgagaaggaggacuucuccgacauggucgccgagcacgccgccaagcagaagcagaagaagcgcaaggcccagccccaggacucccgcggcggcuccaagaaguacaaggaguucaaguucuga

SEQ ID NO: 49337 - RNA, 378 nt, Artificial Sequence
  derived and/or modified sequence opt2 from SF3B6__Homo_sapiens__NP_057131
auggccaugcaggccgccaagcgcgccaacauccgccucccccccgaggucaaccgcauccucuacauccgcaaccuccccuacaagaucaccgccgaggagauguacgacaucuucggcaaguacggccccauccgccagauccgcgucggcaacacccccgagacccgcggcaccgccuacgucgucuacgaggacaucuucgacgccaagaacgccugcgaccaccucuccggcuucaacgucugcaaccgcuaccucgucguccucuacuacaacgccaaccgcgccuuccagaagauggacaccaagaagaaggaggagcagcucaagcuccucaaggagaaguacggcaucaacaccgacccccccaaguga

SEQ ID NO: 49338 - RNA, 3729 nt, Artificial Sequence
  derived and/or modified sequence opt2 from SFI1__Homo_sapiens__NP_001007468
augaagaaccuccucaccgagaagugcaucuccucccacaacuuccaccagaaggucaucaagcagcgcauggagaagaaggucgacucccgcuacuucaaggacggcgccgucaagaagcccuacuccgccaagacccucuccaacaagaaguccuccgccuccuucggcauccgccgcgagcuccccuccaccucccaccucguccaguaccgcggcacccacaccugcacccgccagggccgccuccgcgagcuccgcauccgcugcgucgcccgcaaguuccucuaccucuggauccgcaugaccuucggccgcgucuuccccuccaaggcccgcuucuacuacgagcagcgccuccuccgcaaggucuucgaggaguggaaggaggaguggugggucuuccagcacgaguggaagcucugcguccgcgccgacugccacuaccgcuacuaccucuacaaccucauguuccagaccuggaagaccuacguccgccagcagcaggagaugcgcaacaaguacauccgcgccgagguccacgacgccaagcagaagaugcgccaggccuggaaguccuggcucaucuacgucgucguccgccgcaccaagcuccagaugcagaccaccgcccucgaguuccgccagcgcaucauccuccgcgucuggugguccaccuggcgccagcgccucggccagguccgcgucucccgcgcccuccacgccuccgcccucaagcaccgcgcccucucccuccagguccaggccuggucccaguggcgcgagcagcuccucuacguccagaaggagaagcagaaggucgucuccgccgucaagcaccaccagcacuggcagaagcgccgcuuccucaaggccuggcucgaguaccuccagguccgccgcgucaagcgccagcagaacgagauggccgagcgcuuccaccacgucaccguccuccagaucuacuucugcgacuggcagcaggccugggagcgccgcgagucccucuacgcccaccacgcccaggucgagaagcucgcccgcaagauggcccuccgccgcgccuucacccacuggaagcacuacaugcuccucugcgccgaggaggccgcccaguucgagauggccgaggagcaccaccgccacucccagcucuacuucugcuuccgcgcccucaaggacaacgucacccacgcccaccuccagcagauccgccgcaaccucgcccaccagcagcacggcgucacccuccuccaccgcuucuggaaccucuggcgcucccagaucgagcagaagaaggagcgcgagcuccucccccuccuccacgccgccugggaccacuaccgcaucgcccuccucugcaagugcaucgagcucuggcuccaguacacccagaagcgccgcuacaagcagcuccuccaggcccgcgccgacggccacuuccagcagcgcgcccuccccgccgccuuccacaccuggaaccgccucuggcgcuggcgccaccaggagaacguccucuccgcccgcgccacccgcuuccaccgcgagacccucgagaagcaggucuucucccucuggcgccagaagauguuccagcaccgcgagaaccgccucgccgagcgcauggccauccuccacgccgagcgccagcuccucuaccgcuccugguucauguggcaccagcaggccgccgcccgccaccaggagcaggaguggcagaccgucgccugcgcccaccaccgccacggccgccucaagaaggccuucugccucuggcgcgaguccgcccagggccuccgcaccgagcgcaccggccgcguccgcgccgccgaguuccacauggcccagcuccuccgcugggccuggucccaguggcgcgagugccucgcccuccgcggcgccgagcgccagaagcucaugcgcgccgaccuccaccaccagcacuccguccuccaccgcgcccuccaggccugggucaccuaccagggccgcguccgcuccauccuccgcgaggucgccgcccgcgagucccagcacaaccgccagcuccuccgcggcgcccuccgccgcuggaaggagaacaccauggcccgcgucgacgaggccaagaagaccuuccaggccuccacccacuaccgccgcaccaucugcuccaagguccucguccaguggcgcgaggccgucuccguccagauguacuaccgccagcaggaggacugcgccaucugggaggcccagaagguccucgaccgcggcugccuccgcaccugguuccagcgcuggugggacugcucccgccgcuccgcccagcagcgccuccagcucgagcgcgccguccagcaccaccaccgccagcuccuccucgagggccucgcccgcuggaagacccaccaccuccagugcguccgcaagcgccuccuccaccgccaguccacccagcuccucgcccagcgccucucccgcaccugcuuccgccaguggcgccagcagcucgccgcccgccgccaggagcagcgcgccaccguccgcgcccucugguucugggccuucucccuccaggccaaggucugggccaccuggcucgccuucguccucgagcgccgccgcaagaaggcccgccuccagugggcccuccaggccuaccagggccagcuccuccaggagggcgccacccgccuccuccgcuucgccgccuccaugaaggccucccgccagcagcuccaggcccagcagcagguccaggccgcccacucccuccaccgcgccguccgccgcugcgccacccucuggaagcagaagguccucggccgcggcggcaagccccagccccucgccgccaucgcccccucccgcaaggucaccuucgagggcccccuccucaaccgcaucgccgccggcgccggcgacggcacccucgagaccaagcgcccccaggccucccgcccccucggcgcccucggccgccucgccgccgaggagccccacgcccucgagcucaacaccgcccacuccgcccgcaagcagccccgccgcccccacuuccuccucgagcccgcccagucccagcgcccccagaagccccaggagcacggccucggcauggcccagcccgccgcccccucccucacccgccccuuccucgccgaggcccccaccgcccucgucccccacuccccccuccccggcgcccucuccuccgcccccggccccaagcagccccccaccgccuccaccggccccgagcuccuccuccucccccucuccuccuucaugcccugcggcgccgccgcccccgcccgcgucuccgcccagcgcgccaccccccgcgacaagccccccguccccuccucccucgccuccguccccgacccccaccuccuccuccccggcgacuucuccgccacccgcgccggccccggccucuccaccgccggcucccucgaccucgaggccgagcucgaggagauccagcagcagcuccuccacuaccagaccaccaagcagaaccucugguccugccgccgccaggccuccucccuccgccgcuggcucgagcucaaccgcgaggagcccggccccgaggaccaggaggucgagcagcagguccagaaggagcucgagcaggucgagaugcagauccagcuccucgccgaggagcuccaggcccagcgccagcccaucggcgccugcgucgcccgcauccaggcccuccgccaggcccucugcuga

SEQ ID NO: 49339 - RNA, 2601 nt, Artificial Sequence
  derived and/or modified sequence opt2 from SFMBT1__Homo_sapiens__NP_057413
augaacggcgagcagcagcucgacgccgacgccggcuccggcauggaggaggucgagcucuccugggaggacuaccucgaggagaccggcuccaccgccguccccuacggcuccuucaagcacgucgacacccgccuccagaacggcuucgcccccggcaugaagcucgaggucgccguccgcaccgaccccgagaccuacugggucgccaccgucaucaccaccugcgagcagcuccuccuccuccgcuacgacggcuacggcgaggaccgccgcgccgacuucuggugcgacauccgcaaggccgaccucuaccccaucggcuggugcgagcagaacaagaagacccucgaggcccccgagggcauccgcgacaaggucuccgacugggacgaguuccuccgccagacccucaucggcgccugcuccccccccgucccccuccucgagggccuccgcaacggccgcaacccccucgaccucaucgcccccggcucccgccucgagugccaggccuuccaggacucccucuccaccuggaucgucaccgucgucgagaacaucggcggccgccucaagcuccgcuacgagggccucgaguccuccgacaacuacgagcacuggcucuacuaccucgaccccuuccuccaccacgucggcugggccgcccagcagggcuacgagcuccagccccccuccgccauccgccaccucaagaacgaggccgaguggcaggagauccucgccaaggucaaggaggaggaggaggagccccuccccuccuaccucuucaaggacaagcaggucaucggcauccacaccuucuccgucaacaugaagcucgaggccgucgaccccuggucccccuucggcaucucccccgccaccgucgucaaggucuucgacgagaaguacuuccucgucgagauggacgaccuccgccccgagaaccacgcccgccgcuccuucgucugccacgccgacucccccggcaucuuccccguccaguggucccucaagaacggccuccacaucucccccccccccggcuaccccucccaggacuucgacugggccgacuaccucaagcagugcggcgccgaggccgccccccagcgcugcuuccccccccucaucuccgagcacgaguucaaggagaacaugaagcucgaggccgucaaccccauccuccccgaggaggucugcgucgccaccaucaccgccguccgcggcuccuaccucuggcuccagcucgagggcuccaagaagcccauccccgagugcaucgucuccgucgaguccauggacaucuucccccucggcuggugcgagaccaacggccacccccucuccaccccccgccgcgcccgcgucuacaagcagcgcaagaucgccgucguccagcccgagaagcagguccccuccucccgcaccguccacgagggccuccgcaaccaggagcucaacuccaccgaguccgucaugaucaacggcaaguacugcugccccaagaucuacuucaaccaccgcugcuucuccggccccuaccucaacaagggccgcaucgccgagcucccccagugcgucggccccggcaacugcguccucguccuccgcgagguccucacccuccucaucaacgccgccuacaagcccucccgcguccuccgcgagcuccagcucgacaaggacuccgucuggcacggcugcggcgagguccucaaggccaaguacaagggcaaguccuaccgcgccaccgucgagaucgucaagaccgccgaccgcgucaccgaguucugccgccagaccugcaucaagcucgagugcugccccaaccucuucggcccccgcaugguccucgacaagugcuccgagaacugcuccguccucaccaagaccaaguacacccacuacuacggcaagaagaagaacaagcgcaucggccgcccccccggcggccacuccaaccucgccugcgcccucaagaaggccuccaagcgccgcaagcgccgcaagaacgucuucguccacaagaagaagcgcuccuccgccuccgucgacaacacccccgccggcuccccccagggcuccggcggcgaggacgaggacgaccccgacgagggcgacgacgacucccucuccgagggcuccaccuccgagcagcaggacgagcuccaggaggaguccgagauguccgagaagaaguccugcuccuccucccccacccaguccgagaucuccaccucccucccccccgaccgccagcgccgcaagcgcgagcuccgcaccuucuccuucuccgacgacgagaacaagccccccucccccaaggagauccgcaucgaggucgccgagcgccuccaccucgacuccaacccccucaagugguccgucgccgacgucguccgcuucauccgcuccaccgacugcgccccccucgcccgcaucuuccucgaccaggagaucgacggccaggcccuccuccuccucacccuccccaccguccaggagugcauggaccucaagcucggccccgccaucaagcucugccaccacaucgagcgcaucaaguucgccuucuacgagcaguucgccaacuga

SEQ ID NO: 49340 - RNA, 2685 nt, Artificial Sequence
  derived and/or modified sequence opt2 from SFMBT2__Homo_sapiens__NP_001018049
auggaguccacccucuccgccuccaacaugcaggaccccuccuccuccccccucgagaagugccucggcuccgccaacggcaacggcgaccucgacuccgaggagggcuccucccucgaggagaccggcuucaacuggggcgaguaccucgaggagaccggcgccuccgccgccccccacaccuccuucaagcacgucgagaucuccauccaguccaacuuccagcccggcaugaagcucgaggucgccaacaagaacaaccccgacaccuacugggucgccaccaucaucaccaccugcggccagcuccuccuccuccgcuacugcggcuacggcgaggaccgccgcgccgacuucuggugcgacgucgucaucgccgaccuccaccccgucggcuggugcacccagaacaacaagguccucaugccccccgacgccaucaaggagaaguacaccgacuggaccgaguuccucauccgcgaccucaccggcucccgcaccgcccccgccaaccuccucgagggcccccuccgcggcaagggccccaucgaccucaucaccgucggcucccucaucgagcuccaggacucccagaaccccuuccaguacuggaucgucuccgucaucgagaacgucggcggccgccuccgccuccgcuacgucggccucgaggacaccgaguccuacgaccaguggcucuucuaccucgacuaccgccuccgccccgucggcuggugccaggagaacaaguaccgcauggacccccccuccgagaucuacccccucaagauggccuccgaguggaagugcacccucgagaagucccucaucgacgccgccaaguucccccuccccauggaggucuucaaggaccacgccgaccuccgcucccacuucuucaccgucggcaugaagcucgagaccgucaacaugugcgagcccuucuacaucucccccgccuccgucaccaaggucuucaacaaccacuucuuccaggucaccaucgacgaccuccgccccgagcccuccaagcucuccaugcucugccacgccgacucccucggcauccuccccguccaguggugccucaagaacggcgucucccucaccccccccaagggcuacuccggccaggacuucgacugggccgacuaccacaagcagcacggcgcccaggaggccccccccuucugcuuccgcaacaccuccuucucccgcggcuucaccaagaacaugaagcucgaggccgucaacccccgcaaccccggcgagcucugcgucgccuccgucgucuccgucaagggccgccucauguggcuccaccucgagggccuccagacccccguccccgaggucaucgucgacgucgaguccauggacaucuuccccgucggcuggugcgaggccaacuccuacccccucaccgccccccacaagaccgucucccagaagaagcgcaagaucgccgucguccagcccgagaagcagcucccccccaccguccccgucaagaagaucccccacgaccucugccucuucccccaccucgacaccaccggcaccgucaacggcaaguacugcugcccccagcucuucaucaaccaccgcugcuucuccggccccuaccucaacaagggccgcaucgccgagcucccccaguccgucggccccggcaagugcguccucguccucaaggagguccucuccaugaucaucaacgccgccuacaagcccggccgcguccuccgcgagcuccagcucgucgaggacccccacuggaacuuccaggaggagacccucaaggccaaguaccgcggcaagaccuaccgcgccgucgucaagaucguccgcaccuccgaccaggucgccaacuucugccgccgcgucugcgccaagcucgagugcugccccaaccucuucucccccguccucaucuccgagaacugccccgagaacugcuccauccacaccaagaccaaguacaccuacuacuacggcaagcgcaagaagaucuccaagccccccaucggcgaguccaaccccgacuccggccaccccaagcccgcccgccgccgcaagcgccgcaaguccaucuucguccagaagaagcgccgcuccuccgccgucgacuucaccgccggcuccggcgaggaguccgaggaggaggacgccgacgccauggacgacgacaccgccuccgaggagaccggcuccgagcuccgcgacgaccagaccgacaccuccuccgccgagguccccuccgcccgcccccgccgcgccgucacccuccgcuccggcuccgagcccguccgccgccccccccccgagcgcacccgccgcggccgcggcgcccccgccgccuccuccgccgaggagggcgagaagugcccccccaccaagcccgagggcaccgaggacaccaagcaggaggaggaggagcgccucguccucgaguccaacccccucgaguggaccgucaccgacgucguccgcuucaucaagcucaccgacugcgccccccucgccaagaucuuccaggagcaggacaucgacggccaggcccuccuccuccucacccuccccaccguccaggagugcauggagcucaagcucggccccgccaucaagcucugccaccagaucgagcgcgucaaggucgccuucuacgcccaguacgccaacuga

SEQ ID NO: 49341 - RNA, 738 nt, Artificial Sequence
  derived and/or modified sequence opt2 from SFR1__Homo_sapiens__NP_001002759
auggccgagggcgagaagaaccaggacuucaccuucaagauggagucccccuccgacuccgccgucguccuccccuccaccccccaggccuccgccaaccccuccucccccuacaccaacuccucccgcaagcagcccauguccgccacccuccgcgagcgccuccgcaagacccgcuucuccuucaacuccuccuacaacgucgucaagcgccucaaggucgaguccgaggagaacgaccagaccuucuccgagaagcccgccuccuccaccgaggagaacugccucgaguuccaggaguccuucaagcacaucgacuccgaguucgaggagaacaccaaccucaagaacacccucaagaaccucaacgucugcgagucccagucccucgacuccggcuccugcuccgcccuccagaacgaguucgucuccgagaagcuccccaagcagcgccucaacgccgagaaggccaagcucgucaagcagguccaggagaaggaggaccuccuccgccgccucaagcucgucaagauguaccgcuccaagaacgaccucucccagcuccagcuccucaucaagaaguggcgcuccugcucccagcuccuccucuacgagcuccaguccgccgucuccgaggagaacaagaagcucucccucacccagcucaucgaccacuacggccucgacgacaagcuccuccacuacaaccgcuccgaggaggaguucaucgacgucuga

SEQ ID NO: 49342 - RNA, 945 nt, Artificial Sequence
  derived and/or modified sequence opt2 from SFRP1__Homo_sapiens__NP_003003
augggcaucggccgcuccgagggcggccgccgcggcgccgcccucggcguccuccucgcccucggcgccgcccuccucgccgucggcuccgccuccgaguacgacuacgucuccuuccaguccgacaucggccccuaccaguccggccgcuucuacaccaagcccccccagugcgucgacauccccgccgaccuccgccucugccacaacgucggcuacaagaagaugguccuccccaaccuccucgagcacgagaccauggccgaggucaagcagcaggccuccuccugggucccccuccucaacaagaacugccacgccggcacccaggucuuccucugcucccucuucgcccccgucugccucgaccgccccaucuaccccugccgcuggcucugcgaggccguccgcgacuccugcgagcccgucaugcaguucuucggcuucuacuggcccgagaugcucaagugcgacaaguuccccgagggcgacgucugcaucgccaugaccccccccaacgccaccgaggccuccaagccccagggcaccaccgucugcccccccugcgacaacgagcucaaguccgaggccaucaucgagcaccucugcgccuccgaguucgcccuccgcaugaagaucaaggaggucaagaaggagaacggcgacaagaagaucguccccaagaagaagaagccccucaagcucggccccaucaagaagaaggaccucaagaagcucguccucuaccucaagaacggcgccgacugccccugccaccagcucgacaaccucucccaccacuuccucaucaugggccgcaaggucaagucccaguaccuccucaccgccauccacaagugggacaagaagaacaaggaguucaagaacuucaugaagaagaugaagaaccacgagugccccaccuuccaguccgucuucaaguga

SEQ ID NO: 49343 - RNA, 888 nt, Artificial Sequence
  derived and/or modified sequence opt2 from SFRP2__Homo_sapiens__NP_003004
augcuccagggccccggcucccuccuccuccucuuccucgccucccacugcugccucggcuccgcccgcggccucuuccucuucggccagcccgacuucuccuacaagcgcuccaacugcaagcccauccccgccaaccuccagcucugccacggcaucgaguaccagaacaugcgccuccccaaccuccucggccacgagaccaugaaggagguccucgagcaggccggcgccuggaucccccucgucaugaagcagugccaccccgacaccaagaaguuccucugcucccucuucgcccccgucugccucgacgaccucgacgagaccauccagcccugccacucccucugcguccaggucaaggaccgcugcgcccccgucauguccgccuucggcuuccccuggcccgacaugcucgagugcgaccgcuucccccaggacaacgaccucugcaucccccucgccuccuccgaccaccuccuccccgccaccgaggaggcccccaaggucugcgaggccugcaagaacaagaacgacgacgacaacgacaucauggagacccucugcaagaacgacuucgcccucaagaucaaggucaaggagaucaccuacaucaaccgcgacaccaagaucauccucgagaccaaguccaagaccaucuacaagcucaacggcgucuccgagcgcgaccucaagaaguccguccucuggcucaaggacucccuccagugcaccugcgaggagaugaacgacaucaacgcccccuaccucgucaugggccagaagcagggcggcgagcucgucaucaccuccgucaagcgcuggcagaagggccagcgcgaguucaagcgcaucucccgcuccauccgcaagcuccagugcuga

SEQ ID NO: 49344 - RNA, 1041 nt, Artificial Sequence
  derived and/or modified sequence opt2 from SFRP4__Homo_sapiens__NP_003005
auguuccucuccauccucgucgcccucugccucuggcuccaccucgcccucggcguccgcggcgcccccugcgaggccguccgcauccccaugugccgccacaugcccuggaacaucacccgcaugcccaaccaccuccaccacuccacccaggagaacgccauccucgccaucgagcaguacgaggagcucgucgacgucaacugcuccgccguccuccgcuucuuccucugcgccauguacgcccccaucugcacccucgaguuccuccacgaccccaucaagcccugcaaguccgucugccagcgcgcccgcgacgacugcgagccccucaugaagauguacaaccacuccuggcccgagucccucgccugcgacgagcuccccgucuacgaccgcggcgucugcaucucccccgaggccaucgucaccgaccuccccgaggacgucaaguggaucgacaucacccccgacaugaugguccaggagcgcccccucgacgucgacugcaagcgccucucccccgaccgcugcaagugcaagaaggucaagcccacccucgccaccuaccucuccaagaacuacuccuacgucauccacgccaagaucaaggccguccagcgcuccggcugcaacgaggucaccaccgucgucgacgucaaggagaucuucaaguccuccucccccaucccccgcacccaggucccccucaucaccaacuccuccugccagugcccccacauccucccccaccaggacguccucaucaugugcuacgaguggcgcucccgcaugaugcuccucgagaacugccucgucgagaaguggcgcgaccagcucuccaagcgcuccauccagugggaggagcgccuccaggagcagcgccgcaccguccaggacaagaagaagaccgccggccgcaccucccgcuccaacccccccaagcccaagggcaagccccccgcccccaagcccgccucccccaagaagaacaucaagacccgcuccgcccagaagcgcaccaaccccaagcgcgucuga

SEQ ID NO: 49345 - RNA, 954 nt, Artificial Sequence
  derived and/or modified sequence opt2 from SFRP5__Homo_sapiens__NP_003006
augcgcgccgccgccgccggcggcggcguccgcaccgccgcccucgcccuccuccucggcgcccuccacugggcccccgcccgcugcgaggaguacgacuacuacggcuggcaggccgagccccuccacggccgcuccuacuccaagcccccccagugccucgacauccccgccgaccucccccucugccacaccgucggcuacaagcgcaugcgccuccccaaccuccucgagcacgagucccucgccgaggucaagcagcaggccuccuccuggcucccccuccucgccaagcgcugccacuccgacacccaggucuuccucugcucccucuucgcccccgucugccucgaccgccccaucuaccccugccgcucccucugcgaggccguccgcgccggcugcgccccccucauggaggccuacggcuuccccuggcccgagaugcuccacugccacaaguucccccucgacaacgaccucugcaucgccguccaguucggccaccuccccgccaccgccccccccgucaccaagaucugcgcccagugcgagauggagcacuccgccgacggccucauggagcagaugugcuccuccgacuucgucgucaagaugcgcaucaaggagaucaagaucgagaacggcgaccgcaagcucaucggcgcccagaagaagaagaagcuccucaagcccggcccccucaagcgcaaggacaccaagcgccucguccuccacaugaagaacggcgccggcugccccugcccccagcucgacucccucgccggcuccuuccucgucaugggccgcaaggucgacggccagcuccuccucauggccgucuaccgcugggacaagaagaacaaggagaugaaguucgccgucaaguucauguucuccuaccccugcucccucuacuaccccuucuucuacggcgccgccgagccccacuga

SEQ ID NO: 49346 - RNA, 3012 nt, Artificial Sequence
  derived and/or modified sequence opt2 from SFSWAP__Homo_sapiens__NP_001248340
auguacggcgccuccggcggccgcgccaagcccgagcgcaaguccggcgccaaggaggaggccggccccggcggcgccggcggcggcggcucccgcgucgagcuccucgucuucggcuacgccugcaagcucuuccgcgacgacgagcgcgcccucgcccaggagcagggccagcaccucauccccuggaugggcgaccacaagauccucaucgaccgcuacgacggccgcggccaccuccacgaccucuccgaguacgacgccgaguacuccaccuggaaccgcgacuaccagcucuccgaggaggaggcccgcaucgaggcccucugcgacgaggagcgcuaccucgcccuccacaccgaccuccucgaggaggaggcccgccaggaggaggaguacaagcgccucuccgaggcccucgccgaggacggcuccuacaacgccgucggcuucaccuacggcuccgacuacuacgaccccuccgagcccaccgaggaggaggagcccuccaagcagcgcgagaagaacgaggccgagaaccucgaggagaacgaggagcccuucgucgccccccucggccucuccguccccuccgacgucgagcucccccccaccgccaagaugcacgccaucaucgagcgcaccgccuccuucgucugccgccagggcgcccaguucgagaucaugcucaaggccaagcaggcccgcaacucccaguucgacuuccuccgcuucgaccacuaccucaaccccuacuacaaguucauccagaaggccaugaaggagggccgcuacaccguccucgccgagaacaaguccgacgagaagaagaaguccggcgucuccuccgacaacgaggacgacgacgacgaggaggacggcaacuaccuccaccccucccucuucgccuccaagaagugcaaccgccucgaggagcucaugaagccccucaaggucgucgaccccgaccacccccucgccgcccucguccgcaaggcccaggccgacuccuccacccccaccccccacaacgccgacggcgcccccguccagcccucccaggucgaguacaccgccgacuccaccgucgccgccauguacuacuccuacuacaugcuccccgacggcaccuacugccucgccccccccccccccggcaucgacgucaccaccuacuacuccacccuccccgccggcgucaccgucuccaacucccccggcgucaccaccaccgccccccccccccccggcaccaccccccuccccccccccaccaccgccgagaccuccuccggcgccaccuccaccaccaccaccaccuccgcccucgcccccgucgccgccaucaucccccccccccccgacguccagcccgucaucgacaagcucgccgaguacgucgcccgcaacggccucaaguucgagaccuccguccgcgccaagaacgaccagcgcuucgaguuccuccagcccuggcaccaguacaacgccuacuacgaguucaagaagcaguucuuccuccagaaggagggcggcgacuccaugcaggccgucuccgcccccgaggaggcccccaccgacuccgcccccgagaagcccuccgacgccggcgaggacggcgcccccgaggacgccgccgaggucggcgcccgcgccggcuccggcggcaagaaggaggccuccuccuccaagaccguccccgacggcaagcucgucaaggccuccuucgcccccaucuccuucgccaucaaggccaaggagaacgaccuccucccccucgagaagaaccgcgucaagcucgacgacgacuccgacgacgacgaggaguccaaggagggccaggaguccuccuccuccgccgccaacaccaaccccgccgucgccccccccugcgucgucgucgaggagaagaagccccagcucacccaggaggagcucgaggccaagcaggccaagcagaagcucgaggaccgccucgccgccgccgcccgcgagaagcucgcccaggccuccaaggaguccaaggagaagcagcuccaggccgagcgcaagcgcaaggccgcccucuuccuccagacccucaagaacccccuccccgaggccgaggccggcaagaucgaggagucccccuucuccgucgaggaguccuccaccacccccugcccccuccucaccggcggccgcccccuccccacccucgaggucaagccccccgaccgccccuccuccaaguccaaggaccccccccgcgaggaggagaaggagaagaagaagaagaagcacaagaagcgcucccgcacccgcucccgcucccccaaguaccacuccuccuccaagucccgcucccgcucccacuccaaggccaagcacucccuccccuccgccuaccgcaccguccgccgcucccgcgucaccgccucccccggcacccuccgcgccgagcccugccaguccuccgccuccgucaccgccgccgccgagcccggcuccuaccaggccgccuccaccaccacccgcuucgacuccgccuccuccuucgagggcaagcccggcaagaccucccgcucccgcucccgcuccccccgccgccgcgcccacucccccgagcgccgccgcgaggagcgcuccguccccaccgccuaccgcgucucccgcucccccggcgccucccgcaagcgcacccgcucccgcuccccccacgagaagaagaagaagcgccgcucccgcucccgcaccaaguccaaggcccgcucccaguccgucucccccuccaagcaggccgccccccgccccgccgcccccgccgcccacuccgcccacuccgccuccgucucccccgucgagucccgcggcuccucccaggagcgcucccgcggcgucucccaggagaaggaggcccagaucuccuccgccaucgucuccuccguccaguccaagaucacccaggaccucauggccaagguccgcgccaugcucgccgccuccaagaaccuccagaccuccgccuccuga

SEQ ID NO: 49347 - RNA, 483 nt, Artificial Sequence
  derived and/or modified sequence opt2 from SFT2D2__Homo_sapiens__NP_955376
auggacaagcucaagaagguccucuccggccaggacaccgaggaccgcuccggccucuccgaggucgucgaggccuccucccucuccugguccacccgcaucaagggcuucaucgccugcuucgccaucggcauccucugcucccuccucggcaccguccuccucugggucccccgcaagggccuccaccucuucgccgucuucuacaccuucggcaacaucgccuccaucggcuccaccaucuuccucaugggccccgucaagcagcucaagcgcauguucgagcccacccgccucaucgccaccaucaugguccuccucugcuucgcccucacccucugcuccgccuucugguggcacaacaagggccucgcccucaucuucugcauccuccagucccucgcccucaccugguacucccucuccuucauccccuucgcccgcgacgccgucaagaagugcuucgccgucugccucgccuga

SEQ ID NO: 49348 - RNA, 648 nt, Artificial Sequence
  derived and/or modified sequence opt2 from SFT2D3__Homo_sapiens__NP_116129
auggccgaccuccaccgccagcuccaggaguaccucgcccagggcaaggccggcggccccgccgccgccgagccccuccucgccgccgagaaggccgaggagcccggcgaccgccccgccgaggaguggcucggccgcgccggccuccgcuggaccugggcccgcucccccgccgaguccgccgccgccggccucaccugccuccccuccgucacccgcggccagcgccucgccgccggcggcggcugccuccuccucgccgcccucugcuucggccucgccgcccucuacgcccccguccuccuccuccgcgcccgcaaguucgcccuccucuggucccucggcuccgcccucgcccucgccggcuccgcccuccuccgcggcggcgccgccugcggccgccuccuccgcugcgaggaggcccccucccgccccgcccuccucuacauggccgcccucggcgccacccucuucgccgcccucggccuccgcuccacccuccucaccguccucggcgccggcgcccaggucgccgcccuccucgccgcccucgucggccuccuccccuggggcggcggcaccgcccuccgccucgcccucggccgccucggccgcggcgccggccucgccaagguccuccccgucuga

SEQ ID NO: 49349 - RNA, 237 nt, Artificial Sequence
  derived and/or modified sequence opt2 from SFTA2__Homo_sapiens__NP_995326
augggcuccggccucccccucguccuccuccucacccuccucggcuccucccacggcaccggccccggcaugacccuccagcucaagcucaaggaguccuuccucaccaacuccuccuacgaguccuccuuccucgagcuccucgagaagcucugccuccuccuccaccuccccuccggcaccuccgucacccuccaccacgcccgcucccagcaccacgucgucugcaacaccuga

SEQ ID NO: 49350 - RNA, 285 nt, Artificial Sequence
  derived and/or modified sequence opt2 from SFTA3__Homo_sapiens__NP_001094811
augcgcgccggcuucuccgacuuccagcucauccgcgaccagguccucuuccuccaggaccaggcccagcgccucaccgaguggcuccagcucuccggcuucgagaaccccgucuccgaguccaccacccucugccuccgcgagcgcgagaagcgcauccccaccugcgucgccgucugcguccccucccccggcaccguccacaccgcccuccuccaccccaccacccucucccagucccgcuccuccuccgaggccaagaugcucaucauccacaccgccuga

SEQ ID NO: 49351 - RNA, 645 nt, Artificial Sequence
  derived and/or modified sequence opt2 from SFTPA1__Homo_sapiens__NP_001158117
augcgccccugccagguccccggcgccgccaccggcccccgcgccauguggcucugcccccucgcccucaaccucauccucauggccgccuccggcgccgucugcgaggucaaggacgucugcgucggcacccccggcauccccggcgagugcggcgagaagggcgagcccggcgagcgcggcccccccggccuccccgcccaccucgacgaggagcuccaggccacccuccacgacuuccgccaccagauccuccagacccgcggcgcccucucccuccagggcuccaucaugaccgucggcgagaaggucuucuccuccaacggccaguccaucaccuucgacgccauccaggaggccugcgcccgcgccggcggccgcaucgccgucccccgcaaccccgaggagaacgaggccaucgccuccuucgucaagaaguacaacaccuacgccuacgucggccucaccgagggccccucccccggcgacuuccgcuacuccgacggcacccccgucaacuacaccaacugguaccgcggcgagcccgccggccgcggcaaggagcagugcgucgagauguacaccgacggccaguggaacgaccgcaacugccucuacucccgccucaccaucugcgaguucuga

SEQ ID NO: 49352 - RNA, 798 nt, Artificial Sequence
  derived and/or modified sequence opt2 from SFTPA2__Homo_sapiens__XP_005270185
augcgcgaccgcugguccgaguccguccgcgccgccaccggcccccgcgccauguggcucugcccccucgcccucacccucauccucauggccgccuccggcgccgccugcgaggucaaggacgucugcgucggcucccccggcauccccggcacccccggcucccacggccuccccggccgcgacggccgcgacggcgucaagggcgaccccggcccccccggccccaugggcccccccggcgagacccccugcccccccggcaacaacggccuccccggcgcccccggcguccccggcgagcgcggcgagaagggcgaggccggcgagcgcggcccccccggccuccccgcccaccucgacgaggagcuccaggccacccuccacgacuuccgccaccagauccuccagacccgcggcgcccucucccuccagggcuccaucaugaccgucggcgagaaggucuucuccuccaacggccaguccaucaccuucgacgccauccaggaggccugcgcccgcgccggcggccgcaucgccgucccccgcaaccccgaggagaacgaggccaucgccuccuucgucaagaaguacaacaccuacgccuacgucggccucaccgagggccccucccccggcgacuuccgcuacuccgacggcacccccgucaacuacaccaacugguaccgcggcgagcccgccggccgcggcaaggagcagugcgucgagauguacaccgacggccaguggaacgaccgcaacugccucuacucccgccucaccaucugcgaguucuga

SEQ ID NO: 49353 - RNA, 1182 nt, Artificial Sequence
  derived and/or modified sequence opt2 from SFTPB__Homo_sapiens__XP_005264544
augcaccaggccggcuaccccggcugccgcggcgccauggccgagucccaccuccuccaguggcuccuccuccuccuccccacccucugcggccccggcaccgccgccuggaccaccuccucccucgccugcgcccagggccccgaguucuggugccagucccucgagcaggcccuccagugccgcgcccucggccacugccuccaggaggucuggggccacgucggcgccgacgaccucugccaggagugcgaggacaucguccacauccucaacaagauggccaaggaggccaucuuccaggacaccaugcgcaaguuccucgagcaggagugcaacguccucccccucaagcuccucaugccccagugcaaccagguccucgacgacuacuucccccucgucaucgacuacuuccagaaccagaccgacuccaacggcaucugcaugcaccucggccucugcaagucccgccagcccgagcccgagcaggagcccggcauguccgacccccuccccaagccccuccgcgacccccuccccgacccccuccucgacaagcucguccuccccguccuccccggcgcccuccaggcccgccccggcccccacacccaggaccucuccgagcagcaguuccccaucccccuccccuacugcuggcucugccgcgcccucaucaagcgcauccaggccaugauccccaagggcgcccucgccgucgccgucgcccaggucugccgcgucgucccccucgucgccggcggcaucugccagugccucgccgagcgcuacuccgucauccuccucgacacccuccucggccgcaugcucccccagcucgucugccgccucguccuccgcugcuccauggacgacuccgccggcccccgcucccccaccggcgaguggcucccccgcgacuccgagugccaccucugcauguccgucaccacccaggccggcaacuccuccgagcaggccaucccccaggccaugcuccaggccugcgucggcuccuggcucgaccgcgagaagugcaagcaguucgucgagcagcacaccccccagcuccucacccucgucccccgcggcugggacgcccacaccaccugccaggcccucggcgucugcggcaccauguccuccccccuccagugcauccacucccccgaccucuga

SEQ ID NO: 49354 - RNA, 576 nt, Artificial Sequence
  derived and/or modified sequence opt2 from SFTPC__Homo_sapiens__NP_001165828
auggacgucggcuccaaggagguccucauggaguccccccccgacuacuccgccgccccccgcggccgcuucggcauccccugcugccccguccaccucaagcgccuccucaucgucgucgucgucgucguccucaucgucgucgucaucgucggcgcccuccucaugggccuccacaugucccagaagcacaccgagaugguccucgagauguccaucggcgcccccgaggcccagcagcgccucgcccucuccgagcaccucgucaccaccgccaccuucuccaucggcuccaccggccucgucgucuacgacuaccagcagcuccucaucgccuacaagcccgcccccggcaccugcugcuacaucaugaagaucgcccccgaguccauccccucccucgaggcccucacccgcaagguccacaacuuccaggccaagcccgccguccccaccuccaagcucggccaggccgagggccgcgacgccggcuccgcccccuccggcggcgaccccgccuuccucggcauggccgucuccacccucugcggcgaggucccccucuacuacaucuga

SEQ ID NO: 49355 - RNA, 1128 nt, Artificial Sequence
  derived and/or modified sequence opt2 from SFTPD__Homo_sapiens__NP_003010
augcuccucuuccuccucuccgcccucguccuccucacccagccccucggcuaccucgaggccgagaugaagaccuacucccaccgcaccaugcccuccgccugcacccucgucaugugcuccuccgucgaguccggccuccccggccgcgacggccgcgacggccgcgagggcccccgcggcgagaagggcgaccccggccuccccggcgccgccggccaggccggcaugcccggccaggccggccccgucggccccaagggcgacaacggcuccgucggcgagcccggccccaagggcgacaccggccccuccggcccccccggcccccccggcguccccggccccgccggccgcgagggcccccucggcaagcagggcaacaucggcccccagggcaagcccggccccaagggcgaggccggccccaagggcgaggucggcgcccccggcaugcagggcuccgccggcgcccgcggccucgccggccccaagggcgagcgcggcguccccggcgagcgcggcguccccggcaacaccggcgccgccggcuccgccggcgccaugggcccccagggcucccccggcgcccgcggcccccccggccucaagggcgacaagggcauccccggcgacaagggcgccaagggcgaguccggccuccccgacgucgccucccuccgccagcaggucgaggcccuccagggccagguccagcaccuccaggccgccuucucccaguacaagaaggucgagcucuuccccaacggccaguccgucggcgagaagaucuucaagaccgccggcuucgucaagcccuucaccgaggcccagcuccucugcacccaggccggcggccagcucgccuccccccgcuccgccgccgagaacgccgcccuccagcagcucgucgucgccaagaacgaggccgccuuccucuccaugaccgacuccaagaccgagggcaaguucaccuaccccaccggcgagucccucgucuacuccaacugggcccccggcgagcccaacgacgacggcggcuccgaggacugcgucgagaucuucaccaacggcaaguggaacgaccgcgccugcggcgagaagcgccucgucgucugcgaguucuga

SEQ ID NO: 49356 - RNA, 969 nt, Artificial Sequence
  derived and/or modified sequence opt2 from SFXN1__Homo_sapiens__NP_073591
auguccggcgagcucccccccaacaucaacaucaaggagccccgcugggaccaguccaccuucaucggccgcgccaaccacuucuucaccgucaccgacccccgcaacauccuccucaccaacgagcagcucgaguccgcccgcaagaucguccacgacuaccgccagggcaucgucccccccggccucaccgagaacgagcucuggcgcgccaaguacaucuacgacuccgccuuccaccccgacaccggcgagaagaugauccucaucggccgcauguccgcccagguccccaugaacaugaccaucaccggcugcaugaugaccuucuaccgcaccacccccgccguccucuucuggcaguggaucaaccaguccuucaacgccgucgucaacuacaccaaccgcuccggcgacgccccccucaccgucaacgagcucggcaccgccuacgucuccgccaccaccggcgccgucgccaccgcccucggccucaacgcccucaccaagcacgucuccccccucaucggccgcuucguccccuucgccgccgucgccgccgccaacugcaucaacaucccccucaugcgccagcgcgagcucaaggucggcauccccgucaccgacgagaacggcaaccgccucggcgaguccgccaacgccgccaagcaggccaucacccaggucgucgucucccgcauccucauggccgcccccggcauggccaucccccccuucaucaugaacacccucgagaagaaggccuuccucaagcgcuuccccuggauguccgcccccauccaggucggccucgucggcuucugccucgucuucgccaccccccucugcugcgcccucuucccccagaaguccuccauguccgucaccucccucgaggccgagcuccaggccaagauccaggagucccaccccgagcuccgccgcgucuacuucaacaagggccucuga

SEQ ID NO: 49357 - RNA, 969 nt, Artificial Sequence
  derived and/or modified sequence opt2 from SFXN2__Homo_sapiens__NP_849189
auggaggccgaccucuccggcuucaacaucgacgccccccgcugggaccagcgcaccuuccucggccgcgucaagcacuuccucaacaucaccgacccccgcaccgucuucgucuccgagcgcgagcucgacugggccaaggucauggucgagaagucccgcaugggcgucgucccccccggcacccaggucgagcagcuccucuacgccaagaagcucuacgacuccgccuuccaccccgacaccggcgagaagaugaacgucaucggccgcauguccuuccagcuccccggcggcaugaucaucaccggcuucaugcuccaguucuaccgcaccaugcccgccgucaucuucuggcagugggucaaccaguccuucaacgcccucgucaacuacaccaaccgcaacgccgccucccccaccuccguccgccagauggcccucuccuacuucaccgccaccaccaccgccgucgccaccgccgucggcaugaacaugcucaccaagaaggcccccccccucgucggccgcuggguccccuucgccgccgucgccgccgccaacugcgucaacauccccaugaugcgccagcaggagcucaucaagggcaucugcgucaaggaccgcaacgagaacgagaucggccacucccgccgcgccgccgccaucggcaucacccaggucgucaucucccgcaucaccauguccgcccccggcaugauccuccuccccgucaucauggagcgccucgagaagcuccacuucaugcagaaggucaagguccuccacgccccccuccaggucaugcucuccggcugcuuccucaucuucaugguccccgucgccugcggccucuucccccagaagugcgagcuccccgucuccuaccucgagcccaagcuccaggacaccaucaaggccaaguacggcgagcucgagcccuacgucuacuucaacaagggccucuga

SEQ ID NO: 49358 - RNA, 1014 nt, Artificial Sequence
  derived and/or modified sequence opt2 from SFXN4__Homo_sapiens__NP_998814
augucccucgagcaggaggaggagacccagcccggccgccuccucggccgccgcgacgccguccccgccuucaucgagcccaacguccgcuucuggaucaccgagcgccaguccuucauccgccgcuuccuccaguggaccgagcuccucgaccccaccaacgucuucaucuccgucgaguccaucgagaacucccgccagcuccucugcaccaacgaggacgucuccucccccgccuccgccgaccagcgcauccaggaggccuggaagcgcucccucgccaccguccaccccgacuccuccaaccucauccccaagcucuuccgccccgccgccuuccuccccuucauggcccccaccgucuuccucuccaugaccccccucaagggcaucaaguccgucauccucccccaggucuuccucugcgccuacauggccgccuucaacuccaucaacggcaaccgcuccuacaccugcaagccccucgagcgcucccuccucauggccggcgccgucgccuccuccaccuuccucggcgucaucccccaguucguccagaugaaguacggccucaccggccccuggaucaagcgccuccuccccgucaucuuccucguccaggccuccggcaugaacgucuacaugucccgcucccucgaguccaucaagggcaucgccgucauggacaaggagggcaacguccucggccacucccgcaucgccggcaccaaggccguccgcgagacccucgccucccgcaucguccucuucggcaccuccgcccucauccccgaggucuucaccuacuucuucaagcgcacccaguacuuccgcaagaaccccggcucccucuggauccucaagcucuccugcaccguccucgccaugggccucaugguccccuucuccuucuccaucuucccccagaucggccagauccaguacugcucccucgaggagaagauccagucccccaccgaggagaccgagaucuucuaccaccgcggcgucuga

SEQ ID NO: 49359 - RNA, 1164 nt, Artificial Sequence
  derived and/or modified sequence opt2 from SGCA__Homo_sapiens__NP_000014
auggccgagacccucuucuggaccccccuccucgucguccuccucgccggccucggcgacaccgaggcccagcagaccacccuccacccccucgucggccgcgucuucguccacacccucgaccacgagaccuuccucucccuccccgagcacgucgccgucccccccgccguccacaucaccuaccacgcccaccuccagggccaccccgaccucccccgcuggcuccgcuacacccagcgcuccccccaccaccccggcuuccucuacggcuccgccacccccgaggaccgcggccuccaggucaucgaggucaccgccuacaaccgcgacuccuucgacaccacccgccagcgccucguccucgagaucggcgaccccgagggcccccuccuccccuaccaggccgaguuccucguccgcucccacgacgccgaggagguccuccccuccacccccgccucccgcuuccucuccgcccucggcggccucugggagcccggcgagcuccagcuccucaacgucaccuccgcccucgaccgcggcggccgcgucccccuccccaucgagggccgcaaggagggcgucuacaucaaggucggcuccgccucccccuucuccaccugccucaagauggucgccucccccgacucccacgcccgcugcgcccagggccagcccccccuccucuccugcuacgacacccucgccccccacuuccgcgucgacuggugcaacgucacccucgucgacaaguccguccccgagcccgccgacgagguccccacccccggcgacggcauccucgagcacgaccccuucuucugcccccccaccgaggcccccgaccgcgacuuccucgucgacgcccucgucacccuccucgucccccuccucgucgcccuccuccucacccuccuccucgccuacgucaugugcugccgccgcgagggccgccucaagcgcgaccucgccaccuccgacauccagaugguccaccacugcaccauccacggcaacaccgaggagcuccgccagauggccgccucccgcgaggucccccgcccccucuccacccuccccauguucaacguccacaccggcgagcgccuccccccccgcgucgacuccgcccaggucccccucauccucgaccagcacuga

SEQ ID NO: 49360 - RNA, 957 nt, Artificial Sequence
  derived and/or modified sequence opt2 from SGCB__Homo_sapiens__NP_000223
auggccgccgccgccgccgccgccgccgagcagcaguccuccaacggccccgucaagaaguccaugcgcgagaaggccgucgagcgccgcuccgucaacaaggagcacaacuccaacuucaaggccggcuacauccccaucgacgaggaccgccuccacaagaccggccuccgcggccgcaagggcaaccucgccaucugcgucaucauccuccucuucauccucgccgucaucaaccucaucaucacccucgucaucugggccgucauccgcaucggccccaacggcugcgacuccauggaguuccacgaguccggccuccuccgcuucaagcaggucuccgacaugggcgucauccacccccucuacaaguccaccgucggcggccgccgcaacgagaaccucgucaucaccggcaacaaccagcccaucgucuuccagcagggcaccaccaagcucuccgucgagaacaacaagaccuccaucaccuccgacaucggcaugcaguucuucgacccccgcacccagaacauccucuucuccaccgacuacgagacccacgaguuccaccuccccuccggcgucaagucccucaacguccagaaggccuccaccgagcgcaucaccuccaacgccaccuccgaccucaacaucaaggucgacggccgcgccaucguccgcggcaacgagggcgucuucaucaugggcaagaccaucgaguuccacaugggcggcaacauggagcucaaggccgagaacuccaucauccucaacggcuccgucauggucuccaccacccgccuccccuccuccuccuccggcgaccagcucggcuccggcgacuggguccgcuacaagcucugcaugugcgccgacggcacccucuucaagguccaggucaccucccagaacaugggcugccagaucuccgacaaccccugcggcaacacccacuga

SEQ ID NO: 49361 - RNA, 771 nt, Artificial Sequence
  derived and/or modified sequence opt2 from SGCD__Homo_sapiens__NP_758447
augaugccccaggagcaguacacccaccaccgcuccaccaugcccggcuccgucggcccccaggucuacaaggucggcaucuacggcuggcgcaagcgcugccucuacuucuucguccuccuccucaugauccucauccucgucaaccucgccaugaccaucuggauccucaaggucaugaacuucaccaucgacggcaugggcaaccuccgcaucaccgagaagggccucaagcucgagggcgacuccgaguuccuccagccccucuacgccaaggagauccagucccgccccggcaacgcccucuacuucaaguccgcccgcaacgucaccgucaacauccucaacgaccagaccaagguccucacccagcucaucaccggccccaaggccgucgaggccuacggcaagaaguucgaggucaagaccgucuccggcaagcuccucuucuccgccgacaacaacgaggucgucgucggcgccgagcgccuccgcguccucggcgccgagggcaccgucuuccccaaguccaucgagacccccaacguccgcgccgaccccuucaaggagcuccgccucgagucccccacccgcucccucgucauggaggcccccaagggcgucgagaucaacgccgaggccggcaacauggaggccaccugccgcaccgagcuccgccucgaguccaaggacggcgagguccgcgacgagaaggaccgcuccuccaaguccuacuccuucaaccgccccacccuccccaucaccggcuga

SEQ ID NO: 49362 - RNA, 1356 nt, Artificial Sequence
  derived and/or modified sequence opt2 from SGCE__Homo_sapiens__NP_001092870
augcagcucccccgcuggugggagcucggcgaccccugcgccuggaccggccagggccgcggcacccgccgcaugucccccgccaccaccggcaccuuccuccucaccgucuacuccaucuucuccaagguccacuccgaccgcaacgucuaccccuccgccggcguccucuucguccacguccucgagcgcgaguacuucaagggcgaguucccccccuaccccaagcccggcgagaucuccaacgaccccaucaccuucaacaccaaccucaugggcuaccccgaccgccccggcuggcuccgcuacauccagcgcacccccuacuccgacggcguccucuacggcucccccaccgccgagaacgucggcaagcccaccaucaucgagaucaccgccuacaaccgccgcaccuucgagaccgcccgccacaaccucaucaucaacaucauguccgccgaggacuucccccuccccuaccaggccgaguucuucaucaagaacaugaacgucgaggagaugcucgccuccgagguccucggcgacuuccucggcgccgucaagaacgucuggcagcccgagcgccucaacgccaucaacaucaccuccgcccucgaccgcggcggccgcgucccccuccccaucaacgaccucaaggagggcgucuacgucauggucggcgccgacguccccuucuccuccugccuccgcgaggucgagaacccccagaaccagcuccgcugcucccaggagauggagcccgucaucaccugcgacaagaaguuccgcacccaguucuacaucgacuggugcaagaucucccucgucgacaagaccaagcaggucuccaccuaccaggaggucauccgcggcgagggcauccuccccgacggcggcgaguacaagccccccuccgacucccucaagucccgcgacuacuacaccgacuuccucaucacccucgccguccccuccgccgucgcccucguccucuuccucauccucgccuacaucaugugcugccgccgcgagggcgucauccagcucguccaccacuccgccauccagaaguccaccaaggagcuccgcgacauguccaagaaccgcgagaucgccuggccccucuccacccuccccgucuuccaccccgucaccggcgagaucauccccccccuccacaccgacaacuacgacuccaccaacaugccccucaugcagacccagcagaaccucccccaccagacccagaucccccagcagcagaccaccggcgacuuccgccucaccaccuuccagcgcuucgaggucaacggcauccccgaggagcgcaagcucaccgaggccaugaaccucuga

SEQ ID NO: 49363 - RNA, 876 nt, Artificial Sequence
  derived and/or modified sequence opt2 from SGCG__Homo_sapiens__XP_005266562
augguccgcgagcaguacaccaccgccaccgagggcaucugcaucgagcgccccgagaaccaguacgucuacaagaucggcaucuacggcuggcgcaagcgcugccucuaccucuucguccuccuccuccucaucauccucgucgucaaccucgcccucaccaucuggauccucaaggucaugugguucucccccgccggcaugggccaccucugcgucaccaaggacggccuccgccucgagggcgaguccgaguuccucuucccccucuacgccaaggagauccacucccgcgucgacuccucccuccuccuccaguccacccagaacgucaccgucaacgcccgcaacuccgagggcgaggucaccggccgccucaaggucggccccaagauggucgagguccagaaccagcaguuccagaucaacuccaacgacggcaagccccucuucaccgucgacgagaaggaggucgucgucggcaccgacaagcuccgcgucaccggccccgagggcgcccucuucgagcacuccgucgagaccccccucguccgcgccgaccccuuccaggaccuccgccucgagucccccacccgcucccucuccauggacgccccccgcggcguccacauccaggcccacgccggcaagaucgaggcccucucccagauggacauccucuuccacuccuccgacggcaugcucguccucgacgccgagaccgucugccuccccaagcucguccagggcaccuggggccccuccggcuccucccagucccucuacgagaucugcgucugccccgacggcaagcucuaccucuccgucgccggcgucuccaccaccugccaggagcacaaccacaucugccucuga

SEQ ID NO: 49364 - RNA, 939 nt, Artificial Sequence
  derived and/or modified sequence opt2 from SGCZ__Homo_sapiens__NP_631906
auggaccgcuccaccaaccucgacaucgaggagcucaagaugacccgcgagcaguacauccucgccacccagcagaacaaccucccccgcaccgagaacgcccagcucuaccccgucggcaucuacggcuggcgcaagcgcugccucuacuucuucguccuccuccuccucgucaccaugaucgucaaccucgccaugaccaucuggauccucaaggucaugaacuucaccgucgacggcaugggcaaccuccgcgucaccaagaagggcauccgccucgagggcaucuccgaguuccuccucccccucuacgucaaggagauccacucccgcaaggacuccccccucguccuccaguccgaccgcaacgucaccgucaacgcccgcaaccacaugggccagcucaccggccagcucaccaucggcgccgacgccgucgaggcccagugcaagcgcuucgagguccgcgccuccgaggacggccgcguccucuucuccgccgacgaggacgagaucaccaucggcgccgagaagcucaaggucaccggcaccgagggcgccgucuucggccacuccgucgagaccccccacauccgcgccgagcccucccaggaccuccgccucgagucccccacccgcucccucaucauggaggccccccgcggcguccaggucuccgccgccgccggcgacuucaaggccaccugccgcaaggagcuccaccuccaguccaccgagggcgagaucuuccucaacgccgagaccaucaagcucggcaaccuccccaccggcuccuucuccuccuccucccccuccuccuccuccucccgccagaccgucuacgagcucugcgucugccccaacggcaagcucuaccucucccccgccggcgucggcuccaccugccaguccuccuccaacaucugccucugguccuga

SEQ ID NO: 49365 - RNA, 1830 nt, Artificial Sequence
  derived and/or modified sequence opt2 from SGIP1__Homo_sapiens__XP_011540595
augauggagggccucaagaagcgcacccgcaaggccuucggcauccgcaagaaggagaaggacaccgacuccaccggcucccccgaccgcgacggcaucaagaaguccaacggcgcccccaacggcuucuacgccgagaucgacugggagcgcuacaacucccccgagcucgacgaggagggcuacuccauccgccccgaggagcccggcuccaccaagggcaagcacuucuacuccuccuccgaguccgaggaggaggaggagucccacaagaaguucaacaucaagaucaagccccuccaguccaaggacauccucaagaacgccgccaccgucgacgagcucaaggccuccaucggcaacaucgcccucucccccucccccgucggcgccaucaagcgcaaccucuccuccgaggaggucgcccgcccccgccgcuccacccccacccccgagcucaucuccaagaagccccccgacgacaccaccgcccucgccccccucuucggccccccccucgaguccgccuucgacgagcagaagaccgagguccuccucgaccagcccgagaucuggggcuccggccagcccaucaaccccuccauggagucccccaagcucacccgccccuuccccaccggcaccccccccccccucccccccaagaacguccccgccacccccccccgcaccggcuccccccucaccaucggccccggcgccuccucccccgcccgccccgccaccccccucguccccugccgcuccaccacccccccccccccccccccccgcccccccucccgccccaagcucccccccggcaagcccggcgucggcgacgucucccgccccuucuccccccccauccacuccuccucccccccccccaucgccccccucgcccgcgccgaguccaccuccuccaucuccuccaccaacucccucuccgccgccaccacccccaccgucggcuccucccgcggccccuccccccucaccaugggcgcccaggacacccuccccgucgccgccgccuucaccgagaccgucaacgccuacuucaagggcgccgaccccuccaagugcaucgucaagaucaccggcgagaugguccucuccuuccccgccggcaucacccgccacuucgccaacaaccccucccccgccgcccucaccuuccgcgucaucaacuucucccgccucgagcacguccuccccaacccccagcuccucugcugcgacaacacccagaacgacgccaacaccaaggaguucugggucaacaugcccaaccucaugacccaccucaagaaggucuccgagcagaagccccaggccaccuacuacaacgucgacaugcucaaguaccaggucuccgcccagggcauccaguccaccccccucaaccucgccgucaacuggcgcugcgagcccuccuccaccgaccuccgcaucgacuacaaguacaacaccgacgccaugaccaccgccgucgcccucaacaacguccaguuccucguccccaucgacggcggcgucaccaagcuccaggccguccucccccccgccgucuggaacgccgagcagcagcgcauccucuggaagauccccgacaucucccagaaguccgagaacggcggcgucggcucccuccucgcccgcuuccagcucuccgagggccccuccaagcccuccccccucgucguccaguucaccuccgagggcuccacccucuccggcugcgacaucgagcucgucggcgccggcuaccgcuucucccucaucaagaagcgcuucgccgccggcaaguaccucgccgacaacuga

SEQ ID NO: 49366 - RNA, 1581 nt, Artificial Sequence
  derived and/or modified sequence opt2 from SGK1__Homo_sapiens__NP_001137148
auggucaacaaggacaugaacggcuuccccgucaagaagugcuccgccuuccaguucuucaagaagcgcguccgccgcuggaucaagucccccauggucuccgucgacaagcaccagucccccucccucaaguacaccggcuccuccaugguccacaucccccccggcgagcccgacuucgaguccucccucugccagaccugccucggcgagcacgccuuccagcgcggcguccucccccaggagaacgaguccugcuccugggagacccaguccggcugcgagguccgcgagcccugcaaccacgccaacauccucaccaagcccgacccccgcaccuucuggaccaacgacgaccccgccuucaugaagcagcgccgcaugggccucaacgacuucauccagaagaucgccaacaacuccuacgccugcaagcaccccgagguccaguccauccucaagaucucccagccccaggagcccgagcucaugaacgccaaccccucccccccccccucccccucccagcagaucaaccucggccccuccuccaacccccacgccaagcccuccgacuuccacuuccucaaggucaucggcaagggcuccuucggcaagguccuccucgcccgccacaaggccgaggaggucuucuacgccgucaagguccuccagaagaaggccauccucaagaagaaggaggagaagcacaucauguccgagcgcaacguccuccucaagaacgucaagcaccccuuccucgucggccuccacuucuccuuccagaccgccgacaagcucuacuucguccucgacuacaucaacggcggcgagcucuucuaccaccuccagcgcgagcgcugcuuccucgagccccgcgcccgcuucuacgccgccgagaucgccuccgcccucggcuaccuccacucccucaacaucgucuaccgcgaccucaagcccgagaacauccuccucgacucccagggccacaucguccucaccgacuucggccucugcaaggagaacaucgagcacaacuccaccaccuccaccuucugcggcacccccgaguaccucgcccccgagguccuccacaagcagcccuacgaccgcaccgucgacugguggugccucggcgccguccucuacgagaugcucuacggccucccccccuucuacucccgcaacaccgccgagauguacgacaacauccucaacaagccccuccagcucaagcccaacaucaccaacuccgcccgccaccuccucgagggccuccuccagaaggaccgcaccaagcgccucggcgccaaggacgacuucauggagaucaagucccacgucuucuucucccucaucaacugggacgaccucaucaacaagaagaucaccccccccuucaaccccaacgucuccggccccaacgaccuccgccacuucgaccccgaguucaccgaggagcccguccccaacuccaucggcaagucccccgacuccguccucgucaccgccuccgucaaggaggccgccgaggccuuccucggcuucuccuacgccccccccaccgacuccuuccucuga

SEQ ID NO: 49367 - RNA, 4221 nt, Artificial Sequence
  derived and/or modified sequence opt2 from SGK223__Homo_sapiens__XP_005272427
augcaccagacccucugccucaaccccgagucccucaagauguccgccugcuccgacuucgucgagcacaucuggaagcccggcuccugcaagaacugcuucugccuccgcuccgaccaccagcucgucgccggccccccccagccccgcgccggcucccuccccccccccccccgccuccccccccgccccgagaacugccgccucgaggacgagggcgucaacuccucccccuacuccaagcccaccaucgccgucaagcccaccaugauguccuccgaggccuccgacgucuggaccgaggccaaccucuccgccgaggucucccaggucaucuggcgccgcgcccccggcaagcucccccuccccaagcaggaggacgcccccgucgucuaccucggcuccuuccgcggcguccagaagcccgccggccccuccaccucccccgacggcaacucccgcugcccccccgccuacaccauggucggccuccacaaccucgagccccgcggcgagcgcaacaucgccuuccaccccgucuccuuccccgaggagaaggccguccacaaggagaagcccuccuuccccuaccaggaccgccccuccacccaggaguccuuccgccagaagcucgccgccuucgccggcaccaccuccggcugccaccagggccccggcccccuccgcgagucccuccccuccgaggacgacuccgaccagcgcugcucccccuccggcgacuccgagggcggcgaguacugcuccauccucgacugcugccccggcucccccgucgccaaggccgccucccagaccgccggcucccgcggccgccacggcggccgcgacugcucccccaccugcugggagcagggcaagugcuccggccccgccgagcaggagaagcgcggccccuccuuccccaaggagugcugcucccagggccccaccgcccaccccuccugccucggccccaagaagcucucccucaccuccgaggccgccaucuccuccgacggccucuccugcggcuccggcuccggcuccggcuccggcgccuccucccccuucgucccccaccucgaguccgacuacugcucccucaugaaggagcccgcccccgagaagcagcaggaccccggcugccccggcgucacccccucccgcugccucggccucaccggcgagccccagccccccgcccacccccgcgaggccacccagcccgagcccaucuacgccgaguccaccaagcgcaagaaggccgcccccguccccuccaagucccaggccaagaucgagcacgccgccgccgcccagggccagggccaggucugcaccggcaacgccugggcccagaaggccgccuccggcuggggccgcgacucccccgaccccaccccccaggucuccgccaccaucaccgucauggccgcccaccccgaggaggaccaccgcaccaucuaccucuccucccccgacuccgccgucggcguccaguggccccgcggccccgucucccagaacuccgaggucggcgaggaggagaccuccgccggccagggccucuccucccgcgagucccacgcccacuccgccuccgaguccaagcccaaggagcgccccgccaucccccccaagcucuccaaguccucccccgucggcucccccgucucccccuccgccggcggcccccccgucuccccccucgccgaccucuccgacggcuccuccggcggcuccuccaucggcccccagccccccucccagggccccgccgaccccgcccccuccugccgcaccaacggcgucgccaucuccgaccccucccgcugcccccagcccgccgccuccuccgccuccgagcagcgccgcccccgcuuccaggccggcaccuggucccgccagugccgcaucgaggaggaggaggaggucgagcaggagcuccucucccacuccuggggccgcgagaccaagaacggccccaccgaccacuccaacuccaccaccuggcaccgccuccaccccaccgacggcuccuccggccagaacuccaaggucggcaccggcauguccaaguccgccuccuucgccuucgaguuccccaaggaccgcuccggcaucgagaccuucuccccccccccccccccccccaagucccgccaccuccucaagaugaacaaguccuccuccgaccucgagaaggucucccagggcuccgccgagucccucucccccuccuuccgcggcguccacgucuccuucaccaccggcuccaccgacucccucgccuccgacucccgcaccugcuccgacggcggccccuccuccgagcucgcccacucccccaccaacuccggcaagaagcucuucgcccccguccccuuccccuccggcuccaccgaggacgucucccccuccggcccccagcagccccccccccucccccagaagaagaucgucucccgcgccgccuccucccccgacggcuucuucuggacccagggcucccccaagcccggcaccgccucccccaagcucaaccucucccacuccgagaccaacguccacgacgagucccacuucuccuacucccucucccccggcaaccgccaccaccccgucuucuccuccuccgacccccucgagaaggccuucaagggcuccggccacuggcuccccgccgccggccucgccggcaaccgcggcggcugcggcucccccggccuccagugcaagggcgcccccuccgccuccuccucccagcucuccgucuccucccaggccuccaccggcuccacccagcuccagcuccacggccuccucuccaacaucuccuccaaggagggcaccuacgccaagcucggcggccucuacacccagucccucgcccgccucgucgccaagugcgaggaccucuucaugggcggccagaagaaggagcuccacuucaacgagaacaacuggucccucuucaagcucaccugcaacaagcccugcugcgacuccggcgacgccaucuacuacugcgccaccugcuccgaggaccccggcuccaccuacgccgucaagaucugcaaggcccccgagcccaagaccgucuccuacugcucccccuccguccccguccacuucaacauccagcaggacugcggccacuucgucgccuccguccccuccuccaugcucuccucccccgacgcccccaaggaccccguccccgcccuccccacccacccccccgcccaggagcaggacugcgucgucgucaucacccgcgaggucccccaccagaccgccuccgacuucguccgcgacuccgccgccucccaccaggccgagcccgaggccuacgagcgccgcgucugcuuccuccuccuccagcucugcaacggccucgagcaccucaaggagcacggcaucauccaccgcgaccucugccucgagaaccuccuccucguccacugcacccuccaggccggccccggccccgcccccgcccccgcccccgcccccgcccccgccgccgccgccccccccugcuccuccgccgccccccccgccggcggcacccucucccccgccgccggccccgccucccccgagggcccccgcgagaagcagcucccccgccucaucaucuccaacuuccucaaggccaagcagaagcccggcggcacccccaaccuccagcagaagaagucccaggcccgccucgcccccgagaucgucuccgccucccaguaccgcaaguucgacgaguuccagaccggcauccucaucuacgagcuccuccaccagcccaaccccuucgagguccgcgcccagcuccgcgagcgcgacuaccgccaggaggaccuccccccccuccccgcccucucccucuacucccccggccuccagcagcucgcccaccuccuccucgaggccgaccccaucaagcgcauccgcaucggcgaggccaagcgcguccuccagugccuccucuggggcccccgccgcgagcucguccagcagcccggcaccuccgaggaggcccucugcggcacccuccacaacuggaucgacaugaagcgcgcccucaugaugaugaaguucgccgagaaggccgucgaccgccgccgcggcgucgagcucgaggacuggcucugcugccaguaccucgccuccgccgagcccggcgcccuccuccagucccucaagcuccuccagcuccucuga

SEQ ID NO: 49368 - RNA, 1104 nt, Artificial Sequence
  derived and/or modified sequence opt2 from SGK2__Homo_sapiens__NP_001186193
augaacuccucccccgccggcacccccuccccccagcccucccgcgccaacggcaacaucaaccucggccccuccgccaaccccaacgcccagcccaccgacuucgacuuccucaaggucaucggcaagggcaacuacggcaagguccuccucgccaagcgcaaguccgacggcgccuucuacgccgucaagguccuccagaagaaguccauccucaagaagaaggagcagucccacaucauggccgagcgcuccguccuccucaagaacguccgccaccccuuccucgucggccuccgcuacuccuuccagacccccgagaagcucuacuucguccucgacuacgucaacggcggcgagcucuucuuccaccuccagcgcgagcgccgcuuccucgagccccgcgcccgcuucuacgccgccgaggucgccuccgccaucggcuaccuccacucccucaacaucaucuaccgcgaccucaagcccgagaacauccuccucgacugccagggccacgucguccucaccgacuucggccucugcaaggagggcgucgagcccgaggacaccaccuccaccuucugcggcacccccgaguaccucgcccccgagguccuccgcaaggagcccuacgaccgcgccgucgacugguggugccucggcgccguccucuacgagaugcuccacggccucccccccuucuacucccaggacgucucccagauguacgagaacauccuccaccagccccuccagauccccggcggccgcaccgucgccgccugcgaccuccuccagucccuccuccacaaggaccagcgccagcgccucggcuccaaggccgacuuccucgagaucaagaaccacgucuucuucucccccaucaacugggacgaccucuaccacaagcgccucaccccccccuucaaccccaacgucaccggccccgccgaccucaagcacuucgaccccgaguucacccaggaggccgucuccaaguccaucggcugcacccccgacaccgucgccuccuccuccggcgccuccuccgccuuccucggcuucuccuacgcccccgaggacgacgacauccucgacugcuga

SEQ ID NO: 49369 - RNA, 1491 nt, Artificial Sequence
  derived and/or modified sequence opt2 from SGK3__Homo_sapiens__NP_001028750
augcagcgcgaccacaccauggacuacaaggaguccugccccuccgucuccauccccuccuccgacgagcaccgcgagaagaagaagcgcuucaccgucuacaagguccucgucuccgucggccgcuccgagugguucgucuuccgccgcuacgccgaguucgacaagcucuacaacacccucaagaagcaguuccccgccauggcccucaagauccccgccaagcgcaucuucggcgacaacuucgaccccgacuucaucaagcagcgccgcgccggccucaacgaguucauccagaaccucguccgcuaccccgagcucuacaaccaccccgacguccgcgccuuccuccagauggacucccccaagcaccaguccgaccccuccgaggacgaggacgagcgcuccucccagaagcuccacuccaccucccagaacaucaaccucggccccuccggcaacccccacgccaagcccaccgacuucgacuuccucaaggucaucggcaagggcuccuucggcaagguccuccucgccaagcgcaagcucgacggcaaguucuacgccgucaagguccuccagaagaagaucguccucaaccgcaaggagcagaagcacaucauggccgagcgcaacguccuccucaagaacgucaagcaccccuuccucgucggccuccacuacuccuuccagaccaccgagaagcucuacuucguccucgacuucgucaacggcggcgagcucuucuuccaccuccagcgcgagcgcuccuuccccgagcaccgcgcccgcuucuacgccgccgagaucgccuccgcccucggcuaccuccacuccaucaagaucgucuaccgcgaccucaagcccgagaacauccuccucgacuccgucggccacgucguccucaccgacuucggccucugcaaggagggcaucgccaucuccgacaccaccaccaccuucugcggcacccccgaguaccucgcccccgaggucauccgcaagcagcccuacgacaacaccgucgacugguggugccucggcgccguccucuacgagaugcucuacggccucccccccuucuacugccgcgacgucgccgagauguacgacaacauccuccacaagccccucucccuccgccccggcgucucccucaccgccugguccauccucgaggagcuccucgagaaggaccgccagaaccgccucggcgccaaggaggacuuccucgagauccagaaccaccccuucuucgagucccucuccugggccgaccucguccagaagaagauccccccccccuucaaccccaacgucgccggccccgacgacauccgcaacuucgacaccgccuucaccgaggagaccguccccuacuccgucugcgucuccuccgacuacuccaucgucaacgccuccguccucgaggccgacgacgccuucgucggcuucuccuacgccccccccuccgaggaccucuuccucuga

SEQ ID NO: 49370 - RNA, 1242 nt, Artificial Sequence
  derived and/or modified sequence opt2 from SGMS1__Homo_sapiens__XP_011537885
augaaggaggucgucuacuggucccccaagaaggucgccgacuggcuccucgagaacgccaugcccgaguacugcgagccccucgagcacuucaccggccaggaccucaucaaccucacccaggaggacuucaagaagcccccccucugccgcgucuccuccgacaacggccagcgccuccucgacaugaucgagacccucaagauggagcaccaccucgaggcccacaagaacggccacgccaacggccaccucaacaucggcgucgacauccccacccccgacggcuccuucuccaucaagaucaagcccaacggcaugcccaacggcuaccgcaaggagaugaucaagauccccaugcccgagcucgagcgcucccaguaccccauggaguggggcaagaccuuccucgccuuccucuacgcccucuccugcuucguccucaccaccgucaugaucuccgucguccacgagcgcgucccccccaaggagguccagcccccccuccccgacaccuucuucgaccacuucaaccgcguccagugggccuucuccaucugcgagaucaacggcaugauccucgucggccucuggcucauccaguggcuccuccucaaguacaaguccaucaucucccgccgcuucuucugcaucgucggcacccucuaccucuaccgcugcaucaccauguacgucaccacccuccccguccccggcaugcacuucaacugcucccccaagcucuucggcgacugggaggcccagcuccgccgcaucaugaagcucaucgccggcggcggccucuccaucaccggcucccacaacaugugcggcgacuaccucuacuccggccacaccgucaugcucacccucaccuaccucuucaucaaggaguacuccccccgccgccucuggugguaccacuggaucugcuggcuccucuccgucgucggcaucuucugcauccuccucgcccacgaccacuacaccgucgacgucgucgucgccuacuacaucaccacccgccucuucuggugguaccacaccauggccaaccagcagguccucaaggaggccucccagaugaaccuccucgcccgcgucuggugguaccgccccuuccaguacuucgagaagaacguccagggcaucgucccccgcuccuaccacuggcccuuccccuggcccgucguccaccucucccgccaggucaaguacucccgccucgucaacgacaccuga

SEQ ID NO: 49371 - RNA, 1098 nt, Artificial Sequence
  derived and/or modified sequence opt2 from SGMS2__Homo_sapiens__NP_001129730
auggacaucaucgagaccgccaagcucgaggagcaccucgagaaccagcccuccgaccccaccaacaccuacgcccgccccgccgagcccgucgaggaggagaacaagaacggcaacggcaagcccaagucccucuccuccggccuccgcaagggcaccaagaaguaccccgacuacauccagaucgccaugcccaccgagucccgcaacaaguucccccucgagugguggaagaccggcaucgccuucaucuacgccgucuucaaccucguccucaccaccgucaugaucaccgucguccacgagcgcgucccccccaaggagcucucccccccccuccccgacaaguucuucgacuacaucgaccgcgucaagugggccuucuccgucuccgagaucaacggcaucauccucgucggccucuggaucacccaguggcucuuccuccgcuacaaguccaucgucggccgccgcuucugcuucaucaucggcacccucuaccucuaccgcugcaucaccauguacgucaccacccuccccguccccggcaugcacuuccagugcgcccccaagcucaacggcgacucccaggccaagguccagcgcauccuccgccucaucuccggcggcggccucuccaucaccggcucccacauccucugcggcgacuuccucuucuccggccacaccgucacccucacccucaccuaccucuucaucaaggaguacuccccccgccacuucuggugguaccaccucaucugcuggcuccucuccgccgccggcaucaucugcauccucgucgcccacgagcacuacaccaucgacgucaucaucgccuacuacaucaccacccgccucuucuggugguaccacuccauggccaacgagaagaaccucaaggucuccucccagaccaacuuccucucccgcgccuggugguuccccaucuucuacuucuucgagaagaacguccagggcuccauccccugcugcuucuccuggccccucuccuggccccccggcugcuucaaguccuccugcaagaaguacucccgcguccagaagaucggcgaggacaacgagaaguccaccuga

SEQ ID NO: 49372 - RNA, 1584 nt, Artificial Sequence
  derived and/or modified sequence opt2 from SGOL1__Homo_sapiens__NP_001012409
auggccaaggagcgcugccucaagaaguccuuccaggacucccucgaggacaucaagaagcgcaugaaggagaagcgcaacaagaaccucgccgagaucggcaagcgccgcuccuucaucgccgcccccugccagaucaucaccaacaccuccacccuccucaagaacuaccaggacaacaacaagaugcucguccucgcccucgagaacgagaaguccaaggucaaggaggcccaggacaucauccuccagcuccgcaaggagugcuacuaccucaccugccagcucuacgcccucaagggcaagcucaccucccagcagaccgucgagcccgcccagaaccaggagaucugcuccuccggcauggaccccaacuccgacgacuccucccgcaaccucuucgucaaggaccucccccagaucccccucgaggagaccgagcuccccggccagggcgaguccuuccagaucgaggaccagauccccaccaucccccaggacacccucggcgucgacuucgacuccggcgaggccaaguccaccgacaacguccucccccgcaccgucuccguccgcuccucccucaagaagcacugcaacuccaucugccaguucgacucccucgacgacuucgagaccucccaccucgccggcaaguccuucgaguucgagcgcgucggcuuccucgacccccucgucaacaugcacauccccgagaacguccagcacaacgccugccagugguccaaggaccaggucaaccucucccccaagcucauccagcccggcaccuucaccaagaccaaggaggacauccucgaguccaaguccgagcagaccaaguccaagcagcgcgacacccaggagcgcaagcgcgaggagaagcgcaaggccaaccgccgcaaguccaagcgcauguccaaguacaaggagaacaaguccgagaacaagaagaccgucccccagaagaagaugcacaaguccgucuccuccaacgacgccuacaacuucaaccucgaggagggcguccaccucacccccuuccgccagaaggucuccaacgacuccaaccgcgaggagaacaacgaguccgaggucucccucugcgaguccuccggcuccggcgacgacuccgacgaccucuaccuccccaccugcaaguacauccagaaccccaccuccaacuccgaccgccccgucacccgcccccucgccaagcgcgcccucaaguacaccgacgagaaggagaccgagggcuccaagcccaccaagacccccaccaccaccccccccgagacccagcaguccccccaccucucccucaaggacaucaccaacgucucccucuaccccgucgucaagauccgccgccucucccucucccccaagaagaacaaggccucccccgccgucgcccuccccaagcgccgcugcaccgccuccgucaacuacaaggagcccacccucgccuccaagcuccgccgcggcgaccccuucaccgaccucugcuuccucaacucccccaucuucaagcagaagaaggaccuccgccgcuccaagaaguccaugaagcagauccaguga

SEQ ID NO: 49373 - RNA, 1707 nt, Artificial Sequence
  derived and/or modified sequence opt2 from SGPL1__Homo_sapiens__XP_011538619
augcccuccaccgaccuccucaugcucaaggccuucgagcccuaccucgagauccucgaggucuacuccaccaaggccaagaacuacgucaacggccacugcaccaaguacgagcccuggcagcucaucgccugguccgucgucuggacccuccucaucgucuggggcuacgaguucgucuuccagcccgagucccucuggucccgcuucaagaagaagugcuucaagcucacccgcaagaugcccaucaucggccgcaagauccaggacaagcucaacaagaccaaggacgacaucuccaagaacauguccuuccucaaggucgacaaggaguacgucaaggcccuccccucccagggccucuccuccuccgccguccucgagaagcucaaggaguacuccuccauggacgccuucuggcaggagggccgcgccuccggcaccgucuacuccggcgaggagaagcucaccgagcuccucgucaaggccuacggcgacuucgccugguccaacccccuccaccccgacaucuuccccggccuccgcaagaucgaggccgagaucguccgcaucgccugcucccucuucaacggcggccccgacuccugcggcugcgucaccuccggcggcaccgaguccauccucauggccugcaaggccuaccgcgaccucgccuucgagaagggcaucaagacccccgagaucgucgccccccaguccgcccacgccgccuucaacaaggccgccuccuacuucggcaugaagaucguccgcgucccccucaccaagaugauggaggucgacguccgcgccaugcgccgcgccaucucccgcaacaccgccaugcucgucugcuccaccccccaguucccccacggcgucaucgaccccguccccgaggucgccaagcucgccgucaaguacaagaucccccuccacgucgacgccugccucggcggcuuccucaucgucuucauggagaaggccggcuacccccucgagcaccccuucgacuuccgcgucaagggcgucaccuccaucuccgccgacacccacaaguacggcuacgcccccaagggcuccucccucguccucuacuccgacaagaaguaccgcaacuaccaguucuucgucgacaccgacuggcagggcggcaucuacgccucccccaccaucgccggcucccgccccggcggcaucuccgccgccugcugggccgcccucaugcacuucggcgagaacggcuacgucgaggccaccaagcagaucaucaagaccgcccgcuuccucaaguccgagcucgagaacaucaagggcaucuucgucuucggcaacccccagcucuccgucaucgcccucggcucccgcgacuucgacaucuaccgccucuccaaccucaugaccgccaagggcuggaaccucaaccagcuccaguucccccccuccauccacuucugcaucacccuccuccacgcccgcaagcgcgucgccauccaguuccucaaggacauccgcgaguccgucacccagaucaugaagaaccccaaggccaagaccaccggcaugggcgccaucuacggcauggcccagaccaccgucgaccgcaacauggucgccgagcucuccuccgucuuccucgacucccucuacuccaccgacaccgucacccagggcucccagaugaacggcucccccaagccccacuga

SEQ ID NO: 49374 - RNA, 1326 nt, Artificial Sequence
  derived and/or modified sequence opt2 from SGPP1__Homo_sapiens__NP_110418
augucccuccgccagcgccucgcccagcucgucggccgccuccaggacccccagaaggucgcccgcuuccagcgccucugcggcgucgaggcccccccccgccgcuccgccgaccgccgcgaggacgagaaggccgaggccccccucgccggcgacccccgccuccgcggccgccagcccggcgcccccggcggcccccagccccccggcuccgaccgcaaccagugccccgccaagcccgacggcggcggcgcccccaacggcguccgcaacggccucgccgccgagcucggccccgccuccccccgccgcgccggcgcccuccgccgcaacucccucaccggcgaggagggccagcucgcccgcgucuccaacuggccccucuacugccucuucugcuucggcaccgagcucggcaacgagcucuucuacauccucuucuuccccuucuggaucuggaaccucgacccccucgucggccgccgccucgucgucaucuggguccucgucauguaccucggccagugcaccaaggacaucauccgcuggccccgccccgccuccccccccgucgucaagcucgaggucuucuacaacuccgaguacuccaugcccuccacccacgccauguccggcaccgccauccccaucuccaugguccuccucaccuacggccgcuggcaguacccccucaucuacggccucauccucauccccugcuggugcucccucgucugccucucccgcaucuacaugggcaugcacuccauccucgacaucaucgccggcuuccucuacaccauccucauccucgccgucuucuaccccuucgucgaccucaucgacaacuucaaccagacccacaaguacgcccccuucaucaucaucggccuccaccucgcccucggcaucuucuccuucacccucgacaccugguccaccucccgcggcgacaccgccgagauccucggcuccggcgccggcaucgccugcggcucccacgucaccuacaacaugggccucguccucgaccccucccucgacacccucccccucgccggcccccccaucaccgucacccucuucggcaaggccauccuccgcauccucaucggcauggucuucguccucaucauccgcgacgucaugaagaagaucaccaucccccucgccugcaagaucuucaacauccccugcgacgacauccgcaaggcccgccagcacauggaggucgagcuccccuaccgcuacaucaccuacggcauggucggcuucuccaucaccuucuucguccccuacaucuucuucuucaucggcaucuccuga

SEQ ID NO: 49375 - RNA, 1200 nt, Artificial Sequence
  derived and/or modified sequence opt2 from SGPP2__Homo_sapiens__NP_689599
auggccgagcuccuccgcucccuccaggacucccagcucgucgcccgcuuccagcgccgcugcggccucuuccccgcccccgacgagggcccccgcgagaacggcgccgaccccaccgagcgcgccgcccgcguccccggcgucgagcaccuccccgccgccaacggcaagggcggcgaggcccccgccaacggccuccgccgcgccgccgcccccgaggccuacguccagaaguacgucgucaagaacuacuucuacuacuaccucuuccaguucuccgccgcccucggccaggaggucuucuacaucaccuuccuccccuucacccacuggaacaucgaccccuaccucucccgccgccucaucaucaucuggguccucgucauguacaucggccaggucgccaaggacguccucaaguggccccgccccuccuccccccccgucgucaagcucgagaagcgccucaucgccgaguacggcaugcccuccacccacgccauggccgccaccgccaucgccuucacccuccucaucuccaccauggaccgcuaccaguaccccuucguccucggccucgucauggccgucgucuucuccacccucgucugccucucccgccucuacaccggcaugcacaccguccucgacguccucggcggcguccucaucaccgcccuccucaucguccucaccuaccccgccuggaccuucaucgacugccucgacuccgccuccccccucuuccccgucugcgucaucgucguccccuucuuccucugcuacaacuaccccgucuccgacuacuacucccccacccgcgccgacaccaccaccauccucgccgccggcgccggcgucaccaucggcuucuggaucaaccacuucuuccagcucgucuccaagcccgccgagucccuccccgucauccagaacauccccccccucaccaccuacaugcucguccucggccucaccaaguucgccgucggcaucguccucauccuccucguccgccagcucguccagaaccucucccuccagguccucuacuccugguucaaggucgucacccgcaacaaggaggcccgccgccgccucgagaucgagguccccuacaaguucgucaccuacaccuccgucggcaucugcgccaccaccuucguccccaugcuccaccgcuuccucggccuccccuga

SEQ ID NO: 49376 - RNA, 1509 nt, Artificial Sequence
  derived and/or modified sequence opt2 from SGSH__Homo_sapiens__NP_000190
auguccugccccguccccgccugcugcgcccuccuccucguccucggccucugccgcgcccgcccccgcaacgcccuccuccuccucgccgacgacggcggcuucgaguccggcgccuacaacaacuccgccaucgccaccccccaccucgacgcccucgcccgccgcucccuccucuuccgcaacgccuucaccuccgucuccuccugcucccccucccgcgccucccuccucaccggccucccccagcaccagaacggcauguacggccuccaccaggacguccaccacuucaacuccuucgacaagguccgcucccucccccuccuccucucccaggccggcguccgcaccggcaucaucggcaagaagcacgucggccccgagaccgucuaccccuucgacuucgccuacaccgaggagaacggcuccguccuccaggucggccgcaacaucacccgcaucaagcuccucguccgcaaguuccuccagacccaggacgaccgccccuucuuccucuacgucgccuuccacgacccccaccgcugcggccacucccagccccaguacggcaccuucugcgagaaguucggcaacggcgaguccggcaugggccgcauccccgacuggaccccccaggccuacgacccccucgacguccucguccccuacuucguccccaacacccccgccgcccgcgccgaccucgccgcccaguacaccaccgucggccgcauggaccagggcgucggccucguccuccaggagcuccgcgacgccggcguccucaacgacacccucgucaucuucaccuccgacaacggcauccccuuccccuccggccgcaccaaccucuacuggcccggcaccgccgagccccuccucgucuccucccccgagcaccccaagcgcuggggccaggucuccgaggccuacgucucccuccucgaccucacccccaccauccucgacugguucuccauccccuaccccuccuacgccaucuucggcuccaagaccauccaccucaccggccgcucccuccuccccgcccucgaggccgagccccucugggccaccgucuucggcucccagucccaccacgaggucaccauguccuaccccaugcgcuccguccagcaccgccacuuccgccucguccacaaccucaacuucaagaugcccuuccccaucgaccaggacuucuacgucucccccaccuuccaggaccuccucaaccgcaccaccgccggccagcccaccggcugguacaaggaccuccgccacuacuacuaccgcgcccgcugggagcucuacgaccgcucccgcgacccccacgagacccagaaccucgccaccgacccccgcuucgcccagcuccucgagaugcuccgcgaccagcucgccaaguggcagugggagacccacgaccccugggucugcgcccccgacggcguccucgaggagaagcucuccccccagugccagccccuccacaacgagcucuga

SEQ ID NO: 49377 - RNA, 3021 nt, Artificial Sequence
  derived and/or modified sequence opt2 from SGSM2__Homo_sapiens__NP_001091979
augggcuccgccgaggacgccgucaaggagaagcuccucuggaacgucaagaaggaggucaagcagaucauggaggaggccgucacccgcaaguucguccacgaggacuccucccacaucaucgcccucugcggcgccgucgaggccugccuccuccaccagcuccgccgccgcgccgccggcuuccuccgcuccgacaagauggccgcccucuucaccaaggucggcaagaccugccccgucgccggcgagaucugccacaagguccaggagcuccagcagcaggccgagggccgcaagcccuccggcgucucccaggaggcccuccgccgccagggcuccgccuccggcaaggcccccgcccucuccccccaggcccucaagcacgucuggguccgcaccgcccucaucgagaagguccucgacaaggucguccaguaccucgccgagaacugcuccaaguacuacgagaaggaggcccuccucgccgaccccgucuucggccccauccucgccucccuccucgucggccccugcgcccucgaguacaccaagcucaagaccgccgaccacuacuggaccgaccccuccgccgacgagcucguccagcgccaccgcauccgcggcccccccacccgccaggacucccccgccaagcgccccgcccucggcauccgcaagcgccacuccuccggcuccgccuccgaggaccgccucgccgccugcgcccgcgagugcgucgagucccuccaccagaacucccgcacccgccuccucuacggcaagaaccacguccucguccagcccaaggaggacauggaggccguccccggcuaccucucccuccaccaguccgccgagucccucacccucaaguggacccccaaccagcucaugaacggcacccucggcgacuccgagcucgagaaguccgucuacugggacuacgcccucgucguccccuucucccaggucgucugcauccacugccaccagcagaaguccggcggcacccucguccucgucucccaggacggcauccagcgccccccccuccacuucccccagggcggccaccuccucuccuuccucuccugccucgagaacggccuccucccccgcggccagcucgagcccccccucuggacccagcagggcaagggcaaggucuuccccaagcuccgcaagcgcuccuccauccgcuccgucgacauggaggagaugggcaccggccgcgccaccgacuacgucuuccgcaucaucuaccccggccaccgccacgagcacaacgccggcgacaugaucgagaugcagggcuucggccccucccuccccgccuggcaccucgagccccucugcucccagggcuccuccugccucuccugcuccuccuccuccuccccccacgccacccccucccacugcuccugcauccccgaccgccucccccuccgccuccucugcgaguccaugaagcgccagaucgucucccgcgccuucuacggcuggcucgcccacugccgccaccucuccaccguccgcacccaccucuccgcccucguccaccacuccgucaucccccccgaccgcccccccggcgccuccgccggccucaccaaggacgucugguccaaguaccagaaggacaagaagaacuacaaggagcucgagcuccuccgccaggucuacuacggcggcaucgagcacgagauccgcaaggacgucuggcccuuccuccucggccacuacaaguucggcauguccaagaaggagauggagcaggucgacgccgucgucgccgcccgcuaccagcagguccucgccgaguggaaggccugcgaggucgucguccgccagcgcgagcgcgaggcccaccccgccacccgcaccaaguucuccuccggcuccuccaucgacucccacguccagcgccucauccaccgcgacuccaccaucuccaacgacgucuucaucuccgucgacgaccucgagccccccgagccccaggaccccgaggacucccgccccaagcccgagcaggaggccggccccggcacccccggcaccgccgucgucgagcagcagcacuccgucgaguucgacucccccgacuccggccuccccuccucccgcaacuacuccgucgccuccggcauccaguccucccucgacgagggccaguccgucggcuucgaggaggaggacggcggcggcgaggagggcuccuccggccccggccccgccgcccacacccuccgcgagccccaggaccccucccaggagaagccccaggccggcgagcucgaggccggcgaggagcucgccgccgucugcgccgccgccuacaccaucgagcuccucgacaccgucgcccucaaccuccaccgcaucgacaaggacguccagcgcugcgaccgcaacuacugguacuucaccccccccaaccucgagcgccuccgcgacgucaugugcuccuacgucugggagcaccucgacgucggcuacguccagggcaugugcgaccuccucgccccccuccucgucacccucgacaacgaccagcucgccuacuccugcuucucccaccucaugaagcgcaugucccagaacuuccccaacggcggcgccauggacacccacuucgccaacaugcgcucccucauccagauccucgacuccgagcucuucgagcucaugcaccagaacggcgacuacacccacuucuacuucugcuaccgcugguuccuccucgacuucaagcgcgagcuccucuacgaggacgucuucgccgucugggaggucaucugggccgcccgccacaucuccuccgagcacuucguccucuucaucgcccucgcccucgucgaggccuaccgcgagaucauccgcgacaacaacauggacuucaccgacaucaucaaguucuucaacgagcgcgccgagcaccacgacgcccaggagauccuccgcaucgcccgcgaccucguccacaagguccagaugcucaucgagaacaaguga

SEQ ID NO: 49378 - RNA, 2250 nt, Artificial Sequence
  derived and/or modified sequence opt2 from SGSM3__Homo_sapiens__NP_056520
auguccggcucccacacccccgccugcggccccuucuccgcccucacccccuccaucuggccccaggagauccucgccaaguacacccagaaggaggaguccgccgagcagcccgaguucuacuacgacgaguucggcuuccgcgucuacaaggaggagggcgacgagcccggcuccucccuccucgccaacuccccccucauggaggacgccccccagcgccuccgcuggcaggcccaccucgaguucacccacaaccacgacgucggcgaccucaccugggacaagaucgccgucucccucccccgcuccgagaagcuccgcucccucguccucgccggcaucccccacggcaugcgcccccagcucuggaugcgccucuccggcgcccuccagaagaagcgcaacuccgagcucuccuaccgcgagaucgucaagaacuccuccaacgacgagaccaucgccgccaagcagaucgagaaggaccuccuccgcaccaugcccuccaacgccugcuucgccuccaugggcuccaucggcgucccccgccuccgccgcguccuccgcgcccucgccuggcucuaccccgagaucggcuacugccagggcaccggcauggucgccgccugccuccuccucuuccucgaggaggaggacgccuucuggaugauguccgccaucaucgaggaccuccuccccgccuccuacuucuccaccacccuccucggcguccagaccgaccagcgcguccuccgccaccucaucguccaguaccucccccgccucgacaagcuccuccaggagcacgacaucgagcucucccucaucacccuccacugguuccucaccgccuucgccuccgucgucgacaucaagcuccuccuccgcaucugggaccucuucuucuacgagggcucccgcguccucuuccagcucacccucggcaugcuccaccucaaggaggaggagcucauccaguccgagaacuccgccuccaucuucaacacccucuccgacauccccucccagauggaggacgccgagcuccuccucggcgucgccaugcgccucgccggcucccucaccgacgucgccgucgagacccagcgccgcaagcaccucgccuaccucaucgccgaccagggccagcuccucggcgccggcacccucaccaaccucucccaggucguccgccgccgcacccagcgccgcaaguccaccaucaccgcccuccucuucggcgaggacgaccucgaggcccucaaggccaagaacaucaagcagaccgagcucgucgccgaccuccgcgaggccauccuccgcgucgcccgccacuuccagugcaccgaccccaagaacugcuccgucgagcucacccccgacuacuccauggagucccaccagcgcgaccacgagaacuacgucgccugcucccgcucccaccgccgccgcgccaaggcccuccucgacuucgagcgccacgacgacgacgagcucggcuuccgcaagaacgacaucaucaccaucgucucccagaaggacgagcacugcugggucggcgagcucaacggccuccgcggcugguuccccgccaaguucgucgagguccucgacgagcgcuccaaggaguacuccaucgccggcgacgacuccgucaccgagggcgucaccgaccucguccgcggcacccucugccccgcccucaaggcccucuucgagcacggccucaagaagcccucccuccucggcggcgccugccaccccuggcucuucaucgaggaggccgccggccgcgaggucgagcgcgacuucgccuccgucuacucccgccucguccucugcaagaccuuccgccucgacgaggacggcaagguccucacccccgaggagcuccucuaccgcgccguccaguccgucaacgucacccacgacgccguccacgcccagauggacgucaagcuccgcucccucaucugcgucggccucaacgagcagguccuccaccucuggcucgagguccucugcuccucccuccccaccgucgagaagugguaccagcccugguccuuccuccgcucccccggcuggguccagaucaagugcgagcuccgcguccucugcugcuucgccuucucccucucccaggacugggagcuccccgccaagcgcgaggcccagcagccccucaaggagggcguccgcgacaugcucgucaagcaccaccucuucuccugggacgucgacggcuga

SEQ ID NO: 49379 - RNA, 942 nt, Artificial Sequence
  derived and/or modified sequence opt2 from SGTA__Homo_sapiens__XP_011526480
auggacaacaagaagcgccucgccuacgccaucauccaguuccuccacgaccagcuccgccacggcggccucuccuccgacgcccaggagucccucgaggucgccauccagugccucgagaccgccuucggcgucaccgucgaggacuccgaccucgcccucccccagacccuccccgagaucuucgaggccgccgccaccggcaaggagaugccccaggaccuccgcucccccgcccgcaccccccccuccgaggaggacuccgccgaggccgagcgccucaagaccgagggcaacgagcagaugaaggucgagaacuucgaggccgccguccacuucuacggcaaggccaucgagcucaaccccgccaacgccgucuacuucugcaaccgcgccgccgccuacuccaagcucggcaacuacgccggcgccguccaggacugcgagcgcgccaucugcaucgaccccgccuacuccaaggccuacggccgcaugggccucgcccucuccucccucaacaagcacgucgaggccgucgccuacuacaagaaggcccucgagcucgaccccgacaacgagaccuacaaguccaaccucaagaucgccgagcucaagcuccgcgaggcccccucccccaccggcggcgucggcuccuucgacaucgccggccuccucaacaaccccggcuucauguccauggccuccaaccucaugaacaacccccagauccagcagcucauguccggcaugaucuccggcggcaacaacccccucggcacccccggcaccucccccucccagaacgaccucgccucccucauccaggccggccagcaguucgcccagcagaugcagcagcagaaccccgagcucaucgagcagcuccgcucccagauccgcucccgcacccccuccgccuccaacgacgaccagcaggaguga

SEQ ID NO: 49380 - RNA, 2271 nt, Artificial Sequence
  derived and/or modified sequence opt2 from SH2B1__Homo_sapiens__NP_001139267
augaacggcgcccccucccccgaggacggcgccucccccuccucccccccccucccccccccccccccccccuccuggcgcgaguucugcgagucccacgcccgcgccgccgcccucgacuucgcccgccgcuuccgccucuaccucgccucccacccccaguacgccggccccggcgccgaggccgccuucucccgccgcuucgccgagcucuuccuccagcacuucgaggccgaggucgcccgcgccuccggcucccucuccccccccauccucgccccccucucccccggcgccgagaucuccccccacgaccucucccucgaguccugccgcgucggcggcccccucgccguccucggccccucccgcuccuccgaggaccucgccggcccccuccccuccuccgucuccuccuccuccaccaccuccuccaagcccaagcucaagaagcgcuucucccuccgcuccgucggccgcuccguccgcggcuccguccgcggcauccuccaguggcgcggcaccgucgacccccccuccuccgccggcccccucgagaccuccuccggcccccccguccucggcggcaacuccaacuccaacuccuccggcggcgccggcaccgucggccgcggccucgucuccgacggcaccucccccggcgagcgcuggacccaccgcuucgagcgccuccgccucucccgcggcggcggcgcccucaaggacggcgccggcaugguccagcgcgaggagcuccucuccuucaugggcgccgaggaggccgcccccgaccccgccggcgucggccgcggcggcggcgucgccggcccccccuccggcggcggcggccagccccaguggcagaagugccgccuccuccuccgcuccgagggcgagggcggcggcggcucccgccucgaguucuucgucccccccaaggccucccgcccccgccucuccauccccugcuccuccaucaccgacguccgcaccaccaccgcccucgagaugcccgaccgcgagaacaccuucgucgucaaggucgagggccccuccgaguacaucauggagaccgucgacgcccagcacgucaaggccugggucuccgacauccaggagugccucucccccggccccugccccgccaccuccccccgccccaugacccucccccucgcccccggcaccuccuuccucacccgcgagaacaccgacucccucgagcucuccugccucaaccacuccgagucccuccccucccaggaccuccuccucggccccuccgaguccaacgaccgccucucccagggcgccuacggcggccucuccgaccgccccuccgccuccaucucccccuccuccgccuccaucgccgccucccacuucgacuccauggagcuccucccccccgagcuccccccccgcauccccaucgaggagggcccccccaccggcaccguccacccccucuccgcccccuaccccccccucgacacccccgagaccgccaccggcuccuuccucuuccagggcgagcccgagggcggcgagggcgaccagccccucuccggcuaccccugguuccacggcaugcucucccgccucaaggccgcccagcucguccucaccggcggcaccggcucccacggcgucuuccucguccgccaguccgagacccgccgcggcgaguacguccucaccuucaacuuccagggcaaggccaagcaccuccgccucucccucaacgaggagggccagugccgcguccagcaccucugguuccaguccaucuucgacaugcucgagcacuuccgcguccaccccaucccccucgaguccggcggcuccuccgacgucguccucgucuccuacguccccuccucccagcgccagcaggagcccaccaccucccacgaccccccccagccccccgagccccccuccuggaccgaccccccccagcccggcgccgaggaggccucccgcgcccccgaggucgccgccgccgccgccgccgccgccaaggagcgccaggagaaggagaaggccggcggcggcggcguccccgaggagcucguccccgucgucgagcucguccccgucgucgagcucgaggaggccaucgcccccggcuccgaggcccagggcgccggcuccggcggcgacgccggcgucccccccaugguccagcuccagcaguccccccucggcggcgacggcgaggagggcggccacccccgcgccaucaacaaccaguacuccuucgucuga

SEQ ID NO: 49381 - RNA, 2028 nt, Artificial Sequence
  derived and/or modified sequence opt2 from SH2B2__Homo_sapiens__NP_066189
auggaccccuccuacugccccgcccacggcuuccccucccaggacccccucuggccccucuccucccagcagugguccuccgcccacuacuccgagcccgccgccggcggcugcgacggcaccgaggccaugaacggcgccggccccggccccgccgccgccgcccccguccccguccccguccccguccccgacuggcgccaguucugcgagcuccacgcccaggccgccgccgucgacuucgcccacaaguucugccgcuuccuccgcgacaaccccgccuacgacacccccgacgccggcgccuccuucucccgccacuucgccgccaacuuccucgacgucuucggcgaggagguccgccgcguccucgucgccggccccaccacccgcggcgccgccgucuccgccgaggccauggagcccgagcucgccgacaccuccgcccucaaggccgcccccuacggccacucccgcuccuccgaggacgucuccacccacgccgccaccaaggcccgcguccgcaagggcuucucccuccgcaacaugucccucugcgucgucgacggcguccgcgacauguggcaccgccgcgccucccccgagcccgacgccgccgccgccccccgcaccgccgagccccgcgacaaguggacccgccgccuccgccucucccgcacccucgccgccaaggucgagcucgucgacauccagcgcgagggcgcccuccgcuucauggucgccgacgacgccgccgccggcuccggcggcuccgcccaguggcagaagugccgccuccuccuccgccgcgccgucgccgaggagcgcuuccgccucgaguucuucgucccccccaaggccucccgccccaaggucuccaucccccucuccgccaucaucgagguccgcaccaccaugccccucgagaugcccgagaaggacaacaccuucguccucaaggucgagaacggcgccgaguacauccucgagaccaucgacucccuccagaagcacuccugggucgccgacauccagggcugcgucgaccccggcgacuccgaggaggacaccgagcucuccugcacccgcggcggcugccucgccucccgcgucgccuccugcuccugcgagcuccucaccgacgccgucgaccucccccgcccccccgagaccaccgccgucggcgccgucgucaccgccccccacucccgcggccgcgacgccguccgcgagucccucauccacgucccccucgagaccuuccuccagacccucgagucccccggcggcuccggcuccgacuccaacaacaccggcgagcagggcgccgagaccgaccccgaggccgagcccgagcucgagcucuccgacuaccccugguuccacggcacccucucccgcgucaaggccgcccagcucguccucgccggcggcccccgcaaccacggccucuucgucauccgccaguccgagacccgccccggcgaguacguccucaccuucaacuuccagggcaaggccaagcaccuccgccucucccucaacggccacggccagugccacguccagcaccucugguuccaguccguccucgacaugcuccgccacuuccacacccaccccaucccccucgaguccggcggcuccgccgacaucacccuccgcuccuacguccgcgcccaggaccccccccccgagcccggccccaccccccccgccgcccccgccucccccgccugcugguccgacucccccggccagcacuacuucuccucccucgccgccgccgccugcccccccgccucccccuccgacgccgccggcgccuccuccuccuccgccuccuccuccuccgccgccuccggccccgcccccccccgccccgucgagggccagcucuccgcccgcucccgcuccaacuccgccgagcgccuccucgaggccgucgccgccaccgccgccgaggagccccccgaggccgcccccggccgcgcccgcgccgucgagaaccaguacuccuucuacuga

SEQ ID NO: 49382 - RNA, 1122 nt, Artificial Sequence
  derived and/or modified sequence opt2 from SH2B3__Homo_sapiens__NP_001278353
augggcuuccccguccucugccgcggcuggcgccgcaccuggcccggcugcgccuccuggcucggcgccccccccccccagaagccccuccucuccccccuccuccucaaccaccgcuccuccaaguccucccgccccaagcuccaggccgccugcuccuccauccaggagguccgcuggugcacccgccucgagaugcccgacaaccucuacaccuucguccucaaggucaaggaccgcaccgacaucaucuucgaggucggcgacgagcagcagcucaacuccuggauggccgagcucuccgagugcaccggccgcggccucgaguccaccgaggccgagaugcacauccccuccgcccucgagcccuccaccuccuccuccccccgcggcuccaccgacucccucaaccagggcgccucccccggcggccuccucgaccccgccugccagaagaccgaccacuuccucuccugcuaccccugguuccacggccccaucucccgcgucaaggccgcccagcucguccagcuccagggccccgacgcccacggcgucuuccucguccgccaguccgagacccgccgcggcgaguacguccucaccuucaacuuccagggcaucgccaagcaccuccgccucucccucaccgagcgcggccagugccgcguccagcaccuccacuuccccuccgucgucgacaugcuccaccacuuccagcgcucccccaucccccucgagugcggcgccgccugcgacguccgccucuccuccuacgucgucgucgucucccagccccccggcuccugcaacaccguccucuuccccuucucccucccccacugggacuccgagucccucccccacuggggcuccgagcucggccucccccaccucuccuccuccggcugcccccgcggccucucccccgagggccuccccggccgcuccuccccccccgagcagaucuuccaccucguccccucccccgaggagcucgccaacucccuccagcaccucgagcacgagcccgucaaccgcgcccgcgacuccgacuacgagauggacuccuccucccgcucccaccuccgcgccaucgacaaccaguacaccccccucuga

SEQ ID NO: 49383 - RNA, 378 nt, Artificial Sequence
  derived and/or modified sequence opt2 from SH2D1A__Homo_sapiens__NP_001108409
auggacgccgucgccgucuaccacggcaagaucucccgcgagaccggcgagaagcuccuccucgccaccggccucgacggcuccuaccuccuccgcgacuccgaguccguccccggcgucuacugccucugcguccucuaccacggcuacaucuacaccuaccgcgucucccagaccgagaccggcuccugguccgccgagaccgcccccggcguccacaagcgcuacuuccgcaagaucaagaaccucaucuccgccuuccagaagcccgaccagggcaucgucaucccccuccaguaccccgucgagaagaaguccuccgcccgcuccacccagggcauccgcgaggaccccgacgucugccucaaggcccccuga

SEQ ID NO: 49384 - RNA, 1200 nt, Artificial Sequence
  derived and/or modified sequence opt2 from SH2D2A__Homo_sapiens__NP_001154913
auggaguucccccucgcccagaucugcccccagggcucccacgaggcccccauccccaccuucuccaccuuccagaucaccgacaugacccgccgcuccugccagaaccucggcuacaccgccgccuccccccaggcccccgaggccgccuccaacaccggcaacgccgagcgcgccgaggagguccccggcgagggcucccucuuccuccaggccgagacccgcgccugguuccagaagacccaggcccacuggcuccuccagcacggcgccgcccccgccugguuccacggcuucaucacccgccgcguccgccccccccucuccgucacccaccgcgaggccgagcgccuccucgagcccaagccccagggcugcuaccucguccgcuucuccgaguccgccgucaccuucguccucaccuaccgcucccgcaccugcugccgccacuuccuccucgcccagcuccgcgacggccgccacgucguccucggcgaggacuccgcccacgcccgccuccaggaccuccuccuccacuacaccgcccacccccucucccccuacggcgagacccucaccgagccccucgcccgccagacccccgagcccgccggccucucccuccgcaccgaggaguccaacuucggcuccaagucccaggaccccaacccccaguacucccccaucaucaagcagggccaggcccccguccccaugcagaaggagggcgccggcgagaaggagcccucccagcuccuccgccccaagccccccauccccgccaagccccagcucccccccgaggucuacaccauccccgucccccgccaccgccccgccccccgccccaagcccuccaaccccaucuacaacgagcccgacgagcccaucgccuucuacgccaugggccgcggcucccccggcgaggcccccuccaacaucuacgucgaggucgaggacgagggccuccccgccacccucggccaccccguccuccgcaaguccuggucccgccccguccccggcggccagaacaccggcggcucccagcuccacuccgagaacuccgucaucggccagggccccccccucccccaccagcccccccccgccuggcgccacacccucccccacaaccucucccgccagguccuccaggaccgcggccaggccuggcucccccucggccccccccaguga

SEQ ID NO: 49385 - RNA, 1731 nt, Artificial Sequence
  derived and/or modified sequence opt2 from SH2D3A__Homo_sapiens__NP_005481
augcaggucccccaggacggcgaggaccucgccggccagcccugguaccacggccuccucucccgccagaaggccgaggcccuccuccagcagaacggcgacuuccucguccgcgccuccggcucccgcggcggcaaccccgucaucuccugccgcuggcgcggcuccgcccuccacuucgaggucuuccgcgucgcccuccgcccccgccccggccgccccaccgcccucuuccagcucgaggacgagcaguuccccuccauccccgcccucguccacuccuacaugaccggccgccgcccccucucccaggccaccggcgccgucgucucccgccccgucaccuggcagggcccccuccgccgcuccuucuccgaggacacccucauggacggccccgcccgcaucgagccccuccgcgcccgcaagugguccaacucccagcccgccgaccucgcccacaugggccgcucccgcgaggaccccgccggcauggaggccuccaccaugcccaucuccgcccucccccgcaccuccuccgaccccguccuccucaaggcccccgccccccucggcaccgucgccgacucccuccgcgccuccgacggccagcuccaggccaaggcccccaccaagcccccccgcacccccuccuucgagcuccccgacgccuccgagcgcccccccaccuacugcgagcucgucccccgcguccccuccguccagggcaccucccccucccaguccugccccgagcccgaggcccccuggugggaggccgaggaggacgaggaggaggagaaccgcugcuucacccgcccccaggccgagaucuccuucugcccccacgacgcccccuccugccuccucggcccccagaaccgcccccucgagccccagguccuccacacccuccgcggccucuuccucgagcaccaccccggcuccaccgcccuccaccuccuccucgucgacugccaggccaccggccuccucggcgucacccgcgaccagcgcggcaacaugggcgucuccuccggccucgagcuccucacccucccccacggccaccaccuccgccucgagcuccucgagcgccaccagacccucgcccucgccggcgcccucgccguccucggcugcuccggcccccucgaggagcgcgccgccgcccuccgcggccucgucgagcucgcccucgcccuccgccccggcgccgccggcgaccuccccggccucgccgccgucaugggcgcccuccucaugccccaggucucccgccucgagcacaccuggcgccagcuccgccgcucccacaccgaggccgcccucgccuucgagcaggagcucaagccccucaugcgcgcccucgacgagggcgccggccccugcgaccccggcgaggucgcccucccccacgucgcccccaugguccgccuccucgagggcgaggaggucgccggcccccucgacgaguccugcgagcgccuccuccgcacccuccacggcgcccgccacaugguccgcgacgcccccaaguuccgcaaggucgccgcccagcgccuccgcggcuuccgccccaaccccgagcuccgcgaggcccucaccaccggcuucguccgccgccuccucuggggcucccgcggcgccggcgccccccgcgccgagcgcuucgagaaguuccagcgcguccucggcguccucucccagcgccucgagcccgaccgcuga

SEQ ID NO: 49386 - RNA, 2109 nt, Artificial Sequence
  derived and/or modified sequence opt2 from SH2D3C__Homo_sapiens__NP_001136005
augaccgagcgcugcucccucugguccgcccucuccgccgccgccugcugcuucuaccgcggcuccuucguccagguccaguucuccaaggagaaguacauccucgacuccucccccgagaagcuccacaaggagcucgaggaggagcucaagcucuccuccaccgaccuccgcucccacgccugguaccacggccgcaucccccgcgaggucuccgagacccucguccagcgcaacggcgacuuccucauccgcgacucccucaccucccucggcgacuacguccucaccugccgcuggcgcaaccaggcccuccacuucaagaucaacaaggucgucgucaaggccggcgaguccuacacccacauccaguaccucuucgagcaggaguccuucgaccacguccccgcccucguccgcuaccacgucggcucccgcaaggccgucuccgagcaguccggcgccaucaucuacugccccgucaaccgcaccuucccccuccgcuaccucgaggccuccuacggccucggccagggcuccuccaagcccgccucccccgucucccccuccggccccaagggcucccacaugaagcgccgcuccgucaccaugaccgacggccucaccgccgacaaggucacccgcuccgacggcugccccaccuccaccucccucccccgcccccgcgacuccauccgcuccugcgcccucuccauggaccagauccccgaccuccacucccccaugucccccaucuccgagucccccuccucccccgccuacuccaccgucacccgcguccacgccgcccccgccgcccccuccgccaccgcccuccccgccucccccgucgcccgccgcuccuccgagccccagcucugccccggcuccgcccccaagacccacggcgaguccgacaagggcccccacaccucccccucccacacccucggcaaggccucccccucccccucccucuccuccuacuccgaccccgacuccggccacuacugccagcuccagccccccguccgcggcucccgcgagugggccgccaccgagaccuccucccagcaggcccgcuccuacggcgagcgccucaaggagcucuccgagaacggcgcccccgagggcgacuggggcaagaccuucaccguccccaucgucgaggucaccuccuccuucaaccccgccaccuuccagucccuccucaucccccgcgacaaccgcccccucgaggucggccuccuccgcaaggucaaggagcuccucgccgaggucgacgcccgcacccucgcccgccacgucaccaaggucgacugccucgucgcccgcauccucggcgucaccaaggagaugcagacccucaugggcguccgcuggggcauggagcuccucacccucccccacggccgccagcuccgccucgaccuccucgagcgcuuccacaccauguccaucaugcucgccgucgacauccucggcugcaccggcuccgccgaggagcgcgccgcccuccuccacaagaccauccagcucgccgccgagcuccgcggcaccaugggcaacauguucuccuucgccgccgucaugggcgcccucgacauggcccagaucucccgccucgagcagaccugggucacccuccgccagcgccacaccgagggcgccauccucuacgagaagaagcucaagcccuuccucaagucccucaacgagggcaaggagggccccccccucuccaacaccaccuucccccacguccucccccucaucacccuccucgagugcgacuccgccccccccgagggccccgagcccuggggcuccaccgagcacggcgucgaggucguccucgcccaccucgaggccgcccgcaccgucgcccaccacggcggccucuaccacaccaacgccgaggucaagcuccagggcuuccaggcccgccccgagcuccucgaggucuucuccaccgaguuccagaugcgccuccucuggggcucccagggcgccuccuccucccaggcccgccgcuacgagaaguucgacaagguccucaccgcccucucccacaagcucgagcccgccguccgcuccuccgagcucuga

SEQ ID NO: 49387 - RNA, 1365 nt, Artificial Sequence
  derived and/or modified sequence opt2 from SH2D4A__Homo_sapiens__NP_001167630
augcucaagcagauccucuccgagauguacaucgaccccgaccuccucgccgagcucuccgaggagcagaagcagauccucuucuucaagaugcgcgaggagcagauccgccgcuggaaggagcgcgaggccgccauggagcgcaaggagucccuccccgucaagccccgccccaagaaggagaacggcaaguccguccacuggaagcucggcgccgacaaggaggucugggucugggucaugggcgagcaccaccucgacaagcccuacgacguccucugcaacgagaucaucgccgagcgcgcccgccucaaggccgagcaggaggccgaggagccccgcaagacccacuccgaggaguucaccaacucccucaagaccaagucccaguaccacgaccuccaggcccccgacaaccagcagaccaaggacaucuggaagaaggucgccgagaaggaggagcucgagcagggcucccgccccgcccccacccucgaggaggagaagauccgcucccucuccuccuccucccgcaacauccagcagaugcucgccgacuccaucaaccgcaugaaggccuacgccuuccaccagaagaaggaguccaugaagaagaagcaggacgaggagaucaaccagaucgaggaggagcgcaccaagcagaucugcaaguccuggaaggaggacuccgaguggcaggccucccuccgcaaguccaaggccgccgacgagaagcgccgcucccucgccaagcaggcccgcgaggacuacaagcgccucucccucggcgcccagaagggccgcggcggcgagcgccuccaguccccccuccgcgucccccagaagcccgagcgccccccccucccccccaagccccaguuccucaacuccggcgccuacccccagaagccccuccgcaaccagggcgucguccgcacccucuccuccuccgcccaggaggacaucauccgcugguucaaggaggagcagcucccccuccgcgccggcuaccagaagaccuccgacaccaucgcccccugguuccacggcauccucacccucaagaaggccaacgagcuccuccucuccaccggcaugcccggcuccuuccucauccgcgucuccgagcgcaucaagggcuacgcccucuccuaccucuccgaggacggcugcaagcacuuccucaucgacgccuccgccgacgccuacuccuuccucggcgucgaccagcuccagcacgccacccucgccgaccucgucgaguaccacaaggaggagcccaucaccucccucggcaaggagcuccuccucuaccccugcggccagcaggaccagcuccccgacuaccucgagcucuucgaguga

SEQ ID NO: 49388 - RNA, 930 nt, Artificial Sequence
  derived and/or modified sequence opt2 from SH2D4B__Homo_sapiens__NP_001139191
augcuccccgaggacuccggcggcucccccgacgccgccgccuccgacaagcacauccaguggcuccucggcgccgacggcgaggucugggucuggaucaugggcgagggccccggcgacaagcccuacgaggagaucuccgaggagcucaucgccgagcgcgcccgccuccaggcccagcgcgaggccgaggagcucuggcgccagaaggaggccgagaucaccaagaaguuccgcgacgcccucgccaacgagaaggcccgcauccucgccgagaaguggaaggucgagauggaggaccgcaaggccgccaagguccucgaggagcgcauccacgaggaguucaagcgcaaggaggaggaggagcgcaagcgcggcgaggagcagauccgccuccaggaggagcagcgcgccaaggagcucuacuggacccucaagcaggcccagcuccacugccaggccuccgagaaggaggagcgcgagugggaggagcagcuccgccgcuccaaggccgccgacgaggagcgcucccgccgcgcccagcgcgcccgcgacgaguaccgccaccacucccuccgcgccauccagaagggcaccgucgccggccucuccuccauguuccgcgagcucggccagucccacgagcaggaggcccgccucuaccaccaccuccccgaccccggccucccccagccccucgcccuccccgucucccgcaccugggagcgcccccuccgccccgucucccgcgacgucaucguccgcugguucaaggaggagcagcucccccgccgcgccggcuucgagcgcaacaccaaguucaucgcccccugguuccacggcggcaacuaccacugcuuccgccgccgcgucaccuccggcacccuccgcaccgagggccagcccacccgccuccccuccgucgucuga

SEQ ID NO: 49389 - RNA, 387 nt, Artificial Sequence
  derived and/or modified sequence opt2 from SH3BGR__Homo_sapiens__NP_001001713
augcgcgagaacguccccggcgagaagaagccccagaacggcaucccccuccccccccagaucuucaacgaggagcaguacugcggcgacuucgacuccuucuucuccgccaaggaggagaacaucaucuacuccuuccucggccucgcccccccccccgacuccaagggcuccgagaaggccgaggagggcggcgagaccgaggcccagaaggagggcuccgaggacgucggcaaccuccccgaggcccaggagaagaacgaggaggagggcgagaccgccaccgaggagaccgaggagaucgccauggagggcgccgagggcgaggccgaggaggaggaggagaccgccgagggcgaggagcccggcgaggacgaggacuccuga

SEQ ID NO: 49390 - RNA, 324 nt, Artificial Sequence
  derived and/or modified sequence opt2 from SH3BGRL2__Homo_sapiens__NP_113657
auggucauccgcgucuucaucgccuccuccuccggcuucgucgccaucaagaagaagcagcaggacgucguccgcuuccucgaggccaacaagaucgaguucgaggaggucgacaucaccauguccgaggagcagcgccaguggauguacaagaacgucccccccgagaagaagcccacccagggcaacccccuccccccccagaucuucaacggcgaccgcuacugcggcgacuacgacuccuucuucgaguccaaggaguccaacaccgucuucuccuuccucggccucaagccccgccucgccuccaaggccgagcccuga

SEQ ID NO: 49391 - RNA, 345 nt, Artificial Sequence
  derived and/or modified sequence opt2 from SH3BGRL__Homo_sapiens__NP_003013
auggucauccgcgucuacaucgccuccuccuccggcuccaccgccaucaagaagaagcagcaggacguccucggcuuccucgaggccaacaagaucggcuucgaggagaaggacaucgccgccaacgaggagaaccgcaaguggaugcgcgagaacguccccgagaacucccgccccgccaccggcuacccccuccccccccagaucuucaacgagucccaguaccgcggcgacuacgacgccuucuucgaggcccgcgagaacaacgccgucuacgccuuccucggccucaccgccccccccggcuccaaggaggccgagguccaggccaagcagcaggccuga

SEQ ID NO: 49392 - RNA, 2106 nt, Artificial Sequence
  derived and/or modified sequence opt2 from SH3BP1__Homo_sapiens__NP_061830
augaugaagcgccagcuccaccgcaugcgccagcucgcccagaccggcucccucggccgcacccccgagaccgccgaguuccucggcgaggaccuccuccaggucgagcagcgccucgagcccgccaagcgcgccgcccacaacauccacaagcgccuccaggccugccuccagggccaguccggcgccgacauggacaagcgcgucaagaagcucccccucauggcccucuccaccaccauggccgaguccuucaaggagcucgaccccgacuccuccaugggcaaggcccucgagauguccugcgccauccagaaccagcucgcccgcauccucgccgaguucgagaugacccucgagcgcgacguccuccagccccucucccgccucuccgaggaggagcuccccgccauccucaagcacaagaagucccuccagaagcucgucuccgacuggaacacccucaagucccgccucucccaggccaccaagaacuccggcuccucccagggccucggcggcucccccggcucccacucccacaccaccauggccaacaaggucgagacccucaaggaggaggaggaggagcucaagcgcaaggucgagcagugccgcgacgaguaccucgccgaccucuaccacuucgucaccaaggaggacuccuacgccaacuacuucauccgccuccucgagauccaggccgacuaccaccgccgcucccucuccucccucgacaccgcccucgccgagcuccgcgagaaccacggccaggccgaccacucccccuccaugaccgccacccacuucccccgcgucuacggcgucucccucgccacccaccuccaggagcucggccgcgagaucgcccuccccaucgaggccugcgucaugaugcuccucuccgagggcaugaaggaggagggccucuuccgccucgccgccggcgccuccguccucaagcgccucaagcagaccauggccuccgacccccacucccucgaggaguucugcuccgacccccacgccgucgccggcgcccucaaguccuaccuccgcgagcuccccgagccccucaugaccuucgaccucuacgacgacuggaugcgcgccgccucccucaaggagcccggcgcccgccuccaggcccuccaggaggucugcucccgccucccccccgagaaccucuccaaccuccgcuaccucaugaaguuccucgcccgccucgccgaggagcaggaggucaacaagaugacccccuccaacaucgccaucguccucggccccaaccuccucuggccccccgagaaggagggcgaccaggcccagcucgacgccgccuccgucuccuccauccaggucgucggcgucgucgaggcccucauccaguccgccgacacccucuuccccggcgacaucaacuucaacgucuccggccucuucuccgccgucacccuccaggacaccgucuccgaccgccucgccuccgaggagcuccccuccaccgccguccccacccccgccaccacccccgcccccgcccccgcccccgcccccgcccccgcccccgcccucgccuccgccgccaccaaggagcgcaccgaguccgagguccccccccgccccgccucccccaaggucacccgcuccccccccgagaccgccgcccccgucgaggacauggcccgccgcaccaagcgccccgcccccgcccgccccaccaugccccccccccaggucuccggcucccgcuccuccccccccgcccccccccucccccccggcuccggcucccccggcaccccccaggcccucccccgccgccucgucggcuccucccuccgcgcccccaccgucccccccccccucccccccacccccccccagcccgcccgccgccagucccgccgcucccccgccucccccucccccgccucccccggccccgccucccccucccccgucucccucuccaaccccgcccaggucgaccucggcgccgccaccgccgagggcggcgcccccgaggccaucuccggcguccccaccccccccgccauccccccccagccccgcccccgcucccucgccuccgagaccaacuga

SEQ ID NO: 49393 - RNA, 1770 nt, Artificial Sequence
  derived and/or modified sequence opt2 from SH3BP2__Homo_sapiens__NP_001139327
auggccucccucggcccccgcacccccgcccccucccgcucccgcggccgccgcgccaugugcugggucuccaccaucuccuucauggccgccgaggagaugcacuggcccguccccaugaaggccaucggcgcccagaaccuccucaccaugcccggcggcgucgccaaggccggcuaccuccacaagaagggcggcacccagcuccagcuccucaaguggccccuccgcuucgucaucauccacaagcgcugcgucuacuacuucaaguccuccaccuccgccuccccccagggcgccuucucccucuccggcuacaaccgcgucaugcgcgccgccgaggagaccaccuccaacaacgucuuccccuucaagaucauccacaucuccaagaagcaccgcaccugguucuucuccgccuccuccgaggaggagcgcaaguccuggauggcccuccuccgccgcgagaucggccacuuccacgagaagaaggaccucccccucgacaccuccgacuccuccuccgacaccgacuccuucuacggcgccgucgagcgccccgucgacaucucccucucccccuaccccaccgacaacgaggacuacgagcacgacgacgaggacgacuccuaccucgagcccgacucccccgagcccggccgccucgaggacgcccucaugcacccccccgccuacccccccccccccguccccaccccccgcaagcccgccuucuccgacaugccccgcgcccacuccuucaccuccaagggccccggcccccuccuccccccccccccccccaagcacggccuccccgacgucggccucgccgccgaggacuccaagcgcgacccccucugcccccgccgcgccgagcccugcccccgcguccccgccaccccccgccgcauguccgaccccccccucuccaccaugcccaccgcccccggccuccgcaagccccccugcuuccgcgaguccgccucccccucccccgagcccuggacccccggccacggcgccugcuccaccuccuccgccgccaucauggccaccgccaccucccgcaacugcgacaagcucaaguccuuccaccucuccccccgcggcccccccaccuccgagcccccccccguccccgccaacaagcccaaguuccucaagaucgccgaggaggaccccccccgcgaggccgccaugcccggccucuucgucccccccgucgccccccgcccccccgcccucaagcuccccguccccgaggccauggcccgccccgccguccucccccgccccgagaagccccagcucccccaccuccagcgcuccccccccgacggccaguccuuccgcuccuucuccuucgagaagccccgccagcccucccaggccgacaccggcggcgacgacuccgacgaggacuacgagaaggucccccuccccaacuccgucuucgucaacaccaccgaguccugcgaggucgagcgccucuucaaggccaccuccccccgcggcgagccccaggacggccucuacugcauccgcaacuccuccaccaaguccggcaagguccucgucgucugggacgagaccuccaacaagguccgcaacuaccgcaucuucgagaaggacuccaaguucuaccucgagggcgagguccucuucgucuccgucggcuccauggucgagcacuaccacacccacguccuccccucccaccagucccuccuccuccgccaccccuacggcuacaccggcccccgcuga

SEQ ID NO: 49394 - RNA, 2892 nt, Artificial Sequence
  derived and/or modified sequence opt2 from SH3BP4__Homo_sapiens__XP_011509196
auggccgcccagcgcauccgcgccgccaacuccaacggccucccccgcugcaaguccgagggcacccucaucgaccucuccgagggcuucuccgagaccuccuucaacgacaucaagguccccucccccuccgcccuccucgucgacaaccccacccccuucggcaacgccaaggaggucaucgccaucaaggacuacugccccaccaacuucaccacccucaaguucuccaagggcgaccaccucuacguccucgacaccuccggcggcgaguggugguacgcccacaacaccaccgagaugggcuacauccccuccuccuacguccagccccucaacuaccgcaacuccacccucuccgacuccggcaugaucgacaaccuccccgacucccccgacgaggucgccaaggagcucgagcuccucggcggcuggaccgacgacaagaagguccccggccgcauguacuccaacaaccccuucuggaacggcguccagaccaaccccuuccucaacggcaacguccccgucaugcccucccucgacgagcucaaccccaaguccaccgucgaccuccuccucuucgacgccggcaccuccuccuucaccgaguccuccuccgccaccaccaacuccaccggcaacaucuucgacgagcuccccgucaccaacggccuccacgccgagccccccguccgccgcgacaaccccuucuuccgcuccaagcgcuccuacucccucuccgagcucuccguccuccaggccaaguccgacgcccccaccuccuccuccuucuucaccggccucaagucccccgcccccgagcaguuccagucccgcgaggacuuccgcaccgccuggcucaaccaccgcaagcucgcccgcuccugccacgaccucgaccuccucggccagucccccggcuggggccagacccaggccgucgagaccaacaucgucugcaagcucgacuccuccggcggcgccguccagcuccccgacaccuccaucuccauccacguccccgagggccacgucgcccccggcgagacccagcagaucuccaugaaggcccuccucgaccccccccucgagcucaacuccgaccgcuccugcuccaucucccccguccucgaggucaagcucuccaaccucgaggucaagaccuccaucauccucgagaugaaggucuccgccgagaucaagaacgaccucuucuccaaguccaccgucggccuccagugccuccgcuccgacuccaaggagggccccuacgucuccgucccccucaacugcuccugcggcgacaccguccaggcccagcuccacaaccucgagcccugcauguacgucgccgucgucgcccacggccccuccauccucuaccccuccaccgucugggacuucaucaacaagaaggucaccgucggccucuacggccccaagcacauccaccccuccuucaagaccgucgucaccaucuucggccacgacugcgcccccaagacccuccucgucuccgaggucacccgccaggcccccaaccccgcccccgucgcccuccagcucuggggcaagcaccaguucguccucucccgcccccaggaccucaaggucugcauguucuccaacaugaccaacuacgaggucaaggccuccgagcaggccaaggucguccgcggcuuccagcucaagcucggcaaggucucccgccucaucuuccccaucaccucccagaaccccaacgagcucuccgacuucacccuccgcguccaggucaaggacgaccaggaggccauccucacccaguucugcguccagaccccccagcccccccccaaguccgccaucaagcccuccggccagcgccgcuuccucaagaagaacgaggucggcaagaucauccucucccccuucgccaccaccaccaaguaccccaccuuccaggaccgccccgucuccucccucaaguucggcaagcuccucaagaccgucguccgccagaacaagaaccacuaccuccucgaguacaagaagggcgacggcaucgcccuccucuccgaggagcgcguccgccuccgcggccagcucuggaccaaggagugguacaucggcuacuaccagggccgcgucggccucguccacaccaagaacguccucgucgucggccgcgcccgccccucccucugcuccggccccgagcucuccaccuccguccuccucgagcagauccuccgccccugcaaguuccucaccuacaucuacgccuccguccgcacccuccucauggagaacaucuccuccuggcgcuccuucgccgacgcccucggcuacgucaaccucccccucaccuucuucugccgcgccgagcucgacuccgagcccgagcgcgucgccuccguccucgagaagcucaaggaggacugcaacaacaccgagaacaaggagcgcaaguccuuccagaaggagcucgucauggcccuccucaagauggacugccagggccucgucguccgccucauccaggacuucguccuccucaccaccgccgucgaggucgcccagcgcuggcgcgagcucgccgagaagcucgccaaggucuccaagcagcagauggacgccuacgaguccccccaccgcgaccgcaacggcgucgucgacuccgaggccauguggaagcccgccuacgacuuccuccucaccuggucccaccagaucggcgacuccuaccgcgacgucauccaggagcuccaccucggccucgacaagaugaagaaccccaucaccaagcgcuggaagcaccucaccggcacccucauccucgucaacucccucgacguccuccgcgccgccgccuucucccccgccgaccaggacgacuucgucaucuga

SEQ ID NO: 49395 - RNA, 897 nt, Artificial Sequence
  derived and/or modified sequence opt2 from SH3BP5__Homo_sapiens__NP_001018009
augcucaaccacgccacccagcgcgucauggaggccgagcagaccaagacccgcuccgagcucguccacaaggagaccgccgcccgcuacaacgccgccaugggccgcaugcgccagcucgagaagaagcucaagcgcgccaucaacaaguccaagcccuacuucgagcucaaggccaaguacuacguccagcucgagcagcucaagaagaccgucgacgaccuccaggccaagcucacccucgccaagggcgaguacaagauggcccucaagaaccucgagaugaucuccgacgagauccacgagcgccgccgcuccuccgccaugggcccccgcggcugcggcgucggcgccgagggcuccuccaccuccgucgaggaccuccccggcuccaagcccgagcccgacgccaucuccgucgccuccgaggccuucgaggacgacuccugcuccaacuucgucuccgaggacgacuccgagacccaguccgucuccuccuucuccuccggccccaccucccccuccgagaugcccgaccaguuccccgccgucguccgccccggcucccucgaccuccccucccccgucucccucuccgaguucggcaugauguuccccguccucggcccccgcuccgagugcuccggcgccuccucccccgagugcgaggucgagcgcggcgaccgcgccgagggcgccgagaacaagaccuccgacaaggccaacaacaaccgcggccucuccuccuccuccggcuccggcggcuccuccaagucccaguccuccaccucccccgagggccaggcccucgagaaccgcaugaagcagcucucccuccagugcuccaagggccgcgacggcaucaucgccgacaucaagaugguccagaucggcuga

SEQ ID NO: 49396 - RNA, 2373 nt, Artificial Sequence
  derived and/or modified sequence opt2 from SH3D19__Homo_sapiens__NP_001009555
augaacaucaugaacaccgagcagucccagaacuccaucgucucccgcaucaaggucuucgagggccagaccaacaucgagaccuccggccuccccaagaagcccgagaucaccccccgcucccucccccccaagcccaccgucuccuccggcaagcccuccgucgcccccaagcccgccgccaaccgcgccuccggcgagugggacuccggcaccgagaaccgccucaaggucaccuccaaggagggccucacccccuaccccccccuccaggaggccggcuccauccccgucaccaagcccgagcuccccaagaagcccaaccccggccucauccgcuccgucaaccccgagauccccggccgcggcccccucgccgaguccuccgacuccggcaagaagguccccacccccgccccccgcccccuccuccucaagaaguccgucuccuccgagaaccccaccuaccccuccgccccccucaagcccgucaccguccccccccgccucgccggcgccucccaggccaaggccuacaagucccucggcgagggcccccccgccaacccccccguccccguccuccaguccaagccccucgucgacaucgaccucaucuccuucgacgacgacguccuccccacccccuccggcaaccucgccgaggaguccgucggcuccgagaugguccucgaccccuuccagcuccccgccaagaccgagcccaucaaggagcgcgccguccagcccgcccccacccgcaagcccaccgucauccgcauccccgccaagcccggcaagugccuccacgaggacccccaguccccccccccccuccccgccgagaagcccaucggcaacaccuucuccaccgucuccggcaagcucuccaacgucgagcgcacccgcaaccucgaguccaaccaccccggccagaccggcggcuucguccgcguccccccccgccuccccccccgccccgucaacggcaagaccauccccacccagcagccccccaccaaggucccccccgagcgcccccccccccccaagcucuccgccacccgccgcuccaacaagaagcuccccuucaaccgcuccuccuccgacauggaccuccagaagaagcaguccaaccucgccaccggccucuccaaggccaagucccaggucuucaagaaccaggaccccguccuccccccccgccccaagcccggccacccccucuacuccaaguacaugcucuccgucccccacggcaucgccaacgaggacaucgucucccagaaccccggcgagcucuccugcaagcgcggcgacguccucgucaugcucaagcagaccgagaacaacuaccucgagugccagaagggcgaggacaccggccgcguccaccucucccagaugaagaucaucaccccccucgacgagcaccuccgcucccgccccaacgaccccucccacgcccagaagcccgucgacuccggcgccccccacgccgucguccuccacgacuuccccgccgagcaggucgacgaccucaaccucaccuccggcgagaucgucuaccuccucgagaagaucgacaccgacugguaccgcggcaacugccgcaaccagaucggcaucuuccccgccaacuacgucaaggucaucaucgacauccccgagggcggcaacggcaagcgcgagugcgucuccucccacugcgucaagggcucccgcugcgucgcccgcuucgaguacaucggcgagcagaaggacgagcucuccuucuccgagggcgagaucaucauccucaaggaguacgucaacgaggagugggcccgcggcgagguccgcggccgcaccggcaucuucccccucaacuucgucgagcccgucgaggacuaccccaccuccggcgccaacguccucuccaccaaggucccccucaagaccaagaaggaggacuccggcuccaacucccaggucaacucccuccccgccgaguggugcgaggcccuccacuccuucaccgccgagaccuccgacgaccucuccuucaagcgcggcgaccgcauccagauccucgagcgccucgacuccgacuggugccgcggccgccuccaggaccgcgagggcaucuuccccgccgucuucguccgccccugccccgccgaggccaaguccaugcucgccaucguccccaagggccgcaaggccaaggcccucuacgacuuccgcggcgagaacgaggacgagcucuccuucaaggccggcgacaucaucaccgagcucgaguccgucgacgacgacuggauguccggcgagcucaugggcaaguccggcaucuuccccaagaacuacauccaguuccuccagaucuccuga

SEQ ID NO: 49397 - RNA, 963 nt, Artificial Sequence
  derived and/or modified sequence opt2 from SH3GL1__Homo_sapiens__NP_001186872
auguccgucgccggccucaagaagcaguucuacaaggccucccagcucgucuccgagaaggucggcggcgccgagggcaccaagcucgacgacgacuucaaggagauggagaagaaggucgacgucaccuccaaggccgucaccgagguccucgcccgcaccaucgaguaccuccagcccaaccccggcgacgcccuccucgacgccggcgaguccaugaagcgccucgccgaggucaaggacucccucgacaucgaggucaagcagaacuucaucgacccccuccagaaccucugcgagaaggaccucaaggagauccagcaccaccucaagaagcucgagggccgccgccucgacuucgacuacaagaagaagcgccagggcaagauccccgacgaggagcuccgccaggcccucgagaaguucgaggaguccaaggaggucgccgagaccuccaugcacaaccuccucgagaccgacaucgagcaggucucccagcucuccgcccucgucgacgcccagcucgacuaccaccgccaggccguccagauccucgacgagcucgccgagaagcucaagcgccgcaugcgcgaggccuccucccgccccaagcgcgaguacaagcccaagccccgcgagcccuucgaccucggcgagcccgagcaguccaacggcggcuuccccugcaccaccgcccccaagaucgccgccuccuccuccuuccgcuccuccgacaagcccauccgcacccccucccgcuccaugcccccccucgaccagcccuccugcaaggcccucuacgacuucgagcccgagaacgacggcgagcucggcuuccacgagggcgacgucaucacccucaccaaccagaucgacgagaacugguacgagggcaugcucgacggccaguccggcuucuucccccucuccuacgucgagguccucgucccccucccccaguga

SEQ ID NO: 49398 - RNA, 1059 nt, Artificial Sequence
  derived and/or modified sequence opt2 from SH3GL2__Homo_sapiens__NP_003017
auguccgucgccggccucaagaagcaguuccacaaggccacccagaaggucuccgagaaggucggcggcgccgagggcaccaagcucgacgacgacuucaaggagauggagcgcaaggucgacgucaccucccgcgccgucauggagaucaugaccaagaccaucgaguaccuccagcccaaccccgccucccgcgccaagcucuccaugaucaacaccauguccaagauccgcggccaggagaagggccccggcuacccccaggccgaggcccuccucgccgaggccaugcucaaguucggccgcgagcucggcgacgacugcaacuucggccccgcccucggcgaggucggcgaggccaugcgcgagcucuccgaggucaaggacucccucgacaucgaggucaagcagaacuucaucgacccccuccagaaccuccacgacaaggaccuccgcgagauccagcaccaccucaagaagcucgagggccgccgccucgacuucgacuacaagaagaagcgccagggcaagauccccgacgaggagcuccgccaggcccucgagaaguucgacgaguccaaggagaucgccgaguccuccauguucaaccuccucgagauggacaucgagcaggucucccagcucuccgcccucguccaggcccagcucgaguaccacaagcaggccguccagauccuccagcaggucaccguccgccucgaggagcgcauccgccaggccuccucccagccccgccgcgaguaccagcccaagccccgcaugucccucgaguuccccaccggcgacuccacccagcccaacggcggccucucccacaccggcacccccaagcccuccggcguccagauggaccagcccugcugccgcgcccucuacgacuucgagcccgagaacgagggcgagcucggcuucaaggagggcgacaucaucacccucaccaaccagaucgacgagaacugguacgagggcaugcuccacggccacuccggcuucuuccccaucaacuacgucgagauccucgucgcccucccccacuga

SEQ ID NO: 49399 - RNA, 1068 nt, Artificial Sequence
  derived and/or modified sequence opt2 from SH3GL3__Homo_sapiens__NP_001288038
auggacggcaucuucgccggcaucaucugcaaccaggccaaccgcugccucaccuggaccucccagcagcucuucuccgagaagaucuccggcgccgagggcaccaagcucgacgacgaguuccucgacauggagcgcaagaucgacgucaccaacaaggucgucgccgagauccucuccaagaccaccgaguaccuccagcccaaccccgccuaccgcgccaagcucggcaugcucaacaccgucuccaagauccgcggccaggucaagaccaccggcuacccccagaccgagggccuccucggcgacugcaugcucaaguacggcaaggagcucggcgaggacuccaccuucggcaacgcccucaucgaggucggcgaguccaugaagcucauggccgaggucaaggacucccucgacaucaacgucaagcagaccuucaucgacccccuccagcuccuccaggacaaggaccucaaggagaucggccaccaccucaagaagcucgagggccgccgccucgacuacgacuacaagaagaagcgcgucggcaagauccccgacgaggagguccgccaggccgucgagaaguucgaggaguccaaggagcucgccgagcgcuccauguucaacuuccucgagaacgacgucgagcaggucucccagcucgccgucuucaucgaggccgcccucgacuaccaccgccaguccaccgagauccuccaggagcuccaguccaagcuccagaugcgcaucuccgccgccuccuccgucccccgccgcgaguacaagccccgccccgucaagcgcuccuccuccgagcucaacggcgucuccaccaccuccgucgucaagaccaccggcuccaacauccccauggaccagcccugcugccgcggccucuacgacuucgagcccgagaaccagggcgagcucggcuucaaggagggcgacaucaucacccucaccaaccagaucgacgagaacugguacgagggcaugauccacggcgaguccggcuucuuccccaucaacuacgucgaggucaucgucccccucccccaguga

SEQ ID NO: 49400 - RNA, 1887 nt, Artificial Sequence
  derived and/or modified sequence opt2 from SH3KBP1__Homo_sapiens__NP_001019837
auggaggucuccgccgccaaggcccccuccgccgccgaccucuccgagaucgagaucaagaaggagaugaagaaggacccccucaccaacaaggcccccgagaagccccuccacgagguccccuccggcaacucccuccucuccuccgagaccauccuccgcaccaacaagcgcggcgagcgccgccgccgccgcugccaggucgccuucuccuaccucccccagaacgacgacgagcucgagcucaaggucggcgacaucaucgaggucgucggcgaggucgaggagggcuggugggagggcguccucaacggcaagaccggcauguuccccuccaacuucaucaaggagcucuccggcgaguccgacgagcucggcaucucccaggacgagcagcucuccaaguccucccuccgcgagaccaccggcuccgaguccgacggcggcgacuccuccuccaccaaguccgagggcgccaacggcaccgucgccaccgccgccauccagcccaagaaggucaagggcgucggcuucggcgacaucuucaaggacaagcccaucaagcuccgcccccgcuccaucgaggucgagaacgacuuccuccccgucgagaagaccaucggcaagaagcuccccgccaccaccgccacccccgacuccuccaagaccgagauggacucccgcaccaaguccaaggacuacugcaaggucaucuuccccuacgaggcccagaacgacgacgagcucaccaucaaggagggcgacaucgucacccucaucaacaaggacugcaucgacgucggcuggugggagggcgagcucaacggccgccgcggcgucuuccccgacaacuucgucaagcuccucccccccgacuucgagaaggagggcaaccgccccaagaagccccccccccccuccgcccccgucaucaagcagggcgccggcaccaccgagcgcaagcacgagaucaagaagaucccccccgagcgccccgagaugcuccccaaccgcaccgaggagaaggagcgccccgagcgcgagcccaagcucgaccuccagaagcccuccguccccgccaucccccccaagaagccccgcccccccaagaccaacucccucucccgccccggcgcccuccccccccgccgccccgagcgccccgucggcccccucacccacacccgcggcgacucccccaagaucgaccucgccggcuccucccucuccggcauccucgacaaggaccucuccgaccgcuccaacgacaucgaccucgagggcuucgacuccgucgucuccuccaccgagaagcucucccaccccaccaccucccgccccaaggccaccggccgccgcccccccucccagucccucaccuccuccucccucuccucccccgacaucuucgacucccccucccccgaggaggacaaggaggagcacaucucccucgcccaccgcggcgucgacgccuccaagaagaccuccaagaccgucaccaucucccaggucuccgacaacaaggccucccucccccccaagcccggcaccauggccgccggcggcggcggccccgccccccucuccuccgccgcccccuccccccucuccuccucccucggcaccgccggccaccgcgccaacucccccucccucuucggcaccgagggcaagcccaagauggagcccgccgccuccucccaggccgccgucgaggagcuccgcacccagguccgcgagcuccgcuccaucaucgagaccaugaaggaccagcagaagcgcgagaucaagcagcuccucuccgagcucgacgaggagaagaagauccgccuccgccuccagauggaggucaacgacaucaagaaggcccuccaguccaaguga

SEQ ID NO: 49401 - RNA, 3318 nt, Artificial Sequence
  derived and/or modified sequence opt2 from SH3PXD2A__Homo_sapiens__NP_055446
augcucgccuacugcguccaggacgccaccgucgucgacgucgagaagcgccgcaaccccuccaagcacuacgucuacaucaucaacgucaccugguccgacuccaccucccagaccaucuaccgccgcuacuccaaguucuucgaccuccagaugcagcuccucgacaaguuccccaucgagggcggccagaaggaccccaagcagcgcaucauccccuuccuccccggcaagauccucuuccgccgcucccacauccgcgacgucgccgucaagcgccucaagcccaucgacgaguacugccgcgcccucguccgccuccccccccacaucucccagugcgacgaggucuuccgcuucuucgaggcccgccccgaggacgucaacccccccaaggaggacuacggcuccuccaagcgcaaguccgucuggcucuccuccugggccgagucccccaagaaggacgucaccggcgccgacgccaccgccgagcccaugauccucgagcaguacgucgucgucuccaacuacaagaagcaggagaacuccgagcucucccuccaggccggcgaggucgucgacgucaucgagaagaacgaguccggcuggugguucgucuccaccuccgaggagcagggcuggguccccgccaccuaccucgaggcccagaacggcacccgcgacgacuccgacaucaacaccuccaagaccggcgaggaggagaaguacgucaccguccagcccuacaccucccaguccaaggacgagaucggcuucgagaagggcgucaccgucgaggucauccgcaagaaccucgagggcuggugguacauccgcuaccucggcaaggagggcugggcccccgccuccuaccucaagaaggccaaggacgaccuccccacccgcaagaagaaccucgccggccccgucgagaucaucggcaacaucauggagaucuccaaccuccucaacaagaaggccuccggcgacaaggagaccccccccgccgagggcgagggccacgaggcccccaucgccaagaaggagaucucccuccccauccucugcaacgccuccaacggcuccgccgucggcguccccgaccgcaccgucucccgccucgcccagggcucccccgccgucgcccgcaucgccccccagcgcgcccagaucuccucccccaaccuccgcacccgcccccccccccgccgcgaguccucccucggcuuccagcuccccaagccccccgagccccccuccgucgaggucgaguacuacaccaucgccgaguuccaguccugcaucuccgacggcaucuccuuccgcggcggccagaaggccgaggucaucgacaagaacuccggcggcuggugguacguccagaucggcgagaaggagggcugggcccccgccuccuacaucgacaagcgcaagaagcccaaccucucccgccgcaccuccacccucacccgccccaagguccccccccccgccccccccuccaagcccaaggaggccgaggagggccccaccggcgccuccgagucccaggacuccccccgcaagcucaaguacgaggagcccgaguacgacauccccgccuucggcuucgacuccgagcccgagcucuccgaggagcccgucgaggaccgcgccuccggcgagcgccgccccgcccagccccaccgccccucccccgccuccucccuccagcgcgcccgcuucaaggucggcgaguccuccgaggacgucgcccucgaggaggagaccaucuacgagaacgagggcuuccgccccuacgccgaggacacccucuccgcccgcggcuccuccggcgacuccgacucccccggcuccuccucccucucccucacccgcaagaacucccccaaguccggcucccccaaguccuccucccuccucaagcucaaggccgagaagaacgcccaggccgagaugggcaagaaccacuccuccgccuccuucuccuccuccaucaccaucaacaccaccugcugcuccuccuccuccuccuccuccuccucccucuccaagaccuccggcgaccucaagccccgcuccgccuccgacgccggcauccgcggcacccccaagguccgcgccaagaaggacgccgacgccaacgccggccucaccuccugcccccgcgccaagcccuccguccgccccaagcccuuccucaaccgcgccgagucccagucccaggagaagauggacaucuccacccuccgccgccagcuccgccccaccggccagcuccgcggcggccucaagggcuccaaguccgaggacuccgagcuccccccccagaccgccuccgaggcccccuccgagggcucccgccgcuccuccuccgaccucaucacccuccccgccaccaccccccccugccccaccaagaaggagugggagggccccgccaccuccuacaugaccugcuccgccuaccagaagguccaggacuccgagaucuccuuccccgccggcgucgagguccagguccucgagaagcaggaguccggcuggugguacguccgcuucggcgagcucgagggcugggcccccucccacuaccucguccucgacgagaacgagcagcccgaccccuccggcaaggagcucgacaccguccccgccaagggccgccagaacgagggcaaguccgacucccucgagaagaucgagcgccgcguccaggcccucaacaccgucaaccaguccaagaaggccaccccccccauccccuccaagccccccggcggcuucggcaagaccuccggcacccccgccgucaagaugcgcaacggcguccgccaggucgccguccgcccccaguccgucuucgucucccccccccccaaggacaacaaccucuccugcgcccuccgccgcaacgagucccucaccgccaccgacggccuccgcggcguccgccgcaacuccuccuucuccaccgcccgcuccgccgccgccgaggccaagggccgccucgccgagcgcgccgccucccagggcuccgacuccccccuccuccccgcccagcgcaacuccauccccgucucccccguccgccccaagcccaucgagaagucccaguucauccacaacaaccucaaggacgucuacgucuccaucgccgacuacgagggcgacgaggagaccgccggcuuccaggagggcgucuccauggagguccucgagcgcaaccccaacggcuggugguacugccagauccucgacggcgucaagcccuucaagggcuggguccccuccaacuaccucgagaagaagaacuga

SEQ ID NO: 49402 - RNA, 2736 nt, Artificial Sequence
  derived and/or modified sequence opt2 from SH3PXD2B__Homo_sapiens__NP_001017995
augcccccccgccgcuccaucgucgaggucaagguccucgacguccagaagcgccgcguccccaacaagcacuacgucuacaucauccgcgucaccugguccuccggcuccaccgaggccaucuaccgccgcuacuccaaguucuucgaccuccagaugcagaugcucgacaaguuccccauggagggcggccagaaggaccccaagcagcgcaucauccccuuccuccccggcaagauccucuuccgccgcucccacauccgcgacgucgccgucaagcgccucauccccaucgacgaguacugcaaggcccucauccagcucccccccuacaucucccagugcgacgagguccuccaguucuucgagacccgccccgaggaccucaacccccccaaggaggagcacaucggcaagaagaaguccggcggcgaccagaccuccgucgaccccaugguccucgagcaguacgucgucgucgccaacuaccagaagcaggaguccuccgagaucucccucuccgucggccaggucgucgacaucaucgagaagaacgaguccggcuggugguucgucuccaccgccgaggagcagggcuggguccccgccaccugccucgagggccaggacggcguccaggacgaguucucccuccagcccgaggaggaggagaaguacaccgucaucuaccccuacaccgcccgcgaccaggacgagaugaaccucgagcgcggcgccgucgucgaggucauccagaagaaccucgagggcugguggaagauccgcuaccagggcaaggagggcugggcccccgccuccuaccucaagaagaacuccggcgagccccucccccccaagcccggccccggcucccccucccaccccggcgcccucgaccucgacggcgucucccgccagcagaacgccgucggccgcgagaaggagcuccucuccucccagcgcgacggccgcuucgagggccgccccguccccgacggcgacgccaagcagcgcucccccaagaugcgccagcgcccccccccccgccgcgacaugaccaucccccgcggccucaaccuccccaagccccccauccccccccaggucgaggaggaguacuacaccaucgccgaguuccagaccaccauccccgacggcaucuccuuccaggccggccucaaggucgaggucaucgagaagaaccucuccggcuggugguacauccagaucgaggacaaggagggcugggcccccgccaccuucaucgacaaguacaagaagaccuccaacgccucccgccccaacuuccucgccccccucccccacgaggucacccagcuccgccucggcgaggccgccgcccucgagaacaacaccggcuccgaggccaccggccccucccgcccccuccccgacgccccccacggcgucauggacuccggccuccccugguccaaggacuggaagggcuccaaggacguccuccgcaaggccuccuccgacauguccgccuccgccggcuacgaggagaucuccgaccccgacauggaggagaagcccucccuccccccccgcaaggaguccaucaucaaguccgagggcgagcuccucgagcgcgagcgcgagcgccagcgcaccgagcagcuccgcggccccacccccaagccccccggcgucauccuccccaugaugcccgccaagcacaucccccccgcccgcgacucccgccgccccgagcccaagcccgacaagucccgccucuuccagcucaagaacgacaugggccucgagugcggccacaagguccucgccaaggaggucaagaagcccaaccuccgccccaucuccaaguccaagaccgaccuccccgaggagaagcccgacgccaccccccagaaccccuuccucaagucccgcccccagguccgccccaagcccgcccccucccccaagaccgagcccccccagggcgaggaccaggucgacaucugcaaccuccgcuccaagcuccgccccgccaagucccaggacaagucccuccucgacggcgagggcccccaggccgucggcggccaggacgucgccuucucccgcuccuuccuccccggcgagggccccggccgcgcccaggaccgcaccggcaagcaggacggccucucccccaaggagaucuccugccgcgcccccccccgccccgccaagaccaccgaccccgucuccaaguccguccccgucccccuccaggaggccccccagcagcgccccgucguccccccccgccgcccccccccccccaagaagaccuccuccuccucccgcccccuccccgagguccgcggcccccagugcgagggccacgagucccgcgccgcccccacccccggccgcgcccuccucgucccccccaaggccaagcccuuccucuccaacucccucggcggccaggacgacacccgcggcaagggcucccucggccccuggggcaccggcaagaucggcgagaaccgcgagaaggccgccgccgccuccguccccaacgccgacggccucaaggacucccucuacgucgccgucgccgacuucgagggcgacaaggacaccuccuccuuccaggagggcaccgucuucgagguccgcgagaagaacuccuccggcuggugguucugccagguccucuccggcgcccccuccugggagggcuggauccccuccaacuaccuccgcaagaagcccuga

SEQ ID NO: 49403 - RNA, 2667 nt, Artificial Sequence
  derived and/or modified sequence opt2 from SH3RF1__Homo_sapiens__NP_065921
auggacgaguccgcccuccucgaccuccucgagugccccgucugccucgagcgccucgacgccuccgccaagguccuccccugccagcacaccuucugcaagcgcugccuccucggcaucgucggcucccgcaacgagcuccgcugccccgagugccgcacccucgucggcuccggcgucgaggagcuccccuccaacauccuccucguccgccuccucgacggcaucaagcagcgccccuggaagcccggccccggcggcggcuccggcaccaacugcaccaacgcccuccgcucccaguccuccaccgucgccaacugcuccuccaaggaccuccaguccucccagggcggccagcagccccgcguccaguccugguccccccccguccgcggcaucccccagcuccccugcgccaaggcccucuacaacuacgagggcaaggagcccggcgaccucaaguucuccaagggcgacaucaucauccuccgccgccaggucgacgagaacugguaccacggcgaggucaacggcauccacggcuucuuccccaccaacuucguccagaucaucaagccccucccccagccccccccccagugcaaggcccucuacgacuucgaggucaaggacaaggaggccgacaaggacugccuccccuucgccaaggacgacguccucaccgucauccgccgcgucgacgagaacugggccgagggcaugcucgccgacaagaucggcaucuuccccaucuccuacgucgaguucaacuccgccgccaagcagcucaucgagugggacaagccccccguccccggcgucgacgccggcgagugcuccuccgccgccgcccaguccuccaccgcccccaagcacuccgacaccaagaagaacaccaagaagcgccacuccuucaccucccucaccauggccaacaaguccucccaggccucccagaaccgccacuccauggagaucuccccccccguccucaucuccuccuccaaccccaccgccgccgcccgcaucuccgagcucuccggccucuccugcuccgcccccucccagguccacaucuccaccaccggccucaucgucacccccccccccuccucccccgucaccaccggccccuccuucaccuuccccuccgacguccccuaccaggccgcccucggcacccucaaccccccccuccccccccccccccuccucgccgccaccguccucgccuccaccccccccggcgccaccgccgccgccgccgccgccggcaugggcccccgccccauggccggcuccaccgaccagaucgcccaccuccgcccccagacccgccccuccgucuacgucgccaucuaccccuacaccccccgcaaggaggacgagcucgagcuccgcaagggcgagauguuccucgucuucgagcgcugccaggacggcugguucaagggcaccuccaugcacaccuccaagaucggcgucuuccccggcaacuacgucgcccccgucacccgcgccgucaccaacgccucccaggccaagguccccauguccaccgccggccagaccucccgcggcgucaccauggucucccccuccaccgccggcggccccgcccagaagcuccagggcaacggcgucgccggcucccccuccgucguccccgccgccgucgucuccgccgcccacauccagaccuccccccaggccaagguccuccuccacaugaccggccagaugaccgucaaccaggcccgcaacgccguccgcaccgucgccgcccacaaccaggagcgccccaccgccgccgucacccccauccagguccagaacgccgccggccucucccccgccuccgucggccucucccaccacucccucgccuccccccagcccgccccccucaugcccggcuccgccacccacaccgccgccaucuccaucucccgcgccuccgccccccucgccugcgccgccgccgccccccucaccucccccuccaucaccuccgccucccucgaggccgagcccuccggccgcaucgucaccguccuccccggccuccccaccucccccgacuccgccuccuccgccugcggcaacuccuccgccaccaagcccgacaaggacuccaagaaggagaagaagggccuccucaagcuccucuccggcgccuccaccaagcgcaagccccgcgucuccccccccgccucccccacccucgaggucgagcucggcuccgccgagcucccccuccagggcgccgucggccccgagcucccccccggcggcggccacggccgcgccggcuccugccccgucgacggcgacggccccgucaccaccgccgucgccggcgccgcccucgcccaggacgccuuccaccgcaaggccuccucccucgacuccgccguccccaucgccccccccccccgccaggccugcuccucccucggccccguccucaacgagucccgccccgucgucugcgagcgccaccgcgucgucgucuccuaccccccccaguccgaggccgagcucgagcucaaggagggcgacaucgucuucguccacaagaagcgcgaggacggcugguucaagggcacccuccagcgcaacggcaagaccggccucuuccccggcuccuucgucgagaacaucuga

SEQ ID NO: 49404 - RNA, 2649 nt, Artificial Sequence
  derived and/or modified sequence opt2 from SH3RF3__Homo_sapiens__NP_001092759
augcuccucggcgccuccuggcucugcgccuccaaggccgccgccgccgccgcccaguccgagggcgacgaggaccgccccggcgagcgccgccgccgccgcgccgccgccaccgccgccggcgccggcgaggacauggacgaguccucccuccucgaccuccucgagugcuccgucugccucgagcgccucgacaccaccgccaagguccuccccugccagcacaccuucugccgccgcugccucgaguccaucgucugcucccgccacgagcuccgcugccccgagugccgcauccucgucggcugcggcgucgacgagcuccccgccaacauccuccucguccgccuccucgacggcauccgccagcgcccccgcgccggcaccucccccggcggcuccccccccgcccgccccauccccggccaguccgccgcccccacccucgccggcggcggcggcggcgccgccggcuccacccccggcucccccgucuuccucuccgccgccgccggcuccaccgccggcucccuccgcgagcucgccaccucccgcaccgcccccgccgccaagaaccccugccuccuccccuacggcaaggcccucuacuccuacgagggcaaggagcccggcgaccucaaguucaacaagggcgacaucaucguccuccgccgcaaggucgacgagcagugguaccacggcgagcuccacggcacccagggcuuccuccccgccuccuacauccagugcauccagccccucccccacgcccccccccagggcaaggcccucuacgacuucgagaugaaggacaaggaccaggacaaggacugccucaccuucaccaaggacgagauccucaccguccuccgccgcgucgacgagaacugggccgagggcaugcucggcgacaagaucggcaucuucccccuccucuacgucgagcucaacgacuccgccaagcagcucaucgagauggacaagcccugccccgccgccgccuccuccugcaacgccucccuccccuccgacuccggcgccgucgccuccgucgcccccucccccacccucuccuccuccggcgccgucuccgccuuccagcgccgcgucgacggcaagaagaacaccaagaagcgccacuccuucaccgcccucuccgucacccaccgcuccucccaggccgccucccaccgccacuccauggagaucuccgcccccguccucaucuccuccuccgacccccgcgccgccgcccgcaucggcgaccucgcccaccucuccugcgccgcccccacccaggacgucuccuccuccgccggcuccacccccaccgccgucccccgcgccgccuccgucuccggcgagcagggcaccccccccaagguccagcucccccucaacgucuaccucgcccucuacgccuacaagccccagaaguccgacgagcucgagcuccacaagggcgagauguaccgcguccucgagaagugccaggacggcugguucaagggcgccucccuccgcaccggcgucuccggcgucuuccccggcaacuacgucacccccgucucccgcguccccgccggcggcgccggccccccccgcaacaacgucgucggcggcuccccccucgccaagggcaucaccaccaccaugcaccccggcuccggcucccucuccucccucgccaccgccacccgccccgcccuccccaucaccaccccccaggcccacgcccagcaccccaccgccuccccccccaccggcuccugccuccgccacuccgcccagcccaccgccucccaggcccgcuccaccaucuccaccgccgcccacuccgccgcccaggcccaggaccgccccaccgccaccgucuccccccuccgcacccagaacucccccucccgccuccccgccaccucccuccgcccccacuccgucgucuccccccagcacucccaccagccccccguccagaugugcccccgccccgccaucccccucaccuccgccgccuccgccaucaccccccccaacgucuccgccgccaaccucaacggcgaggccggcggcggccccaucggcguccucuccaccuccucccccaccaacaccggcugcaagcucgacgagaagaaguccgagaagaaggagaagaaguccggccuccucaagcuccucgccggcgccuccaccaagaagaagucccgcuccccccccuccgucucccccacccacgacccccaggucgccgucgacgcccuccuccagggcgccgucggccccgaggucuccucccucuccauccacggccgcgccggcuccugccccaucgaguccgagaugcagggcgccaugggcauggagccccuccaccgcaaggccggcucccucgaccucaacuucaccucccccucccgccaggccccccucuccauggccgccauccgccccgagcccaagcuccucccccgcgagcgcuaccgcgucgucgucuccuaccccccccaguccgaggccgagaucgagcucaaggagggcgacaucgucuucguccacaagaagcgcgaggacggcugguacaagggcacccuccagcgcaacggccgcaccggccucuuccccggcuccuucgucgaguccuucuga

SEQ ID NO: 49405 - RNA, 3867 nt, Artificial Sequence
  derived and/or modified sequence opt2 from SH3TC2__Homo_sapiens__NP_078853
augggcggcugcuucugcaucccccgcgagcgcucccucacccgcggccccggcaaggagacccccuccaaggaccccaccgucuccuccgagugcaucgccuccuccgaguacaaggagaagugcuuccucccccagaacaucaaccccgaccucacccucuccuucugcgucaagucccgcucccgccgcugcgucaacggcccccuccaggaggccgcccgccgccgccucugggcccucgagaacgaggaccaggagguccgcaugcucuucaaggaccucuccgcccgccucgucuccauccagucccagcgcgcccaguuccucaucaccuucaagaccauggaggagaucuggaaguucuccaccuaccucaaccucggcuacgucuccaugugccucgagcaccuccucuucgaccacaaguacuggcucaacugcauccucgucgaggacaccgagauccaggucuccgucgacgacaagcaccucgagaccaucuaccucggccuccucauccaggagggccacuucuucugccgcgcccucugcuccgucaccccccccgccgagaaggagggcgagugccucacccucugcaagaacgagcucaucuccgucaagauggccgaggccggcuccgagcucgagggcgucucccucgucaccggccagcgcggccucguccucgucuccgcccucgagccccucccccuccccuuccaccagugguuccucaagaacuaccccggcuccugcggccucucccgcaagcgcgacuggaccggcuccuaccagaucggccgcggccgcugcaaggcccucaccggcuacgagcccggcgagaaggacgagcucaacuucuaccagggcgaguccaucgagaucaucggcuucgucauccccggccuccagugguucaucggcaaguccaccuccuccggccaggucggcuucguccccacccgcaacaucgaccccgacuccuacucccccaugucccgcaacuccgccuuccucuccgacgaggagcgcugcucccuccucgcccucggcuccgacaagcagaccgagugcuccuccuuccuccacacccucgcccgcaccgacaucaccuccgucuaccgccucuccggcuucgaguccauccagaacccccccaacgaccucuccgccucccagcccgagggcuucaaggagguccgccccggccgcgccugggaggagcaccaggccgucggcucccgccaguccuccuccuccgaggacuccucccucgaggaggagcuccucuccgccaccuccgacuccuaccgccuccccgagcccgacgaccucgacgaccccgagcuccucauggaccucuccaccggccaggaggaggaggccgagaacuucgcccccauccucgccuuccucgaccacgagggcuacgccgaccacuucaagucccucuacgacuucuccuucuccuuccucaccuccuccuucuacuccuucuccgaggaggacgaguucgucgccuaccucgaggccucccgcaagugggccaagaagucccacaugaccugggcccacgcccgccucugcuuccuccucggccgccucuccauccgcaaggucaagcucucccaggcccgcgucuacuucgaggaggccauccacauccucaacggcgccuucgaggaccucucccucgucgccacccucuacaucaaccucgccgccaucuaccucaagcagcgccuccgccacaagggcuccgcccuccucgagaaggccggcgcccuccucgccugccuccccgaccgcgaguccuccgccaagcacgagcucgacgucgucgccuacguccuccgccagggcaucgucgucggcuccuccccccucgaggcccgcgccugcuuccucgccauccgccuccuccucucccucggccgccacgaggagguccuccccuucgccgagcgccuccagcuccucuccggccacccccccgccuccgaggccgucgccuccguccucuccuuccucuacgacaagaaguaccucccccaccucgccgucgccuccguccagcagcacggcauccaguccgcccagggcaugucccuccccaucuggcagguccaccucguccuccagaacaccaccaagcuccucggcuuccccucccccggcuggggcgaggucuccgcccucgccugccccaugcuccgccaggcccucgccgccugcgaggagcucgccgaccgcuccacccagcgcgcccucugccucauccucuccaaggucuaccucgagcaccgcucccccgacggcgccauccacuaccucucccaggcccucguccucggccagcuccucggcgagcaggaguccuucgaguccucccucugccucgccugggccuaccuccucgccucccaggccaagaaggcccucgacguccucgagccccuccucugcucccucaaggagaccgagucccucacccagcgcggcgucaucuacaaccuccucggccucgcccuccagggcgagggccgcgucaaccgcgccgccaaguccuaccuccgcgcccucaaccgcgcccaggaggucggcgacguccacaaccaggccgucgccauggccaaccucggccaccucucccucaaguccugggcccagcaccccgcccgcaacuaccuccuccaggccguccgccucuacugcgagcuccaggccuccaaggagaccgacauggagcucguccaggucuuccucuggcucgcccagguccucgucuccggccaccagcucacccacggccuccucugcuacgagauggcccuccucuucggccuccgccaccgccaccucaagucccagcuccaggccaccaagucccucugccacuucuacuccuccgucucccccaaccccgaggccugcaucaccuaccacgagcacuggcucgcccucgcccagcagcuccgcgaccgcgagauggagggccgccuccucgagucccucggccagcucuaccgcaaccucaacaccgcccgcucccuccgccgcucccucaccugcaucaaggagucccuccgcaucuucaucgaccucggcgagaccgacaaggccgccgaggccuggcucggcgccggccgccuccacuaccucaugcaggaggacgagcucgucgagcucugccuccaggccgccauccagaccgcccucaaguccgaggagccccuccucgcccucaagcucuacgaggaggccggcgacgucuucuucaacggcacccgccaccgccaccacgccgucgaguacuaccgcgccggcgccgucccccucgcccgccgccucaaggccguccgcaccgagcuccgcaucuucaacaagcucaccgagcuccagaucucccucgagggcuacgagaaggcccucgaguucgccacccucgccgcccgccucuccaccgucaccggcgaccagcgccaggagcucgucgccuuccaccgccucgccaccgucuacuacucccuccacauguacgagauggccgaggacugcuaccucaagacccucucccucugcccccccuggcuccagucccccaaggaggcccucuacuacgccaaggucuacuaccgccucggccgccucaccuucugccagcucaaggacgcccacgacgccaccgaguacuuccuccucgcccucgccgccgccguccuccucggcgacgaggagcuccaggacaccauccgcucccgccucgacaacaucugccaguccccccucuggcacucccgccccuccggcugcuccuccgagcgcgcccgcuggcucuccggcggcggccucgcccucuga

SEQ ID NO: 49406 - RNA, 972 nt, Artificial Sequence
  derived and/or modified sequence opt2 from SH3YL1__Homo_sapiens__NP_001153069
augaacaaccccauccccuccaaccucaaguccgaggccaagaaggccgccaagauccuccgcgaguucaccgagaucaccucccgcaacggccccgacaagaucauccccgcccacgucaucgccaaggccaagggccucgccauccucuccgucaucaaggccggcuuccucgucaccgcccgcggcggcuccggcaucgucgucgcccgccuccccgacggcaagugguccgcccccuccgccaucggcaucgccggccucggcggcggcuucgagaucggcaucgaggucuccgaccucgucaucauccucaacuacgaccgcgccgucgaggccuucgccaagggcggcaaccucacccucggcggcaaccucaccgucgccgucggcccccucggccgcaaccucgagggcaacgucgcccuccgcuccuccgccgccgucuucaccuacugcaagucccgcggccucuucgccggcgucucccucgagggcuccugccucaucgagcgcaaggagaccaaccgcaaguucuacugccaggacauccgcgccuacgacauccucuucggcgacaccccccgccccgcccaggccgaggaccucuacgagauccucgacuccuucaccgagaaguacgagaacgagggccagcgcaucaacgcccgcaaggccgcccgcgagcagcgcaaguccuccgccaaggagcucccccccaagccccucucccgcccccagcaguccuccgcccccguccagcucaacuccggcucccaguccaaccucaaccagcccaucgaggucaccgcccucuacuccuucgagggccagcagcccggcgaccucaacuuccaggccggcgaccgcaucaccgucaucuccaagaccgacucccacuucgacuggugggagggcaagcuccgcggccagaccggcaucuuccccgccaacuacgucaccaugaacuga

SEQ ID NO: 49407 - RNA, 6486 nt, Artificial Sequence
  derived and/or modified sequence opt2 from SHANK1__Homo_sapiens__XP_006723296
augacccacucccccgccaccuccgaggacgaggagcgccacuccgccuccgagugccccgagggcggcuccgaguccgacuccucccccgacggccccggccgcggcccccgcggcacccgcggccagggcuccggcgcccccggcucccucgccuccguccgcggccuccagggccgcuccauguccguccccgacgacgcccacuucuccaugauggucuuccgcaucggcauccccgaccuccaccagaccaagugccuccgcuucaaccccgacgccaccaucuggaccgccaagcagcagguccucugcgcccucuccgagucccuccaggacguccucaacuacggccucuuccagcccgccaccuccggccgcgacgccaacuuccucgaggaggagcgccuccuccgcgaguacccccaguccuucgagaagggcguccccuaccucgaguuccgcuacaagacccgcgucuacaagcagaccaaccucgacgagaagcagcucgccaagcuccacaccaagaccggccucaagaaguuccucgaguacguccagcucggcaccuccgacaaggucgcccgccuccucgacaagggccucgaccccaacuaccacgacuccgacuccggcgagaccccccucacccucgccgcccagaccgagggcuccgucgaggucauccgcacccucugccucggcggcgcccacaucgacuuccgcgcccgcgacggcaugaccgcccuccacaaggccgccugcgcccgccacugccucgcccucaccgcccuccucgaccucggcggcucccccaacuacaaggaccgccgcggccucaccccccucuuccacaccgccauggucggcggcgacccccgcugcugcgagcuccuccucuucaaccgcgcccagcucggcaucgccgacgagaacggcuggcaggagauccaccaggccugccagcgcggccacucccagcaccucgagcaccuccucuucuacggcgccgagcccggcgcccagaacgccuccggcaacaccgcccuccacaucugcgcccucuacaacaaggagaccugcgcccgcauccuccucuaccgcggcgccgacaaggacgucaagaacaacaacggccagacccccuuccaggucgccgucaucgccggcaacuucgagcucggcgagcucauccgcaaccaccgcgagcaggacgucguccccuuccaggagucccccaaguacgccgcccgccgccgcggcccccccggcaccggccucaccgucccccccgcccuccuccgcgccaacuccgacaccuccauggcccuccccgacuggauggucuucuccgcccccggcgccgccuccuccggcgcccccggccccaccuccggcucccagggccagucccagcccuccgcccccaccaccaagcucuccuccggcacccuccgcuccgccuccuccccccgcggcgcccgcgcccgcucccccucccgcggccgccaccccgaggacgccaagcgccagccccgcggccgccccuccuccuccggcaccccccgcgagggccccgccggcggcaccggcggcuccggcggccccggcggcucccucggcucccgcggccgccgccgcaagcucuacuccgccguccccggccgcuccuucauggccgucaaguccuaccaggcccaggccgagggcgagaucucccucuccaagggcgagaagaucaagguccucuccaucggcgagggcggcuucugggagggccaggucaagggccgcgucggcugguuccccuccgacugccucgaggaggucgccaaccgcucccaggaguccaagcaggagucccgcuccgacaaggccaagcgccucuuccgccacuacaccgucggcuccuacgacuccuucgacgcccccucccucauggacggcaucggccccggcuccgacuacaucaucaaggagaagaccguccuccuccagaagaaggacuccgagggcuucggcuucguccuccgcggcgccaaggcccagacccccaucgaggaguucacccccacccccgccuuccccgcccuccaguaccucgaguccgucgacgagggcggcgucgccuggcgcgccggccuccgcaugggcgacuuccucaucgaggucaacggccagaacgucgucaaggucggccaccgccaggucgucaacaugauccgccagggcggcaacacccucauggucaaggucgucauggucacccgccaccccgacauggacgaggccguccacaagaaggccccccagcaggccaagcgccuccccccccccaccaucucccuccgcuccaaguccaugaccuccgagcucgaggagauggaguacgagcagcagcccgcccccguccccuccauggagaagaagcgcaccgucuaccagauggcccucaacaagcucgacgagauccucgccgccgcccagcagaccaucuccgccuccgagucccccggccccggcggccucgccucccucggcaagcaccgccccaagggcuucuucgccaccgaguccuccuucgacccccaccaccgcgcccagcccuccuacgagcgccccuccuuccucccccccggccccggccucaugcuccgccagaaguccaucggcgccgccgaggacgaccgccccuaccucgccccccccgccaugaaguucucccgcucccucuccguccccggcuccgaggacaucccccccccccccaccaccuccccccccgagccccccuacuccaccccccccguccccuccuccuccggccgccucacccccuccccccgcggcggccccuucaaccccggcuccggcggcccccuccccgccuccucccccgccuccuucgacggccccuccccccccgacacccgcgucggcucccgcgagaagucccucuaccacuccggcccccucccccccgcccaccaccaccccccccaccaccaccaccaccacgccccccccccccagccccaccaccaccacgcccaccccccccacccccccgagauggagaccggcggcucccccgacgacccccccccccgccucgcccucggcccccagcccucccuccgcggcuggcgcggcggcggccccucccccacccccggcgcccccucccccucccaccacggcuccgccggcggcggcggcggcuccucccagggccccgcccuccgcuacuuccagcuccccccccgcgccgccuccgccgccauguacguccccgcccgcuccggccgcggccgcaagggcccccucgucaagcagaccaaggucgagggcgagccccagaagggcggcggccucccccccgcccccucccccaccucccccgccuccccccagcccccccccgccgucgccgcccccuccgagaagaacuccauccccauccccaccaucaucaucaaggcccccuccaccuccuccuccggccgcuccucccagggcuccuccaccgaggccgagccccccacccagcccgagcccaccggcggcggcggcggcggcggcuccucccccucccccgcccccgccaugucccccgucccccccucccccucccccguccccacccccgccucccccuccggccccgccacccucgacuucaccucccaguucggcgccgcccucgucggcgccgcccgccgcgagggcggcuggcagaacgaggcccgccgccgcuccacccucuuccucuccaccgacgccggcgacgaggacggcggcgacggcggccucggcaccggcgccgcccccggcccccgccuccgccacuccaaguccaucgacgagggcauguucuccgccgagcccuaccuccgccucgaguccgccggcuccggcgccggcuacggcggcuacggcgccggcucccgcgccuacggcggcggcggcggcuccuccgccuucaccuccuuccuccccccccgcccccucguccacccccucaccggcaaggcccucgaccccgccuccccccucggccucgcccucgccgcccgcgagcgcgcccucaaggaguccuccgagggcggcggcgccccccagccccccccccgcccccccuccccccgcuacgaggcccccccccccaccccccaccaccacuccccccacgcccaccacgagcccguccuccgccucuggggcgccuccccccccgaccccgcccgccgcgagcucggcuaccgcgccggccucggcucccaggagaagucccuccccgccuccccccccgccgcccgccgcucccuccuccaccgccucccccccaccgcccccggcgucggcccccuccuccuccagcucggcaccgagccccccgccccccaccccggcgucuccaagcccuggcgcuccgccgcccccgaggagcccgagcgccucccccuccacguccgcuuccucgagaacugccagccccgcgcccccgucaccuccggccgcggcccccccuccgaggacggccccggcguccccccccccuccccccgccgcuccgucccccccucccccaccuccccccgcgccuccgaggagaacggccucccccuccucguccuccccccccccgcccccuccgucgacgucgaggacggcgaguuccucuucgucgagccccucccccccccccucgaguucuccaacuccuucgagaagcccgaguccccccucacccccggccccccccacccccuccccgacacccccgcccccgccaccccccucccccccguccccccccccgccgucgccgccgccccccccacccucgacuccaccgccuccucccucaccuccuacgacuccgaggucgccacccucacccagggcgccuccgccgcccccggcgacccccacccccccggcccccccgcccccgccgcccccgcccccgccgccccccagcccggccccgaccccccccccggcaccgacuccggcaucgaggaggucgacucccgcuccuccuccgaccacccccucgagaccaucuccuccgccuccacccucuccucccucuccgccgagggcggcggcuccgccggcggcggcggcggcgccggcgccggcgucgccuccggccccgagcuccucgacaccuacgucgccuaccucgacggccaggccuucggcggcuccuccacccccggcccccccuaccccccccagcucaugacccccuccaagcuccgcggccgcgcccucggcgccuccggcggccuccgccccggccccuccggcggccuccgcgaccccgucacccccaccucccccaccgucuccgucaccggcgccggcaccgacggccuccucgcccuccgcgccugcuccggcccccccaccgccggcgucgccggcggccccgucgccgucgagcccgaggucccccccgucccccuccccaccgccuccucccucccccgcaagcuccuccccugggaggagggccccggcccccccccccccccccuccccggcccccucgcccagccccaggccuccgcccucgccaccgucaaggccuccaucaucuccgagcucuccuccaagcuccagcaguucggcggcuccuccgccgccggcggcgcccuccccugggcccgcggcggcuccggcggcggcggcgacucccaccacggcggcgccuccuacguccccgagcgcaccuccucccuccagcgccagcgccucuccgacgacucccaguccucccuccucuccaagcccgucuccucccucuuccagaacuggcccaagcccccccuccccccccuccccaccggcaccggcgucucccccaccgccgccgccgcccccggcgccaccucccccuccgccuccuccuccuccaccuccacccgccaccuccagggcgucgaguucgagaugcgccccccccuccuccgccgcgcccccucccccucccuccuccccgccuccgagcacaaggucucccccgccccccgccccuccucccuccccauccuccccuccggcccccucuaccccggccucuucgacauccgcggcucccccaccggcggcgccggcggcuccgccgaccccuucgcccccgucuucguccccccccaccccggcaucuccggcggccucggcggcgcccucuccggcgccucccgcucccucucccccacccgccuccucucccucccccccgacaagcccuucggcgccaagccccucggcuucuggaccaaguucgacgucgccgacuggcucgaguggcucggccucgccgagcaccgcgcccaguuccucgaccacgagaucgacggcucccaccuccccgcccucaccaaggaggacuacgucgaccucggcgucacccgcgucggccaccgcaugaacaucgaccgcgcccucaaguucuuccucgagcgcuga

SEQ ID NO: 49408 - RNA, 5550 nt, Artificial Sequence
  derived and/or modified sequence opt2 from SHANK2__Homo_sapiens__NP_036441
augccccgcucccccaccuccuccgaggacgagauggcccaguccuucuccgacuacuccgucggcuccgaguccgacuccuccaaggaggagaccaucuacgacaccauccgcgccaccgccgagaagcccggcggcgcccgcaccgaggagucccagggcaacacccucgucauccgcgucgucauccacgaccuccagcagaccaagugcauccgcuucaaccccgacgccaccgucugggucgccaagcagcgcauccucugcacccucacccagucccucaaggacguccucaacuacggccucuuccagcccgccuccaacggccgcgacggcaaguuccucgacgaggagcgccuccuccgcgaguacccccagcccgucggcgagggcguccccucccucgaguuccgcuacaagaagcgcgucuacaagcaggccucccucgacgagaagcagcucgccaagcuccacaccaagaccaaccucaagaagugcauggaccacauccagcaccgccucgucgagaagaucaccaagaugcucgaccgcggccucgaccccaacuuccacgaccccgagaccggcgagaccccccucacccucgccgcccagcucgacgacuccgucgaggucaucaaggcccucaagaacggcggcgcccaccucgacuuccgcgccaaggacggcaugaccgcccuccacaaggccgcccgcgcccgcaaccaggucgcccucaagacccuccucgagcucggcgccucccccgacuacaaggacuccuacggccucaccccccucuaccacaccgccaucgucggcggcgaccccuacugcugcgagcuccuccuccacgagcacgccaccgucugcugcaaggacgagaacggcuggcacgagauccaccaggccugccgcuacggccacguccagcaccucgagcaccuccucuucuacggcgccgacauguccgcccagaacgccuccggcaacaccgcccuccacaucugcgcccucuacaaccaggacuccugcgcccgcguccuccucuuccgcggcggcaacaaggagcucaagaacuacaacucccagacccccuuccaggucgccaucaucgccggcaacuucgagcucgccgaguacaucaagaaccacaaggagaccgacaucguccccuuccgcgaggcccccgccuacuccaaccgccgccgccgcccccccaacacccucgccgccccccgcguccuccuccgcuccaacuccgacaacaaccucaacgccuccgcccccgacugggccgucugcuccaccgccaccucccaccgcucccucuccccccagcuccuccagcagaugcccuccaagcccgagggcgccgccaagaccaucggcuccuacguccccggcccccgcucccgcucccccucccucaaccgccucggcggcgccggcgaggacggcaagcgcccccagccccucuggcacgucggcucccccuucgcccucggcgccaacaaggacucccucuccgccuucgaguaccccggccccaagcgcaagcucuacuccgccguccccggccgccucuucgucgccgucaagcccuaccagccccaggucgacggcgagaucccccuccaccgcggcgaccgcgucaagguccucuccaucggcgagggcggcuucugggagggcuccgcccgcggccacaucggcugguuccccgccgagugcgucgaggagguccagugcaagccccgcgacucccaggccgagacccgcgccgaccgcuccaagaagcucuuccgccacuacaccgucggcuccuacgacuccuucgacaccuccuccgacugcaucaucgaggagaagaccgucguccuccagaagaaggacaacgagggcuucggcuucguccuccgcggcgccaaggccgacacccccaucgaggaguucacccccacccccgccuuccccgcccuccaguaccucgaguccgucgacgagggcggcgucgccuggcaggccggccuccgcaccggcgacuuccucaucgaggucaacaacgagaacgucgucaaggucggccaccgccaggucgucaacaugauccgccagggcggcaaccaccucguccucaaggucgucaccgucacccgcaaccucgaccccgacgacaccgcccgcaagaaggccccccccccccccaagcgcgcccccaccaccgcccucacccuccgcuccaaguccaugaccuccgagcucgaggagcucgucgacaaggccuccguccgcaagaagaaggacaagcccgaggagaucguccccgccuccaagcccucccgcgccgccgagaacauggccgucgagccccgcgucgccaccaucaagcagcgccccuccucccgcugcuuccccgccggcuccgacaugaacuccgucuacgagcgccagggcaucgccgucaugacccccaccguccccggcucccccaaggcccccuuccucggcaucccccgcggcaccaugcgccgccagaaguccaucgacucccgcaucuuccucuccggcaucaccgaggaggagcgccaguuccucgccccccccaugcucaaguucacccgcucccucuccaugcccgacaccuccgaggacauccccccccccccccaguccgucccccccuccccccccccccccucccccaccaccuacaacugccccaagucccccaccccccgcgucuacggcaccaucaagcccgccuucaaccagaacuccgccgccaaggucucccccgccacccgcuccgacaccgucgccaccaugaugcgcgagaagggcauguacuuccgccgcgagcucgaccgcuacucccucgacuccgaggaccucuacucccgcaacgccggcccccaggccaacuuccgcaacaagcgcggccagaugcccgagaaccccuacuccgaggucggcaagaucgccuccaaggccgucuacguccccgccaagcccgcccgccgcaagggcaugcucgucaagcaguccaacgucgaggacucccccgagaagaccugcuccauccccauccccaccaucaucgucaaggagcccuccaccuccuccuccggcaaguccucccagggcuccuccauggagaucgacccccaggcccccgagccccccucccagcuccgccccgacgagucccucaccgucuccucccccuucgccgccgccaucgccggcgccguccgcgaccgcgagaagcgccucgaggcccgccgcaacucccccgccuuccucuccaccgaccucggcgacgaggacgucggccucggcccccccgccccccgcacccgccccuccauguuccccgaggagggcgacuucgccgacgaggacuccgccgagcagcucuccucccccaugcccuccgccaccccccgcgagcccgagaaccacuucgucggcggcgccgaggccuccgcccccggcgaggccggccgcccccucaacuccaccuccaaggcccagggccccgaguccucccccgccguccccuccgccuccuccggcaccgccggccccggcaacuacguccacccccucaccggccgccuccucgaccccuccuccccccucgcccucgcccucuccgcccgcgaccgcgccaugaaggagucccagcagggccccaagggcgaggcccccaaggccgaccucaacaagccccucuacaucgacaccaagaugcgccccucccucgacgccggcuuccccaccgucacccgccagaacacccgcggcccccuccgccgccaggagaccgagaacaaguacgagaccgaccucggccgcgaccgcaagggcgacgacaagaagaacaugcucaucgacaucauggacaccucccagcagaaguccgccggccuccucaugguccacaccgucgacgccaccaagcucgacaacgcccuccaggaggaggacgagaaggccgaggucgagaugaagcccgacuccucccccuccgagguccccgagggcgucuccgagaccgagggcgcccuccagaucuccgccgcccccgagcccaccaccguccccggccgcaccaucgucgccgucggcuccauggaggaggccgucauccuccccuuccgcauccccccccccccccucgccuccgucgaccucgacgaggacuucaucuucaccgagccccucccccccccccucgaguucgccaacuccuucgacauccccgacgaccgcgccgccuccguccccgcccucuccgaccucgucaagcagaagaaguccgacaccccccagucccccucccucaacuccucccagcccaccaacuccgccgacuccaagaagcccgccucccucuccaacugccuccccgccuccuuccuccccccccccgaguccuucgacgccgucgccgacuccggcaucgaggaggucgacucccgcuccuccuccgaccaccaccucgagaccaccuccaccaucuccaccgucuccuccaucuccacccucuccuccgagggcggcgagaacgucgacaccugcaccgucuacgccgacggccaggccuucauggucgacaagccccccgucccccccaagcccaagaugaagcccaucauccacaaguccaacgcccucuaccaggacgcccucgucgaggaggacgucgacuccuucgucauccccccccccgcccccccccccccccccggcuccgcccagcccggcauggccaagguccuccagccccgcaccuccaagcucuggggcgacgucaccgagaucaagucccccauccucuccggccccaaggccaacgucaucuccgagcucaacuccauccuccagcagaugaaccgcgagaagcucgccaagcccggcgagggccucgacucccccaugggcgccaaguccgccucccucgccccccgcucccccgagaucauguccaccaucuccggcacccgcuccaccaccgucaccuucaccguccgccccggcaccucccagcccaucacccuccagucccgcccccccgacuacgagucccgcaccuccggcacccgccgcgcccccucccccgucgucucccccaccgagaugaacaaggagacccuccccgccccccucuccgccgccaccgccucccccucccccgcccucuccgacgucuucucccuccccucccagccccccuccggcgaccucuucggccucaaccccgccggccgcucccgcucccccucccccuccauccuccagcagcccaucuccaacaagcccuucaccaccaagcccguccaccucuggaccaagcccgacgucgccgacuggcucgagucccucaaccucggcgagcacaaggaggccuucauggacaacgagaucgacggcucccaccuccccaaccuccagaaggaggaccucaucgaccucggcgucacccgcgucggccaccgcaugaacaucgagcgcgcccucaagcagcuccucgaccgcuga

SEQ ID NO: 49409 - RNA, 5196 nt, Artificial Sequence
  derived and/or modified sequence opt2 from SHANK3__Homo_sapiens__NP_277052
auggacggccccggcgccuccgccgucgucguccgcgucggcauccccgaccuccagcagaccaagugccuccgccucgaccccgccgcccccgucugggccgccaagcagcgcguccucugcgcccucaaccacucccuccaggacgcccucaacuacggccucuuccagccccccucccgcggccgcgccggcaaguuccucgacgaggagcgccuccuccaggaguacccccccaaccucgacaccccccuccccuaccucgaguuccgcuacaagcgccgcgucuacgcccagaaccucaucgacgacaagcaguucgccaagcuccacaccaaggccaaccucaagaaguucauggacuacguccagcuccacuccaccgacaaggucgcccgccuccucgacaagggccucgaccccaacuuccacgaccccgacuccggcgagugcccccucucccucgccgcccagcucgacaacgccaccgaccuccucaagguccucaagaacggcggcgcccaccucgacuuccgcacccgcgacggccucaccgccguccacugcgccacccgccagcgcaacgccgccgcccucaccacccuccucgaccucggcgccucccccgacuacaaggacucccgcggccucaccccccucuaccacuccgcccucggcggcggcgacgcccucugcugcgagcuccuccuccacgaccacgcccagcucggcaucaccgacgagaacggcuggcaggagauccaccaggccugccgcuucggccacguccagcaccucgagcaccuccucuucuacggcgccgacaugggcgcccagaacgccuccggcaacaccgcccuccacaucugcgcccucuacaaccaggaguccugcgcccgcguccuccucuuccgcggcgccaaccgcgacguccgcaacuacaacucccagaccgccuuccaggucgccaucaucgccggcaacuucgagcucgccgaggucaucaagacccacaaggacuccgacgucguccccuuccgcgagacccccuccuacgccaagcgccgccgccucgccggccccuccggccucgccuccccccgcccccuccagcgcuccgccuccgacaucaaccucaagggcgaggcccagcccgccgccucccccggccccucccuccgcucccucccccaccagcuccuccuccagcgccuccaggaggagaaggaccgcgaccgcgacgccgaccaggaguccaacaucuccggcccccucgccggccgcgccggccaguccaagaucucccccuccggccccggcggccccggccccgcccccggccccggccccgccccccccgccccccccgccccccccccccgcggccccaagcgcaagcucuacuccgccguccccggccgcaaguucaucgccgucaaggcccacuccccccagggcgagggcgagaucccccuccaccgcggcgaggccgucaagguccucuccaucggcgagggcggcuucugggagggcaccgucaagggccgcaccggcugguuccccgccgacugcgucgaggagguccagaugcgccagcacgacacccgccccgagacccgcgaggaccgcaccaagcgccucuuccgccacuacaccgucggcuccuacgacucccucaccucccacuccgacuacgucaucgacgacaaggucgccguccuccagaagcgcgaccacgagggcuucggcuucguccuccgcggcgccaaggccgagacccccaucgaggaguucacccccacccccgccuuccccgcccuccaguaccucgaguccgucgacgucgagggcgucgccuggcgcgccggccuccgcaccggcgacuuccucaucgaggucaacggcgucaacgucgucaaggucggccacaagcaggucgucgcccucauccgccagggcggcaaccgccucgucaugaaggucgucuccgucacccgcaagcccgaggaggacggcgcccgccgccgcgccccccccccccccaagcgcgcccccuccaccacccucacccuccgcuccaaguccaugaccgccgagcucgaggagcucgccuccauccgccgccgcaagggcgagaagcucgacgagaugcucgccgccgccgccgagcccacccuccgccccgacaucgccgacgccgacucccgcgccgccaccgucaagcagcgccccaccucccgccgcaucacccccgccgagaucuccucccucuucgagcgccagggccuccccggccccgagaagcuccccggcucccuccgcaagggcaucccccgcaccaaguccgucggcgaggacgagaagcucgccucccuccucgagggccgcuucccccgcuccaccuccaugcaggaccccguccgcgagggccgcggcauccccccccccccccagaccgcccccccccccccccccgcccccuacuacuucgacuccggccccccccccgccuucucccccccccccccccccggccgcgccuacgacaccguccgcuccuccuucaagcccggccucgaggcccgccucggcgccggcgccgccggccucuacgagcccggcgccgcccucggcccccuccccuaccccgagcgccagaagcgcgcccgcuccaugaucauccuccaggacuccgcccccgaguccggcgacgccccccgccccccccccgccgccaccccccccgagcgccccaagcgccgcccccgcccccccggccccgacucccccuacgccaaccucggcgccuucuccgccucccucuucgcccccuccaagccccagcgccgcaaguccccccucgucaagcagcuccaggucgaggacgcccaggagcgcgccgcccucgccgucggcucccccggccccggcggcggcuccuucgcccgcgagcccucccccacccaccgcggcccccgccccggcggccucgacuacggcgccggcgacggccccggccucgccuucggcggccccggccccgccaaggaccgccgccucgaggagcgccgccgcuccaccgucuuccucuccgucggcgccaucgagggcuccgcccccggcgccgaccuccccucccuccagcccucccgcuccaucgacgagcgccuccucggcaccggccccaccgccggccgcgaccuccuccuccccucccccgucuccgcccucaagccccucgucuccggccccucccucggccccuccggcuccaccuucauccacccccucaccggcaagccccucgaccccuccuccccccucgcccucgcccucgccgcccgcgagcgcgcccucgccucccaggcccccucccgcucccccacccccguccacucccccgacgccgaccgccccggcccccucuucgucgacguccaggcccgcgaccccgagcgcggcucccucgccucccccgccuucuccccccgcucccccgccuggauccccguccccgcccgccgcgaggccgagaaggucccccgcgaggagcgcaagucccccgaggacaagaaguccaugauccucuccguccucgacaccucccuccagcgccccgccggccucaucgucguccacgccaccuccaacggccaggagcccucccgccucggcggcgccgaggaggagcgccccggcacccccgagcucgcccccgcccccaugcaguccgccgccgucgccgagccccuccccuccccccgcgcccagccccccggcggcacccccgccgacgccggccccggccagggcuccuccgaggaggagcccgagcucgucuucgccgucaaccucccccccgcccagcucuccuccuccgacgaggagacccgcgaggagcucgcccgcaucggccucguccccccccccgaggaguucgccaacggcguccuccucgccaccccccucgccggccccggccccucccccaccaccguccccucccccgccuccggcaagcccuccuccgagcccccccccgcccccgaguccgccgccgacuccggcgucgaggaggccgacacccgcuccuccuccgacccccaccucgagaccaccuccaccaucuccaccgucuccuccauguccacccucuccuccgaguccggcgagcucaccgacacccacaccuccuucgccgacggccacaccuuccuccucgagaagccccccgucccccccaagcccaagcucaaguccccccucggcaagggccccgucaccuuccgcgacccccuccucaagcaguccuccgacuccgagcucauggcccagcagcaccacgccgccuccgccggccucgccuccgccgccggccccgcccgcccccgcuaccucuuccagcgccgcuccaagcucuggggcgaccccgucgagucccgcggccuccccggccccgaggacgacaagcccaccgucaucuccgagcucuccucccgccuccagcagcucaacaaggacacccgcucccucggcgaggagcccgucggcggccucggcucccuccucgaccccgccaagaagucccccaucgccgccgcccgccucuucuccucccucggcgagcucuccuccaucuccgcccagcgcucccccggcggccccggcggcggcgccuccuacuccguccgccccuccggccgcuaccccgucgcccgccgcgcccccucccccgucaagcccgccucccucgagcgcgucgagggccucggcgccggcgccggcggcgccggccgccccuucggccucaccccccccaccauccucaaguccuccucccucuccaucccccacgagcccaaggagguccgcuucgucguccgcuccgucuccgcccgcucccgcucccccucccccuccccccuccccucccccgccuccggccccggccccggcgcccccggcccccgccgccccuuccagcagaagccccuccagcucugguccaaguucgacgucggcgacuggcucgaguccauccaccucggcgagcaccgcgaccgcuucgaggaccacgagaucgagggcgcccaccuccccgcccucaccaaggacgacuucgucgagcucggcgucacccgcgucggccaccgcaugaacaucgagcgcgcccuccgccagcucgacggcuccuga

SEQ ID NO: 49410 - RNA, 1164 nt, Artificial Sequence
  derived and/or modified sequence opt2 from SHARPIN__Homo_sapiens__NP_112236
auggccccccccgccggcggcgccgccgccgccgccuccgaccucggcuccgccgccguccuccucgccguccacgccgccguccgcccccucggcgccggccccgacgccgaggcccagcuccgccgccuccagcucuccgccgaccccgagcgccccggccgcuuccgccucgagcuccucggcgccggccccggcgccgucaaccucgaguggccccucgaguccgucuccuacaccauccgcggccccacccagcacgagcuccagcccccccccggcggccccggcacccucucccuccacuuccucaacccccaggaggcccagcgcugggccguccucguccgcggcgccaccgucgagggccagaacggcuccaaguccaacuccccccccgcccucggccccgaggccugccccgucucccuccccuccccccccgaggccuccacccucaagggccccccccccgaggccgaccucccccgcucccccggcaaccucaccgagcgcgaggagcucgccggcucccucgcccgcgccaucgccggcggcgacgagaagggcgccgcccaggucgccgccguccucgcccagcaccgcgucgcccucuccguccagcuccaggaggccugcuucccccccggccccauccgccuccaggucacccucgaggacgccgccuccgccgccuccgccgccuccuccgcccacgucgcccuccagguccacccccacugcaccgucgccgcccuccaggagcaggucuucuccgagcucggcuucccccccgccguccagcgcugggucaucggccgcugccucugcguccccgagcgcucccucgccuccuacggcguccgccaggacggcgaccccgccuuccucuaccuccucuccgccccccgcgaggcccccgccaccggccccuccccccagcacccccagaagauggacggcgagcucggccgccucuucccccccucccucggccucccccccggcccccagcccgccgccuccucccuccccuccccccuccagcccuccugguccugccccuccugcaccuucaucaacgcccccgaccgccccggcugcgagaugugcuccacccagcgccccugcaccugggacccccucgccgccgccuccaccuga

SEQ ID NO: 49411 - RNA, 1155 nt, Artificial Sequence
  derived and/or modified sequence opt2 from SHBG__Homo_sapiens__NP_001139751
auggagucccgcggcccccucgccaccucccgccuccuccuccuccuccuccuccuccuccuccgccacacccgccagggcugggcccuccgccccguccuccccacccaguccgcccacgacccccccgccguccaccucuccaacggccccggccaggagcccaucgccgucaugaccuucgaccucaccaagaucaccaagaccuccuccuccuucgagguccgcaccugggaccccgagggcgucaucuucuacggcgacaccaaccccaaggacgacugguucaugcucggccuccgcgacggccgccccgagauccagcuccacaaccacugggcccagcucaccgucggcgccggcccccgccucgacgacggccgcuggcaccaggucgaggucaagauggagggcgacuccguccuccucgaggucgacggcgaggagguccuccgccuccgccaggucuccggcccccucaccuccaagcgccaccccaucaugcgcaucgcccucggcggccuccucuuccccgccuccaaccuccgccuccccgccgagaucuccgccuccgcccccaccucccuccgcuccugcgacgucgaguccaaccccggcaucuuccucccccccggcacccaggccgaguucaaccuccgcgacaucccccagccccacgccgagcccugggccuucucccucgaccucggccucaagcaggccgccggcuccggccaccuccucgcccucggcacccccgagaaccccuccuggcucucccuccaccuccaggaccagaaggucguccucuccuccggcuccggccccggccucgaccucccccucguccucggccucccccuccagcucaagcucuccaugucccgcgucguccucucccagggcuccaagaugaaggcccucgcccuccccccccucggccucgccccccuccucaaccucugggccaagccccagggccgccucuuccucggcgcccuccccggcgaggacuccuccaccuccuucugccucaacggccucugggcccagggccagcgccucgacgucgaccaggcccucaaccgcucccacgagaucuggacccacuccugcccccagucccccggcaacggcaccgacgccucccacuga

SEQ ID NO: 49412 - RNA, 1530 nt, Artificial Sequence
  derived and/or modified sequence opt2 from SHB__Homo_sapiens__NP_003019
auggccaaguggcucaacaaguacuucucccucggcaacuccaagaccaagucccccccccagcccccccgccccgacuaccgcgagcagcgccgccgcggcgagcgccccucccagcccccccaggccgucccccaggccuccuccgccgccuccgccuccugcggccccgccaccgccuccugcuucuccgccuccuccggcucccuccccgacgacuccggcuccaccuccgaccucauccgcgccuaccgcgcccagaaggagcgcgacuucgaggaccccuacaacggccccggcuccucccuccgcaagcuccgcgccaugugccgccucgacuacugcggcggcuccggcgagcccggcggcguccagcgcgccuucuccgccuccuccgccuccggcgccgccggcugcugcugcgccuccuccggcgccggcgccgccgccuccuccuccuccuccuccggcuccccccaccucuaccgcuccuccuccgagcgccgccccgccacccccgccgagguccgcuacaucucccccaagcaccgccucaucaaggucgaguccgccgccggcggcggcgccggcgacccccucggcggcgccugcgccggcggccgcaccuggucccccaccgccugcggcggcaagaagcuccucaacaagugcgccgccuccgccgccgaggaguccggcgccggcaagaaggacaaggucaccaucgccgacgacuacuccgaccccuucgacgccaagaacgaccucaaguccaaggccggcaagggcgaguccgccggcuacauggagcccuacgaggcccagcgcaucaugaccgaguuccagcgccaggaguccguccgcucccagcacaagggcauccagcucuacgacacccccuacgagcccgagggccaguccgucgacuccgacuccgaguccaccgucuccccccgccuccgcgaguccaagcucccccaggacgacgaccgccccgccgacgaguacgaccagcccugggaguggaaccgcgucaccauccccgcccucgccgcccaguucaacggcaacgagaagcgccaguccucccccucccccucccgcgaccgccgccgccagcuccgcgcccccggcggcggcuucaagcccaucaagcacggcucccccgaguucugcggcauccucggcgagcgcgucgaccccgccgucccccucgagaagcagaucugguaccacggcgccaucucccgcggcgacgccgagaaccuccuccgccucugcaaggagugcuccuaccucguccgcaacucccagaccuccaagcacgacuacucccucucccuccgcuccaaccagggcuucaugcacaugaagcucgccaagaccaaggagaaguacguccucggccagaacuccccccccuucgacuccguccccgaggucauccacuacuacaccacccgcaagcuccccaucaagggcgccgagcaccucucccuccucuaccccgucgccguccgcacccucuga

SEQ ID NO: 49413 - RNA, 1755 nt, Artificial Sequence
  derived and/or modified sequence opt2 from SHC1__Homo_sapiens__NP_001123512
auggaccuccucccccccaagcccaaguacaacccccuccgcaacgagucccucuccucccucgaggagggcgccuccggcuccaccccccccgaggagcuccccucccccuccgccuccucccucggccccauccuccccccccuccccggcgacgacucccccaccacccucugcuccuucuucccccgcauguccaaccuccgccucgccaaccccgccggcggccgccccggcuccaagggcgagcccggccgcgccgccgacgacggcgagggcaucgucggcgccgccaugcccgacuccggcccccucccccuccuccaggacaugaacaagcucuccggcggcggcggccgccgcacccgcgucgagggcggccagcucggcggcgaggaguggacccgccacggcuccuucgucaacaagcccacccgcggcuggcuccaccccaacgacaaggucaugggccccggcgucuccuaccucguccgcuacaugggcugcgucgagguccuccaguccaugcgcgcccucgacuucaacacccgcacccaggucacccgcgaggccaucucccucgucugcgaggccguccccggcgccaagggcgccacccgccgccgcaagcccugcucccgcccccucuccuccauccucggccgcuccaaccucaaguucgccggcaugcccaucacccucaccgucuccaccuccucccucaaccucauggccgccgacugcaagcagaucaucgccaaccaccacaugcaguccaucuccuucgccuccggcggcgaccccgacaccgccgaguacgucgccuacgucgccaaggaccccgucaaccagcgcgccugccacauccucgagugccccgagggccucgcccaggacgucaucuccaccaucggccaggccuucgagcuccgcuucaagcaguaccuccgcaacccccccaagcucgucaccccccacgaccgcauggccggcuucgacggcuccgccugggacgaggaggaggaggagccccccgaccaccaguacuacaacgacuuccccggcaaggagcccccccucggcggcgucgucgacaugcgccuccgcgagggcgccgcccccggcgccgcccgccccaccgcccccaacgcccagacccccucccaccucggcgccacccuccccgucggccagcccgucggcggcgaccccgagguccgcaagcagaugcccccccccccccccugccccgccggccgcgagcucuucgacgaccccuccuacgucaacguccagaaccucgacaaggcccgccaggccgucggcggcgccggcccccccaaccccgccaucaacggcuccgccccccgcgaccucuucgacaugaagcccuucgaggacgcccuccgcguccccccccccccccaguccgucuccauggccgagcagcuccgcggcgagcccugguuccacggcaagcucucccgccgcgaggccgaggcccuccuccagcucaacggcgacuuccucguccgcgaguccaccaccacccccggccaguacguccucaccggccuccaguccggccagcccaagcaccuccuccucgucgaccccgagggcgucguccgcaccaaggaccaccgcuucgaguccgucucccaccucaucuccuaccacauggacaaccaccuccccaucaucuccgccggcuccgagcucugccuccagcagcccgucgagcgcaagcucuga

SEQ ID NO: 49414 - RNA, 1749 nt, Artificial Sequence
  derived and/or modified sequence opt2 from SHC2__Homo_sapiens__NP_036567
augacccagggccccggcggccgcgccccccccgccccccccgccccccccgagcccgaggcccccaccaccuucugcgcccuccucccccgcaugccccaguggaaguucgccgcccccggcggcuuccucggccgcggccccgccgccgcccgcgccgccggcgccuccggcggcgccgacccccagcccgagcccgccggccccggcggcguccccgcccucgccgccgccguccucggcgccugcgagccccgcugcgccgcccccugcccccuccccgcccucucccgcugccgcggcgccggcucccgcggcucccgcggcggccgcggcgccgccggcuccggcgacgccgccgccgccgccgaguggauccgcaagggcuccuucauccacaagcccgcccacggcuggcuccaccccgacgcccgcguccucggccccggcgucuccuacgucguccgcuacaugggcugcaucgagguccuccgcuccaugcgcucccucgacuucaacacccgcacccaggucacccgcgaggccaucaaccgccuccacgaggccguccccggcguccgcggcuccuggaagaagaaggcccccaacaaggcccucgccuccguccucggcaaguccaaccuccgcuucgccggcauguccaucuccauccacaucuccaccgacggccucucccucuccguccccgccacccgccaggucaucgccaaccaccacaugcccuccaucuccuucgccuccggcggcgacaccgacaugaccgacuacgucgccuacgucgccaaggaccccaucaaccagcgcgccugccacauccucgagugcugcgagggccucgcccaguccaucaucuccaccgucggccaggccuucgagcuccgcuucaagcaguaccuccacuccccccccaaggucgcccucccccccgagcgccucgccggccccgaggaguccgccuggggcgacgaggaggacucccucgagcacaacuacuacaacuccauccccggcaaggagcccccccucggcggccucgucgacucccgccucgcccucacccagcccugcgcccucaccgcccucgaccagggccccucccccucccuccgcgacgccugcucccuccccugggacgucggcuccaccggcaccgccccccccggcgacggcuacguccaggccgacgcccgcggcccccccgaccacgaggagcaccucuacgucaacacccagggccucgacgcccccgagcccgaggacucccccaagaaggaccucuucgacaugcgccccuucgaggacgcccucaagcuccacgagugcuccgucgccgccggcgucaccgccgccccccucccccucgaggaccaguggcccuccccccccacccgccgcgcccccgucgcccccaccgaggagcagcuccgccaggagcccugguaccacggccgcaugucccgccgcgccgccgagcgcaugcuccgcgccgacggcgacuuccucguccgcgacuccgucaccaaccccggccaguacguccucaccggcaugcacgccggccagcccaagcaccuccuccucgucgaccccgagggcgucguccgcaccaaggacguccucuucgaguccaucucccaccucaucgaccaccaccuccagaacggccagcccaucgucgccgccgaguccgagcuccaccuccgcggcgucgucucccgcgagcccuga

SEQ ID NO: 49415 - RNA, 1785 nt, Artificial Sequence
  derived and/or modified sequence opt2 from SHC3__Homo_sapiens__NP_058544
augcucccccgcaccaaguacaaccgcuuccgcaacgacuccgucaccuccgucgacgaccuccuccacucccucuccgucuccggcggcggcggcaaggucuccgccgcccgcgccacccccgccgccgcccccuaccucgucuccggcgaggcccuccgcaaggcccccgacgacggccccggcucccucggccaccuccuccacaaggucucccaccucaagcucuccuccuccggccuccgcggccucuccuccgccgcccgcgagcgcgccggcgcccgccucuccggcuccugcuccgcccccucccucgccgcccccgacggcuccgcccccuccgccccccgcgcccccgccauguccgccgcccgcaagggccgccccggcgacgagccccucccccgccccccccgcggcgccccccacgccuccgaccagguccucggccccggcgucaccuacgucgucaaguaccucggcugcaucgagguccuccgcuccaugcgcucccucgacuucuccacccgcacccagaucacccgcgaggccaucucccgcgucugcgaggccguccccggcgccaagggcgccuucaagaagcgcaagccccccuccaagaugcucuccuccauccucggcaaguccaaccuccaguucgccggcauguccaucucccucaccaucuccaccgccucccucaaccuccgcacccccgacuccaagcagaucaucgccaaccaccacaugcgcuccaucuccuucgccuccggcggcgaccccgacaccaccgacuacgucgccuacgucgccaaggaccccgucaaccgccgcgccugccacauccucgagugcugcgacggccucgcccaggacgucaucggcuccaucggccaggccuucgagcuccgcuucaagcaguaccuccagugccccaccaagauccccgcccuccacgaccgcaugcagucccucgacgagcccuggaccgaggaggagggcgacggcuccgaccaccccuacuacaacuccauccccuccaagaugcccccccccggcggcuuccucgacacccgccucaagccccgcccccacgcccccgacaccgcccaguucgccggcaaggagcagaccuacuaccagggccgccaccucggcgacaccuucggcgaggacuggcagcagaccccccuccgccagggcuccuccgacaucuacuccacccccgagggcaagcuccacgucgcccccaccggcgaggcccccaccuacgucaacacccagcagauccccccccaggccuggcccgccgccgucuccuccgccgaguccuccccccgcaaggaccucuucgacaugaagcccuucgaggacgcccucaagaaccagccccucggccccguccucuccaaggccgccuccgucgagugcaucucccccgucuccccccgcgcccccgacgccaagaugcucgaggagcuccaggccgagaccugguaccagggcgagaugucccgcaaggaggccgagggccuccucgagaaggacggcgacuuccucguccgcaaguccaccaccaaccccggcuccuucguccucaccggcaugcacaacggccaggccaagcaccuccuccucgucgaccccgagggcaccauccgcaccaaggaccgcgucuucgacuccaucucccaccucaucaaccaccaccucgaguccucccuccccaucgucuccgccggcuccgagcucugccuccagcagcccgucgagcgcaagcaguga

SEQ ID NO: 49416 - RNA, 1893 nt, Artificial Sequence
  derived and/or modified sequence opt2 from SHC4__Homo_sapiens__NP_976224
augcgcgagcgcggccaggacucccucgccggccucguccucuacgucggccucuucggccaccccggcaugcuccaccgcgccaaguacucccgcuuccgcaacgaguccaucaccucccucgacgagggcuccuccggcggcuccgucggcaacaagggcuccccccagcccccccaccccgcccucgccccccaccuccccaccgaggacgccacccuccccucccaggagucccccaccccccucugcacccucaucccccgcauggccuccaugaagcucgccaaccccgccacccuccucucccucaagaacuucugccucggcaccaaggaggucccccgccucaagcuccaggagucccgcgaccccggcuccuccggccccuccucccccgagaccucccucucccgcuccggcaccgccccccccccccagcaggaccucgucggccaccgcgccaccgcccucacccccgacuccugcccccuccccggccccggcgagcccacccuccgcucccgccaggaccgccacuuccuccagcaccuccucggcaugggcaugaacuacugcguccgcuacaugggcugcgucgagguccuccaguccaugcgcucccucgacuucggcaugcgcacccaggucacccgcgaggccaucucccgccucugcgaggccguccccggcgccaacggcgccaucaagaagcgcaagccccccgucaaguuccucuccaccguccucggcaaguccaaccuccaguucuccggcaugaacaucaagcucaccaucuccaccugcucccucacccucaugaaccucgacaaccagcagaucaucgccaaccaccacaugcaguccaucuccuucgccuccggcggcgaccccgacaccaccgacuacgucgccuacgucgccaaggaccccgucaaccagcgcgccugccacauccucgagugccacaacggcauggcccaggacgucaucuccaccaucggccaggccuucgagcuccgcuucaagcaguaccucaagaaccccucccucaacaccuccugcgaguccgaggagguccacaucgacucccacgccgaggagcgcgaggaccacgaguacuacaacgagauccccggcaagcagccccccgucggcggcgucuccgacaugcgcaucaagguccaggccaccgagcagauggccuacugccccauccagugcgagaagcucugcuaccuccccggcaacuccaagugcuccuccgucuacgagaacugccucgagcagucccgcgccaucggcaacguccacccccgcggcguccagucccagcgcgacaccucccuccucaagcacaccugccgcgucgaccucuucgacgaccccugcuacaucaacacccaggcccuccaguccacccccggcuccgccggcaaccagcgcuccgcccagccccucggcucccccuggcacugcggcaaggcccccgagaccguccagcccggcgccaccgcccagcccgccuccucccacucccucccccacaucaagcagcagcucugguccgaggagugcuaccacggcaagcucucccgcaaggccgccgagucccuccucgucaaggacggcgacuuccucguccgcgaguccgccaccucccccggccaguacguccucuccggccuccagggcggccaggccaagcaccuccuccucgucgaccccgagggcaagguccgcaccaaggaccacgucuucgacaacgucggccaccucauccgcuaccacauggacaacucccuccccaucaucuccuccggcuccgaggucucccucaagcagcccguccgcaaggacaacaaccccgcccuccuccacuccaacaaguga

SEQ ID NO: 49417 - RNA, 2019 nt, Artificial Sequence
  derived and/or modified sequence opt2 from SHCBP1__Homo_sapiens__NP_079021
auggccgacggcucccucaccggcggcggccucgaggccgccgccauggcccccgagcgcaccggcugggccgucgagcaggagcucgccucccucgagaagggccucuuccaggacgaggacuccugcuccgacugcuccuaccgcgacaagcccggcuccucccuccaguccuucaugcccgagggcaagaccuucuuccccgagaucuuccagaccaaccagcuccucuucuacgagcgcuuccgcgccuaccaggacuacauccucgccgacugcaaggccuccgagguccaggaguucaccgccgaguuccucgagaagguccucgagcccuccggcuggcgcgccgucuggcacaccaacgucuucaagguccucgucgagaucaccgacgucgacuucgccgcccucaaggccgucguccgccucgccgagcccuaccucugcgacucccaggucuccaccuucaccauggagugcaugaaggagcuccucgaccucaaggagcaccgccucccccuccaggagcucugggucgucuucgacgacuccggcgucuucgaccagaccgcccucgccaucgagcacguccgcuucuucuaccagaacaucuggcgcuccugggacgaggaggaggaggacgaguacgacuacuucguccgcugcgucgagccccgccuccgccuccacuacgacauccucgaggaccgcguccccuccggccucaucgucgacuaccacaaccuccucucccagugcgaggaguccuaccgcaaguuccucaaccuccgcuccucccucuccaacugcaacuccgacuccgagcaggagaacaucuccauggucgagggccucaagcucuacuccgagauggagcagcucaagcagaagcucaagcucaucgagaacccccuccuccgcuacgucuucggcuaccagaagaacuccaacauccaggccaagggcguccgcuccuccggccagaagaucacccacgucgucuccuccaccaugauggccggccuccuccgcucccuccucaccgaccgccucugccaggagcccggcgaggaggagcgcgagauccaguuccacuccgacccccucuccgccaucaacgccugcuucgagggcgacaccgucaucgucugccccggccacuacgucguccacggcaccuucuccaucgccgacuccaucgagcucgagggcuacggccuccccgacgacaucgucaucgagaagcgcggcaagggcgacaccuucgucgacugcaccggcgccgacaucaagaucuccggcaucaaguucguccagcacgacgccgucgagggcauccucaucguccaccgcggcaagaccacccucgagaacugcguccuccagugcgagaccaccggcgucaccguccgcaccuccgccgaguuccucaugaagaacuccgaccucuacggcgccaagggcgccggcaucgagaucuaccccggcucccagugcacccucuccgacaacggcauccaccacugcaaggagggcauccucaucaaggacuuccucgacgagcacuacgacauccccaagaucuccauggucaacaacaucauccacaacaacgagggcuacggcgucguccucgucaagcccaccaucuucuccgaccuccaggagaacgccgaggacggcaccgaggagaacaaggcccucaagauccagaccuccggcgagcccgacgucgccgagcgcgucgaccucgaggagcucaucgagugcgccaccggcaagauggagcucugcgcccgcaccgaccccuccgagcaggucgagggcaacugcgagaucgucaacgagcucaucgccgccuccacccagaagggccagaucaagaagaagcgccucuccgagcucggcaucacccaggccgacgacaaccucaugucccaggagauguucgucggcaucgucggcaaccaguucaaguggaacggcaagggcuccuucggcaccuuccucuucuga

SEQ ID NO: 49418 - RNA, 1326 nt, Artificial Sequence
  derived and/or modified sequence opt2 from SHF__Homo_sapiens__NP_001288097
augcuccucuccggcgccccccccgccggcucccgccccggcccccgcacccagggcuccgccggcggcggccccggcggcucccgccgcggcgccggcggcgccggcgccggccccggcggcggcggcuccggcggcgucgccaaguggcuccgcgagcaccucggcuuccgcggcggcggcggcggcggcggcggcuccaagcccgccccccccgagcccgacuaccgcccccccgcccccucccccgccgccccccccgcccccccccccgacauccucgccgccuaccgccuccagcgcgagcgcgacuucgaggaccccuacuccggcggcuccuccggcuccgccgcccucgccacccccgucgcccccggccccaccccccccccccgccacggcucccccccccaccgccucauccgcgucgagacccccggcccccccgccccccccgccgacgagcgcaucuccggcccccccgccuccuccgaccgccucgccauccucgaggacuacgccgaccccuucgacguccaggagaccggcgagggcuccgccggcgccuccggcgcccccgagaagguccccgagaacgacggcuacauggagcccuacgaggcccagaagaugauggccgagauccgcggcuccaaggagaccgccacccagccccucccccucuacgacacccccuacgagcccgaggaggacggcgccacccccgagggcgagggcgcccccuggccccgcgagucccgccuccccgaggacgacgagcgcccccccgaggaguacgaccagcccugggaguggaagaaggagcgcaucuccaaggccuucgccgcccaguucgagggccccgagaaguccugccucucccccggccgcgaggagaagggccgccuccccccccgccucuccgccggcaaccccaaguccgccaagccccucuccauggagcccuccuccccccucggcgaguggaccgaccccgcccucccccucgagaaccaggucugguaccacggcgccaucucccgcaccgacgccgagaaccuccuccgccucugcaaggaggccuccuaccucguccgcaacuccgagaccuccaagaacgacuucucccucucccucaaguccucccagggcuucaugcacaugaagcucucccgcaccaaggagcacaaguacguccucggccagaacuccccccccuucuccuccguccccgagaucguccaccacuacgccucccgcaagcuccccaucaagggcgccgagcacaugucccuccucuaccccgucgccauccgcacccucuga

SEQ ID NO: 49419 - RNA, 213 nt, Artificial Sequence
  derived and/or modified sequence opt2 from SHFM1__Homo_sapiens__NP_006295
auguccgagaagaagcagcccgucgaccucggccuccucgaggaggacgacgaguucgaggaguuccccgccgaggacugggccggccucgacgaggacgaggacgcccacgucugggaggacaacugggacgacgacaacgucgaggacgacuucuccaaccagcuccgcgccgagcucgagaagcacggcuacaagauggagaccuccuga

SEQ ID NO: 49420 - RNA, 1389 nt, Artificial Sequence
  derived and/or modified sequence opt2 from SHH__Homo_sapiens__NP_000184
augcuccuccucgcccgcugccuccuccucguccucgucuccucccuccucgucugcuccggccucgccugcggccccggccgcggcuucggcaagcgccgccaccccaagaagcucaccccccucgccuacaagcaguucauccccaacgucgccgagaagacccucggcgccuccggccgcuacgagggcaagaucucccgcaacuccgagcgcuucaaggagcucacccccaacuacaaccccgacaucaucuucaaggacgaggagaacaccggcgccgaccgccucaugacccagcgcugcaaggacaagcucaacgcccucgccaucuccgucaugaaccaguggcccggcgucaagcuccgcgucaccgagggcugggacgaggacggccaccacuccgaggagucccuccacuacgagggccgcgccgucgacaucaccaccuccgaccgcgaccgcuccaaguacggcaugcucgcccgccucgccgucgaggccggcuucgacugggucuacuacgaguccaaggcccacauccacugcuccgucaaggccgagaacuccgucgccgccaaguccggcggcugcuuccccggcuccgccaccguccaccucgagcagggcggcaccaagcucgucaaggaccucucccccggcgaccgcguccucgccgccgacgaccagggccgccuccucuacuccgacuuccucaccuuccucgaccgcgacgacggcgccaagaaggucuucuacgucaucgagacccgcgagccccgcgagcgccuccuccucaccgccgcccaccuccucuucgucgccccccacaacgacuccgccaccggcgagcccgaggccuccuccggcuccggcccccccuccggcggcgcccucggcccccgcgcccucuucgccucccgcguccgccccggccagcgcgucuacgucgucgccgagcgcgacggcgaccgccgccuccuccccgccgccguccacuccgucacccucuccgaggaggccgccggcgccuacgccccccucaccgcccagggcaccauccucaucaaccgcguccucgccuccugcuacgccgucaucgaggagcacuccugggcccaccgcgccuucgcccccuuccgccucgcccacgcccuccucgccgcccucgcccccgcccgcaccgaccgcggcggcgacuccggcggcggcgaccgcggcggcggcggcggccgcgucgcccucaccgcccccggcgccgccgacgcccccggcgccggcgccaccgccggcauccacugguacucccagcuccucuaccagaucggcaccuggcuccucgacuccgaggcccuccacccccucggcauggccgucaaguccuccuga

SEQ ID NO: 49421 - RNA, 888 nt, Artificial Sequence
  derived and/or modified sequence opt2 from SHISA2__Homo_sapiens__NP_001007539
auguggggcgcccgccgcuccuccgucuccuccuccuggaacgccgccucccuccuccagcuccuccucgccgcccuccucgccgccggcgcccgcgccuccggcgaguacugccacggcuggcucgacgcccagggcgucuggcgcaucggcuuccagugccccgagcgcuucgacggcggcgacgccaccaucugcugcggcuccugcgcccuccgcuacugcugcuccuccgccgaggcccgccucgaccagggcggcugcgacaacgaccgccagcagggcgccggcgagcccggccgcgccgacaaggacggccccgacggcuccgccguccccaucuacguccccuuccucaucgucggcuccgucuucgucgccuucaucauccucggcucccucgucgccgccugcugcugccgcugccuccgccccaagcaggacccccagcagucccgcgcccccggcggcaaccgccucauggagaccauccccaugauccccuccgccuccaccucccgcggcuccuccucccgccaguccuccaccgccgccuccuccuccuccuccgccaacuccggcgcccgcgccccccccacccgcucccagaccaacugcugccuccccgagggcaccaugaacaacgucuacgucaacaugcccaccaacuucuccguccucaacugccagcaggccacccagaucgucccccaccagggccaguaccuccacccccccuacgucggcuacaccguccagcacgacuccguccccaugaccgccgucccccccuucauggacggccuccagcccggcuaccgccagauccagucccccuucccccacaccaacuccgagcagaagauguaccccgccgucaccgucuga

SEQ ID NO: 49422 - RNA, 717 nt, Artificial Sequence
  derived and/or modified sequence opt2 from SHISA3__Homo_sapiens__NP_001073974
augcgcgcccuccucgcccucugccuccuccucggcuggcuccgcuggggccccgccggcgcccagcaguccggcgaguacugccacggcugggucgacguccagggcaacuaccacgagggcuuccagugccccgaggacuucgacacccucgacgccaccaucugcugcggcuccugcgcccuccgcuacugcugcgccgccgccgacgcccgccucgagcagggcggcugcaccaacgaccgccgcgagcucgagcaccccggcaucaccgcccagcccgucuacguccccuuccucaucgucggcuccaucuucaucgccuucaucauccucggcuccgucgucgccaucuacugcugcaccugccuccgccccaaggagcccucccagcagcccauccgcuucucccuccgcuccuaccagaccgagacccuccccaugauccucaccuccaccuccccccgcgcccccucccgccaguccuccaccgccaccuccuccuccuccaccggcggcuccauccgccgcuucuccuucgcccgcgccgagcccggcugccucguccccuccccccccccccccuacaccaccucccacuccauccaccucgcccagcccuccggcuuccucgucuccccccaguacuucgccuacccccuccagcaggagcccccccuccccggcaaguccugccccgacuucuccuccuccuga

SEQ ID NO: 49423 - RNA, 1503 nt, Artificial Sequence
  derived and/or modified sequence opt2 from SHISA6__Homo_sapiens__NP_001166932
auggcccuccgccgccuccuccuccuccuccuccucucccucgagucccucgaccuccuccccuccguccacggcgcccgcggccgcgccgccaaccgcacccucuccgccggcggcgccgccgucggcggccgccgcgccggcggcgcccucgcccgcggcggccgcgagcucaacggcaccgcccgcgcccccggcauccccgaggccggcucccgccgcggccagcccgccgccgccgucgccgccgccgccuccgccgccgucaccuacgagaccugcuggggcuacuacgacgucuccggccaguacgacaaggaguucgagugcaacaacuccgaguccggcuaccucuacugcugcggcaccugcuacuaccgcuucugcugcaagaagcgccacgagaagcucgaccagcgccagugcaccaacuaccagucccccgucuggguccagacccccuccaccaaggucgucucccccggccccgagaacaaguacgaccccgagaaggacaagaccaacuucaccgucuacaucaccugcggcgucaucgccuucgucaucgucgccggcgucuucgccaaggucuccuacgacaaggcccaccgccccccccgcgagaugaacauccaccgcgcccucgccgacauccuccgccagcagggccccauccccaucgcccacugcgagcgcgagaccaucuccgccaucgacaccucccccaaggagaacacccccguccgcuccuccuccaagaaccacuacacccccguccgcaccgccaagcagacccccgagaagccccgcaugaacaacauccucaccuccgccaccgagcccuacgaccucuccuucucccgcuccuuccagaaccucgcccaccucccccccuccuacgaguccgccgucaagaccaaccccuccaaguacuccucccucaagcgccucaccgacaaggaggccgacgaguacuacaugcgccgccgccaccuccccgaccucgccgcccgcggcacccucccccucaacgucauccagaugucccagcagaagccccucccccgcgagcgcccccgccgccccauccgcgccaugucccaggaccgcguccucucccccgaccgcggccuccccgacgaguucuccaugcccuacgaccgcauccucuccgacgagcagcuccucuccaccgagcgccuccacucccaggacccccuccucucccccgagcgcaccgccuuccccgagcagucccucucccgcgccaucucccacaccgacgucuucgucuccacccccguccucgaccgcuaccgcauguccaagaugcacucccaccccuccgccuccaacaacuccuacgccacccucggccagucccagaccgccgccaagcgccacgccuucgccucccgccgccacaacaccgucgagcagcuccacuacauccccggccaccacaccugcuacaccgccuccaagaccgaggucaccgucuga

SEQ ID NO: 49424 - RNA, 1275 nt, Artificial Sequence
  derived and/or modified sequence opt2 from SHISA9__Homo_sapiens__NP_001138676
augcgccgcguccuccgccuccuccucggcugcuuccucaccgagcucugcgcccgcgucugccgcgcccaggagcgcgccggccacggccagcucgcccagcucggcggcguccuccuccucgccggcggcaaccgcuccggcgccgccuccggcgaggccuccgagggcgccgaggccuccgacgccccccccacccgcgcccccacccccgacuucugccgcggcuacuucgacgucaugggccagugggacccccccuucaacugcuccuccggcgacuucaucuucugcugcggcaccugcggcuuccgcuucugcugcaccuucaagaagcgccgccucaaccaguccaccugcaccaacuacgacaccccccucuggcucaacaccggcaagccccccgcccgcaaggacgacccccuccacgaccccaccaaggacaagaccaaccucaucgucuacaucaucugcggcgucgucgccgucaugguccucgucggcaucuucaccaagcucggccucgagaaggcccaccgcccccagcgcgagcacaugucccgcgcccucgccgacgucaugcgcccccagggccacugcaacaccgaccacauggagcgcgaccucaacaucgucguccacguccagcacuacgagaacauggacacccgcacccccaucaacaaccuccacgccacccagaugaacaacgccguccccaccuccccccuccuccagcagaugggccacccccacuccuaccccaaccucggccagaucuccaaccccuacgagcagcagccccccggcaaggagcucaacaaguacgccucccucaaggccgucggcuccuccgacggcgacugggccgucuccacccucaagucccccaaggccgacaaggucaacgacgacuucuacaccaagcgccgccaccucgccgagcucgccgccaagggcaaccucccccuccaccccguccgcgucgaggacgagccccgcgccuucucccccgagcacggccccgccaagcagaacggccagaagucccgcaccaacaagaugcccccccacccccucgccuacaccuccaccaccaacuucaagggcugggaccccaacgagcagucccuccgccgccaggccuacuccaacaagggcaagcucggcaccgccgagaccggcuccuccgacccccucggcacccgcccccagcacuacccccccccccagcccuacuucaucaccaacuccaagaccgaggucaccgucuga

SEQ ID NO: 49425 - RNA, 1038 nt, Artificial Sequence
  derived and/or modified sequence opt2 from SHMT1__Homo_sapiens__NP_001268715
augggccucgaccuccccgacggcggccaccucacccacggcuucaugaccgacaagaagaagaucuccgccaccuccaucuucuucgaguccaugcccuacaaggucaaccccgacaccggcuacaucaacuacgaccagcucgaggagaacgcccgccucuuccaccccaagcucaucaucgccggcaccuccugcuacucccgcaaccucgaguacgcccgccuccgcaagaucgccgacgagaacggcgccuaccucauggccgacauggcccacaucuccggccucgucgccgccggcgucguccccucccccuucgagcacugccacgucgucaccaccaccacccacaagacccuccgcggcugccgcgccggcaugaucuucuaccgcaagggcgucaaguccgucgaccccaagaccggcaaggagauccucuacaaccucgagucccucaucaacuccgccgucuuccccggccuccagggcggcccccacaaccacgccaucgccggcgucgccgucgcccucaagcaggccaugacccucgaguucaaggucuaccagcaccaggucgucgccaacugccgcgcccucuccgaggcccucaccgagcucggcuacaagaucgucaccggcggcuccgacaaccaccucauccucgucgaccuccgcuccaagggcaccgacggcggccgcgccgagaagguccucgaggccugcuccaucgccugcaacaagaacaccugccccggcgaccgcuccgcccuccgccccuccggccuccgccucggcacccccgcccucaccucccgcggccuccucgagaaggacuuccagaaggucgcccacuucauccaccgcggcaucgagcucacccuccagauccaguccgacaccggcguccgcgccacccucaaggaguucaaggagcgccucgccggcgacaaguaccaggccgccguccaggcccuccgcgaggaggucgaguccuucgccucccucuucccccuccccggccuccccgacuucuga

SEQ ID NO: 49426 - RNA, 1485 nt, Artificial Sequence
  derived and/or modified sequence opt2 from SHMT2__Homo_sapiens__NP_001159828
augcucuacuucucccucuucugggccgcccgcccccuccagcgcugcggccagcucguccgcauggccauccgcgcccagcacuccaacgccgcccagacccagaccggcgaggccaaccgcggcuggaccggccaggagucccucuccgacuccgaccccgagaugugggagcuccuccagcgcgagaaggaccgccagugccgcggccucgagcucaucgccuccgagaacuucugcucccgcgccgcccucgaggcccucggcuccugccucaacaacaaguacuccgagggcuaccccggcaagcgcuacuacggcggcgccgaggucgucgacgagaucgagcuccucugccagcgccgcgcccucgaggccuucgaccucgaccccgcccaguggggcgucaacguccagcccuacuccggcucccccgccaaccucgccgucuacaccgcccuccuccagccccacgaccgcaucaugggccucgaccuccccgacggcggccaccucacccacggcuacauguccgacgucaagcgcaucuccgccaccuccaucuucuucgaguccaugcccuacaagcucaaccucgcccucaccgcccgccucuuccgcccccgccucaucaucgccggcaccuccgccuacgcccgccucaucgacuacgcccgcaugcgcgaggucugcgacgaggucaaggcccaccuccucgccgacauggcccacaucuccggccucgucgccgccaaggucauccccucccccuucaagcacgccgacaucgucaccaccaccacccacaagacccuccgcggcgcccgcuccggccucaucuucuaccgcaagggcgucaaggccgucgaccccaagaccggccgcgagauccccuacaccuucgaggaccgcaucaacuucgccgucuuccccucccuccagggcggcccccacaaccacgccaucgccgccgucgccgucgcccucaagcaggccugcacccccauguuccgcgaguacucccuccagguccucaagaacgcccgcgccauggccgacgcccuccucgagcgcggcuacucccucgucuccggcggcaccgacaaccaccucguccucgucgaccuccgccccaagggccucgacggcgcccgcgccgagcgcguccucgagcucgucuccaucaccgccaacaagaacaccugccccggcgaccgcuccgccaucacccccggcggccuccgccucggcgcccccgcccucaccucccgccaguuccgcgaggacgacuuccgccgcgucgucgacuucaucgacgagggcgucaacaucggccucgaggucaaguccaagaccgccaagcuccaggacuucaaguccuuccuccucaaggacuccgagaccucccagcgccucgccaaccuccgccagcgcgucgagcaguucgcccgcgccuuccccaugcccggcuucgacgagcacuga

SEQ ID NO: 49427 - RNA, 1611 nt, Artificial Sequence
  derived and/or modified sequence opt2 from SHOC2__Homo_sapiens__NP_001255968
auguccuccucccucggcaaggagaaggacuccaaggagaaggaccccaagguccccuccgccaaggagcgcgagaaggaggccaaggccuccggcggcuucggcaaggaguccaaggagaaggagcccaagaccaagggcaaggacgccaaggacggcaagaaggacuccuccgccgcccagcccggcgucgccuucuccgucgacaacaccaucaagcgccccaaccccgcccccggcacccgcaagaaguccuccaacgccgaggucaucaaggagcucaacaagugccgcgaggagaacuccaugcgccucgaccucuccaagcgcuccauccacauccuccccuccuccaucaaggagcucacccagcucaccgagcucuaccucuacuccaacaagcuccagucccuccccgccgaggucggcugccucgucaaccucaugacccucgcccucuccgagaacucccucaccucccuccccgacucccucgacaaccucaagaagcuccgcaugcucgaccuccgccacaacaagcuccgcgagauccccuccgucgucuaccgccucgacucccucaccacccucuaccuccgcuucaaccgcaucaccaccgucgagaaggacaucaagaaccucuccaagcucuccaugcucuccauccgcgagaacaagaucaagcagcuccccgccgagaucggcaaccucuccucccucucccgccucggccuccgcuacaaccgccucuccgccaucccccgcucccucgccaagugcuccgcccucgaggagcucaaccucgagaacaacaacaucuccacccuccccgagucccuccucuccucccucgucaagcucaacucccucacccucgcccgcaacugcuuccagcucuaccccgucggcggccccucccaguucuccaccaucuacucccucaacauggagcacaaccgcaucaacaagauccccuucggcaucuucucccgcgccaagguccucuccaagcucaacaugaaggacaaccagcucaccucccucccccucgacuucggcaccuggaccuccauggucgagcucaaccucgccaccaaccagcucaccaagauccccgaggacgucuccggccucgucucccucgagguccucauccucuccaacaaccuccucaagaagcucccccacggccucggcaaccuccgcaagcuccgcgagcucgaccucgaggagaacaagcucgagucccuccccaacgagaucgccuaccucaaggaccuccagaagcucguccucaccaacaaccagcucaccacccucccccgcggcaucggccaccucaccaaccucacccaccucggccucggcgagaaccuccucacccaccuccccgaggagaucggcacccucgagaaccucgaggagcucuaccucaacgacaaccccaaccuccacucccuccccuucgagcucgcccucugcuccaagcucuccaucauguccaucgagaacugcccccucucccaccuccccccccagaucgucgccggcggccccuccuucaucauccaguuccucaagaugcagggccccuaccgcgccauggucuga

SEQ ID NO: 49428 - RNA, 960 nt, Artificial Sequence
  derived and/or modified sequence opt2 from SHOX2__Homo_sapiens__NP_001157150
auggaggagcucaccgccuucgucuccaaguccuucgaccagaaggucaaggagaagaaggaggccaucaccuaccgcgagguccucgaguccggcccccuccgcggcgccaaggagcccaccggcugcaccgaggccggccgcgacgaccgcuccucccccgccguccgcgccgccggcggcggcggcggcggcggcggcggcggcggcggcggcggcggcggcggcggcgucggcggcggcggcgccggcggcggcgccggcggcggccgcucccccguccgcgagcucgacaugggcgccgccgagcgcucccgcgagcccggcuccccccgccucaccgaggucucccccgagcucaaggaccgcaaggaggacgccaagggcauggaggacgagggccagaccaagaucaagcagcgccgcucccgcaccaacuucacccucgagcagcucaacgagcucgagcgccucuucgacgagacccacuaccccgacgccuucaugcgcgaggagcucucccagcgccucggccucuccgaggcccgcguccaggucugguuccagaaccgccgcgccaagugccgcaagcaggagaaccagcuccacaagggcguccucaucggcgccgccucccaguucgaggccugccgcgucgcccccuacgucaacgucggcgcccuccgcaugcccuuccagcagguccaggcccagcuccagcucgacuccgccgucgcccacgcccaccaccaccuccacccccaccucgccgcccacgcccccuacaugauguuccccgccccccccuucggccucccccucgccacccucgccgccgacuccgccuccgccgccuccgucgucgccgccgccgccgccgccaagaccaccuccaagaacuccuccaucgccgaccuccgccucaaggccaagaagcacgccgccgcccucggccucuga

SEQ ID NO: 49429 - RNA, 879 nt, Artificial Sequence
  derived and/or modified sequence opt2 from SHOX__Homo_sapiens__NP_000442
auggaggagcucaccgccuucgucuccaaguccuucgaccagaaguccaaggacggcaacggcggcggcggcggcggcggcggcaagaaggacuccaucaccuaccgcgagguccucgaguccggccucgcccgcucccgcgagcucggcaccuccgacuccucccuccaggacaucaccgagggcggcggccacugccccguccaccucuucaaggaccacgucgacaacgacaaggagaagcucaaggaguucggcaccgcccgcgucgccgagggcaucuacgagugcaaggagaagcgcgaggacgucaaguccgaggacgaggacggccagaccaagcucaagcagcgccgcucccgcaccaacuucacccucgagcagcucaacgagcucgagcgccucuucgacgagacccacuaccccgacgccuucaugcgcgaggagcucucccagcgccucggccucuccgaggcccgcguccaggucugguuccagaaccgccgcgccaagugccgcaagcaggagaaccagaugcacaagggcgucauccucggcaccgccaaccaccucgacgccugccgcgucgcccccuacgucaacaugggcgcccuccgcaugcccuuccagcagguccaggcccagcuccagcucgagggcgucgcccacgcccacccccaccuccacccccaccucgccgcccacgcccccuaccucauguucccccccccccccuucggccuccccaucgccucccucgccgaguccgccuccgccgccgccgucgucgccgccgccgccaaguccaacuccaagaacuccuccaucgccgaccuccgccucaaggcccgcaagcacgccgaggcccucggccucuga

SEQ ID NO: 49430 - RNA, 1437 nt, Artificial Sequence
  derived and/or modified sequence opt2 from SHPK__Homo_sapiens__NP_037408
auggccgcccgccccaucacccucggcaucgaccucggcaccaccuccgucaaggccgcccuccuccgcgccgcccccgacgaccccuccggcuucgccguccucgccuccugcgcccgcgccgcccgcgccgaggccgccgucgaguccgccgucgccggcccccagggccgcgagcaggacgucucccgcauccuccaggcccuccacgagugccucgccgcccucccccgcccccagcuccgcuccgucgucggcaucggcgucuccggccagaugcacggcgucgucuucuggaagaccggccagggcugcgaguggaccgagggcggcaucacccccgucuucgagccccgcgccgucucccaccucgucaccuggcaggacggccgcugcuccuccgaguuccucgccucccucccccagcccaagucccaccucuccgucgccaccggcuucggcugcgccaccaucuucuggcuccucaaguaccgccccgaguuccucaaguccuacgacgccgccggcaccauccacgacuacgucgucgccaugcucugcggccucccccgcccccucauguccgaccagaacgccgccuccuggggcuacuucaacacccagucccaguccuggaacgucgagacccuccgcuccuccggcuuccccguccaccuccuccccgacaucgccgagcccggcuccgucgccggccgcaccucccacaugugguucgagauccccaagggcacccaggucggcgucgcccucggcgaccuccaggccuccgucuacuccugcauggcccagcgcaccgacgccguccucaacaucuccaccuccguccagcucgccgccuccaugcccuccggcuuccagcccgcccagacccccgaccccaccgcccccgucgccuacuuccccuacuucaaccgcaccuaccucggcgucgccgccucccucaacggcggcaacguccucgccaccuucguccacaugcucguccaguggauggccgaccucggccucgaggucgaggaguccaccgucuacucccgcaugauccaggccgccguccagcagcgcgacacccaccucaccaucacccccaccguccucggcgagcgccaccuccccgaccagcucgccuccgucacccgcaucuccuccuccgaccucucccucggccacgucacccgcgcccucugccgcggcaucguccagaaccuccacuccaugcuccccauccagcagcuccaggaguggggcgucgagcgcgucaugggcuccggcuccgcccucucccgcaacgacguccucaagcaggagguccagcgcgccuucccccuccccauguccuucggccaggacgucgacgccgccgucggcgccgcccucgucaugcuccgccgccaccucaaccagaaggaguccuga

SEQ ID NO: 49431 - RNA, 5052 nt, Artificial Sequence
  derived and/or modified sequence opt2 from SHPRH__Homo_sapiens__NP_001036148
auguccucccgccgcaagcgcgccccccccguccgcgucgacgaggagaagcgccagcagcuccacuggaacaugcacgaggaccgccgcaacgagcccaucaucaucuccgacgacgacgagcagcccugccccggcuccgacaccuccuccgcccacuacaucauccucuccgacucccucaaggaggaggucgcccaccgcgacaagaagcgcugcuccaaggucgucuccuucuccaagcccaucgagaaggaggagaccgucggcaucuucuccccccucuccgucaagcucaacaucgucaucucccccuaccacuucgacaacuccuggaaggccuuccucggcgagcucacccuccagcuccuccccgcccagucccucaucgagaacuucuccgagcgcuccaucacccucauguccuccgaguccuccaaccaguuccucaucuacguccacuccaagggcgaggacgucgagaagcagaagaaggagcccauguccaucugcgacaagggcauccucgucgaguccuccuucuccggcgagaugcucgaggaccucggcuggcuccagaagaagcgccgcaucaagcucuaccagaagcccgagggcaaccacaucaucaaggucggcaucuaccuccucgaggccggccucgccaagcucgacuuccucuccgacgccaacucccgcaugaagaaguucaaccagcucaugaagaaggucauggagaagcuccacaacuccaucauccccgacguccucgaggaggacgaggacgaccccgaguccgagcccgagggccaggacaucgacgagcucuaccacuucgucaagcagacccaccagcaggagacccaguccauccaggucgacguccagcaccccgcccucauccccguccuccgccccuaccagcgcgaggccgucaacuggaugcuccagcaggagugcuuccgcuccucccccgccaccgaguccgcccuccacuuccucuggcgcgagaucgucaccuccgagggccucaagcucuacuacaaccccuacaccggcugcaucauccgcgaguaccccaacuccggcccccagcuccucggcggcauccucgccgacgagaugggccucggcaagaccgucgagguccucgcccucauccucacccacacccgccaggacgucaagcaggacgcccucacccuccccgagggcaaggucgucaacuacuucauccccucccacuacuucggcggcaagcucaagaagaccgagauccagaacaucgaguucgagcccaaggagaagguccagugcccccccacccgcgucaugauccucaccgccgucaaggagaugaacggcaagaagggcgucuccauccucuccaucuacaaguacgucuccuccaucuaccgcuacgacguccagcgcaaccgcucccuccucaagcgcaugcucaagugccucaucuucgagggccucgucaagcagaucaagggccacggcuucuccggcaccuucacccucggcaagaacuacaaggaggaggacaucugcgacaagaccaagaagcaggccgucggcuccccccgcaagauccagaaggagacccgcaaguccggcaacaaggacaccgacuccgaguaccuccccuccgacaccuccgacgacgacgacgaccccuacuacuacuacuacaagucccgccgcaaccgcuccaagcuccgcaagaagcucguccccuccaccaagaagggcaagucccagcccuucaucaaccccgacucccagggccacugccccgccaccuccgacuccggcaucaccgacgucgccauguccaaguccaccugcaucuccgaguucaaccaggagcacgagaccgaggacugcgccgagucccucaaccacgccgacuccgacgucccccccuccaacaccaugucccccuucaacaccuccgacuaccgcuucgagugcaucugcggcgagcucgaccagaucgaccgcaagccccgcguccagugccucaagugccaccucuggcagcacgccaagugcgucaacuacgacgagaagaaccucaagaucaagcccuucuacugcccccacugccucgucgccauggagcccgucuccacccgcgccacccucaucaucucccccuccuccaucugccaccagugggucgacgagaucaaccgccacguccgcuccuccucccuccgcguccucgucuaccagggcgucaagaaggacggcuuccuccagccccacuuccucgccgagcaggacaucgucaucaucaccuacgacguccuccgcuccgagcucaacuacgucgacaucccccacuccaacuccgaggacggccgccgccuccgcaaccagaagcgcuacauggccauccccuccccccucgucgccgucgagugguggcgcaucugccucgacgaggcccagauggucgagugccccaccgucaaggccgccgagauggcccagcgccucuccggcaucaaccgcuggugcaucuccggcacccccguccagcgcggccucgaggaccucuucggccucgucgucuuccucggcaucgagcccuacugcgucaagcacugguggguccgccuccucuaccgccccuacugcaagaagaacccccagcaccucuacuccuucaucgccaagauccucuggcgcuccgccaagaaggacgucaucgaccagauccagauccccccccagaccgaggagauccacuggcuccacuucucccccgucgagcgccacuucuaccaccgccagcacgaggucugcugccaggacgucgucgucaagcuccgcaagaucuccgacugggcccucaagcucuccucccucgaccgccgcaccgucaccuccauccucuacccccuccuccgccuccgccaggccugcugccacccccaggccguccgcggcgaguuccucccccuccagaaguccaccaugaccauggaggagcuccucaccucccuccagaagaagugcggcaccgagugcgaggaggcccaccgccagcucgucugcgcccucaacggccucgccggcauccacaucaucaagggcgaguacgcccucgccgccgagcucuaccgcgagguccuccgcuccuccgaggagcacaagggcaagcucaagaccgacucccuccagcgccuccacgccacccacaaccucauggagcuccucaucgcccgccaccccggcaucccccccacccuccgcgacggccgccucgaggaggaggccaagcagcuccgcgagcacuacauguccaagugcaacaccgaggucgccgaggcccagcaggcccucuaccccguccagcagaccauccacgagcuccagcgcaagauccacuccaacucccccugguggcucaacgucauccaccgcgccaucgaguucaccaucgacgaggagcucguccagcgcguccgcaacgagaucaccuccaacuacaagcagcagaccggcaagcucuccauguccgagaaguuccgcgacugccgcggccuccaguuccuccucaccacccagauggaggagcucaacaagugccagaagcucguccgcgaggccgucaagaaccucgagggcccccccucccgcaacgucaucgaguccgccaccgucugccaccuccgccccgcccgccucccccucaacugcugcgucuucugcaaggccgacgagcucuucaccgaguacgaguccaagcucuucuccaacaccgucaagggccagaccgccaucuucgaggagaugaucgaggacgaggagggccucgucgacgaccgcgcccccaccaccacccgcggccucugggccaucuccgagaccgagcgcuccaugaaggccauccucuccuucgccaagucccaccgcuucgacgucgaguucgucgacgagggcuccaccuccauggaccucuucgaggccuggaagaaggaguacaagcuccuccacgaguacuggauggcccuccgcaaccgcgucuccgccgucgacgagcucgccauggccaccgagcgccuccgcguccgcgacccccgcgagcccaagcccaacccccccguccuccacaucaucgagccccacgaggucgagcagaaccgcaucaagcuccucaacgacaaggccgucgccaccucccagcuccagaagaagcucggccagcuccucuaccucaccaaccucgagaagucccaggacaagaccuccggcggcgucaaccccgagcccugccccaucugcgcccgccagcucggcaagcagugggccguccucaccugcggccacugcuucugcaacgagugcaucuccaucaucaucgagcaguacuccgucggcucccaccgcuccuccaucaagugcgccaucugccgccagaccaccucccacaaggagaucuccuacgucuucaccuccgagaaggccaaccaggaggaggacauccccgucaagggcucccacuccaccaaggucgaggccgucguccgcacccucaugaagauccagcuccgcgaccccggcgccaaggcccucgucuucuccaccuggcaggacguccucgacaucaucuccaaggcccucaccgacaacaacauggaguucgcccagaucucccgcgucaagaccuuccaggagaaccucuccgccuucaagcgcgacccccagaucaacauccuccuccucccccuccacaccggcuccaacggccucaccaucaucgaggccacccacguccuccucgucgagcccauccucaaccccgcccacgagcuccaggccaucggccgcguccaccgcaucggccagaccaagcccaccaucguccaccgcuuccucaucaaggccaccaucgaggagcgcaugcaggccaugcucaagaccgccgagcgcucccacaccaacuccuccgccaagcacuccgaggccuccguccucaccgucgccgaccucgccgaccucuucaccaaggagaccgaggagcucgaguga

SEQ ID NO: 49432 - RNA, 1734 nt, Artificial Sequence
  derived and/or modified sequence opt2 from SHQ1__Homo_sapiens__NP_060600
augcucacccccgccuucgaccucucccaggaccccgacuuccucaccaucgccauccgcguccccuacgcccgcgucuccgaguucgacgucuacuucgagggcuccgacuucaaguucuacgccaagcccuacuuccuccgccucacccuccccggccgcaucgucgagaacggcuccgagcagggcuccuacgacgccgacaagggcaucuucaccauccgccuccccaaggagacccccggccagcacuucgagggccucaacaugcucaccgcccuccucgccccccgcaagucccgcaccgccaagccccucgucgaggagaucggcgccuccgagauccccgaggaggucgucgacgacgaggaguucgacugggagaucgagcagacccccugcgaggaggucuccgaguccgcccucaacccccagugccacuacggcuucggcaaccuccgcuccggcguccuccagcgccuccaggacgagcucuccgacgucaucgacaucaaggaccccgacuucacccccgccgccgagcgccgccagaagcgccucgccgccgagcucgccaaguucgaccccgaccacuaccucgccgacuucuucgaggacgaggccaucgagcagauccucaaguacaaccccugguggaccgacaaguacuccaagaugauggccuuccucgagaagucccaggagcaggagaaccacgccacccucgucuccuucuccgaggaggagaaguaccagcuccgcaaguucgucaacaaguccuaccuccucgacaagcgcgccugccgccaggucugcuacucccucaucgacauccuccucgccuacugcuacgagacccgcgucaccgagggcgagaagaacgucgaguccgccuggaacauccgcaagcucucccccacccucugcugguucgagaccuggaccaacguccacgacaucauggucuccuucggccgccgcguccucugcuacccccucuaccgccacuucaagcucgucaugaaggccuaccgcgacaccaucaagauccuccagcucggcaaguccgccguccucaagugccuccucgacauccacaagaucuuccaggagaacgaccccgccuacauccucaacgaccucuacaucuccgacuacugcgucuggauccagaaggucaaguccaagaagcucgccgcccucgccgaggcccucaaggaggucucccucaccaaggcccagcucggccucgagcucgaggagcucgaggccgccgcccuccucguccaggaggaggagaccgcccucaaggccgcccacuccgucuccggccagcagacccucugcuccuccuccgaggccuccgacuccgaggacuccgacuccuccgucuccuccggcaacgaggacuccggcuccgacuccgagcaggacgagcucaaggacucccccuccgagaccgucuccucccuccagggccccuuccucgaggaguccuccgccuuccucaucgucgacggcggcguccgccgcaacaccgccauccaggaguccgacgccucccagggcaagccccucgccuccuccuggccccucggcgucuccggcccccucaucgaggagcucggcgagcagcucaagaccaccguccaggucuccgagcccaagggcaccaccgccgucaaccgcuccaacauccaggagcgcgacggcugccagacccccaacaacuga

SEQ ID NO: 49433 - RNA, 4851 nt, Artificial Sequence
  derived and/or modified sequence opt2 from SHROOM2__Homo_sapiens__NP_001640
auggagggcgccgagccccgcgcccgccccgagcgccucgccgaggccgagacccgcgccgccgacggcggccgccucgucgagguccagcucuccggcggcgcccccuggggcuucacccucaagggcggccgcgagcacggcgagccccucgucaucaccaagaucgaggagggcuccaaggccgccgccgucgacaagcuccucgccggcgacgagaucgucggcaucaacgacaucggccucuccggcuuccgccaggaggccaucugccucgucaagggcucccacaagacccucaagcucgucgucaagcgccgcuccgagcucggcuggcgcccccacuccuggcacgccaccaaguucuccgacucccaccccgagcucgccgccucccccuucaccuccaccuccggcugccccuccugguccggccgccaccacgccuccuccuccucccacgaccucuccuccuccugggagcagaccaaccuccagcgcacccucgaccacuucuccucccucggcuccgucgacucccucgaccaccccuccucccgccucuccgucgccaaguccaacuccuccaucgaccaccucggcucccacuccaagcgcgacuccgccuacggcuccuucuccaccuccuccuccacccccgaccacacccucuccaaggccgacaccuccuccgccgagaacauccucuacaccgucggccucugggaggccccccgccagggcggccgccaggcccaggccgccggcgacccccagggcuccgaggagaagcucuccugcuuccccccccgcguccccggcgacuccggcaagggcccccgccccgaguacaacgccgagcccaagcucgccgcccccggccgcuccaacuucggccccgucugguacguccccgacaagaagaaggcccccuccuccccccccccccccccccccccccuccgcuccgacuccuucgccgccaccaagucccacgagaaggcccagggccccgucuucuccgaggccgccgccgcccagcacuucaccgcccucgcccaggcccagccccgcggcgaccgccgccccgagcucaccgaccgccccuggcgcuccgcccaccccggcucccucggcaagggcuccggcggccccggcugcccccaggaggcccacgccgacggcuccuggccccccuccaaggacggcgccuccucccgccuccaggccucccucuccuccuccgacguccgcuucccccaguccccccacuccggccgccaccccccccucuacuccgaccacuccccccucugcgccgacucccucggccaggagcccggcgccgccuccuuccagaacgacucccccccccagguccgcggccucuccuccugcgaccagaagcucggcuccggcuggcagggcccccgccccugcguccagggcgaccuccaggccgcccagcucugggccggcugcuggcccuccgacaccgcccucggcgcccucgagucccuccccccccccaccgucggccaguccccccgccaccaccucccccagcccgagggcccccccgacgcccgcgagaccggccgcugcuacccccucgacaagggcgccgagggcugcuccgccggcgcccaggagcccccccgcgccucccgcgccgagaaggccucccagcgccucgccgccuccaucaccugggccgacggcgaguccucccgcaucugcccccaggagaccccccuccuccacucccucacccaggagggcaagcgccgccccgaguccucccccgaggacuccgccacccgccccccccccuucgacgcccacgucggcaagcccacccgccgcuccgaccgcuucgccaccacccuccgcaacgagauccagaugcaccgcgccaagcuccagaagucccgcuccaccgucgcccucaccgccgccggcgaggccgaggacggcaccggccgcuggcgcgccggccucggcggcggcacccaggagggcccccucgccggcaccuacaaggaccaccucaaggaggcccaggcccgcguccuccgcgccaccuccuucaagcgccgcgaccucgaccccaaccccggcgaccucuaccccgagucccucgagcaccgcaugggcgaccccgacaccgucccccacuucugggaggccggccucgcccagccccccuccuccaccuccggcggcccccaccccccccgcaucggcggccgccgccgcuucaccgccgagcagaagcucaaguccuacuccgagcccgagaagaugaacgaggucggccucacccgcggcuacuccccccaccagcacccccgcaccuccgaggacaccgucggcaccuucgccgaccgcuggaaguucuucgaggagaccuccaagcccgucccccagcgccccgcccagaagcaggcccuccacggcaucccccgcgacaagcccgagcgcccccgcaccgccggccgcaccugcgagggcaccgagcccuggucccgcaccaccucccucggcgacucccucaacgcccacuccgccgccgagaaggccggcaccuccgaccucccccgccgccucggcaccuucgccgaguaccaggccuccuggaaggagcagcgcaagccccucgaggcccgcuccuccggccgcugccacuccgccgacgacauccucgacgucucccucgacccccaggagcgcccccagcacguccacggccgcucccgcuccucccccuccaccgaccacuacaagcaggaggccuccgucgagcuccgccgccaggccggcgaccccggcgagccccgcgaggagcuccccuccgccguccgcgccgaggagggccaguccaccccccgccaggccgacgcccagugccgcgagggcucccccggcucccagcagcacccccccucccagaaggcccccaacccccccaccuucuccgagcucucccacugccgcggcgcccccgagcucccccgcgagggccgcggccgcgccggcacccucccccgcgacuaccgcuacuccgaggaguccacccccgccgaccucggcccccgcgcccagucccccggcuccccccuccacgcccgcggccaggacuccuggcccgucuccuccgcccuccucuccaagcgccccgccccccagcgcccccccccccccaagcgcgagccccgccgcuaccgcgccaccgacggcgcccccgccgacgcccccgucggcguccucggccgccccuuccccacccccucccccgccucccucgacgucuacgucgcccgccucucccucucccacucccccuccgucuucuccuccgcccagccccaggacacccccaaggccaccgucugcgagcgcggcucccagcacgucuccggcgacgccucccgcccccuccccgaggcccuccucccccccaagcagcagcaccuccgccuccagaccgccaccauggagaccucccgcucccccuccccccaguucgccccccagaagcucaccgacaagcccccccuccucauccaggacgaggacuccacccgcaucgagcgcgucauggacaacaacaccaccgucaagaugguccccaucaagaucguccacuccgagucccagcccgagaaggagucccgccagucccucgccugccccgccgagccccccgcccucccccacggccucgagaaggaccagaucaagacccucuccaccuccgagcaguucuacucccgcuucugccucuacacccgccagggcgccgagcccgaggccccccaccgcgcccagcccgccgagccccagccccucggcacccaggucccccccgagaaggaccgcugcaccuccccccccggccucuccuacaugaaggccaaggagaagaccgucgaggaccucaaguccgaggagcucgcccgcgagaucgucggcaaggacaagucccucgccgacauccucgaccccuccgucaagaucaagaccaccauggaccucauggagggcaucuuccccaaggacgagcaccuccucgaggaggcccagcagcgccgcaagcuccuccccaagauccccuccccccgcuccaccgaggagcgcaaggaggagcccuccguccccgccgccgucucccucgccaccaacuccaccuacuacuccaccuccgcccccaaggccgagcuccucaucaagaugaaggaccuccaggagcagcaggagcacgaggaggacuccggcuccgaccucgaccacgaccucuccgucaagaagcaggagcucaucgaguccaucucccgcaagcuccagguccuccgcgaggcccgcgagucccuccucgaggacguccaggccaacaccguccucggcgccgaggucgaggccaucgucaagggcgucugcaagcccuccgaguucgacaaguuccgcauguucaucggcgaccucgacaaggucgucaaccuccuccucucccucuccggccgccucgcccgcgucgagaacgcccucaacaaccucgacgacggcgccucccccggcgaccgccagucccuccucgagaagcagcgcguccucauccagcagcacgaggacgccaaggagcucaaggagaaccucgaccgccgcgagcgcaucgucuucgacauccucgccaacuaccucuccgaggagucccucgccgacuacgagcacuucgucaagaugaaguccgcccucaucaucgagcagcgcgagcucgaggacaagauccaccucggcgaggagcagcucaagugccuccucgacucccuccagcccgagcgcggcaaguga

SEQ ID NO: 49434 - RNA, 5991 nt, Artificial Sequence
  derived and/or modified sequence opt2 from SHROOM3__Homo_sapiens__NP_065910
augaugcgcaccaccgaggacuuccacaagcccuccgccacccucaacuccaacaccgccaccaagggccgcuacaucuaccucgaggccuuccucgagggcggcgcccccuggggcuucacccucaagggcggccucgagcacggcgagccccucaucaucuccaaggucgaggagggcggcaaggccgacacccucuccuccaagcuccaggccggcgacgaggucguccacaucaacgaggucacccucuccuccucccgcaaggaggccgucucccucgucaagggcuccuacaagacccuccgccucgucguccgccgcgacgucugcaccgaccccggccacgccgacaccggcgccuccaacuucgucucccccgagcaccucaccuccggcccccagcaccgcaaggccgccugguccggcggcgucaagcuccgccucaagcaccgccgcuccgagcccgccggccgcccccacuccuggcacaccaccaaguccggcgagaagcagcccgacgccuccaugaugcagaucucccagggcaugaucggcccccccuggcaccaguccuaccacuccuccuccuccaccuccgaccucuccaacuacgaccacgccuaccuccgccgcucccccgaccagugcuccucccagggcuccauggagucccucgagcccuccggcgccuacccccccugccaccucucccccgccaaguccaccggcuccaucgaccagcucucccacuuccacaacaagcgcgacuccgccuacuccuccuucuccaccuccuccuccauccucgaguacccccaccccggcaucuccggccgcgagcgcuccggcuccauggacaacaccuccgcccgcggcggccuccucgagggcaugcgccaggccgacauccgcuacgucaagaccgucuacgacacccgccgcggcgucuccgccgaguacgaggucaacuccuccgcccuccuccuccagggccgcgaggcccgcgccuccgccaacggccagggcuacgacaagugguccaacaucccccgcggcaagggcguccccccccccuccuggucccagcagugccccuccucccucgagaccgccaccgacaaccucccccccaaggucggcgccccccucccccccgcccgcuccgacuccuacgccgccuuccgccaccgcgagcgccccuccuccugguccucccucgaccagaagcgccucugccgcccccaggccaacucccucggcucccucaagucccccuucaucgaggagcagcuccacaccguccucgagaagucccccgagaacuccccccccgucaagcccaagcacaacuacacccagaaggcccagcccggccagccccuccuccccaccuccaucuaccccguccccucccucgagccccacuucgcccaggucccccagcccuccgucuccuccaacggcaugcucuaccccgcccucgccaaggaguccggcuacaucgccccccagggcgccugcaacaagauggccaccaucgacgagaacggcaaccagaacggcuccggccgccccggcuucgccuucugccagccccucgagcacgaccuccucucccccgucgagaagaagcccgaggccaccgccaaguacguccccuccaagguccacuucugcuccguccccgagaacgaggaggacgccucccucaagcgccaccucacccccccccagggcaacuccccccacuccaacgagcgcaaguccacccacuccaacaagcccuccucccacccccacucccucaagugcccccaggcccaggccuggcaggccggcgaggacaagcgcuccucccgccucuccgagcccugggagggcgacuuccaggaggaccacaacgccaaccucuggcgccgccucgagcgcgagggccucggccagucccucuccggcaacuucggcaagaccaaguccgccuucuccucccuccagaacauccccgagucccuccgccgccacuccucccucgagcucggccgcggcacccaggagggcuaccccggcggccgccccaccugcgccgucaacaccaaggccgaggaccccggccgcaaggccgcccccgaccucggcucccaccucgaccgccaggucuccuacccccgccccgagggccgcaccggcgccuccgccuccuucaacuccaccgaccccucccccgaggagccccccgcccccucccacccccacaccuccucccucggccgccgcggccccggccccggcuccgccuccgcccuccagggcuuccaguacggcaagccccacugcuccguccucgagaaggucuccaaguucgagcagcgcgagcagggcucccagcgccccuccgucggcggcuccggcuucggccacaacuaccgcccccaccgcaccgucuccaccuccuccaccuccggcaacgacuucgaggagaccaaggcccacauccgcuucuccgaguccgccgagccccucggcaacggcgagcagcacuucaagaacggcgagcucaagcucgaggaggccucccgccagcccugcggccagcagcucuccggcggcgccuccgacuccggccgcggcccccagcgccccgacgcccgccuccuccgcucccaguccaccuuccagcucuccuccgagcccgagcgcgagcccgaguggcgcgaccgccccggcucccccgaguccccccuccucgacgcccccuucucccgcgccuaccgcaacuccaucaaggacgcccagucccgcguccucggcgccaccuccuuccgccgccgcgaccucgagcucggcgcccccgucgccucccgcuccuggcgcccccgccccuccuccgcccacgucggccuccgcucccccgaggccuccgccuccgccuccccccacaccccccgcgagcgccacuccgucacccccgccgagggcgaccucgcccgccccgucccccccgccgcccgccgcggcgcccgccgccgccucacccccgagcagaagaagcgcuccuacuccgagcccgagaagaugaacgaggucggcaucgucgaggaggccgagcccgccccccucggcccccagcgcaacggcaugcgcuuccccgaguccuccgucgccgaccgccgccgccucuucgagcgcgacggcaaggccugcuccacccucucccucuccggccccgagcucaagcaguuccagcaguccgcccucgccgacuacauccagcgcaagaccggcaagcgccccaccuccgccgccggcugcucccuccaggagcccggcccccuccgcgagcgcgcccaguccgccuaccuccagcccggccccgccgcccucgagggcuccggccucgccuccgccuccucccucuccucccuccgcgagcccucccuccagccccgccgcgaggccacccuccuccccgccaccgucgccgagacccagcaggccccccgcgaccgcuccuccuccuucgccggcggccgccgccucggcgagcgccgccgcggcgaccuccucuccggcgccaacggcggcacccgcggcacccagcgcggcgacgagaccccccgcgagcccuccuccuggggcgcccgcgccggcaaguccauguccgccgaggaccuccucgagcgcuccgacguccucgccggccccguccacguccgcucccgcuccucccccgccaccgccgacaagcgccaggacguccuccucggccaggacuccggcuucggccucgucaaggaccccugcuaccucgccggccccggcucccgcucccucuccugcuccgagcgcggccaggaggagaugcucccccucuuccaccaccucaccccccgcuggggcggcuccggcugcaaggccaucggcgacuccuccguccccuccgagugccccggcacccucgaccaccagcgccaggccucccgcacccccugcccccgccccccccucgccggcacccagggccucgucaccgacacccgcgccgccccccucacccccaucggcaccccccuccccuccgccauccccuccggcuacugcucccaggacggccagaccggccgccagccccucccccccuacacccccgccaugaugcaccgcuccaacggccacacccucacccagccccccggcccccgcggcugcgagggcgacggccccgagcacggcgucgaggagggcacccgcaagcgcgucucccucccccaguggcccccccccucccgcgccaagugggcccacgccgcccgcgaggacucccuccccgaggaguccuccgcccccgacuucgccaaccucaagcacuaccagaagcagcagucccuccccucccucugcuccaccuccgaccccgacaccccccucggcgcccccuccacccccggccgcaucucccuccgcaucuccgaguccguccuccgcgacuccccccccccccacgaggacuacgaggacgaggucuucguccgcgacccccaccccaaggccaccuccucccccaccuucgagccccucccccccccccccccccccccccccucccaggagacccccgucuacuccauggacgacuucccccccccccccccccacaccgucugcgaggcccagcucgacuccgaggaccccgagggcccccgccccuccuucaacaagcucuccaaggucaccaucgcccgcgagcgccacaugcccggcgccgcccacgucgucggcucccagacccucgccucccgccuccagaccuccaucaagggcuccgaggccgaguccaccccccccuccuucauguccguccacgcccagcucgccggcucccucggcggccagcccgcccccauccagacccagucccucucccacgaccccgucuccggcacccagggccucgagaagaaggucucccccgacccccagaaguccuccgaggacauccgcaccgaggcccucgccaaggagaucguccaccaggacaagucccucgccgacauccucgaccccgacucccgccucaagaccaccauggaccucauggagggccucuucccccgcgacgucaaccuccucaaggagaacuccgucaagcgcaaggccauccagcgcaccgucuccuccuccggcugcgagggcaagcgcaacgaggacaaggaggccgucuccaugcucgucaacugccccgccuacuacuccgucuccgcccccaaggccgagcuccucaacaagaucaaggagaugcccgccgaggucaacgaggaggaggagcaggccgacgucaacgagaagaaggccgagcucaucggcucccucacccacaagcucgagacccuccaggaggccaagggcucccuccucaccgacaucaagcucaacaacgcccucggcgaggaggucgaggcccucaucuccgagcucugcaagcccaacgaguucgacaaguaccgcauguucaucggcgaccucgacaaggucgucaaccuccuccucucccucuccggccgccucgcccgcgucgagaacguccucuccggccucggcgaggacgccuccaacgaggagcgcuccucccucuacgagaagcgcaagauccucgccggccagcacgaggacgcccgcgagcucaaggagaaccucgaccgccgcgagcgcgucguccucggcauccucgccaacuaccucuccgaggagcagcuccaggacuaccagcacuucgucaagaugaaguccacccuccucaucgagcagcgcaagcucgacgacaagaucaagcucggccaggagcaggucaagugccuccucgagucccuccccuccgacuucauccccaaggccggcgcccucgcccucccccccaaccucaccuccgagcccauccccgccggcggcugcaccuucuccggcaucuuccccacccucaccuccccccucuga

SEQ ID NO: 49435 - RNA, 4482 nt, Artificial Sequence
  derived and/or modified sequence opt2 from SHROOM4__Homo_sapiens__NP_065768
auggagaaccgccccggcuccuuccaguacguccccguccagcuccagggcggcgcccccuggggcuucacccucaagggcggccucgagcacugcgagccccucaccgucuccaagaucgaggacggcggcaaggccgcccucucccagaagaugcgcaccggcgacgagcucgucaacaucaacggcaccccccucuacggcucccgccaggaggcccucauccucaucaagggcuccuuccgcauccucaagcucaucguccgccgccgcaacgcccccgucucccgcccccacuccuggcacgucgccaagcuccucgagggcugccccgaggccgccaccaccaugcacuuccccuccgaggccuucucccucuccuggcacuccggcugcaacaccuccgacgucugcguccaguggugcccccucucccgccacugcuccaccgagaaguccuccuccaucggcuccauggagucccucgagcagcccggccaggccaccuacgagucccaccuccuccccaucgaccagaacauguaccccaaccagcgcgacuccgccuacuccuccuucuccgccuccuccaacgccuccgacugcgcccucucccuccgccccgaggagcccgccuccaccgacugcaucaugcagggccccggccccaccaaggcccccuccggccgccccaacgucgccgagaccuccggcggcucccgccgcaccaacggcggccaccucacccccuccucccagauguccucccgcccccaggagggcuaccaguccggccccgccaaggccguccgcggccccccccagccccccguccgccgcgacucccuccaggccucccgcgcccagcuccucaacggcgagcagcgccgcgccuccgagcccgucgucccccucccccagaaggagaagcucucccucgagcccguccuccccgcccgcaaccccaaccgcuucugcugccucuccggccacgaccaggucaccuccgagggccaccagaacugcgaguucucccagccccccgaguccucccagcagggcuccgagcaccuccucaugcaggccuccaccaaggccgucggcucccccaaggccugcgaccgcgccuccuccgucgacuccaacccccucaacgaggccuccgccgagcucgccaaggccuccuucggccgccccccccaccucaucggccccaccggccaccgccacuccgcccccgagcagcuccucgccucccaccuccagcacguccaccucgacacccgcggcuccaagggcauggagcucccccccguccaggacggccaccaguggacccucuccccccuccacuccucccacaagggcaagaagucccccugcccccccaccggcggcacccacgaccaguccuccaaggagcgcaagacccgccaggucgacgaccgcucccucguccucggccaccagucccaguccucccccccccacggcgaggccgacggccaccccuccgagaagggcuuccucgaccccaaccgcaccucccgcgccgccuccgagcucgccaaccagcagcccuccgccuccggcucccucguccagcaggccaccgacugcuccuccaccaccaaggccgccuccggcaccgaggccggcgaggagggcgacuccgagcccaaggagugcucccgcaugggcggccgccgcuccggcggcacccgcggccgcuccauccagaaccgccgcaaguccgagcgcuucgccaccaaccuccgcaacgagauccagcgccgcaaggcccagcuccagaaguccaagggcccccucucccagcucugcgacaccaaggagcccgucgaggagacccaggagccccccgagucccccccccucaccgccuccaacaccucccuccucuccuccugcaagaagccccccuccccccgcgacaagcucuucaacaaguccaugaugcuccgcgcccgcuccuccgagugccucucccaggcccccgagucccacgagucccgcaccggccucgagggccgcaucucccccggccagcgccccggccaguccucccucggccucaacaccugguggaaggcccccgaccccuccuccuccgaccccgagaaggcccacgcccacugcggcguccgcggcggccacuggcgcuggucccccgagcacaacucccagccccucgucgccgccgccauggagggccccuccaaccccggcgacaacaaggagcucaaggccuccaccgcccaggccggcgaggacgccauccuccuccccuucgccgaccgccgcaaguucuucgaggaguccuccaagucccucuccaccucccaccuccccggccucaccacccacuccaacaagaccuucacccagcgccccaagcccaucgaccagaacuuccagcccauguccuccuccugccgcgagcuccgccgccaccccauggaccaguccuaccacuccgccgaccagcccuaccacgccaccgaccaguccuaccacuccauguccccccuccaguccgagacccccaccuacuccgagugcuucgccuccaagggccucgagaacuccaugugcugcaagccccuccacugcggcgacuucgacuaccaccgcaccugcuccuacuccugcuccguccagggcgcccucguccacgaccccugcaucuacugcuccggcgagaucugccccgcccuccucaagcgcaacaugaugcccaacugcuacaacugccgcugccaccaccaccagugcauccgcugcuccgucugcuaccacaacccccagcacuccgcccucgaggacuccucccucgcccccggcaacaccuggaagccccgcaagcucaccguccaggaguuccccggcgacaaguggaaccccaucaccggcaaccgcaagaccucccaguccggccgcgagauggcccacuccaagaccuccuucuccugggccacccccuuccaccccugccucgagaaccccgcccucgaccucuccuccuaccgcgccaucuccucccucgaccuccucggcgacuucaagcacgcccucaagaaguccgaggagaccuccgucuacgaggagggcuccucccucgccuccaugccccacccccuccgcucccgcgccuucuccgagucccacaucucccucgccccccaguccacccgcgccuggggccagcaccgccgcgagcucuucuccaagggcgacgagacccaguccgaccuccucggcgcccgcaagaaggccuucccccccccccgcccccccccccccaacugggagaaguaccgccucuuccgcgccgcccagcagcagaagcagcagcagcagcagcagaagcagcaggaggaggaggaggaggaggaggaggaggaggaggaggaggaggaggaggaggaggaggaggccgaggaggaggaggaggagcuccccccccaguacuucuccuccgagaccuccggcuccugcgcccucaaccccgaggagguccucgagcagccccagccccucuccuucggccaccucgagggcucccgccagggcucccaguccguccccgccgagcaggaguccuucgcccuccacuccuccgacuuccucccccccauccgcggccaccucggcucccagcccgagcaggcccagccccccugcuacuacggcaucggcggccucuggcgcaccuccggccaggaggccaccgaguccgccaagcaggaguuccagcacuucuccccccccuccggcgcccccggcauccccaccuccuacuccgccuacuacaacaucuccgucgccaaggccgagcuccucaacaagcucaaggaccagcccgagauggccgagaucggccucggcgaggaggaggucgaccacgagcucgcccagaagaagauccagcucaucgaguccaucucccgcaagcucuccguccuccgcgaggcccagcgcggccuccucgaggacaucaacgccaacuccgcccucggcgaggaggucgaggccaaccucaaggccgucugcaaguccaacgaguucgagaaguaccaccucuucgucggcgaccucgacaaggucgucaaccuccuccucucccucuccggccgccucgcccgcgucgagaacgcccucaacuccaucgacuccgaggccaaccaggagaagcucguccucaucgagaagaagcagcagcucaccggccagcucgccgacgccaaggagcucaaggagcacgucgaccgccgcgagaagcucgucuucggcauggucucccgcuaccucccccaggaccagcuccaggacuaccagcacuucgucaagaugaaguccgcccucaucaucgagcagcgcgagcucgaggagaagaucaagcucggcgaggagcagcucaagugccuccgcgagucccuccuccucggccccuccaacuucuga

SEQ ID NO: 49436 - RNA, 1467 nt, Artificial Sequence
  derived and/or modified sequence opt2 from SIAE__Homo_sapiens__NP_001186851
augguccuccagaaggagcccgccggcgccgucaucuggggcuucggcacccccggcgccaccgucaccgucacccuccgccagggccaggagaccaucaugaagaaggucaccuccgucaaggcccacuccgacaccuggauggucguccucgaccccaugaagcccggcggccccuucgaggucauggcccagcagacccucgagaagaucaacuucacccuccgcguccacgacguccucuucggcgacgucuggcucugcuccggccaguccaacaugcagaugaccguccuccagaucuucaacgccacccgcgagcucuccaacaccgccgccuaccaguccguccgcauccucuccgucucccccauccaggccgagcaggagcucgaggaccucgucgccgucgaccuccagugguccaagcccaccuccgagaaccucggccacggcuacuucaaguacauguccgccgucugcuggcucuucggccgccaccucuacgacacccuccaguaccccaucggccucaucgccuccuccuggggcggcacccccaucgaggccugguccuccggccgcucccucaaggccugcggcguccccaagcagggcuccauccccuacgacuccgucaccggccccuccaagcacuccguccucuggaacgccaugauccacccccucugcaacaugacccucaagggcgucgucugguaccagggcgaguccaacaucaacuacaacaccgaccucuacaacugcaccuuccccgcccucaucgaggacuggcgcgagaccuuccaccgcggcucccagggccagaccgagcgcuucuuccccuucggccucguccagcucuccuccgaccucuccaagaaguccuccgacgacggcuucccccagauccgcuggcaccagaccgccgacuucggcuacguccccaaccccaagaugcccaacaccuucauggccgucgccauggaccucugcgaccgcgacucccccuucggcuccauccacccccgcgacaagcagaccgucgccuaccgccuccaccucggcgcccgcgcccucgccuacggcgagaagaaccucaccuucgagggcccccuccccgagaagaucgagcuccucgcccacaagggccuccucaaccucaccuacuaccagcagauccagguccagaagaaggacaacaagaucuucgagaucuccugcugcuccgaccaccgcugcaaguggcuccccgccuccaugaacaccgucuccacccagucccucacccucgccaucgacuccugccacggcaccgucgucgcccuccgcuacgccuggaccaccuggcccugcgaguacaagcagugcccccucuaccaccccuccuccgcccuccccgccccccccuucaucgccuucaucaccgaccagggccccggccaccaguccaacgucgccaaguga

SEQ ID NO: 49437 - RNA, 942 nt, Artificial Sequence
  derived and/or modified sequence opt2 from SIAH1__Homo_sapiens__NP_001006611
augaccggcaaggccaccccccccucccucuacuccuggcgcggcguccucuucaccugccuccccgccgcccgcacccgcaagcgcaaggagaugucccgccagaccgccaccgcccuccccaccggcaccuccaagugcccccccucccagcgcguccccgcccucaccggcaccaccgccuccaacaacgaccucgccucccucuucgagugccccgucugcuucgacuacguccucccccccauccuccagugccaguccggccaccucgucugcuccaacugccgccccaagcucaccugcugccccaccugccgcggcccccucggcuccauccgcaaccucgccauggagaaggucgccaacuccguccucuuccccugcaaguacgccuccuccggcugcgagaucacccucccccacaccgagaaggccgaccacgaggagcucugcgaguuccgccccuacuccugccccugccccggcgccuccugcaaguggcagggcucccucgacgccgucaugccccaccucaugcaccagcacaaguccaucaccacccuccagggcgaggacaucgucuuccucgccaccgacaucaaccuccccggcgccgucgacugggucaugaugcaguccugcuucggcuuccacuucaugcucguccucgagaagcaggagaaguacgacggccaccagcaguucuucgccaucguccagcucaucggcacccgcaagcaggccgagaacuucgccuaccgccucgagcucaacggccaccgccgccgccucaccugggaggccaccccccgcuccauccacgagggcaucgccaccgccaucaugaacuccgacugccucgucuucgacaccuccaucgcccagcucuucgccgagaacggcaaccucggcaucaacgucaccaucuccaugugcuga

SEQ ID NO: 49438 - RNA, 975 nt, Artificial Sequence
  derived and/or modified sequence opt2 from SIAH2__Homo_sapiens__NP_005058
augucccgccccuccuccaccggccccuccgccaacaagcccugcuccaagcagccccccccccagccccagcacacccccucccccgccgccccccccgccgccgccaccaucuccgccgccggccccggcuccuccgccguccccgccgccgccgccgucaucuccggccccggcggcggcggcggcgccggccccgucuccccccagcaccacgagcucaccucccucuucgagugccccgucugcuucgacuacguccucccccccauccuccagugccaggccggccaccucgucugcaaccagugccgccagaagcucuccugcugccccaccugccgcggcgcccucacccccuccauccgcaaccucgccauggagaaggucgccuccgccguccucuuccccugcaaguacgccaccaccggcugcucccucacccuccaccacaccgagaagcccgagcacgaggacaucugcgaguaccgccccuacuccugccccugccccggcgccuccugcaaguggcagggcucccucgaggccgucaugucccaccucaugcacgcccacaaguccaucaccacccuccagggcgaggacaucgucuuccucgccaccgacaucaaccuccccggcgccgucgacugggucaugaugcaguccugcuucggccaccacuucaugcucguccucgagaagcaggagaaguacgagggccaccagcaguucuucgccaucguccuccucaucggcacccgcaagcaggccgagaacuucgccuaccgccucgagcucaacggcaaccgccgccgccucaccugggaggccaccccccgcuccauccacgacggcgucgccgccgccaucaugaacuccgacugccucgucuucgacaccgccaucgcccaccucuucgccgacaacggcaaccucggcaucaacgucaccaucuccaccugcugccccuga

SEQ ID NO: 49439 - RNA, 2484 nt, Artificial Sequence
  derived and/or modified sequence opt2 from SIDT1__Homo_sapiens__NP_060169
augcgcggcugccuccgccucgcccuccucugcgcccuccccuggcuccuccucgccgccucccccggccaccccgccaaguccccccgccagccccccgccccccgccgcgaccccuucgacgccgcccgcggcgccgacuucgaccacgucuacuccggcgucgucaaccucuccaccgagaacaucuacuccuucaacuacaccucccagcccgaccaggucaccgccguccgcgucuacgucaacuccuccuccgagaaccucaacuaccccguccucgucgucguccgccagcagaaggagguccucuccuggcaggucccccuccucuuccagggccucuaccagcgcuccuacaacuaccaggaggucucccgcacccucugccccuccgaggccaccaacgagaccggcccccuccagcagcucaucuucgucgacgucgccuccauggccccccucggcgcccaguacaagcuccucgucaccaagcucaagcacuuccagcuccgcaccaacgucgccuuccacuucaccgccucccccucccagccccaguacuuccucuacaaguuccccaaggacgucgacuccgucaucaucaaggucgucuccgagauggccuaccccugcuccgucgucuccguccagaacaucaugugccccgucuacgaccucgaccacaacgucgaguucaacggcgucuaccaguccaugaccaagaaggccgccaucacccuccagaagaaggacuuccccggcgagcaguucuucgucgucuucgucaucaagcccgaggacuacgccugcggcggcuccuucuucauccaggagaaggagaaccagaccuggaaccuccagcgcaagaagaaccucgaggucaccaucguccccuccaucaaggaguccgucuacgucaaguccucccucuucuccgucuucaucuuccucuccuucuaccucggcugccuccucgucggcuucguccacuaccuccgcuuccagcgcaaguccaucgacggcuccuucggcuccaacgacggcuccggcaacauggucgccucccaccccaucgccgccuccacccccgagggcuccaacuacggcaccaucgacgaguccuccuccucccccggccgccagauguccuccuccgacggcggcccccccggccaguccgacaccgacuccuccgucgaggaguccgacuucgacaccaugcccgacaucgaguccgacaagaacaucauccgcaccaagauguuccucuaccucuccgaccucucccgcaaggaccgccgcaucgucuccaagaaguacaagaucuacuucuggaacaucaucaccaucgccgucuucuacgcccuccccgucauccagcucgucaucaccuaccagaccgucgucaacgucaccggcaaccaggacaucugcuacuacaacuuccucugcgcccacccccucggcguccucuccgccuucaacaacauccucuccaaccucggccacguccuccucggcuuccucuuccuccucaucguccuccgccgcgacauccuccaccgccgcgcccucgaggccaaggacaucuucgccgucgaguacggcauccccaagcacuucggccucuucuacgccaugggcaucgcccucaugauggagggcguccucuccgccugcuaccacgucugccccaacuacuccaacuuccaguucgacaccuccuucauguacaugaucgccggccucugcaugcucaagcucuaccagacccgccaccccgacaucaacgccuccgccuacuccgccuacgccuccuucgccgucgucaucauggucaccguccucggcgucgucuucggcaagaacgacgucugguucugggucaucuucuccgccauccacguccucgccucccucgcccucuccacccagaucuacuacaugggccgcuucaagaucgaccucggcaucuuccgccgcgccgccauggucuucuacaccgacugcauccagcagugcucccgcccccucuacauggaccgcaugguccuccucgucgucggcaaccucgucaacugguccuucgcccucuucggccucaucuaccgcccccgcgacuucgccuccuacaugcucggcaucuucaucugcaaccuccuccucuaccucgccuucuacaucaucaugaagcuccgcuccuccgagaagguccuccccgucccccucuucugcaucgucgccaccgccgucaugugggccgccgcccucuacuucuucuuccagaaccucuccuccugggagggcacccccgccgagucccgcgagaagaaccgcgagugcauccuccucgacuucuucgacgaccacgacaucuggcacuuccucuccgccaccgcccucuucuucuccuuccucguccuccucacccucgacgacgaccucgacgucguccgccgcgaccagauccccgucuucuga

SEQ ID NO: 49440 - RNA, 1233 nt, Artificial Sequence
  derived and/or modified sequence opt2 from SIGIRR__Homo_sapiens__NP_001128526
augcccggcgucugcgaccgcgcccccgacuuccucucccccuccgaggaccagguccuccgccccgcccucggcuccuccgucgcccucaacugcaccgccugggucgucuccggcccccacugcucccuccccuccguccaguggcucaaggacggccucccccucggcaucggcggccacuacucccuccacgaguacuccugggucaaggccaaccucuccgagguccucgucuccuccguccucggcgucaacgucaccuccaccgaggucuacggcgccuucaccugcuccauccagaacaucuccuucuccuccuucacccuccagcgcgccggccccaccucccacgucgccgccguccucgccucccuccucguccuccucgcccuccuccucgccgcccuccucuacgucaagugccgccucaacguccuccucugguaccaggacgccuacggcgaggucgagaucaacgacggcaagcucuacgacgccuacgucuccuacuccgacugccccgaggaccgcaaguucgucaacuucauccucaagccccagcucgagcgccgccgcggcuacaagcucuuccucgacgaccgcgaccuccucccccgcgccgagcccuccgccgaccuccucgucaaccucucccgcugccgccgccucaucgucguccucuccgacgccuuccucucccgcgccuggugcucccacuccuuccgcgagggccucugccgccuccucgagcucacccgccgccccaucuucaucaccuucgagggccagcgccgcgaccccgcccaccccgcccuccgccuccuccgccagcaccgccaccucgucacccuccuccucuggcgccccggcuccgucacccccuccuccgacuucuggaaggagguccagcucgcccucccccgcaagguccaguaccgccccgucgagggcgacccccagacccagcuccaggacgacaaggaccccaugcucauccuccgcggccgcguccccgagggccgcgcccucgacuccgaggucgaccccgaccccgagggcgaccucggcguccgcggccccgucuucggcgagcccuccgcccccccccacaccuccggcgucucccucggcgagucccgcuccuccgaggucgacgucuccgaccucggcucccgcaacuacuccgcccgcaccgacuucuacugccucgucuccaaggacgacauguga

SEQ ID NO: 49441 - RNA, 1809 nt, Artificial Sequence
  derived and/or modified sequence opt2 from SIGLEC11__Homo_sapiens__NP_001128635
augguccccggccaggcccagccccagucccccgagaugcuccuccucccccuccuccuccccguccucggcgccggcucccucaacaaggaccccuccuacucccuccagguccagcgccagguccccguccccgagggccucugcgucaucgucuccugcaaccucuccuacccccgcgacggcugggacgaguccaccgccgccuacggcuacugguucaagggccgcaccucccccaagaccggcgcccccgucgccaccaacaaccagucccgcgaggucgagauguccacccgcgaccgcuuccagcucaccggcgaccccggcaagggcuccugcucccucgucauccgcgacgcccagcgcgaggacgaggccugguacuucuuccgcgucgagcgcggcucccgcguccgccacuccuuccucuccaacgccuucuuccucaaggucaccgcccucaccaagaagcccgacgucuacauccccgagacccucgagcccggccagcccgucaccgucaucugcgucuucaacugggccuucaagaagugccccgcccccuccuucuccuggaccggcgccgcccucuccccccgccgcacccgccccuccaccucccacuucuccguccucuccuucacccccuccccccaggaccacgacaccgaccucaccugccacgucgacuucucccgcaagggcgucuccgcccagcgcaccguccgccuccgcgucgccuacgcccccaaggaccucaucaucuccaucucccacgacaacaccuccgcccucgagcuccagggcaacgucaucuaccucgagguccagaagggccaguuccuccgccuccucugcgccgccgacucccagccccccgccacccucuccuggguccuccaggaccgcguccucuccuccucccaccccuggggcccccgcacccucggccucgagcuccgcggcguccgcgccggcgacuccggccgcuacaccugccgcgccgagaaccgccucggcucccagcagcaggcccucgaccucuccguccaguacccccccgagaaccuccgcgucauggucucccaggccaaccgcaccguccucgagaaccucggcaacggcaccucccuccccguccucgagggccagucccuccgccucgucugcgucacccacuccuccccccccgcccgccucuccuggacccgcuggggccagaccgucggccccucccagcccuccgaccccggcguccucgagcucccccccauccagauggagcacgagggcgaguucaccugccacgcccagcacccccucggcucccagcacgucucccucucccucuccguccacuggaagcucgagcacggcggcggccucggccucggcgccgcccucggcgccggcgucgccgcccuccucgccuucugcuccugccucgucgucuuccgcgucaagaucugccgcaaggaggcccgcaagcgcgccgccgccgagcaggacguccccuccacccucggccccaucucccagggccaccagcacgagugcuccgccggcuccucccaggaccaccccccccccggcgccgccaccuacacccccggcaagggcgaggagcaggagcuccacuacgccucccucuccuuccagggccuccgccucugggagcccgccgaccaggaggcccccuccaccaccgaguacuccgagaucaagauccacaccggccagccccuccgcggccccggcuucggccuccagcucgagcgcgagauguccggcaugguccccaaguga

SEQ ID NO: 49442 - RNA, 1191 nt, Artificial Sequence
  derived and/or modified sequence opt2 from SIGLEC14__Homo_sapiens__NP_001092082
augcucccccuccuccuccucccccuccucuggggcggcucccuccaggagaagcccgucuacgagcuccagguccagaaguccgucaccguccaggagggccucugcguccucguccccugcuccuucuccuaccccuggcgcuccugguacuccucccccccccucuacgucuacugguuccgcgacggcgagauccccuacuacgccgaggucgucgccaccaacaaccccgaccgccgcgucaagcccgagacccagggccgcuuccgccuccucggcgacguccagaagaagaacugcucccucuccaucggcgacgcccgcauggaggacaccggcuccuacuucuuccgcgucgagcgcggccgcgacgucaaguacuccuaccagcagaacaagcucaaccucgaggucaccgcccucaucgagaagcccgacauccacuuccucgagccccucgaguccggccgccccacccgccucuccugcucccuccccggcuccugcgaggccggccccccccucaccuucuccuggaccggcaacgcccucuccccccucgaccccgagaccacccgcuccuccgagcucacccucaccccccgccccgaggaccacggcaccaaccucaccugccaggucaagcgccagggcgcccaggucaccaccgagcgcaccguccagcucaacgucuccuacgccccccagaaccucgccaucuccaucuucuuccgcaacggcaccggcaccgcccuccgcauccucuccaacggcauguccguccccauccaggagggccagucccucuuccucgccugcaccgucgacuccaacccccccgccucccucuccugguuccgcgagggcaaggcccucaaccccucccagaccuccauguccggcacccucgagcuccccaacaucggcgcccgcgagggcggcgaguucaccugccgcguccagcacccccucggcucccagcaccucuccuucauccucuccguccagcgcuccuccuccuccugcaucugcgucaccgagaagcagcagggcuccuggccccucguccucacccucauccgcggcgcccucaugggcgccggcuuccuccucaccuacggccucaccuggaucuacuacacccgcugcggcggcccccagcagucccgcgccgagcgccccggcuga

SEQ ID NO: 49443 - RNA, 5130 nt, Artificial Sequence
  derived and/or modified sequence opt2 from SIGLEC1__Homo_sapiens__XP_011527630
augggcuuccuccccaagcuccuccuccucgccuccuucuuccccgccggccaggccuccuggggcgucuccuccccccaggacguccagggcgucaagggcuccugccuccucauccccugcaucuucuccuuccccgccgacgucgagguccccgacggcaucaccgccaucugguacuacgacuacuccggccagcgccaggucgucucccacuccgccgaccccaagcucgucgaggcccgcuuccgcggccgcaccgaguucaugggcaaccccgagcaccgcgucugcaaccuccuccucaaggaccuccagcccgaggacuccggcuccuacaacuuccgcuucgagaucuccgaggucaaccgcugguccgacgucaagggcacccucgucaccgucaccgaggagccccgcguccccaccaucgccucccccgucgagcuccucgagggcaccgaggucgacuucaacugcuccacccccuacgucugccuccaggagcagguccgccuccaguggcagggccaggaccccgcccgcuccgucaccuucaacucccagaaguucgagcccaccggcgucggccaccucgagacccuccacauggccauguccuggcaggaccacggccgcauccuccgcugccagcucuccgucgccaaccaccgcgcccaguccgagauccaccuccaggucaaguacgcccccaagggcgucaagauccuccucucccccuccggccgcaacauccuccccggcgagcucgucacccucaccugccaggucaacuccuccuaccccgccgucuccuccaucaaguggcucaaggacggcguccgccuccagaccaagaccggcguccuccaccucccccaggccgccugguccgacgccggcgucuacaccugccaggccgagaacggcgucggcucccucgucuccccccccaucucccuccacaucuucauggccgagguccaggucucccccgccggccccauccucgagaaccagaccgucacccucgucugcaacacccccaacgaggcccccuccgaccuccgcuacuccugguacaagaaccacguccuccucgaggacgcccacucccacacccuccgccuccaccucgccacccgcgccgacaccggcuucuacuucugcgagguccagaacguccacggcuccgagcgcuccggccccgucuccgucgucgucaaccaccccccccucacccccguccucaccgccuuccucgagacccaggccggccucgucggcauccuccacugcuccgucgucuccgagccccucgccacccucguccucucccacggcggccacauccucgccuccaccuccggcgacuccgaccacuccccccgcuucuccggcaccuccggccccaacucccuccgccucgagauccgcgaccucgaggagaccgacuccggcgaguacaagugcuccgccaccaacucccucggcaacgccaccuccacccucgacuuccacgccaacgccgcccgccuccucaucucccccgccgccgaggucgucgagggccaggccgucacccucuccugccgcuccggccucucccccacccccgacgcccgcuucuccugguaccucaacggcgcccuccuccacgagggccccggcuccucccuccuccuccccgccgccuccuccaccgacgccggcuccuaccacugccgcgcccgcgacggccacuccgccuccggccccuccucccccgccguccucaccguccucuaccccccccgccagcccaccuucaccacccgccucgaccucgacgccgccggcgccggcgccggccgccgcggccuccuccucugccgcgucgacuccgacccccccgcccgccuccagcuccuccacaaggaccgcgucgucgccaccucccuccccuccggcggcggcugcuccaccugcggcggcugcuccccccgcaugaaggucaccaaggcccccaaccuccuccgcgucgagauccacaacccccuccucgaggaggagggccucuaccucugcgaggccuccaacgcccucggcaacgccuccaccuccgccaccuucaacggccaggccaccguccucgccaucgcccccucccacacccuccaggagggcaccgaggccaaccucaccugcaacgucucccgcgaggccgccggcucccccgccaacuucuccugguuccgcaacggcguccucugggcccagggcccccucgagaccgucacccuccuccccgucgcccgcaccgacgccgcccucuacgccugccgcauccucaccgaggccggcgcccagcucuccacccccguccuccucuccguccucuacccccccgaccgccccaagcucuccgcccuccucgacaugggccagggccacauggcccucuucaucugcaccgucgacucccgcccccucgcccuccucgcccucuuccacggcgagcaccuccucgccaccucccucggcccccagguccccucccacggccgcuuccaggccaaggccgaggccaacucccucaagcucgagguccgcgagcucggccucggcgacuccggcuccuaccgcugcgaggccaccaacguccucggcuccuccaacaccucccucuucuuccagguccgcggcgccuggguccaggucucccccucccccgagcuccaggagggccaggccgucguccucuccugccagguccacaccggcguccccgagggcaccuccuaccgcugguaccgcgacggccagccccuccaggaguccaccuccgccacccuccgcuucgccgccaucacccucacccaggccggcgccuaccacugccaggcccaggcccccggcuccgccaccaccucccucgccgcccccaucucccuccacgucuccuacgccccccgccacgucacccucaccacccucauggacaccggccccggccgccucggccuccuccucugccgcgucgacuccgacccccccgcccagcuccgccuccuccacggcgaccgccucgucgccuccacccuccagggcgucggcggccccgagggcuccuccccccgccuccacgucgccgucgcccccaacacccuccgccucgagauccacggcgccaugcucgaggacgagggcgucuacaucugcgaggccuccaacacccucggccaggccuccgccuccgccgacuucgacgcccaggccgucaacguccaggucuggcccggcgccaccguccgcgagggccagcucgucaaccucaccugccucgucuggaccacccaccccgcccagcucaccuacaccugguaccaggacggccagcagcgccucgacgcccacuccaucccccuccccaacgucaccguccgcgacgccaccuccuaccgcugcggcgucggcccccccggccgcgccccccgccucucccgccccaucacccucgacguccucuacgccccccgcaaccuccgccucaccuaccuccucgagucccacggcggccagcucgcccucguccucugcaccgucgacucccgcccccccgcccagcucgcccucucccacgccggccgccuccucgccuccuccaccgccgccuccguccccaacacccuccgccucgagcuccgcggcccccagccccgcgacgagggcuucuacuccugcuccgcccgcuccccccucggccaggccaacaccucccucgagcuccgccucgagggcguccgcgucauccucgcccccgaggccgccguccccgagggcgcccccaucaccgucaccugcgccgaccccgccgcccacgcccccacccucuacaccugguaccacaacggccgcuggcuccaggagggccccgccgccucccucuccuuccucgucgccacccgcgcccacgccggcgccuacuccugccaggcccaggacgcccagggcacccgcuccucccgccccgccgcccuccagguccucuacgccccccaggacgccguccucuccuccuuccgcgacucccgcgcccgcuccauggccgucauccagugcaccgucgacuccgagccccccgccgagcucgcccucucccacgacggcaagguccucgccaccuccuccggcguccacucccucgccuccggcaccggccacguccaggucgcccgcaacgcccuccgccuccagguccaggacguccccgccggcgacgacaccuacgucugcaccgcccagaaccuccucggcuccaucuccaccaucggccgccuccaggucgagggcgcccgcgucgucgccgagcccggccucgacguccccgagggcgccgcccucaaccucuccugccgccuccucggcggccccggccccgucggcaacuccaccuucgccugguucuggaacgaccgccgccuccacgccgagcccguccccacccucgccuucacccacgucgcccgcgcccaggccggcauguaccacugccucgccgagcuccccaccggcgccgccgccuccgcccccgucaugcuccgcguccucuacccccccaagacccccaccaugauggucuucgucgagcccgagggcggccuccgcggcauccucgacugccgcgucgacuccgagccccucgccucccucacccuccaccucggcucccgccucgucgccuccucccagccccagggcgcccccgccgagccccacauccacguccucgccucccccaacgcccuccgcgucgacaucgaggcccuccgccccuccgaccagggcgaguacaucugcuccgccuccaacguccucggcuccgccuccaccuccaccuacuucggcguccgcgcccuccaccgccuccaccaguuccagcagcuccucuggguccucggccuccucgucggccuccuccuccuccuccucggccucggcgccugcuacaccuggcgccgccgccgcgucugcaagcaguccaugggcgagaacuccgucgagauggccuuccagaaggagaccacccagcucaucgaccccgacgccgccaccugcgagaccuccaccugcgcccccccccucggcuga

SEQ ID NO: 49444 - RNA, 1656 nt, Artificial Sequence
  derived and/or modified sequence opt2 from SIGLEC5__Homo_sapiens__NP_003821
augcucccccuccuccuccucccccuccucuggggcggcucccuccaggagaagcccgucuacgagcuccagguccagaaguccgucaccguccaggagggccucugcguccucguccccugcuccuucuccuaccccuggcgcuccugguacuccucccccccccucuacgucuacugguuccgcgacggcgagauccccuacuacgccgaggucgucgccaccaacaaccccgaccgccgcgucaagcccgagacccagggccgcuuccgccuccucggcgacguccagaagaagaacugcucccucuccaucggcgacgcccgcauggaggacaccggcuccuacuucuuccgcgucgagcgcggccgcgacgucaaguacuccuaccagcagaacaagcucaaccucgaggucaccgcccucaucgagaagcccgacauccacuuccucgagccccucgaguccggccgccccacccgccucuccugcucccuccccggcuccugcgaggccggccccccccucaccuucuccuggaccggcaacgcccucuccccccucgaccccgagaccacccgcuccuccgagcucacccucaccccccgccccgaggaccacggcaccaaccucaccugccagaugaagcgccagggcgcccaggucaccaccgagcgcaccguccagcucaacgucuccuacgccccccagaccaucaccaucuuccgcaacggcaucgcccucgagauccuccagaacaccuccuaccuccccguccucgagggccaggcccuccgccuccucugcgacgcccccuccaacccccccgcccaccucuccugguuccagggcucccccgcccucaacgccacccccaucuccaacaccggcauccucgagcuccgccgcguccgcuccgccgaggagggcggcuucaccugccgcgcccagcacccccucggcuuccuccagaucuuccucaaccucuccgucuacucccucccccagcuccucggccccuccugcuccugggaggccgagggccuccacugccgcugcuccuuccgcgcccgccccgcccccucccucugcuggcgccucgaggagaagccccucgagggcaacuccucccagggcuccuucaaggucaacuccuccuccgccggccccugggccaacuccucccucauccuccacggcggccucuccuccgaccucaaggucuccugcaaggccuggaacaucuacggcucccaguccggcuccguccuccuccuccagggccgcuccaaccucggcaccggcgucguccccgccgcccucggcggcgccggcgucauggcccuccucugcaucugccucugccucaucuucuuccucaucgucaaggcccgccgcaagcaggccgccggccgccccgagaagauggacgacgaggaccccaucaugggcaccaucaccuccggcucccgcaagaagcccuggcccgacucccccggcgaccaggccuccccccccggcgacgcccccccccucgaggagcagaaggagcuccacuacgccucccucuccuucuccgagaugaagucccgcgagcccaaggaccaggaggcccccuccaccaccgaguacuccgagaucaagaccuccaaguga

SEQ ID NO: 49445 - RNA, 438 nt, Artificial Sequence
  derived and/or modified sequence opt2 from SIGLEC7__Homo_sapiens__NP_001264130
augcuccuccuccuccuccucccccuccucuggggccgcgagcgcgucgagggccagaaguccaaccgcaaggacuacucccucaccaugcaguccuccgucaccguccaggagggcaugugcguccacguccgcugcuccuucuccuaccccgucgacucccagaccgacuccgaccccguccacggcuacugguuccgcgccggcaacgacaucuccuggaaggcccccgucgccaccaacaaccccgccugggccguccaggaggagacccgcgaccgcuuccaccuccucggcgacccccagaccaagaacugcacccucuccauccgcgacgcccgcauguccgacgccggccgcuacuucuuccgcauggagaagggcaacaucaaguggaacuacaaguacgaccagcucuccgucaacgucaccggcuga

SEQ ID NO: 49446 - RNA, 1500 nt, Artificial Sequence
  derived and/or modified sequence opt2 from SIGLEC8__Homo_sapiens__NP_055257
augcuccuccuccuccuccuccucccccuccucuggggcaccaagggcauggagggcgaccgccaguacggcgacggcuaccuccuccagguccaggagcucgucaccguccaggagggccucugcguccacguccccugcuccuucuccuacccccaggacggcuggaccgacuccgaccccguccacggcuacugguuccgcgccggcgaccgccccuaccaggacgcccccgucgccaccaacaaccccgaccgcgagguccaggccgagacccagggccgcuuccagcuccucggcgacaucugguccaacgacugcucccucuccauccgcgacgcccgcaagcgcgacaagggcuccuacuucuuccgccucgagcgcggcuccaugaagugguccuacaagucccagcucaacuacaagaccaagcagcucuccgucuucgucaccgcccucacccaccgccccgacauccucauccucggcacccucgaguccggccacucccgcaaccucaccugcuccguccccugggccugcaagcagggcaccccccccaugaucuccuggaucggcgccuccgucuccucccccggccccaccaccgcccgcuccuccguccucacccucacccccaagccccaggaccacggcaccucccucaccugccaggucacccuccccggcaccggcgucaccaccaccuccaccguccgccucgacgucuccuacccccccuggaaccucaccaugaccgucuuccagggcgacgccaccgccuccaccgcccucggcaacggcuccucccucuccguccucgagggccagucccuccgccucgucugcgccgucaacuccaacccccccgcccgccucuccuggacccgcggcucccucacccucugccccucccgcuccuccaaccccggccuccucgagcucccccgcguccacguccgcgacgagggcgaguucaccugccgcgcccagaacgcccagggcucccagcacaucucccucucccucucccuccagaacgagggcaccggcaccucccgccccgucucccaggucacccucgccgccgucggcggcgccggcgccaccgcccucgccuuccucuccuucugcaucaucuucaucaucguccgcuccugccgcaagaaguccgcccgccccgccgccggcgucggcgacaccggcauggaggacgccaaggccauccgcggcuccgccucccagggcccccucaccgaguccuggaaggacggcaacccccucaagaagcccccccccgccgucgcccccuccuccggcgaggagggcgagcuccacuacgccacccucuccuuccacaaggucaagccccaggacccccagggccaggaggccaccgacuccgaguacuccgagaucaagauccacaagcgcgagaccgccgagacccaggccugccuccgcaaccacaaccccuccuccaaggagguccgcggcuga

SEQ ID NO: 49447 - RNA, 1440 nt, Artificial Sequence
  derived and/or modified sequence opt2 from SIGLEC9__Homo_sapiens__NP_001185487
augcuccuccuccuccucccccuccucuggggccgcgagcgcgccgagggccagaccuccaagcuccucaccaugcaguccuccgucaccguccaggagggccucugcguccacguccccugcuccuucuccuaccccucccacggcuggaucuaccccggccccgucguccacggcuacugguuccgcgagggcgccaacaccgaccaggacgcccccgucgccaccaacaaccccgcccgcgccgucugggaggagacccgcgaccgcuuccaccuccucggcgacccccacaccaagaacugcacccucuccauccgcgacgcccgccgcuccgacgccggccgcuacuucuuccgcauggagaagggcuccaucaaguggaacuacaagcaccaccgccucuccgucaacgucaccgcccucacccaccgccccaacauccucauccccggcacccucgaguccggcugcccccagaaccucaccugcuccguccccugggccugcgagcagggcaccccccccaugaucuccuggaucggcaccuccgucuccccccucgaccccuccaccacccgcuccuccguccucacccucaucccccagccccaggaccacggcaccucccucaccugccaggucaccuuccccggcgccuccgucaccaccaacaagaccguccaccucaacgucuccuaccccccccagaaccucaccaugaccgucuuccagggcgacggcaccgucuccaccguccucggcaacggcuccucccucucccuccccgagggccagucccuccgccucgucugcgccgucgacgccgucgacuccaacccccccgcccgccucucccucuccuggcgcggccucacccucugccccucccagcccuccaaccccggcguccucgagcuccccuggguccaccuccgcgacgccgccgaguucaccugccgcgcccagaacccccucggcucccagcaggucuaccucaacgucucccuccaguccaaggccaccuccggcgucacccagggcgucgucggcggcgccggcgccaccgcccucgucuuccucuccuucugcgucaucuucgucgucguccgcuccugccgcaagaaguccgcccgccccgccgccggcgucggcgacaccggcaucgaggacgccaacgccguccgcggcuccgccucccagauccucaaccacuucaucggcuuccccaccuuccucggccucggcuucgaguuccuccucaaccuccgcgaccucugcugccaccccgacuccgaguucuacgucuaccacuucucccacuuccgccucaucaagaacaucgccggcgagaucgucuggucccucgagggcaagauccucuggcuccucgacgucuccgacuucuuccacugguucuuccucaucugcgucggcuga

SEQ ID NO: 49448 - RNA, 612 nt, Artificial Sequence
  derived and/or modified sequence opt2 from SIGMAR1__Homo_sapiens__NP_001269136
augcagugggccgucggccgccgcugggccugggccgcccuccuccucgccgucgccgccguccucacccaggucgucuggcucuggcucggccucgaccacgagcucgccuucucccgccucaucgucgagcuccgccgccuccaccccggccacguccuccccgacgaggagcuccagugggucuucgucaacgccggcggcuggaugggcgccaugugccuccuccacgccucccucuccgaguacguccuccucuucggcaccgcccucggcucccgcggccacuccggccgcuacugggccgagaucuccgacaccaucaucuccggcaccuuccaccaguggcgcgagggcaccaccaaguccgaggucuucuaccccggcgagaccgucguccacggccccggcgaggccaccgccgucgaguggggccccaacaccuggauggucgaguacggccgcggcgucauccccuccacccucgccuucgcccucgccgacaccgucuucuccacccaggacuuccucacccucuucuacacccuccgcuccuacgcccgcggccuccgccucgagcucaccaccuaccucuucggccaggaccccuga

SEQ ID NO: 49449 - RNA, 5484 nt, Artificial Sequence
  derived and/or modified sequence opt2 from SI__Homo_sapiens__NP_001032
auggcccgcaagaaguucuccggccucgagaucucccucaucguccucuucgucaucgucaccaucaucgccaucgcccucaucgucguccucgccaccaagacccccgccgucgacgagaucuccgacuccaccuccacccccgccaccacccgcgucaccaccaaccccuccgacuccggcaagugccccaacguccucaacgaccccgucaacguccgcaucaacugcauccccgagcaguuccccaccgagggcaucugcgcccagcgcggcugcugcuggcgccccuggaacgacucccucauccccuggugcuucuucgucgacaaccacggcuacaacguccaggacaugaccaccaccuccaucggcgucgaggccaagcucaaccgcauccccucccccacccucuucggcaacgacaucaacuccguccucuucaccacccagaaccagacccccaaccgcuuccgcuucaagaucaccgaccccaacaaccgccgcuacgaggucccccaccaguacgucaaggaguucaccggccccaccgucuccgacacccucuacgacgucaaggucgcccagaaccccuucuccauccaggucauccgcaaguccaacggcaagacccucuucgacaccuccaucggcccccucgucuacuccgaccaguaccuccagaucuccacccgccuccccuccgacuacaucuacggcaucggcgagcagguccacaagcgcuuccgccacgaccucuccuggaagaccuggcccaucuucacccgcgaccagcuccccggcgacaacaacaacaaccucuacggccaccagaccuucuucaugugcaucgaggacaccuccggcaaguccuucggcgucuuccucaugaacuccaacgccauggagaucuucauccagcccacccccaucgucaccuaccgcgucaccggcggcauccucgacuucuacauccuccucggcgacacccccgagcaggucguccagcaguaccagcagcucgucggccuccccgccaugcccgccuacuggaaccucggcuuccagcucucccgcuggaacuacaagucccucgacgucgucaaggaggucguccgccgcaaccgcgaggccggcauccccuucgacacccaggucaccgacaucgacuacauggaggacaagaaggacuucaccuacgaccaggucgccuucaacggccucccccaguucguccaggaccuccacgaccacggccagaaguacgucaucauccucgaccccgccaucuccaucggccgccgcgccaacggcaccaccuacgccaccuacgagcgcggcaacacccagcacgucuggaucaacgaguccgacggcuccacccccaucaucggcgaggucuggcccggccucaccgucuaccccgacuucaccaaccccaacugcaucgacuggugggccaacgagugcuccaucuuccaccaggagguccaguacgacggccucuggaucgacaugaacgaggucuccuccuucauccagggcuccaccaagggcugcaacgucaacaagcucaacuacccccccuucacccccgacauccucgacaagcucauguacuccaagaccaucugcauggacgccguccagaacuggggcaagcaguacgacguccacucccucuacggcuacuccauggccaucgccaccgagcaggccguccagaaggucuuccccaacaagcgcuccuucauccucacccgcuccaccuucgccggcuccggccgccacgccgcccacuggcucggcgacaacaccgccuccugggagcagauggagugguccaucaccggcaugcucgaguucucccucuucggcaucccccucgucggcgccgacaucugcggcuucgucgccgagaccaccgaggagcucugccgccgcuggaugcagcucggcgccuucuaccccuucucccgcaaccacaacuccgacggcuacgagcaccaggaccccgccuucuucggccagaacucccuccucgucaaguccucccgccaguaccucaccauccgcuacacccuccuccccuuccucuacacccucuucuacaaggcccacgucuucggcgagaccgucgcccgccccguccuccacgaguucuacgaggacaccaacuccuggaucgaggacaccgaguuccucuggggccccgcccuccucaucacccccguccucaagcagggcgccgacaccgucuccgccuacauccccgacgccaucugguacgacuacgaguccggcgccaagcgccccuggcgcaagcagcgcgucgacauguaccuccccgccgacaagaucggccuccaccuccgcggcggcuacaucauccccauccaggagcccgacgucaccaccaccgccucccgcaagaacccccucggccucaucgucgcccucggcgagaacaacaccgccaagggcgacuucuucugggacgacggcgagaccaaggacaccauccagaacggcaacuacauccucuacaccuucuccgucuccaacaacacccucgacaucgucugcacccacuccuccuaccaggagggcaccacccucgccuuccagaccgucaagauccucggccucaccgacuccgucaccgagguccgcgucgccgagaacaaccagcccaugaacgcccacuccaacuucaccuacgacgccuccaaccagguccuccucaucgccgaccucaagcucaaccucggccgcaacuucuccguccaguggaaccagaucuucuccgagaacgagcgcuucaacugcuaccccgacgccgaccucgccaccgagcagaagugcacccagcgcggcugcgucuggcgcaccggcuccucccucuccaaggcccccgagugcuacuucccccgccaggacaacuccuacuccgucaacuccgcccgcuacuccuccaugggcaucaccgccgaccuccagcucaacaccgccaacgcccgcaucaagcuccccuccgaccccaucuccacccuccgcgucgaggucaaguaccacaagaacgacaugcuccaguucaagaucuacgacccccagaagaagcgcuacgagguccccgucccccucaacauccccaccacccccaucuccaccuacgaggaccgccucuacgacgucgagaucaaggagaaccccuucggcauccagauccgccgccgcuccuccggccgcgucaucugggacuccuggcuccccggcuucgccuucaacgaccaguucauccagaucuccacccgccuccccuccgaguacaucuacggcuucggcgaggucgagcacaccgccuucaagcgcgaccucaacuggaacaccuggggcauguucacccgcgaccagccccccggcuacaagcucaacuccuacggcuuccaccccuacuacauggcccucgaggaggagggcaacgcccacggcgucuuccuccucaacuccaacgccauggacgucaccuuccagcccacccccgcccucaccuaccgcaccgucggcggcauccucgacuucuacauguuccucggccccacccccgaggucgccaccaagcaguaccacgaggucaucggccaccccgucaugcccgccuacugggcccucggcuuccagcucugccgcuacggcuacgccaacaccuccgagguccgcgagcucuacgacgccauggucgccgccaacauccccuacgacguccaguacaccgacaucgacuacauggagcgccagcucgacuucaccaucggcgaggccuuccaggaccucccccaguucgucgacaagauccgcggcgagggcaugcgcuacaucaucauccucgaccccgccaucuccggcaacgagaccaagaccuaccccgccuucgagcgcggccagcagaacgacgucuucgucaaguggcccaacaccaacgacaucugcugggccaaggucuggcccgaccuccccaacaucaccaucgacaagacccucaccgaggacgaggccgucaacgccucccgcgcccacgucgccuuccccgacuucuuccgcaccuccaccgccgaguggugggcccgcgagaucgucgacuucuacaacgagaagaugaaguucgacggccucuggaucgacaugaacgagcccuccuccuucgucaacggcaccaccaccaaccagugccgcaacgacgagcucaacuacccccccuacuuccccgagcucaccaagcgcaccgacggccuccacuuccgcaccaucugcauggaggccgagcagauccucuccgacggcaccuccguccuccacuacgacguccacaaccucuacggcuggucccagaugaagcccacccacgacgcccuccagaagaccaccggcaagcgcggcaucgucaucucccgcuccaccuaccccaccuccggccgcuggggcggccacuggcucggcgacaacuacgcccgcugggacaacauggacaaguccaucaucggcaugauggaguucucccucuucggcauguccuacaccggcgccgacaucugcggcuucuucaacaacuccgaguaccaccucugcacccgcuggaugcagcucggcgccuucuaccccuacucccgcaaccacaacaucgccaacacccgccgccaggaccccgccuccuggaacgagaccuucgccgagaugucccgcaacauccucaacauccgcuacacccuccuccccuacuucuacacccagaugcacgagauccacgccaacggcggcaccgucauccgcccccuccuccacgaguucuucgacgagaagcccaccugggacaucuucaagcaguuccucuggggccccgccuucauggucacccccguccucgagcccuacguccagaccgucaacgccuacguccccaacgcccgcugguucgacuaccacaccggcaaggacaucggcguccgcggccaguuccagaccuucaacgccuccuacgacaccaucaaccuccacguccgcggcggccacauccuccccugccaggagcccgcccagaacaccuucuacucccgccagaagcacaugaagcucaucgucgccgccgacgacaaccagauggcccagggcucccucuucugggacgacggcgaguccaucgacaccuacgagcgcgaccucuaccucuccguccaguucaaccucaaccagaccacccucaccuccaccauccucaagcgcggcuacaucaacaaguccgagacccgccucggcucccuccacgucuggggcaagggcaccacccccgucaacgccgucacccucaccuacaacggcaacaagaacucccuccccuucaacgaggacaccaccaacaugauccuccgcaucgaccucaccacccacaacgucacccucgaggagcccaucgagaucaacugguccuga

SEQ ID NO: 49450 - RNA, 2352 nt, Artificial Sequence
  derived and/or modified sequence opt2 from SIK1__Homo_sapiens__NP_775490
auggucaucauguccgaguucuccgccgaccccgccggccagggccagggccagcagaagccccuccgcgucggcuucuacgacaucgagcgcacccucggcaagggcaacuucgccgucgucaagcucgcccgccaccgcgucaccaagacccaggucgccaucaagaucaucgacaagacccgccucgacuccuccaaccucgagaagaucuaccgcgagguccagcucaugaagcuccucaaccacccccacaucaucaagcucuaccaggucauggagaccaaggacaugcucuacaucgucaccgaguucgccaagaacggcgagauguucgacuaccucaccuccaacggccaccucuccgagaacgaggcccgcaagaaguucuggcagauccucuccgccgucgaguacugccacgaccaccacaucguccaccgcgaccucaagaccgagaaccuccuccucgacggcaacauggacaucaagcucgccgacuucggcuucggcaacuucuacaaguccggcgagccccucuccaccuggugcggcuccccccccuacgccgcccccgaggucuucgagggcaaggaguacgagggcccccagcucgacaucuggucccucggcgucguccucuacguccucgucugcggcucccuccccuucgacggccccaaccuccccacccuccgccagcgcguccucgagggccgcuuccgcauccccuucuucaugucccaggacugcgagucccucauccgccgcaugcucgucgucgaccccgcccgccgcaucaccaucgcccagauccgccagcaccgcuggaugcgcgccgagcccugccuccccggccccgccugccccgccuucuccgcccacuccuacaccuccaaccucggcgacuacgacgagcaggcccucggcaucaugcagacccucggcgucgaccgccagcgcaccgucgagucccuccagaacuccuccuacaaccacuucgccgccaucuacuaccuccuccucgagcgccucaaggaguaccgcaacgcccagugcgcccgccccggccccgcccgccagccccgcccccgcuccuccgaccucuccggccucgaggucccccaggagggccucuccaccgaccccuuccgccccgcccuccucugcccccagccccagacccucguccaguccguccuccaggccgagauggacugcgagcuccaguccucccuccaguggccccucuucuuccccgucgacgccuccugcuccggcgucuuccgcccccgccccgucucccccuccucccuccucgacaccgccaucuccgaggaggcccgccagggccccggccucgaggaggagcaggacacccaggagucccuccccuccuccaccggccgccgccacacccucgccgaggucuccacccgccucuccccccucaccgcccccugcaucgucgucucccccuccaccaccgccucccccgccgagggcaccuccuccgacuccugccucaccuucuccgccuccaagucccccgccggccucuccggcacccccgccacccagggccuccucggcgccugcucccccguccgccucgccucccccuuccucggcucccaguccgccacccccguccuccaggcccagggcggccucggcggcgccguccuccuccccgucuccuuccaggagggccgccgcgccuccgacaccucccucacccagggccucaaggccuuccgccagcagcuccgcaagaccacccgcaccaagggcuuccucggccucaacaagaucaagggccucgcccgccaggucugccaggcccccgccucccgcgccucccgcggcggccucucccccuuccacgcccccgcccagucccccggccuccacggcggcgccgccggcucccgcgagggcuggucccuccucgaggagguccucgagcagcagcgccuccuccagcuccagcaccaccccgccgccgcccccggcugcucccaggccccccagcccgcccccgcccccuucgucaucgcccccugcgacggccccggcgccgccccccuccccuccacccuccucaccuccggccucccccuccucccccccccccuccuccagaccggcgccucccccgucgccuccgccgcccagcuccucgacacccaccuccacaucggcaccggccccaccgcccuccccgccgucccccccccccgccucgcccgccucgcccccggcugcgagccccucggccuccuccagggcgacugcgagauggaggaccucaugcccugcucccucggcaccuucguccucguccaguga

SEQ ID NO: 49451 - RNA, 2781 nt, Artificial Sequence
  derived and/or modified sequence opt2 from SIK2__Homo_sapiens__NP_056006
auggucauggccgacggcccccgccaccuccagcgcggccccguccgcgucggcuucuacgacaucgagggcacccucggcaagggcaacuucgccgucgucaagcucggccgccaccgcaucaccaagaccgaggucgccaucaagaucaucgacaagucccagcucgacgccgucaaccucgagaagaucuaccgcgagguccagaucaugaagaugcucgaccacccccacaucaucaagcucuaccaggucauggagaccaaguccaugcucuaccucgucaccgaguacgccaagaacggcgagaucuucgacuaccucgccaaccacggccgccucaacgaguccgaggcccgccgcaaguucuggcagauccucuccgccgucgacuacugccacggccgcaagaucguccaccgcgaccucaaggccgagaaccuccuccucgacaacaacaugaacaucaagaucgccgacuucggcuucggcaacuucuucaaguccggcgagcuccucgccaccuggugcggcuccccccccuacgccgcccccgaggucuucgagggccagcaguacgagggcccccagcucgacaucugguccaugggcgucguccucuacguccucgucugcggcgcccuccccuucgacggccccacccuccccauccuccgccagcgcguccucgagggccgcuuccgcauccccuacuucauguccgaggacugcgagcaccucauccgccgcaugcucguccucgaccccuccaagcgccucaccaucgcccagaucaaggagcacaaguggaugcucaucgagguccccguccagcgccccguccucuacccccaggagcaggagaacgagcccuccaucggcgaguucaacgagcagguccuccgccucaugcacucccucggcaucgaccagcagaagaccaucgagucccuccagaacaaguccuacaaccacuucgccgccaucuacuuccuccucgucgagcgccucaagucccaccgcuccuccuuccccgucgagcagcgccucgacggccgccagcgccgccccuccaccaucgccgagcagaccgucgccaaggcccagaccgucggccuccccgucaccaugcacucccccaacaugcgccuccuccgcuccgcccuccucccccaggccuccaacgucgaggccuucuccuuccccgccuccggcugccaggccgaggccgccuucauggaggaggagugcgucgacacccccaaggucaacggcugccuccucgaccccgucccccccguccucguccgcaagggcugccagucccuccccuccaacaugauggagaccuccaucgacgagggccucgagaccgagggcgaggccgaggaggaccccgcccacgccuucgaggccuuccaguccacccgcuccggccagcgccgccacacccucuccgaggucaccaaccagcucgucgucaugcccggcgccggcaagaucuucuccaugaacgacucccccucccucgacuccgucgacuccgaguacgacaugggcuccguccagcgcgaccucaacuuccucgaggacaaccccucccucaaggacaucaugcucgccaaccagcccuccccccgcaugaccucccccuucaucucccuccgccccaccaaccccgccaugcaggcccucuccucccagaagcgcgagguccacaaccgcucccccgucuccuuccgcgagggccgccgcgccuccgacaccucccucacccagggcaucgucgccuuccgccagcaccuccagaaccucgcccgcaccaagggcauccucgagcucaacaagguccagcuccucuacgagcagaucggccccgaggccgaccccaaccucgcccccgccgccccccagcuccaggaccucgccuccuccugcccccaggaggaggucucccagcagcaggaguccgucuccacccuccccgccuccguccacccccagcucuccccccgccagucccucgagacccaguaccuccagcaccgccuccagaagcccucccuccucuccaaggcccagaacaccugccagcucuacugcaaggagcccccccgcucccucgagcagcagcuccaggagcaccgccuccagcagaagcgccucuuccuccagaagcagucccagcuccaggccuacuucaaccagaugcagaucgccgaguccuccuacccccagcccucccagcagcucccccucccccgccaggagacccccccccccucccagcaggccccccccuucucccucacccagccccucucccccguccucgagcccuccuccgagcagaugcaguacucccccuuccucucccaguaccaggagaugcagcuccagccccuccccuccaccuccggcccccgcgccgcccccccccuccccacccagcuccagcagcagcagcccccccccccccccccccccccccccccccgccagcccggcgccgcccccgccccccuccaguucuccuaccagaccugcgagcuccccuccgccgccucccccgcccccgacuaccccacccccugccaguaccccgucgacggcgcccagcaguccgaccucaccggccccgacugcccccgcucccccggccuccaggaggcccccuccuccuacgacccccucgcccucuccgagcuccccggccucuucgacugcgagaugcucgacgccgucgacccccagcacaacggcuacguccucgucaacuga

SEQ ID NO: 49452 - RNA, 3786 nt, Artificial Sequence
  derived and/or modified sequence opt2 from SIK3__Homo_sapiens__NP_001268678
auggccgccgccgccgccuccggcgccggcggcgccgccggcgccggcaccggcggcgccggccccgccggccgccuccuccccccccccgcccccggcucccccgccgcccccgccgccgucucccccgccgccggccagccccgcccccccgcccccgccucccgcggccccaugcccgcccgcaucggcuacuacgagaucgaccgcaccaucggcaagggcaacuucgccgucgucaagcgcgccacccaccucgucaccaaggccaaggucgccaucaagaucaucgacaagacccagcucgacgaggagaaccucaagaagaucuuccgcgagguccagaucaugaagaugcucugccacccccacaucauccgccucuaccaggucauggagaccgagcgcaugaucuaccucgucaccgaguacgccuccggcggcgagaucuucgaccaccucgucgcccacggccgcauggccgagaaggaggcccgccgcaaguucaagcagaucgucaccgccgucuacuucugccacugccgcaacaucguccaccgcgaccucaaggccgagaaccuccuccucgacgccaaccucaacaucaagaucgccgacuucggcuucuccaaccucuucacccccggccagcuccucaagaccuggugcggcuccccccccuacgccgcccccgagcucuucgagggcaaggaguacgacggccccaaggucgacaucuggucccucggcgucguccucuacguccucgucugcggcgcccuccccuucgacggcuccacccuccagaaccuccgcgcccgcguccucuccggcaaguuccgcauccccuucuucauguccaccgagugcgagcaccucauccgccacaugcucguccucgaccccaacaagcgccucuccauggagcagaucugcaagcacaaguggaugaagcucggcgacgccgaccccaacuucgaccgccucaucgccgagugccagcagcucaaggaggagcgccaggucgacccccucaacgaggacguccuccucgccauggaggacaugggccucgacaaggagcagacccuccaggccgagcaggccggcaccgccaugaacaucuccgucccccagguccagcucaucaaccccgagaaccagaucgucgagcccgacggcacccucaaccucgacuccgacgagggcgaggagcccucccccgaggcccucguccgcuaccucuccaugcgccgccacaccgucggcgucgccgacccccgcaccgaggucauggaggaccuccagaagcuccuccccggcuuccccggcgucaacccccaggcccccuuccuccaggucgcccccaacgucaacuucaugcacaaccuccuccccaugcagaaccuccagcccaccggccagcucgaguacaaggagcagucccuccuccagccccccacccuccagcuccucaacggcaugggcccccucggccgccgcgccuccgacggcggcgccaacauccagcuccacgcccagcagcuccucaagcgcccccgcggccccuccccccucgucaccaugacccccgccguccccgccgucacccccgucgacgaggaguccuccgacggcgagcccgaccaggaggccguccagcgcuaccucgccaaccgcuccaagcgccacacccucgccaugaccaaccccaccgccgagaucccccccgaccuccagcgccagcucggccagcagcccuuccgcucccgcgucuggcccccccaccucguccccgaccagcaccgcuccaccuacaaggacuccaacacccuccaccuccccaccgagcgcuucucccccguccgccgcuucuccgacggcgccgccuccauccaggccuucaaggcccaccucgagaagaugggcaacaacuccuccaucaagcagcuccagcaggagugcgagcagcuccagaagauguacggcggccagaucgacgagcgcacccucgagaagacccagcagcagcacaugcucuaccagcaggagcagcaccaccagauccuccagcagcagauccaggacuccaucugccccccccagcccucccccccccuccaggccgccugcgagaaccagcccgcccuccucacccaccagcuccagcgccuccgcauccagcccuccucccccccccccaaccaccccaacaaccaccucuuccgccagcccuccaacucccccccccccauguccuccgccaugauccagccccacggcgccgccuccuccucccaguuccagggccuccccucccgcuccgccaucuuccagcagcagcccgagaacugcuccuccccccccaacgucgcccucaccugccucggcaugcagcagcccgcccagucccagcaggucaccauccagguccaggagcccgucgacaugcucuccaacaugcccggcaccgccgccggcuccuccggccgcggcaucuccaucucccccuccgccggccagaugcagaugcagcaccgcaccaaccucauggccacccucuccuacggccaccgcccccucuccaagcagcucuccgccgacuccgccgaggcccacuccgcccaccagcagcccccccacuacaccaccuccgcccuccagcaggcccuccucucccccaccccccccgacuacacccgccaccagcaggucccccacauccuccagggccuccucuccccccgccacucccucaccggccacuccgacauccgccucccccccaccgaguucgcccagcucaucaagcgccagcagcagcagcgccagcagcagcagcagcagcagcagcagcaggaguaccaggagcucuuccgccacaugaaccagggcgacgccggcucccucgcccccucccucggcggccaguccaugaccgagcgccaggcccucuccuaccagaacgccgacuccuaccaccaccacaccuccccccagcaccuccuccagauccgcgcccaggagugcgucucccaggccuccucccccacccccccccacggcuacgcccaccagcccgcccucaugcacuccgaguccauggaggaggacugcuccugcgagggcgccaaggacggcuuccaggacuccaaguccuccuccacccucaccaagggcugccacgacuccccccuccuccucuccaccggcggccccggcgaccccgagucccuccucggcaccgucucccacgcccaggagcucggcauccaccccuacggccaccagcccaccgccgccuucuccaagaacaagguccccucccgcgagcccgucaucggcaacugcauggaccgcuccucccccggccaggccgucgagcuccccgaccacaacggccucggcuaccccgcccgccccuccguccacgagcaccaccgcccccgcgcccuccagcgccaccacaccauccagaacuccgacgacgccuacguccagcucgacaaccuccccggcaugucccucgucgccggcaaggcccucuccuccgcccgcauguccgacgccguccucucccaguccucccucaugggcucccagcaguuccaggacggcgagaacgaggagugcggcgccucccucggcggccacgagcaccccgaccucuccgacggcucccagcaccucaacuccuccugcuaccccuccaccugcaucaccgacauccuccucuccuacaagcaccccgaggucuccuucuccauggagcaggccggcgucuga

SEQ ID NO: 49453 - RNA, 1386 nt, Artificial Sequence
  derived and/or modified sequence opt2 from SIL1__Homo_sapiens__NP_071909
auggccccccagucccuccccuccucccgcauggccccccucggcaugcuccucggccuccucauggccgccugcuucaccuucugccucucccaccagaaccucaaggaguucgcccucaccaaccccgagaaguccuccaccaaggagaccgagcgcaaggagaccaaggccgaggaggagcucgacgccgagguccucgaggucuuccaccccacccacgaguggcaggcccuccagcccggccaggccguccccgccggcucccacguccgccucaaccuccagaccggcgagcgcgaggccaagcuccaguacgaggacaaguuccgcaacaaccucaagggcaagcgccucgacaucaacaccaacaccuacaccucccaggaccucaaguccgcccucgccaaguucaaggagggcgccgagauggaguccuccaaggaggacaaggcccgccaggccgaggucaagcgccucuuccgccccaucgaggagcucaagaaggacuucgacgagcucaacgucgucaucgagaccgacaugcagaucaugguccgccucaucaacaaguucaacuccuccuccuccucccucgaggagaagaucgccgcccucuucgaccucgaguacuacguccaccagauggacaacgcccaggaccuccucuccuucggcggccuccaggucgucaucaacggccucaacuccaccgagccccucgucaaggaguacgccgccuucguccucggcgccgccuucuccuccaaccccaagguccaggucgaggccaucgagggcggcgcccuccagaagcuccucgucauccucgccaccgagcagccccucaccgccaagaagaagguccucuucgcccucugcucccuccuccgccacuuccccuacgcccagcgccaguuccucaagcucggcggccuccagguccuccgcacccucguccaggagaagggcaccgagguccucgccguccgcgucgucacccuccucuacgaccucgucaccgagaagauguucgccgaggaggaggccgagcucacccaggagaugucccccgagaagcuccagcaguaccgccagguccaccuccuccccggccucugggagcagggcuggugcgagaucaccgcccaccuccucgcccuccccgagcacgacgcccgcgagaagguccuccagacccucggcguccuccucaccaccugccgcgaccgcuaccgccaggacccccagcucggccgcacccucgccucccuccaggccgaguaccagguccucgccucccucgagcuccaggacggcgaggacgagggcuacuuccaggagcuccucggcuccgucaacucccuccucaaggagcuccgcuga

SEQ ID NO: 49454 - RNA, 2301 nt, Artificial Sequence
  derived and/or modified sequence opt2 from SIM1__Homo_sapiens__XP_005267157
augaaggagaaguccaagaacgccgcccgcacccgccgcgagaaggagaacuccgaguucuacgagcucgccaagcuccucccccuccccuccgccaucaccucccagcucgacaaggccuccaucauccgccucaccaccuccuaccucaagaugcgcgucgucuuccccgagggccucggcgaggccuggggccacuccucccgcaccuccccccucgacaacgucggccgcgagcucggcucccaccuccuccagacccucgacggcuucaucuucgucgucgcccccgacggcaagaucauguacaucuccgagaccgccuccguccaccucggccucucccaggucgagcucaccggcaacuccaucuacgaguacauccaccccgccgaccacgacgagaugaccgccguccucaccgcccaccagcccuaccacucccacuucguccaggaguacgagaucgagcgcuccuucuuccuccgcaugaagugcguccucgccaagcgcaacgccggccucaccugcggcggcuacaaggucauccacugcuccggcuaccucaagauccgccaguacucccucgacaugucccccuucgacggcugcuaccagaacgucggccucgucgccgucggccacucccucccccccuccgccgucaccgagaucaagcuccacuccaacauguucauguuccgcgccucccucgacaugaagcucaucuuccucgacucccgcgucgccgagcucaccggcuacgagccccaggaccucaucgagaagacccucuaccaccacguccacggcugcgacaccuuccaccuccgcugcgcccaccaccuccuccucgucaagggccaggucaccaccaaguacuaccgcuuccucgccaagcacggcggcugggucuggguccaguccuacgccaccaucguccacaacucccgcuccucccgcccccacugcaucgucuccgucaacuacguccucaccgacaccgaguacaagggccuccagcucucccucgaccagaucuccgccuccaagcccgccuucuccuacaccuccuccuccacccccaccaugaccgacaaccgcaagggcgccaagucccgccucuccuccuccaaguccaagucccgcaccucccccuacccccaguacuccggcuuccacaccgagcgcuccgaguccgaccacgacucccaguggggcggcuccccccucaccgacaccgccuccccccagcuccucgaccccgccgaccgccccggcucccagcacgacgccuccugcgccuaccgccaguucuccgaccgcuccucccucugcuacggcuucgcccucgaccacucccgccucgucgaggagcgccacuuccacacccaggccugcgagggcggccgcugcgaggccggccgcuacuuccucggcaccccccaggccggccgcgagcccugguggggcucccgcgccgcccucccccucaccaaggccucccccgagucccgcgaggccuacgagaacuccaugccccacaucgccuccguccaccgcauccacggccgcggccacugggacgaggacuccgucgucuccucccccgaccccggcuccgccuccgaguccggcgaccgcuaccgcaccgagcaguaccaguccuccccccacgagcccuccaagaucgagacccucauccgcgccacccagcagaugaucaaggaggaggagaaccgccuccagcuccgcaaggcccccuccgaccagcucgccuccaucaacggcgccggcaagaagcacucccucugcuucgccaacuaccagcagcccccccccaccggcgaggucugccacggcuccgcccucgccaacaccucccccugcgaccacauccagcagcgcgagggcaagaugcucuccccccacgagaacgacuacgacaacucccccaccgcccucucccgcaucuccucccccaacuccgaccgcaucuccaaguccucccucauccucgccaaggacuaccuccacuccgacaucuccccccaccagaccgccggcgaccaccccaccgucucccccaacugcuucggcucccaccgccaguacuucgacaagcacgccuacacccucaccggcuacgcccucgagcaccucuacgacuccgagaccauccgcaacuacucccucggcugcaacggcucccacuucgacgucaccucccaccuccgcaugcagcccgaccccgcccagggccacaagggcaccuccgucaucaucaccaacggcuccuga

SEQ ID NO: 49455 - RNA, 2004 nt, Artificial Sequence
  derived and/or modified sequence opt2 from SIM2__Homo_sapiens__NP_005060
augaaggagaaguccaagaacgccgccaagacccgccgcgagaaggagaacggcgaguucuacgagcucgccaagcuccucccccuccccuccgccaucaccucccagcucgacaaggccuccaucauccgccucaccaccuccuaccucaagaugcgcgccgucuuccccgagggccucggcgacgccuggggccagcccucccgcgccggcccccucgacggcgucgccaaggagcucggcucccaccuccuccagacccucgacggcuucgucuucgucgucgccuccgacggcaagaucauguacaucuccgagaccgccuccguccaccucggccucucccaggucgagcucaccggcaacuccaucuacgaguacauccaccccuccgaccacgacgagaugaccgccguccucaccgcccaccagccccuccaccaccaccuccuccaggaguacgagaucgagcgcuccuucuuccuccgcaugaagugcguccucgccaagcgcaacgccggccucaccugcuccggcuacaaggucauccacugcuccggcuaccucaagauccgccaguacaugcucgacaugucccucuacgacuccugcuaccagaucgucggccucgucgccgucggccagucccucccccccuccgccaucaccgagaucaagcucuacuccaacauguucauguuccgcgccucccucgaccucaagcucaucuuccucgacucccgcgucaccgaggucaccggcuacgagccccaggaccucaucgagaagacccucuaccaccacguccacggcugcgacgucuuccaccuccgcuacgcccaccaccuccuccucgucaagggccaggucaccaccaaguacuaccgccuccucuccaagcgcggcggcugggucuggguccaguccuacgccaccgucguccacaacucccgcuccucccgcccccacugcaucgucuccgucaacuacguccucaccgagaucgaguacaaggagcuccagcucucccucgagcaggucuccaccgccaagucccaggacuccuggcgcaccgcccucuccaccucccaggagacccgcaagcucgucaagcccaagaacaccaagaugaagaccaagcuccgcaccaaccccuaccccccccagcaguacuccuccuuccagauggacaagcucgagugcggccagcucggcaacuggcgcgccuccccccccgccuccgccgccgccccccccgagcuccagccccacuccgaguccuccgaccuccucuacacccccuccuacucccuccccuucuccuaccacuacggccacuucccccucgacucccacgucuucuccuccaagaagcccaugcuccccgccaaguucggccagccccagggcucccccugcgaggucgcccgcuucuuccucuccacccuccccgccuccggcgagugccaguggcacuacgccaacccccucguccccuccuccuccucccccgccaagaacccccccgagccccccgccaacaccgcccgccacucccucguccccuccuacgaggcccccgccgccgccguccgccgcuucggcgaggacaccgccccccccuccuuccccuccugcggccacuaccgcgaggagcccgcccucggccccgccaaggccgcccgccaggccgcccgcgacggcgcccgccucgcccucgcccgcgccgcccccgagugcugcgccccccccacccccgaggcccccggcgcccccgcccagcuccccuucguccuccucaacuaccaccgcguccucgcccgccgcggcccccucggcggcgccgcccccgccgccuccggccucgccugcgcccccggcggccccgaggccgccaccggcgcccuccgccuccgccaccccucccccgccgccaccuccccccccggcgccccccucccccacuaccucggcgccuccgucaucaucaccaacggccgcuga

SEQ ID NO: 49456 - RNA, 3822 nt, Artificial Sequence
  derived and/or modified sequence opt2 from SIN3A__Homo_sapiens__XP_006720530
augaagcgccgccucgacgaccaggagucccccgucuacgccgcccagcagcgccgcauccccggcuccaccgaggccuucccccaccagcaccgcguccucgcccccgccccccccgucuacgaggccgucuccgagaccaugcaguccgccaccggcauccaguacuccgucacccccuccuaccaggucuccgccaugccccaguccuccggcucccacggccccgccaucgccgccguccacuccucccaccaccaccccaccgccguccagccccacggcggccaggucguccagucccacgcccaccccgccccccccgucgcccccguccagggccagcagcaguuccagcgccucaaggucgaggacgcccucuccuaccucgaccaggucaagcuccaguucggcucccagccccaggucuacaacgacuuccucgacaucaugaaggaguucaagucccaguccaucgacacccccggcgucaucucccgcgucucccagcucuucaagggccaccccgaccucaucaugggcuucaacaccuuccucccccccggcuacaagaucgagguccagaccaacgacauggucaacgucaccacccccggccagguccaccagauccccacccacggcauccagccccagccccagccccccccccagcaccccucccagcccuccgcccaguccgcccccgcccccgcccagcccgccccccagcccccccccgccaaggucuccaagcccucccagcuccaggcccacacccccgccucccagcagacccccccccucccccccuacgccuccccccgcuccccccccguccagccccacacccccgucaccaucucccucggcaccgcccccucccuccagaacaaccagcccgucgaguucaaccacgccaucaacuacgucaacaagaucaagaaccgcuuccagggccagcccgacaucuacaaggccuuccucgagauccuccacaccuaccagaaggagcagcgcaacgccaaggaggccggcggcaacuacacccccgcccucaccgagcaggaggucuacgcccaggucgcccgccucuucaagaaccaggaggaccuccucuccgaguucggccaguuccuccccgacgccaacuccuccguccuccucuccaagaccaccgccgagaaggucgacuccguccgcaacgaccacggcggcaccgucaagaagccccagcucaacaacaagccccagcgccccucccagaacggcugccagauccgccgccaccccaccggcaccaccccccccgucaagaagaagcccaagcuccucaaccucaaggacuccuccauggccgacgccuccaagcacggcggcggcaccgagucccucuucuucgacaagguccgcaaggcccuccgcuccgccgaggccuacgagaacuuccuccgcugccucgucaucuucaaccaggaggucaucucccgcgccgagcucguccagcucgucucccccuuccucggcaaguuccccgagcucuucaacugguucaagaacuuccucggcuacaaggaguccguccaccucgagaccuaccccaaggagcgcgccaccgagggcaucgccauggagaucgacuacgccuccugcaagcgccucggcuccuccuaccgcgcccuccccaaguccuaccagcagcccaagugcaccggccgcaccccccucugcaaggagguccucaacgacaccugggucuccuuccccuccugguccgaggacuccaccuucgucuccuccaagaagacccaguacgaggagcacaucuaccgcugcgaggacgagcgcuucgagcucgacgucguccucgagaccaaccucgccaccauccgcguccucgaggccauccagaagaagcucucccgccucuccgccgaggagcaggccaaguuccgccucgacaacacccucggcggcaccuccgaggucauccaccgcaaggcccuccagcgcaucuacgccgacaaggccgccgacaucaucgacggccuccgcaagaaccccuccaucgccguccccaucguccucaagcgccucaagaugaaggaggaggaguggcgcgaggcccagcgcggcuucaacaaggucuggcgcgagcagaacgagaaguacuaccucaagucccucgaccaccagggcaucaacuucaagcagaacgacaccaagguccuccgcuccaagucccuccucaacgagaucgaguccaucuacgacgagcgccaggagcaggccaccgaggagaacgccggcguccccgucggcccccaccucucccucgccuacgaggacaagcagauccucgaggacgccgccgcccucaucauccaccacgucaagcgccagaccggcauccagaaggaggacaaguacaagaucaagcagaucaugcaccacuucauccccgaccuccucuucgcccagcgcggcgaccucuccgacgucgaggaggaggaggaggaggagauggacgucgacgaggccaccggcgccgucaagaagcacaacggcgucggcggcuccccccccaaguccaagcuccucuucuccaacaccgccgcccagaagcuccgcggcauggacgaggucuacaaccucuucuacgucaacaacaacugguacaucuucaugcgccuccaccagauccucugccuccgccuccuccgcaucugcucccaggccgagcgccagaucgaggaggagaaccgcgagcgcgagugggagcgcgagguccucggcaucaagcgcgacaaguccgacucccccgccauccagcuccgccucaaggagcccauggacgucgacgucgaggacuacuaccccgccuuccucgacaugguccgcucccuccucgacggcaacaucgacuccucccaguacgaggacucccuccgcgagauguucaccauccacgccuacaucgccuucaccauggacaagcucauccaguccaucguccgccagcuccagcacaucgucuccgacgagaucugcguccaggucaccgaccucuaccucgccgagaacaacaacggcgccaccggcggccagcucaacacccagaacucccgcucccuccucgaguccaccuaccagcgcaaggccgagcagcucauguccgacgagaacugcuucaagcucauguucauccagucccagggccagguccagcucaccaucgagcuccucgacaccgaggaggagaacuccgacgaccccgucgaggccgagcgcugguccgacuacgucgagcgcuacaugaacuccgacaccaccucccccgagcuccgcgagcaccucgcccagaagcccgucuuccucccccgcaaccuccgccgcauccgcaagugccagcgcggccgcgagcagcaggagaaggagggcaaggagggcaacuccaagaagaccauggagaacgucgacucccucgacaagcucgagugccgcuucaagcucaacuccuacaagauggucuacgucaucaaguccgaggacuacauguaccgccgcaccgcccuccuccgcgcccaccagucccacgagcgcgucuccaagcgccuccaccagcgcuuccaggccugggucgacaaguggaccaaggagcacgucccccgcgagauggccgccgagaccuccaaguggcucaugggcgagggccucgagggccucguccccugcaccaccaccugcgacaccgagacccuccacuucgucuccaucaacaaguaccgcgucaaguacggcaccgucuucaaggcccccuga

SEQ ID NO: 49457 - RNA, 3393 nt, Artificial Sequence
  derived and/or modified sequence opt2 from SIN3B__Homo_sapiens__NP_001284524
auggcccacgccggcggcggcuccggcggcuccggcgccggcggccccgccggccgcggccucuccggcgcccgcuggggccgcuccggcuccgccggccacgagaagcuccccguccacgucgaggacgcccucaccuaccucgaccaggucaagauccgcuucggcuccgaccccgccaccuacaacggcuuccucgagaucaugaaggaguucaagucccaguccaucgacacccccggcgucauccgccgcgucucccagcucuuccacgagcaccccgaccucaucgucggcuucaacgccuuccucccccucggcuaccgcaucgacauccccaagaacggcaagcucaacauccaguccccccucaccucccaggagaacucccacaaccacggcgacggcgccgaggacuucaagcagcagguccccuacaaggaggacaagccccaggucccccucgaguccgacuccgucgaguucaacaacgccaucuccuacgucaacaagaucaagacccgcuuccucgaccaccccgagaucuaccgcuccuuccucgagauccuccacaccuaccagaaggagcagcucaacacccgcggccgccccuuccgcggcauguccgaggaggaggucuucaccgaggucgccaaccucuuccgcggccaggaggaccuccucuccgaguucggccaguuccuccccgaggccaagcgcucccucuucaccggcaacggccccugcgagaugcacuccguccagaagaacgagcacgacaagacccccgagcacucccgcaagcgcucccgccccucccuccuccgccccgucuccgcccccgccaagaagaagaugaagcuccgcggcaccaaggaccucuccaucgccgccgucggcaaguacggcacccuccaggaguucuccuucuucgacaagguccgccgcguccucaagucccaggaggucuacgagaacuuccuccgcugcaucgcccucuucaaccaggagcucgucuccggcuccgagcuccuccagcucgucucccccuuccucggcaaguuccccgagcucuucgcccaguucaaguccuuccucggcgucaaggagcucuccuucgccccccccauguccgaccgcuccggcgacggcaucucccgcgagaucgacuacgccuccugcaagcgcaucggcuccuccuaccgcgcccuccccaagaccuaccagcagcccaagugcuccggccgcaccgccaucugcaaggagguccucaacgacaccugggucuccuuccccuccugguccgaggacuccaccuucgucuccuccaagaagacccccuacgaggagcagcuccaccgcugcgaggacgagcgcuucgagcucgacgucguccucgagaccaaccucgccaccauccgcguccucgaguccguccagaagaagcucucccgcauggcccccgaggaccaggagaaguuccgccucgacgacucccucggcggcaccuccgaggucauccagcgccgcgccaucuaccgcaucuacggcgacaaggcccccgagaucaucgagucccucaagaagaaccccgucaccgccguccccgucguccucaagcgccucaaggccaaggaggaggaguggcgcgaggcccagcagggcuucaacaagaucuggcgcgagcaguacgagaaggccuaccucaagucccucgaccaccaggccgucaacuucaagcagaacgacaccaaggcccuccgcuccaagucccuccucaacgagaucgaguccgucuacgacgagcaccaggagcagcacuccgagggccgcuccgcccccuccuccgagccccaccucaucuucgucuacgaggaccgccagauccucgaggacgccgccgcccucaucuccuacuacgucaagcgccagcccgccauccagaaggaggaccagggcaccauccaccagcuccuccaccaguucguccccucccucuucuucucccagcagcucgaccucggcgccuccgaggaguccgccgacgaggaccgcgacuccccccagggccagaccaccgaccccuccgagcgcaagaagcccgcccccggcccccacuccuccccccccgaggagaagggcgccuucggcgacgcccccgccaccgagcagcccccccuccccccccccgccccccacaagccccucgacgacgucuacucccucuucuucgccaacaacaacugguacuucuuccuccgccuccaccagacccucugcucccgccuccucaagaucuaccgccaggcccagaagcagcuccucgaguaccgcaccgagaaggagcgcgagaagcuccucugcgagggccgccgcgagaagggcuccgaccccgccauggagcuccgccucaagcagcccuccgaggucgagcucgaggaguacuaccccgccuuccucgacaugguccgcucccuccucgagggcuccaucgaccccacccaguacgaggacacccuccgcgagauguucaccauccacgccuacgucggcuucaccauggacaagcucguccagaacaucgcccgccagcuccaccaccucgucuccgacgacgucugccucaaggucgucgagcucuaccucaacgagaagaagcgcggcgccgccggcggcaaccucuccucccgcugcguccgcgccgcccgcgagaccuccuaccaguggaaggccgagcgcugcauggccgacgagaacugcuucaaggucauguuccuccagcgcaagggccaggucaucaugaccaucgagcuccucgacaccgaggaggcccagaccgaggaccccgucgagguccagcaccucgcccgcuacgucgagcaguacgucggcaccgagggcgccuccuccucccccaccgagggcuuccuccucaagcccgucuuccuccagcgcaaccucaagaaguuccgccgccgcuggcaguccgagcaggcccgcgcccuccgcggcgaggcccgcuccuccuggaagcgccucgucggcgucgaguccgccugcgacgucgacugccgcuucaagcucuccacccacaagauggucuucaucgucaacuccgaggacuacauguaccgccgcggcacccucugccgcgccaagcagguccagccccucguccuccuccgccaccaccagcacuucgaggaguggcacucccgcuggcucgaggacaacgucaccgucgaggccgccucccucguccaggacuggcucaugggcgaggaggacgaggacaugguccccugcaagacccucugcgagaccguccacguccacggccuccccgucacccgcuaccgcguccaguacucccgccgccccgccucccccuga

SEQ ID NO: 49458 - RNA, 3129 nt, Artificial Sequence
  derived and/or modified sequence opt2 from SIPA1__Homo_sapiens__NP_694985
augcccaugugggccggcggcgucggcuccccccgccgcggcauggcccccgccuccaccgacgaccucuucgcccgcaagcuccgccagcccgcccgccccccccucaccccccacaccuucgagccccgccccguccgcggcccccuccuccgcuccggcuccgacgccggcgaggcccgcccccccacccccgccuccccccgcgcccgcgcccacucccacgaggaggccucccgccccgccgccaccuccacccgccucuucaccgacccccucgcccuccucggccuccccgccgaggagcccgagcccgccuucccccccguccucgagccccgcugguucgcccacuacgacguccagucccuccucuucgacugggccccccgcucccagggcaugggcucccacuccgaggccuccuccggcacccucgccuccgccgaggaccaggccgccuccuccgaccuccuccacggcgcccccggcuucgucugcgagcucggcggcgagggcgagcucggccucggcggccccgccuccccccccgucccccccgcccuccccaacgccgccgucuccauccucgaggagccccagaaccgcaccuccgccuacucccucgagcacgccgaccucggcgccggcuacuaccgcaaguacuucuacggcaaggagcaccagaacuucuucggcauggacgagucccucggccccgucgccgucucccuccgccgcgaggagaaggagggcuccggcggcggcacccuccacuccuaccgcgucaucguccgcaccacccagcuccgcacccuccgcggcaccaucuccgaggacgcccucccccccggccccccccgcggccucuccccccgcaagcuccucgagcacgucgccccccagcucucccccuccugccuccgccucggcuccgccucccccaaggucccccgcacccuccucacccucgacgagcagguccucuccuuccagcgcaaggucggcauccucuacugccgcgccggccagggcuccgaggaggagauguacaacaaccaggaggccggccccgccuucaugcaguuccucacccuccucggcgacgucguccgccucaagggcuucgaguccuaccgcgcccagcucgacaccaagaccgacuccaccggcacccacucccucuacaccaccuaccaggaccacgagaucauguuccacgucuccaccaugcuccccuacacccccaacaaccagcagcagcuccuccgcaagcgccacaucggcaacgacaucgucaccaucgucuuccaggagcccggcuccaagcccuucugccccaccaccauccgcucccacuuccagcacgucuuccucgucguccgcgcccacacccccugcaccccccacaccaccuaccgcgucgccgucucccgcacccaggacacccccgccuucggccccgcccuccccgccggcggcggccccuucgccgccaacgccgacuuccgcgccuuccuccucgccaaggcccucaacggcgagcaggccgccggccacgcccgccaguuccacgccauggccacccgcacccgccagcaguaccuccaggaccucgccaccaacgaggucaccaccaccucccucgacuccgccucccgcuucggccuccccucccucggcggccgccgccgcgccgccccccgcggccccggcgccgagcuccaggccgccggcucccucgucuggggcguccgcgccgcccccggcgcccgcgucgccgccggcgcccaggccuccggccccgagggcaucgagguccccugccuccucggcaucuccgccgaggcccucguccucgucgccccccgcgacggccgcgucgucuucaacugcgccugccgcgacguccucgccuggaccuucuccgagcagcagcucgaccucuaccacggccgcggcgaggccaucacccuccgcuucgacggcucccccggccaggccgucggcgaggucgucgcccgccuccagcucgucucccgcggcugcgagacccgcgagcucgcccucccccgcgacggccagggccgccucggcuucgaggucgacgccgagggcuucgucacccacgucgagcgcuucaccuucgccgagaccgccggccuccgccccggcgcccgccuccuccgcgucugcggccagacccuccccucccuccgccccgaggccgccgcccagcuccuccgcuccgcccccaaggucugcgucaccguccucccccccgacgaguccggccgcccccgccgcuccuucuccgagcucuacacccucucccuccaggagcccucccgccgcggcgcccccgaccccguccaggacgagguccagggcgucacccuccuccccaccaccaagcagcuccuccaccucugccuccaggacggcggcuccccccccggccccggcgaccucgccgaggagcgcaccgaguuccuccacucccagaacucccucuccccccgcuccucccucuccgacgaggcccccguccuccccaacaccacccccgaccuccuccucgccaccaccgccaagcccuccguccccuccgccgacuccgagaccccccucacccaggaccgccccggcucccccuccggcuccgaggacaagggcaaccccgcccccgagcuccgcgccuccuuccucccccgcacccucucccuccgcaacuccaucucccgcaucauguccgaggccggcuccggcacccucgaggacgaguggcaggccaucuccgagaucgccuccaccugcaacaccauccucgagucccucucccgcgagggccagcccauccccgaguccggcgaccccaagggcacccccaaguccgacgccgagcccgagcccggcaaccucuccgagaaggucucccaccucgaguccaugcuccgcaagcuccaggaggaccuccagaaggagaaggccgaccgcgccgcccucgaggaggagguccgcucccuccgccacaacaaccgccgccuccaggccgaguccgaguccgccgccacccgccuccuccucgccuccaagcagcucggcucccccaccgccgaccucgccuga

SEQ ID NO: 49459 - RNA, 5169 nt, Artificial Sequence
  derived and/or modified sequence opt2 from SIPA1L2__Homo_sapiens__NP_065859
auguccgacccccgccagucccaggaggagaagcacaagcucggccgcgccuccuccaaguucaaggaccccccccgcaucaugcaguccgacgacuacuucgcccgcaaguucaaggccaucaacggcaacaugggccccaccaccucccucaacgccuccaacuccaacgagaccggcggcggcggccccgccaacggcacccccgccguccccaagaugggcguccgcgcccgcgucuccgaguggccccccaagaaggacugcuccaaggagcucaccugcaaggcccucugggagucccgcucccagaccuccuacgaguccaucaccuccguccuccagaacggccaguccgaccaguccgagggccagcaggacgagcagcucgaccucgacuucgucgaggccaaguacaccaucggcgacaucuucguccacuccccccagcgcggccuccaccccauccgccagcgcuccaacuccgacgucaccaucuccgacaucgacgccgaggacguccucgaccagaacgccgucaaccccaacaccggcgccgcccuccaccgcgaguacggcuccaccuccuccaucgaccgccagggccucuccggcgagaacuucuucgccaugcuccgcggcuaccgcgucgagaacuacgaccacaaggccaugguccccuucggcuuccccgaguucuuccgcugcgaccccgccaucucccccucccuccacgccgccgcccagaucucccgcggcgaguucguccgcaucuccggccucgacuacgucgacuccgcccuccucaugggccgcgaccgcgacaagcccuucaagcgccgccucaaguccgaguccgucgagaccucccucuuccgcaagcuccgcaccgucaaguccgagcacgagaccuucaaguucaccuccgagcucgaggagucccgccucgagcgcggcauccgccccuggaacugccagcgcugcuucgcccacuacgacguccaguccauccucuucaacaucaacgaggccauggccacccgcgccaacgucggcaagcgcaagaacaucaccaccggcgccuccgccgccucccagacccagaugcccaccggccagaccggcaacugcgaguccccccucggcuccaaggaggaccucaacuccaaggagaaccucgacgccgacgagggcgacggcaaguccaacgaccucguccucuccugccccuacuuccgcaacgagaccggcggcgagggcgaccgccgcaucgcccucucccgcgccaacuccuccuccuucuccuccggcgaguccugcuccuucgaguccucccucuccucccacugcaccaacgccggcgucuccguccucgaggucccccgcgagaaccagcccauccaccgcgagaaggucaagcgcuacaucaucgagcacaucgaccucggcgccuacuacuaccgcaaguucuucuacggcaaggagcaccagaacuacuucggcaucgacgagaaccucggccccgucgccgucuccauccgccgcgagaaggucgaggacgccaaggagaaggagggcucccaguucaacuaccgcgucgccuuccgcaccuccgagcucaccacccuccgcggcgccauccucgaggacgccauccccuccaccgcccgccacggcaccgcccgcggccucccccucaaggagguccucgaguacgucauccccgagcucuccauccagugccuccgccaggccuccaacucccccaaggucuccgagcagcuccucaagcucgacgagcagggccucuccuuccagcacaagaucggcauccucuacugcaaggccggccaguccaccgaggaggagauguacaacaacgagaccgccggccccgccuucgaggaguuccucgaccuccucggccagcgcguccgccucaagggcuucuccaaguaccgcgcccagcucgacaacaagaccgacuccaccggcacccacucccucuacaccaccuacaaggacuacgagcucauguuccacgucuccacccuccuccccuacaugcccaacaaccgccagcagcuccuccgcaagcgccacaucggcaacgacaucgucaccaucgucuuccaggagcccggcgcccuccccuucacccccaaguccauccgcucccacuuccagcacgucuucgucaucgucaagguccacaaccccugcaccgagaacgucugcuacuccgucggcgucucccgcuccaaggacgucccccccuucggcccccccauccccaagggcgucaccuuccccaaguccgccgucuuccgcgacuuccuccucgccaaggucaucaacgccgagaacgccgcccacaaguccgagaaguuccgcgccauggccacccgcacccgccaggaguaccucaaggaccucgccgagaacuucgucaccaccgccaccgucgacaccuccgucaaguucuccuucaucacccucggcgccaagaagaaggagaaggucaagccccgcaaggacgcccaccucuucuccaucggcgccaucauguggcacgucaucgcccgcgacuucggccaguccgccgacaucgagugccuccucggcaucuccaacgaguucaucaugcucaucgagaaggacuccaagaacgucgucuucaacugcuccugccgcgacgucaucggcuggaccuccggccucgucuccaucaaggucuucuacgagcgcggcgagugcguccuccucuccuccgucgacaacugcgccgaggacauccgcgagaucguccagcgccucgucaucgucacccgcggcugcgagaccgucgagaugacccuccgccgcaacggccucggccagcucggcuuccacgucaacuucgagggcaucgucgccgacgucgagcccuucggcuucgccuggaaggccggccuccgccagggcucccgccucgucgagaucugcaaggucgccgucgccacccucacccacgagcagaugaucgaccuccuccgcaccuccgucaccgucaaggucgucaucauccagccccacgacgacggcuccccccgccgcggcugcuccgagcucugccgcauccccauggucgaguacaagcucgacuccgagggcacccccugcgaguacaagacccccuuccgccgcaacaccaccuggcaccgcguccccacccccgcccuccagccccucucccgcgccucccccauccccggcacccccgaccgccuccccugccagcagcuccuccagcaggcccaggccgccaucccccgcuccaccuccuucgaccgcaagcuccccgacggcacccgcuccucccccuccaaccaguccuccuccuccgaccccggccccggcggcuccggccccuggcgcccccaggucggcuacgacggcugccaguccccccuccuccucgagcaccagggcuccggcccccucgagugcgacggcgcccgcgagcgcgaggacaccauggaggccucccgccaccccgagaccaaguggcacggcccccccuccaagguccucggcuccuacaaggagcgcgcccuccagaaggacggcuccugcaaggacucccccaacaagcucucccacaucggcgacaaguccugcuccucccacuccuccuccaacacccucuccuccaacaccuccuccaacuccgacgacaagcacuucggcuccggcgaccucauggaccccgagcuccucggccucaccuacaucaagggcgccuccaccgacuccggcaucgacaccgcccccugcaugcccgccaccauccucggccccguccaccucgccggcucccgcucccucauccacucccgcgccgagcagugggccgacgccgccgacgucuccggccccgacgacgagcccgccaagcucuacuccguccacggcuacgccuccaccaucuccgccggcuccgccgccgagggcuccaugggcgaccucuccgagaucuccucccacuccuccggcucccaccacuccggcucccccuccgcccacugcuccaaguccuccggcucccucgacuccuccaaggucuacaucgucucccacuccuccggccagcagguccccggcuccauguccaagcccuaccaccgccagggcgccgucaacaaguacgucaucggcuggaagaaguccgagggcucccccccccccgaggagcccgaggucaccgagugccccggcauguacuccgagauggacgucauguccaccgccacccagcaccagaccgucgucggcgacgccgucgccgagacccagcacguccucuccaaggaggacuuccucaagcucaugcuccccgacuccccccucgucgaggagggccgccgcaaguucuccuucuacggcaaccucuccccccgccgcucccucuaccgcacccucuccgacgaguccaucugcuccaaccgccgcggcuccuccuucggcuccucccgcuccuccguccucgaccaggcccuccccaacgacauccucuucuccaccaccccccccuaccacuccacccuccccccccgcgcccaccccgcccccuccaugggcucccuccgcaacgaguucugguucuccgacggcucccucuccgacaaguccaagugcgccgaccccggccucaugccccuccccgacaccgccaccggccucgacuggacccaccucgucgacgccgcccgcgccuucgagggccucgacuccgacgaggagcucggccuccucugccaccacaccuccuaccucgaccagcgcgucgccuccuucugcacccucaccgacaugcagcacggccaggaccucgagggcgcccaggagcucccccucugcgucgaccccggcuccggcaaggaguucauggacaccaccggcgagcgcucccccuccccccucaccggcaaggucaaccagcucgagcucauccuccgccagcuccagaccgaccuccgcaaggagaagcaggacaaggccguccuccaggccgagguccagcaccuccgccaggacaacaugcgccuccaggaggagucccagaccgccaccgcccagcuccgcaaguucaccgagugguucuucaccaccaucgacaagaaguccuga

SEQ ID NO: 49460 - RNA, 5346 nt, Artificial Sequence
  derived and/or modified sequence opt2 from SIPA1L3__Homo_sapiens__NP_055888
augaccaccuaccgcgccauccccuccgacggcgucgaccucgccgccuccugcggcgcccgcgucggcgacguccuccccggcccccacaccggcgacuacgccccccucggcuucugggcccagaacggcuccaugucccagccccucggcgagucccccgccaccgccaccgccaccgccaccgccaccacccgccccucccccaccacccccgccaugcccaagaugggcguccgcgcccgcgucgccgacuggccccccaagcgcgaggcccuccgcgagcacuccaaccccucccccucccaggacaccgacggcaccaaggccaccaagauggcccacuccaugcgcuccauccagaacggccagccccccaccuccacccccgccuccuccggcuccaaggccuuccaccgccucucccgccgccgcuccaaggacgucgaguuccaggacggcuggccccgcucccccggccgcgccuuccucccccuccgccaccgcuccuccuccgagaucacccucuccgagugcgacgccgaggacgccggcgagccccgcggcgcccgccacaccggcgcccucccccucuuccgcgaguacggcuccaccuccuccaucgacguccagggcaugcccgagcaguccuucuucgacauccucaacgaguuccgcuccgagcagcccgacgcccgcggcugccaggcccucaccgagcuccuccgcgccgaccccggcccccaccucaugggcggcggcggcggcgccaagggcgacucccacaacggccagcccgccaaggacucccuccucccccuccagcccaccaaggagaaggagaaggcccgcaagaagcccgcccgcggccucggcggcggcgacaccgucgacuccuccaucuuccgcaagcuccgcuccuccaagcccgagggcgaggccggccgcucccccggcgaggccgacgagggccgcuccccccccgaggccucccgccccugggucugccagaaguccuucgcccacuucgacguccaguccaugcucuucgaccucaacgaggccgccgccaaccgcgucuccgucucccagcgccgcaacaccaccaccggcgccuccgccgccuccgccgccuccgccauggccucccucaccgccucccgcgcccacucccucggcggccucgaccccgccuucaccuccaccgaggaccucaacugcaaggagaaccucgagcaggaccucggcgacgacaacuccaacgaccuccuccucuccugcccccacuuccgcaacgagaucggcggcgagugcgagcgcaacgucuccuucucccgcgccuccgucggcucccccuccuccggcgagggccaccucgccgagcccgcccucuccgccuaccgcaccaacgccuccaucuccguccucgagguccccaaggagcagcagcgcacccagucccgcccccgccaguacuccaucgagcacgucgaccucggcgcccgcuacuaccaggacuacuucgucggcaaggagcacgccaacuacuucggcgucgacgagaagcucggccccgucgccgucuccaucaagcgcgagaagcucgaggaccacaaggagcacggcccccaguaccaguaccgcaucaucuuccgcacccgcgagcucaucacccuccgcggcuccauccucgaggacgccacccccaccgccaccaagcacggcaccggccgcggccucccccucaaggacgcccucgaguacgucauccccgagcucaacauccacugccuccgccucgcccucaacacccccaaggucaccgagcagcuccucaagcucgacgagcagggccucugccgcaagcacaaggucggcauccucuacugcaaggccggccaguccuccgaggaggagauguacaacaacgaggaggccggccccgccuucgaggaguuccucucccucaucggcgagaaggucugccucaagggcuucaccaaguacgccgcccagcucgacgucaagaccgacuccaccggcacccacucccucuacaccauguaccaggacuacgagaucauguuccacgucuccacccuccuccccuacacccccaacaaccgccagcagcuccuccgcaagcgccacaucggcaacgacaucgucaccaucaucuuccaggagcccggcgcccuccccuucacccccaagaacauccgcucccacuuccagcacgucuucaucaucguccgcguccacaaccccugcaccgacaacgucugcuacuccauggccgucacccgcuccaaggacgccccccccuucggcccccccauccccuccggcaccaccuuccgcaaguccgacgucuuccgcgacuuccuccucgccaaggucaucaacgccgagaacgccgcccacaaguccgacaaguuccacaccauggccacccgcacccgccaggaguaccucaaggaccucgccgagaacugcgucuccaacacccccaucgacuccaccggcaaguucaaccucaucucccucaccuccaagaagaaggagaagaccaaggcccgcgccggcgccgagcagcacuccgccggcgccaucgccuggcgcgucgucgcccaggacuacgcccagggcgucgagaucgacugcauccucggcaucuccaacgaguucgucguccuccucgaccuccgcaccaaggaggucgucuucaacugcuacugcggcgacgucaucggcuggacccccgacuccuccacccucaagaucuucuacggccgcggcgaccacaucuuccuccaggccaccgagggcuccgucgaggacauccgcgagaucguccagcgccucaaggucaugaccuccggcugggagaccgucgacaugacccuccgccgcaacggccucggccagcucggcuuccacgucaaguacgacggcaccgucgccgaggucgaggacuacggcuucgccuggcaggccggccuccgccagggcucccgccucgucgagaucugcaaggucgccgucgucacccucacccacgaccagaugaucgaccuccuccgcaccuccgucaccgucaaggucgucaucaucccccccuucgaggacggcaccccccgccgcggcuggcccgagaccuacgacaugaacaccuccgagcccaagaccgagcaggaguccaucacccccggcggccgcccccccuaccgcuccaacgcccccuggcagugguccggccccgccucccacaacucccuccccgccuccaagugggccacccccaccacccccggccacgcccagucccucucccgcccccucaagcagacccccaucguccccuuccgcgagucccagccccuccacuccaagcgccccgucuccuuccccgagacccccuacaccgucucccccgccggcgccgaccgcgucccccccuaccgccagcccuccggcuccuucuccacccccggcuccgccaccuacguccgcuacaagcccucccccgagcgcuacaccgccgccccccacccccuccucucccucgacccccacuucucccacgacggcaccuccuccggcgacuccuccuccggcggccucaccucccaggaguccaccauggagcgccagaagcccgagccccucuggcacguccccgcccaggcccgccucuccgccaucgccggcuccuccggcaacaagcaccccucccgccaggacgccgccggcaaggacucccccaaccgccacuccaagggcgagccccaguacuccucccacuccuccuccaacacccucuccuccaacgccuccuccucccacuccgacgaccgcugguucgacccccucgacccccucgagcccgagcaggacccccucuccaagggcggcuccuccgacuccggcaucgacaccacccucuacaccuccucccccuccugcaugucccucgccaaggccccccgccccgccaagccccacaagccccccggcuccaugggccucugcggcggcggccgcgaggccgccggccgcucccaccacgccgaccgccgccgcgaggucucccccgcccccgccgucgccggccaguccaagggcuaccgccccaagcucuacuccuccggcuccuccacccccaccggccucgccggcggcucccgcgaccccccccgccagcccuccgacaugggcucccgcgucggcuaccccgcccaggucuacaagaccgccuccgccgagaccccccgccccucccagcucgcccagcccucccccuuccagcucuccgccuccguccccaaguccuucuucuccaagcagcccguccgcaacaagcaccccaccggcuggaagcgcaccgaggagccccccccccgcccccuccccuucuccgaccccaagaagcaggucgacaccaacaccaagaacgucuucggccagccccgccuccgcgccucccuccgcgaccuccgcuccccccgcaagaacuacaaguccaccaucgaggacgaccucaagaagcucaucaucauggacaaccucggccccgagcaggagcgcgacaccggccaguccccccagaagggccuccagcgcacccucuccgacgagucccucugcuccggccgccgcgagcccuccuucgccucccccgccggccucgagcccggccuccccuccgacguccucuucaccuccaccugcgccuuccccuccuccacccuccccgcccgccgccagcaccagcacccccacccccccgucggccccggcgccacccccgccgccggcuccggcuuccccgagaagaaguccaccaucuccgccuccgagcucucccucgccgacggccgcgaccgcccccuccgccgccucgaccccggccucaugccccuccccgacaccgccgccggccucgagugguccucccucgucaacgccgccaaggccuacgagguccagcgcgccgucucccucuucucccucaacgaccccgcccucucccccgacaucccccccgcccacucccccguccacucccaccucucccucgagcgcggcccccccaccccccgcaccacccccaccauguccgaggagcccccccucgaccucaccggcaaggucuaccagcucgaggucaugcucaagcagcuccacaccgaccuccagaaggagaagcaggacaaggucguccuccaguccgaggucgccucccuccgccagaacaaccagcgccuccaggaggagucccaggccgccuccgagcagcuccgcaaguucgccgagaucuucugccgcgagaagaaggagcucuga

SEQ ID NO: 49461 - RNA, 1515 nt, Artificial Sequence
  derived and/or modified sequence opt2 from SIRPA__Homo_sapiens__NP_542970
auggagcccgccggccccgcccccggccgccucggcccccuccucugccuccuccucgccgccuccugcgccugguccggcgucgccggcgaggaggagcuccaggucauccagcccgacaaguccguccucgucgccgccggcgagaccgccacccuccgcugcaccgccaccucccucauccccgucggccccauccagugguuccgcggcgccggccccggccgcgagcucaucuacaaccagaaggagggccacuucccccgcgucaccaccgucuccgaccucaccaagcgcaacaacauggacuucuccauccgcaucggcaacaucacccccgccgacgccggcaccuacuacugcgucaaguuccgcaagggcucccccgacgacgucgaguucaaguccggcgccggcaccgagcucuccguccgcgccaagcccuccgcccccgucgucuccggccccgccgcccgcgccaccccccagcacaccgucuccuucaccugcgagucccacggcuucuccccccgcgacaucacccucaagugguucaagaacggcaacgagcucuccgacuuccagaccaacgucgaccccgucggcgaguccgucuccuacuccauccacuccaccgccaaggucguccucacccgcgaggacguccacucccaggucaucugcgaggucgcccacgucacccuccagggcgacccccuccgcggcaccgccaaccucuccgagaccauccgcgucccccccacccucgaggucacccagcagcccguccgcgccgagaaccaggucaacgucaccugccagguccgcaaguucuacccccagcgccuccagcucaccuggcucgagaacggcaacgucucccgcaccgagaccgccuccaccgucaccgagaacaaggacggcaccuacaacuggauguccuggcuccucgucaacgucuccgcccaccgcgacgacgucaagcucaccugccaggucgagcacgacggccagcccgccgucuccaagucccacgaccucaaggucuccgcccaccccaaggagcagggcuccaacaccgccgccgagaacaccggcuccaacgagcgcaacaucuacaucgucgucggcgucgucugcacccuccucgucgcccuccucauggccgcccucuaccucguccgcauccgccagaagaaggcccagggcuccaccuccuccacccgccuccacgagcccgagaagaacgcccgcgagaucacccaggacaccaacgacaucaccuacgccgaccucaaccuccccaagggcaagaagcccgccccccaggccgccgagcccaacaaccacaccgaguacgccuccauccagaccuccccccagcccgccuccgaggacacccucaccuacgccgaccucgacaugguccaccucaaccgcacccccaagcagcccgcccccaagcccgagcccuccuucuccgaguacgccuccguccaggucccccgcaaguga

SEQ ID NO: 49462 - RNA, 546 nt, Artificial Sequence
  derived and/or modified sequence opt2 from SIRPB1__Homo_sapiens__NP_001077379
augcccguccccgccuccuggccccaccuccccucccccuuccuccucaugacccuccuccucggccgccucaccggcgucgccggcgaggacgagcuccaggucauccagcccgagaaguccgucuccgucgccgccggcgaguccgccacccuccgcugcgccaugaccucccucauccccgucggccccaucaugugguuccgcggcgccggcgccggccgcgagcucaucuacaaccagaaggagggccacuucccccgcgucaccaccgucuccgagcucaccaagcgcaacaaccucgacuucuccaucuccaucuccaacaucacccccgccgacgccggcaccuacuacugcgucaaguuccgcaagggcucccccgacgacgucgaguucaaguccggcgccggcaccgagcucuccguccgcgaggccgcccucgcccccaccgccccccuccucgucgcccuccuccucggccccaagcuccuccucgucgucggcgucuccgccaucuacaucugcuggaagcagaaggccuga

SEQ ID NO: 49463 - RNA, 831 nt, Artificial Sequence
  derived and/or modified sequence opt2 from SIRPG__Homo_sapiens__NP_001034597
augcccguccccgccuccuggccccacccccccggccccuuccuccuccucacccuccuccucggccucaccgaggucgccggcgaggaggagcuccagaugauccagcccgagaagcuccuccucgucaccgucggcaagaccgccacccuccacugcaccgucaccucccuccuccccgucggccccguccucugguuccgcggcgucggccccggccgcgagcucaucuacaaccagaaggagggccacuucccccgcgucaccaccgucuccgaccucaccaagcgcaacaacauggacuucuccauccgcaucuccuccaucacccccgccgacgucggcaccuacuacugcgucaaguuccgcaagggcucccccgagaacgucgaguucaaguccggccccggcaccgagauggcccucggcgccaagcccuccgcccccgucguccucggccccgccgcccgcaccacccccgagcacaccgucuccuucaccugcgagucccacggcuucuccccccgcgacaucacccucaagugguucaagaacggcaacgagcucuccgacuuccagaccaacgucgaccccaccggccaguccgucgccuacuccauccgcuccaccgcccgcgucguccucgaccccugggacguccgcucccaggucaucugcgaggucgcccacgucacccuccagggcgacccccuccgcggcaccgccaaccucuccgaggccauccgcggccccgccuccucccucaccgcccuccuccucaucgccguccuccucggccccaucuacguccccuggaagcagaagaccuga

SEQ ID NO: 49464 - RNA, 1359 nt, Artificial Sequence
  derived and/or modified sequence opt2 from SIRT1__Homo_sapiens__NP_001135970
auguucgacaucgaguacuuccgcaaggacccccgccccuucuucaaguucgccaaggagaucuaccccggccaguuccagcccucccucugccacaaguucaucgcccucuccgacaaggagggcaagcuccuccgcaacuacacccagaacaucgacacccucgagcaggucgccggcauccagcgcaucauccagugccacggcuccuucgccaccgccuccugccucaucugcaaguacaaggucgacugcgaggccguccgcggcgacaucuucaaccaggucgucccccgcugcccccgcugccccgccgacgagccccucgccaucaugaagcccgagaucgucuucuucggcgagaaccuccccgagcaguuccaccgcgccaugaaguacgacaaggacgaggucgaccuccucaucgucaucggcuccucccucaagguccgccccgucgcccucauccccuccuccaucccccacgaggucccccagauccucaucaaccgcgagccccucccccaccuccacuucgacgucgagcuccucggcgacugcgacgucaucaucaacgagcucugccaccgccucggcggcgaguacgccaagcucugcugcaaccccgucaagcucuccgagaucaccgagaagcccccccgcacccagaaggagcucgccuaccucuccgagcucccccccaccccccuccacgucuccgaggacuccuccucccccgagcgcaccuccccccccgacuccuccgucaucgucacccuccucgaccaggccgccaaguccaacgacgaccucgacgucuccgaguccaagggcugcauggaggagaagccccaggagguccagaccucccgcaacgucgaguccaucgccgagcagauggagaaccccgaccucaagaacgucggcuccuccaccggcgagaagaacgagcgcaccuccgucgccggcaccguccgcaagugcuggcccaaccgcgucgccaaggagcagaucucccgccgccucgacggcaaccaguaccucuuccucccccccaaccgcuacaucuuccacggcgccgaggucuacuccgacuccgaggacgacguccucuccuccuccuccugcggcuccaacuccgacuccggcaccugccagucccccucccucgaggagcccauggaggacgaguccgagaucgaggaguucuacaacggccucgaggacgagcccgacguccccgagcgcgccggcggcgccggcuucggcaccgacggcgacgaccaggaggccaucaacgaggccaucuccgucaagcaggaggucaccgacaugaacuaccccuccaacaaguccuga

SEQ ID NO: 49465 - RNA, 705 nt, Artificial Sequence
  derived and/or modified sequence opt2 from SIRT2__Homo_sapiens__NP_001180215
auggacuuccuccgcaaccucuucucccagacccucucccucggcucccagaaggagcgccuccucgacgagcucacccucgagggcgucgcccgcuacaugcaguccgagcgcugccgccgcgucaucugccucgucggcgccggcaucuccaccuccgccggcauccccgacuuccgcucccccuccaccggccucuacgacaaccucgagaaguaccaccuccccuaccccgaggccaucuucgagaucuccuacuucaagaagcaccccgagcccuucuucgcccucgccaaggagcucuaccccggccaguucaagcccaccaucugccacuacuucaugcgccuccucaaggacaagggccuccuccuccgcugcuacacccagaacaucgacacccucgagcgcaucgccggccucgagcaggaggaccucgucgaggcccacggcaccuucuacaccucccacugcgucuccgccuccugccgccacgaguacccccucuccuggaugaaggagaagaucuucuccgaggucacccccaagugcgaggacugccagucccucgucaagcccgacaucgucuucuucggcgagucccuccccgcccgcuucuucuccugcaugcaguccgacuuccucaaggucgaccuccuccucgucaugggcaccucccuccagggccgcggccucgccggcuga

SEQ ID NO: 49466 - RNA, 774 nt, Artificial Sequence
  derived and/or modified sequence opt2 from SIRT3__Homo_sapiens__NP_001017524
auggucggcgccggcaucuccacccccuccggcauccccgacuuccgcucccccggcuccggccucuacuccaaccuccagcaguacgaccuccccuaccccgaggccaucuucgagcuccccuucuucuuccacaaccccaagcccuucuucacccucgccaaggagcucuaccccggcaacuacaagcccaacgucacccacuacuuccuccgccuccuccacgacaagggccuccuccuccgccucuacacccagaacaucgacggccucgagcgcgucuccggcauccccgccuccaagcucgucgaggcccacggcaccuucgccuccgccaccugcaccgucugccagcgccccuuccccggcgaggacauccgcgccgacgucauggccgaccgcgucccccgcugccccgucugcaccggcgucgucaagcccgacaucgucuucuucggcgagccccucccccagcgcuuccuccuccacgucgucgacuuccccauggccgaccuccuccucauccucggcaccucccucgaggucgagcccuucgccucccucaccgaggccguccgcuccuccgucccccgccuccucaucaaccgcgaccucgucggcccccucgccuggcacccccgcucccgcgacgucgcccagcucggcgacgucguccacggcgucgagucccucgucgagcuccucggcuggaccgaggagaugcgcgaccucguccagcgcgagaccggcaagcucgacggccccgacaaguga

SEQ ID NO: 49467 - RNA, 945 nt, Artificial Sequence
  derived and/or modified sequence opt2 from SIRT4__Homo_sapiens__NP_036372
augaagauguccuucgcccucaccuuccgcuccgccaagggccgcuggaucgccaaccccucccagcccugcuccaaggccuccaucggccucuucguccccgccucccccccccucgaccccgagaaggucaaggagcuccagcgcuucaucacccucuccaagcgccuccucgucaugaccggcgccggcaucuccaccgaguccggcauccccgacuaccgcuccgagaaggucggccucuacgcccgcaccgaccgccgccccauccagcacggcgacuucguccgcuccgcccccauccgccagcgcuacugggcccgcaacuucgucggcuggccccaguucuccucccaccagcccaaccccgcccacugggcccucuccaccugggagaagcucggcaagcucuacuggcucgucacccagaacgucgacgcccuccacaccaaggccggcucccgccgccucaccgagcuccacggcugcauggaccgcguccucugccucgacugcggcgagcagaccccccgcggcguccuccaggagcgcuuccagguccucaaccccaccugguccgccgaggcccacggccucgcccccgacggcgacgucuuccucuccgaggagcagguccgcuccuuccagguccccaccugcguccagugcggcggccaccucaagcccgacgucgucuucuucggcgacaccgucaaccccgacaaggucgacuucguccacaagcgcgucaaggaggccgacucccuccucgucgucggcuccucccuccaggucuacuccggcuaccgcuucauccucaccgccugggagaagaagcuccccaucgccauccucaacaucggccccacccgcuccgacgaccucgccugccucaagcucaacucccgcugcggcgagcuccucccccucaucgaccccugcuga

SEQ ID NO: 49468 - RNA, 879 nt, Artificial Sequence
  derived and/or modified sequence opt2 from SIRT5__Homo_sapiens__NP_001180196
augcgcccccuccagaucguccccucccgccucaucucccagcucuacugcggccucaagccccccgccuccacccgcaaccagaucugccucaagauggcccgccccuccuccuccauggccgacuuccgcaaguucuucgccaaggccaagcacaucgucaucaucuccggcgccggcgucuccgccgaguccggcguccccaccuuccgcggcgccggcggcuacuggcgcaaguggcaggcccaggaccucgccaccccccucgccuucgcccacaaccccucccgcgucugggaguucuaccacuaccgccgcgaggucaugggcuccaaggagcccaacgccggccaccgcgccaucgccgagugcgagacccgccucggcaagcagggccgccgcgucgucgucaucacccagaacaucgacgagcuccaccgcaaggccggcaccaagaaccuccucgagauccacggcucccucuucaagacccgcugcaccuccugcggcgucgucgccgagaacuacaagucccccaucugccccgcccucuccggcaagggcugcgaggaggccggcugcggcggccuccuccgcccccacgucgucugguucggcgagaaccucgaccccgccauccucgaggaggucgaccgcgagcucgcccacugcgaccucugccucgucgucggcaccuccuccgucgucuaccccgccgccauguucgccccccaggucgccgcccgcggcguccccgucgccgaguucaacaccgagaccacccccgccaccaaccgcuuccgcuuccacuuccagggccccugcggcaccacccuccccgaggcccucgccugccacgagaacgagaccgucuccuga

SEQ ID NO: 49469 - RNA, 987 nt, Artificial Sequence
  derived and/or modified sequence opt2 from SIRT6__Homo_sapiens__NP_001180214
auguccgucaacuacgccgccggccucucccccuacgccgacaagggcaagugcggccuccccgagaucuucgacccccccgaggagcucgagcgcaaggucugggagcucgcccgccucgucuggcaguccuccuccgucgucuuccacaccggcgccggcaucuccaccgccuccggcauccccgacuuccgcggcccccacggcgucuggaccauggaggagcgcggccucgcccccaaguucgacaccaccuucgaguccgcccgccccacccagacccacauggcccucguccagcucgagcgcgucggccuccuccgcuuccucgucucccagaacgucgacggccuccacguccgcuccggcuucccccgcgacaagcucgccgagcuccacggcaacauguucgucgaggagugcgccaagugcaagacccaguacguccgcgacaccgucgucggcaccaugggccucaaggccaccggccgccucugcaccgucgccaaggcccgcggccuccgcgccugccgcaacgccgaccucuccaucacccucggcaccucccuccagauccgccccuccggcaaccucccccucgccaccaagcgccgcggcggccgccucgucaucgucaaccuccagcccaccaagcacgaccgccacgccgaccuccgcauccacggcuacgucgacgaggucaugacccgccucaugaagcaccucggccucgagauccccgccugggacggcccccgcguccucgagcgcgcccuccccccccucccccgcccccccacccccaagcucgagcccaaggaggagucccccacccgcaucaacggcuccauccccgccggccccaagcaggagcccugcgcccagcacaacggcuccgagcccgccucccccaagcgcgagcgccccaccucccccgccccccaccgcccccccaagcgcgucaaggccaaggccguccccuccuga

SEQ ID NO: 49470 - RNA, 1203 nt, Artificial Sequence
  derived and/or modified sequence opt2 from SIRT7__Homo_sapiens__NP_057622
auggccgccggcggccucucccgcuccgagcgcaaggccgccgagcgcguccgccgccuccgcgaggagcagcagcgcgagcgccuccgccaggucucccgcauccuccgcaaggccgccgccgagcgcuccgccgaggagggccgccuccucgccgaguccgccgaccucgucaccgagcuccagggccgcucccgccgccgcgagggccucaagcgccgccaggaggaggucugcgacgaccccgaggagcuccgcggcaagguccgcgagcucgccuccgccguccgcaacgccaaguaccucgucgucuacaccggcgccggcaucuccaccgccgccuccauccccgacuaccgcggccccaacggcgucuggacccuccuccagaagggccgcuccgucuccgccgccgaccucuccgaggccgagcccacccucacccacauguccaucacccgccuccacgagcagaagcucguccagcacgucgucucccagaacugcgacggccuccaccuccgcuccggccucccccgcaccgccaucuccgagcuccacggcaacauguacaucgaggucugcaccuccugcguccccaaccgcgaguacguccgcgucuucgacgucaccgagcgcaccgcccuccaccgccaccagaccggccgcaccugccacaagugcggcacccagcuccgcgacaccaucguccacuucggcgagcgcggcacccucggccagccccucaacugggaggccgccaccgaggccgccucccgcgccgacaccauccucugccucggcuccucccucaagguccucaagaaguacccccgccucuggugcaugaccaagccccccucccgccgccccaagcucuacaucgucaaccuccaguggacccccaaggacgacugggccgcccucaagcuccacggcaagugcgacgacgucaugcgccuccucauggccgagcucggccucgagauccccgccuacucccgcuggcaggaccccaucuucucccucgccaccccccuccgcgccggcgaggagggcucccacucccgcaagucccucugccgcucccgcgaggaggccccccccggcgaccgcggcgccccccucuccuccgcccccauccucggcggcugguucggccgcggcugcaccaagcgcaccaagcgcaagaaggucaccuga

SEQ ID NO: 49471 - RNA, 591 nt, Artificial Sequence
  derived and/or modified sequence opt2 from SIT1__Homo_sapiens__NP_055265
augaaccaggccgacccccgccuccgcgccgucugccucuggacccucaccuccgccgccaugucccgcggcgacaacugcaccgaccuccucgcccucggcauccccuccaucacccaggccuggggccucuggguccuccucggcgccgucacccuccucuuccucaucucccucgccgcccaccucucccaguggacccgcggccgcucccgcucccaccccggccagggccgcuccggcgaguccgucgaggaggucccccucuacggcaaccuccacuaccuccagaccggccgccucucccaggaccccgagcccgaccagcaggaccccacccucggcggccccgcccgcgccgccgaggaggucaugugcuacaccucccuccagcuccgccccccccagggccgcauccccggccccggcacccccgucaaguacuccgaggucguccucgacuccgagcccaagucccaggccuccggccccgagcccgagcucuacgccuccgucugcgcccagacccgccgcgcccgcgccuccuuccccgaccaggccuacgccaacucccagcccgccgccuccuga

SEQ ID NO: 49472 - RNA, 528 nt, Artificial Sequence
  derived and/or modified sequence opt2 from SIVA1__Homo_sapiens__NP_006418
augcccaagcgcuccugccccuucgccgacgucgccccccuccagcucaagguccgcgucucccagcgcgagcucucccgcggcgucugcgccgagcgcuacucccaggaggucuucgagaagaccaagcgccuccucuuccucggcgcccaggccuaccucgaccacgucugggacgagggcugcgccgucguccaccuccccgagucccccaagcccggccccaccggcgccccccgcgccgcccgcggccagaugcucaucggccccgacggccgccucauccgcucccucggccaggccuccgaggccgaccccuccggcgucgccuccaucgccugcuccuccugcguccgcgccgucgacggcaaggccgucugcggccagugcgagcgcgcccucugcggccagugcguccgcaccugcuggggcugcggcuccgucgccugcacccucugcggccucgucgacugcuccgacauguacgagaagguccucugcaccuccugcgccauguucgagaccuga

SEQ ID NO: 49473 - RNA, 855 nt, Artificial Sequence
  derived and/or modified sequence opt2 from SIX1__Homo_sapiens__NP_005973
auguccaugcuccccuccuucggcuucacccaggagcaggucgccugcgucugcgagguccuccagcagggcggcaaccucgagcgccucggccgcuuccucuggucccuccccgccugcgaccaccuccacaagaacgaguccguccucaaggccaaggccgucgucgccuuccaccgcggcaacuuccgcgagcucuacaagauccucgagucccaccaguucuccccccacaaccaccccaagcuccagcagcucuggcucaaggcccacuacgucgaggccgagaagcuccgcggccgcccccucggcgccgucggcaaguaccgcguccgccgcaaguucccccucccccgcaccaucugggacggcgaggagaccuccuacugcuucaaggagaagucccgcggcguccuccgcgagugguacgcccacaaccccuaccccuccccccgcgagaagcgcgagcucgccgaggccaccggccucaccaccacccaggucuccaacugguucaagaaccgccgccagcgcgaccgcgccgccgaggccaaggagcgcgagaacaccgagaacaacaacuccuccuccaacaagcagaaccagcucuccccccucgagggcggcaagccccucauguccuccuccgaggaggaguucucccccccccagucccccgaccagaacuccguccuccuccuccagggcaacaugggccacgcccgcuccuccaacuacucccuccccggccucaccgccucccagcccucccacggccuccagacccaccagcaccagcuccaggacucccuccucggcccccucaccuccucccucgucgaccucggcuccuga

SEQ ID NO: 49474 - RNA, 876 nt, Artificial Sequence
  derived and/or modified sequence opt2 from SIX2__Homo_sapiens__NP_058628
auguccaugcuccccaccuucggcuucacccaggagcaggucgccugcgucugcgagguccuccagcagggcggcaacaucgagcgccucggccgcuuccucuggucccuccccgccugcgagcaccuccacaagaacgaguccguccucaaggccaaggccgucgucgccuuccaccgcggcaacuuccgcgagcucuacaagauccucgagucccaccaguucuccccccacaaccacgccaagcuccagcagcucuggcucaaggcccacuacaucgaggccgagaagcuccgcggccgcccccucggcgccgucggcaaguaccgcguccgccgcaaguucccccucccccgcuccaucugggacggcgaggagaccuccuacugcuucaaggagaagucccgcuccguccuccgcgagugguacgcccacaaccccuaccccuccccccgcgagaagcgcgagcucgccgaggccaccggccucaccaccacccaggucuccaacugguucaagaaccgccgccagcgcgaccgcgccgccgaggccaaggagcgcgagaacaacgagaacuccaacuccaacucccacaacccccucaacggcuccggcaaguccguccucggcuccuccgaggacgagaagacccccuccggcacccccgaccacuccuccuccucccccgcccuccuccucuccccccccccccccggccuccccucccuccacucccucggccacccccccggccccuccgccguccccguccccguccccggcggcggcggcgccgacccccuccagcaccaccacggccuccaggacuccauccucaaccccauguccgccaaccucgucgaccucggcuccuga

SEQ ID NO: 49475 - RNA, 999 nt, Artificial Sequence
  derived and/or modified sequence opt2 from SIX3__Homo_sapiens__NP_005404
auggucuuccgcuccccccucgaccucuacuccucccacuuccuccuccccaacuucgccgacucccaccaccgcuccauccuccucgccuccuccggcggcggcaacggcgccggcggcggcggcggcgccggcggcggcuccggcggcggcaacggcgccggcggcggcggcgccggcggcgccggcggcggcggcggcggcggcucccgcgccccccccgaggagcucuccauguuccagcuccccacccucaacuucucccccgagcaggucgccuccgucugcgagacccucgaggagaccggcgacaucgagcgccucggccgcuuccucuggucccuccccgucgcccccggcgccugcgaggccaucaacaagcacgaguccauccuccgcgcccgcgccgucgucgccuuccacaccggcaacuuccgcgaccucuaccacauccucgagaaccacaaguucaccaaggagucccacggcaagcuccaggccauguggcucgaggcccacuaccaggaggccgagaagcuccgcggccgcccccucggccccgucgacaaguaccgcguccgcaagaaguucccccucccccgcaccaucugggacggcgagcagaagacccacugcuucaaggagcgcacccgcucccuccuccgcgagugguaccuccaggaccccuaccccaaccccuccaagaagcgcgagcucgcccaggccaccggccucacccccacccaggucggcaacugguucaagaaccgccgccagcgcgaccgcgccgccgccgccaagaaccgccuccagcaccaggccaucggccccuccggcaugcgcucccucgccgagcccggcugccccacccacggcuccgccgagucccccuccaccgccgccucccccaccaccuccgucuccucccucaccgagcgcgccgacaccggcaccuccauccucuccgucaccuccuccgacuccgagugcgacgucuga

SEQ ID NO: 49476 - RNA, 2346 nt, Artificial Sequence
  derived and/or modified sequence opt2 from SIX4__Homo_sapiens__NP_059116
auguccuccuccucccccaccggccagaucgccuccgccgccgacaucaagcaggagaacggcauggaguccgccuccgagggccaggaggcccaccgcgaggucgccggcggcgccgccgucggccucuccccccccgcccccgcccccuucccccucgagcccggcgacgccgccaccgccgccgcccgcgucuccggcgaggagggcgccgucgccgccgccgccgccggcgccgccgccgaccagguccagcuccacuccgagcuccucggccgccaccaccacgccgccgccgccgccgcccagaccccccucgccuucucccccgaccacgucgccugcgucugcgaggcccuccagcagggcggcaaccucgaccgccucgcccgcuuccucuggucccucccccaguccgaccuccuccgcggcaacgagucccuccucaaggcccgcgcccucgucgccuuccaccagggcaucuaccccgagcucuacuccauccucgagucccacuccuucgaguccgccaaccacccccuccuccagcagcucugguacaaggcccgcuacaccgaggccgagcgcgcccgcggccgcccccucggcgccgucgacaaguaccgccuccgccgcaaguucccccucccccgcaccaucugggacggcgaggagaccgucuacugcuucaaggagaagucccgcaacgcccucaaggagcucuacaagcagaaccgcuaccccucccccgccgagaagcgccaccucgccaagaucaccggccucucccucacccaggucuccaacugguucaagaaccgccgccagcgcgaccgcaaccccuccgagacccaguccaaguccgaguccgacggcaaccccuccaccgaggacgaguccuccaagggccacgaggaccucuccccccacccccucuccuccuccuccgacggcaucaccaaccucucccucuccucccacauggagcccgucuacaugcagcagaucggcaacgccaagaucucccucuccuccuccggcguccuccucaacggcucccucguccccgccuccaccucccccgucuuccucaacggcaacuccuucauccagggccccuccggcgucauccucaacggccucaacgucggcaacacccaggccgucgcccucaacccccccaagauguccuccaacaucgucuccaacggcaucuccaugaccgacauccucggcuccaccucccaggacgucaaggaguucaagguccuccaguccuccgccaacuccgccaccaccaccuccuacucccccuccguccccgucuccuuccccggccucauccccuccaccgaggucaagcgcgagggcauccagaccgucgccucccaggacggcggcuccgucgucaccuucaccacccccguccagaucaaccaguacggcaucguccagauccccaacuccggcgccaacucccaguuccucaacggcuccaucggcuucuccccccuccagcucccccccgucuccgucgccgccucccagggcaacaucuccgucuccuccuccaccuccgacggcuccaccuucaccuccgaguccaccaccguccagcagggcaaggucuuccucuccucccucgcccccuccgccgucgucuacaccguccccaacaccggccagaccaucggcuccgucaagcaggagggccucgagcgcucccucgucuucucccagcucaugcccgucaaccagaacgcccaggucaacgccaaccucuccuccgagaacaucuccggcuccggccuccacccccucgccuccucccucgucaacgucucccccacccacaacuucucccucucccccuccacccuccucaaccccaccgagcucaaccgcgacaucgccgacucccagcccauguccgcccccgucgccuccaaguccaccgucaccuccgucuccaacaccaacuacgccacccuccagaacugcucccucaucaccggccaggaccuccucuccguccccaugacccaggccgcccucggcgagaucguccccaccgccgaggaccaggucggccaccccucccccgccguccaccaggacuucguccaggagcaccgccucguccuccaguccgucgccaacaugaaggagaacuuccucuccaacuccgaguccaaggccaccuccucccucaugaugcucgacuccaaguccaaguacguccucgacggcauggucgacaccgucugcgaggaccucgagaccgacaagaaggagcucgccaagcuccagaccguccagcucgacgaggacaugcaggaccucuga

SEQ ID NO: 49477 - RNA, 2220 nt, Artificial Sequence
  derived and/or modified sequence opt2 from SIX5__Homo_sapiens__NP_787071
auggccacccuccccgccgagcccuccgccggccccgccgccggcggcgaggccgucgccgccgccgccgccaccgaggaggaggaggaggaggcccgccagcuccuccagacccuccaggccgccgagggcgaggccgccgccgccgccggcgccggcgccggcgccgccgccgccggcgccgagggccccggcucccccggcguccccggcuccccccccgaggccgccuccgagccccccaccggccuccgcuucucccccgagcaggucgccugcgucugcgaggcccuccuccaggccggccacgccggccgccucucccgcuuccucggcgcccucccccccgccgagcgccuccgcggcuccgaccccguccuccgcgcccgcgcccucgucgccuuccagcgcggcgaguacgccgagcucuaccgccuccucgagucccgccccuuccccgccgcccaccacgccuuccuccaggaccucuaccuccgcgcccgcuaccacgaggccgagcgcgcccgcggccgcgcccucggcgccgucgacaaguaccgccuccgcaagaaguucccccuccccaagaccaucugggacggcgaggagaccgucuacugcuucaaggagcgcucccgcgccgcccucaaggccugcuaccgcggcaaccgcuaccccacccccgacgagaagcgccgccucgccacccucaccggccucucccucacccaggucuccaacugguucaagaaccgccgccagcgcgaccgcaccggcgccggcggcggcgcccccugcaaguccgaguccgacggcaaccccaccaccgaggacgaguccucccgcucccccgaggaccucgagcgcggcgccgcccccgucuccgccgaggccgccgcccagggcuccaucuuccucgccggcaccggcccccccgcccccugccccgccuccuccuccauccucgucaacggcuccuuccucgccgccuccggcucccccgccguccuccucaacggcggccccgucaucaucaacggccucgcccucggcgaggccuccucccucggcccccuccuccucaccggcggcggcggcgccccccccccccagcccuccccccagggcgccuccgagaccaagaccucccucguccucgacccccagaccggcgagguccgccucgaggaggcccaguccgaggcccccgagaccaagggcgcccaggucgccgcccccggccccgcccucggcgaggagguccucggcccccucgcccaggucguccccggcccccccaccgccgccaccuucccccucccccccggccccguccccgccgucgccgccccccaggucgucccccucucccccccccccggcuaccccaccggccucucccccaccuccccccuccucaaccucccccaggucguccccaccucccaggucgucacccucccccaggccgucggcccccuccagcuccucgccgccggccccggcucccccgucaaggucgccgccgccgccggccccgccaacguccaccucaucaacuccggcgucggcgucaccgcccuccagcuccccuccgccaccgcccccggcaacuuccuccucgccaaccccgucuccggcucccccaucgucaccggcgucgccguccagcagggcaagaucauccucaccgccaccuuccccaccuccaugcucgucucccagguccucccccccgcccccggccucgcccucccccucaagcccgagaccgccaucuccguccccgagggcggccuccccgucgcccccucccccgcccuccccgaggcccacgcccucggcacccucuccgcccagcagcccccccccgccgccgccaccaccuccuccaccucccuccccuucucccccgacucccccggccuccuccccaacuuccccgcccccccccccgagggccucaugcucucccccgccgccguccccgucugguccgccggccucgagcucuccgccggcaccgagggccuccucgaggccgagaagggccucggcacccaggccccccacaccguccuccgccuccccgaccccgaccccgagggccuccuccucggcgccaccgccggcggcgaggucgacgagggccucgaggccgaggccaagguccucacccagcuccaguccguccccgucgaggagccccucgagcucuga

SEQ ID NO: 49478 - RNA, 741 nt, Artificial Sequence
  derived and/or modified sequence opt2 from SIX6__Homo_sapiens__NP_031400
auguuccagcuccccauccucaacuucuccccccagcaggucgccggcgucugcgagacccucgaggaguccggcgacgucgagcgccucggccgcuuccucuggucccuccccgucgcccccgccgccugcgaggcccucaacaagaacgaguccguccuccgcgcccgcgccaucgucgccuuccacggcggcaacuaccgcgagcucuaccacauccucgagaaccacaaguucaccaaggagucccacgccaagcuccaggcccucuggcucgaggcccacuaccaggaggccgagaagcuccgcggccgcccccucggccccgucgacaaguaccgcguccgcaagaaguucccccucccccgcaccaucugggacggcgagcagaagacccacugcuucaaggagcgcacccgccaccuccuccgcgagugguaccuccaggaccccuaccccaaccccuccaagaagcgcgagcucgcccaggccaccggccucacccccacccaggucggcaacugguucaagaaccgccgccagcgcgaccgcgccgccgccgccaagaaccgccuccagcagcagguccucucccagggcuccggccgcgcccuccgcgccgagggcgacggcacccccgagguccucggcgucgccaccucccccgccgccucccucuccuccaaggccgccaccuccgccaucuccaucaccuccuccgacuccgagugcgacaucuga

SEQ ID NO: 49479 - RNA, 768 nt, Artificial Sequence
  derived and/or modified sequence opt2 from SKA1__Homo_sapiens__NP_001034624
auggccuccuccgaccucgagcagcucugcucccacgucaacgagaagaucggcaacaucaagaagacccucucccuccgcaacugcggccaggagcccacccucaagaccguccucaacaagaucggcgacgagaucaucgucaucaacgagcuccucaacaagcucgagcucgagauccaguaccaggagcagaccaacaacucccucaaggagcucugcgagucccucgaggaggacuacaaggacaucgagcaccucaaggagaacguccccucccaccucccccaggucaccgucacccaguccugcgucaagggcuccgaccucgaccccgaggagcccaucaaggucgaggagcccgagcccgucaagaagccccccaaggagcagcgcuccaucaaggagaugcccuucaucaccugcgacgaguucaacggcguccccuccuacaugaagucccgccucaccuacaaccagaucaacgacgucaucaaggagaucaacaaggccgucaucuccaaguacaagauccuccaccagcccaagaaguccaugaacuccgucacccgcaaccucuaccaccgcuucaucgacgaggagaccaaggacaccaagggccgcuacuucaucgucgaggccgacaucaaggaguucaccacccucaaggccgacaagaaguuccacguccuccucaacauccuccgccacugccgccgccucuccgagguccgcggcggcggccucacccgcuacgucaucaccuga

SEQ ID NO: 49480 - RNA, 228 nt, Artificial Sequence
  derived and/or modified sequence opt2 from SKA2__Homo_sapiens__NP_001094065
auggccuccgaggucggccacaaccucgagucccccgagacccccggcggcggcggcuggacccgcgucgaguuccccccccccgcccccaagggcgccgccaccgucuggugccucaaccgccucggcucccgcaagcucucccucaucuggaucaccuucaacaccggcuggaacaugaagucccgccucaucauccucauccagcaggucuccugccaccacuga

SEQ ID NO: 49481 - RNA, 1080 nt, Artificial Sequence
  derived and/or modified sequence opt2 from SKAP1__Homo_sapiens__NP_003717
augcaggccgccgcccuccccgaggagauccgcuggcuccucgaggacgccgaggaguuccucgccgagggccuccgcaacgagaaccucuccgccgucgcccgcgaccaccgcgaccacauccuccgcggcuuccagcagaucaaggcccgcuacuacugggacuuccagccccagggcggcgacaucggccaggacuccuccgacgacaaccacuccggcacccucggccucucccucaccuccgacgcccccuuccucuccgacuaccaggacgagggcauggaggacaucgucaagggcgcccaggagcucgacaacgucaucaagcagggcuaccucgagaagaaguccaaggaccacuccuucuucggcuccgaguggcagaagcgcuggugcgucgucucccgcggccucuucuacuacuacgccaacgagaaguccaagcagcccaagggcaccuuccucaucaagggcuacggcguccgcauggccccccaccuccgccgcgacuccaagaaggaguccugcuucgagcucaccucccaggaccgccgcuccuacgaguucaccgccaccucccccgccgaggcccgcgacugggucgaccagaucuccuuccuccucaaggaccucuccucccucaccauccccuacgaggaggacgaggaggaggaggagaaggaggagaccuacgacgacaucgacggcuucgacucccccuccugcggcucccagugccgccccaccauccuccccggcuccgucggcaucaaggagcccaccgaggagaaggaggaggaggacaucuacgagguccuccccgacgaggagcacgaccucgaggaggacgaguccggcacccgccgcaagggcgucgacuacgccuccuacuaccagggccucugggacugccacggcgaccagcccgacgagcucuccuuccagcgcggcgaccucauccgcauccucuccaaggaguacaacauguacggcuggugggucggcgagcucaacucccucgucggcaucguccccaaggaguaccucaccaccgccuucgaggucgaggagcgcuga

SEQ ID NO: 49482 - RNA, 564 nt, Artificial Sequence
  derived and/or modified sequence opt2 from SKAP2__Homo_sapiens__NP_001290397
augaacaacacccuccgcaaggacggcaagaaggacugcugcuucgagaucuccgcccccgacaagcgcaucuaccaguucaccgccgccucccccaaggacgccgaggaguggguccagcagcucaaguucguccuccaggacauggaguccgacaucauccccgaggacuacgacgagcgcggcgagcucuacgacgacgucgaccacccccuccccaucuccaacccccucaccuccucccagcccaucgacgacgagaucuacgaggagcuccccgaggaggaggaggacuccgcccccgucaaggucgaggagcagcgcaagaugucccaggacuccguccaccacaccuccggcgacaaguccaccgacuacgccaacuucuaccagggccucugggacugcaccggcgccuucuccgacgagcucuccuucaagcgcggcgacgucaucuacauccucuccaaggaguacaaccgcuacggcuggugggucggcgagaugaagggcgccaucggccucguccccaaggccuacaucauggagauguacgacaucuga

SEQ ID NO: 49483 - RNA, 1917 nt, Artificial Sequence
  derived and/or modified sequence opt2 from SKIL__Homo_sapiens__NP_001138569
auggagaaccuccagaccaacuucucccucguccagggcuccaccaagaagcucaacggcaugggcgacgacggcuccccccccgccaagaagaugaucaccgacauccacgccaacggcaagaccaucaacaagguccccaccgucaagaaggagcaccucgacgacuacggcgaggcccccgucgagaccgacggcgagcacgucaagcgcaccugcaccuccguccccgagacccuccaccucaaccccucccucaagcacacccucgcccaguuccaccucuccucccaguccucccucggcggccccgccgccuucuccgcccgccacucccaggaguccaugucccccaccgucuuccucccccuccccuccccccagguccuccccggcccccuccucauccccuccgacuccuccaccgagcucacccagaccguccucgagggcgaguccaucuccugcuuccaggucggcggcgagaagcgccucugccucccccagguccucaacuccguccuccgcgaguucacccuccagcagaucaacaccgucugcgacgagcucuacaucuacugcucccgcugcaccuccgaccagcuccacauccucaagguccucggcauccuccccuucaacgcccccuccugcggccucaucacccucaccgacgcccagcgccucugcaacgcccuccuccgcccccgcaccuucccccagaacggcuccguccuccccgccaaguccucccucgcccagcucaaggagaccggcuccgccuucgaggucgagcacgagugccucggcaagugccagggccucuucgccccccaguucuacguccagcccgacgcccccugcauccagugccucgagugcugcggcauguucgccccccagaccuucgucaugcacucccaccgcucccccgacaagcgcaccugccacuggggcuucgaguccgccaaguggcacugcuaccuccacgucaaccagaaguaccucggcacccccgaggagaagaagcucaagaucauccucgaggagaugaaggagaaguucuccaugcgcuccggcaagcgcaaccaguccaagaccgacgcccccuccggcauggagcuccaguccugguaccccgucaucaagcaggagggcgaccacgucucccagacccacuccuuccuccaccccuccuacuaccucuacaugugcgacaaggucgucgcccccaacgucucccucaccuccgccgucucccaguccaaggagcucaccaagaccgaggccaacgccuccaucuccaacaacuccaccuccaagcgcaaguccgaguccgccaccugcaaccucguccgcgacaucaacaaggucggcaucggccucgucgccgccgccuccuccccccuccucgucaaggacgucaucugcgaggacgacaagggcaagaucauggaggaggucaugcgcaccuaccucaagcagcaggagaagcucaaccucauccuccagaagaagcagcagcuccagauggaggucaagaugcucuccuccuccaaguccaugaaggagcucaccgaggagcagcagaaccuccagaaggagcucgagucccuccagaacgagcacgcccagcgcauggaggaguucuacgucgagcagaaggaccucgagaagaagcucgagcagaucaugaagcagaagugcaccugcgacuccaaccucgagaaggacaaggaggccgaguacgccggccagcucgccgagcuccgccagcgccucgaccacgccgaggccgaccgccaggagcuccaggacgagcuccgccaggagcgcgaggcccgccagaagcucgagaugaugaucaaggagcucaagcuccagauccucaaguccuccaagaccgccaaggaguga

SEQ ID NO: 49484 - RNA, 3129 nt, Artificial Sequence
  derived and/or modified sequence opt2 from SKIV2L2__Homo_sapiens__NP_056175
auggccgacgccuucggcgacgagcucuucuccgucuucgagggcgacuccaccaccgccgccggcaccaagaaggacaaggagaaggacaagggcaaguggaagggcccccccggcuccgccgacaaggccggcaagcgcuucgacggcaagcuccaguccgaguccaccaacaacggcaagaacaagcgcgacgucgacuucgagggcaccgacgagcccaucuucggcaagaagccccgcaucgaggaguccaucaccgaggaccucucccucgccgaccucaugccccgcgucaagguccaguccgucgagaccgucgagggcugcacccacgaggucgcccuccccgccgaggaggacuaccucccccucaagccccgcgucggcaaggccgccaaggaguaccccuucauccucgacgccuuccagcgcgaggccauccagugcgucgacaacaaccaguccguccucgucuccgcccacaccuccgccggcaagaccgucugcgccgaguacgccaucgcccucgcccuccgcgagaagcagcgcgucaucuucaccucccccaucaaggcccucuccaaccagaaguaccgcgagauguacgaggaguuccaggacgucggccucaugaccggcgacgucaccaucaaccccaccgccuccugccucgucaugaccaccgagauccuccgcuccaugcucuaccgcggcuccgaggucaugcgcgaggucgccugggucaucuucgacgagauccacuacaugcgcgacuccgagcgcggcgucgucugggaggagaccaucauccuccuccccgacaacguccacuacgucuuccucuccgccaccauccccaacgcccgccaguucgccgaguggaucugccaccuccacaagcagcccugccacgucaucuacaccgacuaccgccccaccccccuccagcacuacaucuuccccgccggcggcgacggccuccaccucgucgucgacgagaacggcgacuuccgcgaggacaacuucaacaccgccaugcagguccuccgcgacgccggcgaccucgccaagggcgaccagaagggccgcaagggcggcaccaagggccccuccaacgucuucaagaucgucaagaugaucauggagcgcaacuuccagcccgucaucaucuucuccuucuccaagaaggacugcgaggccuacgcccuccagaugaccaagcucgacuucaacaccgacgaggagaagaagauggucgaggaggucuucuccaacgccaucgacugccucuccgacgaggacaagaagcucccccaggucgagcacguccucccccuccucaagcgcggcaucggcauccaccacggcggccuccuccccauccucaaggagaccaucgagauccucuucuccgagggccucaucaaggcccucuucgccaccgagaccuucgccaugggcaucaacaugcccgcccgcaccguccucuucaccaacgcccgcaaguucgacggcaaggacuuccgcuggaucuccuccggcgaguacauccagauguccggccgcgccggccgccgcggcauggacgaccgcggcaucgucauccucauggucgacgagaagaugucccccaccaucggcaagcagcuccucaagggcuccgccgacccccucaacuccgccuuccaccucaccuacaacaugguccucaaccuccuccgcgucgaggagaucaaccccgaguacaugcucgagaaguccuucuaccaguuccagcacuaccgcgccauccccggcgucgucgagaaggucaagaacuccgaggagcaguacaacaagaucgucauccccaacgaggaguccgucgucaucuacuacaagauccgccagcagcucgccaagcucggcaaggagaucgaggaguacauccacaagcccaaguacugccuccccuuccuccagcccggccgccucgucaaggucaagaacgagggcgacgacuucggcuggggcgucgucgucaacuucuccaagaaguccaacgucaagcccaacuccggcgagcucgacccccucuacgucgucgagguccuccuccgcugcuccaaggagucccucaagaacuccgccaccgaggccgccaagcccgccaagcccgacgagaagggcgagaugcaggucguccccguccucguccaccuccucuccgccaucuccuccguccgccucuacauccccaaggaccuccgccccgucgacaaccgccaguccguccucaaguccauccaggagguccagaagcgcuuccccgacggcaucccccuccucgaccccaucgacgacaugggcauccaggaccagggccucaagaaggucauccagaaggucgaggccuucgagcaccgcauguacucccacccccuccacaacgaccccaaccucgagaccgucuacacccucugcgagaagaaggcccagaucgccaucgacaucaaguccgccaagcgcgagcucaagaaggcccgcaccguccuccagauggacgagcucaagugccgcaagcgcguccuccgccgccucggcuucgccaccuccuccgacgucaucgagaugaagggccgcgucgccugcgagaucuccuccgccgacgagcuccuccucaccgagaugauguucaacggccucuucaacgaccucuccgccgagcaggccaccgcccuccucuccugcuucgucuuccaggagaacuccuccgagaugcccaagcucaccgagcagcucgccggcccccuccgccagaugcaggagugcgccaagcgcaucgccaaggucuccgccgaggccaagcucgagaucgacgaggagaccuaccucuccuccuucaagccccaccucauggacgucgucuacaccugggccaccggcgccaccuucgcccacaucugcaagaugaccgacgucuucgagggcuccaucauccgcugcaugcgccgccucgaggagcuccuccgccagaugugccaggccgccaaggccaucggcaacaccgagcucgagaacaaguucgccgagggcaucaccaagaucaagcgcgacaucgucuucgccgccucccucuaccucuga

SEQ ID NO: 49485 - RNA, 3741 nt, Artificial Sequence
  derived and/or modified sequence opt2 from SKIV2L__Homo_sapiens__NP_008860
augauggagaccgagcgccucguccuccccccccccgacccccucgaccucccccuccgcgccgucgagcucggcugcaccggccacugggagcuccucaaccuccccggcgcccccgaguccucccucccccacggccucccccccugcgcccccgaccuccagcaggaggccgagcagcucuuccucuccucccccgccuggcucccccuccacggcgucgagcacuccgcccgcaaguggcagcgcaagaccgaccccuggucccuccucgccguccucggcgcccccguccccuccgaccuccaggcccagcgccaccccaccaccggccagauccucggcuacaaggagguccuccucgagaacaccaaccucuccgccaccaccucccucucccuccgccgcccccccggccccgccucccagucccucuggggcaaccccacccaguaccccuucuggcccggcggcauggacgagcccaccaucaccgaccucaacacccgcgaggaggccgaggaggagaucgacuucgagaaggaccuccucaccaucccccccggcuucaagaagggcauggacuucgcccccaaggacugccccacccccgcccccggccuccucucccucuccugcaugcucgagccccucgaccucggcggcggcgacgaggacgagaacgaggccgucggccagcccggcggcccccgcggcgacaccgucuccgccucccccugcuccgccccccucgcccgcgccuccucccucgaggaccucguccucaaggaggccuccaccgccgucuccacccccgaggcccccgagccccccucccaggagcagugggccauccccgucgacgccaccucccccgucggcgacuucuaccgccucaucccccagcccgccuuccagugggccuucgagcccgacgucuuccagaagcaggccauccuccaccucgagcgccacgacuccgucuucgucgccgcccacaccuccgccggcaagaccgucgucgccgaguacgccaucgcccucgcccagaagcacaugacccgcaccaucuacaccucccccaucaaggcccucuccaaccagaaguuccgcgacuuccgcaacaccuucggcgacgucggccuccucaccggcgacguccagcuccaccccgaggccuccugccucaucaugaccaccgagauccuccgcuccaugcucuacuccggcuccgacgucauccgcgaccucgagugggucaucuucgacgagguccacuacaucaacgacgucgagcgcggcgucgucugggaggagguccucaucaugcuccccgaccacgucuccaucauccuccucuccgccaccguccccaacgcccucgaguucgccgacuggaucggccgccucaagcgccgccagaucuacgucaucuccaccgucacccgccccgucccccucgagcacuaccucuucaccggcaacuccuccaagacccagggcgagcucuuccuccuccucgacucccgcggcgccuuccacaccaagggcuacuacgccgccgucgaggccaagaaggagcgcauguccaagcacgcccagaccuucggcgccaagcagcccacccaccagggcggccccgcccaggaccgcggcgucuaccucucccuccucgccucccuccgcacccgcgcccagcuccccgucgucgucuucaccuucucccgcggccgcugcgacgagcaggccuccggccucaccucccucgaccucaccaccuccuccgagaaguccgagauccaccucuuccuccagcgcugccucgcccgccuccgcggcuccgaccgccagcucccccagguccuccacauguccgagcuccucaaccgcggccucggcguccaccacuccggcauccuccccauccucaaggagaucgucgagaugcucuucucccgcggccucgucaagguccucuucgccaccgagaccuucgccaugggcgucaacaugcccgcccgcaccgucgucuucgacuccaugcgcaagcacgacggcuccaccuuccgcgaccuccuccccggcgaguacguccagauggccggccgcgccggccgccgcggccucgaccccaccggcaccgucauccuccucugcaagggccgcguccccgagauggccgaccuccaccgcaugaugaugggcaagcccucccagcuccagucccaguuccgccucaccuacaccaugauccucaaccuccuccgcgucgacgcccuccgcgucgaggacaugaugaagcgcuccuucuccgaguuccccucccgcaaggacuccaaggcccacgagcaggcccucgccgagcucaccaagcgccucggcgcccucgaggagcccgacaugaccggccagcucgucgaccuccccgaguacuacuccuggggcgaggagcucaccgagacccagcacaugauccagcgccgcaucauggaguccgucaacggccucaagucccucuccgccggccgcgucgucgucgucaagaaccaggagcaccacaacgcccucggcgucauccuccaggucuccuccaacuccaccucccgcgucuucaccacccucguccucugcgacaagccccucucccaggacccccaggaccgcggccccgccaccgccgagguccccuaccccgacgaccucgucggcuucaagcucuuccuccccgagggccccugcgaccacaccgucgucaagcuccagcccggcgacauggccgccaucaccaccaagguccuccgcgucaacggcgagaagauccucgaggacuucuccaagcgccagcagcccaaguucaagaaggaccccccccucgccgccgucaccaccgccguccaggagcuccuccgccucgcccaggcccaccccgccggcccccccacccucgaccccgucaacgaccuccagcucaaggacauguccgucgucgagggcggccuccgcgcccgcaagcucgaggagcucauccagggcgcccagugcguccacuccccccgcuuccccgcccaguaccucaagcuccgcgagcgcaugcagauccagaaggagauggagcgccuccgcuuccuccucuccgaccagucccuccuccuccuccccgaguaccaccagcgcgucgagguccuccgcacccucggcuacgucgacgaggccggcaccgucaagcucgccggccgcgucgccugcgccauguccucccacgagcuccuccucaccgagcucauguucgacaacgcccucuccacccuccgccccgaggagaucgccgcccuccucuccggccucgucugccagucccccggcgacgccggcgaccagcuccccaacacccucaagcagggcaucgagcgcguccgcgccgucgccaagcgcaucggcgagguccaggucgccugcggccucaaccagaccgucgaggaguucgucggcgagcucaacuucggccucgucgaggucgucuacgagugggcccgcggcaugcccuucuccgagcucgccggccucuccggcacccccgagggccucgucguccgcugcauccagcgccucgccgagaugugccgcucccuccgcggcgccgcccgccucgucggcgagcccguccucggcgccaagauggagaccgccgccacccuccuccgccgcgacaucgucuucgccgccucccucuacacccaguga

SEQ ID NO: 49486 - RNA, 2607 nt, Artificial Sequence
  derived and/or modified sequence opt2 from SKOR1__Homo_sapiens__NP_001244953
augauccccaagucccucguccaggccgccgagacccagcgcggccucugcgagcccggcggcaagggccgcgagggccgcuccggcggcaagggcgagacccgcccccgcggcgucggcacccaggagggcaagggcaccauccccggcuccccccgcgagaagcgcggcgagcgcggcgagggcgaccccgcccuccuccccgccgaggaccucuggcgccuccccggcuccaaggaccgccuccgcuccucccuccuccccccccccggcccccccuccuccgacuccggccccggcccccccuccucccacuccggcaagaccgcccagggcccccgcacccucaacugggcccgcaagcaguccgcccgcaccuccuccaaccucugcgccuggucccucgccauggccaccaagauggccgagauccccuccucccccuacgagcccggccagcgcggcaugaaggacacccagcgcggcgacgccccccagcgcggcucccccgagccccgcauccuccagcucgcccgcgucggcaacgucuaccucaaggaggaguccucccgcuccggccgccucgaggccaagaaguggauccccaccaaguuccucgagaaccucuccgucccccacgucgaccucggcggcaaccagcucugguccggcggcauggaggcccucaccacccagcucggccccggccgcgagggcuccuccucccccaacuccaagcaggagcuccagcccuacuccggcuccuccgcccucaagcccaaccaggucggcgagaccucccucuacggcguccccaucgucucccucgucaucgacggccaggagcgccucugccucgcccagaucuccaacacccuccucaagaacuacuccuacaacgagauccacaaccgccgcgucgcccucggcaucaccugcguccagugcacccccguccagcucgagauccuccgccgcgccggcgccaugcccaucuccucccgccgcugcggcaugaucaccaagcgcgaggccgagcgccucugcaaguccuuccucggcgagcacaagccccccaagcuccccgagaacuucgccuucgacgucguccacgagugcgccuggggcucccgcggcuccuucauccccgcccgcuacaacuccucccgcgccaagugcaucaagugcggcuacugcuccauguacuucucccccaacaaguucaucuuccacucccaccgcacccccgacgccaaguacacccagcccgacgccgccaacuucaacuccuggcgccgccaccucaagcucuccgacaaguccgccaccgacgagcucucccacgccugggaggaccgcggccucggccucgccaccggcgccuccggccccgccggccccggcggccccggcggcggcgccggcguccgcuccuaccccgucauccccguccccuccaagggcuucggccuccuccagaagcucccccccccccucuucccccaccccuacggcuuccccaccgccuucggccucugccccaagaaggacgaccccguccucggcgccggcgagcccaagggcggcuccuacgucuccgccuuccgccccgucgucaaggacaccgaguccaucgccaagcucuacggcuccgcccgcgaggccuacggcgccggccccgcccgcggccccggccccggcgccggcuccggcggcuacgucucccccgacuuccucuccgagggcuccuccuccuacaacuccgccucccccgacgucgacaccgccgacgagcccgaggucgacgucgaguccaaccgcuuccccgacgacgaggacgcccaggaggagaccgagcccuccgcccccuccgccggcggcggccccgacgccggccgccccgccuucggcgaccucgccgccgaggaccucguccgccgccccgagcgcuccccccccuccggcggcggcggcuacgagcuccgcgagcccugcggcccccucggcggccccgcccccgccaaggucuucgcccccgagcgcgacgagcacgucaaguccgccgccgucgcccucggccccgccgccuccuacgucugcacccccgaggcccacgagcccgacaaggaggacaaccacucccccgccgacgaccucgagacccgcaaguccuaccccgaccagcgcuccaucucccagcccucccccgccaacaccgaccgcggcgaggacggccucacccucgacgucaccggcacccaccucgucgagaaggacaucgagaaccucgcccgcgaggagcuccagaagcuccuccucgagcagauggagcuccgcaagaagcucgagcgcgaguuccagucccucaaggacaacuuccaggaccagaugaagcgcgagcucgccuaccgcgaggagaugguccagcagcuccagaucguccgcgacacccucugcaacgagcucgaccaggagcgcaaggcccgcuacgccauccagcagaagcucaaggaggcccacgacgcccuccaccacuucuccugcaagaugcucaccccccgccacugcaccggcaacugcuccuucaagcccccccuccuccccuga

SEQ ID NO: 49487 - RNA, 891 nt, Artificial Sequence
  derived and/or modified sequence opt2 from SKOR2__Homo_sapiens__NP_001032891
auggccuccuccccccuccccggccccaacgacauccuccucgccucccccuccuccgccuuccagcccgacacccucucccagccccgccccggccacgccaaccucaagcccaaccaggucggccaggucauccucuacggcauccccaucgucucccucgucaucgacggccaggagcgccucugccucgcccagaucuccaacacccuccucaagaacuucuccuacaacgagauccacaaccgccgcgucgcccucggcaucaccugcguccagugcacccccguccagcucgagauccuccgccgcgccggcgccaugcccaucuccucccgccgcugcggcaugaucaccaagcgcgaggccgagcgccucugcaaguccuuccucggcgagaaccgcccccccaagcuccccgacaacuucgccuucgacgucucccacgagugcgccuggggcugccgcggcuccuucauccccgcccgcuacaacuccucccgcgccaagugcaucaagugcuccuacugcaacauguacuucucccccaacaaguucaucuuccacucccaccgcacccccgacgccaaguacacccagcccgacgccgccaacuucaacuccuggcgccgccaccucaagcucaccgacaaguccccccaggacgagcucgucuucgccugggaggacgucaaggccauguucaacggcggcucccgcaagcgcgcccucccccagcccggcgcccaccccgccugccacccccucuccuccauccgcacccgcuccaucgccuucuccucccagacccucaugcuccucgaggagaucuucggcgagaaggaccaggaggacuacaugcgcaucaacgaggacaacaucuggcucuga

SEQ ID NO: 49488 - RNA, 483 nt, Artificial Sequence
  derived and/or modified sequence opt2 from SKP1__Homo_sapiens__NP_008861
augcccuccaucaagcuccaguccuccgacggcgagaucuucgaggucgacgucgagaucgccaagcaguccgucaccaucaagaccaugcucgaggaccucggcauggacgacgagggcgacgacgaccccgucccccuccccaacgucaacgccgccauccucaagaaggucauccaguggugcacccaccacaaggacgacccccccccccccgaggacgacgagaacaaggagaagcgcaccgacgacauccccgucugggaccaggaguuccucaaggucgaccagggcacccucuucgagcucauccucgccgccaacuaccucgacaucaagggccuccucgacgucaccugcaagaccgucgccaacaugaucaagggcaagacccccgaggagauccgcaagaccuucaacaucaagaacgacuucaccgaggaggaggaggcccaggucggcuccacccaguucugccucuga

SEQ ID NO: 49489 - RNA, 633 nt, Artificial Sequence
  derived and/or modified sequence opt2 from SKP2__Homo_sapiens__NP_001230049
auggaccagccccucgccgagcacuucuccacccucgccaagaacuccaaccucguccgccucaaccucuccggcugcuccggcuucuccgaguucgcccuccagacccuccucuccuccugcucccgccucgacgagcucaaccucuccuggugcuucgacuucaccgagaagcacguccaggucgccgucgcccacgucuccgagaccaucacccagcucaaccucuccggcuaccgcaagaaccuccagaaguccgaccucuccacccucguccgccgcugccccaaccucguccaccucgaccucuccgacuccgucaugcucaagaacgacugcuuccaggaguucuuccagcucaacuaccuccagcaccucucccucucccgcugcuacgacaucauccccgagacccuccucgagcucggcgagauccccacccucaagacccuccaggucuucggcaucguccccgacggcacccuccagcuccucaaggaggcccucccccaccuccagaucaacugcucccacuucaccaccaucgcccgccccaccaucggcaacaagaagaaccaggagaucuggggcaucaagugccgccucacccuccagaagcccuccugccucuga

SEQ ID NO: 49490 - RNA, 786 nt, Artificial Sequence
  derived and/or modified sequence opt2 from SLA2__Homo_sapiens__NP_115590
augggcucccuccccucccgccgcaagucccuccccucccccucccucuccuccuccguccagggccagggccccgucaccauggaggccgagcgcuccaaggccaccgccgucgcccucggcuccuuccccgccggcggccccgccgagcucucccuccgccucggcgagccccucaccaucgucuccgaggacggcgacugguggaccguccucuccgaggucuccggccgcgaguacaacauccccuccguccacgucgccaaggucucccacggcuggcucuacgagggccucucccgcgagaaggccgaggagcuccuccuccuccccggcaaccccggcggcgccuuccucauccgcgagucccagacccgccgcggcuccuacucccucuccguccgccucucccgccccgccuccugggaccgcauccgccacuaccgcauccacugccucgacaacggcuggcucuacaucuccccccgccucaccuuccccucccuccaggcccucgucgaccacuacuccgagcucgccgacgacaucugcugccuccucaaggagcccugcguccuccagcgcgccggcccccuccccggcaaggacaucccccuccccgucaccguccagcgcaccccccucaacuggaaggagcucgacuccucccuccucuucuccgaggccgccaccggcgaggagucccuccucuccgagggccuccgcgagucccucuccuucuacaucucccucaacgacgaggccgucucccucgacgacgccuga

SEQ ID NO: 49491 - RNA, 831 nt, Artificial Sequence
  derived and/or modified sequence opt2 from SLA__Homo_sapiens__NP_001039021
augggcaacuccaugaaguccacccccgcccccgccgagcgcccccuccccaaccccgagggccucgacuccgacuuccucgccguccucuccgacuaccccucccccgacaucuccccccccaucuuccgccgcggcgagaagcuccgcgucaucuccgacgagggcggcugguggaaggccaucucccucuccaccggccgcgaguccuacauccccggcaucugcgucgcccgcgucuaccacggcuggcucuucgagggccucggccgcgacaaggccgaggagcuccuccagcuccccgacaccaaggucggcuccuucaugauccgcgaguccgagaccaagaagggcuucuacucccucuccguccgccaccgccaggucaagcacuaccgcaucuuccgccuccccaacaacugguacuacaucuccccccgccucaccuuccagugccucgaggaccucgucaaccacuacuccgaggucgccgacggccucugcugcguccucaccacccccugccucacccaguccaccgccgcccccgccguccgcgccuccuccucccccgucacccuccgccagaagaccgucgacuggcgccgcgucucccgccuccaggaggaccccgagggcaccgagaacccccucggcgucgacgagucccucuucuccuacggccuccgcgaguccaucgccuccuaccucucccucaccuccgaggacaacaccuccuucgaccgcaagaagaaguccaucucccucauguacggcggcuccaagcgcaaguccuccuucuucuccuccccccccuacuucgaggacuga

SEQ ID NO: 49492 - RNA, 1746 nt, Artificial Sequence
  derived and/or modified sequence opt2 from SLAIN2__Homo_sapiens__NP_065897
auggaggacgucaacuccaacgucaacgccgaccaggagguccgcaagcuccaggagcucgucaagaagcucgagaagcagaacgagcagcuccgcucccgcuccggcgccguccagggcgccggcucccucggccccggcucccccguccgcgccggcgccuccauccccuccuccggcgccgccuccccccgcggcuucccccucggccucuccgccaaguccggcggcggccccggcuccggcccccgccgcaccuccuccgaggagcuccgcgacgccaccucccuccucgccgccggcgagggcggccuccucgacgaggucgagccccuccgccccgacgagcucgagcgccucuccggcugggaggaggaggaggaguccuggcucuacuccucccccaagaagaagcucacccccaugcagaaguccgucuccccccucgucuggugccgccagguccucgacuaccccucccccgacgucgagugcgccaagaagucccucauccacaagcucgaccagaccauguccgcccucaagcgccagaaccucuacaacaaccccuucaacuccauguccuacaccucccccuacucccccaacgccuccucccccuacuccuccggcuucaacucccccuccuccacccccguccgcccccccaucgucaagcagcucauccuccccggcaacuccggcaaccucaaguccuccgaccgcaaccccccccucuccccccaguccuccaucgacuccgagcucuccgccuccgagcucgacgaggacuccaucggcuccaacuacaagcucaacgacgucaccgacguccagauccucgcccgcaugcaggaggagucccuccgccaggaguacgccgccaccaccucccgccgcuccuccggcuccuccugcaacuccacccgccgcggcaccuucuccgaccaggagcucgacgcccagucccucgacgacgaggacgacaacaugcaccacgccgucuaccccgccgucaaccgcuucucccccuccccccgcaacuccccccgccccucccccaagcaguccccccgcaacuccccccgcucccgcucccccgcccgcggcaucgaguacucccgcgucuccccccagcccaugaucucccgccuccagcagccccgccucucccuccagggccaccccaccgaccuccagaccuccaacgucaagaacgaggagaagcuccgccgcucccuccccaaccucucccgcaccuccaacacccaggucgacuccgucaaguccucccgcuccgacuccaacuuccagguccccaacggcggcaucccccgcaugcagccccaggccuccgccauccccucccccggcaaguuccgcucccccgccgcccccuccccccucgcccuccgccagcccgucaaggccuucuccaaccacggcuccggcucccccggcucccaggagaucacccagcucacccagaccaccuccucccccggcccccccaugguccaguccaccgucuccgccaacccccccuccaacaucaacuccgccacccucacccgccccgccggcaccaccgccaugcgcuccggccucccccgccccuccgcccccuccgccggcggcauccccgucccccgcuccaagcucgcccagcccguccgccgcucccuccccgcccccaagaccuacggcuccaugaaggacgacuccuggaaggacggcugcuacuga

SEQ ID NO: 49493 - RNA, 1008 nt, Artificial Sequence
  derived and/or modified sequence opt2 from SLAMF1__Homo_sapiens__NP_003028
auggaccccaagggccuccucucccucaccuucguccucuuccucucccucgccuucggcgccuccuacggcaccggcggccgcaugaugaacugccccaagauccuccgccagcucggcuccaagguccuccucccccucaccuacgagcgcaucaacaaguccaugaacaaguccauccacaucgucgucaccauggccaagucccucgagaacuccgucgagaacaagaucgucucccucgaccccuccgaggccggccccccccgcuaccucggcgaccgcuacaaguucuaccucgagaaccucacccucggcauccgcgagucccgcaaggaggacgagggcugguaccucaugacccucgagaagaacgucuccguccagcgcuucugccuccagcuccgccucuacgagcaggucuccacccccgagaucaagguccucaacaagacccaggagaacggcaccugcacccucauccucggcugcaccgucgagaagggcgaccacgucgccuacuccugguccgagaaggccggcacccacccccucaaccccgccaacuccucccaccuccucucccucacccucggcccccagcacgccgacaacaucuacaucugcaccgucuccaaccccaucuccaacaacucccagaccuucucccccuggcccggcugccgcaccgaccccuccgagaccaagcccugggccgucuacgccggccuccucggcggcgucaucaugauccucaucauggucgucauccuccagcuccgccgccgcggcaagaccaaccacuaccagaccaccgucgagaagaagucccucaccaucuacgcccagguccagaagcccggcccccuccagaagaagcucgacuccuuccccgcccaggaccccugcaccaccaucuacgucgccgccaccgagcccguccccgaguccguccaggagaccaacuccaucaccgucuacgccuccgucacccuccccgaguccuga

SEQ ID NO: 49494 - RNA, 999 nt, Artificial Sequence
  derived and/or modified sequence opt2 from SLAMF6__Homo_sapiens__NP_001171643
augcucuggcucuuccagucccuccucuucgucuucugcuucggccccggcaacgucgucucccaguccucccucaccccccucauggucaacggcauccucggcgaguccgucacccucccccucgaguuccccgccggcgagaaggucaacuucaucaccuggcucuucaacgagaccucccucgccuucaucgucccccacgagaccaagucccccgagauccacgucaccaaccccaagcagggcaagcgccucaacuucacccaguccuacucccuccagcucuccaaccucaagauggaggacaccggcuccuaccgcgcccagaucuccaccaagaccuccgccaagcucuccuccuacacccuccgcauccuccgccagcuccgcaacauccaggucaccaaccacucccagcucuuccagaacaugaccugcgagcuccaccucaccugcuccgucgaggacgccgacgacaacgucuccuuccgcugggaggcccucggcaacacccucuccucccagcccaaccucaccgucuccugggacccccgcaucuccuccgagcaggacuacaccugcaucgccgagaacgccgucuccaaccucuccuucuccgucuccgcccagaagcucugcgaggacgucaagauccaguacaccgacaccaagaugauccucuucauggucuccggcaucugcaucgucuucggcuucaucauccuccuccuccucguccuccgcaagcgccgcgacucccucucccucuccacccagcgcacccagggccccgccgaguccgcccgcaaccucgaguacgucuccgucucccccaccaacaacaccgucuacgccuccgucacccacuccaaccgcgagaccgagaucuggaccccccgcgagaacgacaccaucaccaucuacuccaccaucaaccacuccaaggaguccaagcccaccuucucccgcgccaccgcccucgacaacgucgucuga

SEQ ID NO: 49495 - RNA, 498 nt, Artificial Sequence
  derived and/or modified sequence opt2 from SLAMF7__Homo_sapiens__NP_001269517
auggccggcucccccaccugccucacccucaucuacauccucuggcagcucaccggcuccgccgccuccggccccgucaaggagcucgucggcuccgucggcggcgccgucaccuucccccucaaguccaaggucaagcaggucgacuccaucgucuggaccuucaacaccaccccccucgucaccauccagcccgagggcggcaccaucaucgucacccagaaccgcaaccgcgagcgcgucgacuuccccgacggcggcuacucccucaagcucuccaagcucaagaagaacgacuccggcaucuacuacgucggcaucuacuccuccucccuccagcagcccuccacccaggaguacguccuccacgucuacgagaacaaccccaagggccgcuccuccaaguacggccuccuccacugcggcaacaccgagaaggacggcaaguccccccucaccgcccacgacgcccgccacaccaaggccaucugccucuga

SEQ ID NO: 49496 - RNA, 858 nt, Artificial Sequence
  derived and/or modified sequence opt2 from SLAMF8__Homo_sapiens__NP_064510
auggucaugcgcccccucuggucccuccuccucugggaggcccuccuccccaucaccgucaccggcgcccagguccucuccaaggucggcggcuccguccuccucgucgccgcccgcccccccggcuuccagguccgcgaggccaucuggcgcucccucuggcccuccgaggagcuccucgccaccuucuuccgcggcucccucgagacccucuaccacucccgcuuccucggccgcgcccagcuccacuccaaccucucccucgagcucggcccccucgaguccggcgacuccggcaacuucuccguccucauggucgacacccgcggccagcccuggacccagacccuccagcucaaggucuacgacgccgucccccgccccgucguccaggucuucaucgccgucgagcgcgacgcccagcccuccaagaccugccaggucuuccucuccugcugggcccccaacaucuccgagaucaccuacuccuggcgccgcgagaccaccauggacuucggcauggagccccacucccucuucaccgacggccagguccucuccaucucccucggccccggcgaccgcgacgucgccuacuccugcaucgucuccaaccccgucuccugggaccucgccaccgucacccccugggacuccugccaccacgaggccgcccccggcaaggccuccuacaaggacguccuccucgucgucguccccgucucccuccuccucaugcucgucacccucuucuccgccuggcacuggugccccugcuccggcaagaagaagaaggacguccacgccgaccgcgucggccccgagaccgagaacccccucguccaggaccuccccuga

SEQ ID NO: 49497 - RNA, 813 nt, Artificial Sequence
  derived and/or modified sequence opt2 from SLBP__Homo_sapiens__NP_006518
auggccugccgcccccgcucccccccccgccaccagucccgcugcgacggcgacgccuccccccccucccccgcccgcuggucccucggccgcaagcgccgcgccgacggccgccgcuggcgccccgaggacgccgaggaggccgagcaccgcggcgccgagcgccgccccgaguccuucaccacccccgagggccccaagccccgcucccgcugcuccgacugggccuccgccgucgaggaggacgagaugcgcacccgcgucaacaaggagauggcccgcuacaagcgcaagcuccucaucaacgacuucggccgcgagcgcaaguccuccuccggcuccuccgacuccaaggaguccauguccaccguccccgccgacuucgagaccgacgaguccguccucaugcgccgccagaagcagaucaacuacggcaagaacaccaucgccuacgaccgcuacaucaaggaggucccccgccaccuccgccagcccggcauccaccccaagacccccaacaaguucaagaaguacucccgccgcuccugggaccagcagaucaagcucuggaaggucgcccuccacuucugggacccccccgccgaggagggcugcgaccuccaggagauccaccccgucgaccucgaguccgccgaguccuccuccgagccccagaccuccucccaggacgacuucgacgucuacuccggcacccccaccaagguccgccacauggacucccaggucgaggacgaguucgaccucgaggccugccucaccgagccccuccgcgacuucuccgccauguccuga

SEQ ID NO: 49498 - RNA, 1050 nt, Artificial Sequence
  derived and/or modified sequence opt2 from SLC10A1__Homo_sapiens__NP_003040
auggaggcccacaacgccuccgcccccuucaacuucacccucccccccaacuucggcaagcgccccaccgaccucgcccucuccgucauccucgucuucaugcucuucuucaucaugcucucccucggcugcaccauggaguucuccaagaucaaggcccaccucuggaagcccaagggccucgccaucgcccucgucgcccaguacggcaucaugccccucaccgccuucguccucggcaaggucuuccgccucaagaacaucgaggcccucgccauccucgucugcggcugcucccccggcggcaaccucuccaacgucuucucccucgccaugaagggcgacaugaaccucuccaucgucaugaccaccugcuccaccuucugcgcccucggcaugaugccccuccuccucuacaucuacucccgcggcaucuacgacggcgaccucaaggacaagguccccuacaagggcaucgucaucucccucguccucguccucauccccugcaccaucggcaucguccucaaguccaagcgcccccaguacaugcgcuacgucaucaagggcggcaugaucaucauccuccucugcuccgucgccgucaccguccucuccgccaucaacgucggcaaguccaucauguucgccaugaccccccuccucaucgccaccuccucccucaugcccuucaucggcuuccuccucggcuacguccucuccgcccucuucugccucaacggccgcugccgccgcaccgucuccauggagaccggcugccagaacguccagcucugcuccaccauccucaacgucgccuucccccccgaggucaucggcccccucuucuucuucccccuccucuacaugaucuuccagcucggcgagggccuccuccucaucgccaucuucuggugcuacgagaaguucaagacccccaaggacaagaccaagaugaucuacaccgccgccaccaccgaggagaccauccccggcgcccucggcaacggcaccuacaagggcgaggacugcucccccugcaccgccuga

SEQ ID NO: 49499 - RNA, 1047 nt, Artificial Sequence
  derived and/or modified sequence opt2 from SLC10A2__Homo_sapiens__NP_000443
augaacgaccccaacuccugcgucgacaacgccaccgucugcuccggcgccuccugcgucguccccgaguccaacuucaacaacauccucuccgucguccucuccaccguccucaccauccuccucgcccucgucauguucuccaugggcugcaacgucgagaucaagaaguuccucggccacaucaagcgccccuggggcaucugcgucggcuuccucugccaguucggcaucaugccccucaccggcuucauccucuccgucgccuucgacauccucccccuccaggccgucgucguccucaucaucggcugcugccccggcggcaccgccuccaacauccucgccuacugggucgacggcgacauggaccucuccgucuccaugaccaccugcuccacccuccucgcccucggcaugaugccccucugccuccucaucuacaccaagaugugggucgacuccggcuccaucgucauccccuacgacaacaucggcaccucccucgucgcccucgucguccccgucuccaucggcauguucgucaaccacaaguggccccagaaggccaagaucauccucaagaucggcuccaucgccggcgccauccucaucguccucaucgccgucgucggcggcauccucuaccaguccgccuggaucaucgcccccaagcucuggaucaucggcaccaucuuccccgucgccggcuacucccucggcuuccuccucgcccgcaucgccggccuccccugguaccgcugccgcaccgucgccuucgagaccggcaugcagaacacccagcucugcuccaccaucguccagcucuccuucacccccgaggagcucaacgucgucuucaccuucccccucaucuacuccaucuuccagcucgccuucgccgccaucuuccucggcuucuacgucgccuacaagaagugccacggcaagaacaaggccgagauccccgaguccaaggagaacggcaccgagcccgaguccuccuucuacaaggccaacggcggcuuccagcccgacgagaaguga

SEQ ID NO: 49500 - RNA, 1134 nt, Artificial Sequence
  derived and/or modified sequence opt2 from SLC10A6__Homo_sapiens__NP_932069
augcgcgccaacugcuccuccuccuccgccugccccgccaacuccuccgaggaggagcuccccgucggccucgagguccacggcaaccucgagcucgucuucaccgucgucuccaccgucaugaugggccuccucauguucucccucggcugcuccgucgagauccgcaagcucuggucccacauccgccgccccuggggcaucgccgucggccuccucugccaguucggccucaugcccuucaccgccuaccuccucgccaucuccuucucccucaagcccguccaggccaucgccguccucaucaugggcugcugccccggcggcaccaucuccaacaucuucaccuucugggucgacggcgacauggaccucuccaucuccaugaccaccugcuccaccgucgccgcccucggcaugaugccccucugcaucuaccucuacaccugguccuggucccuccagcagaaccucaccauccccuaccagaacaucggcaucacccucgucugccucaccauccccgucgccuucggcgucuacgucaacuaccgcuggcccaagcaguccaagaucauccucaagaucggcgccgucgucggcggcguccuccuccucgucgucgccgucgccggcgucguccucgccaagggcuccuggaacuccgacaucacccuccucaccaucuccuucaucuucccccucaucggccacgucaccggcuuccuccucgcccucuucacccaccaguccuggcagcgcugccgcaccaucucccucgagaccggcgcccagaacauccagaugugcaucaccaugcuccagcucuccuucaccgccgagcaccucguccagaugcucuccuucccccucgccuacggccucuuccagcucaucgacggcuuccucaucgucgccgccuaccagaccuacaagcgccgccucaagaacaagcacggcaagaagaacuccggcugcaccgaggucugccacacccgcaaguccaccuccucccgcgagaccaacgccuuccucgaggucaacgaggagggcgccaucacccccggcccccccggccccauggacugccaccgcgcccucgagcccgucggccacaucaccuccugcgaguga

SEQ ID NO: 49501 - RNA, 1023 nt, Artificial Sequence
  derived and/or modified sequence opt2 from SLC10A7__Homo_sapiens__NP_001025169
augcgccuccucgagcgcaugcgcaaggacugguucauggucggcaucguccucgccaucgccggcgccaagcucgagcccuccaucggcgucaacggcggcccccucaagcccgagaucaccgucuccuacaucgccgucgccaccaucuucuucaacuccggccucucccucaagaccgaggagcucaccuccgcccucguccaccucaagcuccaccucuucauccagaucuucacccucgccuucuuccccgccaccaucuggcucuuccuccagcuccucuccaucacccccaucaacgaguggcuccucaagggccuccagaccgucggcugcaugcccccccccgucuccuccgccgucauccucaccaaggccgucggcggcaacgaggccgccgccaucuucaacuccgccuucggcuccuuccucggcaucgucaucaccccccuccuccuccuccucuuccucggcuccuccuccuccguccccuucaccuccaucuucucccagcucuucaugaccgucgucgucccccucaucaucggccagaucguccgccgcuacaucaaggacuggcucgagcgcaagaagccccccuucggcgccaucuccuccuccguccuccucaugaucaucuacaccaccuucugcgacaccuucuccaaccccaacaucgaccucgacaaguucucccucguccucauccucuucaucaucuucuccauccagcucuccuucaugcuccucaccuucaucuucuccacccgcaacaacuccggcuucacccccgccgacaccgucgccaucaucuucugcuccacccacaagucccucacccucggcauccccaugcucaagaucgucuucgccggccacgagcaccucucccucaucuccgucccccuccucaucuaccaccccgcccagauccuccucggcuccguccucguccccaccaucaaguccuggauggucucccgccagaagggcgucaagcucacccgccccaccgucuga

SEQ ID NO: 49502 - RNA, 1653 nt, Artificial Sequence
  derived and/or modified sequence opt2 from SLC11A1__Homo_sapiens__NP_000569
augaccggcgacaagggcccccagcgccucuccggcuccuccuacggcuccaucuccucccccaccucccccaccucccccggcccccagcaggcccccccccgcgagaccuaccucuccgagaagauccccauccccgacaccaagcccggcaccuucucccuccgcaagcucugggccuucaccggccccggcuuccucauguccaucgccuuccucgaccccggcaacaucgaguccgaccuccaggccggcgccgucgccggcuucaagcuccucuggguccuccucugggccaccguccucggccuccucugccagcgccucgccgcccgccucggcgucgucaccggcaaggaccucggcgaggucugccaccucuacuaccccaaggucccccgcaccguccucuggcucaccaucgagcucgccaucgucggcuccgacaugcaggaggucaucggcaccgccaucgccuucaaccuccucuccgccggccgcaucccccucuggggcggcguccucaucaccaucgucgacaccuucuucuuccucuuccucgacaacuacggccuccgcaagcucgaggccuucuucggccuccucaucaccaucauggcccucaccuucggcuacgaguacgucgucgcccgccccgagcagggcgcccuccuccgcggccucuuccuccccuccugccccggcugcggccaccccgagcuccuccaggccgucggcaucgucggcgccaucaucaugccccacaacaucuaccuccacuccgcccucgucaagucccgcgagaucgaccgcgcccgccgcgccgacauccgcgaggccaacauguacuuccucaucgaggccaccaucgcccucuccgucuccuucaucaucaaccucuucgucauggccgucuucggccaggccuucuaccagaagaccaaccaggccgccuucaacaucugcgccaacuccucccuccacgacuacgccaagaucuuccccaugaacaacgccaccgucgccgucgacaucuaccagggcggcgucauccucggcugccucuucggccccgccgcccucuacaucugggccaucggccuccucgccgccggccaguccuccaccaugaccggcaccuacgccggccaguucgucauggagggcuuccuccgccuccgcuggucccgcuucgcccgcguccuccucacccgcuccugcgccauccuccccaccguccucgucgccgucuuccgcgaccuccgcgaccucuccggccucaacgaccuccucaacguccuccagucccuccuccuccccuucgccguccuccccauccucaccuucaccuccaugcccacccucaugcaggaguucgccaacggccuccucaacaaggucgucaccuccuccaucaugguccucgucugcgccaucaaccucuacuucgucgucuccuaccuccccucccucccccaccccgccuacuucggccucgccgcccuccucgccgccgccuaccucggccucuccaccuaccucgucuggaccugcugccucgcccacggcgccaccuuccucgcccacuccucccaccaccacuuccucuacggccuccucgaggaggaccagaagggcgagaccuccggcuga

SEQ ID NO: 49503 - RNA, 1686 nt, Artificial Sequence
  derived and/or modified sequence opt2 from SLC11A2__Homo_sapiens__NP_000608
augguccucggccccgagcagaagauguccgacgacuccgucuccggcgaccacggcgaguccgccucccucggcaacaucaaccccgccuacuccaaccccucccucucccagucccccggcgacuccgaggaguacuucgccaccuacuucaacgagaagaucuccauccccgaggaggaguacuccugcuucuccuuccgcaagcucugggccuucaccggccccggcuuccucauguccaucgccuaccucgaccccggcaacaucgaguccgaccuccaguccggcgccgucgccggcuucaagcuccucuggauccuccuccucgccacccucgucggccuccuccuccagcgccucgccgcccgccucggcgucgucaccggccuccaccucgccgaggucugccaccgccaguaccccaaggucccccgcgucauccucuggcucauggucgagcucgccaucaucggcuccgacaugcaggaggucaucggcuccgccaucgccaucaaccuccucuccgucggccgcaucccccucuggggcggcguccucaucaccaucgccgacaccuucgucuuccucuuccucgacaaguacggccuccgcaagcucgaggccuucuucggcuuccucaucaccaucauggcccucaccuucggcuacgaguacgucaccgucaagcccucccagucccagguccucaagggcauguucguccccuccugcuccggcugccgcaccccccagaucgagcaggccgucggcaucgucggcgccgucaucaugccccacaacauguaccuccacuccgcccucgucaagucccgccaggucaaccgcaacaacaagcaggagguccgcgaggccaacaaguacuucuucaucgaguccugcaucgcccucuucgucuccuucaucaucaacgucuucgucgucuccgucuucgccgaggccuucuucggcaagaccaacgagcaggucgucgaggucugcaccaacaccuccuccccccacgccggccucuuccccaaggacaacuccacccucgccgucgacaucuacaagggcggcgucguccucggcugcuacuucggccccgccgcccucuacaucugggccgucggcauccucgccgccggccaguccuccaccaugaccggcaccuacuccggccaguucgucauggagggcuuccucaaccucaaguggucccgcuucgcccgcgucguccucacccgcuccaucgccaucauccccacccuccucgucgccgucuuccaggacgucgagcaccucaccggcaugaacgacuuccucaacguccuccagucccuccagcuccccuucgcccucauccccauccucaccuucaccucccuccgccccgucauguccgacuucgccaacggccucggcuggcgcaucgccggcggcauccucguccucaucaucugcuccaucaacauguacuucgucgucgucuacguccgcgaccucggccacgucgcccucuacgucgucgccgccgucgucuccgucgccuaccucggcuucgucuucuaccucggcuggcagugccucaucgcccucggcauguccuuccucgacugcggccacaccgucuccaucuccaagggccuccucaccgaggaggccacccgcggcuacgucaaguga

SEQ ID NO: 49504 - RNA, 3300 nt, Artificial Sequence
  derived and/or modified sequence opt2 from SLC12A1__Homo_sapiens__NP_000329
augucccucaacaacuccuccaacgucuuccucgacuccguccccuccaacaccaaccgcuuccaggucuccgucaucaacgagaaccacgaguccuccgccgccgccgacgacaacaccgaccccccccacuacgaggagaccuccuucggcgacgaggcccagaagcgccuccgcaucuccuuccgccccggcaaccaggagugcuacgacaacuuccuccaguccggcgagaccgccaagaccgacgccuccuuccacgccuacgacucccacaccaacaccuacuaccuccagaccuucggccacaacaccauggacgccguccccaagaucgaguacuaccgcaacaccggcuccaucuccggccccaaggucaaccgccccucccuccucgagauccacgagcagcucgccaagaacgucgccgucacccccuccuccgccgaccgcgucgccaacggcgacggcauccccggcgacgagcaggccgagaacaaggaggacgaccaggccggcgucgucaaguucggcugggucaagggcguccucguccgcugcaugcucaacaucuggggcgucaugcucuucauccgccucuccuggaucgucggcgaggccggcaucggccucggcguccucaucauccuccucuccaccauggucaccuccaucaccggccucuccaccuccgccaucgccaccaacggcuucguccgcggcggcggcgccuacuaccucaucucccgcucccucggccccgaguucggcggcuccaucggccucaucuucgccuucgccaacgccgucgccgucgccauguacgucgucggcuucgccgagaccgucgucgaccuccucaaggaguccgacuccaugauggucgaccccaccaacgacauccgcaucaucggcuccaucaccgucgucauccuccucggcaucuccgucgccggcauggagugggaggccaaggcccaggucauccuccucgucauccuccucaucgccaucgccaacuucuucaucggcaccgucauccccuccaacaacgagaagaagucccgcggcuucuucaacuaccaggccuccaucuucgccgagaacuucggcccccgcuucaccaagggcgagggcuucuucuccgucuucgccaucuucuuccccgccgccaccggcauccucgccggcgccaacaucuccggcgaccucgaggacccccaggacgccaucccccgcggcaccaugcucgccaucuucaucaccaccgucgccuaccucggcgucgccaucugcgucggcgccugcgucguccgcgacgccaccggcaacaugaacgacaccaucaucuccggcaugaacugcaacggcuccgccgccugcggccucggcuacgacuucucccgcugccgccacgagcccugccaguacggccucaugaacaacuuccaggucauguccauggucuccggcuucggcccccucaucaccgccggcaucuucuccgccacccucuccuccgcccucgccucccucgucuccgcccccaaggucuuccaggcccucugcaaggacaacaucuacaaggcccuccaguucuucgccaagggcuacggcaagaacaacgagccccuccgcggcuacauccucaccuuccucaucgccauggccuucauccucaucgccgagcucaacaccaucgcccccaucaucuccaacuucuuccucgccuccuacgcccucaucaacuucuccugcuuccacgccuccuacgccaagucccccggcuggcgccccgccuacggcaucuacaacaugugggucucccucuucggcgccguccucugcugcgccgucauguucgucaucaacuggugggccgccgucaucaccuacgucaucgaguucuuccucuacgucuacgucaccugcaagaagcccgacgucaacuggggcuccuccacccaggcccucuccuacgucuccgcccucgacaacgcccucgagcucaccaccgucgaggaccacgucaagaacuuccgcccccagugcaucguccucaccggcggccccaugacccgccccgcccuccucgacaucacccacgccuucaccaagaacuccggccucugcaucugcugcgaggucuucgucggcccccgcaagcucugcgucaaggagaugaacuccggcauggccaagaagcaggccuggcucaucaagaacaagaucaaggccuucuacgccgccgucgccgccgacugcuuccgcgacggcguccgcucccuccuccaggccuccggccucggccgcaugaagcccaacacccucgucaucggcuacaagaagaacuggcgcaaggccccccucaccgagaucgagaacuacgucggcaucauccacgacgccuucgacuucgagaucggcgucgucaucguccgcaucucccagggcuucgacaucucccagguccuccagguccaggaggagcucgagcgccucgagcaggagcgccucgcccucgaggccaccaucaaggacaacgagugcgaggaggaguccggcggcauccgcggccucuucaagaaggccggcaagcucaacaucaccaagaccacccccaagaaggacggcuccaucaacaccucccaguccaugcacgucggcgaguucaaccagaagcucgucgaggccuccacccaguucaagaagaagcaggagaagggcaccaucgacgucugguggcucuucgacgacggcggccucacccuccucauccccuacauccucacccuccgcaagaaguggaaggacugcaagcuccgcaucuacgucggcggcaagaucaaccgcaucgaggaggagaagaucgucauggccucccuccucuccaaguuccgcaucaaguucgccgacauccacaucaucggcgacaucaacauccgccccaacaaggaguccuggaaggucuucgaggagaugaucgagcccuaccgccuccacgaguccugcaaggaccucaccaccgccgagaagcucaagcgcgagacccccuggaagaucaccgacgccgagcucgaggccgucaaggagaaguccuaccgccagguccgccucaacgagcuccuccaggagcacucccgcgccgccaaccucaucguccucucccuccccgucgcccgcaagggcuccaucuccgaccuccucuacauggccuggcucgagauccucaccaagaaccucccccccguccuccucguccgcggcaaccacaagaacguccucaccuucuacuccuga

SEQ ID NO: 49505 - RNA, 3591 nt, Artificial Sequence
  derived and/or modified sequence opt2 from SLC12A2__Homo_sapiens__NP_001243390
auggagccccgccccaccgcccccuccuccggcgcccccggccucgccggcgucggcgagacccccuccgccgccgcccucgccgccgcccgcgucgagcuccccggcaccgccguccccuccguccccgaggacgccgcccccgccucccgcgacggcggcggcguccgcgacgagggccccgccgccgccggcgacggccucggccgcccccucggccccacccccucccagucccgcuuccaggucgaccucgucuccgagaacgccggccgcgccgccgccgccgccgccgccgccgccgccgccgccgccgccgccggcgccggcgccggcgccaagcagacccccgccgacggcgaggccuccggcgaguccgagcccgccaagggcuccgaggaggccaagggccgcuuccgcgucaacuucgucgaccccgccgccuccuccuccgccgaggacucccucuccgacgccgccggcgucggcgucgacggccccaacgucuccuuccagaacggcggcgacaccguccucuccgagggcuccucccuccacuccggcggcggcggcggcuccggccaccaccagcacuacuacuacgacacccacaccaacaccuacuaccuccgcaccuucggccacaacaccauggacgccgucccccgcaucgaccacuaccgccacaccgccgcccagcucggcgagaagcuccuccgccccucccucgccgagcuccacgacgagcucgagaaggagcccuucgaggacggcuucgccaacggcgaggaguccacccccacccgcgacgccgucgucaccuacaccgccgaguccaagggcgucgucaaguucggcuggaucaagggcguccucguccgcugcaugcucaacaucuggggcgucaugcucuucauccgccucuccuggaucgucggccaggccggcaucggccucuccguccucgucaucaugauggccaccgucgucaccaccaucaccggccucuccaccuccgccaucgccaccaacggcuucguccgcggcggcggcgccuacuaccucaucucccgcucccucggccccgaguucggcggcgccaucggccucaucuucgccuucgccaacgccgucgccgucgccauguacgucgucggcuucgccgagaccgucgucgagcuccucaaggagcacuccauccucaugaucgacgagaucaacgacauccgcaucaucggcgccaucaccgucgucauccuccucggcaucuccgucgccggcauggagugggaggccaaggcccagaucguccuccucgucauccuccuccucgccaucggcgacuucgucaucggcaccuucaucccccucgaguccaagaagcccaagggcuucuucggcuacaaguccgagaucuucaacgagaacuucggccccgacuuccgcgaggaggagaccuucuucuccgucuucgccaucuucuuccccgccgccaccggcauccucgccggcgccaacaucuccggcgaccucgccgacccccaguccgccauccccaagggcacccuccucgccauccucaucaccacccucgucuacgucggcaucgccgucuccgucggcuccugcgucguccgcgacgccaccggcaacgucaacgacaccaucgucaccgagcucaccaacugcaccuccgccgccugcaagcucaacuucgacuucuccuccugcgaguccucccccugcuccuacggccucaugaacaacuuccaggucauguccauggucuccggcuucaccccccucaucuccgccggcaucuucuccgccacccucuccuccgcccucgccucccucgucuccgcccccaagaucuuccaggcccucugcaaggacaacaucuaccccgccuuccagauguucgccaagggcuacggcaagaacaacgagccccuccgcggcuacauccucaccuuccucaucgcccucggcuucauccucaucgccgagcucaacgucaucgcccccaucaucuccaacuucuuccucgccuccuacgcccucaucaacuucuccgucuuccacgccucccucgccaagucccccggcuggcgccccgccuucaaguacuacaacauguggaucucccuccucggcgccauccucugcugcaucgucauguucgucaucaacuggugggccgcccuccucaccuacgucaucguccucggccucuacaucuacgucaccuacaagaagcccgacgucaacuggggcuccuccacccaggcccucaccuaccucaacgcccuccagcacuccauccgccucuccggcgucgaggaccacgucaagaacuuccgcccccagugccucgucaugaccggcgcccccaacucccgccccgcccuccuccaccucguccacgacuucaccaagaacgucggccucaugaucugcggccacguccacaugggcccccgccgccaggccaugaaggagauguccaucgaccaggccaaguaccagcgcuggcucaucaagaacaagaugaaggccuucuacgcccccguccacgccgacgaccuccgcgagggcgcccaguaccucaugcaggccgccggccucggccgcaugaagcccaacacccucguccucggcuucaagaaggacuggcuccaggccgacaugcgcgacgucgacauguacaucaaccucuuccacgacgccuucgacauccaguacggcgucgucgucauccgccucaaggagggccucgacaucucccaccuccagggccaggaggagcuccucuccucccaggagaagucccccggcaccaaggacgucgucgucuccgucgaguacuccaagaaguccgaccucgacaccuccaagccccucuccgagaagcccaucacccacaaggaguccaagggccccaucgucccccucaacgucgccgaccagaagcuccucgaggccuccacccaguuccagaagaagcagggcaagaacaccaucgacgucugguggcucuucgacgacggcggccucacccuccucauccccuaccuccucaccaccaagaagaaguggaaggacugcaagauccgcgucuucaucggcggcaagaucaaccgcaucgaccacgaccgccgcgccauggccacccuccucuccaaguuccgcaucgacuucuccgacaucaugguccucggcgacaucaacaccaagcccaagaaggagaacaucaucgccuucgaggagaucaucgagcccuaccgccuccacgaggacgacaaggagcaggacaucgccgacaagaugaaggaggacgagcccuggcgcaucaccgacaacgagcucgagcucuacaagaccaagaccuaccgccagauccgccucaacgagcuccucaaggagcacuccuccaccgccaacaucaucgucaugucccuccccgucgcccgcaagggcgccgucuccuccgcccucuacauggccuggcucgaggcccucuccaaggaccucccccccauccuccucguccgcggcaaccaccaguccguccucaccuucuacuccuga

SEQ ID NO: 49506 - RNA, 3093 nt, Artificial Sequence
  derived and/or modified sequence opt2 from SLC12A3__Homo_sapiens__NP_000330
auggccgagcuccccaccaccgagacccccggcgacgccacccucugcuccggccgcuucaccaucuccacccuccucuccuccgacgagcccuccccccccgccgccuacgacuccucccaccccucccaccucacccacuccuccaccuucugcaugcgcaccuucggcuacaacaccaucgacgucguccccaccuacgagcacuacgccaacuccacccagcccggcgagccccgcaagguccgccccacccucgccgaccuccacuccuuccucaagcaggagggccgccaccuccacgcccucgccuucgacucccgccccucccacgagaugaccgacggccucgucgagggcgaggccggcaccuccuccgagaagaaccccgaggagcccguccgcuucggcugggucaagggcgucaugauccgcugcaugcucaacaucuggggcgucauccucuaccuccgccuccccuggaucaccgcccaggccggcaucguccucaccuggaucaucauccuccucuccgucaccgucaccuccaucaccggccucuccaucuccgccaucuccaccaacggcaaggucaaguccggcggcaccuacuuccucaucucccgcucccucggccccgagcucggcggcuccaucggccucaucuucgccuucgccaacgccgucggcgucgccaugcacaccgucggcuucgccgagaccguccgcgaccuccuccaggaguacggcgcccccaucgucgaccccaucaacgacauccgcaucaucggcgucgucuccgucaccguccuccucgccaucucccucgccggcauggagugggaguccaaggcccagguccucuucuuccucgucaucauggucuccuucgccaacuaccucgucggcacccucaucccccccuccgaggacaaggccuccaagggcuucuucuccuaccgcgccgacaucuucguccagaaccucguccccgacuggcgcggccccgacggcaccuucuucggcauguucuccaucuucuuccccuccgccaccggcauccucgccggcgccaacaucuccggcgaccucaaggaccccgccaucgccauccccaagggcacccucauggccaucuucuggaccaccaucuccuaccucgccaucuccgccaccaucggcuccugcgucguccgcgacgccuccggcguccucaacgacaccgucacccccggcuggggcgccugcgagggccucgccugcuccuacggcuggaacuucaccgagugcacccagcagcacuccugccacuacggccucaucaacuacuaccagaccauguccauggucuccggcuucgccccccucaucaccgccggcaucuucggcgccacccucuccuccgcccucgccugccucgucuccgccgccaaggucuuccagugccucugcgaggaccagcucuacccccucaucggcuucuucggcaagggcuacggcaagaacaaggagcccguccgcggcuaccuccucgccuacgccaucgccgucgccuucaucaucaucgccgagcucaacaccaucgcccccaucaucuccaacuucuuccucugcuccuacgcccucaucaacuucuccugcuuccacgccuccaucaccaacucccccggcuggcgccccuccuuccaguacuacaacaagugggccgcccucuucggcgccaucaucuccgucgucaucauguuccuccucaccuggugggccgcccucaucgccaucggcgucguccucuuccuccuccucuacgucaucuacaagaagcccgaggucaacuggggcuccuccguccaggccggcuccuacaaccucgcccucuccuacuccgucggccucaacgaggucgaggaccacaucaagaacuaccgcccccagugccucguccucaccggcccccccaacuuccgccccgcccucgucgacuucgucggcaccuucacccgcaaccucucccucaugaucugcggccacguccucaucggcccccacaagcagcgcaugcccgagcuccagcucaucgccaacggccacaccaaguggcucaacaagcgcaagaucaaggccuucuacuccgacgucaucgccgaggaccuccgccgcggcguccagauccucaugcaggccgccggccucggccgcaugaagcccaacauccucgucgucggcuucaagaagaacuggcaguccgcccaccccgccaccgucgaggacuacaucggcauccuccacgacgccuucgacuucaacuacggcgucugcgucaugcgcaugcgcgagggccucaacgucuccaagaugaugcaggcccacaucaaccccgucuucgaccccgccgaggacggcaaggaggccuccgcccgcggcgcccgccccuccgucuccggcgcccucgaccccaaggcccucgucaaggaggagcaggccaccaccaucuuccaguccgagcagggcaagaagaccaucgacaucuacuggcucuucgacgacggcggccucacccuccucauccccuaccuccucggccgcaagcgccgcugguccaagugcaagauccgcgucuucgucggcggccagaucaaccgcauggaccaggagcgcaaggccaucaucucccuccucuccaaguuccgccucggcuuccacgagguccacauccuccccgacaucaaccagaacccccgcgccgagcacaccaagcgcuucgaggacaugaucgcccccuuccgccucaacgacggcuucaaggacgaggccaccgucaacgagaugcgccgcgacugccccuggaagaucuccgacgaggagaucaccaagaaccgcgucaagucccuccgccagguccgccucaacgagaucguccucgacuacucccgcgacgccgcccucaucgucaucacccuccccaucggccgcaagggcaagugccccuccucccucuacauggccuggcucgagacccucucccaggaccuccgcccccccgucauccucauccgcggcaaccaggagaacguccucaccuucuacugccaguga

SEQ ID NO: 49507 - RNA, 3240 nt, Artificial Sequence
  derived and/or modified sequence opt2 from SLC12A4__Homo_sapiens__NP_001139433
augccccacuucaccgucguccccgucgacggcccccgccgcggcgacuacgacaaccucgagggccucuccugggucgacuacggcgagcgcgccgagcucgacgacuccgacggccacggcaaccaccgcgaguccucccccuuccucuccccccucgaggccucccgcggcaucgacuacuacgaccgcaaccucgcccucuucgaggaggagcucgacauccgccccaaggucuccucccuccucggcaagcucgucuccuacaccaaccucacccagggcgccaaggagcacgaggaggccgaguccggcgagggcacccgccgccgcgccgccgaggcccccuccaugggcacccucaugggcgucuaccuccccugccuccagaacaucuucggcgucauccucuuccuccgccucaccuggauggucggcaccgccggcguccuccaggcccuccucaucguccucaucugcugcugcugcacccuccucaccgccaucuccauguccgccaucgccaccaacggcgucguccccgccggcggcuccuacuucaugaucucccgcucccucggccccgaguucggcggcgccgucggccucugcuucuaccucggcaccaccuucgccgccgccauguacauccucggcgccaucgagauccuccucaccuacaucgccccccccgccgccaucuucuaccccuccggcgcccacgacaccuccaacgccacccucaacaacaugcgcgucuacggcaccaucuuccucaccuucaugacccucgucgucuucgucggcgucaaguacgucaacaaguucgccucccucuuccucgccugcgucaucaucuccauccucuccaucuacgccggcggcaucaaguccaucuucgacccccccgucuuccccgucugcaugcucggcaaccgcacccucucccgcgaccaguucgacaucugcgccaagaccgccgucgucgacaacgagaccgucgccacccagcucugguccuucuucugccacucccccaaccucaccaccgacuccugcgaccccuacuucaugcucaacaacgucaccgagauccccggcauccccggcgccgccgccggcguccuccaggagaaccucugguccgccuaccucgagaagggcgacaucgucgagaagcacggccuccccuccgccgacgcccccucccucaaggagucccucccccucuacgucgucgccgacaucgccaccuccuucaccguccucgucggcaucuucuuccccuccgucaccggcaucauggccggcuccaaccgcuccggcgaccuccgcgacgcccagaaguccauccccgucggcaccauccucgccaucaucaccaccucccucgucuacuucuccuccgucguccucuucggcgccugcaucgagggcgucguccuccgcgacaaguacggcgacggcgucucccgcaaccucgucgucggcacccucgccuggcccucccccugggucaucgucaucggcuccuucuucuccaccugcggcgccggccuccagucccucaccggcgccccccgccuccuccaggccaucgccaaggacaacaucauccccuuccuccgcgucuucggccacggcaaggucaacggcgagcccaccugggcccuccuccucaccgcccucaucgccgagcucggcauccucaucgccucccucgacauggucgcccccauccucuccauguucuuccucaugugcuaccucuucgucaaccucgccugcgccguccagacccuccuccgcacccccaacuggcgcccccgcuucaaguacuaccacugggcccucuccuuccucggcaugucccucugccucgcccucauguucgucuccuccugguacuacgcccucgucgccaugcucaucgccggcaugaucuacaaguacaucgaguaccagggcgccgagaaggaguggggcgacggcauccgcggccucucccucuccgccgcccgcuacgcccuccuccgccucgaggagggccccccccacaccaagaacuggcgcccccagcuccucguccuccucaagcucgacgaggaccuccacgucaaguacccccgccuccucaccuucgccucccagcucaaggccggcaagggccucaccaucgucggcuccgucauccagggcuccuuccucgaguccuacggcgaggcccaggccgccgagcagaccaucaagaacaugauggagaucgagaaggucaagggcuucugccaggucgucgucgccuccaagguccgcgagggccucgcccaccucauccaguccugcggccucggcggcaugcgccacaacuccgucguccucggcuggcccuacggcuggcgccaguccgaggacccccgcgccuggaagaccuucaucgacaccguccgcugcaccaccgccgcccaccucgcccuccucguccccaagaacaucgccuucuaccccuccaaccacgagcgcuaccucgagggccacaucgacgucugguggaucguccacgacggcggcaugcucaugcuccuccccuuccuccuccgccagcacaaggucuggcgcaagugccgcaugcgcaucuucaccgucgcccagauggacgacaacuccauccagaugaagaaggaccucgccgucuuccucuaccaccuccgccucgaggccgagcacaacuccgacaucuccgccuacaccuacgagcgcacccucaugauggagcagcgcucccagaugcuccgccagaugcgccucaccaagaccgagcgcgagcgcgaggcccagcucgucaaggaccgccacuccgcccuccgccucgagucccucuacuccgacgaggaggacgaguccgccgucggcgccgacaagauccagaugaccuggacccgcgacaaguacaugaccgagaccugggaccccucccacgcccccgacaacuuccgcgagcucguccacaucaagcccgaccaguccaacguccgccgcaugcacaccgccgucaagcucaacgaggucaucgucacccgcucccacgacgcccgccucguccuccucaacaugcccggccccccccgcaacuccgagggcgacgagaacuacauggaguuccucgagguccucaccgagggccucgagcgcguccuccucguccgcggcggcggccgcgaggucaucaccaucuacuccuga

SEQ ID NO: 49508 - RNA, 3420 nt, Artificial Sequence
  derived and/or modified sequence opt2 from SLC12A5__Homo_sapiens__NP_001128243
augucccgccgcuucaccgucaccucccucccccccgccggccccgcccgcucccccgaccccgagucccgccgccacuccgucgccgacccccgccaccuccccggcgaggacgucaagggcgacggcaaccccaaggaguccucccccuucaucaacuccaccgacaccgagaagggcaaggaguacgacggcaagaacauggcccucuucgaggaggagauggacaccucccccauggucuccucccuccucuccggccucgccaacuacaccaaccucccccagggcucccgcgagcacgaggaggccgagaacaacgagggcggcaagaagaagcccguccaggccccccgcaugggcaccuucaugggcgucuaccuccccugccuccagaacaucuucggcgucauccucuuccuccgccucaccugggucgucggcaucgccggcaucauggaguccuucugcauggucuucaucugcugcuccugcaccaugcucaccgccaucuccauguccgccaucgccaccaacggcgucguccccgccggcggcuccuacuacaugaucucccgcucccucggccccgaguucggcggcgccgucggccucugcuucuaccucggcaccaccuucgccggcgccauguacauccucggcaccaucgagauccuccucgccuaccucuuccccgccauggccaucuucaaggccgaggacgccuccggcgaggccgccgccaugcucaacaacaugcgcgucuacggcaccugcguccucaccugcauggccaccgucgucuucgucggcgucaaguacgucaacaaguucgcccucgucuuccucggcugcgucauccucuccauccucgccaucuacgccggcgucaucaaguccgccuucgacccccccaacuuccccaucugccuccucggcaaccgcacccucucccgccacggcuucgacgucugcgccaagcucgccugggagggcaacgagaccgucaccacccgccucuggggccucuucugcuccucccgcuuccucaacgccaccugcgacgaguacuucacccgcaacaacgucaccgagauccagggcauccccggcgccgccuccggccucaucaaggagaaccucugguccuccuaccucaccaagggcgucaucgucgagcgcuccggcaugaccuccgucggccucgccgacggcacccccaucgacauggaccaccccuacgucuucuccgacaugaccuccuacuucacccuccucgucggcaucuacuuccccuccgucaccggcaucauggccggcuccaaccgcuccggcgaccuccgcgacgcccagaaguccauccccaccggcaccauccucgccaucgccaccaccuccgccgucuacaucuccuccgucguccucuucggcgccugcaucgagggcgucguccuccgcgacaaguucggcgaggccgucaacggcaaccucgucgucggcacccucgccuggcccucccccugggucaucgucaucggcuccuucuucuccaccugcggcgccggccuccagucccucaccggcgccccccgccuccuccaggccaucucccgcgacggcaucguccccuuccuccaggucuucggccacggcaaggccaacggcgagcccaccugggcccuccuccucaccgccugcaucugcgagaucggcauccucaucgccucccucgacgaggucgcccccauccucuccauguucuuccucaugugcuacauguucgucaaccucgccugcgccguccagacccuccuccgcacccccaacuggcgcccccgcuuccgcuacuaccacuggacccucuccuuccucggcaugucccucugccucgcccucauguucaucugcuccugguacuacgcccucgucgccaugcucaucgccggccucaucuacaaguacaucgaguaccgcggcgccgagaaggaguggggcgacggcauccgcggccucucccucuccgccgcccgcuacgcccuccuccgccucgaggagggccccccccacaccaagaacuggcgcccccagcuccucguccucguccgcgucgaccaggaccagaacgucguccacccccagcuccucucccucaccucccagcucaaggccggcaagggccucaccaucgucggcuccguccucgagggcaccuuccucgagaaccacccccaggcccagcgcgccgaggaguccauccgccgccucauggaggccgagaaggucaagggcuucugccaggucgucaucuccuccaaccuccgcgacggcgucucccaccucauccaguccggcggccucggcggccuccagcacaacaccguccucgucggcuggccccgcaacuggcgccagaaggaggaccaccagaccuggcgcaacuucaucgagcucguccgcgagaccaccgccggccaccucgcccuccucgucaccaagaacgucuccauguuccccggcaaccccgagcgcuucuccgagggcuccaucgacgucugguggaucguccacgacggcggcaugcucaugcuccuccccuuccuccuccgccaccacaaggucuggcgcaagugcaagaugcgcaucuucaccgucgcccagauggacgacaacuccauccagaugaagaaggaccucaccaccuuccucuaccaccuccgcaucaccgccgaggucgaggucgucgagaugcacgaguccgacaucuccgccuacaccuacgagaagacccucgucauggagcagcgcucccagauccucaagcagaugcaccucaccaagaacgagcgcgagcgcgagauccaguccaucaccgacgagucccgcggcuccauccgccgcaagaaccccgccaacacccgccuccgccucaacguccccgaggagaccgccggcgacuccgaggagaagcccgaggaggagguccagcucauccacgaccaguccgcccccuccugccccuccuccucccccucccccggcgaggagcccgagggcgagggcgagaccgaccccgagaagguccaccucaccuggaccaaggacaaguccgucgccgagaagaacaagggccccucccccgucuccuccgagggcaucaaggacuucuucuccaugaagcccgagugggagaaccucaaccaguccaacguccgccgcaugcacaccgccguccgccucaacgaggucaucgucaagaagucccgcgacgccaagcucguccuccucaacaugcccggccccccccgcaaccgcaacggcgacgagaacuacauggaguuccucgagguccucaccgagcaccucgaccgcgucaugcucguccgcggcggcggccgcgaggucaucaccaucuacuccuga

SEQ ID NO: 49509 - RNA, 3276 nt, Artificial Sequence
  derived and/or modified sequence opt2 from SLC12A6__Homo_sapiens__NP_001035960
auguccgagauguccggcgccaccaccucccucgccaccgucgcccucgacccccccuccgaccgcaccucccacccccaggacgucaucgaggaccucucccagaacuccaucaccggcgagcacucccagcuccucgacgacggccacaagaaggcccgcaacgccuaccucaacaacuccaacuacgaggagggcgacgaguacuucgacaagaaccucgcccucuucgaggaggagauggacacccgccccaaggucuccucccuccucaaccgcauggccaacuacaccaaccucacccagggcgccaaggagcacgaggaggccgagaacaucaccgagggcaagaagaagcccaccaagaccccccagaugggcaccuucaugggcgucuaccuccccugccuccagaacaucuucggcgucauccucuuccuccgccucaccugggucgucggcaccgccggcguccuccaggccuucgccaucguccucaucugcugcugcugcaccaugcucaccgccaucuccauguccgccaucgccaccaacggcgucguccccgccggcggcuccuacuucaugaucucccgcgcccucggccccgaguucggcggcgccgucggccucugcuucuaccucggcaccaccuucgccgccgccauguacauccucggcgccaucgagaucuuccucgucuacaucgucccccgcgccgccaucuuccacuccgacgacgcccucaaggaguccgccgccaugcucaacaacaugcgcgucuacggcaccgccuuccucguccucaugguccucgucgucuucaucggcguccgcuacgucaacaaguucgccucccucuuccucgccugcgucaucgucuccauccucgccaucuacgccggcgccaucaaguccuccuucgcccccccccacuuccccgucugcaugcucggcaaccgcacccucuccucccgccacaucgacgucugcuccaagaccaaggagaucaacaacaugaccguccccuccaagcucuggggcuucuucugcaacuccucccaguucuucaacgccaccugcgacgaguacuucguccacaacaacgucaccuccauccagggcauccccggccucgccuccggcaucaucaccgagaaccucugguccaacuaccuccccaagggcgagaucaucgagaagcccuccgccaaguccuccgacguccucggcucccucaaccacgaguacguccucgucgacaucaccaccuccuucacccuccucgucggcaucuucuuccccuccgucaccggcaucauggccggcuccaaccgcuccggcgaccucaaggacgcccagaaguccauccccaucggcaccauccucgccauccucaccaccuccuucgucuaccucuccaacgucguccucuucggcgccugcaucgagggcgucguccuccgcgacaaguucggcgacgccgucaagggcaaccucgucgucggcacccucuccuggcccucccccugggucaucgucaucggcuccuucuucuccaccugcggcgccggccuccagucccucaccggcgccccccgccuccuccaggccaucgccaaggacaacaucauccccuuccuccgcgucuucggccacuccaaggccaacggcgagcccaccugggcccuccuccucaccgccgccaucgccgagcucggcauccucaucgccucccucgaccucgucgcccccauccucuccauguucuuccucaugugcuaccucuucgucaaccucgccugcgcccuccagacccuccuccgcacccccaacuggcgcccccgcuuccgcuacuaccacugggcccucuccuucaugggcauguccaucugccucgcccucauguucaucuccuccugguacuacgccaucgucgccauggucaucgccggcaugaucuacaaguacaucgaguaccagggcgccgagaaggaguggggcgacggcauccgcggccucucccucuccgccgcccgcuucgcccuccuccgccucgaggagggccccccccacaccaagaacuggcgcccccagcuccucguccuccucaagcucgacgaggaccuccacgucaagcacccccgccuccucaccuucgccucccagcucaaggccggcaagggccucaccaucgucggcuccgucaucgucggcaacuuccucgagaacuacggcgaggcccucgccgccgagcagaccaucaagcaccucauggaggccgagaaggucaagggcuucugccagcucgucgucgccgccaagcuccgcgagggcaucucccaccucauccaguccugcggccucggcggcaugaagcacaacaccgucgucaugggcuggcccaacggcuggcgccaguccgaggacgcccgcgccuggaagaccuucaucggcaccguccgcgucaccaccgccgcccaccucgcccuccucgucgccaagaacaucuccuucuuccccuccaacgucgagcaguucuccgagggcaacaucgacgucugguggaucguccacgacggcggcaugcucaugcuccuccccuuccuccucaagcagcacaaggucuggcgcaagugcuccauccgcaucuucaccgucgcccagcucgaggacaacuccauccagaugaagaaggaccucgccaccuuccucuaccaccuccgcaucgaggccgaggucgaggucgucgagaugcacgacuccgacaucuccgccuacaccuacgagcgcacccucaugauggagcagcgcucccagaugcuccgccacaugcgccucuccaagaccgagcgcgaccgcgaggcccagcucgucaaggaccgcaacuccaugcuccgccucaccuccaucggcuccgacgaggacgaggagaccgagaccuaccaggagaagguccacaugaccuggaccaaggacaaguacauggccucccgcggccagaaggccaaguccauggagggcuuccaggaccuccucaacaugcgccccgaccaguccaacguccgccgcaugcacaccgccgucaagcucaacgaggucaucgucaacaagucccacgaggccaagcucguccuccucaacaugcccggccccccccgcaaccccgagggcgacgagaacuacauggaguuccucgagguccucaccgagggccucgagcgcguccuccucguccgcggcggcggcuccgaggucaucaccaucuacuccuga

SEQ ID NO: 49510 - RNA, 3252 nt, Artificial Sequence
  derived and/or modified sequence opt2 from SLC12A7__Homo_sapiens__NP_006589
augcccaccaacuucaccgucguccccgucgaggcccacgccgacggcggcggcgacgagaccgccgagcgcaccgaggcccccggcacccccgagggccccgagcccgagcgccccucccccggcgacggcaacccccgcgagaacucccccuuccucaacaacgucgaggucgagcaggaguccuucuucgagggcaagaacauggcccucuucgaggaggagauggacuccaaccccauggucuccucccuccucaacaagcucgccaacuacaccaaccucucccagggcgucgucgagcacgaggaggacgaggagucccgccgccgcgaggccaaggccccccgcaugggcaccuucaucggcgucuaccuccccugccuccagaacauccucggcgucauccucuuccuccgccucaccuggaucgucggcgucgccggcguccucgaguccuuccucaucgucgccaugugcugcaccugcaccaugcucaccgccaucuccauguccgccaucgccaccaacggcgucguccccgccggcggcuccuacuacaugaucucccgcucccucggccccgaguucggcggcgccgucggccucugcuucuaccucggcaccaccuucgccggcgccauguacauccucggcaccaucgagaucuuccucaccuacaucucccccggcgccgccaucuuccaggccgaggccgccggcggcgaggccgccgccaugcuccacaacaugcgcgucuacggcaccugcacccucguccucauggcccucgucgucuucgucggcgucaaguacgucaacaagcucgcccucgucuuccucgccugcgucguccucuccauccucgccaucuacgccggcgucaucaaguccgccuucgacccccccgacauccccgucugccuccucggcaaccgcacccucucccgccgcuccuucgacgccugcgucaaggccuacggcauccacaacaacuccgccaccuccgcccucuggggccucuucugcaacggcucccagcccuccgccgccugcgacgaguacuucauccagaacaacgucaccgagauccagggcauccccggcgccgccuccggcgucuuccucgagaaccucugguccaccuacgcccacgccggcgccuucgucgagaagaagggcguccccuccguccccgucgccgaggagucccgcgccuccgcccuccccuacguccucaccgacaucgccgccuccuucacccuccucgucggcaucuacuuccccuccgucaccggcaucauggccggcuccaaccgcuccggcgaccucaaggacgcccagaaguccauccccaccggcaccauccucgccaucgucaccaccuccuucaucuaccucuccugcaucguccucuucggcgccugcaucgagggcgucguccuccgcgacaaguucggcgaggcccuccagggcaaccucgucaucggcaugcucgccuggcccucccccugggucaucgucaucggcuccuucuucuccaccugcggcgccggccuccagucccucaccggcgccccccgccuccuccaggccaucgcccgcgacggcaucguccccuuccuccaggucuucggccacggcaaggccaacggcgagcccaccugggcccuccuccucaccguccucaucugcgagaccggcauccucaucgccucccucgacuccgucgcccccauccucuccauguucuuccucaugugcuaccucuucgucaaccucgccugcgccguccagacccuccuccgcacccccaacuggcgcccccgcuucaaguucuaccacuggacccucuccuuccucggcaugucccucugccucgcccucauguucaucugcuccugguacuacgcccucuccgccaugcucaucgccggcugcaucuacaaguacaucgaguaccgcggcgccgagaaggaguggggcgacggcauccgcggccucucccucaacgccgcccgcuacgcccuccuccgcgucgagcacggccccccccacaccaagaacuggcgcccccagguccucgucaugcucaaccucgacgccgagcaggccgucaagcacccccgccuccucuccuucaccucccagcucaaggccggcaagggccucaccaucgucggcuccguccucgagggcaccuaccucgacaagcacauggaggcccagcgcgccgaggagaacauccgcucccucauguccaccgagaagaccaagggcuucugccagcucgucgucuccuccucccuccgcgacggcaugucccaccucauccaguccgccggccucggcggccucaagcacaacaccguccucauggccuggcccgccuccuggaagcaggaggacaaccccuucuccuggaagaacuucgucgacaccguccgcgacaccaccgccgcccaccaggcccuccucgucgccaagaacgucgacuccuucccccagaaccaggagcgcuucggcggcggccacaucgacgucugguggaucguccacgacggcggcaugcucaugcuccuccccuuccuccuccgccagcacaaggucuggcgcaagugccgcaugcgcaucuucaccgucgcccaggucgacgacaacuccauccagaugaagaaggaccuccagauguuccucuaccaccuccgcaucuccgccgaggucgaggucgucgagauggucgagaacgacaucuccgccuucaccuacgagcgcacccucaugauggagcagcgcucccagaugcucaagcagaugcagcucuccaagaacgagcaggagcgcgaggcccagcucauccacgaccgcaacaccgccucccacaccgccgccgccgcccgcacccaggccccccccacccccgacaagguccagaugaccuggacccgcgagaagcucaucgccgagaaguaccgcucccgcgacaccucccucuccggcuucaaggaccucuucuccaugaagcccgaccaguccaacguccgccgcaugcacaccgccgucaagcucaacggcgucguccucaacaagucccaggacgcccagcucguccuccucaacaugcccggcccccccaagaaccgccagggcgacgagaacuacauggaguuccucgagguccucaccgagggccucaaccgcguccuccucguccgcggcggcggccgcgaggucaucaccaucuacuccuga

SEQ ID NO: 49511 - RNA, 2145 nt, Artificial Sequence
  derived and/or modified sequence opt2 from SLC12A8__Homo_sapiens__NP_001182412
augacccagaugucccagguccaggagcucuuccacgaggccgcccagcaggacgcccucgcccagccccagcccugguggaagacccagcucuucaugugggagcccguccucuucggcaccugggacggcgucuucaccuccugcaugaucaacaucuucggcgucguccucuuccuccgcaccggcuggcucgucggcaacaccggcguccuccucggcauguuccucgucuccuucgucauccucgucgcccucgucaccguccucuccggcaucggcgucggcgagcgcuccuccaucggcuccggcggcgucuacuccaugaucuccuccguccucggcggccagaccggcggcaccaucggccuccucuacgucuucggccagugcgucgccggcgccauguacaucaccggcuucgccgaguccaucuccgaccuccucggccucggcaacaucugggccguccgcggcaucuccgucgccguccuccucgcccuccucggcaucaaccucgccggcgucaaguggaucauccgccuccagcuccuccuccucuuccuccucgccgucuccacccucgacuucgucgucggcuccuucacccaccucgaccccgagcacggcuucaucggcuacucccccgagcuccuccagaacaacacccuccccgacuacucccccggcgaguccuucuucaccgucuucggcgucuucuuccccgccgccaccggcgucauggccggcuucaacaugggcggcgaccuccgcgagcccgccgccuccaucccccucggcucccucgccgccgucggcaucuccugguuccucuacaucgucuucgucuuccuccucggcgccaucugcacccgcgaggcccuccgcuacgacuuccucaucgccgagaaggucucccucaugggcuuccucuuccuccucggccucuacaucuccucccucgccuccugcaugggcggccucuacggcgccccccgcauccuccagugcaucgcccaggagaaggucauccccgcccucgccugccucggccagggcaagggccccaacaagacccccgucgccgccaucugccucaccucccucgucaccauggccuucgucuucgucggccaggucaacguccucgcccccaucgucaccaucaacuucaugcucaccuacgucgccgucgacuacuccuacuucucccucuccaugugcuccugcucccucacccccguccccgagcccguccuccgcgagggcgccgagggccuccacugcuccgagcaccuccuccucgagaaggcccccuccuacggcuccgagggccccgcccagcgcguccucgagggcacccuccucgaguucaccaaggacauggaccagcuccuccagcucacccgcaagcucgaguccucccagccccgccagggcgagggcaaccgcacccccgagucccagaagcgcaaguccaagaaggccaccaagcagacccuccaggacuccuuccuccucgaccucaaguccccccccuccuuccccgucgagaucuccgaccgccuccccgccgccuccugggagggccaggaguccugcuggaacaagcagaccuccaaguccgagggcacccagcccgagggcaccuacggcgagcagcucguccccgagcucugcaaccaguccgaguccuccggcgaggacuucuuccucaagucccgccuccaggagcaggacgucuggcgccgcuccaccuccuucuacacccacaugugcaaccccugggucucccuccucggcgccgucggcucccuccucaucauguucgucauccagugggucuacacccucgucaacaugggcgucgccgccaucgucuacuucuacaucggccgcgccucccccggccuccaccucggcuccgccuccaacuucuccuucuuccgcuggaugcgcucccuccuccuccccuccugccgcucccuccgcuccccccaggagcagaucauccucgcccccucccucgccaaggucgacauggagaugacccagcucacccaggagaacgccgacuucgccacccgcgaccgcuaccaccacuccucccucgucaaccgcgagcagcucaugccccacuacuga

SEQ ID NO: 49512 - RNA, 1896 nt, Artificial Sequence
  derived and/or modified sequence opt2 from SLC12A9__Homo_sapiens__NP_001254741
auggccuccgaguccuccccccuccucgccuaccgccuccucggcgaggagggcgucgcccuccccgccaacggcgccggcggccccggcggcgccuccgcccgcaagcucuccaccuuccucggcgucgucguccccaccguccucuccauguucuccaucgucgucuuccuccgcaucggcuucgucgucggccacgccggccuccuccaggcccucgccaugcuccucgucgccuacuucauccucgcccucaccguccucuccgucugcgccaucgccaccaacggcgccguccagggcggcggcgccuacuucaugaucucccgcacccucggccccgaggucggcggcuccaucggccucauguucuaccucgccaacgucugcggcugcgccgucucccuccucggccucgucgaguccguccucgacgucuucggcgccgacgccaccggccccuccggccuccgcguccucccccagggcuacggcuggaaccuccucuacggcucccuccuccucggccucgucggcggcgucugcacccucggcgccggccucuacgcccgcgccuccuuccucaccuuccuccucgucuccggcucccucgccuccguccucaucuccuucgucgccgucggcccccgcgacauccgccucaccccccgccccggccccaacggcuccucccuccccccccgcuucggccacuucaccggcuucaacuccuccacccucaaggacaaccucggcgccggcuacgccgaggacuacaccaccggcgccgucaugaacuucgccuccgucuucgccguccucuucaacggcugcaccggcaucauggccggcgccaacauguccggcgagcucaaggaccccucccgcgccaucccccucggcaccaucgucgccgucgccuacaccuucuucgucuacguccuccucuucuuccucuccuccuucaccugcgaccgcacccuccuccaggaggacuacggcuucuuccgcgccaucucccucuggcccccccucguccucaucggcaucuacgccaccgcccucuccgccuccauguccucccucaucggcgccucccgcauccuccacgcccucgcccgcgacgaccucuucggcgucauccucgcccccgccaaggucgucucccgcggcggcaaccccugggccgccguccucuacuccuggggccucguccagcucguccuccucgccggcaagcucaacacccucgccgccgucgucaccgucuucuaccucgucgccuacgccgccgucgaccucuccugccucucccucgagugggccuccgcccccaacuuccgccccaccuucucccucuucuccuggcacaccugccuccucggcgucgccuccugccuccucaugauguuccucaucucccccggcgccgccggcggcucccuccuccucaugggccuccucgccgcccuccucaccgcccgcggcggccccuccuccuggggcuacgucucccaggcccuccucuuccaccagguccgcaaguaccuccuccgccucgacguccgcaaggaccacgucaaguucuggcgcccccagcuccuccuccucgucggcaacccccgcggcgcccucccccuccuccgccucgccaaccagcucaagaagggcggccucuacguccucggccacgucacccucggcgaccucgacucccuccccuccgaccccguccagccccaguacggcgccuggcucucccucgucgaccgcgcccaggucaaggccuucgucgaccucacccucucccccuccguccgccagggcgcccagcaccuccuccgcaucuccggccucgaguccggcacccuccuccccuggggcuuccgcuccuga

SEQ ID NO: 49513 - RNA, 1788 nt, Artificial Sequence
  derived and/or modified sequence opt2 from SLC13A1__Homo_sapiens__NP_071889
augaaguucuucuccuacauccucgucuaccgccgcuuccucuucgucgucuucaccguccucguccuccucccccuccccaucguccuccacaccaaggaggccgagugcgccuacacccucuucgucgucgccaccuucuggcucaccgaggcccucccccucuccgucaccgcccuccuccccucccucaugcuccccauguucggcaucaugcccuccaagaaggucgccuccgccuacuucaaggacuuccaccuccuccucaucggcgucaucugccucgccaccuccaucgagaaguggaaccuccacaagcgcaucgcccucaagauggucaugauggucggcgucaaccccgccuggcucacccucggcuucauguccuccaccgccuuccucuccauguggcucuccaacaccuccaccgccgccauggucaugcccaucgccgaggccgucguccagcagaucaucaacgccgaggccgaggucgaggccacccagaugaccuacuucaacggcuccaccaaccacggccucgagaucgacgaguccgucaacggccacgagaucaacgagcgcaaggagaagaccaagcccguccccggcuacaacaacgacaccggcaagaucuccuccaaggucgagcucgagaagaacuccggcaugcgcaccaaguaccgcaccaagaagggccacgucacccgcaagcucaccugccucugcaucgccuacuccuccaccaucggcggccucaccaccaucaccggcaccuccaccaaccucaucuucgccgaguacuucaacacccgcuaccccgacugccgcugccucaacuucggcuccugguucaccuucuccuuccccgccgcccucaucauccuccuccucuccuggaucuggcuccaguggcucuuccucggcuucaacuucaaggagauguucaagugcggcaagaccaagaccguccagcagaaggccugcgccgaggucaucaagcaggaguaccagaagcucggccccauccgcuaccaggagaucgucacccucguccucuucaucaucauggcccuccucugguucucccgcgaccccggcuucguccccggcugguccgcccucuucuccgaguaccccggcuucgccaccgacuccaccgucgcccuccucaucggccuccucuucuuccucauccccgccaagacccucaccaagaccacccccaccggcgagaucgucgccuucgacuacuccccccucaucaccuggaaggaguuccaguccuucaugcccugggacaucgccauccucgucggcggcggcuucgcccucgccgacggcugcgaggaguccggccucuccaaguggaucggcaacaagcucuccccccucggcucccuccccgccuggcucaucauccucaucuccucccucauggucaccucccucaccgaggucgccuccaaccccgccaccaucacccucuuccuccccauccucuccccccucgccgaggccauccacgucaacccccucuacauccucauccccuccacccucugcaccuccuucgccuuccuccuccccgucgccaacccccccaacgccaucgucuucuccuacggccaccucaaggucaucgacauggucaaggccggccucggcgucaacaucgucggcgucgccgucgucaugcucggcaucugcaccuggaucguccccauguucgaccucuacaccuaccccuccugggcccccgccauguccaacgagaccaugcccuga

SEQ ID NO: 49514 - RNA, 1926 nt, Artificial Sequence
  derived and/or modified sequence opt2 from SLC13A2__Homo_sapiens__NP_001139447
auggccaccugcuggcaggcccucugggccuaccgcuccuaccucaucgucuucuucguccccauccuccuccucccccuccccauccucguccccuccaaggaggccuacugcgccuacgccaucauccucauggcccucuucuggugcaccgaggcccucccccucgccgucaccgcccucuucccccucauccucuuccccaugaugggcaucgucgacgccuccgagaucauccagcgccccuuccccuccuccuucgagucccccggcgagugccaguccgucggcauguccgucaccgccucccacaaccucggcggcaccgucggcgacucccgcgucuuccccccccucucccacgucuccaccugccaggucgccgucgaguaccucaaggacuccaaccuccucuucuucggcggccuccucgucgccaucgccgucgagcacuggaaccuccacaagcgcaucgcccuccgcguccuccucaucgucggcguccgccccgccccccucauccucggcuucaugcucgucaccgccuuccucuccauguggaucuccaacaccgccaccuccgccaugaugguccccaucgcccacgccguccucgaccagcuccacuccucccaggccuccuccaacgucgaggagggcuccaacaaccccaccuucgagcuccaggagcccuccccccagaaggaggucaccaagcucgacaacggccaggcccuccccgucaccuccgccuccuccgagggccgcgcccaccucucccagaagcaccuccaccucacccagugcaugucccucugcgucugcuacuccgccuccaucggcggcaucgccacccucaccggcaccgcccccaaccucguccuccagggccagaucaacucccucuucccccagaacggcaacgucgucaacuucgccuccugguucuccuucgccuuccccaccauggucauccuccuccuccucgccuggcucuggcuccagauccucuuccucggcuucaacuuccgcaagaacuucggcaucggcgagaagaugcaggagcagcagcaggccgccuacugcgucauccagaccgagcaccgccuccucggccccaugaccuucgccgagaaggccaucuccauccucuucgucauccucguccuccucugguucacccgcgagcccggcuucuuccucggcuggggcaaccucgccuuccccaacgccaagggcgaguccauggucuccgacggcaccgucgccaucuucaucggcaucaucauguucaucauccccuccaaguuccccggccucacccaggaccccgagaaccccggcaagcucaaggccccccucggccuccucgacuggaagaccgucaaccagaagaugcccuggaacaucguccuccuccucggcggcggcuacgcccucgccaagggcuccgagcgcuccggccucuccgaguggcucggcaacaagcucaccccccuccaguccguccccgcccccgccaucgccaucauccucucccuccucgucgccaccuucaccgagugcaccuccaacgucgccaccaccaccaucuuccuccccauccucgccuccauggcccaggccaucugccuccacccccucuacgucaugcuccccugcacccucgccaccucccucgccuucaugcuccccgucgccaccccccccaacgccaucgucuucuccuucggcgaccucaagguccucgacauggcccgcgccggcuuccuccucaacaucaucggcguccucaucaucgcccucgccaucaacuccuggggcaucccccucuucucccuccacuccuuccccuccugggcccaguccaacaccaccgcccagugccuccccucccucgccaacaccaccacccccucccccuga

SEQ ID NO: 49515 - RNA, 1668 nt, Artificial Sequence
  derived and/or modified sequence opt2 from SLC13A3__Homo_sapiens__NP_001011554
auggccgucuacuggugcaccgaggcccucccccucuccgucaccgcccuccuccccaucguccucuuccccuucaugggcauccuccccuccaacaaggucugcccccaguacuuccucgacaccaacuuccucuuccucuccggccucaucauggccuccgccaucgaggaguggaaccuccaccgccgcaucgcccucaagauccucaugcucgucggcguccagcccgcccgccucauccucggcaugauggucaccaccuccuuccucuccauguggcucuccaacaccgccuccaccgccaugaugcuccccaucgccaacgccauccucaagucccucuucggccagaaggagguccgcaaggaccccucccaggaguccgaggagaacaccgccgccguccgccgcaacggccuccacaccguccccaccgagaugcaguuccucgccuccaccgaggccaaggaccaccccggcgagaccgaggucccccucgaccuccccgccgacucccgcaaggaggacgaguaccgccgcaacaucuggaagggcuuccucaucuccauccccuacuccgccuccaucggcggcaccgccacccucaccggcaccgcccccaaccucauccuccucggccagcucaaguccuucuucccccagugcgacgucgucaacuucggcuccugguucaucuucgccuucccccucaugcuccucuuccuccucgccggcuggcucuggaucuccuuccucuacggcggccucuccuuccgcggcuggcgcaagaacaaguccgagauccgcaccaacgccgaggaccgcgcccgcgccgucauccgcgaggaguaccagaaccucggccccaucaaguucgccgagcaggccgucuucauccucuucugcauguucgccauccuccucuucacccgcgaccccaaguucauccccggcugggccucccucuucaaccccggcuuccucuccgacgccgucaccggcgucgccaucgucaccauccucuucuucuuccccucccagcgccccucccucaaguggugguucgacuucaaggcccccaacaccgagaccgagccccuccucaccuggaagaaggcccaggagaccguccccuggaacaucauccuccuccucggcggcggcuucgccauggccaagggcugcgaggaguccggccucuccgucuggaucggcggccagcuccacccccucgagaacgucccccccgcccucgccguccuccucaucaccgucgucaucgccuucuucaccgaguucgccuccaacaccgccaccaucaucaucuuccuccccguccucgccgagcucgccauccgccuccgcguccacccccucuaccucaugauccccggcaccgucggcugcuccuucgccuucaugcuccccgucuccaccccccccaacuccaucgccuucgccuccggccaccuccucgucaaggacaugguccgcaccggccuccucaugaaccucaugggcguccuccuccucucccucgccaugaacaccugggcccagaccaucuuccagcucggcaccuuccccgacugggccgacauguacuccgucaacgucaccgcccucccccccacccucgccaacgacaccuuccgcacccucuga

SEQ ID NO: 49516 - RNA, 1569 nt, Artificial Sequence
  derived and/or modified sequence opt2 from SLC13A5__Homo_sapiens__NP_001137310
auggccuccgcccucuccuacgucuccaaguucaaguccuucgucauccucuucgucaccccccuccuccuccucccccucgucauccucaugcccgccaaguucguccgcugcgccuacgucaucauccucauggccaucuacuggugcaccgaggucaucccccucgccgucaccucccucaugcccguccuccucuucccccucuuccagauccucgacucccgccaggucugcguccaguacaugaaggacaccaacaugcucuuccucggcggccucaucgucgccgucgccgucgagcgcuggaaccuccacaagcgcaucgcccuccgcacccuccucugggucggcgccaagcccgcccgccucaugcucggcuucaugggcgucaccgcccuccucuccauguggaucuccaacaccgccaccaccgccaugaugguccccaucgucgaggccauccuccagcagauggaggccaccuccgccgccaccgaggccggccucgagcucgucgacaagggcaaggccaaggagcuccccggcucccaggucaucuucgagggccccacccucggccagcaggaggaccaggagcgcaagcgccucugcaaggccaugacccucugcaucugcuacgccgccuccaucggcggcaccgccacccucaccggcaccggccccaacgucguccuccucggccagaugaacgagcucuuccccgacuccaaggaccucgucaacuucgccuccugguucgccuucgccuuccccaacaugcucgucaugcuccucuucgccuggcucuggcuccaguucgucuacaugcgcuucaacuucaagaaguccuggggcugcggccucgaguccaagaagaacgagaaggccgcccucaagguccuccaggaggaguaccgcaagcucggcccccucuccuucgccgagaucaacguccucaucugcuucuuccuccucgucauccucugguucucccgcgaccccggcuucaugcccggcuggcucaccgucgccugggucgagggcgagaccaaguacgucuccgacgccaccgucgccaucuucgucgccacccuccucuucaucguccccucccagaagcccaaguucaacuuccgcucccagaccgaggaggagcgcaagacccccuucuacccccccccccuccucgacuggaaggucacccaggagaagguccccuggggcaucguccuccuccucggcggcggcuucgcccucgccaagggcuccgaggccuccggccucuccgucuggaugggcaagcagauggagccccuccacgccgucccccccgccgccaucacccucauccucucccuccucgucgccgucuucaccgagugcaccuccaacgucgccaccaccacccucuuccuccccaucuucgccuccauggucaagaccggcgucaucaugaacaucaucggcgucuucugcgucuuccucgccgucaacaccuggggccgcgccaucuucgaccucgaccacuuccccgacugggccaacgucacccacaucgagaccuga

SEQ ID NO: 49517 - RNA, 1338 nt, Artificial Sequence
  derived and/or modified sequence opt2 from SLC14A1__Homo_sapiens__NP_001122060
augaacggccgcucccucaucggcggcgccggcgacgcccgccacggccccgucuggaaggaccccuucggcaccaaggccggcgacgccgcccgccgcggcaucgcccgccucucccucgcccucgccgacggcucccaggagcaggagcccgaggaggagaucgccauggaggacucccccaccaugguccgcgucgacucccccaccaugguccgcggcgagaaccaggucucccccugccagggccgccgcugcuuccccaaggcccucggcuacgucaccggcgacaugaaggagcucgccaaccagcucaaggacaagcccgucguccuccaguucaucgacuggauccuccgcggcaucucccaggucgucuucgucaacaaccccgucuccggcauccucauccucgucggccuccucguccagaaccccuggugggcccucaccggcuggcucggcaccgucgucuccacccucauggcccuccuccucucccaggaccgcucccucaucgccuccggccucuacggcuacaacgccacccucgucggcguccucauggccgucuucuccgacaagggcgacuacuucugguggcuccuccuccccgucugcgccauguccaugaccugccccaucuucuccuccgcccucaacuccaugcucuccaagugggaccuccccgucuucacccuccccuucaacauggcccucuccauguaccucuccgccaccggccacuacaaccccuucuuccccgccaagcucgucauccccaucaccaccgcccccaacaucuccugguccgaccucuccgcccucgagcuccucaaguccauccccgucggcgucggccagaucuacggcugcgacaaccccuggaccggcggcaucuuccucggcgccauccuccucuccuccccccucaugugccuccacgccgccaucggcucccuccucggcaucgccgccggccucucccucuccgcccccuucgaggacaucuacuucggccucuggggcuucaacuccucccucgccugcaucgccaugggcggcauguucauggcccucaccuggcagacccaccuccucgcccucggcugcgcccucuucaccgccuaccucggcgucggcauggccaacuucauggccgaggucggccuccccgccugcaccuggcccuucugccucgccacccuccucuuccucaucaugaccaccaagaacuccaacaucuacaagaugccccucuccaaggucaccuaccccgaggagaaccgcaucuucuaccuccaggccaagaagcgcauggucgaguccccccucuga

SEQ ID NO: 49518 - RNA, 2763 nt, Artificial Sequence
  derived and/or modified sequence opt2 from SLC14A2__Homo_sapiens__XP_011524518
auguccgacccccacuccuccccccuccuccccgagccccucuccucccgcuacaagcucuacgaggccgaguucaccucccccuccuggcccuccaccucccccgacacccaccccgcccucccccuccucgagaugcccgaggagaaggaccuccgcuccuccaacgaggacucccacaucgucaagaucgagaagcucaacgagcgcuccaagcgcaaggacgacggcgucgcccaccgcgacuccgccggccagcgcugcaucugccucuccaaggccgucggcuaccucaccggcgacaugaaggaguaccgcaucuggcucaaggacaagcaccucgcccuccaguucaucgacuggguccuccgcggcaccgcccaggucauguucaucaacaacccccucuccggccucaucaucuucaucggccuccucauccagaaccccugguggaccaucaccggcggccucggcaccgucgucuccacccucaccgcccucgcccucggccaggaccgcuccgccaucgccuccggccuccacggcuacaacggcaugcucgucggccuccucauggccgucuucuccgagaagcucgacuacuacugguggcuccucuuccccgucaccuucaccgccauguccugccccguccucuccuccgcccucaacuccaucuucuccaagugggaccuccccgucuucacccuccccuucaacaucgccgucacccucuaccucgccgccaccggccacuacaaccucuucuuccccaccacccucgucgagcccgucuccuccguccccaacaucaccuggaccgagauggagaugccccuccuccuccaggccauccccgucggcgucggccaggucuacggcugcgacaaccccuggaccggcggcgucuuccucgucgcccucuucaucuccuccccccucaucugccuccacgccgccaucggcuccaucgucggccuccucgccgcccucuccgucgccacccccuucgagaccaucuacaccggccucugguccuacaacugcguccucuccugcaucgccaucggcggcauguucuacgcccucaccuggcagacccaccuccucgcccucaucugcgcccucuucugcgccuacauggaggccgccaucuccaacaucauguccgucgucggcgucccccccggcaccugggccuucugccucgccaccaucaucuuccuccuccucaccaccaacaaccccgccaucuuccgccucccccucuccaaggucaccuaccccgaggccaaccgcaucuacuaccucaccgucaaguccggcgaggaggagaaggcccccuccggcggcggcggcgagcacccccccaccgccggccccaaggucgaggagggcuccgaggccguccucuccaagcaccgcuccgucuuccacaucgagugguccuccauccgccgccgcuccaaggucuucggcaagggcgagcaccaggagcgccagaacaaggaccccuuccccuaccgcuaccgcaagcccaccgucgagcuccucgaccucgacaccauggaggaguccuccgagaucaaggucgagaccaacaucuccaagaccuccuggauccgcuccuccauggccgccuccggcaagcgcgucuccaaggcccucuccuacaucaccggcgagaugaaggagugcggcgagggccucaaggacaagucccccgucuuccaguucuucgacuggguccuccgcggcaccucccaggucauguucgucaacaacccccucuccggcauccucaucauccucggccucuucauccagaaccccuggugggccaucuccggcugccucggcaccaucauguccacccucaccgcccucauccucucccaggacaaguccgccaucgccgccggcuuccacggcuacaacggcguccucgucggccuccucauggccgucuucuccgacaagggcgacuacuacugguggcuccuccuccccgucaucaucauguccauguccugccccauccucuccuccgcccucggcaccaucuucuccaagugggaccuccccgucuucacccuccccuucaacaucaccgucacccucuaccucgccgccaccggccacuacaaccucuucuuccccaccacccuccuccagcccgccuccgccaugcccaacaucaccugguccgagguccaggucccccuccuccuccgcgccauccccgucggcaucggccaggucuacggcugcgacaaccccuggaccggcggcaucuuccucaucgcccucuucaucuccuccccccucaucugccuccacgccgccaucggcuccaccaugggcaugcucgccgcccucaccaucgccacccccuucgacuccaucuacuucggccucugcggcuucaacuccacccucgccugcaucgccaucggcggcauguucuacgucaucaccuggcagacccaccuccucgccaucgccugcgcccucuucgccgccuaccucggcgccgcccucgccaacaugcucuccgucuucggccucccccccugcaccuggcccuucugccucuccgcccucaccuuccuccuccucaccaccaacaaccccgccaucuacaagcucccccucuccaaggucaccuaccccgaggccaaccgcaucuacuaccucucccaggagcgcaaccgccgcgccuccaucaucaccaaguaccaggccuacgacgucuccuga

SEQ ID NO: 49519 - RNA, 2127 nt, Artificial Sequence
  derived and/or modified sequence opt2 from SLC15A1__Homo_sapiens__NP_005064
augggcauguccaagucccacuccuucuucggcuacccccucuccaucuucuucaucgucgucaacgaguucugcgagcgcuucuccuacuacggcaugcgcgccauccucauccucuacuucaccaacuucaucuccugggacgacaaccucuccaccgccaucuaccacaccuucgucgcccucugcuaccucacccccauccucggcgcccucaucgccgacuccuggcucggcaaguucaagaccaucgucucccucuccaucgucuacaccaucggccaggccgucaccuccgucuccuccaucaacgaccucaccgaccacaaccacgacggcacccccgacucccuccccguccacgucguccucucccucaucggccucgcccucaucgcccucggcaccggcggcaucaagcccugcgucuccgccuucggcggcgaccaguucgaggagggccaggagaagcagcgcaaccgcuucuucuccaucuucuaccucgccaucaacgccggcucccuccucuccaccaucaucacccccaugcuccgcguccagcagugcggcauccacuccaagcaggccugcuacccccucgccuucggcguccccgccgcccucauggccgucgcccucaucgucuucguccucggcuccggcauguacaagaaguucaagccccagggcaacaucaugggcaaggucgccaagugcaucggcuucgccaucaagaaccgcuuccgccaccgcuccaaggccuuccccaagcgcgagcacuggcucgacugggccaaggagaaguacgacgagcgccucaucucccagaucaagauggucacccgcgucauguuccucuacaucccccuccccauguucugggcccucuucgaccagcagggcucccgcuggacccuccaggccaccaccauguccggcaagaucggcgcccucgagauccagcccgaccagaugcagaccgucaacgccauccucaucgucaucaugguccccaucuucgacgccguccucuacccccucaucgccaagugcggcuucaacuucaccucccucaagaagauggccgucggcaugguccucgccuccauggccuucgucgucgccgccaucguccaggucgagaucgacaagacccuccccgucuuccccaagggcaacgagguccagaucaagguccucaacaucggcaacaacaccaugaacaucucccuccccggcgagauggucacccucggccccaugucccagaccaacgccuucaugaccuucgacgucaacaagcucacccgcaucaacaucuccucccccggcucccccgucaccgccgucaccgacgacuucaagcagggccagcgccacacccuccucgucugggcccccaaccacuaccaggucgucaaggacggccucaaccagaagcccgagaagggcgagaacggcauccgcuucgucaacaccuucaacgagcucaucaccaucaccauguccggcaaggucuacgccaacaucuccuccuacaacgccuccaccuaccaguucuuccccuccggcaucaagggcuucaccaucuccuccaccgagauccccccccagugccagcccaacuucaacaccuucuaccucgaguucggcuccgccuacaccuacaucguccagcgcaagaacgacuccugccccgaggucaaggucuucgaggacaucuccgccaacaccgucaacauggcccuccagaucccccaguacuuccuccucaccugcggcgaggucgucuucuccgucaccggccucgaguucuccuacucccaggcccccuccaacaugaaguccguccuccaggccggcuggcuccucaccgucgccgucggcaacaucaucguccucaucgucgccggcgccggccaguucuccaagcagugggccgaguacauccucuucgccgcccuccuccucgucgucugcgucaucuucgccaucauggcccgcuucuacaccuacaucaaccccgccgagaucgaggcccaguucgacgaggacgagaagaagaaccgccucgagaaguccaaccccuacuucauguccggcgccaacucccagaagcagauguga

SEQ ID NO: 49520 - RNA, 2097 nt, Artificial Sequence
  derived and/or modified sequence opt2 from SLC15A2__Homo_sapiens__NP_001139470
augaaccccuuccagaagaacgaguccaaggagacccucuucucccccgucuccaucgaggagguccccccccgcccccccuccccccccaagaagcccucccccaccaucugcggcuccaacuacccccucuccaucgccuucaucgucgucaacgaguucugcgagcgcuucuccuacuacggcaugaaggccguccucauccucuacuuccucuacuuccuccacuggaacgaggacaccuccaccuccaucuaccacgccuucuccucccucugcuacuucacccccauccucggcgccgccaucgccgacuccuggcucggcaaguucaagguccucucccucaucggccucucccucaucgcccucggcaccggcggcaucaagcccugcgucgccgccuucggcggcgaccaguucgaggagaagcacgccgaggagcgcacccgcuacuucuccgucuucuaccucuccaucaacgccggcucccucaucuccaccuucaucacccccaugcuccgcggcgacguccagugcuucggcgaggacugcuacgcccucgccuucggcguccccggccuccucauggucaucgcccucgucgucuucgccaugggcuccaagaucuacaacaagcccccccccgagggcaacaucgucgcccaggucuucaagugcaucugguucgccaucuccaaccgcuucaagaaccgcuccggcgacauccccaagcgccagcacuggcucgacugggccgccgagaaguaccccaagcagcucaucauggacgucaaggcccucacccgcguccucuuccucuacaucccccuccccauguucugggcccuccucgaccagcagggcucccgcuggacccuccaggccauccgcaugaaccgcaaccucggcuucuucguccuccagcccgaccagaugcagguccucaacccccuccucguccucaucuucaucccccucuucgacuucgucaucuaccgccucgucuccaagugcggcaucaacuucuccucccuccgcaagauggccgucggcaugauccucgccugccucgccuucgccgucgccgccgccgucgagaucaagaucaacgagauggcccccgcccagcccggcccccaggaggucuuccuccagguccucaaccucgccgacgacgaggucaaggucaccgucgucggcaacgagaacaacucccuccucaucgaguccaucaaguccuuccagaagaccccccacuacuccaagcuccaccucaagaccaagucccaggacuuccacuuccaccucaaguaccacaaccucucccucuacaccgagcacuccguccaggagaagaacugguacucccucgucauccgcgaggacggcaacuccaucuccuccaugauggucaaggacaccgagucccgcaccaccaacggcaugaccaccguccgcuucgucaacacccuccacaaggacgucaacaucucccucuccaccgacaccucccucaacgucggcgaggacuacggcgucuccgccuaccgcaccguccagcgcggcgaguaccccgccguccacugccgcaccgaggacaagaacuucucccucaaccucggccuccucgacuucggcgccgccuaccucuucgucaucaccaacaacaccaaccagggccuccaggccuggaagaucgaggacauccccgccaacaagauguccaucgccuggcagcucccccaguacgcccucgucaccgccggcgaggucauguucuccgucaccggccucgaguucuccuacucccaggcccccuccuccaugaaguccguccuccaggccgccuggcuccucaccaucgccgucggcaacaucaucguccucgucgucgcccaguucuccggccucguccagugggccgaguucauccucuucuccugccuccuccucgucaucugccucaucuucuccaucaugggcuacuacuacguccccgucaagaccgaggacaugcgcggccccgccgacaagcacaucccccacauccagggcaacaugaucaagcucgagaccaagaagaccaagcucuga

SEQ ID NO: 49521 - RNA, 1734 nt, Artificial Sequence
  derived and/or modified sequence opt2 from SLC15A4__Homo_sapiens__NP_663623
auggagggcuccggcggcggcgccggcgagcgcgccccccuccucggcgcccgccgcgccgccgccgccgccgccgccgccggcgccuucgccggccgccgcgccgccugcggcgccguccuccucaccgagcuccucgagcgcgccgccuucuacggcaucaccuccaaccucguccucuuccucaacggcgcccccuucugcugggagggcgcccaggccuccgaggcccuccuccucuucaugggccucaccuaccucggcucccccuucggcggcuggcucgccgacgcccgccucggccgcgcccgcgccauccuccucucccucgcccucuaccuccucggcaugcucgccuucccccuccucgccgcccccgccacccgcgccgcccucugcggcuccgcccgccuccucaacugcaccgcccccggccccgacgccgccgcccgcugcugcucccccgccaccuucgccggccucguccucgucggccucggcgucgccaccgucaaggccaacaucacccccuucggcgccgaccaggucaaggaccgcggccccgaggccacccgccgcuucuucaacugguucuacugguccaucaaccucggcgccauccucucccucggcggcaucgccuacauccagcagaacgucuccuucgucaccggcuacgccauccccaccgucugcgucggccucgccuucgucgucuuccucugcggccaguccgucuucaucaccaagccccccgacggcuccgccuucaccgacauguucaagauccucaccuacuccugcugcucccagaagcgcuccggcgagcgccaguccaacggcgagggcaucggcgucuuccagcaguccuccaagcagucccucuucgacuccugcaagaugucccacggcggccccuucaccgaggagaaggucgaggacgucaaggcccucgucaagaucguccccgucuuccucgcccucauccccuacuggaccgucuacuuccagaugcagaccaccuacguccuccagucccuccaccuccgcauccccgagaucuccaacaucaccaccaccccccacacccuccccgccgccuggcucaccauguucgacgccguccucauccuccuccucaucccccucaaggacaagcucgucgaccccauccuccgccgccacggccuccuccccuccucccucaagcgcaucgccgucggcauguucuucgucaugugcuccgccuucgccgccggcauccucgaguccaagcgccucaaccucgucaaggagaagaccaucaaccagaccaucggcaacgucgucuaccacgccgccgaccucucccucugguggcaggucccccaguaccuccucaucggcaucuccgagaucuucgccuccaucgccggccucgaguucgccuacuccgccgcccccaaguccaugcaguccgccaucaugggccucuucuucuucuucuccggcgucggcuccuucgucggcuccggccuccucgcccucgucuccaucaaggccaucggcuggauguccucccacaccgacuucggcaacaucaacggcugcuaccucaacuacuacuucuuccuccucgccgccauccagggcgccacccuccuccucuuccucaucaucuccgucaaguacgaccaccaccgcgaccaccagcgcucccgcgccaacggcguccccaccucccgccgcgccuga

SEQ ID NO: 49522 - RNA, 1548 nt, Artificial Sequence
  derived and/or modified sequence opt2 from SLC16A10__Homo_sapiens__NP_061063
augguccucucccaggaggagcccgacuccgcccgcggcaccuccgaggcccagccccucggccccgcccccaccggcgccgcccccccccccggccccggccccuccgacucccccgaggccgccgucgagaaggucgaggucgagcucgccggccccgccaccgccgagccccacgagccccccgagccccccgagggcggcuggggcuggcucgucaugcucgccgccauguggugcaacggcuccgucuucggcauccagaacgccugcggcguccucuucgucuccaugcucgagaccuucggcuccaaggacgacgacaagauggucuucaagaccgccugggucggcucccucuccaugggcaugaucuucuucugcugccccaucgucuccgucuucaccgaccucuucggcugccgcaagaccgccgucgucggcgccgccgucggcuucgucggccucauguccuccuccuucgucuccuccaucgagccccucuaccucaccuacggcaucaucuucgccugcggcugcuccuucgccuaccagcccucccucgucauccucggccacuacuucaagaagcgccucggccucgucaacggcaucgucaccgccggcuccuccgucuucaccauccuccucccccuccuccuccgcguccucaucgacuccgucggccucuucuacacccuccgcguccucugcaucuucauguucguccucuuccucgccggcuucaccuaccgcccccucgccaccuccaccaaggacaaggaguccggcggcuccggcuccucccucuucucccgcaagaaguucuccccccccaagaagaucuucaacuucgccaucuucaaggucaccgccuacgccgucugggccgucggcaucccccucgcccucuucggcuacuucguccccuacguccaccucaugaagcacgucaacgagcgcuuccaggacgagaagaacaaggaggucguccucaugugcaucggcgucaccuccggcgucggccgccuccucuucggccgcaucgccgacuacguccccggcgucaagaaggucuaccuccagguccucuccuucuucuucaucggccucauguccaugaugaucccccucugcuccaucuucggcgcccucaucgccgucugccucaucaugggccucuucgacggcugcuucaucuccaucauggcccccaucgccuucgagcucgucggcgcccaggacgucucccaggccaucggcuuccuccucggcuucauguccauccccaugaccgucggcccccccaucgccggccuccuccgcgacaagcucggcuccuacgacgucgccuucuaccucgccggcguccccccccucaucggcggcgccguccucugcuucauccccuggauccacuccaagaagcagcgcgagaucuccaagaccaccggcaaggagaagauggagaagaugcucgagaaccagaacucccuccucuccuccuccuccggcauguucaagaaggaguccgacuccaucaucuga

SEQ ID NO: 49523 - RNA, 1416 nt, Artificial Sequence
  derived and/or modified sequence opt2 from SLC16A11__Homo_sapiens__NP_699188
augcccgccccccagcgcaagcaccgccgcggcggcuucucccaccgcugcuuccccaccccccagaccgccaugaccccccagcccgccggcccccccgacggcggcuggggcugggucgucgccgccgccgccuucgccaucaacggccucuccuacggccuccuccgcucccucggccucgccuuccccgaccucgccgagcacuucgaccgcuccgcccaggacaccgccuggaucuccgcccucgcccucgccguccagcaggccgccucccccgucggcuccgcccucuccacccgcuggggcgcccgccccgucgucauggucggcggcguccucgccucccucggcuucgucuucuccgccuucgccuccgaccuccuccaccucuaccucggccucggccuccucgccggcuucggcugggcccucgucuucgcccccgcccucggcacccucucccgcuacuucucccgccgccgcguccucgccgucggccucgcccucaccggcaacggcgccuccucccuccuccucgcccccgcccuccagcuccuccucgacaccuucggcuggcgcggcgcccuccuccuccucggcgccaucacccuccaccucacccccugcggcgcccuccuccucccccucguccuccccggcgacccccccgcccccccccgcuccccccucgccgcccucggccucucccucuucacccgccgcgccuucuccaucuucgcccucggcaccgcccucgucggcggcggcuacuucguccccuacguccaccucgccccccacgcccucgaccgcggccucggcggcuacggcgccgcccucgucgucgccgucgccgccaugggcgacgccggcgcccgccucgucugcggcuggcucgccgaccagggcugggucccccucccccgccuccucgccgucuucggcgcccucaccggccucggccucugggucgucggccucguccccgucgucggcggcgaggaguccuggggcggcccccuccucgccgccgccgucgccuacggccucuccgccggcuccuacgccccccucgucuucggcguccuccccggccucgucggcgucggcggcgucguccaggccaccggccucgucaugaugcucaugucccucggcggccuccucggccccccccucuccggcuuccuccgcgacgagaccggcgacuucaccgccuccuuccuccucuccggcucccucauccucuccggcuccuucaucuacaucggccucccccgcgcccuccccuccugcggccccgccuccccccccgccacccccccccccgagaccggcgagcuccuccccgccccccaggccguccuccucucccccggcggccccggcuccacccucgacaccaccugcuga

SEQ ID NO: 49524 - RNA, 1551 nt, Artificial Sequence
  derived and/or modified sequence opt2 from SLC16A12__Homo_sapiens__NP_998771
augcccuccggcucccacuggaccgccaacuccuccaagaucaucaccuggcuccucgagcagcccggcaaggaggagaagcgcaagaccauggccaaggucaaccgcgcccgcuccaccuccccccccgacggcggcuggggcuggaugaucgucgccggcugcuuccucgucaccaucugcacccgcgccgucacccgcugcaucuccaucuucuucgucgaguuccagaccuacuucacccaggacuacgcccagaccgccuggauccacuccaucgucgacugcgucaccaugcucugcgccccccucggcuccgucgucuccaaccaccucuccugccaggucggcaucaugcucggcggccuccucgccuccaccggccucauccucuccuccuucgccaccucccucaagcaccucuaccucacccucggcguccucaccggccucggcuucgcccucugcuacucccccgccaucgccauggucggcaaguacuucucccgccgcaaggcccucgccuacggcaucgccauguccggcuccggcaucggcaccuucauccucgcccccgucguccagcuccucaucgagcaguucuccuggcgcggcgcccuccucauccucggcggcuucguccucaaccucugcgucugcggcgcccucaugcgccccaucacccucaaggaggaccacaccacccccgagcagaaccacgucugccgcacccagaaggaggacaucaagcgcgucucccccuacuccucccucaccaaggagugggcccagaccugccucugcugcugccuccagcaggaguacuccuuccuccucauguccgacuucgucguccucgccgucuccguccucuucauggccuacggcugcuccccccucuucgucuaccucguccccuacgcccucuccgucggcgucucccaccagcaggccgccuuccucauguccauccucggcgucaucgacaucaucggcaacaucaccuucggcuggcucaccgaccgccgcugccucaagaacuaccaguacgucugcuaccucuucgccgucggcauggacggccucugcuaccucugccuccccaugcuccagucccucccccuccucguccccuucuccugcaccuucggcuacuucgacggcgccuacgucacccucauccccgucgucaccaccgagaucgucggcaccaccucccucuccuccgcccucggcgucgucuacuuccuccacgccguccccuaccucgucuccccccccaucgccggccgccucgucgacaccaccggcuccuacaccgccgccuuccuccucugcggcuucuccaugaucuucuccuccguccuccucggcuucgcccgccucaucaagcgcaugcgcaagacccagcuccaguucaucgccaaggaguccgaccccaagcuccagcucuggaccaacggcuccgucgccuacuccgucgcccgcgagcucgaccagaagcacggcgagcccgucgccaccgccguccccggcuacucccucaccuga

SEQ ID NO: 49525 - RNA, 1281 nt, Artificial Sequence
  derived and/or modified sequence opt2 from SLC16A13__Homo_sapiens__NP_963860
auggcccgccgcaccgagccccccgacggcggcuggggcugggucgucguccucuccgccuucuuccaguccgcccucgucuucggcguccuccgcuccuucggcgucuucuucgucgaguucgucgccgccuucgaggagcaggccgcccgcgucuccuggaucgccuccaucggcaucgccguccagcaguucggcucccccgucggcuccgcccucuccaccaaguucggcccccgccccgucgucaugaccggcggcauccucgccgcccucggcaugcuccucgccuccuucgccaccucccucacccaccucuaccucuccaucggccuccucuccggcuccggcugggcccucaccuucgcccccacccucgccugccucuccugcuacuucucccgccgccgcucccucgccaccggccucgcccucaccggcgucggccucuccuccuucaccuucgcccccuucuuccaguggcuccucucccacuacgccuggcgcggcucccuccuccucgucuccgcccucucccuccaccucgucgccugcggcgcccuccuccgcccccccucccucgccgaggaccccgccgucggcggcccccgcgcccagcucaccucccuccuccaccacggccccuuccuccgcuacaccgucgcccucacccucaucaacaccggcuacuucauccccuaccuccaccucgucgcccaccuccaggaccucgacugggacccccuccccgccgccuuccuccucuccgucgucgccaucuccgaccucgucggccgcgucgucuccggcuggcucggcgacgccguccccggccccgucacccgccuccucaugcucuggaccacccucaccggcgucucccucgcccucuuccccgucgcccaggcccccaccgcccucgucgcccucgccgucgccuacggcuucaccuccggcgcccucgccccccucgccuucuccguccuccccgagcucaucggcacccgccgcaucuacugcggccucggccuccuccagaugaucgaguccaucggcggccuccucggccccccccucuccggcuaccuccgcgacgucaccggcaacuacaccgccuccuucgucgucgccggcgccuuccuccucuccggcuccggcauccuccucacccucccccacuucuucugcuucuccaccaccaccuccggcccccaggaccucgucaccgaggcccucgacaccaaggucccccuccccaaggagggccucgaggaggacuga

SEQ ID NO: 49526 - RNA, 1503 nt, Artificial Sequence
  derived and/or modified sequence opt2 from SLC16A1__Homo_sapiens__XP_011540329
augccccccgccgucggcggccccgucggcuacaccccccccgacggcggcuggggcugggccgucgucaucggcgccuucaucuccaucggcuucuccuacgccuuccccaaguccaucaccgucuucuucaaggagaucgagggcaucuuccacgccaccaccuccgaggucuccuggaucuccuccaucaugcucgccgucauguacggcggcggccccaucuccuccauccucgucaacaaguacggcucccgcaucgucaugaucgucggcggcugccucuccggcugcggccucaucgccgccuccuucugcaacaccguccagcagcucuacgucugcaucggcgucaucggcggccucggccucgccuucaaccucaaccccgcccucaccaugaucggcaaguacuucuacaagcgccgcccccucgccaacggccucgccauggccggcucccccgucuuccucugcacccucgccccccucaaccaggucuucuucggcaucuucggcuggcgcggcuccuuccucauccucggcggccuccuccucaacugcugcgucgccggcgcccucaugcgccccaucggccccaagcccaccaaggccggcaaggacaaguccaaggccucccucgagaaggccggcaaguccggcgucaagaaggaccuccacgacgccaacaccgaccucaucggccgccaccccaagcaggagaagcgcuccgucuuccagaccaucaaccaguuccucgaccucacccucuucacccaccgcggcuuccuccucuaccucuccggcaacgucaucauguucuucggccucuucgccccccucgucuuccucuccuccuacggcaagucccagcacuacuccuccgagaaguccgccuuccuccucuccauccucgccuucgucgacauggucgcccgccccuccaugggccucgucgccaacaccaagcccauccgcccccgcauccaguacuucuucgccgccuccgucgucgccaacggcgucugccacaugcucgccccccucuccaccaccuacgucggcuucugcgucuacgccggcuucuucggcuucgccuucggcuggcucuccuccguccucuucgagacccucauggaccucgucggcccccagcgcuucuccuccgccgucggccucgucaccaucgucgagugcugccccguccuccucggccccccccuccucggccgccucaacgacauguacggcgacuacaaguacaccuacugggccugcggcgucguccucaucaucuccggcaucuaccucuucaucggcaugggcaucaacuaccgccuccucgccaaggagcagaaggccaacgagcagaagaaggaguccaaggaggaggagaccuccaucgacgucgccggcaagcccaacgaggucaccaaggccgccgagucccccgaccagaaggacaccgacggcggccccaaggaggaggagucccccgucuga

SEQ ID NO: 49527 - RNA, 1620 nt, Artificial Sequence
  derived and/or modified sequence opt2 from SLC16A2__Homo_sapiens__NP_006508
auggcccuccagucccaggccuccgaggaggccaagggccccuggcaggaggccgaccaggagcagcaggagcccgucggcucccccgagcccgaguccgagcccgagcccgagcccgagcccgagcccguccccguccccccccccgagccccagcccgagccccagccccuccccgaccccgccccccuccccgagcucgaguucgaguccgagcgcguccacgagcccgagcccacccccaccgucgagacccgcggcaccgcccgcggcuuccagccccccgagggcggcuucggcugggucgucgucuucgccgccaccuggugcaacggcuccaucuucggcauccacaacuccgucggcauccucuacuccaugcuccucgaggaggagaaggagaagaaccgccaggucgaguuccaggccgccugggucggcgcccucgccaugggcaugaucuucuucugcucccccaucgucuccaucuucaccgaccgccucggcugccgcaucaccgccaccgccggcgccgccgucgccuucaucggccuccacaccuccuccuucaccuccucccucucccuccgcuacuucaccuacggcauccucuucggcugcggcugcuccuucgccuuccagcccucccucgucauccucggccacuacuuccagcgccgccucggccucgccaacggcgucgucuccgccggcuccuccaucuucuccauguccuuccccuuccucauccgcaugcucggcgacaagaucaagcucgcccagaccuuccagguccucuccaccuucauguucguccucaugcuccucucccucaccuaccgcccccuccuccccuccucccaggacacccccuccaagcgcggcguccgcacccuccaccagcgcuuccucgcccagcuccgcaaguacuucaacaugcgcgucuuccgccagcgcaccuaccgcaucugggccuucggcaucgccgccgccgcccucggcuacuucguccccuacguccaccucaugaaguacgucgaggaggaguucuccgagaucaaggagaccuggguccuccucgucugcaucggcgccaccuccggccucggccgccucgucuccggccacaucuccgacuccauccccggccucaagaagaucuaccuccagguccucuccuuccuccuccucggccucauguccaugaugaucccccucugccgcgacuucggcggccucaucgucgucugccucuuccucggccucugcgacggcuucuucaucaccaucauggcccccaucgccuucgagcucgucggccccaugcaggccucccaggccaucggcuaccuccucggcaugauggcccuccccaugaucgccggcccccccaucgccggccuccuccgcaacugcuucggcgacuaccacgucgccuucuacuucgccggcgucccccccaucaucggcgccgucauccucuucuucgucccccucaugcaccagcgcauguucaagaaggagcagcgcgacuccuccaaggacaagaugcucgcccccgaccccgaccccaacggcgagcuccuccccggcucccccaaccccgaggagcccaucuga

SEQ ID NO: 49528 - RNA, 1398 nt, Artificial Sequence
  derived and/or modified sequence opt2 from SLC16A3__Homo_sapiens__XP_011521909
augggcggcgccgucgucgacgagggccccaccggcgucaaggcccccgacggcggcuggggcugggccguccucuucggcugcuucgucaucaccggcuucuccuacgccuuccccaaggccgucuccgucuucuucaaggagcucauccaggaguucggcaucggcuacuccgacaccgccuggaucuccuccauccuccucgccaugcucuacggcaccggcccccucugcuccgucugcgucaaccgcuucggcugccgccccgucaugcucgucggcggccucuucgccucccucggcauggucgccgccuccuucugccgcuccaucauccaggucuaccucaccaccggcgucaucaccggccucggccucgcccucaacuuccagcccucccucaucaugcucaaccgcuacuucuccaagcgccgccccauggccaacggccucgccgccgccggcucccccgucuuccucugcgcccucuccccccucggccagcuccuccaggaccgcuacggcuggcgcggcggcuuccucauccucggcggccuccuccucaacugcugcgucugcgccgcccucaugcgcccccucgucgucaccgcccagcccggcuccggccccccccgccccucccgccgccuccucgaccucuccgucuuccgcgaccgcggcuucguccucuacgccgucgccgccuccgucaugguccucggccucuucgucccccccgucuucgucgucuccuacgccaaggaccucggcguccccgacaccaaggccgccuuccuccucaccauccucggcuucaucgacaucuucgcccgccccgccgccggcuucgucgccggccucggcaagguccgccccuacuccgucuaccucuucuccuucuccauguucuucaacggccucgccgaccucgccggcuccaccgccggcgacuacggcggccucgucgucuucugcaucuucuucggcaucuccuacggcauggucggcgcccuccaguucgagguccucauggccaucgucggcacccacaaguucuccuccgccaucggccucguccuccucauggaggccgucgccguccucgucggcccccccuccggcggcaagcuccucgacgccacccacgucuacauguacgucuucauccucgccggcgccgagguccucaccuccucccucauccuccuccucggcaacuucuucugcauccgcaagaagcccaaggagccccagcccgaggucgccgccgccgaggaggagaagcuccacaagccccccgccgacuccggcgucgaccuccgcgaggucgagcacuuccucaaggccgagcccgagaagaacggcgaggucguccacacccccgagaccuccgucuga

SEQ ID NO: 49529 - RNA, 1572 nt, Artificial Sequence
  derived and/or modified sequence opt2 from SLC16A6__Homo_sapiens__NP_004685
augacccagaacaagcucaagcucugcuccaaggccaacgucuacaccgagguccccgacggcggcuggggcugggccgucgccgucuccuucuucuucgucgaggucuucaccuacggcaucaucaagaccuucggcgucuucuucaacgaccucauggacuccuucaacgaguccaacucccgcaucuccuggaucaucuccaucugcgucuucguccucaccuucuccgccccccucgccaccguccucuccaaccgcuucggccaccgccucgucgucaugcucggcggccuccucgucuccaccggcauggucgccgccuccuucucccaggaggucucccacauguacgucgccaucggcaucaucuccggccucggcuacugcuucuccuuccuccccaccgucaccauccucucccaguacuucggcaagcgccgcuccaucgucaccgccgucgccuccaccggcgagugcuucgccgucuucgccuucgcccccgccaucauggcccucaaggagcgcaucggcuggcgcuacucccuccucuucgucggccuccuccagcucaacaucgucaucuucggcgcccuccuccgccccaucuucauccgcggccccgccucccccaagaucgucauccaggagaaccgcaaggaggcccaguacaugcucgagaacgagaagacccgcaccuccaucgacuccaucgacuccggcgucgagcucaccaccucccccaagaacguccccacccacaccaaccucgagcucgagcccaaggccgacaugcagcagguccucgucaagaccuccccccgccccuccgagaagaaggccccccuccucgacuucuccauccucaaggagaaguccuucaucugcuacgcccucuucggccucuucgccacccucggcuucuucgcccccucccucuacaucaucccccucggcaucucccucggcaucgaccaggaccgcgccgccuuccuccucuccaccauggccaucgccgaggucuucggccgcaucggcgccggcuucguccucaaccgcgagcccauccgcaagaucuacaucgagcucaucugcgucauccuccucaccgucucccucuucgccuucaccuucgccaccgaguucuggggccucauguccugcuccaucuucuucggcuucauggucggcaccaucggcggcacccacaucccccuccucgccgaggacgacgucgucggcaucgagaagauguccuccgccgccggcgucuacaucuucauccaguccaucgccggccucgccggccccccccucgccggccuccucgucgaccaguccaagaucuacucccgcgccuucuacuccugcgccgccggcauggcccucgccgccgucugccucgcccucguccgccccugcaagaugggccucugccagcaccaccacuccggcgagaccaaggucgucucccaccgcggcaagacccuccaggacauccccgaggacuuccucgagauggaccucgccaagaacgagcaccgcguccacguccagauggagcccgucuga

SEQ ID NO: 49530 - RNA, 1437 nt, Artificial Sequence
  derived and/or modified sequence opt2 from SLC16A7__Homo_sapiens__XP_005269288
augccccccaugcccuccgccccccccguccaccccccccccgacggcggcuggggcuggaucgucgucggcgccgccuucaucuccaucggcuucuccuacgccuuccccaaggccgucaccgucuucuucaaggagauccagcagaucuuccacaccaccuacuccgagaucgccuggaucuccuccaucaugcucgccgucauguacgccggcggccccgucuccuccguccucgucaacaaguacggcucccgccccgucgucaucgccggcggccuccucugcugccucggcaugguccucgccuccuucuccuccuccgucguccagcucuaccucaccaugggcuucaucaccggccucggccucgccuucaaccuccagcccgcccucaccaucaucggcaaguacuucuaccgcaagcgccccauggccaacggccucgccauggccggcucccccgucuuccucuccucccucgcccccuucaaccaguaccucuucaacaccuucggcuggaagggcuccuuccucauccucggcucccuccuccucaacgccugcgucgccggcucccucaugcgcccccucggccccaaccagaccaccuccaaguccaagaacaagaccggcaagaccgaggacgacuccucccccaagaagaucaagaccaagaaguccaccugggagaaggucaacaaguaccucgacuucucccucuucaagcaccgcggcuuccucaucuaccucuccggcaacgucaucauguuccucggcuucuucgcccccaucaucuuccucgcccccuacgccaaggaccagggcaucgacgaguacuccgccgccuuccuccucuccgucauggccuucgucgacauguucgcccgccccuccgucggccucaucgccaacuccaaguacauccgcccccgcauccaguacuucuucuccuucgccaucauguucaacggcgucugccaccuccucugcccccucgcccaggacuacaccucccucguccucuacgccgucuucuucggccucggcuucggcuccgucuccuccguccucuucgagacccucauggaccucgucggcgccccccgcuucuccuccgccgucggccucgucaccaucgucgagugcggccccguccuccucggccccccccucgccggcaagcucgucgaccucaccggcgaguacaaguacauguacauguccugcggcgccaucgucgucgccgccuccgucuggcuccucaucggcaacgccaucaacuaccgccuccucgccaaggagcgcaaggaggagaacgcccgccagaagacccgcgaguccgagccccucuccaaguccaagcacuccgaggacgucaacgucaaggucuccaacgcccaguccgucaccuccgagcgcgagaccaacaucuga

SEQ ID NO: 49531 - RNA, 1515 nt, Artificial Sequence
  derived and/or modified sequence opt2 from SLC16A8__Homo_sapiens__NP_037488
augggcgccggcggcccccgccgcggcgagggcccccccgacggcggcuggggcugggucguccucggcgccugcuucgucgucaccggcuucgccuacggcuuccccaaggccgucuccgucuucuuccgcgcccucaugcgcgacuucgacgccggcuacuccgacaccgccugggucuccuccaucaugcucgccaugcucuacggcaccggccccgucuccuccauccucgucacccgcuucggcugccgccccgucaugcucgccggcggccuccucgccuccgccggcaugauccucgccuccuucgccacccgccuccucgagcucuaccucaccgccggcguccucaccggccucggccucgcccucaacuuccagcccucccucaucaugcucggccucuacuucgagcgccgccgcccccucgccaacggccucgccgccgccggcucccccgucuuccucuccgcccucuccccccucggccagcagcuccucgagcgcuucggcuggcgcggcggcuuccuccuccucggcggccuccuccuccacugcugcgccugcggcgccgucaugcgccccccccccggccccggcccccgcccccgccgcgacuccgccggcgaccgcgccggcgacgcccccggcgaggccgaggccgacggcgccggccuccagcuccgcgaggccuccccccgcguccgcccccgccgccgccuccucgaccucgccgucugcaccgaccgcgccuucgccgucuacgccgucaccaaguuccucauggcccucggccucuucguccccgccauccuccucgucaacuacgccaaggacgccggcguccccgacaccgacgccgccuuccuccucuccaucgucggcuucgucgacaucgucgcccgccccgccugcggcgcccucgccggccucgcccgccuccgcccccacguccccuaccucuucucccucgcccuccucgccaacggccucaccgaccucuccuccgcccgcgcccgcuccuacggcgcccucgucgccuucugcgucgccuucggccucuccuacggcauggucggcgcccuccaguucgagguccucauggccgccgucggcgccccccgcuuccccuccgcccucggccucguccuccucgucgaggccgccgccguccucaucggcccccccuccgccggccgccucgucgacguccucaagaacuacgagaucaucuucuaccucgccggcuccgaggucgcccucgccggcgucuucauggccgucgccaccaacugcugccuccgcugcgccaaggccgcccccuccggccccggcaccgagggcggcgccuccgacaccgaggacgccgaggccgagggcgacuccgagccccuccccgucgucgccgaggagcccggcaaccucgaggcccucgagguccucuccgcccgcggcgagcccaccgagcccgagaucgaggcccgcccccgccucgccgccgaguccgucuga

SEQ ID NO: 49532 - RNA, 1530 nt, Artificial Sequence
  derived and/or modified sequence opt2 from SLC16A9__Homo_sapiens__NP_919274
auggagcucaagaagucccccgacggcggcuggggcugggucaucgucuucgucuccuuccucacccaguuccucugcuacggcuccccccucgccgucggcguccucuacaucgaguggcucgacgccuucggcgagggcaagggcaagaccgccugggucggcucccucgccuccggcgucggccuccucgccucccccgucugcucccucugcgucuccuccuucggcgcccgccccgucaccaucuucuccggcuucauggucgccggcggccucaugcucuccuccuucgcccccaacaucuacuuccucuucuucuccuacggcaucgucgucggccucggcugcggccuccucuacaccgccaccgucaccaucaccugccaguacuucgacgaccgccgcggccucgcccucggccucaucuccaccggcuccuccgucggccucuucaucuacgccgcccuccagcgcaugcucgucgaguucuacggccucgacggcugccuccucaucgucggcgcccucgcccucaacauccucgccugcggcucccucaugcgcccccuccaguccuccgacugcccccuccccaagaagaucgcccccgaggaccuccccgacaaguacuccaucuacaacgagaagggcaagaaccucgaggagaacaucaacauccucgacaaguccuacuccuccgaggagaagugccgcaucacccucgccaacggcgacuggaagcaggacucccuccuccacaagaaccccaccgucacccacaccaaggagcccgagaccuacaagaagaaggucgccgagcagaccuacuucugcaagcagcucgccaagcgcaaguggcagcucuacaagaacuacugcggcgagaccgucgcccucuucaagaacaaggucuucuccgcccucuucaucgccauccuccucuucgacaucggcggcuucccccccucccuccucauggaggacgucgcccgcuccuccaacgucaaggaggaggaguucaucaugccccucaucuccaucaucggcaucaugaccgccgucggcaagcuccuccucggcauccucgccgacuucaaguggaucaacacccucuaccucuacgucgccacccucaucaucaugggccucgcccucugcgccauccccuucgccaaguccuacgucacccucgcccuccucuccggcauccucggcuuccucaccggcaacugguccaucuuccccuacgucaccaccaagaccgucggcaucgagaagcucgcccacgccuacggcauccucauguucuucgccggccucggcaacucccucggcccccccaucgucggcugguucuacgacuggacccagaccuacgacaucgccuucuacuucuccggcuucugcguccuccucggcggcuucauccuccuccucgccgcccuccccuccugggacaccugcaacaagcagcuccccaagcccgcccccaccaccuuccucuacaaggucgccuccaacgucuga

SEQ ID NO: 49533 - RNA, 1404 nt, Artificial Sequence
  derived and/or modified sequence opt2 from SLC17A1__Homo_sapiens__NP_005065
augcagauggacaaccgccucccccccaagaagguccccggcuucugcuccuuccgcuacggccucuccuuccucguccacugcugcaacgucaucaucaccgcccagcgcgccugccucaaccucaccauggucgucauggucaacuccaccgacccccacggccuccccaacaccuccaccaagaagcuccucgacaacaucaagaaccccauguacaacuggucccccgacauccagggcaucauccucuccuccaccuccuacggcgucaucaucauccagguccccgucggcuacuucuccggcaucuacuccaccaagaagaugaucggcuucgcccucugccucuccuccguccucucccuccucaucccccccgccgccggcaucggcgucgccugggucgucgucugccgcgccguccagggcgccgcccagggcaucgucgccaccgcccaguucgagaucuacgucaagugggcccccccccucgagcgcggccgccucaccuccauguccaccuccggcuuccuccucggccccuucaucguccuccucgucaccggcgucaucugcgagucccucggcuggcccauggucuucuacaucuucggcgccugcggcugcgccgucugccuccucugguucguccucuucuacgacgaccccaaggaccaccccugcaucuccaucuccgagaaggaguacaucaccuccucccucguccagcaggucuccuccucccgccagucccuccccaucaaggccauccucaagucccuccccgucugggccaucuccaccggcuccuucaccuucuucuggucccacaacaucaugacccucuacacccccauguucaucaacuccaugcuccacgucaacaucaaggagaacggcuuccucuccucccuccccuaccucuucgccuggaucugcggcaaccucgccggccagcucuccgacuucuuccucacccgcaacauccucuccgucaucgccguccgcaagcucuucaccgccgccggcuuccuccuccccgccaucuucggcgucugccuccccuaccucuccuccaccuucuacuccaucgucaucuuccucauccucgccggcgccaccggcuccuucugccucggcggcgucuucaucaacggccucgacaucgccccccgcuacuucggcuucaucaaggccugcuccacccucaccggcaugaucggcggccucaucgccuccacccucaccggccucauccucaagcaggaccccgaguccgccugguucaagaccuucauccucauggccgccaucaacgucaccggccucaucuucuaccucaucgucgccaccgccgagauccaggacugggccaaggagaagcagcacacccgccucuga

SEQ ID NO: 49534 - RNA, 1437 nt, Artificial Sequence
  derived and/or modified sequence opt2 from SLC17A2__Homo_sapiens__NP_001273052
auggacggcaagcccgccacccgcaagggccccgacuucugcucccuccgcuacggccucgcccucaucaugcacuucuccaacuucaccaugaucacccagcgcgucucccucuccaucgccaucaucgccauggucaacaccacccagcagcagggccucuccaacgccuccaccgagggccccgucgccgacgccuucaacaacuccuccaucuccaucaaggaguucgacaccaaggccuccgucuaccaguggucccccgagacccagggcaucaucuucuccuccaucaacuacggcaucauccucacccucauccccuccggcuaccucgccggcaucuucggcgccaagaagaugcucggcgccggccuccucaucuccucccuccucacccucuucaccccccucgccgccgacuucggcgucauccucgucaucaugguccgcaccguccagggcauggcccagggcauggccuggaccggccaguucaccaucugggccaagugggcccccccccucgagcgcuccaagcucaccaccaucgccggcuccggcuccgccuucggcuccuucaucauccucugcgucggcggccucaucucccaggcccucuccuggcccuucaucuucuacaucuucggcuccaccggcugcgucugcugccuccucugguucaccgucaucuacgacgaccccaugcaccaccccugcaucuccguccgcgagaaggagcacauccucuccucccucgcccagcagcccuccucccccggccgcgccguccccaucaaggccauggucaccugccucccccucugggccaucuuccucggcuucuucucccacuucuggcucugcaccaucauccucaccuaccuccccaccuacaucuccacccuccuccacgucaacauccgcgacuccggcguccucuccucccuccccuucaucgccgccgccuccugcaccauccucggcggccagcucgccgacuuccuccucucccgcaaccuccuccgccucaucaccguccgcaagcucuucuccucccucggccuccuccuccccuccaucugcgccgucgcccuccccuucgucgccuccuccuacgucaucaccaucauccuccucauccucauccccggcaccuccaaccucugcgacuccggcuucaucaucaacacccucgacaucgccccccgcuacgccuccuuccucaugggcaucucccgcggcuucggccucaucgccggcaucaucuccuccaccgccaccggcuuccucaucucccaggacuucgaguccggcuggcgcaacgucuucuuccucuccgccgccgucaacauguucggccucgucuucuaccucaccuucggccaggccgagcuccaggacugggccaaggagcgcacccucacccgccucuga

SEQ ID NO: 49535 - RNA, 1497 nt, Artificial Sequence
  derived and/or modified sequence opt2 from SLC17A3__Homo_sapiens__NP_001091956
auggccaccaagaccgagcucucccccaccgcccgcgaguccaagaacgcccaggacaugcaggucgacgagacccucaucccccgcaagguccccucccucugcuccgcccgcuacggcaucgcccucguccuccacuucugcaacuucaccaccaucgcccagaacgucaucaugaacaucaccauggucgccauggucaacuccaccuccccccagucccagcucaacgacuccuccgagguccuccccgucgacuccuucggcggccucuccaaggcccccaagucccuccccgccaaggcccccgucuacgacugguccccccagauccagggcaucaucuucggcgccgucggcuacggcggcauccucaccauggcccccuccggcuaccucgccggccgcgucggcaccaagcgcgucgucggcaucucccucuucgccaccuccuuccucacccucugcaucccccucgccaccgacuucggcaucguccuccucaucgucacccgcaucguccagggccucucccaguccuccauccucggcggccaguucgccaucugggagaaguggggccccccccaggagcgcucccgccucugcuccaucgcccucuccggcaugcuccucggcugcuucaccgccauccucaucggcggcuucaucuccgagacccucggcuggcccuucgucuucuacaucuucggcggcgucggcugcgucugcugccuccucugguucgucgucaucuacgacgaccccgucuccuaccccuggaucuccaccuccgagaaggaguacaucaucuccucccucaagcagcaggucggcuccuccaagcagccccuccccaucaaggccaugcuccgcucccuccccaucugguccaucugccucggcugcuucucccaccaguggcucgucuccaccauggucgucuacauccccaccuacaucuccuccgucuaccacgucaacauccgcgacaacggccuccucuccgcccuccccuucaucgucgccugggucaucggcauggucggcggcuaccucgccgacuuccuccucaccaagaaguuccgccucaucaccguccgcaagaucgccaccauccucggcucccuccccuccuccgcccucaucgucucccuccccuaccucaacuccggcuacaucaccgccaccgcccuccucacccucuccugcggccucuccacccucugccaguccggcaucuacaucaacguccucgacaucgccccccgcuacuccuccuuccucaugggcgccucccgcggcuucuccuccaucgcccccgucaucguccccaccgucuccggcuuccuccucucccaggaccccgaguucggcuggcgcaacgucuucuuccuccucuucgccgucaaccuccucggccuccucuucuaccucaucuucggcgaggccgacguccaggagugggccaaggagcgcaagcucacccgccucuga

SEQ ID NO: 49536 - RNA, 1494 nt, Artificial Sequence
  derived and/or modified sequence opt2 from SLC17A4__Homo_sapiens__NP_005486
auguccaccggccccgacgucaaggccaccgucggcgacaucuccuccgacggcaaccucaacgucgcccaggaggagugcucccgcaagggcuucugcuccguccgccacggccucgcccucauccuccagcucugcaacuucuccaucuacacccagcagaugaaccucuccaucgccauccccgccauggucaacaacaccgccccccccucccagcccaacgccuccaccgagcgccccuccaccgacucccagggcuacuggaacgagacccucaaggaguucaaggccauggcccccgccuacgacuggucccccgagauccagggcaucauccucuccucccucaacuacggcuccuuccucgcccccauccccuccggcuacgucgccggcaucuucggcgccaaguacgucgucggcgccggccucuucaucuccuccuuccucacccucuucaucccccucgccgccaacgccggcgucgcccuccucaucguccuccgcaucguccagggcaucgcccaggucaugguccucaccggccaguacuccaucugggucaagugggcccccccccucgagcgcucccagcucaccaccaucgccggcuccggcuccaugcucggcuccuucaucguccuccucgccggcggccuccucugccagaccaucggcuggcccuacgucuucuacaucuucggcggcaucggcugcgccugcugcccccucugguucccccucaucuacgacgaccccgucaaccaccccuucaucuccgccggcgagaagcgcuacaucgucugcucccucgcccagcaggacugcucccccggcuggucccuccccauccgcgccaugaucaagucccucccccucugggccauccucgucuccuacuucugcgaguacuggcucuucuacaccaucauggccuacacccccaccuacaucuccuccguccuccaggccaaccuccgcgacuccggcauccucuccgcccuccccuucgucgucggcugcaucugcaucauccucggcggccuccucgccgacuuccuccucucccgcaagauccuccgccucaucaccauccgcaagcucuucaccgccaucggcguccucuuccccuccgucauccucgucucccuccccuggguccgcuccucccacuccaugaccaugaccuuccucguccucuccuccgccaucuccuccuucugcgaguccggcgcccucgucaacuuccucgacaucgccccccgcuacaccggcuuccucaagggccuccuccaggucuucgcccacaucgccggcgccaucucccccaccgccgccggcuucuucaucucccaggacuccgaguucggcuggcgcaacgucuuccuccucuccgccgccgucaacaucuccggccucgucuucuaccucaucuucggccgcgccgacguccaggacugggccaaggagcagaccuucacccaccucuga

SEQ ID NO: 49537 - RNA, 1488 nt, Artificial Sequence
  derived and/or modified sequence opt2 from SLC17A5__Homo_sapiens__NP_036566
augcgcucccccguccgcgaccucgcccgcaacgacggcgaggaguccaccgaccgcaccccccuccuccccggcgccccccgcgccgaggccgcccccgucugcugcuccgcccgcuacaaccucgccauccucgccuucuucggcuucuucaucgucuacgcccuccgcgucaaccucuccgucgcccucgucgacauggucgacuccaacaccacccucgaggacaaccgcaccuccaaggccugccccgagcacuccgcccccaucaagguccaccacaaccagaccggcaagaaguaccagugggacgccgagacccagggcuggauccucggcuccuucuucuacggcuacaucaucacccagauccccggcggcuacgucgccuccaagaucggcggcaagaugcuccucggcuucggcauccucggcaccgccguccucacccucuucacccccaucgccgccgaccucggcgucggcccccucaucguccuccgcgcccucgagggccucggcgagggcgucaccuuccccgccaugcacgccaugugguccuccugggcccccccccucgagcgcuccaagcuccucuccaucuccuacgccggcgcccagcucggcaccgucaucucccucccccucuccggcaucaucugcuacuacaugaacuggaccuacgucuucuacuucuucggcaccaucggcaucuucugguuccuccucuggaucuggcucgucuccgacaccccccagaagcacaagcgcaucucccacuacgagaaggaguacauccucuccucccuccgcaaccagcucuccucccagaaguccguccccuggguccccauccucaagucccucccccucugggccaucgucgucgcccacuucuccuacaacuggaccuucuacacccuccucacccuccuccccaccuacaugaaggagauccuccgcuucaacguccaggagaacggcuuccucuccucccuccccuaccucggcuccuggcucugcaugauccucuccggccaggccgccgacaaccuccgcgccaaguggaacuucuccacccucugcguccgccgcaucuucucccucaucggcaugaucggccccgccgucuuccucgucgccgccggcuucaucggcugcgacuacucccucgccgucgccuuccucaccaucuccaccacccucggcggcuucugcuccuccggcuucuccaucaaccaccucgacaucgcccccuccuacgccggcauccuccucggcaucaccaacaccuucgccaccauccccggcauggucggccccgucaucgccaagucccucacccccgacaacaccgucggcgaguggcagaccgucuucuacaucgccgccgccaucaacgucuucggcgccaucuucuucacccucuucgccaagggcgagguccagaacugggcccucaacgaccaccacggccaccgccacuga

SEQ ID NO: 49538 - RNA, 1749 nt, Artificial Sequence
  derived and/or modified sequence opt2 from SLC17A6__Homo_sapiens__NP_065079
auggaguccgucaagcagcgcauccucgcccccggcaaggagggccucaagaacuucgccggcaagucccucggccagaucuaccgcguccucgagaagaagcaggacaccggcgagaccaucgagcucaccgaggacggcaagccccucgagguccccgagcgcaaggccccccucugcgacugcaccugcuucggccucccccgccgcuacaucaucgccaucauguccggccucggcuucugcaucuccuucggcauccgcugcaaccucggcgucgccaucgucgacauggucaacaacuccaccauccaccgcggcggcaaggucaucaaggagaaggccaaguucaacugggaccccgagaccgucggcaugauccacggcuccuucuucuggggcuacaucaucacccagauccccggcggcuacaucgccucccgccucgccgccaaccgcgucuucggcgccgccauccuccucaccuccacccucaacaugcucauccccuccgccgcccgcguccacuacggcugcgucaucuucguccgcauccuccagggccucgucgagggcgucaccuaccccgccugccacggcaucugguccaagugggcccccccccucgagcgcucccgccucgccaccaccuccuucugcggcuccuacgccggcgccgucaucgccaugccccucgccggcauccucguccaguacaccggcugguccuccgucuucuacgucuacggcuccuucggcauggucugguacauguucuggcuccucgucuccuacgagucccccgccaagcaccccaccaucaccgacgaggagcgccgcuacaucgaggaguccaucggcgaguccgccaaccuccucggcgccauggagaaguucaagacccccuggcgcaaguucuucaccuccaugcccgucuacgccaucaucgucgccaacuucugccgcuccuggaccuucuaccuccuccucaucucccagcccgccuacuucgaggaggucuucggcuucgagaucuccaaggucggcaugcucuccgccgucccccaccucgucaugaccaucaucguccccaucggcggccagaucgccgacuuccuccgcuccaagcagauccucuccaccaccaccguccgcaagaucaugaacugcggcggcuucggcauggaggccacccuccuccucgucgucggcuacucccacacccgcggcgucgccaucuccuuccucguccucgccgucggcuucuccggcuucgccaucuccggcuucaacgucaaccaccucgacaucgccccccgcuacgccuccauccucaugggcaucuccaacggcgucggcacccucuccggcauggucugccccaucaucgucggcgccaugaccaagaacaagucccgcgaggaguggcaguacgucuuccucaucgccgcccucguccacuacggcggcgucaucuucuacgccaucuucgccuccggcgagaagcagcccugggccgaccccgaggagaccuccgaggagaagugcggcuucauccacgaggacgagcucgacgaggagaccggcgacaucacccagaacuacaucaacuacggcaccaccaaguccuacggcgccaccacccaggccaacggcggcuggcccuccggcugggagaagaaggaggaguucguccagggcgagguccaggacucccacuccuacaaggaccgcgucgacuacuccuga

SEQ ID NO: 49539 - RNA, 1683 nt, Artificial Sequence
  derived and/or modified sequence opt2 from SLC17A7__Homo_sapiens__NP_064705
auggaguuccgccaggaggaguuccgcaagcucgccggccgcgcccucggcaagcuccaccgccuccucgagaagcgccaggagggcgccgagacccucgagcucuccgccgacggccgccccgucaccacccagacccgcgacccccccgucgucgacugcaccugcuucggccucccccgccgcuacaucaucgccaucauguccggccucggcuucugcaucuccuucggcauccgcugcaaccucggcgucgccaucgucuccauggucaacaacuccaccacccaccgcggcggccacgucgucguccagaaggcccaguucuccugggaccccgagaccgucggccucauccacggcuccuucuucuggggcuacaucgucacccagauccccggcggcuucaucugccagaaguucgccgccaaccgcgucuucggcuucgccaucgucgccaccuccacccucaacaugcucauccccuccgccgcccgcguccacuacggcugcgucaucuucguccgcauccuccagggccucgucgagggcgucaccuaccccgccugccacggcaucugguccaagugggcccccccccucgagcgcucccgccucgccaccaccgccuucugcggcuccuacgccggcgccgucgucgccaugccccucgccggcguccucguccaguacuccggcugguccuccgucuucuacgucuacggcuccuucggcaucuucugguaccucuucuggcuccucgucuccuacgagucccccgcccuccaccccuccaucuccgaggaggagcgcaaguacaucgaggacgccaucggcgaguccgccaagcucaugaacccccucaccaaguucuccacccccuggcgccgcuucuucaccuccaugcccgucuacgccaucaucgucgccaacuucugccgcuccuggaccuucuaccuccuccucaucucccagcccgccuacuucgaggaggucuucggcuucgagaucuccaaggucggccucgucuccgcccucccccaccucgucaugaccaucaucguccccaucggcggccagaucgccgacuuccuccgcucccgccgcaucauguccaccaccaacguccgcaagcucaugaacugcggcggcuucggcauggaggccacccuccuccucgucgucggcuacucccacuccaagggcgucgccaucuccuuccucguccucgccgucggcuucuccggcuucgccaucuccggcuucaacgucaaccaccucgacaucgccccccgcuacgccuccauccucaugggcaucuccaacggcgucggcacccucuccggcauggucugccccaucaucgucggcgccaugaccaagcacaagacccgcgaggaguggcaguacgucuuccucaucgccucccucguccacuacggcggcgucaucuucuacggcgucuucgccuccggcgagaagcagcccugggccgagcccgaggagauguccgaggagaagugcggcuucgucggccacgaccagcucgccggcuccgacgacuccgagauggaggacgaggccgagccccccggcgccccccccgcccccccccccuccuacggcgccacccacuccaccuuccagcccccccgcccccccccccccguccgcgacuacuga

SEQ ID NO: 49540 - RNA, 1620 nt, Artificial Sequence
  derived and/or modified sequence opt2 from SLC17A8__Homo_sapiens__NP_001138760
augcccuucaaggccuucgacaccuucaaggagaagauccucaagcccggcaaggagggcgucaagaacgccgucggcgacucccucggcauccuccagcgcaagaucgacggcaccaccgaggaggaggacaacaucgagcucaacgaggagggccgccccguccagaccucccgccccucccccccccucugcgacugccacugcugcggccuccccaagcgcuacaucaucgccaucauguccggccucggcuucugcaucuccuucggcauccgcugcaaccucggcgucgccaucgucgagauggucaacaacuccaccgucuacgucgacggcaagcccgagauccagaccgcccaguucaacugggaccccgagaccgucggccucauccacggcuccuucuucuggggcuacaucaugacccagauccccggcggcuucaucuccaacaaguucgccgccaaccgcgucuucggcgccgccaucuuccucaccuccacccucaacauguucauccccuccgccgcccgcguccacuacggcugcgucaugugcguccgcauccuccagggccucgucgagggcgucaccuaccccgccugccacggcaugugguccaagugggcccccccccucgagcgcucccgccucgccaccaccuccuucugcggcuccuacgccggcgccgucgucgccaugccccucgccggcguccucguccaguacaucggcugguccuccgucuucuacaucuacggcauguucggcaucaucugguacauguucuggcuccuccaggccuacgagugccccgccgcccaccccaccaucuccaacgaggagaagaccuacaucgagaccuccaucggcgagggcgccaacgucgucucccucuccgucggccuccucuccgccgucccccacauggucaugaccaucgucguccccaucggcggccagcucgccgacuaccuccgcucccgccagauccucaccaccaccgccguccgcaagaucaugaacugcggcggcuucggcauggaggccacccuccuccucgucgucggcuucucccacaccaagggcgucgccaucuccuuccucguccucgccgucggcuucuccggcuucgccaucuccggcuucaacgucaaccaccucgacaucgccccccgcuacgccuccauccucaugggcaucuccaacggcgucggcacccucuccggcauggucugcccccucaucgucggcgccaugacccgccacaagacccgcgaggaguggcagaacgucuuccucaucgccgcccucguccacuacuccggcgucaucuucuacggcgucuucgccuccggcgagaagcaggagugggccgaccccgagaaccucuccgaggagaagugcggcaucaucgaccaggacgagcucgccgaggagaucgagcucaaccacgaguccuucgccucccccaagaagaagauguccuacggcgccaccucccagaacugcgagguccagaagaaggaguggaagggccagcgcggcgccacccucgacgaggaggagcucaccuccuaccagaacgaggagcgcaacuucuccaccaucuccuga

SEQ ID NO: 49541 - RNA, 1578 nt, Artificial Sequence
  derived and/or modified sequence opt2 from SLC18A1__Homo_sapiens__XP_011542926
augcuccgcaccauccucgacgccccccagcgccuccucaaggagggccgcgccucccgccagcucguccucgucgucgucuucgucgcccuccuccucgacaacaugcucuucaccgucgucguccccaucguccccaccuuccucuacgacauggaguucaaggaggucaacuccucccuccaccucggccacgccggcuccuccccccacgcccucgccucccccgccuucuccaccaucuucuccuucuucaacaacaacaccgucgccgucgaggaguccguccccuccggcaucgccuggaugaacgacaccgccuccaccauccccccccccgccaccgaggccaucuccgcccacaagaacaacugccuccagggcaccggcuuccucgaggaggagaucacccgcgucggcguccucuucgccuccaaggccgucaugcagcuccucgucaaccccuucgucggcccccucaccaaccgcaucggcuaccacauccccauguucgccggcuucgucaucauguuccucuccaccgucauguucgccuucuccggcaccuacacccuccucuucgucgcccgcacccuccagggcaucggcuccuccuucuccuccgucgccggccucggcaugcucgccuccgucuacaccgacgaccacgagcgcggccgcgccaugggcaccgcccucggcggccucgcccucggccuccucgucggcgcccccuucggcuccgucauguacgaguucgucggcaaguccgcccccuuccucauccucgccuuccucgcccuccucgacggcgcccuccagcucugcauccuccagcccuccaaggucucccccgaguccgccaagggcaccccccucuucaugcuccucaaggaccccuacauccucgucgccgccggcuccaucugcuucgccaacaugggcgucgccauccucgagcccacccuccccaucuggaugaugcagaccaugugcucccccaaguggcagcucggccucgccuuccuccccgccuccgucuccuaccucaucggcaccaaccucuucggcguccucgccaacaagaugggccgcuggcucugcucccucaucggcaugcucgucgucggcaccucccuccucugcgucccccucgcccacaacaucuucggccucaucggccccaacgccggccucggccucgccaucggcauggucgacuccuccaugaugcccaucaugggccaccucgucgaccuccgccacaccuccgucuacggcuccgucuacgccaucgccgacgucgccuucugcaugggcuucgccaucggccccuccaccggcggcgccaucgucaaggccaucggcuuccccuggcucauggucaucaccggcgucaucaacaucgucuacgccccccucugcuacuaccuccgcuccccccccgccaaggaggagaagcucgccauccucucccaggacugccccauggagacccgcauguacgccacccagaagcccaccaaggaguucccccucggcgaggacuccgacgaggagcccgaccacgaggaguga

SEQ ID NO: 49542 - RNA, 1545 nt, Artificial Sequence
  derived and/or modified sequence opt2 from SLC18A2__Homo_sapiens__NP_003045
auggcccucuccgagcucgcccucguccgcuggcuccaggagucccgccgcucccgcaagcucauccucuucaucgucuuccucgcccuccuccucgacaacaugcuccucaccgucgucguccccaucauccccuccuaccucuacuccaucaagcacgagaagaacgccaccgagauccagaccgcccgccccguccacaccgccuccaucuccgacuccuuccaguccaucuucuccuacuacgacaacuccaccauggucaccggcaacgccacccgcgaccucacccuccaccagaccgccacccagcacauggucaccaacgccuccgccguccccuccgacugccccuccgaggacaaggaccuccucaacgagaacguccaggucggccuccucuucgccuccaaggccaccguccagcucaucaccaaccccuucaucggccuccucaccaaccgcaucggcuaccccauccccaucuucgccggcuucugcaucauguucgucuccaccaucauguucgccuucuccuccuccuacgccuuccuccucaucgcccgcucccuccagggcaucggcuccuccugcuccuccgucgccggcaugggcaugcucgccuccgucuacaccgacgacgaggagcgcggcaacgucaugggcaucgcccucggcggccucgccaugggcguccucgucggcccccccuucggcuccguccucuacgaguucgucggcaagaccgcccccuuccucguccucgccgcccucguccuccucgacggcgccauccagcucuucguccuccagcccucccgcguccagcccgagucccagaagggcaccccccucaccacccuccucaaggaccccuacauccucaucgccgccggcuccaucugcuucgccaacaugggcaucgccaugcucgagcccgcccuccccaucuggaugauggagaccaugugcucccgcaaguggcagcucggcgucgccuuccuccccgccuccaucuccuaccucaucggcaccaacaucuucggcauccucgcccacaagaugggccgcuggcucugcgcccuccucggcaugaucaucgucggcgucuccauccucugcauccccuucgccaagaacaucuacggccucaucgcccccaacuucggcgucggcuucgccaucggcauggucgacuccuccaugaugcccaucaugggcuaccucgucgaccuccgccacgucuccgucuacggcuccgucuacgccaucgccgacgucgccuucugcaugggcuacgccaucggccccuccgccggcggcgccaucgccaaggccaucggcuuccccuggcucaugaccaucaucggcaucaucgacauccucuucgccccccucugcuucuuccuccgcuccccccccgccaaggaggagaagauggccauccucauggaccacaacugccccaucaagaccaagauguacacccagaacaacauccaguccuaccccaucggcgaggacgaggaguccgaguccgacuga

SEQ ID NO: 49543 - RNA, 1599 nt, Artificial Sequence
  derived and/or modified sequence opt2 from SLC18A3__Homo_sapiens__NP_003046
auggaguccgccgagcccgccggccaggcccgcgccgccgccaccaagcucuccgaggccgucggcgccgcccuccaggagccccgccgccagcgccgccucguccucgucaucgucugcgucgcccuccuccucgacaacaugcucuacauggucaucguccccaucguccccgacuacaucgcccacaugcgcggcggcggcgagggccccacccgcacccccgaggucugggagcccacccucccccuccccacccccgccaacgccuccgccuacaccgccaacaccuccgccucccccaccgccgccuggcccgccggcuccgcccuccgcccccgcuaccccaccgaguccgaggacgucaagaucggcguccucuucgccuccaaggccauccuccagcuccucgucaacccccucuccggccccuucaucgaccgcauguccuacgacgucccccuccucaucggccucggcgucauguucgccuccaccguccucuucgccuucgccgaggacuacgccacccucuucgccgcccgcucccuccagggccucggcuccgccuucgccgacaccuccggcaucgccaugaucgccgacaaguaccccgaggagcccgagcgcucccgcgcccucggcgucgcccucgccuucaucuccuucggcucccucgucgccccccccuucggcggcauccucuacgaguucgccggcaagcgcguccccuuccucguccucgccgccgucucccucuucgacgcccuccuccuccucgccgucgccaagcccuucuccgccgccgcccgcgcccgcgccaaccuccccgucggcacccccauccaccgccucaugcucgaccccuacaucgccgucgucgccggcgcccucaccaccugcaacaucccccucgccuuccucgagcccaccaucgccaccuggaugaagcacaccauggccgccuccgagugggagaugggcauggccuggcuccccgccuucgucccccacguccucggcgucuaccucaccguccgccucgccgcccgcuacccccaccuccaguggcucuacggcgcccucggccucgccgucaucggcgccuccuccugcaucguccccgccugccgcuccuucgccccccucgucgucucccucugcggccucugcuucggcaucgcccucgucgacaccgcccuccuccccacccucgccuuccucgucgacguccgccacgucuccgucuacggcuccgucuacgccaucgccgacaucuccuacuccgucgccuacgcccucggccccaucgucgccggccacaucguccacucccucggcuucgagcagcucucccucggcaugggccucgccaaccuccucuacgcccccguccuccuccuccuccgcaacgucggccuccucacccgcucccgcuccgagcgcgacguccuccucgacgagcccccccagggccucuacgacgccguccgccuccgcgagcgccccgucuccggccaggacggcgagccccgcuccccccccggccccuucgacgccugcgaggacgacuacaacuacuacuacacccgcuccuga

SEQ ID NO: 49544 - RNA, 1470 nt, Artificial Sequence
  derived and/or modified sequence opt2 from SLC19A1__Homo_sapiens__NP_001192135
augguccccuccucccccgccgucgagaagcagguccccgucgagcccggccccgaccccgagcuccgcuccuggcgccaccucgucugcuaccucugcuucuacggcuucauggcccagauccgccccggcgaguccuucaucacccccuaccuccucggccccgacaagaacuucacccgcgagcaggucaccaacgagaucacccccguccucuccuacuccuaccucgccguccucguccccgucuuccuccucaccgacuaccuccgcuacacccccguccuccuccuccagggccucuccuucgucuccgucuggcuccuccuccuccucggccacuccgucgcccacaugcagcucauggagcucuucuacuccgucaccauggccgcccgcaucgccuacuccuccuacaucuucucccucguccgccccgcccgcuaccagcgcgucgccggcuacucccgcgccgccguccuccucggcgucuucaccuccuccguccucggccagcuccucgucaccgucggccgcgucuccuucuccacccucaacuacaucucccucgccuuccucaccuucuccgucguccucgcccucuuccucaagcgccccaagcgcucccucuucuucaaccgcgacgaccgcggccgcugcgagaccuccgccuccgagcucgagcgcaugaaccccggccccggcggcaagcucggccacgcccuccgcgucgccugcggcgacuccguccucgcccgcaugcuccgcgagcucggcgacucccuccgccgcccccagcuccgccucuggucccucuggugggucuucaacuccgccggcuacuaccucgucgucuacuacguccacauccucuggaacgaggucgaccccaccaccaacuccgcccgcgucuacaacggcgccgccgacgccgccuccacccuccucggcgccaucaccuccuucgccgccggcuucgucaagauccgcugggcccgcugguccaagcuccucaucgccggcgucaccgccacccaggccggccucgucuuccuccucgcccacacccgccaccccuccuccaucuggcucugcuacgccgccuucguccucuuccgcggcuccuaccaguuccucguccccaucgccaccuuccagaucgccuccucccucuccaaggagcucugcgcccucgucuucggcgucaacaccuucuucgccaccaucgucaagaccaucaucaccuucaucgucuccgacguccgcggccucggccuccccguccgcaagcagaacgaggagcuccacgucgccucccucucccucuggaagucccaccuccgccucgccgccgacacccucuccuccgagggcuccuccggcuccggcccccgcuccugguuccucucccccacccuccgcgccgcccuccacggccccgucugccccuccgaggucugccccuccuga

SEQ ID NO: 49545 - RNA, 1494 nt, Artificial Sequence
  derived and/or modified sequence opt2 from SLC19A2__Homo_sapiens__NP_008927
auggacguccccggccccgucucccgccgcgccgccgccgccgccgccaccguccuccuccgcaccgcccgcguccgccgcgagugcugguuccuccccaccgcccuccucugcgccuacggcuucuucgccucccuccgccccuccgagcccuuccucacccccuaccuccucggccccgacaagaaccucaccgagcgcgaggucuucaacgagaucuaccccgucuggaccuacuccuaccucguccuccucuuccccgucuuccucgccaccgacuaccuccgcuacaagcccgucguccuccuccagggccucucccucaucgucaccugguucaugcuccucuacgcccagggccuccucgccauccaguuccucgaguucuucuacggcaucgccaccgccaccgagaucgccuacuacuccuacaucuacuccgucgucgaccucggcauguaccagaaggucaccuccuacugccgcuccgccacccucgucggcuucaccgucggcuccguccucggccagauccucgucuccgucgccggcuggucccucuucucccucaacgucaucucccucaccugcgucuccgucgccuucgccgucgccugguuccuccccaugccccagaagucccucuucuuccaccacauccccuccaccugccagcgcgucaacggcaucaagguccagaacggcggcaucgucaccgacacccccgccuccaaccaccuccccggcugggaggacaucgaguccaagaucccccucaacauggaggagccccccgucgaggagcccgagcccaagcccgaccgccuccucguccucaagguccucuggaacgacuuccucaugugcuacuccucccgcccccuccucugcugguccgucuggugggcccucuccaccugcggcuacuuccaggucgucaacuacacccagggccucugggagaaggucaugcccucccgcuacgccgccaucuacaacggcggcgucgaggccgucuccacccuccucggcgccgucgccgucuucgccgucggcuacaucaagaucuccugguccaccuggggcgagaugacccucucccucuucucccuccucaucgccgccgccgucuacaucauggacaccgucggcaacaucugggucugcuacgccuccuacgucgucuuccgcaucaucuacaugcuccucaucaccaucgccaccuuccagaucgccgccaaccucuccauggagcgcuacgcccucgucuucggcgucaacaccuucaucgcccucgcccuccagacccuccucacccucaucgucgucgacgccuccggccucggccucgagaucaccacccaguuccucaucuacgccuccuacuucgcccucaucgccgucgucuuccucgccuccggcgccgucuccgucaugaagaagugccgcaagcucgaggacccccaguccuccucccaggucaccaccuccuga

SEQ ID NO: 49546 - RNA, 1479 nt, Artificial Sequence
  derived and/or modified sequence opt2 from SLC19A3__Homo_sapiens__XP_005246931
augaacccccucggcuccgccucccgcgccaccgucgaccagcucaccgaccuccccuccaaggagcagcucuccugcgucgucuucgcccucuggccccccgccuucuccuccaaccucuccgaccccggcgucaagaucaccaacgagaucuuccccgucuggaccuacuccuaccucguccuccuccuccccgucuucguccucaccgacuacguccgcuacaagcccgucaucauccuccagggcaucuccuucaucaucaccuggcuccuccuccucuucggccagggcgucaagaccaugcaggucgucgaguucuucuacggcauggucaccgccgccgaggucgccuacuacgccuacaucuacuccgucgucucccccgagcacuaccagcgcgucuccggcuacugccgcuccgucacccucgccgccuacaccgccggcuccguccucgcccagcuccucgucucccucgccaacauguccuacuucuaccucaacgucaucucccucgccuccgucuccgucgccuuccucuucucccucuuccuccccaugcccaagaaguccauguucuuccacgccaagcccucccgcgagaucaagaaguccuccuccgucaaccccguccucgaggagacccacgagggcgaggcccccggcugcgaggagcagaagcccaccuccgagauccucuccaccuccggcaagcucaacaagggccagcucaacucccucaagcccuccaacgucaccgucgacgucuucguccagugguuccaggaccucaaggagugcuacuccuccaagcgccucuucuacuggucccucuggugggccuucgccaccgccggcuucaaccagguccucaacuacguccagauccucugggacuacaaggcccccucccaggacuccuccaucuacaacggcgccgucgaggccaucgccaccuucggcggcgccgucgccgccuucgccgucggcuacgucaaggucaacugggaccuccucggcgagcucgcccucgucgucuucuccgucgucaacgccggcucccucuuccucaugcacuacaccgccaacaucugggccugcuacgccggcuaccucaucuucaaguccuccuacaugcuccucaucaccaucgccgucuuccagaucgccgucaaccucaacgucgagcgcuacgcccucgucuucggcaucaacaccuucaucgcccucgucauccagaccaucaugaccgucaucgucgucgaccagcgcggccucaaccuccccgucuccauccaguuccucgucuacggcuccuacuucgccgucaucgccggcaucuuccucaugcgcuccauguacaucaccuacuccaccaagucccagaaggacguccagucccccgcccccuccgagaaccccgacgucucccaccccgaggaggaguccaacaucaucauguccaccaagcucuga

SEQ ID NO: 49547 - RNA, 1575 nt, Artificial Sequence
  derived and/or modified sequence opt2 from SLC1A1__Homo_sapiens__NP_004161
augggcaagcccgcccgcaagggcugcgaguggaagcgcuuccucaagaacaacuggguccuccucuccaccgucgccgccgucguccucggcaucaccaccggcguccucguccgcgagcacuccaaccucuccacccucgagaaguucuacuucgccuuccccggcgagauccucaugcgcaugcucaagcucaucauccucccccucaucaucuccuccaugaucaccggcgucgccgcccucgacuccaacgucuccggcaagaucggccuccgcgccgucgucuacuacuucugcaccacccucaucgccgucauccucggcaucguccucgucgucuccaucaagcccggcgucacccagaaggucggcgagaucgcccgcaccggcuccacccccgaggucuccaccgucgacgccaugcucgaccucauccgcaacauguuccccgagaaccucguccaggccugcuuccagcaguacaagaccaagcgcgaggaggucaagccccccuccgaccccgagaugaacaugaccgaggaguccuucaccgccgucaugaccaccgccaucuccaagaacaagaccaaggaguacaagaucgucggcauguacuccgacggcaucaacguccucggccucaucgucuucugccucgucuucggccucgucaucggcaagaugggcgagaagggccagauccucgucgacuucuucaacgcccucuccgacgccaccaugaagaucguccagaucaucaugugcuacaugccccucggcauccucuuccucaucgccggcaagaucaucgaggucgaggacugggagaucuuccgcaagcucggccucuacauggccaccguccucaccggccucgccauccacuccaucgucauccucccccucaucuacuucaucgucguccgcaagaaccccuuccgcuucgccaugggcauggcccaggcccuccucaccgcccucaugaucuccuccuccuccgccacccuccccgucaccuuccgcugcgccgaggagaacaaccaggucgacaagcgcaucacccgcuucguccuccccgucggcgccaccaucaacauggacggcaccgcccucuacgaggccgucgccgccgucuucaucgcccagcucaacgaccucgaccucggcaucggccagaucaucaccaucuccaucaccgccaccuccgccuccaucggcgccgccggcgucccccaggccggccucgucaccauggucaucguccucuccgccgucggccuccccgccgaggacgucacccucaucaucgccgucgacuggcuccucgaccgcuuccgcaccauggucaacguccucggcgacgccuucggcaccggcaucgucgagaagcucuccaagaaggagcucgagcagauggacgucuccuccgaggucaacaucgucaaccccuucgcccucgaguccaccauccucgacaacgaggacuccgacaccaagaaguccuacgucaacggcggcuucgccgucgacaaguccgacaccaucuccuucacccagaccucccaguucuga

SEQ ID NO: 49548 - RNA, 1698 nt, Artificial Sequence
  derived and/or modified sequence opt2 from SLC1A2__Homo_sapiens__NP_001182657
augcccaagcaggucgagguccgcaugcacgacucccaccucggcuccgaggagcccaagcaccgccaccucggccuccgccucugcgacaagcucggcaagaaccuccuccucacccucaccgucuucggcgucauccucggcgccgucugcggcggccuccuccgccucgccucccccauccaccccgacgucgucaugcucaucgccuuccccggcgacauccucaugcgcaugcucaagaugcucauccucccccucaucaucuccucccucaucaccggccucuccggccucgacgccaaggccuccggccgccucggcacccgcgccauggucuacuacauguccaccaccaucaucgccgccguccucggcgucauccucguccucgccauccaccccggcaaccccaagcucaagaagcagcucggccccggcaagaagaacgacgaggucuccucccucgacgccuuccucgaccucauccgcaaccucuuccccgagaaccucguccaggccugcuuccagcagauccagaccgucaccaagaagguccucgucgcccccccccccgacgaggaggccaacgccaccuccgccgucgucucccuccucaacgagaccgucaccgagguccccgaggagaccaagauggucaucaagaagggccucgaguucaaggacggcaugaacguccucggccucaucggcuucuucaucgccuucggcaucgccaugggcaagaugggcgaccaggccaagcucauggucgacuucuucaacauccucaacgagaucgucaugaagcucgucaucaugaucaugugguacuccccccucggcaucgccugccucaucugcggcaagaucaucgccaucaaggaccucgaggucgucgcccgccagcucggcauguacauggucaccgucaucaucggccucaucauccacggcggcaucuuccucccccucaucuacuucgucgucacccgcaagaaccccuucuccuucuucgccggcaucuuccaggccuggaucaccgcccucggcaccgccuccuccgccggcacccuccccgucaccuuccgcugccucgaggagaaccucggcaucgacaagcgcgucacccgcuucguccuccccgucggcgccaccaucaacauggacggcaccgcccucuacgaggccgucgccgccaucuucaucgcccagaugaacggcgucguccucgacggcggccagaucgucaccgucucccucaccgccacccucgccuccgucggcgccgccuccauccccuccgccggccucgucaccaugcuccucauccucaccgccgucggccuccccaccgaggacaucucccuccucgucgccgucgacuggcuccucgaccgcaugcgcaccuccgucaacgucgucggcgacuccuucggcgccggcaucgucuaccaccucuccaaguccgagcucgacaccaucgacucccagcaccgcguccacgaggacaucgagaugaccaagacccaguccaucuacgacgacaugaagaaccaccgcgaguccaacuccaaccagugcgucuacgccgcccacaacuccgucaucgucgacgagugcaaggucacccucgccgccaacggcaaguccgccgacugcuccgucgaggaggagcccuggaagcgcgagaaguga

SEQ ID NO: 49549 - RNA, 1494 nt, Artificial Sequence
  derived and/or modified sequence opt2 from SLC1A3__Homo_sapiens__NP_001160167
augaccaaguccaacggcgaggagcccaagaugggcggccgcauggagcgcuuccagcagggcguccgcaagcgcacccuccucgccaagaagaagguccagaacaucaccaaggaggacgucaaguccuaccucuuccgcaacgccuucguccuccucaccgucaccgccgucaucgucggcaccauccucggcuucacccuccgccccuaccgcauguccuaccgcgaggucaaguacuucuccuuccccggcgagcuccucaugcgcaugcuccagaugcucguccucccccucaucaucuccucccucgucaccggcauggccgcccucgacuccaaggccuccggcaagaugggcaugcgcgccgucgucuacuacaugaccaccaccaucaucgccgucgucaucggcaucaucaucgucaucaucauccaccccggcaagggcaccaaggagaacaugcaccgcgagggcaagaucguccgcgucaccgccgccgacgccuuccucgaccucauccgcaacauguucccccccaaccucgucgaggccugcuucaagcaguucaagaccaacuacgagaagcgcuccuucaagguccccauccaggccaacgagacccucgucggcgccgucaucaacaacgucuccgaggccauggagacccucacccgcaucaccgaggagcucguccccguccccggcuccgucaacggcgucaacgcccucggccucgucgucuucuccaugugcuucggcuucgucaucggcaacaugaaggagcagggccaggcccuccgcgaguucuucgacucccucaacgaggccaucaugcgccucgucgccgucaucaugugguacgcccccgucggcauccucuuccucaucgccggcaagaucgucgagauggaggacaugggcgucaucggcggccagcucgccauguacaccgucaccgucaucgucggccuccucauccacgccgucaucguccucccccuccucuacuuccucgucacccgcaagaaccccugggucuucaucggcggccuccuccaggcccucaucaccgcccucggcaccuccuccuccuccgccacccuccccaucaccuucaagugccucgaggagaacaacggcgucgacaagcgcgucacccgcuucguccuccccgucggcgccaccaucaacauggacggcaccgcccucuacgaggcccucgccgccaucuucaucgcccaggucaacaacuucgagcucaacuucggccagaucaucaccauccgcgaccgccuccgcaccaccaccaacguccucggcgacucccucggcgccggcaucgucgagcaccucucccgccacgagcucaagaaccgcgacgucgagaugggcaacuccgucaucgaggagaacgagaugaagaagcccuaccagcucaucgcccaggacaacgagaccgagaagcccaucgacuccgagaccaagauguga

SEQ ID NO: 49550 - RNA, 705 nt, Artificial Sequence
  derived and/or modified sequence opt2 from SLC1A4__Homo_sapiens__NP_001180422
augaacauccucggccucguccucuucgcccucguccucggcgucgcccucaagaagcucggcuccgagggcgaggaccucauccgcuucuucaacucccucaacgaggccaccaugguccucgucuccuggaucaugugcuccgccacccuccccuccaugaugaagugcaucgaggagaacaacggcgucgacaagcgcaucucccgcuucauccuccccaucggcgccaccgucaacauggacggcgccgccaucuuccagugcgucgccgccgucuucaucgcccagcucaacaacgucgagcucaacgccggccagaucuucaccauccucgucaccgccaccgccuccuccgucggcgccgccggcguccccgccggcggcguccucaccaucgccaucauccucgaggccaucggccuccccacccacgaccucccccucauccucgccgucgacuggaucgucgaccgcaccaccaccgucgucaacgucgagggcgacgcccucggcgccggcauccuccaccaccucaaccagaaggccaccaagaagggcgagcaggagcucgccgaggucaaggucgaggccauccccaacugcaaguccgaggaggagaccuccccccucgucacccaccagaaccccgccggccccgucgccuccgcccccgagcucgaguccaaggaguccguccucuga

SEQ ID NO: 49551 - RNA, 942 nt, Artificial Sequence
  derived and/or modified sequence opt2 from SLC1A5__Homo_sapiens__NP_001138616
augaacauccucggccucgucgucuucgccaucgucuucggcgucgcccuccgcaagcucggccccgagggcgagcuccucauccgcuucuucaacuccuucaacgaggccaccaugguccucgucuccuggaucaugugguacgcccccgucggcaucauguuccucgucgccggcaagaucgucgagauggaggacgucggccuccucuucgcccgccucggcaaguacauccucugcugccuccucggccacgccauccacggccuccucguccucccccucaucuacuuccucuucacccgcaagaaccccuaccgcuuccucuggggcaucgucaccccccucgccaccgccuucggcaccuccuccuccuccgccacccucccccucaugaugaagugcgucgaggagaacaacggcgucgccaagcacaucucccgcuucauccuccccaucggcgccaccgucaacauggacggcgccgcccucuuccagugcgucgccgccgucuucaucgcccagcucucccagcagucccucgacuucgucaagaucaucaccauccucgucaccgccaccgccuccuccgucggcgccgccggcauccccgccggcggcguccucacccucgccaucauccucgaggccgucaaccuccccgucgaccacaucucccucauccucgccgucgacuggcucgucgaccgcuccugcaccguccucaacgucgagggcgacgcccucggcgccggccuccuccagaacuacgucgaccgcaccgagucccgcuccaccgagcccgagcucauccaggucaaguccgagcucccccucgacccccuccccguccccaccgaggagggcaacccccuccucaagcacuaccgcggccccgccggcgacgccaccgucgccuccgagaaggaguccgucauguga

SEQ ID NO: 49552 - RNA, 939 nt, Artificial Sequence
  derived and/or modified sequence opt2 from SLC1A6__Homo_sapiens__NP_001259017
auguccucccacggcaacucccucuuccuccgcgaguccggccagcgccucggccgcgucggcuggcuccagcgccuccaggagucccuccagcagcgcgcccuccgcacccgccuccgccuccagaccaugacccucgagcacguccuccgcuuccuccgccgcaacgccuucauccuccucaccgucuccgccgucgucaucggcgucucccucgccuucgcccuccgccccuaccagcucaccuaccgccagaucaaguacuucuccuuccccggcgagcuccucaugcgcaugcuccagaugcucguccucccccucaucgucuccucccucgucaccggcauggccucccucgacaacaaggccaccggccgcaugggcaugcgcgccgccgucuacuacauggucaccaccaucaucgccgucuucaucggcauccucauggucaccaucauccaccccggcaagggcuccaaggagggccuccaccgcgagggccgcaucgagaccauccccaccgccgacgccuucauggaccucauccgcaacauguucccccccaaccucgucgaggccugcuucaagcaguucaagacccaguacuccacccgcgucgucacccgcaccaugguccgcaccgagaacggcuccgagcccggcgccuccaugcccccccccuucuccgucgagaacggcaccuccuuccucgagaacgucacccgcgcccucggcacccuccaggagaugcucuccuucgaggagaccguccccguccccggcuccgccaacggcaucaacgcccucggccucgucgucuucuccgucgccuucggccucgucaucggcggcaugaagcacaagggccgcguccuccgcgacuucuucgacucccucaacgaggccaucaugcgccucgucggcaucaucaucugguga

SEQ ID NO: 49553 - RNA, 2040 nt, Artificial Sequence
  derived and/or modified sequence opt2 from SLC20A1__Homo_sapiens__NP_005406
auggccacccucaucaccuccaccaccgccgccaccgccgccuccggcccccucgucgacuaccucuggaugcucauccucggcuucaucaucgccuucguccucgccuucuccgucggcgccaacgacgucgccaacuccuucggcaccgccgucggcuccggcgucgucacccucaagcaggccugcauccucgccuccaucuucgagaccgucggcuccguccuccucggcgccaaggucuccgagaccauccgcaagggccucaucgacgucgagauguacaacuccacccagggccuccucauggccggcuccgucuccgccauguucggcuccgccgucuggcagcucgucgccuccuuccucaagcuccccaucuccggcacccacugcaucgucggcgccaccaucggcuucucccucgucgccaagggccaggagggcgucaagugguccgagcucaucaagaucgucauguccugguucgucuccccccuccucuccggcaucauguccggcauccucuucuuccucguccgcgccuucauccuccacaaggccgaccccguccccaacggccuccgcgcccuccccgucuucuacgccugcaccgucggcaucaaccucuucuccaucauguacaccggcgccccccuccucggcuucgacaagcucccccucuggggcaccauccucaucuccgucggcugcgccgucuucugcgcccucaucgucugguucuucgucugcccccgcaugaagcgcaagaucgagcgcgagaucaagugcucccccuccgaguccccccucauggagaagaagaacucccucaaggaggaccacgaggagaccaagcucuccgucggcgacaucgagaacaagcaccccgucuccgaggucggccccgccaccgucccccuccaggccgucgucgaggagcgcaccgucuccuucaagcucggcgaccucgaggaggcccccgagcgcgagcgccuccccuccgucgaccucaaggaggagaccuccaucgacuccaccgucaacggcgccguccagcuccccaacggcaaccucguccaguucucccaggccgucuccaaccagaucaacuccuccggccacuaccaguaccacaccguccacaaggacuccggccucuacaaggagcuccuccacaagcuccaccucgccaaggucggcgacugcaugggcgacuccggcgacaagccccuccgccgcaacaacuccuacaccuccuacaccauggccaucugcggcaugccccucgacuccuuccgcgccaaggagggcgagcagaagggcgaggagauggagaagcucaccuggcccaacgccgacuccaagaagcgcauccgcauggacuccuacaccuccuacugcaacgccgucuccgaccuccacuccgccuccgagaucgacauguccgucaaggccgagaugggccucggcgaccgcaagggcuccaacggcucccucgaggagugguacgaccaggacaagcccgaggucucccuccucuuccaguuccuccagauccucaccgccugcuucggcuccuucgcccacggcggcaacgacgucuccaacgccaucggcccccucgucgcccucuaccucgucuacgacaccggcgacgucuccuccaaggucgccacccccaucuggcuccuccucuacggcggcgucggcaucugcgucggccucugggucuggggccgccgcgucauccagaccaugggcaaggaccucacccccaucacccccuccuccggcuucuccaucgagcucgccuccgcccucaccgucgucaucgccuccaacaucggccuccccaucuccaccacccacugcaaggucggcuccgucgucuccgucggcuggcuccgcuccaagaaggccgucgacuggcgccucuuccgcaacaucuucauggccugguucgucaccguccccaucuccggcgucaucuccgccgccaucauggccaucuuccgcuacgucauccuccgcauguga

SEQ ID NO: 49554 - RNA, 1959 nt, Artificial Sequence
  derived and/or modified sequence opt2 from SLC20A2__Homo_sapiens__XP_005273670
auggccauggacgaguaccucuggauggucauccucggcuucaucaucgccuucauccucgccuucuccgucggcgccaacgacgucgccaacuccuucggcaccgccgucggcuccggcgucgucacccuccgccaggccugcauccucgccuccaucuucgagaccaccggcuccguccuccucggcgccaaggucggcgagaccauccgcaagggcaucaucgacgucaaccucuacaacgagaccgucgagacccucauggccggcgaggucuccgccauggucggcuccgccgucuggcagcucaucgccuccuuccuccgccuccccaucuccggcacccacugcaucgucggcuccaccaucggcuucucccucgucgccaucggcaccaagggcguccaguggauggagcucgucaagaucgucgccuccugguucaucuccccccuccucuccggcuucauguccggccuccucuucguccucauccgcaucuucauccucaagaaggaggaccccguccccaacggccuccgcgcccuccccgucuucuacgccgccaccaucgccaucaacgucuucuccaucauguacaccggcgcccccguccucggccucguccuccccaugugggccaucgcccucaucuccuucggcgucgcccuccucuucgccuucuucgucuggcucuucgucugccccuggaugcgccgcaagaucaccggcaagcuccagaaggagggcgcccucucccgcgucuccgacgagucccucuccaagguccaggaggccgagucccccgucuucaaggagcuccccggcgccaaggccaacgacgacuccaccaucccccucaccggcgccgccggcgagacccucggcaccuccgagggcaccuccgccggcucccacccccgcgccgccuacggccgcgcccucuccaugacccacggcuccgucaagucccccaucuccaacggcaccuucggcuucgacggccacacccgcuccgacggccacgucuaccacaccguccacaaggacuccggccucuacaaggaccuccuccacaagauccacaucgaccgcggccccgaggagaagcccgcccaggaguccaacuaccgccuccuccgccgcaacaacuccuacaccugcuacaccgccgccaucugcggccuccccguccacgccaccuuccgcgccgccgacuccuccgcccccgaggacuccgagaagcucgucggcgacaccgucuccuacuccaagaagcgccuccgcuacgacuccuacuccuccuacugcaacgccgucgccgaggccgagaucgaggccgaggagggcggcgucgagaugaagcucgccuccgagcucgccgaccccgaccagccccgcgaggaccccgccgaggaggagaaggaggagaaggacgcccccgagguccaccuccucuuccacuuccuccagguccucaccgccugcuucggcuccuucgcccacggcggcaacgacgucuccaacgccaucggcccccucgucgcccucuggcucaucuacaagcagggcggcgucacccaggaggccgccacccccgucuggcuccucuucuacggcggcgucggcaucugcaccggccucugggucuggggccgccgcgucauccagaccaugggcaaggaccucacccccaucacccccuccuccggcuucaccaucgagcucgccuccgccuucaccgucgucaucgccuccaacaucggccuccccgucuccaccacccacugcaaggucggcuccgucgucgccgucggcuggauccgcucccgcaaggccgucgacuggcgccucuuccgcaacaucuucgucgccugguucgucaccguccccgucgccggccucuucuccgccgccgucauggcccuccucauguacggcauccuccccuacgucuga

SEQ ID NO: 49555 - RNA, 1653 nt, Artificial Sequence
  derived and/or modified sequence opt2 from SLC22A11__Homo_sapiens__NP_060954
auggccuucuccaagcuccucgagcaggccggcggcgucggccucuuccagacccuccagguccucaccuucauccuccccugccucaugauccccucccagaugcuccucgagaacuucuccgccgccauccccggccaccgcugcuggacccacaugcucgacaacggcuccgccgucuccaccaacaugacccccaaggcccuccucaccaucuccaucccccccggccccaaccagggcccccaccagugccgccgcuuccgccagccccaguggcagcuccucgaccccaacgccaccgccaccuccugguccgaggccgacaccgagcccugcgucgacggcugggucuacgaccgcuccgucuucaccuccaccaucgucgccaagugggaccucgucugcuccucccagggccucaagccccucucccaguccaucuucauguccggcauccucgucggcuccuucaucuggggccuccucuccuaccgcuucggccgcaagcccaugcucuccuggugcugccuccagcucgccgucgccggcaccuccaccaucuucgcccccaccuucgucaucuacugcggccuccgcuucgucgccgccuucggcauggccggcaucuuccucuccucccucacccucauggucgaguggaccaccaccucccgccgcgccgucaccaugaccgucgucggcugcgccuucuccgccggccaggccgcccucggcggccucgccuucgcccuccgcgacuggcgcacccuccagcucgccgccuccguccccuucuucgccaucucccucaucuccugguggcuccccgaguccgcccgcuggcucaucaucaagggcaagcccgaccaggcccuccaggagcuccgcaaggucgcccgcaucaacggccacaaggaggccaagaaccucaccaucgagguccucauguccuccgucaaggaggaggucgccuccgccaaggagccccgcuccguccucgaccucuucugcguccccguccuccgcuggcgcuccugcgccaugcucgucgucaacuucucccuccucaucuccuacuacggccucgucuucgaccuccagucccucggccgcgacaucuuccuccuccaggcccucuucggcgccgucgacuuccucggccgcgccaccaccgcccuccuccucuccuuccucggccgccgcaccauccaggccggcucccaggccauggccggccucgccauccucgccaacaugcucgucccccaggaccuccagacccuccgcgucgucuucgccguccucggcaagggcugcuucggcaucucccucaccugccucaccaucuacaaggccgagcucuuccccacccccguccgcaugaccgccgacggcauccuccacaccgucggccgccucggcgccaugaugggcccccucauccucaugucccgccaggcccucccccuccuccccccccuccucuacggcgucaucuccaucgccuccucccucgucguccucuucuuccuccccgagacccagggccucccccuccccgacaccauccaggaccucgagucccagaaguccaccgccgcccagggcaaccgccaggaggccgucaccgucgaguccaccucccucuga

SEQ ID NO: 49556 - RNA, 1560 nt, Artificial Sequence
  derived and/or modified sequence opt2 from SLC22A12__Homo_sapiens__NP_001263255
auggccuucuccgagcuccucgaccucgucggcggccucggccgcuuccagguccuccagaccauggcccucauggucuccaucauguggcucugcacccaguccaugcucgagaacuucuccgccgccguccccucccaccgcugcugggccccccuccucgacaacuccaccgcccaggccuccauccucggcucccucucccccgaggcccuccucgccaucuccaucccccccggccccaaccagcgcccccaccagugccgccgcuuccgccagccccaguggcagcuccucgaccccaacgccaccgccaccuccugguccgaggccgacaccgagcccugcgucgacggcugggucuacgaccgcuccaucuucaccuccaccaucgucgccaaguggaaccucgucugcgacucccacgcccucaagcccauggcccaguccaucuaccucgccggcauccucgucggcgccgccgccugcggccccgccuccgaccgcuucggccgccgccucguccucaccugguccuaccuccagauggccgucauggucauggaguggaccgccgcccgcgcccgcccccucgucaugacccucaacucccucggcuucuccuucggccacggccucaccgccgccgucgccuacggcguccgcgacuggacccuccuccagcucgucgucuccguccccuucuuccucugcuuccucuacuccugguggcucgccgaguccgcccgcuggcuccucaccaccggccgccucgacuggggccuccaggagcucuggcgcgucgccgccaucaacggcaagggcgccguccaggacacccucacccccgagguccuccucuccgccaugcgcgaggagcucuccaugggccagccccccgccucccucggcacccuccuccgcaugcccggccuccgcuuccgcaccugcaucuccacccucugcugguucgccuucggcuucaccuucuucggccucgcccucgaccuccaggcccucggcuccaacaucuuccuccuccagauguucaucggcgucgucgacauccccgccaagaugggcgcccuccuccuccucucccaccucggccgccgccccacccucgccgccucccuccuccucgccggccucugcauccucgccaacacccucgucccccacgagaugggcgcccuccgcuccgcccucgccguccucggccucggcggcgucggcgccgccuucaccugcaucaccaucuacuccuccgagcucuuccccaccguccuccgcaugaccgccgucggccucggccagauggccgcccgcggcggcgccauccucggcccccucguccgccuccucggcguccacggccccuggcucccccuccucgucuacggcaccguccccguccucuccggccucgccgcccuccuccuccccgagacccagucccucccccuccccgacaccauccaggacguccagaaccaggccgucaagaaggccacccacggcacccucggcaacuccguccucaaguccacccaguucuga

SEQ ID NO: 49557 - RNA, 1656 nt, Artificial Sequence
  derived and/or modified sequence opt2 from SLC22A13__Homo_sapiens__NP_004247
auggcccaguucguccagguccucgccgagaucggcgacuucggccgcuuccagauccagcuccucauccuccucugcguccucaacuuccucucccccuucuacuucuucgcccacgucuucaugguccucgacgagccccaccacugcgccgucgccugggucaagaaccacaccuucaaccucuccgccgccgagcagcucguccucuccgucccccucgacaccgccggccaccccgagcccugccucauguuccgccccccccccgccaacgccucccuccaggacauccucucccaccgcuucaacgagacccagcccugcgacaugggcugggaguaccccgagaaccgccuccccucccucaagaacgaguucaaccucgucugcgaccgcaagcaccucaaggacaccacccaguccgucuucauggccggccuccucgucggcacccucauguucggcccccucugcgaccgcaucggccgcaaggccaccauccucgcccagcuccuccucuucacccucaucggccucgccaccgccuucguccccuccuucgagcucuacauggcccuccgcuucgccgucgccaccgccgucgccggccucuccuucuccaacgucacccuccucaccgagugggucggccccuccuggcgcacccaggccgucguccucgcccagugcaacuucucccucggccagaugguccucgccggccucgccuacggcuuccgcaacuggcgccuccuccagaucaccggcaccgcccccggccuccuccucuucuucuacuucugggcccuccccgaguccgcccgcuggcuccucacccgcggccgcauggacgaggccauccagcucauccagaaggccgccuccgucaaccgccgcaagcucucccccgagcucaugaaccagcucguccccgagaagaccggccccuccggcaacgcccucgaccucuuccgccacccccagcuccgcaaggucacccucaucaucuucugcgucugguucgucgacucccucggcuacuacggccucucccuccaggucggcgacuucggccucgacgucuaccucacccagcucaucuucggcgccgucgagguccccgcccgcugcuccuccaucuucaugaugcagcgcuucggccgcaaguggucccagcucggcacccucguccucggcggccucaugugcaucaucaucaucuucauccccgccgaccuccccgucgucgucaccaugcucgccgucgucggcaagauggccaccgccgccgccuucaccaucuccuacgucuacuccgccgagcucuuccccaccauccuccgccagaccggcaugggccucgucggcaucuucucccgcaucggcggcauccucaccccccucgucauccuccucggcgaguaccacgccgcccuccccaugcucaucuacggcucccuccccaucgucgccggccuccucugcacccuccuccccgagacccacggccagggccucaaggacacccuccaggaccucgagcucggcccccacccccgcucccccaaguccguccccuccgagaaggagaccgaggccaagggccgcaccuccucccccggcgucgccuucgucuccuccaccuacuucuga

SEQ ID NO: 49558 - RNA, 1785 nt, Artificial Sequence
  derived and/or modified sequence opt2 from SLC22A14__Homo_sapiens__NP_004794
auggccggcgaggagaacuucaaggaggagcuccgcucccaggacgccucccgcaaccucaaccagcacgaggucgccggccacccccacuccuggucccucgagaugcuccuccgccgccuccgcgccguccacaccaagcaggacgacaaguucgccaaccuccucgacgccgucggcgaguucggcaccuuccagcagcgccucgucgcccucaccuucauccccuccaucauguccgccuucuucauguucgccgaccacuucgucuucaccgcccagaagcccuacugcaacaccuccuggauccucgccgucggcccccaccucuccaaggccgagcagcucaaccucaccaucccccaggcccccaacggcuccuuccucaccugcuucauguaccuccccguccccuggaaccucgacuccaucauccaguucggccucaacgacaccgacaccugccaggacggcuggaucuaccccgacgccaagaagcgcucccucaucaacgaguucgaccucgucugcggcauggagaccaagaaggacaccgcccagaucauguucauggccggccuccccaucggcucccucaucuuccgccucaucaccgacaagaugggccgcuaccccgccauccuccucucccuccucggccucaucaucuucggcuucggcaccgccuucaugaacuccuuccaccucuaccucuucuuccgcuucggcaucucccaguccgucgucggcuacgccaucuccuccaucucccucgccaccgaguggcucgucggcgagcaccgcgcccacgccaucauccucggccacugcuucuucgccgucggcgccguccuccucaccggcaucgccuacucccucccccacuggcagcuccucuuccucgucggcggcauccucgucauccccuucaucuccuacaucuggauccuccccgaguccccccgcuggcucaugaugaagggcaaggucaaggaggccaagcagguccucugcuacgccgccuccgucaacaagaagaccauccccuccaaccuccucgacgagcuccagcucccccgcaagaaggucacccgcgccuccguccucgacuucugcaagaaccgccagcucugcaaggucacccucgucauguccugcgucugguucaccgucuccuacaccuacuucacccucucccuccgcaugcgcgagcucggcgucuccguccacuuccgccacgucguccccuccaucauggagguccccgcccgccucugcugcaucuuccuccuccagcagaucggccgcaaguggucccucgccgucacccuccuccaggccaucaucuggugccuccuccuccucuuccuccccgagggcgaggacggccuccgccucaaguggccccgcugccccgccaccgagcucaaguccaugaccauccucguccucaugcuccgcgaguucucccucgccgccaccgucaccgucuucuuccucuacaccgccgagcuccuccccaccguccuccgcgccaccggccucggccucgucucccucgccuccgucgccggcgccauccucucccucaccaucaucucccagacccccucccuccuccccaucuuccucugcugcguccucgccaucgucgccuucucccucuccucccuccuccccgagacccgcgaccagccccucuccgagucccucaaccacuccucccagauccgcaacaaggucaaggacaugaagaccaaggagaccuccuccgacgacgucuga

SEQ ID NO: 49559 - RNA, 1734 nt, Artificial Sequence
  derived and/or modified sequence opt2 from SLC22A16__Homo_sapiens__NP_149116
augggcucccgccacuucgagggcaucuacgaccacgucggccacuucggccgcuuccagcgcguccucuacuucaucugcgccuuccagaacaucuccugcggcauccacuaccucgccuccgucuucaugggcgucaccccccaccacgucugccgcccccccggcaacgucucccaggucgucuuccacaaccacuccaacuggucccucgaggacaccggcgcccuccucuccuccggccagaaggacuacgucaccguccagcuccagaacggcgagaucugggagcucucccgcugcucccgcaacaagcgcgagaacaccuccucccucggcuacgaguacaccggcuccaagaaggaguuccccugcgucgacggcuacaucuacgaccagaacaccuggaaguccaccgccgucacccaguggaaccucgucugcgaccgcaaguggcucgccaugcucauccagccccucuucauguucggcguccuccucggcuccgucaccuucggcuacuucuccgaccgccucggccgccgcgucguccucugggccaccuccuccuccauguuccucuucggcaucgccgccgccuucgccgucgacuacuacaccuucauggccgcccgcuucuuccucgccauggucgccuccggcuaccucgucgucggcuucgucuacgucauggaguucaucggcaugaagucccgcaccugggccuccguccaccuccacuccuucuucgccgucggcacccuccucgucgcccucaccggcuaccucguccgcaccugguggcucuaccagaugauccucuccaccgucaccguccccuucauccucugcugcuggguccuccccgagacccccuucuggcuccucuccgagggccgcuacgaggaggcccagaagaucgucgacaucauggccaaguggaaccgcgccuccuccugcaagcucuccgagcuccucucccucgaccuccagggccccgucuccaacucccccaccgagguccagaagcacaaccucuccuaccucuucuacaacugguccaucaccaagcgcacccucaccgucuggcucaucugguucaccggcucccucggcuucuacuccuucucccucaacuccgucaaccucggcggcaacgaguaccucaaccucuuccuccucggcgucgucgagauccccgccuacaccuucgucugcaucgccauggacaaggucggccgccgcaccguccucgccuacucccucuucugcuccgcccucgccugcggcgucgucauggucaucccccagaagcacuacauccucggcgucgucaccgccauggucggcaaguucgccaucggcgccgccuucggccucaucuaccucuacaccgccgagcucuaccccaccaucguccgcucccucgccgucggcuccggcuccauggucugccgccucgccuccauccucgcccccuucuccgucgaccucuccuccaucuggaucuucaucccccagcucuucgucggcaccauggcccuccucuccggcguccucacccucaagcuccccgagacccucggcaagcgccucgccaccaccugggaggaggccgccaagcucgaguccgagaacgaguccaaguccuccaagcuccuccucaccaccaacaacuccggccucgagaagaccgaggccaucaccccccgcgacuccggccucggcgaguga

SEQ ID NO: 49560 - RNA, 1563 nt, Artificial Sequence
  derived and/or modified sequence opt2 from SLC22A17__Homo_sapiens__NP_057693
auggccuccgaccccaucuucacccucgcccccccccuccacugccacuacggcgccuucccccccaacgccuccggcugggagcagccccccaacgccuccggcgucuccgucgccuccgccgcccucgccgccuccgccgccucccgcgucgccaccuccaccgaccccuccugcuccggcuucgccccccccgacuucaaccacugccucaaggacugggacuacaacggccuccccguccucaccaccaacgccaucggccagugggaccucgucugcgaccucggcuggcaggucauccucgagcagauccucuucauccucggcuucgccuccggcuaccucuuccucggcuaccccgccgaccgcuucggccgccgcggcaucguccuccucacccucggccucgucggccccugcggcgucggcggcgccgccgccggcuccuccaccggcgucauggcccuccgcuuccuccucggcuuccuccucgccggcgucgaccucggcgucuaccucaugcgccucgagcucugcgaccccacccagcgccuccgcgucgcccucgccggcgagcucgucggcgucggcggccacuuccucuuccucggccucgcccucgucuccaaggacuggcgcuuccuccagcgcaugaucaccgcccccugcauccucuuccucuucuacggcuggcccggccucuuccucgaguccgcccgcuggcucaucgucaagcgccagaucgaggaggcccaguccguccuccgcauccucgccgagcgcaaccgcccccacggccagaugcucggcgaggaggcccaggaggcccuccaggaccucgagaacaccugcccccuccccgccaccuccuccuucuccuucgccucccuccucaacuaccgcaacaucuggaagaaccuccucauccucggcuucaccaacuucaucgcccacgccauccgccacugcuaccagcccgucggcggcggcggcucccccuccgacuucuaccucugcucccuccucgccuccggcaccgccgcccucgccugcgucuuccucggcgucaccgucgaccgcuucggccgccgcggcauccuccuccucuccaugacccucaccggcaucgccucccucguccuccucggccucugggacuaccucaacgaggccgccaucaccaccuucuccguccucggccucuucuccucccaggccgccgccauccucuccacccuccucgccgccgaggucauccccaccaccguccgcggccgcggccucggccucaucauggcccucggcgcccucggcggccucuccggccccgcccagcgccuccacaugggccacggcgccuuccuccagcacgucguccucgccgccugcgcccuccucugcauccucuccaucaugcuccuccccgagaccaagcgcaagcuccuccccgagguccuccgcgacggcgagcucugccgccgccccucccuccuccgccagcccccccccacccgcugcgaccacgucccccuccucgccacccccaaccccgcccucuga

SEQ ID NO: 49561 - RNA, 453 nt, Artificial Sequence
  derived and/or modified sequence opt2 from SLC22A18AS__Homo_sapiens__NP_001289791
augcgcugcgccgagggcgccuggugguucucccccgacggccccgccggcuccgccgccuccaucuggcccgccgagggcgccgagggccuccccggccagcucggccgcgaccgccucgaggucgucuacuccguccccgacaacguccccggccagaacggcucccgccgcccccucgucugcaagaucaccggcaagugccucuccgucugcuccgaggagaacgccaaggccggcggcugcuccgccuucccccuccuccucucccagcucggcgcccgcaugaccggccgcgagcacgcccacaagggccccgagcucaccacccccgacuccggccucccccgcccccccaaccccgcccucgccggcuuccgcgcccucgcccagcacucccccccccucggcaccuccacccccuccgccguccuccucuccgccgccaccuga

SEQ ID NO: 49562 - RNA, 1275 nt, Artificial Sequence
  derived and/or modified sequence opt2 from SLC22A18__Homo_sapiens__NP_899056
augcagggcgcccgcgccccccgcgaccagggccgcucccccggccgcauguccgcccucggccgcuccuccgucauccuccucaccuacguccucgccgccaccgagcucaccugccucuucaugcaguucuccaucguccccuaccucucccgcaagcucggccucgacuccaucgccuucggcuaccuccagaccaccuucggcguccuccagcuccucggcggccccgucuucggccgcuucgccgaccagcgcggcgcccgcgccgcccucacccucuccuuccucgccgcccucgcccucuaccuccuccucgccgccgccuccucccccgcccuccccggcgucuaccuccucuucgccucccgccuccccggcgcccucaugcacacccuccccgccgcccagauggucaucaccgaccucuccgcccccgaggagcgccccgccgcccucggccgccucggccucugcuucggcgucggcgucauccucggcucccuccucggcggcacccucgucuccgccuacggcauccagugccccgccauccucgccgcccucgccacccuccucggcgccguccucuccuucaccugcauccccgccuccaccaagggcgccaagaccgacgcccaggccccccuccccggcggcccccgcgccuccgucuucgaccucaaggccaucgccucccuccuccgccuccccgacgucccccgcaucuuccucgucaaggucgccuccaacugccccaccggccucuucauggucauguucuccaucaucuccauggacuucuuccagcucgaggccgcccaggccggcuaccucauguccuucuucggccuccuccagauggucacccagggccucgucaucggccagcucuccucccacuucuccgaggagguccuccuccgcgccuccguccucgucuucaucgucgucggccucgccauggccuggauguccuccgucuuccacuucugccuccucguccccggccucgucuucucccucugcacccucaacgucgucaccgacuccaugcucaucaaggccgucuccaccuccgacaccggcaccaugcucggccucugcgccuccguccagccccuccuccgcacccucggccccaccgucggcggccuccucuaccgcuccuucggcguccccgucuucggccacguccaggucgccaucaacacccucguccuccucguccucuggcgcaagcccaugccccagcgcaaggacaagguccgcuga

SEQ ID NO: 49563 - RNA, 1665 nt, Artificial Sequence
  derived and/or modified sequence opt2 from SLC22A1__Homo_sapiens__NP_003048
augcccaccgucgacgacauccucgagcaggucggcgaguccggcugguuccagaagcaggccuuccucauccucugccuccucuccgccgccuucgcccccaucugcgucggcaucgucuuccucggcuucacccccgaccaccacugccagucccccggcgucgccgagcucucccagcgcugcggcuggucccccgccgaggagcucaacuacaccguccccggccucggccccgccggcgaggccuuccucggccagugccgccgcuacgaggucgacuggaaccaguccgcccucuccugcgucgacccccucgccucccucgccaccaaccgcucccaccucccccucggccccugccaggacggcugggucuacgacacccccggcuccuccaucgucaccgaguucaaccucgucugcgccgacuccuggaagcucgaccucuuccaguccugccucaacgccggcuuccucuucggcucccucggcgucggcuacuucgccgaccgcuucggccgcaagcucugccuccucggcaccguccucgucaacgccgucuccggcguccucauggccuucucccccaacuacauguccaugcuccucuuccgccuccuccagggccucgucuccaagggcaacuggauggccggcuacacccucaucaccgaguucgucggcuccggcucccgccgcaccgucgccaucauguaccagauggccuucaccgucggccucgucgcccucaccggccucgccuacgcccucccccacuggcgcuggcuccagcucgccgucucccuccccaccuuccucuuccuccucuacuacuggugcguccccgaguccccccgcuggcuccucucccagaagcgcaacaccgaggccaucaagaucauggaccacaucgcccagaagaacggcaagcucccccccgccgaccucaagaugcucucccucgaggaggacgucaccgagaagcucucccccuccuucgccgaccucuuccgcaccccccgccuccgcaagcgcaccuucauccucauguaccucugguucaccgacuccguccucuaccagggccucauccuccacaugggcgccaccuccggcaaccucuaccucgacuuccucuacuccgcccucgucgagauccccggcgccuucaucgcccucaucaccaucgaccgcgucggccgcaucuaccccauggccauguccaaccuccucgccggcgccgccugccucgucaugaucuucaucucccccgaccuccacuggcucaacaucaucaucaugugcgucggccgcaugggcaucaccaucgccauccagaugaucugccucgucaacgccgagcucuaccccaccuucguccgcaaccucggcgucauggucugcuccucccucugcgacaucggcggcaucaucacccccuucaucgucuuccgccuccgcgaggucuggcaggcccucccccucauccucuucgccguccucggccuccucgccgccggcgucacccuccuccuccccgagaccaagggcgucgcccuccccgagaccaugaaggacgccgagaaccucggccgcaaggccaagcccaaggagaacaccaucuaccucaagguccagaccuccgagcccuccggcaccuga

SEQ ID NO: 49564 - RNA, 1086 nt, Artificial Sequence
  derived and/or modified sequence opt2 from SLC22A23__Homo_sapiens__NP_001273385
auggccaucgaccgccgccgcgaggccgccggcggcggccccggccgccagcccgcccccgccgaggagaacggcucccucccccccggcgacgccgccgccuccgccccccucggcggccgcgccggccccggcggcggcgccgagauccagccccuccccccccuccaccccggcggcggcccccaccccuccugcugcuccgccgccgccgcccccucccuccuccuccucgacuacgacggcuccguccuccccuuccucggcggccucggcggcggcuaccagaagacccucguccuccucaccuggauccccgcccucuucaucggcuucucccaguucuccgacuccuuccuccucgaccagcccaacuucuggugccgcggcgccggcaagggcaccgagcucgccggcgucaccaccaccggccgcggcggcgacaugggcaacuggaccucccuccccaccacccccuucgccaccgcccccugggaggccgccggcaaccgcuccaacuccuccggcgccgacggcggcgacacccccccccuccccuccccccccgacaagggcgacaacgccuccaacugcgacugccgcgccugggacuacggcauccgcgccggccucguccagaacgucgucuccaagugggaccucgucugcgacaacgccuggaagguccacaucgccaaguucucccuccucgucggccucaucuucggcuaccucaucaccggcugcaucgccgacugggucggccgccgccccguccuccucuucuccaucaucuucauccucaucuucggccucaccgucgcccucuccgucaacgucaccauguucuccacccuccgcuucuucgagggcuucugccucgccggcaucauccucacccucuacgcccuccgcaucgagcucugcccccccggcaagcgcuucaugaucaccauggucgccuccuucgucgccauggccggccaguuccucaugcccggccucgccgcccucugccgcgacuggcagguccuccaggcccucaucaucugccccuuccuccucaugcuccucuacugguccuga

SEQ ID NO: 49565 - RNA, 1659 nt, Artificial Sequence
  derived and/or modified sequence opt2 from SLC22A24__Homo_sapiens__NP_001129978
augggcuucgacguccuccucgaccaggucggcggcaugggccgcuuccagaucugccucaucgccuucuucugcaucaccaacauccuccucuuccccaacaucguccucgagaacuucaccgccuucacccccucccaccgcugcugggucccccuccucgacaacgacaccgucuccgacaacgacaccggcacccucuccaaggacgaccuccuccgcaucuccaucccccucgacuccaaccuccgcccccagaagugccagcgcuucauccacccccaguggcagcuccuccaccucaacggcaccuuccccaacaccaacgagcccgacaccgagcccugcgucgacggcugggucuacgaccgcuccuccuuccucuccaccaucgucaccgagugggaccucgucugcgagucccagucccucaaguccaugguccagucccucuucauggccggcucccuccucggcggccucaucuacggccaccucuccgaccgcgucggccgcaagaucaucugcaagcucugcuuccuccagcucgccaucuccaacaccugcgccgccuucgcccccaccuuccucgucuacugcauccuccgcuuccucgccggcuucuccaccaugaccauccucggcaacaccuucauccucucccucgaguggacccucccccgcucccgcuccaugaccaucaugguccuccucugcuccuacuccgucggccagaugcuccucggcggccucgccuucgccauccaggacuggcacauccuccagcucaccgucuccacccccaucaucguccucuuccucuccuccuggaagauggucgaguccgcccgcuggcucaucaucaacaaccagcucgacgagggccucaaggagcuccgccgcgucgcccacaucaacggcaagaagaacaccgaggagacccucaccaccgagcucguccgcuccaccaugaagaaggagcucgacgccguccgcaucaagaccuccaucuucucccucuuccgcgcccccaagcuccgcaugcgcgucuucggccucugcuucguccgcuucgccaucaccguccccuucuacggccucauccucaaccuccagcaccucggcuccaacgucucccucuuccagauccucugcggcgccgucaccuucaccgcccgcugcgucucccuccucacccucaaccacaugggccgccgcaucucccagauccucuucaccuuccccgucggccucuucauccucgucaacaccuuccucccccaggagaugcagauccuccgcgucguccucgccacccucggcaucggcuccgucuccgccgccuccaacuccgccuccguccaccacaacgagcucguccccaccauccuccgcuccaccgucgccggcaucaacgccgucuccggccgcaccggcgccgcccucgccccccuccucaugacccucauggccuacuccccccaccuccccuggaucuccuacggcgucuuccccauccucgccguccccgucauccuccuccuccccgagacccgcgaccucccccuccccaacaccauccaggacgucgagaacgaccgcaaggacucccgcaacaucaagcaggaggacaccugcaugaaggucacccaguucuga

SEQ ID NO: 49566 - RNA, 1668 nt, Artificial Sequence
  derived and/or modified sequence opt2 from SLC22A2__Homo_sapiens__NP_003049
augcccaccaccgucgacgacguccucgagcacggcggcgaguuccacuucuuccagaagcagauguucuuccuccucgcccuccucuccgccaccuucgcccccaucuacgucggcaucgucuuccucggcuucacccccgaccaccgcugccgcucccccggcgucgccgagcucucccuccgcugcggcuggucccccgccgaggagcucaacuacaccguccccggccccggccccgccggcgaggccuccccccgccagugccgccgcuacgaggucgacuggaaccaguccaccuucgacugcgucgacccccucgccucccucgacaccaaccgcucccgccucccccucggccccugccgcgacggcugggucuacgagacccccggcuccuccaucgucaccgaguucaaccucgucugcgccaacuccuggaugcucgaccucuuccaguccuccgucaacgucggcuucuucaucggcuccauguccaucggcuacaucgccgaccgcuucggccgcaagcucugccuccucaccaccguccucaucaacgccgccgccggcguccucauggccaucucccccaccuacaccuggaugcucaucuuccgccucauccagggccucgucuccaaggccggcuggcucaucggcuacauccucaucaccgaguucgucggccgccgcuaccgccgcaccgucggcaucuucuaccaggucgccuacaccgucggccuccucguccucgccggcgucgccuacgcccucccccacuggcgcuggcuccaguucaccgucucccuccccaacuucuucuuccuccucuacuacuggugcauccccgaguccccccgcuggcucaucucccagaacaagaacgccgaggccaugcgcaucaucaagcacaucgccaagaagaacggcaagucccuccccgccucccuccagcgccuccgccucgaggaggagaccggcaagaagcucaaccccuccuuccucgaccucguccgcaccccccagauccgcaagcacaccaugauccucauguacaacugguucaccuccuccguccucuaccagggccucaucaugcacaugggccucgccggcgacaacaucuaccucgacuucuucuacuccgcccucgucgaguuccccgccgccuucaugaucauccucaccaucgaccgcaucggccgccgcuaccccugggccgccuccaacauggucgccggcgccgccugccucgccuccgucuucauccccggcgaccuccaguggcucaagaucaucaucuccugccucggccgcaugggcaucaccauggccuacgagaucgucugccucgucaacgccgagcucuaccccaccuucauccgcaaccucggcguccacaucugcuccuccaugugcgacaucggcggcaucaucacccccuuccucgucuaccgccucaccaacaucuggcucgagcucccccucauggucuucggcguccucggccucgucgccggcggccucguccuccuccuccccgagaccaagggcaaggcccuccccgagaccaucgaggaggccgagaacaugcagcgcccccgcaagaacaaggagaagaugaucuaccuccagguccagaagcucgacaucccccucaacuga

SEQ ID NO: 49567 - RNA, 1671 nt, Artificial Sequence
  derived and/or modified sequence opt2 from SLC22A3__Homo_sapiens__NP_068812
augcccuccuucgacgaggcccuccagcgcgucggcgaguucggccgcuuccagcgccgcgucuuccuccuccucugccucaccggcgucaccuucgccuuccucuucgucggcgucgucuuccucggcacccagcccgaccacuacuggugccgcggccccuccgccgccgcccucgccgagcgcugcggcuggucccccgaggaggaguggaaccgcaccgcccccgccucccgcggccccgagccccccgagcgccgcggccgcugccagcgcuaccuccucgaggccgccaacgacuccgccuccgccaccuccgcccucuccugcgccgacccccucgccgccuuccccaaccgcuccgccccccucguccccugccgcggcggcuggcgcuacgcccaggcccacuccaccaucgucuccgaguucgaccucgucugcgucaacgccuggaugcucgaccucacccaggccauccucaaccucggcuuccucaccggcgccuucacccucggcuacgccgccgaccgcuacggccgcaucgucaucuaccuccucuccugccucggcgucggcgucaccggcgucgucgucgccuucgcccccaacuuccccgucuucgucaucuuccgcuuccuccagggcgucuucggcaagggcaccuggaugaccugcuacgucaucgucaccgagaucgucggcuccaagcagcgccgcaucgucggcaucgucauccagauguucuucacccucggcaucaucauccuccccggcaucgccuacuucauccccaacuggcagggcauccagcucgccaucacccuccccuccuuccucuuccuccucuacuacugggucguccccgaguccccccgcuggcucaucacccgcaagaagggcgacaaggcccuccagauccuccgccgcaucgccaagugcaacggcaaguaccucuccuccaacuacuccgagaucaccgucaccgacgaggaggucuccaaccccuccuuccucgaccucguccgcaccccccagaugcgcaagugcacccucauccucauguucgccugguucaccuccgccgucgucuaccagggccucgucaugcgccucggcaucaucggcggcaaccucuacaucgacuucuucaucuccggcgucgucgagcuccccggcgcccuccucauccuccucaccaucgagcgccucggccgccgccuccccuucgccgccuccaacaucgucgccggcgucgccugccucgucaccgccuuccuccccgagggcaucgccuggcuccgcaccaccgucgccacccucggccgccucggcaucaccauggccuucgagaucgucuaccucgucaacuccgagcucuaccccaccacccuccgcaacuucggcgucucccucugcuccggccucugcgacuucggcggcaucaucgcccccuuccuccucuuccgccucgccgccgucuggcucgagcucccccucaucaucuucggcauccucgccuccaucugcggcggccucgucaugcuccuccccgagaccaagggcaucgcccuccccgagaccgucgacgacgucgagaagcucggcuccccccacuccugcaagugcggccgcaacaagaagacccccgucucccgcucccaccucuga

SEQ ID NO: 49568 - RNA, 1656 nt, Artificial Sequence
  derived and/or modified sequence opt2 from SLC22A4__Homo_sapiens__NP_003050
augcgcgacuacgacgaggucaucgccuuccucggcgaguggggccccuuccagcgccucaucuucuuccuccucuccgccuccaucauccccaacggcuucaacggcauguccgucgucuuccucgccggcacccccgagcaccgcugccgcguccccgacgccgccaaccucuccuccgccuggcgcaacaacuccgucccccuccgccuccgcgacggccgcgaggucccccacuccugcucccgcuaccgccucgccaccaucgccaacuucuccgcccucggccucgagcccggccgcgacgucgaccucggccagcucgagcaggaguccugccucgacggcugggaguucucccaggacgucuaccucuccaccgucgucaccgaguggaaccucgucugcgaggacaacuggaaggucccccucaccaccucccucuucuucgucggcguccuccucggcuccuucgucuccggccagcucuccgaccgcuucggccgcaagaacguccucuucgccaccauggccguccagaccggcuucuccuuccuccagaucuucuccaucuccugggagauguucaccguccucuucgucaucgucggcaugggccagaucuccaacuacgucgucgccuucauccucggcaccgagauccucggcaaguccguccgcaucaucuucuccacccucggcgucugcaccuucuucgccgucggcuacaugcuccucccccucuucgccuacuucauccgcgacuggcgcaugcuccuccucgcccucaccguccccggcguccucugcgucccccucuggugguucauccccgaguccccccgcuggcucaucucccagcgccgcuuccgcgaggccgaggacaucauccagaaggccgccaagaugaacaacaucgccguccccgccgucaucuucgacuccgucgaggagcucaacccccucaagcagcagaaggccuucauccucgaccucuuccgcacccgcaacaucgccaucaugaccaucaugucccuccuccucuggaugcucaccuccgucggcuacuucgcccucucccucgacgcccccaaccuccacggcgacgccuaccucaacugcuuccucuccgcccucaucgagauccccgccuacaucaccgccuggcuccuccuccgcacccucccccgccgcuacaucaucgccgccguccucuucuggggcggcggcguccuccucuucauccagcucguccccgucgacuacuacuuccucuccaucggccucgucaugcucggcaaguucggcaucaccuccgccuucuccaugcucuacgucuucaccgccgagcucuaccccacccucguccgcaacauggccgucggcgucaccuccaccgccucccgcgucggcuccaucaucgcccccuacuucgucuaccucggcgccuacaaccgcaugcuccccuacaucgucaugggcucccucaccguccucaucggcauccucacccucuucuuccccgagucccucggcaugacccuccccgagacccucgagcagaugcagaaggucaagugguuccgcuccggcaagaagacccgcgacuccauggagaccgaggagaaccccaagguccucaucaccgccuucuga

SEQ ID NO: 49569 - RNA, 1674 nt, Artificial Sequence
  derived and/or modified sequence opt2 from SLC22A5__Homo_sapiens__NP_003051
augcgcgacuacgacgaggucaccgccuuccucggcgaguggggccccuuccagcgccucaucuucuuccuccucuccgccuccaucauccccaacggcuucaccggccucuccuccgucuuccucaucgccacccccgagcaccgcugccgcguccccgacgccgccaaccucuccuccgccuggcgcaaccacaccgucccccuccgccuccgcgacggccgcgaggucccccacuccugccgccgcuaccgccucgccaccaucgccaacuucuccgcccucggccucgagcccggccgcgacgucgaccucggccagcucgagcaggaguccugccucgacggcugggaguucucccaggacgucuaccucuccaccaucgucaccgaguggaaccucgucugcgaggacgacuggaaggccccccucaccaucucccucuucuucgucggcguccuccucggcuccuucaucuccggccagcucuccgaccgcuucggccgcaagaacguccucuucgucaccaugggcaugcagaccggcuucuccuuccuccagaucuucuccaagaacuucgagauguucgucguccucuucguccucgucggcaugggccagaucuccaacuacgucgccgccuucguccucggcaccgagauccucggcaaguccguccgcaucaucuucuccacccucggcgucugcaucuucuacgccuucggcuacaugguccucccccucuucgccuacuucauccgcgacuggcgcaugcuccucgucgcccucaccaugcccggcguccucugcgucgcccucuggugguucauccccgaguccccccgcuggcucaucucccagggccgcuucgaggaggccgaggucaucauccgcaaggccgccaaggccaacggcaucgucguccccuccaccaucuucgaccccuccgagcuccaggaccucuccuccaagaagcagcagucccacaacauccucgaccuccuccgcaccuggaacauccgcauggucaccaucauguccaucaugcucuggaugaccaucuccgucggcuacuucggccucucccucgacacccccaaccuccacggcgacaucuucgucaacugcuuccucuccgccauggucgagguccccgccuacguccucgccuggcuccuccuccaguaccucccccgccgcuacuccauggccaccgcccucuuccucggcggcuccguccuccucuucaugcagcucgucccccccgaccucuacuaccucgccaccguccucgucauggucggcaaguucggcgucaccgccgccuucuccauggucuacgucuacaccgccgagcucuaccccaccgucguccgcaacaugggcgucggcgucuccuccaccgccucccgccucggcuccauccucucccccuacuucgucuaccucggcgccuacgaccgcuuccuccccuacauccucaugggcucccucaccauccucaccgccauccucacccucuuccuccccgaguccuucggcaccccccuccccgacaccaucgaccagaugcuccgcgucaagggcaugaagcaccgcaagacccccucccacacccgcaugcucaaggacggccaggagcgccccaccauccucaaguccaccgccuucuga

SEQ ID NO: 49570 - RNA, 1692 nt, Artificial Sequence
  derived and/or modified sequence opt2 from SLC22A6__Homo_sapiens__NP_004781
auggccuucaacgaccuccuccagcaggucggcggcgucggccgcuuccagcagauccaggucacccucgucguccucccccuccuccucauggccucccacaacacccuccagaacuucaccgccgccauccccacccaccacugccgcccccccgccgacgccaaccucuccaagaacggcggccucgaggucuggcucccccgcgaccgccagggccagcccgaguccugccuccgcuucaccuccccccaguggggccuccccuuccucaacggcaccgaggccaacggcaccggcgccaccgagcccugcaccgacggcuggaucuacgacaacuccaccuuccccuccaccaucgucaccgagugggaccucgucugcucccaccgcgcccuccgccagcucgcccagucccucuacauggucggcguccuccucggcgccauggucuucggcuaccucgccgaccgccucggccgccgcaagguccucauccucaacuaccuccagaccgccgucuccggcaccugcgccgccuucgcccccaacuuccccaucuacugcgccuuccgccuccucuccggcauggcccucgccggcaucucccucaacugcaugacccucaacgucgaguggaugcccauccacacccgcgccugcgucggcacccucaucggcuacgucuacucccucggccaguuccuccucgccggcgucgccuacgccgucccccacuggcgccaccuccagcuccucgucuccgcccccuucuucgccuucuucaucuacuccugguucuucaucgaguccgcccgcuggcacuccuccuccggccgccucgaccucacccuccgcgcccuccagcgcgucgcccgcaucaacggcaagcgcgaggagggcgccaagcucuccauggagguccuccgcgccucccuccagaaggagcucaccaugggcaagggccaggccuccgccauggagcuccuccgcugccccacccuccgccaccucuuccucugccucuccaugcucugguucgccaccuccuucgccuacuacggccucgucauggaccuccagggcuucggcgucuccaucuaccucauccaggucaucuucggcgccgucgaccuccccgccaagcucgucggcuuccucgucaucaacucccucggccgccgccccgcccagauggccgcccuccuccucgccggcaucugcauccuccucaacggcgucaucccccaggaccaguccaucguccgcaccucccucgccguccucggcaagggcugccucgccgccuccuucaacugcaucuuccucuacaccggcgagcucuaccccaccaugauccgccagaccggcaugggcaugggcuccaccauggcccgcgucggcuccaucgucuccccccucgucuccaugaccgccgagcucuaccccuccaugccccucuucaucuacggcgccguccccgucgccgccuccgccgucaccguccuccuccccgagacccucggccagccccuccccgacaccguccaggaccucgagucccgcugggcccccacccagaaggaggccggcaucuacccccgcaagggcaagcagacccgccagcagcaggagcaccagaaguacauggucccccuccaggccuccgcccaggagaagaacggccucuga

SEQ ID NO: 49571 - RNA, 1641 nt, Artificial Sequence
  derived and/or modified sequence opt2 from SLC22A7__Homo_sapiens__NP_006663
augggcuucgaggagcuccucgagcaggucggcggcuucggccccuuccagcuccgcaacgucgcccuccucgcccucccccgcguccuccucccccuccacuuccuccuccccaucuuccucgccgccguccccgcccaccgcugcgcccuccccggcgcccccgccaacuucucccaccaggacgucuggcucgaggcccaccucccccgcgagcccgacggcacccucuccuccugccuccgcuucgccuacccccaggcccuccccaacaccacccucggcgaggagcgccagucccgcggcgagcucgaggacgagcccgccaccguccccugcucccagggcugggaguacgaccacuccgaguucuccuccaccaucgccaccgagugggaccucgucugcgagcagaagggccucaaccgcgccgccuccaccuucuucuucgccggcguccucgucggcgccgucgccuucggcuaccucuccgaccgcuucggccgccgccgccuccuccucgucgccuacgucuccacccucguccucggccucgccuccgccgccuccgucuccuacgucauguucgccaucacccgcacccucaccggcuccgcccucgccggcuucaccaucaucgucaugccccucgagcucgaguggcucgacgucgagcaccgcaccgucgccggcguccucuccuccaccuucuggaccggcggcgucaugcuccucgcccucgucggcuaccucauccgcgacuggcgcuggcuccuccucgccgucacccuccccugcgcccccggcauccucucccucugguggguccccgaguccgcccgcuggcuccucacccagggccacgucaaggaggcccaccgcuaccuccuccacugcgcccgccucaacggccgccccgucugcgaggacuccuucucccaggaggccgucuccaaggucgccgccggcgagcgcgucguccgccgccccuccuaccucgaccucuuccgcaccccccgccuccgccacaucucccucugcugcgucgucgucugguucggcgucaacuucuccuacuacggccucucccucgacgucuccggccucggccucaacgucuaccagacccagcuccucuucggcgccgucgagcuccccuccaagcuccucgucuaccucuccguccgcuacgccggccgccgccucacccaggccggcacccuccucggcaccgcccucgccuucggcacccgccuccucgucuccuccgacaugaaguccugguccaccguccucgccgucaugggcaaggccuucuccgaggccgccuucaccaccgccuaccucuucaccuccgagcucuaccccaccguccuccgccagaccggcaugggccucaccgcccucgucggccgccucggcggcucccucgccccccucgccgcccuccucgacggcgucuggcucucccuccccaagcucaccuacggcggcaucgcccuccucgccgccggcaccgcccuccuccuccccgagacccgccaggcccagcuccccgagaccauccaggacgucgagcgcaaguccgcccccaccucccuccaggaggaggagaugcccaugaagcagguccagaacuga

SEQ ID NO: 49572 - RNA, 1629 nt, Artificial Sequence
  derived and/or modified sequence opt2 from SLC22A8__Homo_sapiens__NP_001171661
augaccuucuccgagauccucgaccgcgucggcuccaugggccacuuccaguuccuccacgucgccauccucggccuccccauccucaacauggccaaccacaaccuccuccagaucuucaccgccgccacccccguccaccacugccgccccccccacaacgccuccaccggccccuggguccuccccaugggccccaacggcaagcccgagcgcugccuccgcuucguccacccccccaacgccucccuccccaacgacacccagcgcgccauggagcccugccucgacggcugggucuacaacuccaccaaggacuccaucgucaccgagugggaccucgucugcaacuccaacaagcucaaggagauggcccaguccaucuucauggccggcauccucaucggcggccucguccucggcgaccucuccgaccgcuucggccgccgccccauccucaccugcuccuaccuccuccucgccgccuccggcuccggcgccgccuucucccccaccuuccccaucuacauggucuuccgcuuccucugcggcuucggcaucuccggcaucacccucuccaccgucauccucaacgucgaguggguccccacccgcaugcgcgccaucauguccaccgcccucggcuacugcuacaccuucggccaguucauccuccccggccucgccuacgccaucccccaguggcgcuggcuccagcucaccgucuccauccccuucuucgucuucuuccucuccuccugguggacccccgaguccauccgcuggcucguccucuccggcaaguccuccaaggcccucaagauccuccgccgcgucgccgucuucaacggcaagaaggaggagggcgagcgccucucccucgaggagcucaagcucaaccuccagaaggagaucucccucgccaaggccaaguacaccgccuccgaccucuuccgcauccccaugcuccgccgcaugaccuucugccucucccucgccugguucgccaccggcuucgccuacuacucccucgccaugggcgucgaggaguucggcgucaaccucuacauccuccagaucaucuucggcggcgucgacguccccgccaaguucaucaccauccucucccucuccuaccucggccgccacaccacccaggccgccgcccuccuccucgccggcggcgccauccucgcccucaccuucgucccccucgaccuccagaccguccgcaccguccucgccgucuucggcaagggcugccucuccuccuccuucuccugccucuuccucuacaccuccgagcucuaccccaccgucauccgccagaccggcaugggcgucuccaaccucuggacccgcgucggcuccauggucuccccccucgucaagaucaccggcgagguccagcccuucauccccaacaucaucuacggcaucaccgcccuccucggcggcuccgccgcccucuuccuccccgagacccucaaccagccccuccccgagaccaucgaggaccucgagaacuggucccuccgcgccaagaagcccaagcaggagcccgaggucgagaaggccucccagcgcaucccccuccagccccacggccccggccucggcuccuccuga

SEQ ID NO: 49573 - RNA, 1797 nt, Artificial Sequence
  derived and/or modified sequence opt2 from SLC23A1__Homo_sapiens__NP_005838
augcgcgcccaggaggaccucgagggccgcacccagcacgagaccacccgcgaccccuccaccccccuccccaccgagcccaaguucgacaugcucuacaagaucgaggacgucccccccugguaccucugcauccuccucggcuuccagcacuaccucaccugcuucuccggcaccaucgccguccccuuccuccucgccgaggcccucugcgucggccacgaccagcacauggucucccagcucaucggcaccaucuucaccugcgucggcaucaccacccucauccagaccaccgucggcauccgccucccccucuuccaggccuccgccuucgccuuccucguccccgccaaggccauccucgcccucgagcgcuggaagugcccccccgaggaggagaucuacggcaacuggucccucccccucaacaccucccacaucuggcacccccgcauccgcgagguccagggcgccaucauggucuccuccgucgucgaggucgucaucggccuccucggccuccccggcgcccuccucaacuacaucggcccccucaccgucacccccaccgucucccucaucggccucuccgucuuccaggccgccggcgaccgcgccggcucccacuggggcaucuccgccugcuccauccuccucaucauccucuucucccaguaccuccgcaaccucaccuuccuccuccccgucuaccgcuggggcaagggccucacccuccuccgcauccagaucuucaagauguuccccaucaugcucgccaucaugaccgucuggcuccucugcuacguccucacccucaccgacguccuccccaccgaccccaaggccuacggcuuccaggcccgcaccgacgcccgcggcgacaucauggccaucgcccccuggauccgcauccccuaccccugccaguggggccuccccaccgucaccgccgccgccguccucggcauguucuccgccacccucgccggcaucaucgaguccaucggcgacuacuacgccugcgcccgccucgccggcgccccccccccccccguccacgccaucaaccgcggcaucuucaccgagggcaucugcugcaucaucgccggccuccucggcaccggcaacggcuccaccuccuccucccccaacaucggcguccucggcaucaccaaggucggcucccgccgcgucguccaguacggcgccgccaucaugcucguccucggcaccaucggcaaguucaccgcccucuucgccucccuccccgaccccauccucggcggcauguucugcacccucuucggcaugaucaccgccgucggccucuccaaccuccaguucgucgacaugaacuccucccgcaaccucuucguccucggcuucuccauguucuucggccucacccuccccaacuaccucgaguccaaccccggcgccaucaacaccggcauccucgaggucgaccagauccucaucguccuccucaccaccgagauguucgucggcggcugccucgccuucauccucgacaacaccguccccggcucccccgaggagcgcggccucauccaguggaaggccggcgcccacgccaacuccgacauguccuccucccucaaguccuacgacuuccccaucggcaugggcaucgucaagcgcaucaccuuccucaaguacauccccaucugccccgucuucaagggcuucuccuccuccuccaaggaccagaucgccauccccgaggacacccccgagaacaccgagaccgccuccgucugcaccaaggucuga

SEQ ID NO: 49574 - RNA, 1953 nt, Artificial Sequence
  derived and/or modified sequence opt2 from SLC23A2__Homo_sapiens__NP_005107
augaugggcaucggcaagaacaccaccuccaaguccauggaggccggcuccuccaccgagggcaaguacgaggacgaggccaagcaccccgccuucuucacccuccccgucgucaucaacggcggcgccaccuccuccggcgagcaggacaacgaggacaccgagcucauggccaucuacaccaccgagaacggcaucgccgagaaguccucccucgccgagacccucgacuccaccggcucccucgacccccagcgcuccgacaugaucuacaccaucgaggacgucccccccugguaccucugcaucuuccucggccuccagcacuaccucaccugcuucuccggcaccaucgccguccccuuccuccucgccgacgccaugugcgucggcuacgaccagugggccaccucccagcucaucggcaccaucuucuucugcgucggcaucaccacccuccuccagaccaccuucggcugccgccucccccucuuccaggccuccgccuucgccuuccucgcccccgcccgcgccauccucucccucgacaaguggaagugcaacaccaccgacgucuccgucgccaacggcaccgccgagcuccuccacaccgagcacaucugguacccccgcauccgcgagauccagggcgccaucaucauguccucccucaucgaggucgucaucggccuccucggccuccccggcgcccuccucaaguacaucggcccccucaccaucacccccaccgucgcccucaucggccucuccggcuuccaggccgccggcgagcgcgccggcaagcacuggggcaucgccaugcucaccaucuuccucguccuccucuucucccaguacgcccgcaacgucaaguucccccuccccaucuacaaguccaagaagggcuggaccgccuacaagcuccagcucuucaagauguuccccaucauccucgccauccucgucuccuggcuccucugcuucaucuucaccgucaccgacgucuucccccccgacuccaccaaguacggcuucuacgcccgcaccgacgcccgccagggcguccuccucgucgcccccugguucaagguccccuaccccuuccaguggggccuccccaccgucuccgccgccggcgucaucggcaugcucuccgccgucgucgccuccaucaucgaguccaucggcgacuacuacgccugcgcccgccucuccugcgccccccccccccccauccacgccaucaaccgcggcaucuucgucgagggccucuccugcguccucgacggcaucuucggcaccggcaacggcuccaccuccuccucccccaacaucggcguccucggcaucaccaaggucggcucccgccgcgucauccagugcggcgccgcccucaugcucgcccucggcaugaucggcaaguucuccgcccucuucgccucccuccccgaccccguccucggcgcccucuucugcacccucuucggcaugaucaccgccgucggccucuccaaccuccaguucaucgaccucaacuccucccgcaaccucuucguccucggcuucuccaucuucuucggccucguccuccccuccuaccuccgccagaacccccucgucaccggcaucaccggcaucgaccagguccucaacguccuccucaccaccgccauguucgucggcggcugcgucgccuucauccucgacaacaccauccccggcacccccgaggagcgcggcauccgcaaguggaagaagggcgucggcaagggcaacaagucccucgacggcauggaguccuacaaccuccccuucggcaugaacaucaucaagaaguaccgcugcuucuccuaccuccccaucucccccaccuucgucggcuacaccuggaagggccuccgcaaguccgacaacucccgcuccuccgacgaggacucccaggccaccggcuga

SEQ ID NO: 49575 - RNA, 3300 nt, Artificial Sequence
  derived and/or modified sequence opt2 from SLC24A1__Homo_sapiens__NP_004718
augggcaagcucauccgcaugggcccccaggagcgcuggcuccuccgcaccaagcgccuccacuggucccgccuccucuuccuccucggcaugcucaucaucggcuccaccuaccagcaccuccgccgcccccgcggccucuccucccucugggccgccgucuccucccaccagcccaucaagcucgccucccgcgaccucuccuccgaggagaugaugaugauguccuccucccccuccaagcccuccuccgagaugggcggcaagaugcucgucccccaggccuccgucggcuccgacgaggccacccucuccaugaccgucgagaacauccccuccaugcccaagcgcaccgccaagaugauccccaccaccaccaagaacaacuacucccccaccgccgccggcaccgagcgccgcaaggaggacacccccaccuccucccgcacccucaccuacuacaccuccaccuccucccgccagaucgucaagaaguacacccccaccccccgcggcgagaugaaguccuacucccccacccagguccgcgagaaggucaaguacacccccuccccccgcggccgccgcgucggcaccuacguccccuccaccuucaugaccauggagaccucccacgccaucaccccccgcaccaccgucaaggacuccgacaucaccgccaccuacaagauccucgagaccaacucccucaagcgcaucauggaggagaccacccccaccacccucaagggcauguucgacuccacccccaccuuccucacccacgaggucgaggccaacguccucaccuccccccgcuccgucauggagaagaacaaccucuuccccccccgccgcgucgaguccaacuccuccgcccaccccuggggccucgucggcaaguccaaccccaagaccccccagggcaccguccuccuccacacccccgccaccuccgagggccaggucaccaucuccaccaugaccggcuccucccccgccgagaccaaggccuucaccgccgccuggucccuccgcaaccccuccccccgcaccuccgucuccgccaucaagaccgcccccgccaucgucuggcgccucgccaagaagcccuccaccgcccccuccaccuccaccacccccaccguccgcgccaagcucaccaugcagguccaccacugcgucgucgucaagcccacccccgccaugcucaccacccccucccccucccucaccaccgcccuccuccccgaggagcucucccccucccccuccguccucccccccucccuccccgaccuccaccccaagggcgaguacccccccgaccucuucuccgucgaggagcgccgccagggcugggucguccuccacgucuucggcaugauguacgucuucgucgcccucgccaucgucugcgacgaguacuucguccccgcccucggcgucaucaccgacaagcuccagaucuccgaggacgucgccggcgccaccuucauggccgccggcggcuccgcccccgagcucuucaccucccucaucggcgucuucaucucccacuccaacgucggcaucggcaccaucgucggcuccgccgucuucaacauccucuucgucaucggcaccugcucccucuucucccgcgagauccucaaccucaccugguggccccucuuccgcgacgucuccuucuacauccucgaccucaucaugcucauccucuucuuccucgacucccucaucgccuggugggagucccuccuccuccuccucgccuacgccuucuacgucuucaccaugaaguggaacaagcacaucgaggucugggucaaggagcagcucucccgccgccccgucgccaaggucauggcccucgaggaccucuccaagcccggcgacggcgccaucgccgucgacgagcuccaggacaacaagaagcucaagcuccccucccuccucacccgcggcuccuccuccaccucccuccacaacuccaccauccgcuccaccaucuaccagcucaugcuccacucccucgacccccuccgcgagguccgccucgccaaggagaaggaggaggagucccucaaccagggcgcccgcgcccagccccaggccaaggccgaguccaagcccgaggaggaggagcccgccaagcuccccgccgucaccgucacccccgcccccguccccgacaucaagggcgaccagaaggagaaccccggcggccaggaggacgucgccgaggccgaguccaccggcgagaugcccggcgaggagggcgagaccgccggcgagggcgagaccgaggagaaguccggcggcgagacccagcccgagggcgagggcgagaccgagacccagggcaagggcgaggagugcgaggacgagaacgaggccgagggcaagggcgacaacgagggcgaggacgagggcgagauccacgccgaggacggcgagaugaagggcaacgagggcgagaccgagucccaggagcucuccgccgagaaccacggcgaggccaagaacgacgagaagggcgucgaggacggcggcggcuccgacggcggcgacuccgaggaggaggaggaggaggaggaggagcaggaggaggaggaggaggaggaggagcaggaggaggaggaggaggaggaggaggaggaggaggagaagggcaacgaggagccccucucccucgacuggcccgagacccgccagaagcaggccaucuaccucuuccuccuccccaucgucuucccccucuggcucaccguccccgacguccgccgccaggagucccgcaaguucuucgucuucaccuuccucggcuccaucauguggaucgccauguucuccuaccucauggucuggugggcccaccaggucggcgagaccaucggcaucuccgaggagaucaugggccucaccauccucgccgccggcaccuccauccccgaccucaucaccuccgucaucgucgcccgcaagggccucggcgacauggccgucuccuccuccgucggcuccaacaucuucgacaucaccgucggccuccccguccccuggcuccucuucucccucaucaacggccuccagcccguccccgucuccuccaacggccucuucugcgccaucguccuccucuuccucaugcuccucuucgucaucuccuccaucgccuccugcaaguggcgcaugaacaagauccucggcuucaccauguuccuccucuacuucgucuuccucaucaucuccgucaugcucgaggaccgcaucaucuccugccccgucuccgucuga

SEQ ID NO: 49576 - RNA, 1986 nt, Artificial Sequence
  derived and/or modified sequence opt2 from SLC24A2__Homo_sapiens__XP_005251482
auggaccuccagcaguccaccaccaucaccucccucgagaaguggugccucgacgagucccucuccggcugccgccgccacuacuccgucaagaagaagcucaagcucauccgcguccucggccucuucaugggccucgucgccaucuccaccgucuccuucuccaucuccgccuucuccgagaccgacacccaguccaccggcgaggccuccgucgucuccggcccccgcgucgcccagggcuaccaccagcgcacccuccucgaccucaacgacaagauccucgacuacaccccccagcccccccucuccaaggagggcgaguccgagaacuccaccgaccacgcccagggcgacuaccccaaggacaucuucucccucgaggagcgccgcaagggcgccaucauccuccacgucaucggcaugaucuacauguucaucgcccucgccaucgucugcgacgaguucuucguccccucccucaccgucaucaccgagaagcucggcaucuccgacgacgucgccggcgccaccuucauggccgccggcggcuccgcccccgagcucuucaccucccucaucggcgucuucaucgcccacuccaacgucggcaucggcaccaucgucggcuccgccgucuucaacauccucuucgucaucggcaugugcgcccucuucucccgcgagauccucaaccucaccugguggccccucuuccgcgacgucuccuucuacaucgucgaccucaucaugcucaucaucuucuuccucgacaacgucaucauguggugggagucccuccuccuccucaccgccuacuucugcuacgucgucuucaugaaguucaacguccaggucgagaagugggucaagcagaugaucaaccgcaacaaggucgucaaggucaccgcccccgaggcccaggccaagcccuccgccgcccgcgacaaggacgagcccacccuccccgccaagccccgccuccagcgcggcggcuccuccgccucccuccacaacucccucaugcgcaacuccaucuuccagcucaugauccacacccucgacccccucgccgaggagcucggcuccuacggcaagcucaaguacuacgacaccaugaccgaggagggccgcuuccgcgagaaggccuccauccuccacaagaucgccaagaagaagugccacgucgacgagaacgagcgccagaacggcgccgccaaccacgucgagaagaucgagcuccccaacuccaccuccaccgacgucgagaugacccccuccuccgacgccuccgagcccguccagaacggcaaccucucccacaacaucgagggcgccgaggcccagaccgccgacgaggaggaggaccagccccucucccucgccuggcccuccgagacccgcaagcaggucaccuuccucaucgucuuccccaucgucuucccccucuggaucacccuccccgacguccgcaagcccuccucccgcaaguucuuccccaucaccuucuucggcuccaucaccuggaucgccgucuucuccuaccucauggucuggugggcccaccaggucggcgagaccaucggcaucuccgaggagaucaugggccucaccauccucgccgccggcaccuccauccccgaccucaucaccuccgucaucgucgcccgcaagggccucggcgacauggccgucuccuccuccgucggcuccaacaucuucgacaucaccgucggccucccccuccccuggcuccucuacaccgucauccaccgcuuccagcccgucgccgucuccuccaacggccucuucugcgccaucguccuccucuucaucaugcuccucuucgucauccucuccaucgcccucugcaaguggcgcaugaacaagauccucggcuucaucauguucggccucuacuucgucuuccucgucgucuccguccuccucgaggaccgcauccucaccugccccgucuccaucuga

SEQ ID NO: 49577 - RNA, 1935 nt, Artificial Sequence
  derived and/or modified sequence opt2 from SLC24A3__Homo_sapiens__NP_065740
augcgccccuccggcgacgaggaccgcgcccgccgccgccgccgccgccgccgccgccgcgaccuccuccucucccagcucugcuuccucgccuccgucgcccuccuccucuggucccucuccucccuccgcgagcagaaggagcucgaccucauggaccucgucggcgaggaccgcaaguggaugauggcccgcaagcucaugcaggucaacgacacccucaccuccgaggacgccggccuccgcaacuccaagaacugcaccgagcccgcccuccacgaguuccccaacgacaucuucaccaacgaggaccgccgccagggcgccgucguccuccacguccucugcgccaucuacauguucuacgcccucgccaucgucugcgacgacuucuucguccccucccucgagaagaucugcgagcgccuccaccucuccgaggacgucgccggcgccaccuucauggccgccggcuccuccgcccccgagcucuucaccuccgucaucggcgucuucaucaccaagggcgacgucggcgucggcaccaucgucggcuccgccgucuucaacauccucugcaucaucggcgucugcggccucuucgccggccaggucgucgcccucuccuccuggugccuccuccgcgacuccaucuacuacacccucuccgucaucgcccucaucgucuucaucuacgacgagaaggucuccuggugggagucccucguccucguccucauguaccucaucuacaucgucaucaugaaguacaacgccugcauccaccagugcuucgagcgccgcaccaagggcgccggcaacauggucaacggccucgccaacaacgccgagaucgacgacuccuccaacugcgacgccaccgucguccuccucaagaaggccaacuuccaccgcaaggccuccgucaucauggucgacgagcuccucuccgccuacccccaccagcucuccuucuccgaggccggccuccgcaucaugaucaccucccacuucccccccaagacccgccucuccauggccucccgcaugcucaucaacgagcgccagcgccucaucaacucccgcgccuacaccaacggcgaguccgaggucgccaucaagauccccaucaagcacaccgucgagaacggcaccggccccuccuccgcccccgaccgcggcgucaacggcacccgccgcgacgacgucgucgccgaggccggcaacgagaccgagaacgagaacgaggacaacgagaacgacgaggaggaggaggaggacgaggacgacgacgagggccccuacacccccuucgacacccccuccggcaagcucgagaccgucaagugggccuucaccuggccccucuccuucguccucuacuucaccguccccaacugcaacaagccccgcugggagaagugguucauggucaccuucgccuccuccacccucuggaucgccgccuucuccuacaugauggucuggauggucaccaucaucggcuacacccucggcauccccgacgucaucaugggcaucaccuuccucgccgccggcaccuccguccccgacugcauggccucccucaucgucgcccgccagggcaugggcgacauggccgucuccaacuccaucggcuccaacgucuucgacauccucaucggccucggccuccccugggcccuccagacccucgccgucgacuacggcuccuacauccgccucaacucccgcggccucaucuacuccgucggccuccuccucgccuccgucuucgucaccgucuucggcguccaccucaacaaguggcagcucgacaagaagcucggcugcggcugccuccuccucuacggcgucuuccucugcuucuccaucaugaccgaguucaacgucuucaccuucgucaaccuccccaugugcggcgaccacuga

SEQ ID NO: 49578 - RNA, 1869 nt, Artificial Sequence
  derived and/or modified sequence opt2 from SLC24A4__Homo_sapiens__NP_705932
auggcccuccgcggcacccuccgcccccucaagguccgccgccgccgcgagaugcucccccagcaggucggcuucgucugcgccguccucgcccucgucugcugcgccuccggccucuucggcucccucggccacaagaccgccuccgccuccaagcgcguccuccccgacaccuggcgcaaccgcaagcucauggcccccgucaacggcacccagaccgccaagaacugcaccgaccccgccauccacgaguuccccaccgaccucuucuccaacaaggagcgccagcacggcgccguccuccuccacauccucggcgcccucuacauguucuacgcccucgccaucgucugcgacgacuucuucguccccucccucgagaagaucugcgagcgccuccaccucuccgaggacgucgccggcgccaccuucauggccgccggcuccuccacccccgagcucuucgccuccgucaucggcgucuucaucacccacggcgacgucggcgucggcaccaucgucggcuccgccgucuucaacauccucugcaucaucggcgucugcggccucuucgccggccaggucguccgccucaccuggugggccgucugccgcgacuccgucuacuacaccaucuccgucaucguccucaucgucuucaucuacgacgagcagaucgucuggugggagggccucguccucaucauccucuacgucuucuacauccucaucaugaaguacaacgucaagaugcaggccuucuucaccgucaagcagaaguccaucgccaacggcaaccccgucaacuccgagcucgaggccggcaacgacuucuacgacggcuccuacgacgaccccuccgucccccuccucggccaggucaaggagaagccccaguacggcaagaaccccgucgucauggucgacgagaucauguccuccuccccccccaaguucaccuuccccgaggccggccuccgcaucaugaucaccaacaaguucggcccccgcacccgccuccgcauggccucccgcaucaucaucaacgagcgccagcgccucaucaacuccgccaacggcgucuccuccaagccccuccagaacggccgccacgagaacaucgagaacggcaacguccccgucgagaaccccgaggacccccagcagaaccaggagcagcagccccccccccagccccccccccccgagcccgagcccgucgaggccgacuuccucucccccuucuccguccccgaggcccgcggcgacaaggucaagugggucuucaccuggccccucaucuuccuccucugcgucaccauccccaacugcuccaagccccgcugggagaaguucuucauggucaccuucaucaccgccacccucuggaucgccgucuucuccuacaucauggucuggcucgucaccaucaucggcuacacccucggcauccccgacgucaucaugggcaucaccuuccucgccgccggcaccuccguccccgacugcauggccucccucaucgucgcccgccagggccucggcgacauggccgucuccaacaccaucggcuccaacgucuucgacauccucgucggccucggcguccccuggggccuccagaccauggucgucaacuacggcuccaccgucaagaucaacucccgcggccucgucuacuccgucguccuccuccucggcuccgucgcccucaccguccucggcauccaccucaacaaguggcgccucgaccgcaagcucggcgucuacguccucguccucuacgccaucuuccucugcuucuccaucaugaucgaguucaacgucuucaccuucgucaaccuccccaugugccgcgaggacgacuga

SEQ ID NO: 49579 - RNA, 1503 nt, Artificial Sequence
  derived and/or modified sequence opt2 from SLC24A5__Homo_sapiens__NP_995322
augcagaccaagggcggccagaccugggcccgccgcgcccuccuccucggcauccucugggccaccgcccaccucccccucuccggcaccucccucccccagcgccucccccgcgccaccggcaacuccacccagugcgucaucucccccuccuccgaguuccccgagggcuucuucacccgccaggagcgccgcgacggcggcaucaucaucuacuuccucaucaucgucuacauguucauggccaucuccaucgucugcgacgaguacuuccuccccucccucgagaucaucuccgagucccucggccucucccaggacgucgccggcaccaccuucauggccgccggcuccuccgcccccgagcucgucaccgccuuccucggcgucuucaucaccaagggcgacaucggcaucuccaccauccucggcuccgccaucuacaaccuccucggcaucugcgccgccugcggccuccucuccaacaccgucuccacccucuccugcuggccccucuuccgcgacugcgccgccuacaccaucuccgccgccgccguccucggcaucaucuacgacaaccaggucuacugguacgagggcgcccuccuccuccucaucuacggccucuacguccucguccucugcuucgacaucaagaucaaccaguacaucaucaagaagugcucccccugcugcgccugccucgccaaggccauggagcgcuccgagcagcagccccucaugggcugggaggacgagggccagcccuucauccgccgccagucccgcaccgacuccggcaucuucuacgaggacuccggcuacucccagcucuccaucucccuccacggccucucccaggucuccgaggacccccccuccgucuucaacaugcccgaggccgaccucaagcgcaucuucuggguccucucccuccccaucaucacccuccucuuccucaccacccccgacugccgcaagaaguucuggaagaacuacuucgucaucaccuucuucauguccgccaucuggaucuccgccuucaccuacauccucgucuggauggucaccaucaccggcgagacccucgagauccccgacaccgucaugggccucacccuccucgccgccggcaccuccauccccgacaccaucgccuccguccucgucgcccgcaagggcaagggcgacauggccauguccaacaucgucggcuccaacgucuucgacaugcucugccucggcauccccugguucaucaagaccgccuucaucaacggcuccgcccccgccgaggucaacucccgcggccucaccuacaucaccaucucccucaacaucuccaucaucuuccucuuccucgccguccacuucaacggcuggaagcucgaccgcaagcucggcaucgucugccuccucuccuaccucggccucgccacccucuccguccucuacgagcucggcaucaucggcaacaacaagauccgcggcugcggcggcuga

SEQ ID NO: 49580 - RNA, 891 nt, Artificial Sequence
  derived and/or modified sequence opt2 from SLC25A10__Homo_sapiens__NP_001257817
auggccgccgaggcccgcgucucccgcugguacuucggcggccucgccuccugcggcgccgccugcugcacccacccccucgaccuccucaagguccaccuccagacccagcaggaggucaagcuccgcaugaccggcauggcccuccgcgucguccgcaccgacggcauccucgcccucuacuccggccucuccgccucccucugccgccagaugaccuacucccucacccgcuucgccaucuacgagaccguccgcgaccgcgucgccaagggcucccagggcccccuccccuuccacgagaagguccuccucggcuccgucuccggccucgccggcggcuucgucggcacccccgccgaccucgucaacguccgcaugcagaacgacgucaagcucccccagggccagcgccgcaacuacgcccacgcccucgacggccucuaccgcgucgcccgcgaggagggccuccgccgccucuucuccggcgccaccauggccuccucccgcggcgcccucgucaccgucggccagcucuccugcuacgaccaggccaagcagcucguccucuccaccggcuaccucuccgacaacaucuucacccacuucgucgccuccuucaucgccgccgccggcgacgagccccccccccagggcggcugcgccaccuuccucugccagccccucgacguccucaagacccgccucaugaacuccaagggcgaguaccagggcgucuuccacugcgccgucgagaccgccaagcucggcccccucgccuucuacaagggccucguccccgccggcauccgccucaucccccacaccguccucaccuucgucuuccucgagcagcuccgcaagaacuucggcaucaagguccccuccuga

SEQ ID NO: 49581 - RNA, 2037 nt, Artificial Sequence
  derived and/or modified sequence opt2 from SLC25A12__Homo_sapiens__NP_003696
auggccgucaagguccagaccaccaagcgcggcgacccccacgagcuccgcaacaucuuccuccaguacgccuccaccgaggucgacggcgagcgcuacaugacccccgaggacuucguccagcgcuaccucggccucuacaacgaccccaacuccaaccccaagaucguccagcuccucgccggcgucgccgaccagaccaaggacggccucaucuccuaccaggaguuccucgccuucgaguccguccucugcgcccccgacuccauguucaucgucgccuuccagcucuucgacaaguccggcaacggcgaggucaccuucgagaacgucaaggagaucuucggccagaccaucauccaccaccacauccccuucaacugggacugcgaguucauccgccuccacuucggccacaaccgcaagaagcaccucaacuacaccgaguucacccaguuccuccaggagcuccagcucgagcacgcccgccaggccuucgcccucaaggacaaguccaaguccggcaugaucuccggccucgacuucuccgacaucauggucaccauccgcucccacaugcucacccccuucgucgaggagaaccucgucuccgccgccggcggcuccaucucccaccaggucuccuucuccuacuucaacgccuucaacucccuccucaacaacauggagcucguccgcaagaucuacuccacccucgccggcacccgcaaggacgucgaggucaccaaggaggaguucgcccaguccgccauccgcuacggccaggucaccccccucgagaucgacauccucuaccagcucgccgaccucuacaacgccuccggccgccucacccucgccgacaucgagcgcaucgccccccucgccgagggcgcccuccccuacaaccucgccgagcuccagcgccagcagucccccggccucggccgccccaucuggcuccagaucgccgaguccgccuaccgcuucacccucggcuccgucgccggcgccgucggcgccaccgccgucuaccccaucgaccucgucaagacccgcaugcagaaccagcgcggcuccggcuccgucgucggcgagcucauguacaagaacuccuucgacugcuucaagaagguccuccgcuacgagggcuucuucggccucuaccgcggccucaucccccagcucaucggcgucgcccccgagaaggccaucaagcucaccgucaacgacuucguccgcgacaaguucacccgccgcgacggcuccgucccccuccccgccgagguccucgccggcggcugcgccggcggcucccaggucaucuucaccaacccccucgagaucgucaagauccgccuccaggucgccggcgagaucaccaccggcccccgcgucuccgcccucaacguccuccgcgaccucggcaucuucggccucuacaagggcgccaaggccugcuuccuccgcgacauccccuucuccgccaucuacuuccccgucuacgcccacugcaagcuccuccucgccgacgagaacggccacgucggcggccucaaccuccucgccgccggcgccauggccggcguccccgccgccucccucgucacccccgccgacgucaucaagacccgccuccaggucgccgcccgcgccggccagaccaccuacuccggcgucaucgacugcuuccgcaagauccuccgcgaggagggccccuccgccuucuggaagggcaccgccgcccgcgucuuccgcuccuccccccaguucggcgucacccucgucaccuacgagcuccuccagcgcugguucuacaucgacuucggcggccucaagcccgccggcuccgagcccacccccaagucccgcaucgccgaccucccccccgccaaccccgaccacaucggcggcuaccgccucgccaccgccaccuucgccggcaucgagaacaaguucggccucuaccuccccaaguucaagucccccuccgucgccgucguccagcccaaggccgccgucgccgccacccaguga

SEQ ID NO: 49582 - RNA, 2031 nt, Artificial Sequence
  derived and/or modified sequence opt2 from SLC25A13__Homo_sapiens__NP_001153682
auggccgccgccaaggucgcccucaccaagcgcgccgaccccgccgagcuccgcaccaucuuccucaaguacgccuccaucgagaagaacggcgaguucuucaugucccccaacgacuucgucacccgcuaccucaacaucuucggcgagucccagcccaaccccaagaccgucgagcuccucuccggcgucgucgaccagaccaaggacggccucaucuccuuccaggaguucgucgccuucgaguccguccucugcgcccccgacgcccucuucauggucgccuuccagcucuucgacaaggccggcaagggcgaggucaccuucgaggacgucaagcaggucuucggccagaccaccauccaccagcacauccccuucaacugggacuccgaguucguccagcuccacuucggcaaggagcgcaagcgccaccucaccuacgccgaguucacccaguuccuccucgagauccagcucgagcacgccaagcaggccuucguccagcgcgacaacgcccgcaccggccgcgucaccgccaucgacuuccgcgacaucauggucaccauccgcccccacguccucacccccuucgucgaggagugccucgucgccgccgccggcggcaccaccucccaccaggucuccuucuccuacuucaacggcuucaacucccuccucaacaacauggagcucauccgcaagaucuacuccacccucgccggcacccgcaaggacgucgaggucaccaaggaggaguucguccucgccgcccagaaguucggccaggucacccccauggaggucgacauccucuuccagcucgccgaccucuacgagccccgcggccgcaugacccucgccgacaucgagcgcaucgccccccucgaggagggcacccuccccuucaaccucgccgaggcccagcgccagcagaaggccuccggcgacuccgcccgccccguccuccuccaggucgccgaguccgccuaccgcuucggccucggcuccgucgccggcgccgucggcgccaccgccgucuaccccaucgaccucgucaagacccgcaugcagaaccagcgcuccaccggcuccuucgucggcgagcucauguacaagaacuccuucgacugcuucaagaagguccuccgcuacgagggcuucuucggccucuaccgcggccuccucccccagcuccucggcgucgcccccgagaaggccaucaagcucaccgucaacgacuucguccgcgacaaguucaugcacaaggacggcuccgucccccucgccgccgagauccucgccggcggcugcgccggcggcucccaggucaucuucaccaacccccucgagaucgucaagauccgccuccaggucgccggcgagaucaccaccggcccccgcgucuccgcccucuccgucguccgcgaccucggcuucuucggcaucuacaagggcgccaaggccugcuuccuccgcgacauccccuucuccgccaucuacuuccccugcuacgcccacgucaaggccuccuucgccaacgaggacggccaggucucccccggcucccuccuccucgccggcgccaucgccggcaugcccgccgccucccucgucacccccgccgacgucaucaagacccgccuccaggucgccgcccgcgccggccagaccaccuacuccggcgucaucgacugcuuccgcaagauccuccgcgaggagggccccaaggcccucuggaagggcgccggcgcccgcgucuuccgcuccuccccccaguucggcgucacccuccucaccuacgagcuccuccagcgcugguucuacaucgacuucggcggcgucaagcccaugggcuccgagcccguccccaagucccgcaucaaccuccccgcccccaaccccgaccacgucggcggcuacaagcucgccgucgccaccuucgccggcaucgagaacaaguucggccucuaccucccccucuucaagcccuccgucuccaccuccaaggccaucggcggcggccccuga

SEQ ID NO: 49583 - RNA, 978 nt, Artificial Sequence
  derived and/or modified sequence opt2 from SLC25A14__Homo_sapiens__NP_001269124
augggcaucuuccccggcaucauccucaucuuccuccgcgucaaguucgccaccgccgccgucaucgucuccggccaccagaaguccaccaccgucucccacgagauguccggccucaacuggaagcccuucgucuacggcggccucgccuccaucgucgccgaguucggcaccuuccccgucgaccucaccaagacccgccuccagguccagggccaguccaucgacgcccgcuucaaggagaucaaguaccgcggcauguuccacgcccucuuccgcaucugcaaggaggagggcguccucgcccucuacuccggcaucgcccccgcccuccuccgccaggccuccuacggcaccaucaagaucggcaucuaccagucccucaagcgccucuucgucgagcgccucgaggacgagacccuccucaucaacaugaucugcggcgucgucuccggcgucaucuccuccaccaucgccaaccccaccgacguccucaagauccgcaugcaggcccagggcucccucuuccagggcuccaugaucggcuccuucaucgacaucuaccagcaggagggcacccgcggccucuggcgcggcgucguccccaccgcccagcgcgccgccaucgucgucggcgucgagcuccccgucuacgacaucaccaagaagcaccucauccucuccggcaugaugggcgacaccauccucacccacuucgucuccuccuucaccugcggccucgccggcgcccucgccuccaaccccgucgacgucguccgcacccgcaugaugaaccagcgcgccaucgucggccacgucgaccucuacaagggcaccgucgacggcauccucaagauguggaagcacgagggcuucuucgcccucuacaagggcuucuggcccaacuggcuccgccucggccccuggaacaucaucuucuucaucaccuacgagcagcucaagcgccuccagaucuga

SEQ ID NO: 49584 - RNA, 906 nt, Artificial Sequence
  derived and/or modified sequence opt2 from SLC25A15__Homo_sapiens__NP_055067
augaaguccaaccccgccauccaggccgccaucgaccucaccgccggcgccgccggcggcaccgccugcguccucaccggccagcccuucgacaccaugaaggucaagaugcagaccuuccccgaccucuaccgcggccucaccgacugcugccucaagaccuacucccaggucggcuuccgcggcuucuacaagggcaccucccccgcccucaucgccaacaucgccgagaacuccguccucuucaugugcuacggcuucugccagcaggucguccgcaaggucgccggccucgacaagcaggccaagcucuccgaccuccagaacgccgccgccggcuccuucgccuccgccuucgccgcccucguccucugccccaccgagcucgucaagugccgccuccagaccauguacgagauggagaccuccggcaagaucgccaagucccagaacaccgucugguccgucaucaaguccauccuccgcaaggacggcccccucggcuucuaccacggccucuccuccacccuccuccgcgagguccccggcuacuucuucuucuucggcggcuacgagcucucccgcuccuucuucgccuccggccgcuccaaggacgagcucggccccgucccccucaugcucuccggcggcgucggcggcaucugccucuggcucgccgucuaccccgucgacugcaucaagucccgcauccagguccucuccauguccggcaagcaggccggcuucauccgcaccuucaucaacgucgucaagaacgagggcaucaccgcccucuacuccggccucaagcccaccaugauccgcgccuuccccgccaacggcgcccucuuccucgccuacgaguacucccgcaagcucaugaugaaccagcucgaggccuacuga

SEQ ID NO: 49585 - RNA, 705 nt, Artificial Sequence
  derived and/or modified sequence opt2 from SLC25A16__Homo_sapiens__XP_006718050
augaugauccgcaucuuccccuacggcgccauccaguucauggccuucgagcacuacaagacccucaucaccaccaagcucggcaucuccggccacguccaccgccucauggccggcuccauggccggcaugaccgccgucaucugcaccuacccccucgacaugguccgcguccgccucgccuuccaggucaagggcgagcacuccuacaccggcaucauccacgccuucaagaccaucuacgccaaggagggcggcuucuucggcuucuaccgcggccucaugcccaccauccucggcauggcccccuacgccggcgucuccuucuucaccuucggcacccucaaguccgucggccucucccacgcccccacccuccucggccgccccuccuccgacaaccccaacguccucguccucaagacccacgucaaccuccucugcggcggcgucgccggcgccaucgcccagaccaucuccuaccccuucgacgucacccgccgccgcaugcagcucggcaccguccuccccgaguucgagaagugccucaccaugcgcgacaccaugaaguacgucuacggccaccacggcauccgcaagggccucuaccgcggccucucccucaacuacauccgcugcauccccucccaggccgucgccuucaccaccuacgagcucaugaagcaguucuuccaccucaacuga

SEQ ID NO: 49586 - RNA, 948 nt, Artificial Sequence
  derived and/or modified sequence opt2 from SLC25A18__Homo_sapiens__NP_001290413
augacccaccaggaccucuccaucaccgccaagcucaucaacggcggcgucgccggccucgucggcgucaccugcgucuuccccaucgaccucgccaagacccgccuccagaaccagcacggcaaggccauguacaagggcaugaucgacugccucaugaagaccgcccgcgccgagggcuucuucggcauguaccgcggcgccgccgucaaccucacccucgucacccccgagaaggccaucaagcucgccgccaacgacuucuuccgccgccuccucauggaggacggcaugcagcgcaaccucaagauggagaugcucgccggcugcggcgccggcaugugccaggucgucgucaccugccccauggagaugcucaagauccagcuccaggacgccggccgccucgccguccaccaccagggcuccgccuccgcccccuccaccucccgcuccuacaccaccggcuccgccuccacccaccgccgccccuccgccacccucaucgccugggagcuccuccgcacccagggccucgccggccucuaccgcggccucggcgccacccuccuccgcgacauccccuucuccaucaucuacuucccccucuucgccaaccucaacaaccucggcuucaacgagcucgccggcaaggccuccuucgcccacuccuucgucuccggcugcgucgccggcuccaucgccgccgucgccgucaccccccucgacguccucaagacccgcauccagacccucaagaagggccucggcgaggacauguacuccggcaucaccgacugcgcccgcaagcucuggauccaggagggccccuccgccuucaugaagggcgccggcugccgcgcccucgucaucgccccccucuucggcaucgcccagggcgucuacuucaucggcaucggcgagcgcauccucaagugcuucgacuga

SEQ ID NO: 49587 - RNA, 963 nt, Artificial Sequence
  derived and/or modified sequence opt2 from SLC25A19__Homo_sapiens__XP_006722070
auggucggcuacgaccccaagcccgacggccgcaacaacaccaaguuccaggucgccgucgccggcuccgucuccggccucgucacccgcgcccucaucucccccuucgacgucaucaagauccgcuuccagcuccagcacgagcgccucucccgcuccgaccccuccgccaaguaccacggcauccuccaggccucccgccagauccuccaggaggagggccccaccgccuucuggaagggccacguccccgcccagauccucuccaucggcuacggcgccguccaguuccucuccuucgagaugcucaccgagcucguccaccgcggcuccgucuacgacgcccgcgaguucuccguccacuucgucugcggcggccucgccgccugcauggccacccucaccguccaccccgucgacguccuccgcacccgcuucgccgcccagggcgagcccaaggucuacaacacccuccgccacgccgucggcaccauguaccgcuccgagggcccccaggucuucuacaagggccucgcccccacccucaucgccaucuuccccuacgccggccuccaguucuccugcuacuccucccucaagcaccucuacaagugggccauccccgccgagggcaagaagaacgagaaccuccagaaccuccucugcggcuccggcgccggcgucaucuccaagacccucaccuacccccucgaccucuucaagaagcgccuccaggucggcggcuucgagcacgcccgcgccgccuucggccagguccgccgcuacaagggccucauggacugcgccaagcagguccuccagaaggagggcgcccucggcuucuucaagggccucucccccucccuccucaaggccgcccucuccaccggcuucauguucuucuccuacgaguucuucugcaacgucuuccacugcaugaaccgcaccgccucccagcgcuga

SEQ ID NO: 49588 - RNA, 957 nt, Artificial Sequence
  derived and/or modified sequence opt2 from SLC25A1__Homo_sapiens__NP_001243463
auguuccccgccgcccucgcccgccgcccccgccgccccaaguccggcaccggcgagggccccgagcgccagcgccccggcggcucccuccgcuccggcuuccccguccccgccggcggccucgccggcggcaucgagaucugcaucaccuuccccaccgaguacgucaagacccagcuccagcucgacgagcgcucccaccccccccgcuaccgcggcaucggcgacugcguccgccagaccguccgcucccacggcguccucggccucuaccgcggccucuccucccuccucuacggcuccauccccaaggccgccguccgcuucggcauguucgaguuccucuccaaccacaugcgcgacgcccagggccgccucgacuccacccgcggccuccucugcggccucggcgccggcgucgccgaggccgucgucgucgucugccccauggagaccaucaaggucaaguucauccacgaccagaccucccccaaccccaaguaccgcggcuucuuccacggcguccgcgagaucguccgcgagcagggccucaagggcaccuaccagggccucaccgccaccguccucaagcagggcuccaaccaggccauccgcuucuucgucaugaccucccuccgcaacugguaccgcggcgacaaccccaacaagcccaugaacccccucaucaccggcgucuucggcgccaucgccggcgccgccuccgucuucggcaacaccccccucgacgucaucaagacccgcaugcagggccucgaggcccacaaguaccgcaacaccugggacugcggccuccagauccucaagaaggagggccucaaggccuucuacaagggcaccgucccccgccucggccgcgucugccucgacgucgccaucgucuucgucaucuacgacgaggucgucaagcuccucaacaaggucuggaagaccgacuga

SEQ ID NO: 49589 - RNA, 906 nt, Artificial Sequence
  derived and/or modified sequence opt2 from SLC25A20__Homo_sapiens__NP_000378
auggccgaccagcccaagcccaucuccccccucaagaaccuccucgccggcggcuucggcggcgucugccucgucuucgucggccacccccucgacaccgucaagguccgccuccagacccagccccccucccuccccggccagccccccauguacuccggcaccuucgacugcuuccgcaagacccucuuccgcgagggcaucaccggccucuaccgcggcauggccgcccccaucaucggcgucacccccauguucgccgucugcuucuucggcuucggccucggcaagaagcuccagcagaagcaccccgaggacguccucuccuacccccagcucuucgccgccggcaugcucuccggcgucuucaccaccggcaucaugacccccggcgagcgcaucaagugccuccuccagauccaggccuccuccggcgaguccaaguacaccggcacccucgacugcgccaagaagcucuaccaggaguucggcauccgcggcaucuacaagggcaccguccucacccucaugcgcgacguccccgccuccggcauguacuucaugaccuacgaguggcucaagaacaucuucacccccgagggcaagcgcgucuccgagcucuccgccccccgcauccucgucgccggcggcaucgccggcaucuucaacugggccgucgccaucccccccgacguccucaagucccgcuuccagaccgccccccccggcaaguaccccaacggcuuccgcgacguccuccgcgagcucauccgcgacgagggcgucaccucccucuacaagggcuucaacgccgucaugauccgcgccuuccccgccaacgccgccugcuuccucggcuucgaggucgccaugaaguuccucaacugggccacccccaaccucuga

SEQ ID NO: 49590 - RNA, 897 nt, Artificial Sequence
  derived and/or modified sequence opt2 from SLC25A21__Homo_sapiens__NP_001164641
auguccgccaagcccgaggucucccucguccgcgaggccucccgccagaucgucgccggcggcuccgccggccucgucgagaucugccucaugcacccccucgacgucgucaagacccgcuuccagauccagcgcugcgccaccgaccccaacuccuacaagucccucgucgacuccuuccgcaugaucuuccagauggagggccucuucggcuucuacaagggcauccucccccccauccucgccgagacccccaagcgcgccgucaaguucuucaccuucgagcaguacaagaagcuccucggcuacgucucccucucccccgcccucaccuucgccaucgccggccucggcuccggccucaccgaggccaucgucgucaaccccuucgaggucgucaaggucggccuccaggccaaccgcaacaccuucgccgagcagcccuccaccgucggcuacgcccgccagaucaucaagaaggagggcuggggccuccagggccucaacaagggccucaccgccacccucggccgccacggcgucuucaacauggucuacuucggcuucuacuacaacgucaagaacaugauccccgucaacaaggaccccauccucgaguucuggcgcaaguucggcaucggccuccucuccggcaccaucgccuccgucaucaacauccccuucgacgucgccaagucccgcauccagggcccccagcccguccccggcgagaucaaguaccgcaccugcuucaagaccauggccaccgucuaccaggaggagggcauccucgcccucuacaagggccuccuccccaagaucaugcgccucggccccggcggcgccgucaugcuccucgucuacgaguacaccuacuccuggcuccaggagaacuga

SEQ ID NO: 49591 - RNA, 972 nt, Artificial Sequence
  derived and/or modified sequence opt2 from SLC25A22__Homo_sapiens__XP_011518673
auggccgacaagcagaucucccuccccgccaagcucaucaacggcggcaucgccggccucaucggcgucaccugcgucuuccccaucgaccucgccaagacccgccuccagaaccagcagaacggccagcgcgucuacaccuccauguccgacugccucaucaagaccguccgcuccgagggcuacuucggcauguaccgcggcgccgccgucaaccucacccucgucacccccgagaaggccaucaagcucgccgccaacgacuucuuccgccaccagcucuccaaggacggccagaagcucacccuccucaaggagaugcucgccggcugcggcgccggcaccugccaggucaucgucaccacccccauggagaugcucaagauccagcuccaggacgccggccgcaucgccgcccagcgcaagauccucgccgcccagggccagcucuccgcccagggcggcgcccagcccuccgucgaggcccccgccgccccccgccccaccgccacccagcucacccgcgaccuccuccgcucccgcggcaucgccggccucuacaagggccucggcgccacccuccuccgcgacguccccuucuccgucgucuacuucccccucuucgccaaccucaaccagcucggccgccccgccuccgaggagaagucccccuucuacgucuccuuccucgccggcugcgucgccggcuccgccgccgccgucgccgucaaccccugcgacgucgucaagacccgccuccagucccuccagcgcggcgucaacgaggacaccuacuccggcauccucgacugcgcccgcaagauccuccgccacgagggccccuccgccuuccucaagggcgccuacugccgcgcccucgucaucgccccccucuucggcaucgcccaggucgucuacuuccucggcaucgccgagucccuccucggccuccuccaggacccccaggccuga

SEQ ID NO: 49592 - RNA, 1407 nt, Artificial Sequence
  derived and/or modified sequence opt2 from SLC25A23__Homo_sapiens__NP_077008
augcgcggcucccccggcgacgccgagcgccgccagcgcuggggccgccucuucgaggagcucgacuccaacaaggacggccgcgucgacguccacgagcuccgccagggccucgcccgccucggcggcggcaaccccgaccccggcgcccagcagggcaucuccuccgagggcgacgccgaccccgacggcggccucgaccucgaggaguucucccgcuaccuccaggagcgcgagcagcgccuccuccucauguuccacucccucgaccgcaaccaggacggccacaucgacgucuccgagauccagcaguccuuccgcgcccucggcaucuccaucucccucgagcaggccgagaagauccuccacuccauggaccgcgacggcaccaugaccaucgacuggcaggaguggcgcgaccacuuccuccuccacucccucgagaacgucgaggacguccucuacuucuggaagcacuccaccguccucgacaucggcgagugccucaccguccccgacgaguucuccaagcaggagaagcucaccggcaugugguggaagcagcucgucgccggcgccgucgccggcgccgucucccgcaccggcaccgccccccucgaccgccucaaggucuucaugcagguccacgccuccaagaccaaccgccucaacauccucggcggccuccgcuccaugguccucgagggcggcauccgcucccucuggcgcggcaacggcaucaacguccucaagaucgcccccgaguccgccaucaaguucauggccuacgagcagaucaagcgcgccauccucggccagcaggagacccuccacguccaggagcgcuucgucgccggcucccucgccggcgccaccgcccagaccaucaucuaccccauggagguccucaagacccgccucacccuccgccgcaccggccaguacaagggccuccucgacugcgcccgccgcauccucgagcgcgagggcccccgcgccuucuaccgcggcuaccuccccaacguccucggcaucauccccuacgccggcaucgaccucgccgucuacgagacccucaagaacugguggcuccagcaguacucccacgacuccgccgaccccggcauccucguccuccucgccugcggcaccaucuccuccaccugcggccagaucgccuccuacccccucgcccucguccgcacccgcaugcaggcccaggccuccaucgagggcggcccccagcucuccaugcucggccuccuccgccacauccucucccaggagggcaugcgcggccucuaccgcggcaucgcccccaacuucaugaaggucauccccgccgucuccaucuccuacgucgucuacgagaacaugaagcaggcccucggcgucaccucccgcuga

SEQ ID NO: 49593 - RNA, 1512 nt, Artificial Sequence
  derived and/or modified sequence opt2 from SLC25A25__Homo_sapiens__NP_001006642
auggucuccuccguccucugccgcugcgucgccucccccccccccgacgccgccgccaccgccgccuccuccuccgccuccucccccgccuccgucggcgaccccugcggcggcgccaucugcggcggccccgaccaccgccuccgccucuggcgccucuuccagacccucgacgucaaccgcgacggcggccucugcgucaacgaccucgccgucggccuccgccgccucggccuccaccgcaccgagggcgagcuccagaagaucguccaggccggcgacaaggaccucgacggccagcucgacuucgaggaguucguccacuaccuccaggaccacgagaagaagcuccgccucgucuucaagucccucgacaagaagaacgacggccgcaucgacgcccaggagaucaugcagucccuccgcgaccucggcgucaagaucuccgagcagcaggccgagaagauccucaaguccauggacaagaacggcaccaugaccaucgacuggaacgaguggcgcgacuaccaccuccuccaccccgucgagaacauccccgagaucauccucuacuggaagcacuccaccaucuucgacgucggcgagaaccucaccguccccgacgaguucaccgucgaggagcgccagaccggcaugugguggcgccaccucgucgccggcggcggcgccggcgccgucucccgcaccugcaccgccccccucgaccgccucaagguccucaugcagguccacgccucccgcuccaacaacaugggcaucgucggcggcuucacccagaugauccgcgagggcggcgcccgcucccucuggcgcggcaacggcaucaacguccucaagaucgcccccgaguccgccaucaaguucauggccuacgagcagaucaagcgccucgucggcuccgaccaggagacccuccgcauccacgagcgccucgucgccggcucccucgccggcgccaucgcccaguccuccaucuaccccauggagguccucaagacccgcauggcccuccgcaagaccggccaguacuccggcaugcucgacugcgcccgccgcauccucgcccgcgagggcgucgccgccuucuacaagggcuacguccccaacaugcucggcaucauccccuacgccggcaucgaccucgccgucuacgagacccucaagaacgccuggcuccagcacuacgccgucaacuccgccgaccccggcgucuucguccuccucgccugcggcaccauguccuccaccugcggccagcucgccuccuacccccucgcccucguccgcacccgcaugcaggcccaggccuccaucgagggcgcccccgaggucaccauguccucccucuucaagcacauccuccgcaccgagggcgccuucggccucuaccgcggccucgcccccaacuucaugaaggucauccccgccgucuccaucuccuacgucgucuacgagaaccucaagaucacccucggcguccagucccgcuga

SEQ ID NO: 49594 - RNA, 903 nt, Artificial Sequence
  derived and/or modified sequence opt2 from SLC25A27__Homo_sapiens__NP_001190980
auguccguccccgaggaggaggagcgccuccucccccucacccagcgcuggccccgcgccuccaaguuccuccucuccggcugcgccgccaccgucgccgagcucgccaccuucccccucgaccucaccaagacccgccuccagaugcagggcgaggccgcccucgcccgccucggcgacggcgcccgcgaguccgcccccuaccgcggcaugguccgcaccgcccucggcaucaucgaggaggagggcuuccucaagcucuggcagggcgucacccccgccaucuaccgccacgucgucuacuccggcggccgcauggucaccuacgagcaccuccgcgaggucgucuucggcaaguccgaggacgagcacuacccccucuggaaguccgucaucggcggcaugauggccggcgucaucggccaguuccucgccaaccccaccgaccucgucaagguccagaugcagauggagggcaagcgcaagcucgagggcaagccccuccgcuuccgcggcguccaccacgccuucgccaagauccucgccgagggcggcauccgcggccucugggccggcuggguccccaacauccagcgcgccgcccucgucaacaugggcgaccucaccaccuacgacaccgucaagcacuaccucguccucaacaccccccucgaggacaacaucaugacccacggccucuccucccucugcuccggccucgucgccuccauccucggcacccccgccgacgucaucaagucccgcaucaugaaccagccccgcgacaagcagggccgcggccuccucuacaaguccuccaccgacugccucauccaggccguccagggcgagggcuucaugucccucuacaagggcuuccuccccuccuggcuccgcauguga

SEQ ID NO: 49595 - RNA, 906 nt, Artificial Sequence
  derived and/or modified sequence opt2 from SLC25A2__Homo_sapiens__NP_114153
augaaguccggccccggcauccaggccgccaucgaccucaccgccggcgccgccggcggcaccgccugcguccucaccggccagcccuucgacaccaucaaggucaagaugcagaccuuccccgaccucuacaagggccucaccgacugcuuccucaagaccuacgcccaggucggccuccgcggcuucuacaagggcaccggccccgcccucauggccuacgucgccgagaacuccguccucuucaugugcuacggcuucugccagcaguucguccgcaaggucgccggcauggacaagcaggccaagcucuccgaccuccagaccgccgccgccggcuccuucgccuccgccuucgccgcccucgcccucugccccaccgagcucgucaagugccgccuccagaccauguacgagauggagauguccggcaagaucgccaagucccacaacaccaucugguccgucgucaagggcauccucaagaaggacggcccccucggcuucuaccacggccucuccuccacccuccuccaggagguccccggcuacuucuucuucuucggcggcuacgagcucucccgcuccuucuucgccuccggccgcuccaaggacgagcucggccccguccaccucaugcucuccggcggcgucgccggcaucugccucuggcucgucgucuuccccgucgacugcaucaagucccgcauccagguccucuccauguacggcaagcaggccggcuucaucggcacccuccucuccgucguccgcaacgagggcaucgucgcccucuacuccggccucaaggccaccaugauccgcgccauccccgccaacggcgcccucuucgucgccuacgaguacucccgcaagaugaugaugaagcagcucgaggccuacuga

SEQ ID NO: 49596 - RNA, 936 nt, Artificial Sequence
  derived and/or modified sequence opt2 from SLC25A36__Homo_sapiens__NP_001098117
augucccagcgcgacacccucguccaccucuucgccggcggcugcggcggcaccgucggcgccauccucaccugcccccucgaggucgucaagacccgccuccaguccuccuccgucacccucuacaucuccgagguccagcucaacaccauggccggcgccuccgucaaccgcgucgucucccccggcccccuccacugccucaaggucauccucgagaaggagggcccccgcucccucuuccgcggccucggccccaaccucgucggcgucgcccccucccgcgccaucuacuucgccgccuacuccaacugcaaggagaagcucaacgacgucuucgaccccgacuccacccagguccacaugaucuccgccgccauggccggcuucaccgccaucaccgccaccaaccccaucuggcucaucaagacccgccuccagcucgacgcccgcaaccgcggcgagcgccgcaugggcgccuucgagugcguccgcaaggucuaccagaccgacggccucaagggcuucuaccgcggcauguccgccuccuacgccggcaucuccgagaccgucauccacuucgucaucuacgaguccaucaagcagaagcuccucgaguacaagaccgccuccaccauggagaacgacgaggaguccgucaaggaggccuccgacuucgucggcaugaugcucgccgccgccaccuccaagaccugcgccaccaccaucgccuacccccacgaggucguccgcacccgccuccgcgaggagggcaccaaguaccgcuccuucuuccagacccucucccuccucguccaggaggagggcuacggcucccucuaccgcggccucaccacccaccucguccgccagauccccaacaccgccaucaugauggccaccuacgagcucgucgucuaccuccucaacggcuga

SEQ ID NO: 49597 - RNA, 1017 nt, Artificial Sequence
  derived and/or modified sequence opt2 from SLC25A37__Homo_sapiens__NP_057696
auggagcuccgcuccggcuccgucggcucccaggccgucgcccgccgcauggacggcgacucccgcgacggcggcggcggcaaggacgccaccggcuccgaggacuacgagaaccuccccaccuccgccuccgucuccacccacaugaccgccggcgccauggccggcauccucgagcacuccgucauguaccccgucgacuccgucaagacccgcaugcagucccucucccccgaccccaaggcccaguacaccuccaucuacggcgcccucaagaagaucaugcgcaccgagggcuucuggcgcccccuccgcggcgucaacgucaugaucaugggcgccggccccgcccacgccauguacuucgccugcuacgagaacaugaagcgcacccucaacgacgucuuccaccaccagggcaacucccaccucgccaacggcaucgccggcuccauggccacccuccuccacgacgccgucaugaaccccgccgaggucgucaagcagcgccuccagauguacaacucccagcaccgcuccgccaucuccugcauccgcaccgucuggcgcaccgagggccucggcgccuucuaccgcuccuacaccacccagcucaccaugaacauccccuuccaguccauccacuucaucaccuacgaguuccuccaggagcaggucaacccccaccgcaccuacaacccccagucccacaucaucuccggcggccucgccggcgcccucgccgccgccgccaccaccccccucgacgucugcaagacccuccucaacacccaggagaacgucgcccucucccucgccaacaucuccggccgccucuccggcauggccaacgccuuccgcaccgucuaccagcucaacggccucgccggcuacuucaagggcauccaggcccgcgucaucuaccagaugcccuccaccgccaucuccugguccgucuacgaguucuucaaguacuuccucaccaagcgccagcucgagaaccgcgcccccuacuga

SEQ ID NO: 49598 - RNA, 915 nt, Artificial Sequence
  derived and/or modified sequence opt2 from SLC25A38__Homo_sapiens__NP_060345
augauccagaacucccgccccucccuccuccagccccaggacgucggcgacaccgucgagacccucaugcuccaccccgucaucaaggccuuccucugcggcuccaucuccggcaccugcuccacccuccucuuccagccccucgaccuccucaagacccgccuccagacccuccagcccuccgaccacggcucccgccgcgucggcaugcucgccguccuccucaaggucguccgcaccgagucccuccucggccucuggaagggcaugucccccuccaucguccgcugcguccccggcgucggcaucuacuucggcacccucuacucccucaagcaguacuuccuccgcggccacccccccaccgcccucgaguccgucaugcucggcgucggcucccgcuccgucgccggcgucugcaugucccccaucaccgucaucaagacccgcuacgaguccggcaaguacggcuacgaguccaucuacgccgcccuccgcuccaucuaccacuccgagggccaccgcggccucuucuccggccucaccgccacccuccuccgcgacgcccccuucuccggcaucuaccucauguucuacaaccagaccaagaacaucgucccccacgaccaggucgacgccacccucauccccaucaccaacuucuccugcggcaucuucgccggcauccucgccucccucgucacccagcccgccgacgucaucaagacccacaugcagcucuacccccucaaguuccaguggaucggccaggccgucacccucaucuucaaggacuacggccuccgcggcuucuuccagggcggcaucccccgcgcccuccgccgcacccucauggccgccauggccuggaccgucuacgaggagaugauggccaagaugggccucaaguccuga

SEQ ID NO: 49599 - RNA, 1086 nt, Artificial Sequence
  derived and/or modified sequence opt2 from SLC25A3__Homo_sapiens__NP_002626
auguucuccuccgucgcccaccucgcccgcgccaaccccuucaacaccccccaccuccagcucguccacgacggccucggcgaccuccgcuccuccucccccggccccaccggccagccccgccgcccccgcaaccucgccgccgccgccgucgaggaguacuccugcgaguucggcuccgccaaguacuacgcccucugcggcuucggcggcguccucuccugcggccucacccacaccgccgucgucccccucgaccucgucaagugccgcaugcaggucgacccccagaaguacaagggcaucuucaacggcuucuccgucacccucaaggaggacggcguccgcggccucgccaagggcugggcccccaccuuccucggcuacuccaugcagggccucugcaaguucggcuucuacgaggucuucaagguccucuacuccaacaugcucggcgaggagaacaccuaccucuggcgcaccucccucuaccucgccgccuccgccuccgccgaguucuucgccgacaucgcccucgcccccauggaggccgccaagguccgcauccagacccagcccggcuacgccaacacccuccgcgacgccgcccccaagauguacaaggaggagggccucaaggccuucuacaagggcgucgccccccucuggaugcgccagauccccuacaccaugaugaaguucgccugcuucgagcgcaccgucgaggcccucuacaaguucgucguccccaagccccgcuccgagugcuccaagcccgagcagcucgucgucaccuucgucgccggcuacaucgccggcgucuucugcgccaucgucucccaccccgccgacuccgucgucuccguccucaacaaggagaagggcuccuccgccucccucguccucaagcgccucggcuucaagggcgucuggaagggccucuucgcccgcaucaucaugaucggcacccucaccgcccuccagugguucaucuacgacuccgucaaggucuacuuccgccucccccgcccccccccccccgagaugcccgagucccucaagaagaagcucggccucacccaguga

SEQ ID NO: 49600 - RNA, 1017 nt, Artificial Sequence
  derived and/or modified sequence opt2 from SLC25A40__Homo_sapiens__NP_061331
auggaccccgagacccgcggccaggagaucaucaaggucaccccccuccagcagaugcucgccuccugcaccggcgccauccucaccuccgucaucgucaccccccucgacgucgucaagauccgccuccaggcccagaacaacccccuccccaagggcaagugcuucgucuacuccaacggccucauggaccaccucugcgucugcgaggagggcggcaacaagcucugguacaagaagcccggcaacuuccagggcacccucgacgccuucuucaagaucauccgcaacgagggcaucaagucccucugguccggccucccccccacccucgucauggccguccccgccaccgucaucuacuucaccugcuacgaccagcucuccgcccuccuccgcuccaagcucggcgagaacgagaccugcauccccaucgucgccggcaucgucgcccgcuucggcgccgucaccgucaucuccccccucgagcucauccgcaccaagaugcaguccaagaaguucuccuacgucgagcuccaccgcuucgucuccaagaaggucuccgaggacggcuggaucucccucuggcgcggcugggcccccaccguccuccgcgacguccccuucuccgccauguacugguacaacuacgagauccucaagaaguggcucugcgagaaguccggccucuacgagcccaccuucaugaucaacuucaccuccggcgcccucuccggcuccuucgccgccgucgccacccuccccuucgacgucgucaagacccagaagcagacccagcucuggaccuacgagucccacaagaucuccaugccccuccacauguccaccuggaucaucaugaagaacaucgucgccaagaacggcuucuccggccucuucuccggccucaucccccgccucaucaagaucgcccccgccugcgccaucaugaucuccaccuacgaguucggcaaggccuucuuccagaagcagaacguccgccgccagcaguacuga

SEQ ID NO: 49601 - RNA, 1113 nt, Artificial Sequence
  derived and/or modified sequence opt2 from SLC25A41__Homo_sapiens__NP_775908
augggcgcccagcccggcgagccccagaacaccugcucccgcauccagacccucuuccgccgcgucaagacccuccucaucaaggcccccccccccccccagccccccccccccccccccuccuggaaccccggcugcacccacgucuacggcuacgccuucggccacaugcacgacaacaaccucgagcaccuccccucccagcagguccucgacaccggcgagcagcucaugguccccgucgagguccucgaggucgacaacaaggaggcccucuggaaguuccuccucuccggcgccauggccggcgccgucucccgcaccggcaccgccccccucgaccgcgccaaggucuacaugcaggucuacuccuccaagaccaacuucaccaaccuccucggcggccuccaguccaugguccaggagggcggcuuccgcucccucuggcgcggcaacggcaucaacguccucaagaucgcccccgaguacgccaucaaguucuccgucuucgagcagugcaagaacuacuucugcggcauccagggcuccccccccuuccaggagcgccuccucgccggcucccucgccgucgccaucucccagacccucaucaaccccauggagguccucaagacccgccucacccuccgccgcaccggccaguacaagggccuccucgacugcgcccgccagauccuccagcgcgagggcacccgcgcccucuaccgcggcuaccuccccaacaugcucggcaucauccccuacgccugcaccgaccucgccgucuacgagaugcuccagugcuucugggucaaguccggccgcgacaugggcgaccccuccggccucgucucccucuccuccgucacccucuccaccaccugcggccagauggccuccuacccccucacccucguccgcacccgcaugcaggcccaggacaccgucgagggcuccaaccccaccaugcgcggcguccuccagcgcauccucgcccagcagggcuggcucggccucuaccgcggcaugacccccacccuccucaagguccuccccgccggcggcaucuccuacgucgucuacgaggccaugaagaagacccucggcaucuga

SEQ ID NO: 49602 - RNA, 957 nt, Artificial Sequence
  derived and/or modified sequence opt2 from SLC25A42__Homo_sapiens__NP_848621
augggcaacggcgucaaggagggccccguccgccuccacgaggacgccgaggccguccucuccuccuccgucuccuccaagcgcgaccaccgccagguccucuccucccuccucuccggcgcccucgccggcgcccucgccaagaccgccgucgccccccucgaccgcaccaagaucaucuuccaggucuccuccaagcgcuucuccgccaaggaggccuuccgcguccucuacuacaccuaccucaacgagggcuuccucucccucuggcgcggcaacuccgccaccaugguccgcgucguccccuacgccgccauccaguucuccgcccacgaggaguacaagcgcauccucggcuccuacuacggcuuccgcggcgaggcccucccccccuggccccgccucuucgccggcgcccucgccggcaccaccgccgccucccucaccuacccccucgaccucguccgcgcccgcauggccgucacccccaaggagauguacuccaacaucuuccacgucuucauccgcaucucccgcgaggagggccucaagacccucuaccacggcuucaugcccaccguccucggcgucauccccuacgccggccucuccuucuucaccuacgagacccucaagucccuccaccgcgaguacuccggccgccgccagcccuaccccuucgagcgcaugaucuucggcgccugcgccggccucaucggccaguccgccuccuacccccucgacgucguccgccgccgcaugcagaccgccggcgucaccggcuacccccgcgccuccaucgcccgcacccuccgcaccaucguccgcgaggagggcgccguccgcggccucuacaagggccucuccaugaacugggucaagggccccaucgccgucggcaucuccuucaccaccuucgaccucaugcagauccuccuccgccaccuccaguccuga

SEQ ID NO: 49603 - RNA, 1026 nt, Artificial Sequence
  derived and/or modified sequence opt2 from SLC25A43__Homo_sapiens__NP_660348
auggccaccuggcgccgcgacggccgccucaccggcggccagcgccuccucugcgccggccucgccggcacccucucccucucccucaccgccccccucgagcucgccaccguccucgcccaggucggcgucguccgcggccacgcccgcggccccugggccaccggccaccgcgucuggcgcgccgagggccuccgcgcccucuggaagggcaacgccgucgccugccuccgccucuuccccugcuccgccguccagcucgccgccuaccgcaaguucgucguccucuucaccgacgaccucggccacaucucccagugguccuccaucauggccggcucccucgccggcauggucuccaccaucgucaccuaccccaccgaccucaucaagacccgccucaucaugcagaacauccucgagcccuccuaccgcggccuccuccacgccuucuccaccaucuaccagcaggagggcuuccucgcccucuaccgcggcgucucccucaccgucgucggcgcccuccccuucuccgccggcucccuccucgucuacaugaaccucgagaagaucuggaacggcccccgcgaccaguucucccucccccagaacuucgccaacgucugccucgccgccgccgucacccagacccucuccuuccccuucgagaccgucaagcgcaagaugcaggcccagucccccuaccucccccacuccggcggcgucgacguccacuucuccggcgccgucgacugcuuccgccagaucgucaaggcccagggcguccucggccucuggaacggccucaccgccaaccuccucaagaucguccccuacuucggcaucauguucuccaccuucgaguucugcaagcgcaucugccucuaccagaacggcuacauccucuccccccucuccuacaagcucacccccggcgucgaccagucccuccagccccaggagcuccgcgagcucaagaaguucuucaagacccgcaagcccaagcccaagaagcccacccucuga

SEQ ID NO: 49604 - RNA, 795 nt, Artificial Sequence
  derived and/or modified sequence opt2 from SLC25A45__Homo_sapiens__NP_001265179
augcccgucgaggaguucgucgccggcuggaucuccggcgcccucggccucguccucggccaccccuucgacaccgucaagcuccucggcuucuucaagggcauguccuuccccaucgccuccaucgccgucgucaacuccguccucuucggcgucuacuccaacacccuccucguccucaccgccaccucccaccaggagcgccgcgcccagccccccuccuacaugcacaucuuccucgccggcugcaccggcggcuuccuccaggccuacugccucgcccccuucgaccucaucaagguccgccuccagaaccagaccgagccccgcgcccagcccggcuccccccccccccgcuaccagggccccguccacugcgccgccuccaucuuccgcgaggagggcccccgcggccucuuccgcggcgccugggcccucacccuccgcgacacccccaccgucggcaucuacuucaucaccuacgagggccucugccgccaguacacccccgagggccagaaccccuccuccgccaccguccucgucgccggcggcuucgccggcaucgccuccugggucgccgccaccccccucgacgucaucaagucccgcaugcagauggacggccuccgccgccgcgucuaccagggcaugcucgacugcauggucuccuccauccgccaggagggccucggcgucuucuuccgcggcgucaccaucaacuccgcccgcgccuuccccgucaacgccgucaccuuccucuccuacgaguaccuccuccgcugguggggcuga

SEQ ID NO: 49605 - RNA, 1014 nt, Artificial Sequence
  derived and/or modified sequence opt2 from SLC25A46__Homo_sapiens__NP_001290178
augcacccccgccgccccgacggcuucgacggccucggcuaccgcggcggcgcccgcgacgagcagggcuucggcggcgccuuccccgcccgcuccuucuccaccggcuccgaccucggccacugggucaccaccccccccgacauccccggcucccgcaaccuccacuggggcgagaaguccccccccuacggcguccccaccaccuccacccccuacgagggccccaccgaggagcccuucuccuccggcggcggcggcuccguccagggccaguccuccgagcagcucaaccgcuucgccggcuucggcaucggccucgccucccucuucaccgagaacguccucgcccaccccugcaucguccuccgccgccagugccaggucaacuaccacgcccagcacuaccaccucacccccuucaccgucaucaacaucauguacuccuucaacaagacccagggcccccgcgcccucuggaagggcaugggcuccaccuucaucguccagggcgucacccucggcgccgagggcaucaucuccgaguucaccccccucccccgcgagguccuccacaaguggucccccaagcagaucggcgagcaccuccuccucaagucccucaccuacgucgucgccaugcccuucuacuccgccucccucaucgagaccguccaguccaugcucgacgccuacuuccccgagcucaucgccaacuucgccgccucccucugcuccgacgucauccucuacccccucgagaccguccuccaccgccuccacauccagggcacccgcaccaucaucgacaacaccgaccucggcuacgagguccuccccaucaacacccaguacgagggcaugcgcgacugcaucaacaccauccgccaggaggagggcgucuucggcuucuacaagggcuucggcgccgucaucauccaguacacccuccacgccgccguccuccagaucaccaagaucaucuacuccacccuccuccagaacaacaucuga

SEQ ID NO: 49606 - RNA, 927 nt, Artificial Sequence
  derived and/or modified sequence opt2 from SLC25A47__Homo_sapiens__NP_997000
auggacuucgucgccggcgccaucggcggcgucugcggcgucgccgucggcuacccccucgacaccgucaagguccgcauccagaccgagcccaaguacaccggcaucuggcacugcguccgcgacaccuaccaccgcgagcgcgucuggggcuucuaccgcggccucucccuccccgucugcaccgucucccucgucuccuccgucuccuucggcaccuaccgccacugccucgcccacaucugccgccuccgcuacggcaaccccgacgccaagcccaccaaggccgacaucacccucuccggcugcgccuccggccucguccgcgucuuccucaccucccccaccgaggucgccaagguccgccuccagacccagacccaggcccagaagcagcagcgccgccucuccgccuccggcccccucgccgucccccccaugugccccgucccccccgccugccccgagcccaaguaccgcggcccccuccacugccucgccaccgucgcccgcgaggagggccucugcggccucuacaagggcuccuccgcccucguccuccgcgacggccacuccuucgccaccuacuuccucuccuacgccguccucugcgaguggcucucccccgccggccacucccgccccgacguccccggcguccucgucgccggcggcugcgccggcguccucgccugggccgucgccacccccauggacgucaucaagucccgccuccaggccgacggccagggccagcgccgcuaccgcggccuccuccacugcauggucaccuccguccgcgaggagggcccccgcguccucuucaagggccucguccucaacugcugccgcgccuuccccgucaacauggucgucuucgucgccuacgaggccguccuccgccucgcccgcggccuccucaccuga

SEQ ID NO: 49607 - RNA, 897 nt, Artificial Sequence
  derived and/or modified sequence opt2 from SLC25A4__Homo_sapiens__NP_001142
augggcgaccacgccugguccuuccucaaggacuuccucgccggcggcgucgccgccgccgucuccaagaccgccgucgcccccaucgagcgcgucaagcuccuccuccagguccagcacgccuccaagcagaucuccgccgagaagcaguacaagggcaucaucgacugcgucguccgcauccccaaggagcagggcuuccucuccuucuggcgcggcaaccucgccaacgucauccgcuacuuccccacccaggcccucaacuucgccuucaaggacaaguacaagcagcucuuccucggcggcgucgaccgccacaagcaguucuggcgcuacuucgccggcaaccucgccuccggcggcgccgccggcgccaccucccucugcuucgucuacccccucgacuucgcccgcacccgccucgccgccgacgucggcaagggcgccgcccagcgcgaguuccacggccucggcgacugcaucaucaagaucuucaaguccgacggccuccgcggccucuaccagggcuucaacgucuccguccagggcaucaucaucuaccgcgccgccuacuucggcgucuacgacaccgccaagggcaugcuccccgaccccaagaacguccacaucuucgucuccuggaugaucgcccaguccgucaccgccgucgccggccucgucuccuaccccuucgacaccguccgccgccgcaugaugaugcaguccggccgcaagggcgccgacaucauguacaccggcaccgucgacugcuggcgcaagaucgccaaggacgagggcgccaaggccuucuucaagggcgccugguccaacguccuccgcggcaugggcggcgccuucguccucguccucuacgacgagaucaagaaguacgucuga

SEQ ID NO: 49608 - RNA, 924 nt, Artificial Sequence
  derived and/or modified sequence opt2 from SLC25A52__Homo_sapiens__NP_001029344
augcccuucaugcgcaagauccucuccaacaugaucgacuccgaggcccacgagaagcgcccccccauccucaccuccuccaagcaggacaucuccccccacaucaccaacgucggcgagaugaagcacuaccucugcggcugcugcgccgccuucaacaacgucgccaucaccuaccccauccagaagguccucuuccgccagcagcucuacggcaucaagacccgcgacgccguccuccagcuccgccgcgacggcuuccgcaaccucuaccgcggcauccuccccccccucaugcagaagaccaccacccucgcccucauguucggccucuacgaggaccucuccugccuccuccgcaagcacguccgcgcccccgaguucgccacccacggcgucgccgccguccucgccggcaccgccgaggccaucuucaccccccucgagcgcguccagacccuccuccagaaccacaagcaccacgacaaguucaccaacaccuaccaggccuucaaggcccucaagugccacggcaucggcgaguacuaccgcggccucguccccauccucuuccgcaacggccucuccaacguccucuucuucggccuccgcggccccaucaaggagcaccuccccaccgccaccacccacuccgcccaccucgucaacgacuucaucggcggcggccuccucggcgccaugcucggcuuccucugcuuccccaucaacgucgucaagacccgccuccagucccagaucggcggcgaguuccaguccuuccccaaggucuuccagaagaucuggcucgagcgcgaccgcaagcucaucaaccucuuccgcggcgcccaccucaacuaccaccgcucccucaucuccuggggcaucaucaacgccaccuacgaguuccuccucaaguucaucuga

SEQ ID NO: 49609 - RNA, 897 nt, Artificial Sequence
  derived and/or modified sequence opt2 from SLC25A5__Homo_sapiens__NP_001143
augaccgacgccgccgucuccuucgccaaggacuuccucgccggcggcgucgccgccgccaucuccaagaccgccgucgcccccaucgagcgcgucaagcuccuccuccagguccagcacgccuccaagcagaucaccgccgacaagcaguacaagggcaucaucgacugcgucguccgcauccccaaggagcagggcguccucuccuucuggcgcggcaaccucgccaacgucauccgcuacuuccccacccaggcccucaacuucgccuucaaggacaaguacaagcagaucuuccucggcggcgucgacaagcgcacccaguucuggcucuacuucgccggcaaccucgccuccggcggcgccgccggcgccaccucccucugcuucgucuacccccucgacuucgcccgcacccgccucgccgccgacgucggcaaggccggcgccgagcgcgaguuccgcggccucggcgacugccucgucaagaucuacaaguccgacggcaucaagggccucuaccagggcuucaacgucuccguccagggcaucaucaucuaccgcgccgccuacuucggcaucuacgacaccgccaagggcaugcuccccgaccccaagaacacccacaucgucaucuccuggaugaucgcccagaccgucaccgccgucgccggccucaccuccuaccccuucgacaccguccgccgccgcaugaugaugcaguccggccgcaagggcaccgacaucauguacaccggcacccucgacugcuggcgcaagaucgcccgcgacgagggcggcaaggccuucuucaagggcgccugguccaacguccuccgcggcaugggcggcgccuucguccucguccucuacgacgagaucaagaaguacaccuga

SEQ ID NO: 49610 - RNA, 897 nt, Artificial Sequence
  derived and/or modified sequence opt2 from SLC25A6__Homo_sapiens__NP_001627
augaccgagcaggccaucuccuucgccaaggacuuccucgccggcggcaucgccgccgccaucuccaagaccgccgucgcccccaucgagcgcgucaagcuccuccuccagguccagcacgccuccaagcagaucgccgccgacaagcaguacaagggcaucgucgacugcaucguccgcauccccaaggagcagggcguccucuccuucuggcgcggcaaccucgccaacgucauccgcuacuuccccacccaggcccucaacuucgccuucaaggacaaguacaagcagaucuuccucggcggcgucgacaagcacacccaguucuggcgcuacuucgccggcaaccucgccuccggcggcgccgccggcgccaccucccucugcuucgucuacccccucgacuucgcccgcacccgccucgccgccgacgucggcaaguccggcaccgagcgcgaguuccgcggccucggcgacugccucgucaagaucaccaaguccgacggcauccgcggccucuaccagggcuucuccgucuccguccagggcaucaucaucuaccgcgccgccuacuucggcgucuacgacaccgccaagggcaugcuccccgaccccaagaacacccacaucgucgucuccuggaugaucgcccagaccgucaccgccgucgccggcgucgucuccuaccccuucgacaccguccgccgccgcaugaugaugcaguccggccgcaagggcgccgacaucauguacaccggcaccgucgacugcuggcgcaagaucuuccgcgacgagggcggcaaggccuucuucaagggcgccugguccaacguccuccgcggcaugggcggcgccuucguccucguccucuacgacgagcucaagaaggucaucuga

SEQ ID NO: 49611 - RNA, 2106 nt, Artificial Sequence
  derived and/or modified sequence opt2 from SLC26A1__Homo_sapiens__NP_071325
auggacgagucccccgagccccuccagcagggccgcggccccguccccguccgccgccagcgccccgccccccgcggccuccgcgagaugcucaaggcccgccucuggugcuccugcuccugcuccguccucugcguccgcgcccucguccaggaccuccuccccgccacccgcuggcuccgccaguaccgcccccgcgaguaccucgccggcgacgucauguccggccucgucaucggcaucauccucgucccccaggccaucgccuacucccuccucgccggccuccagcccaucuacucccucuacaccuccuucuucgccaaccucaucuacuuccucaugggcaccucccgccacgucuccgucggcaucuucucccuccucugccucauggucggccaggucgucgaccgcgagcuccagcucgccggcuucgaccccucccaggacggccuccagcccggcgccaacuccuccacccucaacggcuccgccgccaugcucgacugcggccgcgacugcuacgccauccgcgucgccaccgcccucacccucaugaccggccucuaccagguccucaugggcguccuccgccucggcuucgucuccgccuaccucucccagccccuccucgacggcuucgccaugggcgccuccgucaccauccucaccucccagcucaagcaccuccucggcguccgcaucccccgccaccagggccccggcauggucguccucaccuggcucucccuccuccgcggcgccggccaggccaacgucugcgacgucgucaccuccaccgucugccucgccguccuccucgccgccaaggagcucuccgaccgcuaccgccaccgccuccgcgucccccuccccaccgagcuccucgucaucgucgucgccacccucgucucccacuucggccagcuccacaagcgcuucggcuccuccgucgccggcgacauccccaccggcuucaugcccccccagguccccgagccccgccucaugcagcgcgucgcccucgacgccgucgcccucgcccucgucgccgccgccuucuccaucucccucgccgagauguucgcccgcucccacggcuacuccguccgcgccaaccaggagcuccucgccgucggcugcugcaacguccuccccgccuuccuccacugcuucgccaccuccgccgcccucgccaagucccucgucaagaccgccaccggcugccgcacccagcucuccuccgucgucuccgccaccgucguccuccucguccuccucgcccucgccccccucuuccacgaccuccagcgcuccguccucgccugcgucaucgucgucucccuccgcggcgcccuccgcaaggucugggaccucccccgccucuggcgcaugucccccgccgacgcccucgucugggccggcaccgccgccaccugcaugcucgucuccaccgaggccggccuccucgccggcgucauccucucccuccucucccucgccggccgcacccagcgcccccgcaccgcccuccucgcccgcaucggcgacaccgccuucuacgaggacgccaccgaguucgagggccucguccccgagcccggcguccgcgucuuccgcuucggcggcccccucuacuacgccaacaaggacuucuuccuccagucccucuacucccucaccggccucgacgccggcugcauggccgcccgccgcaaggagggcggcuccgagaccggcgucggcgagggcggccccgcccagggcgaggaccucggccccgucuccacccgcgccgcccucguccccgccgccgccggcuuccacaccgucgucaucgacugcgccccccuccucuuccucgacgccgccggcgucuccacccuccaggaccuccgccgcgacuacggcgcccucggcaucucccuccuccucgccugcugcuccccccccguccgcgacauccucucccgcggcggcuuccucggcgagggccccggcgacaccgccgaggaggagcagcucuuccucuccguccacgacgccguccagaccgcccgcgcccgccaccgcgagcucgaggccaccgacgcccaccucuga

SEQ ID NO: 49612 - RNA, 2220 nt, Artificial Sequence
  derived and/or modified sequence opt2 from SLC26A2__Homo_sapiens__NP_000103
auguccuccgaguccaaggagcagcacaacgucuccccccgcgacuccgccgagggcaacgacuccuaccccuccggcauccaccucgagcuccagcgcgaguccuccaccgacuucaagcaguucgagaccaacgaccagugccgccccuaccaccgcauccucaucgagcgccaggagaaguccgacaccaacuucaaggaguucgucaucaagaagcuccagaagaacugccagugcucccccgccaaggccaagaacaugauccucggcuuccuccccguccuccaguggcuccccaaguacgaccucaagaagaacauccucggcgacgucauguccggccucaucgucggcauccuccucgucccccaguccaucgccuacucccuccucgccggccaggagcccgucuacggccucuacaccuccuucuucgccuccaucaucuacuuccuccucggcaccucccgccacaucuccgucggcaucuucggcguccucugccucaugaucggcgagaccgucgaccgcgagcuccagaaggccggcuacgacaacgcccacuccgcccccucccucggcauggucuccaacggcuccacccuccucaaccacaccuccgaccgcaucugcgacaaguccugcuacgccaucauggucggcuccaccgucaccuucaucgccggcgucuaccaggucgccaugggcuucuuccaggucggcuucgucuccgucuaccucuccgacgcccuccucuccggcuucgucaccggcgccuccuucaccauccucaccucccaggccaaguaccuccucggccucaaccucccccgcaccaacggcgucggcucccucaucaccaccuggauccacgucuuccgcaacauccacaagaccaaccucugcgaccucaucaccucccuccucugccuccucguccuccuccccaccaaggagcucaacgagcacuucaaguccaagcucaaggcccccauccccaucgagcucgucgucgucgucgccgccacccucgccucccacuucggcaagcuccacgagaacuacaacuccuccaucgccggccacauccccaccggcuucaugccccccaagguccccgaguggaaccucauccccuccgucgccgucgacgccaucgccaucuccaucaucggcuucgccaucaccgucucccucuccgagauguucgccaagaagcacggcuacaccgucaaggccaaccaggagauguacgccaucggcuucugcaacaucauccccuccuucuuccacugcuucaccaccuccgccgcccucgccaagacccucgucaaggaguccaccggcugccacacccagcucuccggcgucgucaccgcccucguccuccuccucguccuccucgucaucgccccccucuucuacucccuccagaaguccguccucggcgucaucaccaucgucaaccuccgcggcgcccuccgcaaguuccgcgaccuccccaagaugugguccaucucccgcauggacaccgucaucugguucgucaccaugcucuccuccgcccuccucuccaccgagaucggccuccucgucggcgucugcuucuccaucuucugcgucauccuccgcacccagaagcccaaguccucccuccucggccucgucgaggaguccgaggucuucgaguccgucuccgccuacaagaaccuccagaucaagcccggcaucaagaucuuccgcuucgucgccccccucuacuacaucaacaaggagugcuucaaguccgcccucuacaagcagaccgucaaccccauccucaucaaggucgccuggaagaaggccgccaagcgcaagaucaaggagaaggucgucacccucggcggcauccaggacgagauguccguccagcucucccacgacccccucgagcuccacaccaucgucaucgacugcuccgccauccaguuccucgacaccgccggcauccacacccucaaggagguccgccgcgacuacgaggccaucggcauccagguccuccucgcccagugcaaccccaccguccgcgacucccucaccaacggcgaguacugcaagaaggaggaggagaaccuccucuucuacuccgucuacgaggccauggccuucgccgaggucuccaagaaccagaagggcgucugcguccccaacggccucucccucuccuccgacuga

SEQ ID NO: 49613 - RNA, 2295 nt, Artificial Sequence
  derived and/or modified sequence opt2 from SLC26A3__Homo_sapiens__XP_011514169
augaucgagcccuucggcaaccaguacaucgucgcccgccccgucuacuccaccaacgccuucgaggagaaccacaagaagaccggccgccaccacaagaccuuccucgaccaccucaaggucugcugcuccugcuccccccagaaggccaagcgcaucguccucucccucuuccccaucgccuccuggcuccccgccuaccgccucaaggaguggcuccucuccgacaucgucuccggcaucuccaccggcaucgucgccguccuccagggccucgccuucgcccuccucgucgacaucccccccgucuacggccucuacgccuccuucuuccccgccaucaucuaccucuucuucggcaccucccgccacaucuccgucggccccuuccccauccucuccaugauggucggccucgccgucuccggcgccgucuccaaggccguccccgaccgcaacgccaccacccucggccuccccaacaacuccaacaacuccucccuccucgacgacgagcgcguccgcgucgccgccgccgccuccgucaccguccucuccggcaucauccagcucgccuucggcauccuccgcaucggcuucgucgucaucuaccucuccgagucccucaucuccggcuucaccaccgccgccgccguccacguccucgucucccagcucaaguucaucuuccagcucaccguccccucccacaccgaccccgucuccaucuucaagguccucuacuccgucuucucccagaucgagaagaccaacaucgccgaccucgucaccgcccucaucguccuccucgucgucuccaucgucaaggagaucaaccagcgcuucaaggacaagcuccccguccccauccccaucgaguucaucaugaccgucaucgccgccggcgucuccuacggcugcgacuucaagaaccgcuucaaggucgccgucgucggcgacaugaaccccggcuuccagccccccaucacccccgacgucgagaccuuccagaacaccgucggcgacugcuucggcaucgccauggucgccuucgccgucgccuucuccgucgccuccgucuacucccucaaguacgacuacccccucgacggcaaccaggagcucaucgcccucggccucggcaacaucgucugcggcgucuuccgcggcuucgccggcuccaccgcccucucccgcuccgccguccaggaguccaccggcggcaagacccagaucgccggccucaucggcgccaucaucguccucaucgucguccucgccaucggcuuccuccucgccccccuccagaaguccguccucgccgcccucgcccucggcaaccucaagggcaugcucaugcaguucgccgagaucggccgccucuggcgcaaggacaaguacgacugccucaucuggaucaugaccuucaucuucaccaucguccucggccucggccucggccucgccgccuccgucgccuuccagcuccucaccaucgucuuccgcacccaguuccccaagugcuccacccucgccaacaucggccgcaccaacaucuacaagaacaagaaggacuacuacgacauguacgagcccgagggcgucaagaucuuccgcugccccucccccaucuacuucgccaacaucggcuucuuccgccgcaagcucaucgacgccgucggcuucuccccccuccgcauccuccgcaagcgcaacaaggcccuccgcaagauccgcaagcuccagaagcagggccuccuccaggucacccccaagggcuucaucugcaccgucgacaccaucaaggacuccgacgaggagcucgacaacaaccagaucgagguccucgaccagcccaucaacaccaccgaccuccccuuccacaucgacuggaacgacgaccucccccucaacaucgagguccccaagaucucccuccacucccucauccucgacuucuccgccgucuccuuccucgacgucuccuccguccgcggccucaaguccauccuccaggaguucauccgcaucaaggucgacgucuacaucgucggcaccgacgacgacuucaucgagaagcucaaccgcuacgaguucuucgacggcgaggucaaguccuccaucuucuuccucaccauccacgacgccguccuccacauccucaugaagaaggacuacuccaccuccaaguucaaccccucccaggagaaggacggcaagaucgacuucaccaucaacaccaacggcggccuccgcaaccgcgucuacgagguccccgucgagaccaaguucuga

SEQ ID NO: 49614 - RNA, 2343 nt, Artificial Sequence
  derived and/or modified sequence opt2 from SLC26A4__Homo_sapiens__NP_000432
auggccgcccccggcggccgcuccgagcccccccagcuccccgaguacuccugcuccuacauggucucccgccccgucuacuccgagcucgccuuccagcagcagcacgagcgccgccuccaggagcgcaagacccuccgcgagucccucgccaagugcugcuccugcucccgcaagcgcgccuucggcguccucaagacccucguccccauccucgaguggcuccccaaguaccgcgucaaggaguggcuccucuccgacgucaucuccggcgucuccaccggccucgucgccacccuccagggcauggccuacgcccuccucgccgccguccccgucggcuacggccucuacuccgccuucuuccccauccucaccuacuucaucuucggcaccucccgccacaucuccgucggccccuuccccgucgucucccucauggucggcuccgucguccucuccauggcccccgacgagcacuuccucgucuccuccuccaacggcaccguccucaacaccaccaugaucgacaccgccgcccgcgacaccgcccgcguccucaucgccuccgcccucacccuccucgucggcaucauccagcucaucuucggcggccuccagaucggcuucaucguccgcuaccucgccgacccccucgucggcggcuucaccaccgccgccgccuuccagguccucgucucccagcucaagaucguccucaacgucuccaccaagaacuacaacggcguccucuccaucaucuacacccucgucgagaucuuccagaacaucggcgacaccaaccucgccgacuucaccgccggccuccucaccaucgucgucugcauggccgucaaggagcucaacgaccgcuuccgccacaagauccccguccccauccccaucgaggucaucgucaccaucaucgccaccgccaucuccuacggcgccaaccucgagaagaacuacaacgccggcaucgucaaguccaucccccgcggcuuccucccccccgagcucccccccgucucccucuucuccgagaugcucgccgccuccuucuccaucgccgucgucgccuacgccaucgccgucuccgucggcaaggucuacgccaccaaguacgacuacaccaucgacggcaaccaggaguucaucgccuucggcaucuccaacaucuucuccggcuucuucuccugcuucgucgccaccaccgcccucucccgcaccgccguccaggaguccaccggcggcaagacccaggucgccggcaucaucuccgccgccaucgucaugaucgccauccucgcccucggcaagcuccucgagccccuccagaaguccguccucgccgccgucgucaucgccaaccucaagggcauguucaugcagcucugcgacaucccccgccucuggcgccagaacaagaucgacgccgucaucugggucuucaccugcaucgucuccaucauccucggccucgaccucggccuccucgccggccucaucuucggccuccucaccgucguccuccgcguccaguuccccuccuggaacggccucggcuccauccccuccaccgacaucuacaaguccaccaagaacuacaagaacaucgaggagccccagggcgucaagauccuccgcuucuccucccccaucuucuacggcaacgucgacggcuucaagaagugcaucaaguccaccgucggcuucgacgccauccgcgucuacaacaagcgccucaaggcccuccgcaagauccagaagcucaucaaguccggccagcuccgcgccaccaagaacggcaucaucuccgacgccgucuccaccaacaacgccuucgagcccgacgaggacaucgaggaccucgaggagcucgacauccccaccaaggagaucgagauccaggucgacuggaacuccgagcuccccgucaaggucaacguccccaagguccccauccacucccucguccucgacugcggcgccaucuccuuccucgacgucgucggcguccgcucccuccgcgucaucgucaaggaguuccagcgcaucgacgucaacgucuacuucgccucccuccaggacuacgucaucgagaagcucgagcagugcggcuucuucgacgacaacauccgcaaggacaccuucuuccucaccguccacgacgccauccucuaccuccagaaccaggucaagucccaggagggccagggcuccauccucgagaccaucacccucauccaggacugcaaggacacccucgagcucaucgagaccgagcucaccgaggaggagcucgacguccaggacgaggccaugcgcacccucgccuccuga

SEQ ID NO: 49615 - RNA, 2139 nt, Artificial Sequence
  derived and/or modified sequence opt2 from SLC26A5__Homo_sapiens__NP_001161434
auggaccacgccgaggagaacgagauccucgccgccacccagcgcuacuacgucgagcgccccaucuucucccaccccguccuccaggagcgccuccacaccaaggacaagguccccgacuccaucgccgacaagcucaagcaggccuucaccugcacccccaagaagauccgcaacaucaucuacauguuccuccccaucaccaaguggcuccccgccuacaaguucaaggaguacguccucggcgaccucgucuccggcaucuccaccggcguccuccagcucccccagggccucgccuucgccaugcucgccgccgucccccccaucuucggccucuacuccuccuucuaccccgucaucauguacugcuuccucggcaccucccgccacaucuccaucggccccuucgccgucaucucccucaugaucggcggcgucgccguccgccucguccccgacgacaucgucauccccggcggcgucaacgccaccaacggcaccgaggcccgcgacgcccuccgcgucaaggucgccauguccgucacccuccucuccggcaucauccaguucugccucggcgucugccgcuucggcuucgucgccaucuaccucaccgagccccucguccgcggcuucaccaccgccgccgccguccacgucuucaccuccaugcucaaguaccucuucggcgucaagaccaagcgcuacuccggcaucuucuccgucgucuacuccaccgucgccguccuccagaacgucaagaaccucaacgucugcucccucggcgucggccucauggucuucggccuccuccucggcggcaaggaguucaacgagcgcuucaaggagaagcuccccgcccccaucccccucgaguucuucgccgucgucaugggcaccggcaucuccgccggcuucaaccucaaggaguccuacaacgucgacgucgucggcacccucccccucggccuccucccccccgccaaccccgacaccucccucuuccaccucgucuacgucgacgccaucgccaucgccaucgucggcuucuccgucaccaucuccauggccaagacccucgccaacaagcacggcuaccaggucgacggcaaccaggagcucaucgcccucggccucugcaacuccaucggcucccucuuccagaccuucuccaucuccugcucccucucccgcucccucguccaggagggcaccggcggcaagacccagcucgccggcugccucgccucccucaugauccuccucgucauccucgccaccggcuuccucuucgagucccucccccagaccaucuggcucaccaccuucgucuccucccucuuccucggccucgacuacggccucaucaccgccgucaucaucgcccuccucaccgucaucuaccgcacccagucccccuccuacaagguccucggcaagcuccccgagaccgacgucuacaucgacaucgacgccuacgaggaggucaaggagauccccggcaucaagaucuuccagaucaacgcccccaucuacuacgccaacuccgaccucuacuccaacgcccucaagcgcaagaccggcgucaaccccgccgucaucaugggcgcccgccgcaaggccaugcgcaaguacgccaaggaggucggcaacgccaacauggccaacgccaccgucgucaaggccgacgccgaggucgacggcgaggacgccaccaagcccgaggaggaggacggcgaggucaaguacccccccaucgucaucaaguccaccuuccccgaggagaugcagcgcuucaugccccccggcgacaacguccacaccgucauccucgacuucacccaggucaacuucaucgacuccgucggcgucaagacccucgccggcaucgucaaggaguacggcgacgucggcaucuacgucuaccucgccggcugcuccgcccaggucgucaacgaccucacccgcaaccgcuucuucgagaaccccgcccucugggagcuccucuuccacuccauccacgacgccguccucggcucccagcuccgcgaggcccucgccgagcaggaggccuccgccccccccucccaggaggaccucgagcccaacgccacccccgccacccccgaggccuga

SEQ ID NO: 49616 - RNA, 2217 nt, Artificial Sequence
  derived and/or modified sequence opt2 from SLC26A6__Homo_sapiens__NP_001035544
auggaccuccgccgccgcgacuaccacauggagcgcccccuccucaaccaggagcaccucgaggagcucggccgcuggggcuccgccccccgcacccaccaguggcgcaccuggcuccagugcucccgcgcccgcgccuacgcccuccuccuccagcaccuccccguccucgucuggcucccccgcuaccccguccgcgacuggcuccucggcgaccuccucuccggccucuccgucgccaucaugcagcucccccagggccucgccuacgcccuccucgccggccucccccccgucuucggccucuacuccuccuucuaccccgucuucaucuacuuccucuucggcaccucccgccacaucuccgucggcaccuucgccgucauguccgucauggucggcuccgucaccgagucccucgccccccaggcccucaacgacuccaugaucaacgagaccgcccgcgacgccgcccgcguccaggucgccuccacccucuccguccucgucggccucuuccaggucggccucggccucauccacuucggcuucgucgucaccuaccucuccgagccccucguccgcggcuacaccaccgccgccgccguccaggucuucgucucccagcucaaguacgucuucggccuccaccucuccucccacuccggcccccucucccucaucuacaccguccucgaggucugcuggaagcucccccaguccaaggucggcaccgucgucaccgccgccgucgccggcgucguccucgucgucgucaagcuccucaacgacaagcuccagcagcagcuccccaugcccauccccggcgagcuccucacccucaucggcgccaccggcaucuccuacggcaugggccucaagcaccgcuucgaggucgacgucgucggcaacauccccgccggccucgucccccccgucgcccccaacacccagcucuucuccaagcucgucggcuccgccuucaccaucgccgucgucggcuucgccaucgccaucucccucggcaagaucuucgcccuccgccacggcuaccgcgucgacuccaaccaggagcucgucgcccucggccucuccaaccucaucggcggcaucuuccagugcuuccccgucuccugcuccaugucccgcucccucguccaggaguccaccggcggcaacucccaggucgccggcgccaucuccucccucuucauccuccucaucaucgucaagcucggcgagcucuuccacgaccuccccaaggccguccucgccgccaucaucaucgucaaccucaagggcaugcuccgccagcucuccgacaugcgcucccucuggaaggccaaccgcgccgaccuccucaucuggcucgucaccuucaccgccaccauccuccucaaccucgaccucggccucgucgucgccgucaucuucucccuccuccucgucgucguccgcacccagaugccccacuacuccguccucggccagguccccgacaccgacaucuaccgcgacgucgccgaguacuccgaggccaaggagguccgcggcgucaaggucuuccgcuccuccgccaccgucuacuucgccaacgccgaguucuacuccgacgcccucaagcagcgcugcggcgucgacgucgacuuccucaucucccagaagaagaagcuccucaagaagcaggagcagcucaagcucaagcagcuccagaaggaggagaagcuccgcaagcaggccgccucccccaagggcgccuccgucuccaucaacgucaacaccucccucgaggacaugcgcuccaacaacgucgaggacugcaagaugaugcaggucuccuccggcgacaagauggaggacgccaccgccaacggccaggaggacuccaaggcccccgacggcuccacccucaaggcccucggccucccccagcccgacuuccacucccucauccucgaccucggcgcccucuccuucgucgacaccgucugccucaagucccucaagaacaucuuccacgacuuccgcgagaucgaggucgaggucuacauggccgccugccacucccccgucgucucccagcucgaggccggccacuucuucgacgccuccaucaccaagaagcaccucuucgccuccguccacgacgccgucaccuucgcccuccagcacccccgccccguccccgacucccccgucuccgucacccgccucuga

SEQ ID NO: 49617 - RNA, 1971 nt, Artificial Sequence
  derived and/or modified sequence opt2 from SLC26A7__Homo_sapiens__NP_439897
augaccggcgccaagcgcaagaagaaguccaugcucugguccaagaugcacaccccccagugcgaggacaucauccaguggugccgccgccgccuccccauccucgacugggccccccacuacaaccucaaggagaaccuccuccccgacaccgucuccggcaucaugcucgccguccagcaggucacccagggccucgccuucgccguccucuccuccguccaccccgucuucggccucuacggcucccucuuccccgccaucaucuacgccaucuucggcaugggccaccacgucgccaccggcaccuucgcccucaccucccucaucuccgccaacgccgucgagcgcaucgucccccagaacaugcagaaccucaccacccaguccaacaccuccguccucggccucuccgacuucgagaugcagcgcauccacgucgccgccgccgucuccuuccucggcggcgucauccaggucgccauguucguccuccagcucggcuccgccaccuucgucgucaccgagcccgucaucuccgccaugaccaccggcgccgccacccacgucgucaccucccaggucaaguaccuccucggcaugaagaugcccuacaucuccggcccccucggcuucuucuacaucuacgccuacgucuucgagaacaucaaguccguccgccucgaggcccuccuccucucccuccucuccaucgucguccucguccucgucaaggagcucaacgagcaguucaagcgcaagaucaaggucguccuccccgucgaccucguccucaucaucgccgccuccuucgccugcuacugcaccaacauggagaacaccuacggccucgaggucgucggccacaucccccagggcauccccuccccccgcgccccccccaugaacauccucuccgccgucaucaccgaggccuucggcgucgcccucgucggcuacgucgccucccucgcccucgcccagggcuccgccaagaaguucaaguacuccaucgacgacaaccaggaguuccucgcccacggccucuccaacaucgucuccuccuucuucuucugcauccccuccgccgccgccaugggccgcaccgccggccucuacuccaccggcgccaagacccaggucgccugccucaucuccugcaucuucguccucaucgucaucuacgccaucggcccccuccucuacuggcuccccaugugcguccucgccuccaucaucgucgucggccucaagggcaugcucauccaguuccgcgaccucaagaaguacuggaacgucgacaagaucgacuggggcaucugggucuccaccuacgucuucaccaucugcuucgccgccaacgucggccuccucuucggcgucgucugcaccaucgccaucgucaucggccgcuucccccgcgccaugaccgucuccaucaagaacaugaaggagauggaguucaaggucaagaccgagauggacuccgagacccuccagcaggucaagaucaucuccaucaacaacccccucgucuuccucaacgccaagaaguucuacaccgaccucaugaacaugauccagaaggagaacgccugcaaccagccccucgacgacaucuccaagugcgagcagaacacccuccucaacucccucuccaacggcaacugcaacgaggaggccucccaguccugccccaacgagaagugcuaccucauccucgacugcuccggcuucaccuucuucgacuacuccggcgucuccaugcucgucgaggucuacauggacugcaagggccgcuccgucgacguccuccucgcccacugcaccgccucccucaucaaggccaugaccuacuacggcaaccucgacuccgagaagcccaucuucuucgaguccgucuccgccgccaucucccacauccacuccaacaagaaccucuccaagcucuccgaccacuccgaggucuga

SEQ ID NO: 49618 - RNA, 2913 nt, Artificial Sequence
  derived and/or modified sequence opt2 from SLC26A8__Homo_sapiens__NP_001180405
auggcccagcucgagcgcuccgccaucuccggcuucuccuccaagucccgccgcaacuccuucgccuacgacgucaagcgcgaggucuacaacgaggagaccuuccagcaggagcacaagcgcaaggccuccuccuccggcaacaugaacaucaacaucaccaccuuccgccaccacguccagugccgcugcuccuggcaccgcuuccuccgcugcguccucaccaucuuccccuuccucgaguggaugugcauguaccgccucaaggacuggcuccucggcgaccuccucgccggcaucuccgucggccucguccaggucccccagggccucacccucucccuccucgcccgccagcucauccccccccucaacaucgccuacgccgccuucugcuccuccgucaucuacgucaucuucggcuccugccaccagauguccaucggcuccuucuuccucgucuccgcccuccucaucaacguccucaaggucucccccuucaacaacggccagcucgucaugggcuccuucgucaagaacgaguucuccgcccccuccuaccucaugggcuacaacaagucccucuccgucgucgccaccaccaccuuccucaccggcaucauccagcucaucaugggcguccucggccucggcuucaucgccaccuaccuccccgaguccgccauguccgccuaccucgccgccgucgcccuccacaucaugcucucccagcucaccuucaucuucggcaucaugaucuccuuccacgccggccccaucuccuucuucuacgacaucaucaacuacugcgucgcccuccccaaggccaacuccaccuccauccucgucuuccucaccgucgucgucgcccuccgcaucaacaagugcauccgcaucuccuucaaccaguaccccaucgaguuccccauggagcucuuccucaucaucggcuucaccgucaucgccaacaagaucuccauggccaccgagaccucccagacccucaucgacaugauccccuacuccuuccuccuccccgucacccccgacuucucccuccuccccaagaucauccuccaggccuucucccucucccucgucuccuccuuccuccucaucuuccucggcaagaagaucgccucccuccacaacuacuccgucaacuccaaccaggaccucaucgccaucggccucugcaacgucgucuccuccuucuuccgcuccugcgucuucaccggcgccaucgcccgcaccaucauccaggacaaguccggcggccgccagcaguucgccucccucgucggcgccggcgucaugcuccuccucauggucaagaugggccacuucuucuacacccuccccaacgccguccucgccggcaucauccucuccaacgucauccccuaccucgagaccaucuccaaccuccccucccucuggcgccaggaccaguacgacugcgcccucuggaugaugaccuucuccuccuccaucuuccucggccucgacaucggccucaucaucuccgucgucuccgccuucuucaucaccaccguccgcucccaccgcgccaagauccuccuccucggccagauccccaacaccaacaucuaccgcuccaucaacgacuaccgcgagaucaucaccauccccggcgucaagaucuuccagugcugcuccuccaucaccuucgucaacgucuacuaccucaagcacaagcuccucaaggaggucgacauggucaaggucccccucaaggaggaggagaucuucucccucuucaacuccuccgacaccaaccuccagggcggcaagaucugccgcugcuucugcaacugcgacgaccucgagccccucccccgcauccucuacaccgagcgcuucgagaacaagcucgaccccgaggccuccuccaucaaccucauccacugcucccacuucgaguccaugaacaccucccagaccgccuccgaggaccagguccccuacaccgucuccuccgucucccagaagaaccagggccagcaguacgaggaggucgaggaggucuggcuccccaacaacuccucccgcaacuccucccccggccuccccgacgucgccgagucccagggccgccgcucccucauccccuacuccgacgccucccuccuccccuccguccacaccaucauccucgacuucuccaugguccacuacgucgacucccgcggccucgucguccuccgccagaucugcaacgccuuccagaacgccaacauccucauccucaucgccggcugccacuccuccaucguccgcgccuucgagcgcaacgacuucuucgacgccggcaucaccaagacccagcucuuccucuccguccacgacgccguccucuucgcccucucccgcaaggucaucggcuccuccgagcucuccaucgacgaguccgagaccgucauccgcgagaccuacuccgagaccgacaagaacgacaacucccgcuacaagauguccuccuccuuccucggcucccagaagaacgucucccccggcuucaucaagauccagcagcccgucgaggaggaguccgagcucgaccucgagcucgaguccgagcaggaggccggccucggccucgaccucgaccucgaccgcgagcucgagcccgagauggagcccaaggccgagaccgagaccaagacccagaccgagauggagccccagcccgagaccgagcccgagauggagcccaaccccaagucccgcccccgcgcccacaccuucccccagcagcgcuacuggcccauguaccaccccuccauggccuccacccagucccagacccagacccgcaccugguccgucgagcgccgccgccaccccauggacuccuacucccccgagggcaacuccaacgaggacgucuga

SEQ ID NO: 49619 - RNA, 2664 nt, Artificial Sequence
  derived and/or modified sequence opt2 from SLC26A9__Homo_sapiens__NP_599152
augucccagccccgcccccgcuacgucgucgaccgcgccgccuacucccucacccucuucgacgacgaguucgagaagaaggaccgcaccuaccccgucggcgagaagcuccgcaacgccuuccgcugcuccuccgccaagaucaaggccgucgucuucggccuccuccccguccucuccuggcuccccaaguacaagaucaaggacuacaucauccccgaccuccucggcggccucuccggcggcuccauccaggucccccagggcauggccuucgcccuccucgccaaccuccccgccgucaacggccucuacuccuccuucuucccccuccucaccuacuucuuccucggcggcguccaccagaugguccccggcaccuucgccgucaucuccauccucgucggcaacaucugccuccagcucgcccccgaguccaaguuccaggucuucaacaacgccaccaacgaguccuacgucgacaccgccgccauggaggccgagcgccuccacgucuccgccacccucgccugccucaccgccaucauccagaugggccucggcuucaugcaguucggcuucgucgccaucuaccucuccgaguccuucauccgcggcuucaugaccgccgccggccuccagauccucaucuccguccucaaguacaucuucggccucaccauccccuccuacaccggccccggcuccaucgucuucaccuucaucgacaucugcaagaaccucccccacaccaacaucgccucccucaucuucgcccucaucuccggcgccuuccucguccucgucaaggagcucaacgcccgcuacaugcacaagauccgcuuccccauccccaccgagaugaucgucgucgucgucgccaccgccaucuccggcggcugcaagaugcccaagaaguaccacaugcagaucgucggcgagauccagcgcggcuuccccacccccgucucccccgucgucucccaguggaaggacaugaucggcaccgccuucucccucgccaucgucuccuacgucaucaaccucgccaugggccgcacccucgccaacaagcacggcuacgacgucgacuccaaccaggagaugaucgcccucggcugcuccaacuucuucggcuccuucuucaagauccacgucaucugcugcgcccucuccgucacccucgccgucgacggcgccggcggcaagucccaggucgccucccucugcgucucccucgucgucaugaucaccaugcucguccucggcaucuaccucuacccccuccccaaguccguccucggcgcccucaucgccgucaaccucaagaacucccucaagcagcucaccgaccccuacuaccucuggcgcaaguccaagcucgacugcugcaucugggucgucuccuuccucuccuccuucuuccucucccuccccuacggcgucgccgucggcgucgccuucuccguccucgucgucgucuuccagacccaguuccgcaacggcuacgcccucgcccaggucauggacaccgacaucuacgucaaccccaagaccuacaaccgcgcccaggacauccagggcaucaagaucaucaccuacugcuccccccucuacuucgccaacuccgagaucuuccgccagaaggucaucgccaagaccggcauggacccccagaagguccuccucgccaagcagaaguaccucaagaagcaggagaagcgccgcaugcgccccacccagcagcgccgcucccucuucaugaagaccaagaccgucucccuccaggagcuccagcaggacuucgagaacgccccccccaccgaccccaacaacaaccagacccccgccaacggcaccuccgucuccuacaucaccuucucccccgacuccuccucccccgcccaguccgagccccccgccuccgccgaggcccccggcgagcccuccgacaugcucgccuccgucccccccuucgucaccuuccacacccucauccucgacauguccggcgucuccuucgucgaccucaugggcaucaaggcccucgccaagcucuccuccaccuacggcaagaucggcgucaaggucuuccucgucaacauccacgcccaggucuacaacgacaucucccacggcggcgucuucgaggacggcucccucgagugcaagcacgucuuccccuccauccacgacgccguccucuucgcccaggccaacgcccgcgacgucacccccggccacaacuuccagggcgcccccggcgacgccgagcucucccucuacgacuccgaggaggacauccgcuccuacugggaccucgagcaggagauguucggcuccauguuccacgccgagacccucaccgcccucgagucccucuccgccgccggcggcugcuaccccuaccgcuccgagucccucgucuccccccucuucacccgccaggcccucgccgccauggacaagccccccgcccacuccaccccccccaccuccgcccucucccucgccgccgagggccaccucgacuuccagcuccuccgcgucucccagaagcagaaggacaaguacaacugcgccggccuccucuacaagcuccagaaggucucccaguccccccacggcuccgucuccgacggcguccgccucucccgcaccuga

SEQ ID NO: 49620 - RNA, 1977 nt, Artificial Sequence
  derived and/or modified sequence opt2 from SLC27A1__Homo_sapiens__XP_011526304
augcgcgcccccggcgccggcgccgccuccgucgucucccucgcccuccucuggcuccucggccuccccuggaccugguccgccgccgccgcccucggcgucuacgucggcuccggcggcuggcgcuuccuccgcaucgucugcaagaccgcccgccgcgaccucuucggccucuccguccucauccgcguccgccucgagcuccgccgccaccagcgcgccggccacaccaucccccgcaucuuccaggccgucguccagcgccagcccgagcgccucgcccucgucgacgccggcaccggcgagugcuggaccuucgcccagcucgacgccuacuccaacgccgucgccaaccucuuccgccagcucggcuucgcccccggcgacgucgucgccaucuuccucgagggccgccccgaguucgucggccucuggcucggccucgccaaggccggcauggaggccgcccuccucaacgucaaccuccgccgcgagccccucgccuucugccucggcaccuccggcgccaaggcccucaucuucggcggcgagauggucgccgccgucgccgaggucuccggccaccucggcaagucccucaucaaguucugcuccggcgaccucggccccgagggcauccuccccgacacccaccuccucgacccccuccucaaggaggccuccaccgccccccucgcccagauccccuccaagggcauggacgaccgccucuucuacaucuacaccuccggcaccaccggccuccccaaggccgccaucgucguccacucccgcuacuaccgcauggccgccuucggccaccacgccuaccgcaugcaggccgccgacguccucuacgacugccucccccucuaccacuccgccggcaacaucaucggcgucggccagugccucaucuacggccucaccgucguccuccgcaagaaguucuccgccucccgcuucugggacgacugcaucaaguacaacugcaccaucaacggcguccgccacugccgccuccucugccucgucguccaguacaucggcgagaucugccgcuaccuccucaagcagcccguccgcgaggccgagcgccgccaccgcguccgccucgccgucggcaacggccuccgccccgccaucugggaggaguucaccgagcgcuucggcguccgccagaucggcgaguucuacggcgccaccgagugcaacugcuccaucgccaacauggacggcaaggucggcuccugcggcuucaacucccgcauccucccccacgucuaccccauccgccucgucaaggucaacgaggacaccauggagcuccuccgcgacgcccagggccucugcauccccugccaggccggcgagcccggccuccucgucggccagaucaaccagcaggacccccuccgccgcuucgacggcuacgucuccgaguccgccaccuccaagaagaucgcccacuccgucuucuccaagggcgacuccgccuaccucuccggcgacguccucgucauggacgagcucggcuacauguacuuccgcgaccgcuccggcgacaccuuccgcuggcgcggcgagaacgucuccaccaccgaggucgagggcguccucucccgccuccucggccagaccgacgucgccgucuacggcgucgccguccccggcgucgagggcaaggccggcauggccgccgucgccgacccccacucccuccucgaccccaacgccaucuaccaggagcuccagaagguccucgcccccuacgcccgccccaucuuccuccgccuccucccccaggucgacaccaccggcaccuucaagauccagaagacccgccuccagcgcgagggcuucgacccccgccagaccuccgaccgccucuucuuccucgaccucaagcagggccacuaccucccccucaacgaggccgucuacacccgcaucugcuccggcgccuucgcccucuga

SEQ ID NO: 49621 - RNA, 1704 nt, Artificial Sequence
  derived and/or modified sequence opt2 from SLC27A2__Homo_sapiens__NP_001153101
augcucuccgccaucuacaccguccucgccggccuccucuuccucccccuccucgucaaccucugcugccccuacuucuuccaggacaucggcuacuuccucaaggucgccgccgucggccgccgcguccgcuccuacggcaagcgccgccccgcccgcaccauccuccgcgccuuccucgagaaggcccgccagaccccccacaagcccuuccuccucuuccgcgacgagacccucaccuacgcccaggucgaccgccgcuccaaccaggucgcccgcgcccuccacgaccaccucggccuccgccagggcgacugcgucgcccuccucaugggcaacgagcccgccuacgucuggcucuggcucggccucgucaagcucggcugcgccauggccugccucaacuacaacauccgcgccaagucccuccuccacugcuuccagugcugcggcgccaagguccuccucgucucccccgagcuccaggccgccgucgaggagauccuccccucccucaagaaggacgacgucuccaucuacuacgucucccgcaccuccaacaccgacggcaucgacuccuuccucgacaaggucgacgaggucuccaccgagcccauccccgaguccuggcgcuccgaggucaccuucuccacccccgcccucuacaucuacaccuccggcaccaccggcgccacccucgcccuccgcaccaaguucuccgccucccaguucugggacgacugccgcaaguacaacgucaccgucauccaguacaucggcgagcuccuccgcuaccucugcaacuccccccagaagcccaacgaccgcgaccacaagguccgccucgcccucggcaacggccuccgcggcgacgucuggcgccaguucgucaagcgcuucggcgacaucugcaucuacgaguucuacgccgccaccgagggcaacaucggcuucaugaacuacgcccgcaaggucggcgccgucggccgcgucaacuaccuccagaagaagaucaucaccuacgaccucaucaaguacgacgucgagaaggacgagcccguccgcgacgagaacggcuacugcguccgcguccccaagggcgaggucggccuccucgucugcaagaucacccagcucacccccuucaacggcuacgccggcgccaaggcccagaccgagaagaagaagcuccgcgacgucuucaagaagggcgaccucuacuucaacuccggcgaccuccucauggucgaccacgagaacuucaucuacuuccacgaccgcgucggcgacaccuuccgcuggaagggcgagaacgucgccaccaccgaggucgccgacaccgucggccucgucgacuucguccaggaggucaacgucuacggcguccacguccccgaccacgagggccgcaucggcauggccuccaucaagaugaaggagaaccacgaguucgacggcaagaagcucuuccagcacaucgccgacuaccuccccuccuacgcccgcccccgcuuccuccgcauccaggacaccaucgagaucaccggcaccuucaagcaccgcaagaugacccucgucgaggagggcuucaaccccgccgucaucaaggacgcccucuacuuccucgacgacaccgccaagauguacguccccaugaccgaggacaucuacaacgccaucuccgccaagacccucaagcucuga

SEQ ID NO: 49622 - RNA, 2193 nt, Artificial Sequence
  derived and/or modified sequence opt2 from SLC27A3__Homo_sapiens__NP_077306
augggcgucugccagcgcacccgcgcccccuggaaggagaagucccagcucgagcgcgccgcccucggcuuccgcaagggcggcuccggcauguucgccuccggcuggaaccagaccguccccaucgaggaggccggcuccauggccgcccuccuccuccucccccuccuccuccuccucccccuccuccuccucaagcuccaccucuggccccagcuccgcuggcuccccgccgaccucgccuucgccguccgcgcccucugcugcaagcgcgcccuccgcgcccgcgcccucgccgccgccgccgccgaccccgagggccccgagggcggcugcucccucgccuggcgccucgccgagcucgcccagcagcgcgccgcccacaccuuccucauccacggcucccgccgcuucuccuacuccgaggccgagcgcgaguccaaccgcgccgcccgcgccuuccuccgcgcccucggcugggacuggggccccgacggcggcgacuccggcgagggcuccgccggcgagggcgagcgcgccgcccccggcgccggcgacgccgccgccggcuccggcgccgaguucgccggcggcgacggcgccgcccgcggcggcggcgccgccgccccccucucccccggcgccaccgucgcccuccuccuccccgccggccccgaguuccucuggcucugguucggccucgccaaggccggccuccgcaccgccuucguccccaccgcccuccgccgcggcccccuccuccacugccuccgcuccugcggcgcccgcgcccucguccucgcccccgaguuccucgagucccucgagcccgaccuccccgcccuccgcgccaugggccuccaccucugggccgccggccccggcacccaccccgccggcaucuccgaccuccucgccgaggucuccgccgaggucgacggccccguccccggcuaccucuccuccccccaguccaucaccgacaccugccucuacaucuucaccuccggcaccaccggccuccccaaggccgcccgcaucucccaccucaagauccuccagugccagggcuucuaccagcucugcggcguccaccaggaggacgucaucuaccucgcccucccccucuaccacauguccggcucccuccucggcaucgucggcugcaugggcaucggcgccaccgucguccucaaguccaaguucuccgccggccaguucugggaggacugccagcagcaccgcgucaccgucuuccaguacaucggcgagcucugccgcuaccucgucaaccagccccccuccaaggccgagcgcggccacaagguccgccucgccgucggcuccggccuccgccccgacaccugggagcgcuucguccgccgcuucggcccccuccagguccucgagaccuacggccucaccgagggcaacgucgccaccaucaacuacaccggccagcgcggcgccgucggccgcgccuccuggcucuacaagcacaucuuccccuucucccucauccgcuacgacgucaccaccggcgagcccauccgcgacccccagggccacugcauggccaccucccccggcgagcccggccuccucgucgcccccgucucccagcagucccccuuccucggcuacgccggcggccccgagcucgcccagggcaagcuccucaaggacgucuuccgccccggcgacgucuucuucaacaccggcgaccuccucgucugcgacgaccagggcuuccuccgcuuccacgaccgcaccggcgacaccuuccgcuggaagggcgagaacgucgccaccaccgaggucgccgaggucuucgaggcccucgacuuccuccaggaggucaacgucuacggcgucaccguccccggccacgagggccgcgccggcauggccgcccucguccuccgccccccccacgcccucgaccucaugcagcucuacacccacgucuccgagaaccucccccccuacgcccgcccccgcuuccuccgccuccaggagucccucgccaccaccgagaccuucaagcagcagaagguccgcauggccaacgagggcuucgaccccuccacccucuccgacccccucuacguccucgaccaggccgucggcgccuaccucccccucaccaccgcccgcuacuccgcccuccucgccggcaaccuccgcaucuga

SEQ ID NO: 49623 - RNA, 1932 nt, Artificial Sequence
  derived and/or modified sequence opt2 from SLC27A4__Homo_sapiens__NP_005085
augcuccucggcgccucccucgucggcguccuccucuucuccaagcucguccucaagcuccccuggacccaggucggcuucucccuccucuuccucuaccucggcuccggcggcuggcgcuucauccgcgucuucaucaagaccauccgccgcgacaucuucggcggccucguccuccucaaggucaaggccaagguccgccagugccuccaggagcgccgcaccguccccauccucuucgccuccaccguccgccgccaccccgacaagaccgcccucaucuucgagggcaccgacacccacuggaccuuccgccagcucgacgaguacuccuccuccgucgccaacuuccuccaggcccgcggccucgccuccggcgacgucgccgccaucuucauggagaaccgcaacgaguucgucggccucuggcucggcauggccaagcucggcgucgaggccgcccucaucaacaccaaccuccgccgcgacgcccuccuccacugccucaccaccucccgcgcccgcgcccucgucuucggcuccgagauggccuccgccaucugcgagguccacgccucccucgaccccucccucucccucuucugcuccggcuccugggagcccggcgccgucccccccuccaccgagcaccucgacccccuccucaaggacgcccccaagcaccuccccuccugccccgacaagggcuucaccgacaagcucuucuacaucuacaccuccggcaccaccggccuccccaaggccgccaucgucguccacucccgcuacuaccgcauggccgcccucgucuacuacggcuuccgcaugcgccccaacgacaucgucuacgacugccucccccucuaccacuccgccggcaacaucgucggcaucggccagugccuccuccacggcaugaccgucgucauccgcaagaaguucuccgccucccgcuucugggacgacugcaucaaguacaacugcaccaucguccaguacaucggcgagcucugccgcuaccuccucaaccagcccccccgcgaggccgagaaccagcaccagguccgcauggcccucggcaacggccuccgccaguccaucuggaccaacuucuccucccgcuuccacaucccccaggucgccgaguucuacggcgccaccgagugcaacugcucccucggcaacuucgacucccaggucggcgccugcggcuucaacucccgcauccucuccuucgucuaccccauccgccucguccgcgucaacgaggacaccauggagcucauccgcggccccgacggcgucugcauccccugccagcccggcgagcccggccagcucgucggccgcaucauccagaaggacccccuccgccgcuucgacggcuaccucaaccagggcgccaacaacaagaagaucgccaaggacgucuucaagaagggcgaccaggccuaccucaccggcgacguccucgucauggacgagcucggcuaccucuacuuccgcgaccgcaccggcgacaccuuccgcuggaagggcgagaacgucuccaccaccgaggucgagggcacccucucccgccuccucgacauggccgacgucgccgucuacggcgucgagguccccggcaccgagggccgcgccggcauggccgccgucgccucccccaccggcaacugcgaccucgagcgcuucgcccagguccucgagaaggagcucccccucuacgcccgccccaucuuccuccgccuccuccccgagcuccacaagaccggcaccuacaaguuccagaagaccgagcuccgcaaggagggcuucgaccccgccaucgucaaggacccccucuucuaccucgacgcccagaagggccgcuacgucccccucgaccaggaggccuacucccgcauccaggccggcgaggagaagcucuga

SEQ ID NO: 49624 - RNA, 2073 nt, Artificial Sequence
  derived and/or modified sequence opt2 from SLC27A5__Homo_sapiens__NP_036386
augggcguccgccagcagcucgcccuccuccuccuccuccuccuccuccucuggggccucggccagcccgucuggcccgucgccgucgcccucacccuccgcuggcuccucggcgaccccaccugcugcguccuccucggccucgccaugcucgcccgccccuggcucggccccugggucccccacggccucucccucgccgccgccgcccucgcccucacccuccuccccgcccgccucccccccggccuccgcuggcuccccgccgacgucaucuuccucgccaagauccuccaccucggccucaagauccgcggcugccucucccgccagccccccgacaccuucgucgacgccuucgagcgccgcgcccgcgcccagcccggccgcgcccuccucgucuggaccggccccggcgccggcuccgucaccuucggcgagcucgacgcccgcgccugccaggccgccugggcccucaaggccgagcucggcgaccccgccucccucugcgccggcgagcccaccgcccuccucguccucgccucccaggccguccccgcccucugcauguggcucggccucgccaagcucggcugccccaccgccuggaucaacccccacggccgcggcaugccccucgcccacuccguccucuccuccggcgcccgcguccucgucgucgaccccgaccuccgcgagucccucgaggagauccuccccaagcuccaggccgagaacauccgcugcuucuaccucucccacaccucccccacccccggcgucggcgcccucggcgccgcccucgacgccgcccccucccaccccguccccgccgaccuccgcgccggcaucaccuggcgcucccccgcccucuucaucuacaccuccggcaccaccggccuccccaagcccgccauccucacccacgagcgcguccuccagauguccaagaugcucucccucuccggcgccaccgccgacgacgucgucuacaccguccucccccucuaccacgucaugggccucgucgucggcauccucggcugccucgaccucggcgccaccugcguccucgcccccaaguucuccaccuccugcuucugggacgacugccgccagcacggcgucaccgucauccucuacgucggcgagcuccuccgcuaccucugcaacaucccccagcagcccgaggaccgcacccacaccguccgccucgccaugggcaacggccuccgcgccgacgucugggagaccuuccagcagcgcuucggccccauccgcaucugggaggucuacggcuccaccgagggcaacaugggccucgucaacuacgucggccgcugcggcgcccucggcaagauguccugccuccuccgcaugcucucccccuucgagcucguccaguucgacauggaggccgccgagcccguccgcgacaaccagggcuucugcauccccgucggccucggcgagcccggccuccuccucaccaaggucgucucccagcagcccuucgucggcuaccgcggcccccgcgagcucuccgagcgcaagcucguccgcaacguccgccaguccggcgacgucuacuacaacaccggcgacguccucgccauggaccgcgagggcuuccucuacuuccgcgaccgccucggcgacaccuuccgcuggaagggcgagaacgucuccacccacgaggucgagggcguccucucccaggucgacuuccuccagcaggucaacgucuacggcgucugcguccccggcugcgagggcaaggucggcauggccgccguccagcucgcccccggccagaccuucgacggcgagaagcucuaccagcacguccgcgccuggcuccccgccuacgccaccccccacuucauccgcauccaggacgccauggaggucaccuccaccuucaagcucaugaagacccgccucguccgcgagggcuucaacgucggcaucgucgucgacccccucuucguccucgacaaccgcgcccaguccuuccgcccccucaccgccgagauguaccaggccgucugcgagggcaccuggcgccucuga

SEQ ID NO: 49625 - RNA, 1950 nt, Artificial Sequence
  derived and/or modified sequence opt2 from SLC28A1__Homo_sapiens__NP_004204
auggagaacgaccccucccgccgccgcgaguccaucucccucacccccgucgccaagggccucgagaacaugggcgccgacuuccucgagucccucgaggagggccagcucccccgcuccgaccucucccccgccgagauccgcuccuccugguccgaggccgcccccaagcccuucucccgcuggcgcaaccuccagcccgcccuccgcgcccgcuccuucugccgcgagcacaugcagcucuuccgcuggaucggcaccggccuccucugcaccggccucuccgccuuccuccucgucgccugccuccucgacuuccagcgcgcccucgcccucuucguccucaccugcgucguccucaccuuccucggccaccgccuccucaagcgccuccucggccccaagcuccgccgcuuccucaagccccagggccacccccgccuccuccucugguucaagcgcggccucgcccucgccgccuuccucggccucguccucuggcucucccucgacaccucccagcgccccgagcagcucgucuccuucgccggcaucugcgucuucgucgcccuccucuucgccugcuccaagcaccacugcgccgucuccuggcgcgccgucuccuggggccucggccuccaguucguccucggccuccucgucauccgcaccgagcccggcuucaucgccuucgaguggcucggcgagcagauccgcaucuuccucuccuacaccaaggccggcuccuccuucgucuucggcgaggcccucgucaaggacgucuucgccuuccagguccuccccaucaucgucuucuucuccugcgucaucuccguccucuaccacgucggccucaugcagugggucauccucaagaucgccuggcucaugcaggucaccaugggcaccaccgccaccgagacccucuccgucgccggcaacaucuucgucucccagaccgaggccccccuccucauccgccccuaccucgccgacaugacccucuccgagguccacgucgucaugaccggcggcuacgccaccaucgccggcucccuccucggcgccuacaucuccuucggcaucgacgccaccucccucaucgccgccuccgucauggccgcccccugcgcccucgcccucuccaagcucgucuaccccgaggucgaggaguccaaguuccgccgcgaggagggcgucaagcucaccuacggcgacgcccagaaccucaucgaggccgccuccaccggcgccgccaucuccgucaaggucgucgccaacaucgccgccaaccucaucgccuuccucgccguccucgacuucaucaacgccgcccucuccuggcucggcgacauggucgacauccagggccucuccuuccagcucaucugcuccuacauccuccgccccgucgccuuccucaugggcgucgccugggaggacugccccgucgucgccgagcuccucggcaucaagcucuuccucaacgaguucgucgccuaccaggaccucuccaaguacaagcagcgccgccucgccggcgccgaggagugggucggcgaccgcaagcaguggaucuccguccgcgccgagguccucaccaccuucgcccucugcggcuucgccaacuucuccuccaucggcaucaugcucggcggccucaccuccauggucccccagcgcaaguccgacuucucccagaucguccuccgcgcccucuucaccggcgccugcgucucccucgucaacgccugcauggccggcauccucuacaugccccgcggcgccgaggucgacugcaugucccuccucaacaccacccucuccuccuccuccuucgagaucuaccagugcugccgcgaggccuuccaguccgucaaccccgaguucucccccgaggcccucgacaacugcugccgcuucuacaaccacaccaucugcgcccaguga

SEQ ID NO: 49626 - RNA, 1977 nt, Artificial Sequence
  derived and/or modified sequence opt2 from SLC28A2__Homo_sapiens__XP_011520500
auggagaaggccuccggccgccaguccaucgcccucuccaccgucgagaccggcaccgucaaccccggccucgagcucauggagaaggaggucgagcccgagggcuccaagcgcaccgacgcccagggccacucccucggcgacggccucggccccuccaccuaccagcgccgcucccgcuggcccuucuccaaggcccgcuccuucugcaagacccacgccucccucuucaagaagauccuccucggccuccucugccucgccuacgccgccuaccuccucgccgccugcauccucaacuuccagcgcgcccucgcccucuucgucaucaccugccucgucaucuucguccucguccacuccuuccucaagaagcuccucggcaagaagcucacccgcugccucaagcccuucgagaacucccgccuccgccucuggaccaagugggucuucgccggcgucucccucgucggccucauccucuggcucgcccucgacaccgcccagcgccccgagcagcucauccccuucgccggcaucugcauguucauccucauccucuucgccugcuccaagcaccacuccgccgucuccuggcgcaccgucuucuccggccucggccuccaguucgucuucggcauccucgucauccgcaccgaccucggcuacaccgucuuccaguggcucggcgagcagguccagaucuuccucaacuacaccgucgccggcuccuccuucgucuucggcgacacccucgucaaggacgucuucgccuuccaggcccuccccaucaucaucuucuucggcugcgucgucuccauccucuacuaccucggccucguccagugggucguccagaaggucgccugguuccuccagaucaccaugggcaccaccgccaccgagacccucgccgucgccggcaacaucuucgucggcaugaccgaggccccccuccucauccgccccuaccucggcgacaugacccucuccgagauccacgccgucaugaccggcggcuucgccaccaucuccggcaccguccucggcgccuucaucgccuucggcgucgacgccuccucccucaucuccgccuccgucauggccgcccccugcgcccucgccuccuccaagcucgccuaccccgaggucgaggaguccaaguucaaguccgaggagggcgucaagcucccccgcggcaaggagcgcaacguccucgaggccgccuccaacggcgccgucgacgccaucggccucgccaccaacgucgccgccaaccucaucgccuuccucgccguccucgccuucaucaacgccgcccucuccuggcucggcgagcucgucgacauccagggccucaccuuccaggucaucugcuccuaccuccuccgccccauggucuucaugaugggcgucgaguggaccgacugccccauggucgccgagauggucggcaucaaguucuucaucaacgaguucgucgccuaccagcagcucucccaguacaagaacaagcgccucuccggcauggaggaguggaucgagggcgagaagcaguggaucuccguccgcgccgagaucaucaccaccuucucccucugcggcuucgccaaccucuccuccaucggcaucacccucggcggccucaccuccaucgucccccaccgcaaguccgaccucuccaaggucgucguccgcgcccucuucaccggcgccugcgucucccucaucuccgccugcauggccggcauccucuacgucccccgcggcgccgaggccgacugcgucuccuuccccaacaccuccuucaccaaccgcaccuacgagaccuacaugugcugccgcggccucuuccaguccaccucccucaacggcaccaacccccccuccuucuccggccccugggaggacaaggaguucuccgccauggcccucaccaacugcugcggcuucuacaacaacaccgucugcgccuga

SEQ ID NO: 49627 - RNA, 2076 nt, Artificial Sequence
  derived and/or modified sequence opt2 from SLC28A3__Homo_sapiens__NP_001186562
auggagcuccgcuccaccgccgccccccgcgccgagggcuacuccaacgucggcuuccagaacgaggagaacuuccucgagaacgagaacaccuccggcaacaacuccauccgcucccgcgccguccagucccgcgagcacaccaacaccaagcaggacgaggagcaggucaccgucgagcaggacuccccccgcaaccgcgagcacauggaggacgacgacgaggagaugcagcagaagggcugccucgagcgccgcuacgacaccgucugcggcuucugccgcaagcacaagaccacccuccgccacaucaucuggggcauccuccucgccggcuaccucgucauggucaucuccgccugcguccucaacuuccaccgcgcccucccccucuucgucaucaccgucgccgccaucuucuucgucgucugggaccaccucauggccaaguacgagcaccgcaucgacgagaugcucucccccggccgccgccuccucaacucccacugguucuggcucaagugggucaucugguccucccucguccucgccgucaucuucuggcucgccuucgacaccgccaagcucggccagcagcagcucgucuccuucggcggccucaucauguacaucguccuccucuuccucuucuccaaguaccccacccgcgucuacuggcgccccguccucuggggcaucggccuccaguuccuccucggccuccucauccuccgcaccgaccccggcuucaucgccuucgacuggcucggccgccagguccagaccuuccucgaguacaccgacgccggcgccuccuucgucuucggcgagaaguacaaggaccacuucuucgccuucaagguccuccccaucgucgucuucuucuccaccgucauguccaugcucuacuaccucggccucaugcaguggaucauccgcaaggucggcuggaucaugcucgucaccaccggcuccucccccaucgaguccgucgucgccuccggcaacaucuucgucggccagaccgaguccccccuccucguccgccccuaccuccccuacaucaccaaguccgagcuccacgccaucaugaccgccggcuucuccaccaucgccggcuccguccucggcgccuacaucuccuucggcguccccuccucccaccuccucaccgccuccgucauguccgcccccgccucccucgccgccgccaagcucuucuggcccgagaccgagaagcccaagaucacccucaagaacgccaugaagauggaguccggcgacuccggcaaccuccucgaggccgccacccagggcgccuccuccuccaucucccucgucgccaacaucgccgucaaccucaucgccuuccucgcccuccucuccuucaugaacuccgcccucuccugguucggcaacauguucgacuacccccagcucuccuucgagcucaucugcuccuacaucuucaugcccuucuccuucaugaugggcgucgaguggcaggacuccuucauggucgcccgccucaucggcuacaagaccuucuucaacgaguucgucgccuacgagcaccucuccaaguggauccaccuccgcaaggagggcggccccaaguucgucaacggcguccagcaguacaucuccauccgcuccgagaucaucgccaccuacgcccucugcggcuucgccaacaucggcucccucggcaucgucaucggcggccucaccuccauggcccccucccgcaagcgcgacaucgccuccggcgccguccgcgcccucaucgccggcaccgucgccugcuucaugaccgccugcaucgccggcauccucuccuccacccccgucgacaucaacugccaccacguccucgagaacgccuucaacuccaccuuccccggcaacaccaccaaggucaucgccugcugccagucccuccucuccuccaccgucgccaagggccccggcgaggucauccccggcggcaaccacucccucuacucccucaagggcugcugcacccuccucaaccccuccaccuucaacugcaacggcaucuccaacaccuucuga

SEQ ID NO: 49628 - RNA, 1371 nt, Artificial Sequence
  derived and/or modified sequence opt2 from SLC29A1__Homo_sapiens__NP_001071643
augaccaccucccaccagccccaggaccgcuacaaggccgucuggcucaucuucuucaugcucggccucggcacccuccuccccuggaacuucuucaugaccgccacccaguacuucaccaaccgccucgacaugucccagaacgucucccucgucaccgccgagcucuccaaggacgcccaggccuccgccgcccccgccgccccccuccccgagcgcaacucccucuccgccaucuucaacaacgucaugacccucugcgccaugcucccccuccuccucuucaccuaccucaacuccuuccuccaccagcgcaucccccaguccguccgcauccucggcucccucgucgccauccuccucgucuuccucaucaccgccauccucgucaagguccagcucgacgcccuccccuucuucgucaucaccaugaucaagaucguccucaucaacuccuucggcgccauccuccagggcucccucuucggccucgccggccuccuccccgccuccuacaccgcccccaucauguccggccagggccucgccggcuucuucgccuccgucgccaugaucugcgccaucgccuccggcuccgagcucuccgaguccgccuucggcuacuucaucaccgccugcgccgucaucauccucaccaucaucugcuaccucggccucccccgccucgaguucuaccgcuacuaccagcagcucaagcucgagggccccggcgagcaggagaccaagcucgaccucaucuccaagggcgaggagccccgcgccggcaaggaggaguccggcgucuccgucuccaacucccagcccaccaacgagucccacuccaucaaggccauccucaagaacaucuccguccucgccuucuccgucugcuucaucuucaccaucaccaucggcauguuccccgccgucaccgucgaggucaaguccuccaucgccggcuccuccaccugggagcgcuacuucauccccgucuccugcuuccucaccuucaacaucuucgacuggcucggccgcucccucaccgccgucuucauguggcccggcaaggacucccgcuggcuccccucccucguccucgcccgccucgucuucgucccccuccuccuccucugcaacaucaagccccgccgcuaccucaccgucgucuucgagcacgacgccugguucaucuucuucauggccgccuucgccuucuccaacggcuaccucgccucccucugcaugugcuucggccccaagaaggucaagcccgccgaggccgagaccgccggcgccaucauggccuucuuccucugccucggccucgcccucggcgccgucuucuccuuccucuuccgcgccaucgucuga

SEQ ID NO: 49629 - RNA, 1371 nt, Artificial Sequence
  derived and/or modified sequence opt2 from SLC29A2__Homo_sapiens__XP_011543277
auggcccgcggcgacgccccccgcgacuccuaccaccucgucggcaucuccuucuucauccucggccucggcacccuccuccccuggaacuucuucaucaccgccauccccuacuuccaggcccgccucgccggcgccggcaacuccaccgcccgcauccucuccaccaaccacaccggccccgaggacgccuucaacuucaacaacugggucacccuccucucccagcucccccuccuccucuucacccuccucaacuccuuccucuaccagugcguccccgagaccguccgcauccucggcucccuccucgccauccuccuccucuucgcccucaccgccgcccucgucaaggucgacaugucccccggccccuucuucuccaucaccauggccuccgucugcuucaucaacuccuucuccgccguccuccagggcucccucuucggccagcucggcaccaugcccuccaccuacuccacccucuuccucuccggccagggccucgccggcaucuucgccgcccucgccaugcuccucuccauggccuccggcgucgacgccgagaccuccgcccucggcuacuucaucacccccugcgucggcauccucauguccaucgucugcuaccucucccucccccaccucaaguucgcccgcuacuaccucgccaacaaguccucccaggcccaggcccaggagcucgagaccaaggccgagcuccuccaguccgacgagaacggcauccccuccuccccccagaaggucgcccucacccucgaccucgaccucgagaaggagcccgaguccgagcccgacgagccccagaagcccggcaagcccuccgucuucaccgucuuccagaagaucuggcucaccgcccucugccucguccucgucuucaccgucacccucuccgucuuccccgccaucaccgccauggucaccuccuccaccucccccggcaaguggucccaguucuucaaccccaucugcugcuuccuccucuucaacaucauggacuggcucggccgcucccucaccuccuacuuccucuggcccgacgaggacucccgccuccucccccuccucgucugccuccgcuuccucuucgucccccucuucaugcucugccacgucccccagcgcucccgccuccccauccucuucccccaggacgccuacuucaucaccuucaugcuccucuucgccgucuccaacggcuaccucgucucccucaccaugugccucgccccccgccagguccucccccacgagcgcgaggucgccggcgcccucaugaccuucuuccucgcccucggccucuccugcggcgccucccucuccuuccucuucaaggcccuccucuga

SEQ ID NO: 49630 - RNA, 1428 nt, Artificial Sequence
  derived and/or modified sequence opt2 from SLC29A3__Homo_sapiens__NP_060814
auggccgucgucuccgaggacgacuuccagcacuccuccaacuccaccuaccgcaccaccuccuccucccuccgcgccgaccaggaggcccuccucgagaagcuccucgaccgccccccccccggccuccagcgccccgaggaccgcuucugcggcaccuacaucaucuucuucucccucggcaucggcucccuccuccccuggaacuucuucaucaccgccaaggaguacuggauguucaagcuccgcaacuccuccucccccgccaccggcgaggaccccgagggcuccgacauccucaacuacuucgaguccuaccucgccgucgccuccaccguccccuccaugcucugccucgucgccaacuuccuccucgucaaccgcgucgccguccacauccgcguccucgccucccucaccgucauccucgccaucuucauggucaucaccgcccucgucaaggucgacaccuccuccuggacccgcggcuucuucgccgucaccaucgucugcauggucauccucuccggcgccuccaccgucuucuccuccuccaucuacggcaugaccggcuccuuccccaugcgcaacucccaggcccucaucuccggcggcgccaugggcggcaccgucuccgccgucgccucccucgucgaccucgccgccuccuccgacguccgcaacuccgcccucgccuucuuccucaccgccaccgucuuccucguccucugcaugggccucuaccuccuccucucccgccucgaguacgcccgcuacuacaugcgccccguccucgccgcccacgucuucuccggcgaggaggagcucccccaggacucccucuccgcccccuccgucgccucccgcuucaucgacucccacacccccccccuccgccccauccucaagaagaccgccucccucggcuucugcgucaccuacgucuucuucaucaccucccucaucuaccccgccaucugcaccaacaucgagucccucaacaagggcuccggcucccucuggaccaccaaguucuucaucccccucaccaccuuccuccucuacaacuucgccgaccucugcggccgccagcucaccgccuggauccagguccccggccccaacuccaaggcccuccccggcuucguccuccuccgcaccugccucaucccccucuucguccucugcaacuaccagccccgcguccaccucaagaccgucgucuuccaguccgacgucuaccccgcccuccucuccucccuccucggccucuccaacggcuaccucuccacccucgcccuccucuacggccccaagaucgucccccgcgagcucgccgaggccaccggcgucgucauguccuucuacgucugccucggccucacccucggcuccgccugcuccacccuccucguccaccucaucuga

SEQ ID NO: 49631 - RNA, 1593 nt, Artificial Sequence
  derived and/or modified sequence opt2 from SLC29A4__Homo_sapiens__XP_006715730
augggcuccgucggcucccagcgccucgaggagcccuccgucgccggcacccccgaccccggcgucgucauguccuucaccuucgacucccaccagcucgaggaggccgccgaggccgcccagggccagggccuccgcgcccgcggcguccccgccuucaccgacaccacccucgacgagcccguccccgacgaccgcuaccacgccaucuacuucgccaugcuccucgccggcgucggcuuccuccuccccuacaacuccuucaucaccgacgucgacuaccuccaccacaaguaccccggcaccuccaucgucuucgacaugucccucaccuacauccucgucgcccucgccgccguccuccucaacaacguccucgucgagcgccucacccuccacacccgcaucaccgccggcuaccuccucgcccucggcccccuccucuucaucuccaucugcgacgucuggcuccagcucuucucccgcgaccaggccuacgccaucaaccucgccgccgucggcaccgucgccuucggcugcaccguccagcaguccuccuucuacggcuacaccggcaugcuccccaagcgcuacacccagggcgucaugaccggcgaguccaccgccggcgucaugaucucccucucccgcauccucaccaagcuccuccuccccgacgagcgcgccuccacccucaucuucuuccucgucuccgucgcccucgagcuccucugcuuccuccuccaccuccucguccgccgcucccgcuucguccucuucuacaccacccgcccccgcgacucccaccgcggccgccccggccucggccgcggcuacggcuaccgcguccaccacgacgucgucgccggcgacguccacuucgagcaccccgcccccgcccucgcccccaacgagucccccaaggacucccccgcccacgaggucaccggcuccggcggcgccuacaugcgcuucgacgucccccgcccccgcguccagcgcuccuggcccaccuuccgcgcccuccuccuccaccgcuacgucgucgcccgcgucaucugggccgacaugcucuccaucgccgucaccuacuucaucacccucugccucuuccccggccucgaguccgagauccgccacugcauccucggcgaguggcuccccauccucaucauggccgucuucaaccucuccgacuucgucggcaagauccucgccgcccuccccgucgacuggcgcggcacccaccuccucgccugcuccugccuccgcgucgucuucaucccccucuucauccucugcgucuaccccuccggcaugcccgcccuccgccaccccgccuggcccugcaucuucucccuccucaugggcaucuccaacggcuacuucggcuccguccccaugauccucgccgccggcaaggucucccccaagcagcgcgagcucgccggcaacaccaugaccgucuccuacauguccggccucacccucggcuccgccgucgccuacugcaccuacucccucacccgcgacgcccacggcuccugccuccacgccuccaccgccaacggcuccauccucgccggccucuga

SEQ ID NO: 49632 - RNA, 1626 nt, Artificial Sequence
  derived and/or modified sequence opt2 from SLC2A10__Homo_sapiens__NP_110404
augggccacuccccccccguccucccccucugcgccuccgucucccuccucggcggccucaccuucggcuacgagcucgccgucaucuccggcgcccuccucccccuccagcucgacuucggccucuccugccucgagcaggaguuccucgucggcucccuccuccucggcgcccuccucgccucccucgucggcggcuuccucaucgacugcuacggccgcaagcaggccauccucggcuccaaccucguccuccucgccggcucccucacccucggccucgccggcucccucgccuggcucguccucggccgcgccgucgucggcuucgccaucucccucuccuccauggccugcugcaucuacgucuccgagcucgucggcccccgccagcgcggcguccucgucucccucuacgaggccggcaucaccgucggcauccuccucuccuacgcccucaacuacgcccucgccggcacccccuggggcuggcgccacauguucggcugggccaccgcccccgccguccuccagucccucucccuccucuuccuccccgccggcaccgacgagaccgccacccacaaggaccucaucccccuccagggcggcgaggcccccaagcucggccccggccgcccccgcuacuccuuccucgaccucuuccgcgcccgcgacaacaugcgcggccgcaccaccgucggccucggccucguccucuuccagcagcucaccggccagcccaacguccucugcuacgccuccaccaucuucuccuccgucggcuuccacggcggcuccuccgccguccucgccuccgucggccucggcgccgucaaggucgccgccacccucaccgccaugggccucgucgaccgcgccggccgccgcgcccuccuccucgccggcugcgcccucauggcccucuccgucuccggcaucggccucgucuccuucgccguccccauggacuccggccccuccugccucgccguccccaacgccaccggccagaccggccuccccggcgacuccggccuccuccaggacuccucccucccccccaucccccgcaccaacgaggaccagcgcgagcccauccucuccaccgccaagaagaccaagccccacccccgcuccggcgaccccuccgcccccccccgccucgcccucuccuccgcccuccccggccccccccuccccgcccgcggccacgcccuccuccgcuggaccgcccuccucugccucauggucuucgucuccgccuucuccuucggcuucggccccgucaccuggcucguccucuccgagaucuaccccgucgagauccgcggccgcgccuucgccuucugcaacuccuucaacugggccgccaaccucuucaucucccucuccuuccucgaccucaucggcaccaucggccucuccuggaccuuccuccucuacggccucaccgccguccucggccucggcuucaucuaccucuucguccccgagaccaagggccagucccucgccgagaucgaccagcaguuccagaagcgccgcuucacccucuccuucggccaccgccagaacuccaccggcauccccuacucccgcaucgagaucuccgccgccuccuga

SEQ ID NO: 49633 - RNA, 1491 nt, Artificial Sequence
  derived and/or modified sequence opt2 from SLC2A11__Homo_sapiens__NP_001020109
augcgcgcccuccgccgccucauccagggccgcauccuccuccucaccaucugcgccgccggcaucggcggcaccuuccaguucggcuacaaccucuccaucaucaacgcccccacccuccacauccaggaguucaccaacgagaccuggcaggcccgcaccggcgagccccuccccgaccaccucguccuccucauguggucccucaucgucucccucuacccccucggcggccucuucggcgcccuccucgccggcccccucgccaucacccucggccgcaagaagucccuccucgucaacaacaucuucgucgucuccgccgccauccucuucggcuucucccgcaaggccggcuccuucgagaugaucaugcucggccgccuccucgucggcgucaacgccggcgucuccaugaacauccagcccauguaccucggcgaguccgcccccaaggagcuccgcggcgccgucgccauguccuccgccaucuucaccgcccucggcaucgucaugggccaggucgucggccuccgcgagcuccucggcggcccccaggccuggccccuccuccucgccuccugccucguccccggcgcccuccagcucgccucccucccccuccuccccgaguccccccgcuaccuccucaucgacugcggcgacaccgaggccugccucgccgcccuccgccgccuccgcggcuccggcgaccucgccggcgagcucgaggagcucgaggaggagcgcgccgccugccagggcugccgcgcccgccgccccugggagcucuuccagcaccgcgcccuccgccgccaggucaccucccucgucguccucggcuccgccauggagcucugcggcaacgacuccgucuacgccuacgccuccuccgucuuccgcaaggccggcguccccgaggccaagauccaguacgccaucaucggcaccggcuccugcgagcuccucaccgccgucgucuccugcgucgucaucgagcgcgucggccgccgcguccuccucaucggcggcuacucccucaugaccugcuggggcuccaucuucaccgucgcccucugccuccaguccuccuuccccuggacccucuaccucgccauggccugcaucuucgccuucauccucuccuucggcaucggccccgccggcgucaccggcauccucgccaccgagcucuucgaccagauggcccgccccgccgccugcauggucugcggcgcccucauguggaucaugcucauccucgucggccucggcuuccccuucaucauggaggcccucucccacuuccucuacguccccuuccucggcgucugcgucugcggcgccaucuacaccggccucuuccuccccgagaccaagggcaagaccuuccaggagaucuccaaggagcuccaccgccucaacuucccccgccgcgcccagggccccaccuggcgcucccucgaggucauccaguccaccgagcucuga

SEQ ID NO: 49634 - RNA, 1854 nt, Artificial Sequence
  derived and/or modified sequence opt2 from SLC2A12__Homo_sapiens__NP_660159
augguccccgucgagaacaccgagggccccucccuccucaaccagaagggcaccgccgucgagaccgagggcuccggcucccgccacccccccugggcccgcggcugcggcauguucaccuuccucuccuccgucaccgccgccgucuccggccuccucgucggcuacgagcucggcaucaucuccggcgcccuccuccagaucaagacccuccucgcccucuccugccacgagcaggagauggucgucuccucccucgucaucggcgcccuccucgccucccucaccggcggcguccucaucgaccgcuacggccgccgcaccgccaucauccucuccuccugccuccucggccucggcucccucguccucauccucucccucuccuacaccguccucaucgucggccgcaucgccaucggcgucuccaucucccucuccuccaucgccaccugcgucuacaucgccgagaucgccccccagcaccgccgcggccuccucgucucccucaacgagcucaugaucgucaucggcauccucuccgccuacaucuccaacuacgccuucgccaacgucuuccacggcuggaaguacauguucggccucgucaucccccucggcguccuccaggccaucgccauguacuuccucccccccuccccccgcuuccucgucaugaagggccaggagggcgccgccuccaagguccucggccgccuccgcgcccucuccgacaccaccgaggagcucaccgucaucaaguccucccucaaggacgaguaccaguacuccuucugggaccucuuccgcuccaaggacaacaugcgcacccgcaucaugaucggccucacccucgucuucuucguccagaucaccggccagcccaacauccucuucuacgccuccaccguccucaaguccgucggcuuccaguccaacgaggccgccucccucgccuccaccggcgucggcgucgucaaggucaucuccaccauccccgccacccuccucgucgaccacgucggcuccaagaccuuccucugcaucggcuccuccgucauggccgccucccucgucaccaugggcaucgucaaccucaacauccacaugaacuucacccacaucugccgcucccacaacuccaucaaccagucccucgacgaguccgucaucuacggccccggcaaccucuccaccaacaacaacacccuccgcgaccacuucaagggcaucuccucccacucccgcuccucccucaugccccuccgcaacgacgucgacaagcgcggcgagaccaccuccgccucccuccucaacgccggccucucccacaccgaguaccagaucgucaccgaccccggcgacguccccgccuuccucaaguggcucucccucgccucccuccucgucuacgucgccgccuucuccaucggccucggccccaugcccuggcucguccucuccgagaucuuccccggcggcauccgcggccgcgccauggcccucaccuccuccaugaacuggggcaucaaccuccucaucucccucaccuuccucaccgucaccgaccucaucggccuccccugggucugcuucaucuacaccaucaugucccucgccucccuccucuucgucgucauguucauccccgagaccaagggcugcucccucgagcagaucuccauggagcucgccaaggucaacuacgucaagaacaacaucugcuucaugucccaccaccaggaggagcucguccccaagcagccccagaagcgcaagccccaggagcagcuccucgagugcaacaagcucugcggccgcggccagucccgccagcucucccccgagaccuga

SEQ ID NO: 49635 - RNA, 1947 nt, Artificial Sequence
  derived and/or modified sequence opt2 from SLC2A13__Homo_sapiens__NP_443117
augucccgcaaggccuccgagaacgucgaguacacccuccgcucccucuccucccucaugggcgagcgccgccgcaagcagcccgagcccgacgccgccuccgccgccggcgagugcucccuccucgccgccgccgaguccuccaccucccuccaguccgccggcgccggcggcggcggcgucggcgaccucgagcgcgccgcccgccgccaguuccagcaggacgagacccccgccuucgucuacgucgucgccgucuucuccgcccucggcggcuuccucuucggcuacgacaccggcgucgucuccggcgccaugcuccuccucaagcgccagcucucccucgacgcccucuggcaggagcuccucgucuccuccaccgucggcgccgccgccgucuccgcccucgccggcggcgcccucaacggcgucuucggccgccgcgccgccauccuccucgccuccgcccucuucaccgccggcuccgccguccucgccgccgccaacaacaaggagacccuccucgccggccgccucgucgucggccucggcaucggcaucgccuccaugaccguccccgucuacaucgccgaggucuccccccccaaccuccgcggccgccucgucaccaucaacacccucuucaucaccggcggccaguucuucgccuccgucgucgacggcgccuucuccuaccuccagaaggacggcuggcgcuacaugcucggccucgccgccguccccgccgucauccaguucuucggcuuccucuuccuccccgaguccccccgcuggcucauccagaagggccagacccagaaggcccgccgcauccucucccagaugcgcggcaaccagaccaucgacgaggaguacgacuccaucaagaacaacaucgaggaggaggagaaggaggucggcuccgccggccccgucaucugccgcaugcucuccuacccccccacccgccgcgcccucaucgucggcugcggccuccagauguuccagcagcucuccggcaucaacaccaucauguacuacuccgccaccauccuccagauguccggcgucgaggacgaccgccucgccaucuggcucgccuccgucaccgccuucaccaacuucaucuucacccucgucggcgucuggcucgucgagaaggucggccgccgcaagcucaccuucggcucccucgccggcaccaccgucgcccucaucauccucgcccucggcuucguccucuccgcccaggucuccccccgcaucaccuucaagcccaucgcccccuccggccagaacgccaccugcacccgcuacuccuacugcaacgagugcaugcucgaccccgacugcggcuucugcuacaagaugaacaaguccaccgucaucgacuccuccugcguccccgucaacaaggccuccaccaacgaggccgccuggggccgcugcgagaacgagaccaaguucaagaccgaggacaucuucugggccuacaacuucugccccacccccuacuccuggaccgcccuccucggccucauccucuaccucgucuucuucgcccccggcaugggccccaugcccuggaccgucaacuccgagaucuacccccucugggcccgcuccaccggcaacgccugcuccuccggcaucaacuggaucuucaacguccucgucucccucaccuuccuccacaccgccgaguaccucaccuacuacggcgccuucuuccucuacgccggcuucgccgccgucggccuccucuucaucuacggcugccuccccgagaccaagggcaagaagcucgaggagaucgagucccucuucgacaaccgccucugcaccugcggcaccuccgacuccgacgagggccgcuacaucgaguacauccgcgucaagggcuccaacuaccaccucuccgacaacgacgccuccgacgucgaguga

SEQ ID NO: 49636 - RNA, 1494 nt, Artificial Sequence
  derived and/or modified sequence opt2 from SLC2A14__Homo_sapiens__NP_001273163
auggacaaccgccagaacgucacccccgcccucaucuucgccaucaccgucgccaccaucggcuccuuccaguucggcuacaacaccggcgucaucaacgcccccgagaccaucaucaaggaguucaucaacaagacccucaccgacaaggccaacgccccccccuccgagguccuccucaccaaccucuggucccucuccgucgccaucuucuccgucggcggcaugaucggcuccuucuccgucggccucuucgucaaccgcuucggccgccgcaacuccaugcucaucgucaaccuccucgccgccaccggcggcugccucaugggccucugcaagaucgccgaguccgucgagaugcucauccucggccgccucgucaucggccucuucugcggccucugcaccggcuucguccccauguacaucggcgagaucucccccaccgcccuccgcggcgccuucggcacccucaaccagcucggcaucgucaucggcauccucgucgcccagaucuucggccucgagcucauccucggcuccgaggagcucuggcccguccuccucggcuucaccauccuccccgccauccuccaguccgccgcccuccccugcugccccgaguccccccgcuuccuccucaucaaccgcaagaaggaggagaacgccacccgcauccuccagcgccucuggggcacccaggacgucucccaggacauccaggagaugaaggacgaguccgcccgcaugucccaggagaagcaggucaccguccucgagcucuuccgcgucuccuccuaccgccagcccaucaucaucuccaucguccuccagcucucccagcagcucuccggcaucaacgccgucuucuacuacuccaccggcaucuucaaggacgccggcguccagcagcccaucuacgccaccaucuccgccggcgucgucaacaccaucuucacccuccucucccucuuccucgucgagcgcgccggccgccgcacccuccacaugaucggccucggcggcauggccuucugcuccacccucaugaccgucucccuccuccucaagaaccacuacaacggcauguccuucgucugcaucggcgccauccucgucuucgucgccugcuucgagaucggccccggccccauccccugguucaucgucgccgagcucuucucccagggcccccgccccgccgccauggccgucgccggcugcuccaacuggaccuccaacuuccucgucggccuccucuuccccuccgccgccuacuaccucggcgccuacgucuucaucaucuucaccggcuuccucaucaccuuccucgccuucaccuucuucaagguccccgagacccgcggccgcaccuucgaggacaucacccgcgccuucgagggccaggcccacggcgccgaccgcuccggcaaggacggcgucaugggcaugaacuccaucgagcccgccaaggagaccaccaccaacgucuga

SEQ ID NO: 49637 - RNA, 1575 nt, Artificial Sequence
  derived and/or modified sequence opt2 from SLC2A2__Homo_sapiens__NP_000331
augaccgaggacaaggucaccggcacccucgucuucaccgucaucaccgccguccucggcuccuuccaguucggcuacgacaucggcgucaucaacgccccccagcaggucaucaucucccacuaccgccacguccucggcgucccccucgacgaccgcaaggccaucaacaacuacgucaucaacuccaccgacgagcuccccaccaucuccuacuccaugaaccccaagcccacccccugggccgaggaggagaccgucgccgccgcccagcucaucaccaugcucuggucccucuccgucuccuccuucgccgucggcggcaugaccgccuccuucuucggcggcuggcucggcgacacccucggccgcaucaaggccaugcucgucgccaacauccucucccucgucggcgcccuccucaugggcuucuccaagcucggccccucccacauccucaucaucgccggccgcuccaucuccggccucuacugcggccucaucuccggccucguccccauguacaucggcgagaucgcccccaccgcccuccgcggcgcccucggcaccuuccaccagcucgccaucgucaccggcauccucaucucccagaucaucggccucgaguucauccucggcaacuacgaccucuggcacauccuccucggccucuccggcguccgcgccauccuccagucccuccuccucuucuucugccccgaguccccccgcuaccucuacaucaagcucgacgaggaggucaaggccaagcagucccucaagcgccuccgcggcuacgacgacgucaccaaggacaucaacgagaugcgcaaggagcgcgaggaggccuccuccgagcagaaggucuccaucauccagcucuucaccaacuccuccuaccgccagcccauccucgucgcccucaugcuccacgucgcccagcaguucuccggcaucaacggcaucuucuacuacuccaccuccaucuuccagaccgccggcaucuccaagcccgucuacgccaccaucggcgucggcgccgucaacauggucuucaccgccgucuccgucuuccucgucgagaaggccggccgccgcucccucuuccucaucggcauguccggcauguucgucugcgccaucuucauguccgucggccucguccuccucaacaaguucuccuggauguccuacgucuccaugaucgccaucuuccucuucgucuccuucuucgagaucggccccggccccauccccugguucauggucgccgaguucuucucccagggcccccgccccgccgcccucgccaucgccgccuucuccaacuggaccugcaacuucaucgucgcccucugcuuccaguacaucgccgacuucugcggccccuacgucuucuuccucuucgccggcguccuccucgccuucacccucuucaccuucuucaagguccccgagaccaagggcaaguccuucgaggagaucgccgccgaguuccagaagaaguccggcuccgcccaccgccccaaggccgccgucgagaugaaguuccucggcgccaccgagaccgucuga

SEQ ID NO: 49638 - RNA, 1491 nt, Artificial Sequence
  derived and/or modified sequence opt2 from SLC2A3__Homo_sapiens__NP_008862
augggcacccagaaggucacccccgcccucaucuucgccaucaccgucgccaccaucggcuccuuccaguucggcuacaacaccggcgucaucaacgcccccgagaagaucaucaaggaguucaucaacaagacccucaccgacaagggcaacgccccccccuccgagguccuccucaccucccucuggucccucuccgucgccaucuucuccgucggcggcaugaucggcuccuucuccgucggccucuucgucaaccgcuucggccgccgcaacuccaugcucaucgucaaccuccucgccgucaccggcggcugcuucaugggccucugcaaggucgccaaguccgucgagaugcucauccucggccgccucgucaucggccucuucugcggccucugcaccggcuucguccccauguacaucggcgagaucucccccaccgcccuccgcggcgccuucggcacccucaaccagcucggcaucgucgucggcauccucgucgcccagaucuucggccucgaguucauccucggcuccgaggagcucuggccccuccuccucggcuucaccauccuccccgccauccuccaguccgccgcccuccccuucugccccgaguccccccgcuuccuccucaucaaccgcaaggaggaggagaacgccaagcagauccuccagcgccucuggggcacccaggacgucucccaggacauccaggagaugaaggacgaguccgcccgcaugucccaggagaagcaggucaccguccucgagcucuuccgcgucuccuccuaccgccagcccaucaucaucuccaucguccuccagcucucccagcagcucuccggcaucaacgccgucuucuacuacuccaccggcaucuucaaggacgccggcguccaggagcccaucuacgccaccaucggcgccggcgucgucaacaccaucuucaccgucgucucccucuuccucgucgagcgcgccggccgccgcacccuccacaugaucggccucggcggcauggccuucugcuccacccucaugaccgucucccuccuccucaaggacaacuacaacggcauguccuucgucugcaucggcgccauccucgucuucgucgccuucuucgagaucggccccggccccauccccugguucaucgucgccgagcucuucucccagggcccccgccccgccgccauggccgucgccggcugcuccaacuggaccuccaacuuccucgucggccuccucuuccccuccgccgcccacuaccucggcgccuacgucuucaucaucuucaccggcuuccucaucaccuuccucgccuucaccuucuucaagguccccgagacccgcggccgcaccuucgaggacaucacccgcgccuucgagggccaggcccacggcgccgaccgcuccggcaaggacggcgucauggagaugaacuccaucgagcccgccaaggagaccaccaccaacgucuga

SEQ ID NO: 49639 - RNA, 1164 nt, Artificial Sequence
  derived and/or modified sequence opt2 from SLC2A4RG__Homo_sapiens__NP_064446
auggagcgcccccccccccgcgccgccggccgcgaccccuccgcccuccgcgccgaggcccccuggcuccgcgccgagggccccggcccccgcgccgcccccgucaccguccccacccccccccagggcuccuccgucggcggcggcuucgccggccucgaguucgcccgcccccaggaguccgagccccgcgccuccgaccucggcgccccccgcaccuggaccggcgccgccgccggcccccgcacccccuccgcccacauccccguccccgcccagcgcgccacccccggcaaggcccgccucgacgaggucauggccgccgccgcccucaccucccucuccaccuccccccuccuccucggcgcccccgucgccgccuucucccccgagcccggccucgagcccuggaaggaggcccucguccgcccccccggcuccuacuccuccuccuccaacuccggcgacuggggcugggaccucgccuccgaccaguccucccccuccacccccucccccccccucccccccgaggccgcccacuuccucuucggcgagcccacccuccgcaagcgcaagucccccgcccaggucauguuccagugccucuggaaguccugcggcaagguccucuccaccgccuccgccaugcagcgccacauccgccucguccaccucggccgccaggccgagcccgagcaguccgacggcgaggaggacuucuacuacaccgagcucgacgucggcgucgacacccucaccgacggccucuccucccucacccccgucucccccaccgccuccaugccccccgccuucccccgccucgagcuccccgagcuccucgagccccccgcccuccccuccccccuccgcccccccgcccccccccucccccccccccccguccucuccaccgucgccaacccccaguccugccacuccgaccgcgucuaccagggcugccucacccccgcccgccucgagccccagcccaccgaggucggcgccugcccccccgcccucuccucccgcaucggcgucacccuccgcaagccccgcggcgacgccaagaagugccgcaaggucuacggcauggagcgccgcgaccucuggugcaccgccugccgcuggaagaaggccugccagcgcuuccucgacuga

SEQ ID NO: 49640 - RNA, 1476 nt, Artificial Sequence
  derived and/or modified sequence opt2 from SLC2A5__Homo_sapiens__XP_011540307
augcgccucacccucguccucgcccucgccacccucaucgccgccuucggcuccuccuuccaguacggcuacaacgucgccgccgucaacucccccgcccuccucaugcagcaguucuacaacgagaccuacuacggccgcaccggcgaguucauggaggacuucccccucacccuccucugguccgucaccgucuccauguuccccuucggcggcuucaucggcucccuccucgucggcccccucgucaacaaguucggccgcaagggcgcccuccucuucaacaacaucuucuccaucguccccgccauccucaugggcugcucccgcgucgccaccuccuucgagcucaucaucaucucccgccuccucgucggcaucugcgccggcgucuccuccaacgucguccccauguaccucggcgagcucgcccccaagaaccuccgcggcgcccucggcgucgucccccagcucuucaucaccgucggcauccucgucgcccagaucuucggccuccgcaaccuccucgccaacgucgacggcuggcccauccuccucggccucaccggcguccccgccgcccuccagcuccuccuccuccccuucuuccccgaguccccccgcuaccuccucauccagaagaaggacgaggccgccgccaagaaggcccuccagacccuccgcggcugggacuccgucgaccgcgaggucgccgagauccgccaggaggacgaggccgagaaggccgccggcuucaucuccguccucaagcucuuccgcaugcgcucccuccgcuggcagcuccucuccaucaucguccucaugggcggccagcagcucuccggcgucaacgccaucuacuacuacgccgaccagaucuaccucuccgccggcguccccgaggagcacguccaguacgucaccgccggcaccggcgccgucaacgucgucaugaccuucugcgccgucuucgucgucgagcuccucggccgccgccuccuccuccuccucggcuucuccaucugccucaucgccugcugcguccucaccgccgcccucgcccuccaggacaccgucuccuggaugcccuacaucuccaucgucugcgucaucuccuacgucaucggccacgcccucggccccucccccauccccgcccuccucaucaccgagaucuuccuccaguccucccgccccuccgccuucauggucggcggcuccguccacuggcucuccaacuucaccgucggccucaucuuccccuucauccaggagggccucggccccuacuccuucaucgucuucgccgucaucugccuccucaccaccaucuacaucuuccucaucguccccgagaccaaggccaagaccuucaucgagaucaaccagaucuucaccaagaugaacaaggucuccgaggucuaccccgagaaggaggagcucaaggagcucccccccgucaccuccgagcaguga

SEQ ID NO: 49641 - RNA, 1338 nt, Artificial Sequence
  derived and/or modified sequence opt2 from SLC2A6__Homo_sapiens__NP_001138571
augcaggagccccuccucggcgccgagggccccgacuacgacaccuuccccgagaagcccccccccucccccggcgaccgcgcccgcgucggcacccuccagaacaagcgcgucuuccucgccaccuucgccgccguccucggcaacuucuccuucggcuacgcccucgucuacaccucccccgucauccccgcccucgagcgcucccucgaccccgaccuccaccucaccaagucccaggccuccugguucggcuccgucuucacccucggcgccgccgccggcggccucuccgccaugauccucaacgaccuccucggccgcaagcucuccaucauguucuccgccguccccuccgccgccggcuacgcccucauggccggcgcccacggccucuggaugcuccuccucggccgcacccucaccggcuucgccggcggccucaccgccgccugcauccccgucuacgucuccgagaucgccccccccggcguccgcggcgcccucggcgccaccccccagcucauggccgucuucggcucccucucccucuacgcccucggccuccuccuccccuggcgcuggcucgccgucgccggcgaggcccccguccucaucaugauccuccuccucuccuucaugcccaacuccccccgcuuccuccucucccgcggccgcgacgaggaggcccuccgcgcccucgccuggcuccgcggcaccgacgucgacguccacugggaguucgagcagauccaggacaacguccgccgccaguccucccgcgucuccugggccgaggcccgcgccccccacgucugccgccccaucaccgucgcccuccucaugcgccuccuccagcagcucaccggcaucacccccauccucgucuaccuccaguccaucuucgacuccaccgccguccuccucccccccaaggacgacgccgccaucgucggcgccguccgccuccucuccguccucaucgccgcccucaccauggaccucgccggccgcaagguccuccucuucgucuccggcuacgccgucggcuggggccccaucaccuggcuccucauguccgagguccucccccuccgcgcccgcggcgucgccuccggccucugcguccucgccuccuggcucaccgccuucguccucaccaaguccuuccuccccgucgucuccaccuucggccuccagguccccuucuucuucuucgccgccaucugccucgucucccucgucuucaccggcugcugcguccccgagaccaagggccgcucccucgagcagaucgaguccuucuuccgcaccggccgccgcuccuuccuccgcuga

SEQ ID NO: 49642 - RNA, 1236 nt, Artificial Sequence
  derived and/or modified sequence opt2 from SLC2A8__Homo_sapiens__NP_001258640
augacccccgaggaccccgaggagacccagccccuccucggcccccccggcggcuccgccccccgcggccgccgcgucuuccucgccgccuucgccgccgcccucggcccccucuccuucggcuucgcccucggcuacuccucccccgccauccccucccuccagcgcgccgccccccccgccccccgccucgacgacgccgccgccuccugguucggcgccgucgucacccucggcgccgccgccggcggcguccucggcggcuggcucgucgaccgcgccggccgcaagcucucccuccuccucugcuccguccccuucgucgccggcuucgccgucaucaccgccgcccaggacgucuggaugcuccucggcggccgccuccucaccggccucgccugcggcgucgccucccucgucgcccccgucuacaucuccgagaucgccuaccccgccguccgcggccuccucggcuccugcguccagcucauggucgucgucggcauccuccucgccuaccucgccggcuggguccucgaguggcgcuggcucgccguccucggcugcgucccccccucccucaugcuccuccucaugugcuucaugcccgagaccccccgcuuccuccucacccagcaccgccgccaggaggccauggccgcccuccgcuuccucuggggcuccgagcagggcugggaggacccccccaucggcgccgagcaguccuuccaccucgcccuccuccgccagcccggcaucuacaagcccuucaucaucggcgucucccucauggccuuccagcagcucuccggcgucaacgccgucauguucuacgccgagaccaucuucgaggaggccaaguucaaggacuccucccucgccuccgucgucgucggcgucauccagguccucuucaccgccgucgccgcccucaucauggaccgcgccggccgccgccuccuccucguccucuccggcgucgucauggucuucuccaccuccgccuucggcgccuacuucaagcucacccagggcggccccggcaacuccucccacgucgccaucuccgcccccgucuccgcccagcccgucgacgccuccgucggccucgccuggcucgccgucggcuccaugugccucuucaucgccggcggcccccaggcccucuggucccuccucgccugccuccgcuuccuccaccuccagugccccuuccacuucguccucugccccuga

SEQ ID NO: 49643 - RNA, 1536 nt, Artificial Sequence
  derived and/or modified sequence opt2 from SLC2A9__Homo_sapiens__NP_001001290
augaagcucuccaagaaggaccgcggcgaggacgaggaguccgacuccgccaagaagaagcucgacugguccugcucccuccucgucgccucccucgccggcgccuucggcuccuccuuccucuacggcuacaaccucuccgucgucaacgcccccacccccuacaucaaggccuucuacaacgaguccugggagcgccgccacggccgccccaucgaccccgacacccucacccuccucugguccgucaccgucuccaucuucgccaucggcggccucgucggcacccucaucgucaagaugaucggcaagguccucggccgcaagcacacccuccucgccaacaacggcuucgccaucuccgccgcccuccucauggccugcucccuccaggccggcgccuucgagaugcucaucgucggccgcuucaucaugggcaucgacggcggcgucgcccucuccguccuccccauguaccucuccgagaucucccccaaggagauccgcggcucccucggccaggucaccgccaucuucaucugcaucggcgucuucaccggccagcuccucggccuccccgagcuccucggcaaggaguccaccuggcccuaccucuucggcgucaucgucguccccgccgucguccagcuccucucccuccccuuccuccccgacuccccccgcuaccuccuccucgagaagcacaacgaggcccgcgccgucaaggccuuccagaccuuccucggcaaggccgacgucucccaggaggucgaggagguccucgccgagucccgcguccagcgcuccauccgccucgucuccguccucgagcuccuccgcgcccccuacguccgcuggcaggucgucaccgucaucgucaccauggccugcuaccagcucugcggccucaacgccaucugguucuacaccaacuccaucuucggcaaggccggcaucccccccgccaagauccccuacgucacccucuccaccggcggcaucgagacccucgccgccgucuucuccggccucgucaucgagcaccucggccgccgcccccuccucaucggcggcuucggccucaugggccucuucuucggcacccucaccaucacccucacccuccaggaccacgcccccuggguccccuaccucuccaucgucggcauccucgccaucaucgccuccuucugcuccggccccggcggcauccccuucauccucaccggcgaguucuuccagcagucccagcgccccgccgccuucaucaucgccggcaccgucaacuggcucuccaacuucgccgucggccuccucuuccccuucauccagaagucccucgacaccuacugcuuccucgucuucgccaccaucugcaucaccggcgccaucuaccucuacuucguccuccccgagaccaagaaccgcaccuacgccgagaucucccaggccuucuccaagcgcaacaaggccuacccccccgaggagaagaucgacuccgccgucaccgacggcaagaucaacggccgccccuga

SEQ ID NO: 49644 - RNA, 1458 nt, Artificial Sequence
  derived and/or modified sequence opt2 from SLC30A10__Homo_sapiens__NP_061183
augggccgcuacuccggcaagaccugccgccuccucuucaugcucguccucaccgucgccuucuucgucgccgagcucgucuccggcuaccucggcaacuccaucgcccuccucuccgacuccuucaacaugcucuccgaccucaucucccucugcgucggccucuccgccggcuacaucgcccgccgccccacccgcggcuucuccgccaccuacggcuacgcccgcgccgaggucgucggcgcccucuccaacgccgucuuccucaccgcccucugcuucaccaucuucgucgaggccguccuccgccucgcccgccccgagcgcaucgacgaccccgagcucguccucaucgucggcguccucggccuccucgucaacgucgucggccuccucaucuuccaggacugcgccgccugguucgccugcugccuccgcggccgcucccgccgccuccagcagcgccagcagcucgccgagggcugcguccccggcgccuucggcggcccccagggcgccgaggacccccgccgcgccgccgaccccaccgcccccggcuccgacuccgccgucacccuccgcggcaccuccgucgagcgcaagcgcgagaagggcgccaccgucuucgccaacgucgccggcgacuccuucaacacccagaacgagcccgaggacaugaugaagaaggagaagaaguccgaggcccucaacauccgcggcguccuccuccacgucaugggcgacgcccucggcuccgucgucgucgucaucaccgccaucaucuucuacguccucccccucaaguccgaggaccccugcaacuggcagugcuacaucgaccccucccucaccguccucauggucaucaucauccucuccuccgccuucccccucaucaaggagaccgccgccauccuccuccagaugguccccaagggcgucaacauggaggagcucauguccaagcucuccgccguccccggcaucuccuccguccacgagguccacaucugggagcucgucuccggcaagaucaucgccacccuccacaucaaguaccccaaggaccgcggcuaccaggacgccuccaccaagauccgcgagaucuuccaccacgccggcauccacaacgucaccauccaguucgagaacgucgaccucaaggagccccucgagcagaaggaccuccuccuccucugcaacucccccugcaucuccaagggcugcgccaagcagcucugcugcccccccggcgcccucccccucgcccacgucaacggcugcgccgagcacaacggcggccccucccucgacaccuacggcuccgacggccucucccgccgcgacgcccgcgaggucgccaucgaggucucccucgacuccugccucuccgaccacggccagucccucaacaagacccaggaggaccagugcuacgucaaccgcacccacuucuga

SEQ ID NO: 49645 - RNA, 1524 nt, Artificial Sequence
  derived and/or modified sequence opt2 from SLC30A1__Homo_sapiens__NP_067017
augggcugcuggggccgcaaccgcggccgccuccucugcaugcucgcccucaccuucauguucaugguccucgaggucgucgucucccgcgucaccuccucccucgccaugcucuccgacuccuuccacaugcucuccgacguccucgcccucgucgucgcccucgucgccgagcgcuucgcccgccgcacccacgccacccagaagaacaccuucggcuggauccgcgccgaggucaugggcgcccucgucaacgccaucuuccucaccggccucugcuucgccauccuccucgaggccaucgagcgcuucaucgagccccacgagaugcagcagccccucgucguccucggcgucggcgucgccggccuccucgucaacguccucggccucugccucuuccaccaccacuccggcuucucccaggacuccggccacggccacucccacggcggccacggccacggccacggccuccccaagggcccccgcgucaaguccacccgccccggcuccuccgacaucaacgucgcccccggcgagcagggccccgaccaggaggagaccaacacccucgucgccaacaccuccaacuccaacggccucaagcucgaccccgccgaccccgagaacccccgcuccggcgacaccgucgagguccaggucaacggcaaccucguccgcgagcccgaccacauggagcucgaggaggaccgcgccggccagcucaacaugcgcggcgucuuccuccacguccucggcgacgcccucggcuccgucaucgucgucgucaacgcccucgucuucuacuucuccuggaagggcugcuccgagggcgacuucugcgucaaccccugcuuccccgaccccugcaaggccuucgucgagaucaucaacuccacccacgccuccgucuacgaggccggccccugcuggguccucuaccucgaccccacccucugcgucgucauggucugcauccuccucuacaccaccuacccccuccucaaggaguccgcccucauccuccuccagaccguccccaagcagaucgacauccgcaaccucaucaaggagcuccgcaacgucgagggcgucgaggagguccacgagcuccacgucuggcagcucgccggcucccgcaucaucgccaccgcccacaucaagugcgaggaccccaccuccuacauggaggucgccaagaccaucaaggacgucuuccacaaccacggcauccacgccaccaccauccagcccgaguucgccuccgucggcuccaaguccuccgucguccccugcgagcucgccugccgcacccagugcgcccucaagcagugcugcggcacccucccccaggcccccuccggcaaggacgccgagaagacccccgccgucuccaucuccugccucgagcucuccaacaaccucgagaagaagccccgccgcaccaaggccgagaacauccccgccgucgucaucgagaucaagaacaugcccaacaagcagcccgaguccucccucuga

SEQ ID NO: 49646 - RNA, 1167 nt, Artificial Sequence
  derived and/or modified sequence opt2 from SLC30A3__Homo_sapiens__NP_003450
auggagcccucccccgccgccggcggccucgagaccacccgccucgucuccccccgcgaccgcggcggcgccggcggcucccuccgccucaagucccucuucaccgagcccuccgagccccuccccgaggaguccaagcccgucgagaugcccuuccaccacugccaccgcgacccccuccccccccccggccucacccccgagcgccuccacgcccgccgccagcucuacgccgccugcgccgucugcuucgucuucauggccggcgaggucgucggcggcuaccucgcccacucccucgccaucaugaccgacgccgcccaccuccucgccgacgucggcuccaugaugggcucccucuucucccucuggcucuccacccgccccgccacccgcaccaugaccuucggcuggcaccgcuccgagacccucggcgcccucgccuccgucgucucccucuggauggucaccggcauccuccucuaccucgccuucguccgccuccuccacuccgacuaccacaucgagggcggcgccaugcuccucaccgccuccaucgccgucugcgccaaccuccucauggccuucguccuccaccaggccggccccccccacucccacggcucccgcggcgccgaguacgccccccucgaggagggccccgaggagccccucccccucggcaacaccuccguccgcgccgccuucguccacguccucggcgaccuccuccaguccuucggcguccucgccgccuccauccucaucuacuucaagccccaguacaaggccgccgaccccaucuccaccuuccucuucuccaucugcgcccucggcuccaccgcccccacccuccgcgacguccuccgcauccucauggagggcaccccccgcaacgucggcuucgagcccguccgcgacacccuccucuccguccccggcguccgcgccacccacgagcuccaccucugggcccucacccucaccuaccacgucgccuccgcccaccucgccaucgacuccaccgccgaccccgaggccguccucgccgaggccuccucccgccucuacucccgcuucggcuucuccuccugcacccuccaggucgagcaguaccagcccgagauggcccagugccuccgcugccaggagcccccccaggccuga

SEQ ID NO: 49647 - RNA, 1290 nt, Artificial Sequence
  derived and/or modified sequence opt2 from SLC30A4__Homo_sapiens__XP_011520299
auggccggcuccggcgccuggaagcgccucaaguccaugcuccgcaaggacgacgccccccucuuccucaacgacaccuccgccuucgacuucuccgacgaggccggcgacgagggccucucccgcuucaacaagcuccgcgucgucgucgccgacgacggcuccgaggcccccgagcgccccgucaacggcgcccaccccacccuccaggccgacgacgacucccuccucgaccaggaccucccccucaccaacucccagcucucccucaaggucgacuccugcgacaacugcuccaagcagcgcgagauccucaagcagcgcaaggucaaggcccgccucaccaucgccgccguccucuaccuccucuucaugaucggcgagcucgucggcggcuacaucgccaacucccucgccaucaugaccgacgcccuccacaugcucaccgaccucuccgccaucauccucacccuccucgcccucuggcucuccuccaagucccccaccaagcgcuucaccuucggcuuccaccgccucgagguccucuccgccaugaucuccguccuccucgucuacauccucaugggcuuccuccucuacgaggccguccagcgcaccauccacaugaacuacgagaucaacggcgacaucaugcucaucaccgccgccgucggcgucgccgucaacgucaucaugggcuuccuccucaaccaguccggccaccgccacucccacucccacucccuccccuccaacucccccacccgcggcuccggcugcgagcgcaaccacggccaggacucccucgccguccgcgccgccuucguccacgcccucggcgaccucguccaguccgucggcguccucaucgccgccuacaucauccgcuucaagcccgaguacaagaucgccgaccccaucugcaccuacgucuucucccuccucgucgccuucaccaccuuccgcaucaucugggacaccgucgucaucauccucgagggcguccccucccaccucaacgucgacuacaucaaggaggcccucaugaagaucgaggacgucuacuccgucgaggaccucaacaucuggucccucaccuccggcaaguccaccgccaucguccacauccagcucauccccggcuccuccuccaagugggaggagguccaguccaaggccaaccaccuccuccucaacaccuucggcauguaccgcugcaccauccagcuccaguccuaccgccaggaggucgaccgcaccugcgccaacugccaguccuccucccccuga

SEQ ID NO: 49648 - RNA, 2298 nt, Artificial Sequence
  derived and/or modified sequence opt2 from SLC30A5__Homo_sapiens__NP_075053
auggaggagaaguacggcggcgacguccucgccggccccggcggcggcggcggccucggccccgucgacguccccuccgcccgccucaccaaguacaucguccuccucugcuucaccaaguuccucaaggccgucggccucuucgaguccuacgaccuccucaaggccguccacaucguccaguucaucuucauccucaagcucggcaccgccuucuucaugguccucuuccagaagcccuucuccuccggcaagaccaucaccaagcaccaguggaucaagaucuucaagcacgccgucgccggcugcaucaucucccuccucugguucuucggccucacccucugcggcccccuccgcacccuccuccucuucgagcacuccgacaucgucgucaucucccuccucuccguccucuucaccuccuccggcggcggccccgccaagacccgcggcgccgccuucuucaucaucgccgucaucugccuccuccucuucgacaacgacgaccucauggccaagauggccgagcaccccgagggccaccacgacuccgcccucacccacaugcucuacaccgccaucgccuuccucggcgucgccgaccacaagggcggcguccuccuccucguccucgcccucugcugcaaggucggcuuccacaccgccucccgcaagcucuccgucgacgucggcggcgccaagcgccuccaggcccucucccaccucgucuccguccuccuccucugccccugggucaucguccucuccgucaccaccgaguccaaggucgaguccugguucucccucaucaugcccuucgccaccgucaucuucuucgucaugauccucgacuucuacgucgacuccaucugcuccgucaagauggaggucuccaagugcgcccgcuacggcuccuuccccaucuucaucuccgcccuccucuucggcaacuucuggacccaccccaucaccgaccagcuccgcgccaugaacaaggccgcccaccaggaguccaccgagcacguccucuccggcggcgucgucgucuccgccaucuucuucauccucuccgccaacauccucuccucccccuccaagcgcggccagaagggcacccucaucggcuacucccccgagggcaccccccucuacaacuucaugggcgacgccuuccagcacuccucccaguccaucccccgcuucaucaaggagucccucaagcagauccucgaggaguccgacucccgccagaucuucuacuuccucugccucaaccuccucuucaccuucgucgagcucuucuacggcguccucaccaacucccucggccucaucuccgacggcuuccacaugcucuucgacugcuccgcccucgucaugggccucuucgccgcccucaugucccgcuggaaggccacccgcaucuucuccuacggcuacggccgcaucgagauccucuccggcuucaucaacggccucuuccucaucgucaucgccuucuucgucuucauggaguccgucgcccgccucaucgacccccccgagcucgacacccacaugcucacccccgucuccgucggcggccucaucgucaaccucaucggcaucugcgccuucucccacgcccacucccacgcccacggcgccucccagggcuccugccacuccuccgaccacucccacucccaccacaugcacggccacuccgaccacggccacggccacucccacggcuccgccggcggcggcaugaacgccaacaugcgcggcgucuuccuccacguccucgccgacacccucggcuccaucggcgucaucgucuccaccguccucaucgagcaguucggcugguucaucgccgacccccucugcucccucuucaucgccauccucaucuuccucuccgucgucccccucaucaaggacgccugccagguccuccuccuccgccucccccccgaguacgagaaggagcuccacaucgcccucgagaagauccagaagaucgagggccucaucuccuaccgcgacccccacuucuggcgccacuccgccuccaucgucgccggcaccauccacauccaggucaccuccgacguccucgagcagcgcaucguccagcaggucaccggcauccucaaggacgccggcgucaacaaccucaccauccaggucgagaaggaggccuacuuccagcacauguccggccucuccaccggcuuccacgacguccucgccaugaccaagcagauggaguccaugaaguacugcaaggacggcaccuacaucauguga

SEQ ID NO: 49649 - RNA, 1506 nt, Artificial Sequence
  derived and/or modified sequence opt2 from SLC30A6__Homo_sapiens__NP_001180442
augggcaccauccaccucuuccgcaagccccagcgcuccuucuucggcaagcuccuccgcgaguuccgccucgucgccgccgaccgccgcuccuggaagauccuccucuucggcgucaucaaccucaucugcaccggcuuccuccucauguggugcuccuccaccaacuccaucgcccucaccgccuacaccuaccucaccaucuucgaccucuuccgcgacggcgucucccccuucuggcucggcuggucccagacccccgaccucaagugguccacccaccucggccuccccaagugcugggacaaccgccgcgagcuccccugccucuccaacucccucaugaccugccucaucuccuacugggucacccuccgcaagcccucccccgucuacuccuucggcuucgagcgccucgagguccucgccgucuucgccuccaccguccucgcccagcucggcgcccucuucauccucaaggaguccgccgagcgcuuccucgagcagcccgagauccacaccggccgccuccucgucggcaccuucgucgcccucugcuucaaccucuucaccaugcucuccauccgcaacaagcccuucgccuacgucuccgaggccgccuccaccuccuggcuccaggagcacgucgccgaccucucccgcucccucugcggcaucauccccggccucuccuccaucuuccucccccgcaugaaccccuucguccucaucgaccucgccggcgccuucgcccucugcaucaccuacaugcucaucgagaucaacaacuacuucgccgucgacaccgccuccgccaucgccaucgcccucaugaccuucggcaccauguaccccauguccgucuacuccggcaagguccuccuccagaccacccccccccacgucaucggccagcucgacaagcucauccgcgaggucuccacccucgacggcguccucgagguccgcaacgagcacuucuggacccucggcuucggcucccucgccggcuccguccacguccgcauccgccgcgacgccaacgagcagaugguccucgcccacgucaccaaccgccucuacacccucgucuccacccucaccguccagaucuucaaggacgacuggauccgccccgcccuccucuccggccccgucgccgccaacguccucaacuucuccgaccaccacgucauccccaugccccuccucaagggcaccgacgaccucaaccccgucaccuccacccccgccaagcccuccucccccccccccgaguucuccuucaacacccccggcaagaacgucaaccccgucauccuccucaacacccagacccgccccuacggcuucggccucaaccacggccacacccccuacuccuccaugcucaaccagggccucggcguccccggcaucggcgccacccagggccuccgcaccggcuucaccaacauccccucccgcuacggcaccaacaaccgcaucggccagccccgccccuga

SEQ ID NO: 49650 - RNA, 921 nt, Artificial Sequence
  derived and/or modified sequence opt2 from SLC30A7__Homo_sapiens__XP_011539081
auguucuucgacuccaccgccauccucgccggccucgccgccuccgucaucuccaaguggcgcgacaacgacgccuucuccuacggcuacguccgcgccgagguccucgccggcuucgucaacggccucuuccucaucuucaccgccuucuucaucuucuccgagggcgucgagcgcgcccucgccccccccgacguccaccacgagcgccuccuccucgucuccauccucggcuucgucgucaaccucaucggcaucuucgucuucaagcacggcggccacggccacucccacggcuccggccacggccacucccacucccucuucaacggcgcccucgaccaggcccacggccacgucgaccacugccacucccacgaggucaagcacggcgccgcccacucccacgaccacgcccacggccacggccacuuccacucccacgacggccccucccucaaggagaccaccggccccucccgccagauccuccagggcgucuuccuccacauccucgccgacacccucggcuccaucggcgucaucgccuccgccaucaugaugcagaacuucggccucaugaucgccgaccccaucugcuccauccucaucgccauccucaucgucgucuccgucaucccccuccuccgcgaguccgucggcauccucaugcagcgcacccccccccuccucgagaacucccucccccagugcuaccagcgcguccagcagcuccagggcgucuacucccuccaggagcagcacuucuggacccucugcuccgacgucuacgucggcacccucaagcucaucgucgcccccgacgccgacgcccgcuggauccucucccagacccacaacaucuucacccaggccggcguccgccagcucuacguccagaucgacuucgccgccauguga

SEQ ID NO: 49651 - RNA, 963 nt, Artificial Sequence
  derived and/or modified sequence opt2 from SLC30A8__Homo_sapiens__NP_001166286
auguaccacugccacuccggcuccaagcccaccgagaagggcgccaacgaguacgccuacgccaaguggaagcucugcuccgccuccgccaucugcuucaucuucaugaucgccgaggucgucggcggccacaucgccggcucccucgccgucgucaccgacgccgcccaccuccucaucgaccucaccuccuuccuccucucccucuucucccucuggcucuccuccaagccccccuccaagcgccucaccuucggcuggcaccgcgccgagauccucggcgcccuccucuccauccucugcaucugggucgucaccggcguccucgucuaccucgccugcgagcgccuccucuaccccgacuaccagauccaggccaccgucaugaucaucgucuccuccugcgccgucgccgccaacaucguccucaccgucguccuccaccagcgcugccucggccacaaccacaaggagguccaggccaacgccuccguccgcgccgccuucguccacgcccucggcgaccucuuccaguccaucuccguccucaucuccgcccucaucaucuacuucaagcccgaguacaagaucgccgaccccaucugcaccuucaucuucuccauccucguccucgccuccaccaucaccauccucaaggacuucuccauccuccucauggagggcguccccaagucccucaacuacuccggcgucaaggagcucauccucgccgucgacggcguccucuccguccacucccuccacaucuggucccucaccaugaaccaggucauccucuccgcccacgucgccaccgccgccucccgcgacucccaggucguccgccgcgagaucgccaaggcccucuccaaguccuucaccaugcacucccucaccauccagauggagucccccgucgaccaggaccccgacugccucuucugcgaggaccccugcgacuga

SEQ ID NO: 49652 - RNA, 1707 nt, Artificial Sequence
  derived and/or modified sequence opt2 from SLC30A9__Homo_sapiens__NP_006336
augcuccccggccucgccgccgccgccgcccaccgcugcuccugguccucccucugccgccuccgccuccgcugccgcgccgccgccugcaaccccuccgaccgccaggaguggcagaaccucgucaccuucggcuccuucuccaacaugguccccugcucccaccccuacaucggcacccucucccaggucaagcucuacuccaccaacguccagaaggagggccagggcucccagacccuccgcgucgagaagguccccuccuucgagaccgccgagggcaucggcaccgagcucaaggccccccucaagcaggagccccuccagguccgcgucaaggccguccucaagaagcgcgaguacggcuccaaguacacccagaacaacuucaucaccggcguccgcgccaucaacgaguucugccucaaguccuccgaccucgagcagcuccgcaagauccgccgccgcuccccccacgaggacaccgaguccuucaccgucuaccuccgcuccgacgucgaggccaagucccucgaggucuggggcucccccgaggcccucgcccgcgagaagaagcuccgcaaggaggccgagaucgaguaccgcgagcgccucuuccgcaaccagaagauccuccgcgaguaccgcgacuuccucggcaacaccaagccccgcucccgcaccgccuccgucuucuucaagggccccggcaaggucgucauggucgccaucugcaucaacggccucaacugcuucuucaaguuccucgccuggaucuacaccggcuccgccuccauguucuccgaggccauccacucccucuccgacaccugcaaccagggccuccucgcccucggcaucuccaaguccguccagacccccgaccccucccaccccuacggcuucuccaacaugcgcuacaucuccucccucaucuccggcgucggcaucuucaugaugggcgccggccucuccugguaccacggcgucaugggccuccuccacccccagcccaucgagucccuccucugggccuacugcauccucgccggcucccucgucuccgagggcgccacccuccucgucgccgucaacgagcuccgccgcaacgcccgcgccaagggcauguccuucuacaaguacgucauggagucccgcgaccccuccaccaacgucauccuccucgaggacaccgccgccguccucggcgucaucaucgccgccaccugcaugggccucaccuccaucaccggcaacccccucuacgacucccucggcucccucggcgucggcacccuccucggcauggucuccgccuuccucaucuacaccaacaccgaggcccuccucggccgcuccauccagcccgagcagguccagcgccucaccgagcuccucgagaacgaccccuccguccgcgccauccacgacgucaaggccaccgaccucggccucggcaagguccgcuucaaggccgaggucgacuucgacggccgcgucgucacccgcuccuaccucgagaagcaggacuucgaccagaugcuccaggagauccaggaggucaagacccccgaggagcucgagaccuucaugcucaagcacggcgagaacaucaucgacacccucggcgccgaggucgaccgccucgagaaggagcucaagaagcgcaaccccgagguccgccacgucgaccucgagauccucuga

SEQ ID NO: 49653 - RNA, 573 nt, Artificial Sequence
  derived and/or modified sequence opt2 from SLC31A1__Homo_sapiens__NP_001850
auggaccacucccaccacaugggcauguccuacauggacuccaacuccaccaugcagcccucccaccaccaccccaccaccuccgccucccacucccacggcggcggcgacuccuccaugaugaugaugcccaugaccuucuacuucggcuucaagaacgucgagcuccucuucuccggccucgucaucaacaccgccggcgagauggccggcgccuucgucgccgucuuccuccucgccauguucuacgagggccucaagaucgcccgcgagucccuccuccgcaagucccaggucuccauccgcuacaacuccaugcccguccccggccccaacggcaccauccucauggagacccacaagaccgucggccagcagaugcucuccuucccccaccuccuccagaccguccuccacaucauccaggucgucaucuccuacuuccucaugcucaucuucaugaccuacaacggcuaccucugcaucgccgucgccgccggcgccggcaccggcuacuuccucuucuccuggaagaaggccgucgucgucgacaucaccgagcacugccacuga

SEQ ID NO: 49654 - RNA, 432 nt, Artificial Sequence
  derived and/or modified sequence opt2 from SLC31A2__Homo_sapiens__NP_001851
auggccaugcacuucaucuucuccgacaccgccguccuccucuucgacuucugguccguccacucccccgccggcauggcccucuccguccucguccuccuccuccucgccguccucuacgagggcaucaaggucggcaaggccaagcuccucaaccagguccucgucaaccuccccaccuccaucucccagcagaccaucgccgagaccgacggcgacuccgccggcuccgacuccuuccccgucggccgcacccaccaccgcugguaccucugccacuucggccagucccucauccacgucauccaggucgucaucggcuacuucaucaugcucgccgucauguccuacaacaccuggaucuuccucggcgucguccucggcuccgccgucggcuacuaccucgccuacccccuccucuccaccgccuga

SEQ ID NO: 49655 - RNA, 1578 nt, Artificial Sequence
  derived and/or modified sequence opt2 from SLC32A1__Homo_sapiens__NP_542119
auggccacccuccuccgcuccaagcucuccaacgucgccaccuccgucuccaacaagucccaggccaagauguccggcauguucgcccgcaugggcuuccaggccgccaccgacgaggaggccgucggcuucgcccacugcgacgaccucgacuucgagcaccgccagggccuccagauggacauccucaaggccgagggcgagcccugcggcgacgagggcgccgaggcccccgucgagggcgacauccacuaccagcgcggcuccggcgccccccucccccccuccggcuccaaggaccaggucggcggcggcggcgaguucggcggccacgacaagcccaagaucaccgccugggaggccggcuggaacgucaccaacgccauccagggcauguucguccucggccuccccuacgccauccuccacggcggcuaccucggccucuuccucaucaucuucgccgccgucgucugcugcuacaccggcaagauccucaucgccugccucuacgaggagaacgaggacggcgaggucguccgcguccgcgacuccuacgucgccaucgccaacgccugcugcgccccccgcuuccccacccucggcggccgcgucgucaacgucgcccagaucaucgagcucgucaugaccugcauccucuacgucgucgucuccggcaaccucauguacaacuccuuccccggccuccccgucucccagaaguccugguccaucaucgccaccgccguccuccuccccugcgccuuccucaagaaccucaaggccgucuccaaguucucccuccucugcacccucgcccacuucgucaucaacauccucgucaucgccuacugccucucccgcgcccgcgacugggccugggagaaggucaaguucuacaucgacgucaagaaguuccccaucuccaucggcaucaucgucuucuccuacaccucccagaucuuccuccccucccucgagggcaacaugcagcagcccuccgaguuccacugcaugaugaacuggacccacaucgccgccugcguccucaagggccucuucgcccucgucgccuaccucaccugggccgacgagaccaaggaggucaucaccgacaaccuccccggcuccauccgcgccgucgucaacaucuuccucgucgccaaggcccuccucuccuacccccuccccuucuucgccgccgucgagguccucgagaagucccucuuccaggagggcucccgcgccuucuuccccgccugcuacuccggcgacggccgccucaaguccuggggccucacccuccgcugcgcccucgucgucuucacccuccucauggccaucuacgucccccacuucgcccuccucaugggccucaccggcucccucaccggcgccggccucugcuuccuccuccccucccucuuccaccuccgccuccucuggcgcaagcuccucuggcaccaggucuucuucgacgucgccaucuucgucaucggcggcaucugcuccgucuccggcuucguccacucccucgagggccucaucgaggccuaccgcaccaacgccgaggacuga

SEQ ID NO: 49656 - RNA, 1650 nt, Artificial Sequence
  derived and/or modified sequence opt2 from SLC33A1__Homo_sapiens__NP_001177921
augucccccaccaucucccacaaggacuccucccgccagcgccgccccggcaacuucucccacucccucgacaugaaguccggcccccucccccccggcggcugggacgacucccaccucgacuccgccggccgcgagggcgaccgcgaggcccuccucggcgacaccggcaccggcgacuuccucaaggccccccaguccuuccgcgccgagcucuccuccauccuccuccuccucuuccucuacguccuccagggcaucccccucggccucgccggcuccaucccccucauccuccaguccaagaacgucuccuacaccgaccaggccuucuucuccuucgucuucuggcccuucucccucaagcuccucugggccccccucgucgacgccgucuacgucaagaacuucggccgccgcaaguccuggcucguccccacccaguacauccucggccucuucaugaucuaccucuccacccaggucgaccgccuccucggcaacaccgacgaccgcacccccgacgucaucgcccucaccgucgccuucuuccucuucgaguuccucgccgccacccaggacaucgccgucgacggcugggcccucaccaugcucucccgcgagaacgucggcuacgccuccaccugcaacuccgucggccagaccgccggcuacuuccucggcaacguccucuuccucgcccucgaguccgccgacuucugcaacaaguaccuccgcuuccagccccagccccgcggcaucgucacccucuccgacuuccucuucuucuggggcaccgucuuccucaucaccaccacccucgucgcccuccucaagaaggagaacgaggucuccgucgucaaggaggagacccagggcaucaccgacaccuacaagcuccucuucgccaucaucaagaugcccgccguccucaccuucugccuccucauccucaccgccaagaucggcuucuccgccgccgacgccgucaccggccucaagcucgucgaggagggcguccccaaggagcaccucgcccuccucgccguccccauggucccccuccagaucauccucccccucaucaucuccaaguacaccgccggcccccagccccucaacaccuucuacaaggccaugcccuaccgccuccuccucggccucgaguacgcccuccucgucugguggacccccaaggucgagcaccagggcggcuuccccaucuacuacuacaucgucguccuccucuccuacgcccuccaccaggucaccgucuacuccauguacgucuccaucauggccuucaacgccaaggucuccgacccccucaucggcggcaccuacaugacccuccucaacaccgucuccaaccucggcggcaacuggcccuccaccgucgcccucuggcucgucgacccccucaccgucaaggagugcgucggcgccuccaaccagaacugccgcacccccgacgccgucgagcucugcaagaagcucggcggcuccugcgucaccgcccucgacggcuacuacgucgaguccaucaucugcgucuucaucggcuucggcuggugguucuuccucggccccaaguucaagaagcuccaggacgagggcuccuccuccuggaagugcaagcgcaacaacuga

SEQ ID NO: 49657 - RNA, 1023 nt, Artificial Sequence
  derived and/or modified sequence opt2 from SLC34A1__Homo_sapiens__NP_001161051
augcucuccuacggcgagcgccucggcucccccgccgucuccccccuccccguccgcggcggccacgucaugcgcggcaccgccuucgccuacguccccuccccccagguccuccaccgcauccccggcaccuccgccuacgccuuccccucccucggccccgucgcccucgccgagcacaccugccccugcggcgagguccucgagcgccacgagccccuccccgccaagcucgcccucgaggaggagcagaagcccgagucccgccucguccccaagcuccgccaggccggcgccaugcuccucaaggucccccucaugcucaccuuccucuaccucuucgucugcucccucgacaugcucuccuccgccuuccagcucgccggcggcaaggucgccggcgacaucuucaaggacaacgccauccucuccaaccccgucgccggccucgucgucggcauccucgucaccguccucguccaguccuccuccaccuccaccuccaucaucgucuccauggucuccuccggccuccucgaggucuccuccgccauccccaucaucaugggcuccaacaucggcaccuccgucaccaacaccaucgucgcccucaugcaggccggcgaccgcaccgacuuccgccgcgccuucgccggcgccaccguccacgacugcuucaacuggcucuccguccucguccuccucccccucgaggccgccaccggcuaccuccaccacaucacccgccucgucgucgccuccuucaacauccacggcggccgcgacgcccccgaccuccucaagaucaucaccgagcccuucaccaagcucaucauccagcucgacgaguccgucaucaccuccaucgccaccggcgacgagucccuccgcaaccacucccucauccagaucuggugccaccccgacucccuccagcagaaccucgagggccgcgagaucacccacuucgaccuccgcaagaagcaggccauggaggacuccuccgucccccacugccccuga

SEQ ID NO: 49658 - RNA, 2070 nt, Artificial Sequence
  derived and/or modified sequence opt2 from SLC34A2__Homo_sapiens__NP_001171470
auggcccccuggcccgagcucggcgacgcccagcccaaccccgacaaguaccucgagggcgccgccggccagcagcccaccgcccccgacaaguccaaggagaccaacaagaacaacaccgaggcccccgucaccaagaucgagcuccuccccuccuacuccaccgccacccucaucgacgagcccaccgaggucgacgaccccuggaaccuccccacccuccaggacuccggcaucaagugguccgagcgcgacaccaagggcaagauccucugcuucuuccagggcaucggccgccucauccuccuccucggcuuccucuacuucuucgucugcucccucgacauccucuccuccgccuuccagcucgucggcggcaagauggccggccaguucuucuccaacuccuccaucauguccaacccccuccucggccucgucaucggcguccucgucaccguccucguccaguccuccuccaccuccaccuccaucgucgucuccauggucuccuccucccuccucaccguccgcgccgccauccccaucaucaugggcgccaacaucggcaccuccaucaccaacaccaucgucgcccucaugcaggucggcgaccgcuccgaguuccgccgcgccuucgccggcgccaccguccacgacuucuucaacuggcucuccguccucguccuccuccccgucgaggucgccacccacuaccucgagaucaucacccagcucaucgucgaguccuuccacuucaagaacggcgaggacgcccccgaccuccucaaggucaucaccaagcccuucaccaagcucaucguccagcucgacaagaaggucaucucccagaucgccaugaacgacgagaaggccaagaacaagucccucgucaagaucuggugcaagaccuucaccaacaagacccagaucaacgucaccguccccuccaccgccaacugcaccucccccucccucugcuggaccgacggcauccagaacuggaccaugaagaacgucaccuacaaggagaacaucgccaagugccagcacaucuucgucaacuuccaccuccccgaccucgccgucggcaccauccuccucauccucucccuccucguccucugcggcugccucaucaugaucgucaagauccucggcuccguccucaagggccaggucgccaccgucaucaagaagaccaucaacaccgacuuccccuuccccuucgccuggcucaccggcuaccucgccauccucgucggcgccggcaugaccuucaucguccaguccuccuccgucuucaccuccgcccucaccccccucaucggcaucggcgucaucaccaucgagcgcgccuacccccucacccucggcuccaacaucggcaccaccaccaccgccauccucgccgcccucgccucccccggcaacgcccuccgcuccucccuccagaucgcccucugccacuucuucuucaacaucuccggcauccuccucugguaccccauccccuucacccgccuccccauccgcauggccaagggccucggcaacaucuccgccaaguaccgcugguucgccgucuucuaccucaucaucuucuucuuccucaucccccucaccgucuucggccucucccucgccggcuggcgcguccucgucggcgucggcguccccgucgucuucaucaucauccucguccucugccuccgccuccuccagucccgcugcccccgcguccuccccaagaagcuccagaacuggaacuuccucccccucuggaugcgcucccucaagcccugggacgccgucgucuccaaguucaccggcugcuuccagaugcgcugcugcugcugcugccgcgucugcugccgcgccugcugccuccucugcggcugccccaagugcugccgcugcuccaagugcugcgaggaccucgaggaggcccaggagggccaggacguccccgucaaggcccccgagaccuucgacaacaucaccaucucccgcgaggcccagggcgagguccccgccuccgacuccaagaccgagugcaccgcccucuga

SEQ ID NO: 49659 - RNA, 1800 nt, Artificial Sequence
  derived and/or modified sequence opt2 from SLC34A3__Homo_sapiens__NP_001170788
augcccuccucccuccccggcucccaggucccccaccccacccucgacgccgucgaccucgucgagaagacccuccgcaacgagggcaccuccuccuccgcccccguccucgaggagggcgacaccgaccccuggacccucccccagcucaaggacaccucccagcccuggaaggagcuccgcgucgccggccgccuccgccgcgucgccggcuccguccucaaggccugcggccuccucggcucccucuacuucuucaucugcucccucgacguccucuccuccgccuuccagcuccucggcuccaaggucgccggcgacaucuucaaggacaacgucguccucuccaaccccgucgccggccucgucaucggcguccucgucaccgcccucguccaguccuccuccaccuccuccuccaucgucgucuccauggucgccgccaagcuccucaccguccgcgucuccguccccaucaucaugggcgucaacgucggcaccuccaucaccuccacccucgucuccauggcccaguccggcgaccgcgacgaguuccagcgcgccuucuccggcuccgccguccacggcaucuucaacuggcucaccguccucguccuccucccccucgaguccgccaccgcccuccucgagcgccucuccgagcucgcccucggcgccgccucccucaccccccgcgcccaggcccccgacauccucaagguccucaccaagccccucacccaccucaucguccagcucgacuccgacaugaucauguccuccgccaccggcaacgccaccaacuccucccucaucaagcacuggugcggcaccaccggccagcccacccaggagaacuccuccugcggcgccuucggccccugcaccgagaagaacuccaccgcccccgccgaccgccuccccugccgccaccucuucgccggcaccgagcucaccgaccucgccgucggcugcauccuccucgccggcucccuccucguccucugcggcugccucguccucaucgucaagcuccucaacuccguccuccgcggccgcgucgcccaggucguccgcaccgucaucaacgccgacuuccccuucccccucggcuggcucggcggcuaccucgccguccucgccggcgccggccucaccuucgcccuccaguccuccuccgucuucaccgccgccgucgucccccucaugggcgucggcgucaucucccucgaccgcgccuacccccuccuccucggcuccaacaucggcaccaccaccaccgcccuccucgccgcccucgccucccccgccgaccgcaugcucuccgcccuccaggucgcccucauccacuucuucuucaaccucgccggcauccuccucugguaccucguccccgcccuccgccuccccaucccccucgcccgccacuucggcgucgucaccgcccgcuaccgcugggucgccggcgucuaccuccuccucggcuuccuccuccucccccucgccgccuucggccucucccucgccggcggcaugguccucgccgccgucggcggcccccucgucggccucguccuccucgucauccucgucaccguccuccagcgccgccgccccgccuggcuccccguccgccuccgcuccugggccuggcuccccgucuggcuccacucccucgagcccugggaccgccucgucacccgcugcugccccugcaacgucugcuccccccccaaggccaccaccaaggaggccuacugcuacgagaaccccgagauccucgccucccagcagcucuga

SEQ ID NO: 49660 - RNA, 837 nt, Artificial Sequence
  derived and/or modified sequence opt2 from SLC35A1__Homo_sapiens__NP_001161870
auggccgccccccgcgacaacgucacccuccucuucaagcucuacugccucgccgucaugacccucauggccgccgucuacaccaucgcccuccgcuacacccgcaccuccgacaaggagcucuacuucuccaccaccgccgucugcaucaccgaggucaucaagcuccuccucuccgucggcauccucgccaaggagaccggcucccucggccgcuucaaggccucccuccgcgagaacguccucggcucccccaaggagcuccucaagcucuccguccccucccucgucuacgccguccagaacaacauggccuuccucgcccucuccaaccucgacgccgccgucuaccaggucaccuaccagcucaagauccccugcaccgcccucugcaccguccucaugcucaaccgcacccucuccaagcuccagugggucuccgucuucaugcucugcgccggcgucacccucguccaguggaagcccgcccaggccaccaaggucgucgucgagcagaacccccuccucggcuucggcgccaucgccaucgccguccucugcuccggcuucgccguccucgccuccgucggcggccucuacaccuccgucgucgucaaguacaccgacaacaucaugaagggcuucuccgccgccgccgccaucguccucuccaccaucgccuccgucaugcucuucggccuccagaucacccucaccuucgcccucggcacccuccucgucugcgucuccaucuaccucuacggccucccccgccaggacaccaccuccauccagcagggcgagaccgccuccaaggagcgcgucaucggcgucuga

SEQ ID NO: 49661 - RNA, 729 nt, Artificial Sequence
  derived and/or modified sequence opt2 from SLC35A2__Homo_sapiens__NP_001027460
auggccgccgucggcgccggcggcuccaccgccgcccccggccccggcgccgucuccgccggcgcccucgagcccggcaccgccuccgccgcccaccgccgccucaaguacaucucccucgccguccucgucguccagaacgccucccucauccucuccauccgcuacgcccgcacccuccccggcgaccgcuucuucgccaccaccgccgucgucauggccgagguccucaagggccucaccugccuccuccuccucuucgcccagaagcgcggcaacgucaagcaccucguccucuuccuccacgaggccguccucguccaguacgucgacacccucaagcucgccguccccucccucaucuacacccuccagaacaaccuccaguacgucgccaucuccaaccuccccgccgccaccuuccagcccuccccccgcugcucccagucccacucccucugccucugccuccgccuccgcgcccuccgcucccccgccgccucccgcgccgccaccaccaccgccgccgucuucccccccuggcgcccccaccacggcgcccucuccgccaaggucuccgccggcgagguccgcgccggcuccaacggcggcacccagggccgcggcaccggcgucgagggcgucggccaccuccaggaccccucccgccacccccccggccccggcuccuccggcuucggccgcugguccuuccuccccggccacuga

SEQ ID NO: 49662 - RNA, 936 nt, Artificial Sequence
  derived and/or modified sequence opt2 from SLC35A3__Homo_sapiens__XP_011539439
auguccucccgcuccguccucucccccgucgucggcaccgacgcccccgaccagcaccucgagcucaagaagccccaggagcucaaggagauggagcgccucccccucgccaacgaggacaagaccauguucgccaaccucaaguacgucucccucggcauccucgucuuccagaccaccucccucguccucaccaugcgcuacucccgcacccucaaggaggagggcccccgcuaccucuccuccaccgccgucgucgucgccgagcuccucaagaucauggccugcauccuccucgucuacaaggacuccaagugcucccuccgcgcccucaaccgcguccuccacgacgagauccucaacaagcccauggagacccucaagcucgccauccccuccggcaucuacacccuccagaacaaccuccucuacgucgcccucuccaaccucgacgccgccaccuaccaggucaccuaccagcucaagauccucaccaccgcccucuucuccgucuccaugcucuccaagaagcucggcgucuaccaguggcucucccucgucauccucaugaccggcgucgccuucguccaguggcccuccgacucccagcucgacuccaaggagcucuccgccggcucccaguucgucggccucauggccguccucaccgccugcuucuccuccggcuucgccggcgucuacuucgagaagauccucaaggagaccaagcaguccgucuggauccgcaacauccagcucggcuucuucggcuccaucuucggccucaugggcgucuacaucuacgacggcgagcucgucuccaagaacggcuucuuccagggcuacaaccgccucaccuggaucgucgucguccuccagugccucuuccccuggucccaccccugcaacaacuccuacuucuucgucuggcucuga

SEQ ID NO: 49663 - RNA, 975 nt, Artificial Sequence
  derived and/or modified sequence opt2 from SLC35A4__Homo_sapiens__NP_542401
auguccgucgaggacggcggcaugcccggccucggccgcccccgccaggcccgcuggacccucaugcuccuccucuccaccgccauguacggcgcccacgccccccuccucgcccucugccacgucgacggccgcguccccuuccgccccuccuccgccguccuccucaccgagcucaccaagcuccuccucugcgccuucucccuccucgucggcuggcaggccuggccccagggccccccccccuggcgccaggccgcccccuucgcccucuccgcccuccucuacggcgccaacaacaaccucgucaucuaccuccagcgcuacauggaccccuccaccuaccagguccucuccaaccucaagaucggcuccaccgccguccucuacugccucugccuccgccaccgccucuccguccgccagggccucgcccuccuccuccucauggccgccggcgccugcuacgccgccggcggccuccagguccccggcaacacccuccccucccccccccccgccgccgccgccucccccaugccccuccacaucaccccccucggccuccuccuccucauccucuacugccucaucuccggccucuccuccgucuacaccgagcuccucaugaagcgccagcgccucccccucgcccuccagaaccucuuccucuacaccuucggcguccuccucaaccucggccuccacgccggcggcggcuccggccccggccuccucgagggcuucuccggcugggccgcccucgucguccucucccaggcccucaacggccuccucauguccgccgucaugaagcacggcuccuccaucacccgccucuucgucgucuccugcucccucgucgucaacgccguccucuccgccguccuccuccgccuccagcucaccgccgccuucuuccucgccacccuccucaucggccucgccaugcgccucuacuacggcucccgcuga

SEQ ID NO: 49664 - RNA, 1020 nt, Artificial Sequence
  derived and/or modified sequence opt2 from SLC35B2__Homo_sapiens__NP_001273442
augcuccucgccaugcccgcccucugguaccucgccaccuccuggugcuccaccuccggcggccgcaccaccuggcgccccgucuccuaccucaccuggggcguccuccaggagcgcgucaugacccgcuccuacggcgccaccgccaccucccccggcgagcgcuucaccgacucccaguuccucguccucaugaaccgcguccucgcccucaucgucgccggccucuccugcguccucugcaagcagccccgccacggcgcccccauguaccgcuacuccuucgccucccucuccaacguccucuccuccuggugccaguacgaggcccucaaguucgucuccuuccccacccagguccucgccaaggccuccaaggucauccccgucaugcucaugggcaagcucgucucccgccgcuccuacgagcacugggaguaccucaccgccacccucaucuccaucggcgucuccauguuccuccucuccuccggccccgagccccgcuccucccccgccaccacccucuccggccucauccuccucgccggcuacaucgccuucgacuccuucaccuccaacuggcaggacgcccucuucgccuacaagauguccuccguccagaugauguucggcgucaacuucuucuccugccucuucaccgucggcucccuccucgagcagggcgcccuccucgagggcacccgcuucaugggccgccacuccgaguucgccgcccacgcccuccuccucuccaucugcuccgccugcggccagcucuucaucuucuacaccaucggccaguucggcgccgccgucuucaccaucaucaugacccuccgccaggccuucgccauccuccucuccugccuccucuacggccacaccgucaccgucgucggcggccucggcgucgccgucgucuucgccgcccuccuccuccgcgucuacgcccgcggccgccucaagcagcgcggcaagaaggccguccccgucgagucccccguccagaaggucuga

SEQ ID NO: 49665 - RNA, 996 nt, Artificial Sequence
  derived and/or modified sequence opt2 from SLC35B4__Homo_sapiens__NP_116215
augcgccccgcccucgccgucggccucgucuucgccggcugcugcuccaacgucaucuuccucgagcuccucgcccgcaagcaccccggcugcggcaacaucgucaccuucgcccaguuccucuucaucgccgucgagggcuuccucuucgaggccgaccucggccgcaagccccccgccauccccauccgcuacuacgccaucauggucaccauguucuucaccgucuccgucgucaacaacuacgcccucaaccucaacaucgccaugccccuccacaugaucuuccgcuccggcucccucaucgccaacaugauccucggcaucaucauccucaagaagcgcuacuccaucuucaaguacaccuccaucgcccucgucuccgucggcaucuucaucugcaccuucauguccgccaagcaggucaccucccaguccucccucuccgagaacgacggcuuccaggccuucgucugguggcuccucggcaucggcgcccucaccuucgcccuccucauguccgcccgcaugggcaucuuccaggagacccucuacaagcgcuucggcaagcacuccaaggaggcccucuucuacaaccacgcccucccccuccccggcuucgucuuccucgccuccgacaucuacgaccacgccguccucuucaacaaguccgagcucuacgagauccccgucaucggcgucacccuccccaucaugugguucuaccuccucaugaacaucaucacccaguacgucugcauccgcggcgucuucauccucaccaccgagugcgccucccucaccgucacccucgucgucacccuccgcaaguucgucucccucaucuucuccauccucuacuuccagaaccccuucacccucuggcacuggcucggcacccucuucgucuucaucggcacccucauguacaccgaggucuggaacaaccucggcaccaccaaguccgagccccagaaggacuccaagaagaacuga

SEQ ID NO: 49666 - RNA, 1056 nt, Artificial Sequence
  derived and/or modified sequence opt2 from SLC35C1__Homo_sapiens__NP_001138738
auggcccucaccggcgccuccgaccccuccgccgaggccgaggccaacggcgagaagcccuuccuccuccgcgcccuccagaucgcccucgucgucucccucuacugggucaccuccaucuccauggucuuccucaacaaguaccuccucgacucccccucccuccgccucgacacccccaucuucgucaccuucuaccagugccucgucaccacccuccucugcaagggccucuccgcccucgccgccugcugccccggcgccgucgacuuccccucccuccgccucgaccuccgcgucgcccgcuccguccucccccucuccgucgucuucaucggcaugaucaccuucaacaaccucugccucaaguacgucggcgucgccuucuacaacgucggccgcucccucaccaccgucuucaacguccuccucuccuaccuccuccucaagcagaccaccuccuucuacgcccuccucaccugcggcaucaucaucggcggcuucuggcucggcgucgaccaggagggcgccgagggcacccucuccuggcucggcaccgucuucggcguccucgccucccucugcgucucccucaacgccaucuacaccaccaagguccuccccgccgucgacggcuccaucuggcgccucaccuucuacaacaacgucaacgccugcauccucuuccucccccuccuccuccuccucggcgagcuccaggcccuccgcgacuucgcccagcucggcuccgcccacuucuggggcaugaugacccucggcggccucuucggcuucgccaucggcuacgucaccggccuccagaucaaguucaccuccccccucacccacaacgucuccggcaccgccaaggccugcgcccagaccguccucgccguccucuacuacgaggagaccaaguccuuccucugguggaccuccaacaugaugguccucggcggcuccuccgccuacaccuggguccgcggcugggagaugaagaagacccccgaggagcccucccccaaggacuccgagaaguccgccaugggcgucuga

SEQ ID NO: 49667 - RNA, 1251 nt, Artificial Sequence
  derived and/or modified sequence opt2 from SLC35D3__Homo_sapiens__NP_001008783
augcgccagcucugccgcggccgcguccucggcaucuccgucgccaucgcccacggcgucuucuccggcucccucaacauccuccucaaguuccucaucucccgcuaccaguucuccuuccucacccucguccagugccucaccuccuccaccgccgcccucucccucgagcuccuccgccgccucggccucaucgccgucccccccuucggccucucccucgcccgcuccuucgccggcgucgccguccucuccacccuccaguccucccucacccucuggucccuccgcggccucucccuccccauguacgucgucuucaagcgcugccucccccucgucaccaugcucaucggcguccucguccucaagaacggcgcccccucccccggcguccucgccgccguccucaucaccaccugcggcgccgcccucgccggcgccggcgaccucaccggcgaccccaucggcuacgucaccggcguccucgccguccucguccacgccgccuaccucguccucauccagaaggccuccgccgacaccgagcacggcccccucaccgcccaguacgucaucgccgucuccgccaccccccuccucgucaucugcuccuucgccuccaccgacuccauccacgccuggaccuuccccggcuggaaggaccccgccauggucugcaucuucgucgccugcauccucaucggcugcgccaugaacuucaccacccuccacugcaccuacaucaacuccgccgucaccaccuccuucgucggcgucgucaaguccaucgccaccaucaccgucggcauggucgccuucuccgacgucgagcccaccucccucuucaucgccggcgucgucgucaacacccucggcuccaucaucuacugcgucgccaaguucauggagacccgcaagcaguccaacuacgaggaccucgaggcccagccccgcggcgaggaggcccagcucuccggcgaccagcuccccuucgucauggaggagcuccccggcgagggcggcaacggccgcuccgagggcggcgaggccgccggcggccccgcccaggagucccgccaggagguccgcggcuccccccgcggcgucccccucgucgccggcuccuccgaggagggcucccgccgcucccucaaggacgccuaccucgaggucuggcgccucguccgcggcacccgcuacaugaagaaggacuaccucaucgagaacgaggagcuccccucccccuga

SEQ ID NO: 49668 - RNA, 1227 nt, Artificial Sequence
  derived and/or modified sequence opt2 from SLC35F1__Homo_sapiens__NP_001025029
augaucccccccgagcagccccagcagcagcuccagccccccucccccgccccccccaaccacgucgucaccaccaucgagaaccuccccgccgagggcuccggcggcggcggcucccucuccgccuccucccgcgccggcguccgccagcgcauccgcaagguccucaaccgcgagaugcucaucuccgucgcccucggccagguccucucccuccucaucugcggcaucggccucaccuccaaguaccucuccgaggacuuccacgccaacacccccgucuuccaguccuuccucaacuacauccuccucuuccucgucuacaccaccacccucgccguccgccagggcgaggagaaccuccucgccauccuccgccgccgcugguggaaguacaugauccucggccucaucgaccucgaggccaacuaccucgucgucaaggccuaccaguacaccacccucaccuccauccagcuccucgacugcuucgucauccccgucgucauccuccucuccugguucuuccuccucauccgcuacaaggccguccacuucaucggcaucgucgucugcauccucggcaugggcugcauggucggcgccgacguccucgucggccgccaccagggcgccggcgagaacaagcucgucggcgaccuccucguccucggcggcgccacccucuacggcaucuccaacgucugggaggaguacaucauccgcacccucucccgcgucgaguuccucggcaugaucggccucuucggcgccuucuucuccggcauccagcucgccaucauggagcacaaggagcuccucaagguccccugggacuggcagaucggccuccucuacgucggcuucuccgccugcauguucggccucuacuccuucaugcccgucgucaucaagaagaccuccgccaccuccgucaaccucucccuccucaccgccgaccucuacucccucuucugcggccucuuccucuuccacuacaaguucuccggccucuaccuccucuccuucuucaccauccucaucggccucguccucuacuccuccaccuccaccuacaucgcccaggacccccgcgucuacaagcaguuccgcaaccccuccggccccgucgucgaccuccccaccaccgcccaggucgagcccuccgucaccuacaccucccucggccaggagaccgaggaggagccccacguccgcgucgccuga

SEQ ID NO: 49669 - RNA, 1125 nt, Artificial Sequence
  derived and/or modified sequence opt2 from SLC35F2__Homo_sapiens__NP_059985
auggaggccgacucccccgccggccccggcgcccccgagccccucgccgagggcgccgccgccgaguucuccucccuccuccgccgcaucaagggcaagcucuucaccuggaacauccucaagaccaucgcccucggccagaugcucucccucugcaucugcggcaccgccaucaccucccaguaccucgccgagcgcuacaaggucaacacccccaugcuccaguccuucaucaacuacugccuccucuuccucaucuacaccgucaugcucgccuuccgcuccggcuccgacaaccuccucgucauccucaagcgcaagugguggaaguacauccuccucggccucgccgacgucgaggccaacuacgucaucguccgcgccuaccaguacaccacccucaccuccguccagcuccucgacugcuucggcauccccguccucauggcccucuccugguucauccuccacgcccgcuaccgcgucauccacuucaucgccgucgccgucugccuccucggcgucggcaccauggucggcgccgacauccucgccggccgcgaggacaacuccggcuccgacguccucaucggcgacauccucguccuccucggcgccucccucuacgccaucuccaacgucugcgaggaguacaucgucaagaagcucucccgccaggaguuccucggcauggucggccucuucggcaccaucaucuccggcauccagcuccucaucgucgaguacaaggacaucgccuccauccacugggacuggaagaucgcccuccucuucgucgccuucgcccucugcauguucugccucuacuccuucaugccccucgucaucaaggucaccuccgccaccuccgucaaccucggcauccucaccgccgaccucuacucccucuucgucggccucuuccucuucggcuacaaguucuccggccucuacauccucuccuucaccgucaucauggucggcuucauccucuacugcuccacccccacccgcaccgccgagcccgccgaguccuccgucccccccgucaccuccaucggcaucgacaaccucggccucaagcucgaggagaaccuccaggagacccacuccgccguccucuga

SEQ ID NO: 49670 - RNA, 1266 nt, Artificial Sequence
  derived and/or modified sequence opt2 from SLC35F3__Homo_sapiens__NP_001287774
augaagaagcacuccgcccgcgucgccccccucuccgccugcaacucccccguccucacccucaccaaggucgagggcgaggagcgcccccgcgacucccccggccccgccgaggcccaggcccccgccggcgucgaggccggcggccgcgccucccgccgcugcuggaccugcucccgcgcccagcucaagaagaucuucuggggcgucgccgucguccucugcgucugcuccuccugggccggcuccacccagcucgccaagcucaccuuccgcaaguucgacgcccccuucacccucaccugguucgccaccaacuggaacuuccucuucuucccccucuacuacgucggccacgucugcaaguccaccgagaagcaguccgucaagcagcgcuaccgcgagugcugccgcuucuucggcgacaacggccucacccucaaggucuucuucaccaaggccgcccccuucggcguccucuggacccucaccaacuaccucuaccuccacgccaucaagaagaucaacaccaccgacgucuccguccucuucugcugcaacaaggccuucgucuuccuccucuccuggaucguccuccgcgaccgcuucaugggcguccgcaucgucgccgccauccucgccaucgccggcaucgucaugaugaccuacgccgacggcuuccacucccacuccgucaucggcaucgcccucgucgucgccuccgccuccauguccgcccucuacaagguccucuucaagcuccuccucggcuccgccaaguucggcgaggccgcccucuuccucuccauccucggcgucuucaacauccucuucaucaccugcauccccaucauccucuacuucaccaaggucgaguacugguccuccuucgacgacauccccuggggcaaccucugcggcuucuccguccuccuccucaccuucaacaucguccucaacuucggcaucgccgucaccuaccccacccucaugucccucggcaucguccucuccauccccgucaacgccgucaucgaccacuacaccucccagaucgucuucaacggcguccgcgucaucgccaucaucaucaucggccucggcuuccuccuccuccuccuccccgaggagugggacgucuggcucaucaagcuccucacccgccucaagguccgcaagaaggaggagcccgccgagggcgccgccgaccucuccuccggcccccaguccaagaaccgccgcgcccgccccuccuucgcccgcuga

SEQ ID NO: 49671 - RNA, 1599 nt, Artificial Sequence
  derived and/or modified sequence opt2 from SLC35F4__Homo_sapiens__XP_011535022
augcucguccaccuccgcgacucccucuacccccagcucggcaucaaccagcucuccuacacccgcaagcucgccacccgcugcuccuccgucgucaccgccuccuacaccguccucaagcccgagaagcgcaagauccuccuccaguacaaguuccagaaggagaccuuccagcuccccuucaagaccaccuucuggaucaacaacuuccagaucgucaucuucccccucggcucccucugcuccaccucccgcuccuccgucacccgcugcaagcccggcgccaacugccccuccucccacuccggcaucucccgccagcucuccccccucuccgucaccgaggacuccuccgcccccauccucgagcuccagaaccagggcuccuccggcgucugcggccaccgcgucgagcgccagaaccgcuccgccgacgacggcacccagacccacuccgagaacuccucccaggagaaccgcaucaaggcccgcugccucuccugcaccuccaugguccucaagggcaucuggggccuccucaucauccucuccgucuccuccuccugggucggcaccacccagaucgucaagaucaccuacaagaacuucuacugccccuucuucaugaccugguucuccaccaacuggaacaucauguucuuccccgucuacuacuccggccaccucgccaccgcccaggagaagcagucccccaugaagaaguuccgcgagugcucccgcaucuucggcgaggacggccucacccucaagcucuuccucaagcgcaccgcccccuucuccauccucuggacccucaccaacuaccucuaccuccucgcccucaagaagcucaccgccaccgacgucuccgcccucuucugcugcaacaaggccuucgucuuccuccucuccuggaucguccucaaggaccgcuucaugggcguccgcaucgucgccgccaucauggccaucaccggcaucgucaugauggccuacgccgacaacuuccacgccgacuccaucaucggcgucgccuucgccgucggcuccgccuccaccuccgcccucuacaagguccucuucaagauguuccucggcuccgccaacuucggcgaggccgcccacuucgucuccacccucggcuucuucaaccucaucuucaucuccuucacccccgucauccucuacuucaccaaggucgagcacugguccuccuucgccgcccuccccuggggcugccucugcggcauggccggccucuggcucgccuucaacauccucgucaacgucggcgucguccucaccuaccccauccucaucuccaucggcaccguccucuccguccccggcaacgccgccgucgaccuccucaagcaggaggucaucuucaacgucguccgccucgccgccaccaucaucaucugcaucggcuuccuccucaugcuccuccccgaggagugggacgagaucacccuccgcuucaucaacucccucaaggagaagaaguccgaggagcacgucgacgacgucaccgaccccuccauccaccuccgcggccgcggccgcgccaacggcaccgucuccaucccccucgccuga

SEQ ID NO: 49672 - RNA, 1116 nt, Artificial Sequence
  derived and/or modified sequence opt2 from SLC35F6__Homo_sapiens__NP_060347
auggccuggaccaaguaccagcucuuccucgccggccucaugcucgucaccggcuccaucaacacccucuccgccaagugggccgacaacuucauggccgagggcugcggcggcuccaaggagcacuccuuccagcaccccuuccuccaggccgucggcauguuccucggcgaguucuccugccucgccgccuucuaccuccuccgcugccgcgccgccggccaguccgacuccuccgucgacccccagcagcccuucaacccccuccucuuccucccccccgcccucugcgacaugaccggcaccucccucauguacgucgcccucaacaugaccuccgccuccuccuuccagaugcuccgcggcgccgucaucaucuucaccggccucuucuccgucgccuuccucggccgccgccucguccucucccaguggcucggcauccucgccaccaucgccggccucgucgucgucggccucgccgaccuccucuccaagcacgacucccagcacaagcucuccgaggucaucaccggcgaccuccucaucaucauggcccagaucaucgucgccauccagaugguccucgaggagaaguucgucuacaagcacaacguccacccccuccgcgccgucggcaccgagggccucuucggcuucgucauccucucccuccuccucguccccauguacuacauccccgccggcuccuucuccggcaacccccgcggcacccucgaggacgcccucgacgccuucugccaggucggccagcagccccucaucgccgucgcccuccucggcaacaucuccuccaucgccuucuucaacuucgccggcaucuccgucaccaaggagcucuccgccaccacccgcaugguccucgacucccuccgcaccgucgucaucugggcccucucccucgcccucggcugggaggccuuccacgcccuccagauccucggcuuccucauccuccucaucggcaccgcccucuacaacggccuccaccgcccccuccucggccgccucucccgcggccgcccccucgccgaggaguccgagcaggagcgccuccucggcggcacccgcacccccaucaacgacgccuccuga

SEQ ID NO: 49673 - RNA, 1098 nt, Artificial Sequence
  derived and/or modified sequence opt2 from SLC35G1__Homo_sapiens__NP_001128130
augcgcccccaggacuccaccggcgucgccgagcuccaggagcccggccucccccucaccgacgacgccccccccggcgccaccgaggagcccgccgccgccgaggccgccggcgcccccgaccgcggccgcugcuggcucugccucuccucccccugcugcucccgcaccgagcccgaggccaagaagaaggcccccugccccggccucggccucuucuacacccuccucuccgccuuccucuucuccgucggcucccucuucgucaagaagguccaggacguccacgccgucgagaucuccgccuuccgcugcgucuuccagaugcucgucgucauccccugccucaucuaccgcaagaccggcuucaucggccccaagggccagcgcaucuuccucauccuccgcggcguccucggcuccaccgccaugaugcucaucuacuacgccuaccagaccaugucccucgccgacgccaccgucaucaccuucuccucccccgucuucaccuccaucuucgccuggaucugccucaaggagaaguacucccccugggacgcccucuucaccgucuucaccaucaccggcgucauccucaucguccgcccccccuuccucuucggcuccgacaccuccggcauggaggaguccuacuccggccaccucaagggcaccuucgccgccaucggcuccgccgucuucgccgccuccacccucgucauccuccgcaagaugggcaaguccgucgacuacuuccucuccaucugguacuacgucguccucggccucgucgaguccgucaucauccucuccguccucggcgaguggucccuccccuacugcggccucgaccgccucuuccucaucuucaucggccucuucggccucggcggccagaucuucaucaccaaggcccuccagaucgagaaggccggccccgucgccaucaugaagaccauggacgucgucuucgccuucaucuuccagaucaucuucuucaacaacguccccaccugguggaccgucggcggcgcccucugcgucgucgccuccaacgucggcgccgccauccgcaagugguaccaguccuccaaguga

SEQ ID NO: 49674 - RNA, 1239 nt, Artificial Sequence
  derived and/or modified sequence opt2 from SLC35G2__Homo_sapiens__NP_001091069
auggacaccucccccucccgcaaguaccccgucaagaagcgcgucaagauccaccccaacaccgucauggucaaguacaccucccacuacccccagcccggcgacgacggcuacgaggagaucaacgagggcuacggcaacuucauggaggagaaccccaagaagggccuccucuccgagaugaagaagaagggccgcgccuucuucggcaccauggacacccuccccccccccaccgaggaccccaugaucaacgagaucggccaguuccaguccuucgccgagaagaacaucuuccagucccgcaagauguggaucguccucuucggcuccgcccucgcccacggcugcgucgcccucaucacccgccucgucuccgaccgcuccaagguccccucccucgagcucaucuucauccgcuccgucuuccagguccucuccguccucgucgucugcuacuaccaggaggcccccuucggccccuccggcuaccgccuccgccucuucuucuacggcgucugcaacgucaucuccaucaccugcgccuacaccuccuucuccaucgucccccccuccaacggcaccaccauguggcgcgccaccaccaccgucuucuccgccauccucgccuuccuccucgucgacgagaagauggccuacgucgacauggccaccgucgucugcuccauccucggcgucugccucgucaugauccccaacaucgucgacgaggacaacucccuccucaacgccuggaaggaggccuucggcuacaccaugaccgucauggccggccucaccaccgcccucuccaugaucgucuaccgcuccaucaaggagaagaucuccauguggaccgcccucuucaccuucggcuggaccggcaccaucuggggcaucuccaccauguucauccuccaggagcccaucaucccccucgacggcgagaccugguccuaccucaucgccaucugcgucugcuccaccgccgccuuccucggcgucuacuacgcccucgacaaguuccaccccgcccucgucuccaccguccagcaccucgagaucgucgucgccaugguccuccagcuccucguccuccacaucuuccccuccaucuacgacgucuucggcggcgucaucaucaugaucuccgucuucguccucgccggcuacaagcucuacuggcgcaaccuccgcaagcaggacuaccaggagauccucgacucccccaucaaguga

SEQ ID NO: 49675 - RNA, 1017 nt, Artificial Sequence
  derived and/or modified sequence opt2 from SLC35G5__Homo_sapiens__NP_473369
auggccggcucccaccccuacuucaaccuccccgacuccacccaccccuccccccccuccgccccccccucccuccgcuggcaccagcgcugccagcccuccggcgccaccaacggccuccucgucgcccuccucggcggcggccuccccgccggcuucgucggcccccucucccgcauggccuaccagggcuccaaccuccccucccucgagcuccucaucugccgcugccucuuccaccuccccaucgcccuccuccucaagcuccgcggcgacccccuccucggcccccccgacauccgcggcugggccugcuucugcgcccuccucaacguccucuccaucggcugcgccuacuccgccguccaggucguccccgccggcaacgccgccaccguccgcaagggcuccuccaccgucugcuccgccguccucacccucugccucgagucccagggccucggcggcuacgaguggugcggccuccucggcuccauccucggccucaucaucauccucggccccggccucuggacccuccaggagggcaccaccggcgucuacaccacccucggcuacguccaggccuuccucggcggccucgcccucucccucggccuccucgucuaccgcucccuccacuuccccuccugccuccccaccgucgccuuccucuccggccucgucggccuccucggcugcguccccggccucuucguccuccagacccccguccuccccuccgaccuccucuccugguccugcgucggcgccgagggcauccucgcccucgucuccuucaccugcgucggcuacgccgucaccaaggcccaccccgcccucgucugcgccguccuccacuccgaggucgucgucgcccucauccuccaguacuacaugcuccacgagaccgucgcccucuccgacaucaugggcgccggcgucguccucggcuccaucgccaucaucaccgcccgcaaccucuccugcgagcgcaccggcaaggucgaggaguga

SEQ ID NO: 49676 - RNA, 1017 nt, Artificial Sequence
  derived and/or modified sequence opt2 from SLC35G6__Homo_sapiens__NP_001096084
auggccggcucccaccccuaccucaacccccccgacuccacccaccccuccccccccuccgccccccccucccuccgcuggcaccagugcugccagcccuccgacgccaccaacggccuccucgucgcccuccucggcggcggccuccccgccggcuucgucggcccccucucccacauggccuaccaggccuccaaccuccccucccucgagcuccucaucugccgcugccucuuccaccuccccaucgcccuccuccucaagcuccgcggcgacccccuccucggcccccccgacauccgcggccgcgccuacuucuacgcccuccucaacguccucuccaucggcugcgccuacuccgccguccaggucguccccgccggcaacgccgccaccguccgcaagggcuccuccaccgucugcuccgccguccucacccucugccucgagucccagggccucuccggcuacgacuggugcggccuccucggcuccauccucggccucaucaucaucgucggccccggccucuggacccuccaggagggcaucaccggcgucuacaccgcccucggcuacggccaggccuucgucggcggccucgcccucucccucggccuccucgucuaccgcucccuccacuuccccuccugccuccccaccgucgccuuccucuccggccucgucggccuccucggcuccguccccggccucuucguccuccagccccccguccuccccuccgaccuccccuccugguccugcgucggcgccgucggcauccucgcccucgucuccuucaccugcgucuccuacgccgucaccaaggcccaccccgcccucgucugcgccguccuccacuccgaggucgucgucgcccucauccuccaguacuacaugcuccacgagaccgucgcccccuccgacaucgucggcgccggcgucguccucggcuccaucgccaucaucaccgccuggaaccucuccugcgagcgcgagggcaaggucgaggaguga

SEQ ID NO: 49677 - RNA, 1431 nt, Artificial Sequence
  derived and/or modified sequence opt2 from SLC36A1__Homo_sapiens__NP_510968
auguccacccagcgccuccgcaacgaggacuaccacgacuacuccuccaccgacgucucccccgaggagucccccuccgagggccucaacaaccucuccucccccggcuccuaccagcgcuucggccaguccaacuccaccaccugguuccagacccucauccaccuccucaagggcaacaucggcaccggccuccucggccucccccucgccgucaagaacgccggcaucgucaugggccccaucucccuccucaucaucggcaucgucgccguccacugcaugggcauccucgucaagugcgcccaccacuucugccgccgccucaacaaguccuucgucgacuacggcgacaccgucauguacggccucgaguccucccccugcuccuggcuccgcaaccacgcccacuggggccgccgcgucgucgacuucuuccucaucgucacccagcucggcuucugcugcgucuacuucgucuuccucgccgacaacuucaagcaggucaucgaggccgccaacggcaccaccaacaacugccacaacaacgagaccgucauccucacccccaccauggacucccgccucuacaugcucuccuuccuccccuuccucguccuccucgucuucauccgcaaccuccgcgcccucuccaucuucucccuccucgccaacaucaccaugcucgucucccucgucaugaucuaccaguucaucguccagcgcauccccgaccccucccaccucccccucgucgcccccuggaagaccuacccccucuucuucggcaccgccaucuucuccuucgagggcaucggcaugguccucccccucgagaacaagaugaaggacccccgcaaguucccccucauccucuaccucggcauggucaucgucaccauccucuacaucucccucggcugccucggcuaccuccaguucggcgccaacauccagggcuccaucacccucaaccuccccaacugcuggcucuaccaguccgucaagcuccucuacuccaucggcaucuucuucaccuacgcccuccaguucuacguccccgccgagaucaucauccccuucuucgucucccgcgcccccgagcacugcgagcucgucgucgaccucuucguccgcaccguccucgucugccucaccugcauccucgccauccucaucccccgccucgaccucgucaucucccucgucggcuccgucuccuccuccgcccucgcccucaucauccccccccuccucgaggucaccaccuucuacuccgagggcauguccccccucaccaucuucaaggacgcccucaucuccauccucggcuucgucggcuucgucgucggcaccuacgaggcccucuacgagcucauccagcccuccaacgcccccaucuucaucaacuccaccugcgccuucaucuga

SEQ ID NO: 49678 - RNA, 1452 nt, Artificial Sequence
  derived and/or modified sequence opt2 from SLC36A2__Homo_sapiens__NP_861441
auguccgucaccaaguccaccgagggcccccagggcgccgucgccaucaagcucgaccucauguccccccccgaguccgccaagaagcucgagaacaaggacuccaccuuccucgacgagucccccuccgaguccgccggccucaagaagaccaagggcaucaccgucuuccaggcccucauccaccucgucaagggcaacaugggcaccggcauccucggccucccccucgccgucaagaacgccggcauccucaugggcccccucucccuccucgucaugggcuucaucgccugccacugcaugcacauccucgucaagugcgcccagcgcuucugcaagcgccucaacaagcccuucauggacuacggcgacaccgucaugcacggccucgaggccaaccccaacgccuggcuccagaaccacgcccacuggggccgccacaucgucuccuucuuccucaucaucacccagcucggcuucugcugcgucuacaucgucuuccucgccgacaaccucaagcaggucgucgaggccgucaacuccaccaccaacaacugcuacuccaacgagaccgucauccucacccccaccauggacucccgccucuacaugcucuccuuccuccccuuccucguccuccucguccucauccgcaaccuccgcauccucaccaucuucuccaugcucgccaacaucuccaugcucgucucccucgucaucaucauccaguacaucacccaggagauccccgaccccucccgccucccccucgucgccuccuggaagaccuacccccucuucuucggcaccgccaucuucuccuucgaguccaucggcgucguccucccccucgagaacaagaugaagaacgcccgccacuuccccgccauccucucccucggcauguccaucgucaccucccucuacaucggcauggccgcccucggcuaccuccgcuucggcgacgacaucaaggccuccaucucccucaaccuccccaacugcuggcucuaccaguccgucaagcuccucuacaucgccggcauccucugcaccuacgcccuccaguucuacguccccgccgagaucaucauccccuucgccaucucccgcgucuccacccgcugggcccucccccucgaccucuccauccgccucgucauggucugccucaccugccuccucgccauccucaucccccgccucgaccucgucaucucccucgucggcuccgucuccggcaccgcccucgcccucaucauccccccccuccucgaggucaccaccuucuacuccgagggcauguccccccucaccaucuucaaggacgcccucaucuccauccucggcuucgucggcuucgucgucggcaccuaccaggcccucgacgagcuccucaaguccgaggacucccaccccuucuccaacuccaccaccuucguccgcuga

SEQ ID NO: 49679 - RNA, 1602 nt, Artificial Sequence
  derived and/or modified sequence opt2 from SLC37A1__Homo_sapiens__NP_061837
auggcccgccuccccgccggcauccgcuucaucaucuccuucucccgcgaccagugguaccgcgccuucaucuucauccucaccuuccuccucuacgccuccuuccaccucucccgcaagcccaucuccaucgucaagggcgagcuccacaaguacugcaccgccugggacgaggccgacguccgcuucuccucccagaaccgcaaguccggcuccgccgccccccaccagcuccccgacaacgagaccgacugcggcugggcccccuucgacaagaacaacuaccagcagcuccucggcgcccucgacuacuccuuccucugcgccuacgccgucggcauguaccucuccggcaucaucggcgagcgccuccccauccgcuacuaccucaccuucggcaugcucgccuccggcgccuucaccgcccucuucggccucggcuacuucuacaacauccacuccuucggcuucuacgucgucacccaggucaucaacggccucguccagaccaccggcuggcccuccgucgucaccugccucggcaacugguucggcaagggccgccgcggccucaucaugggcgucuggaacucccacaccuccgucggcaacauccucggcucccucaucgccggcuacugggucuccaccugcuggggccucuccuucgucguccccggcgccaucgucgccgccaugggcaucgucugcuuccucuuccucaucgagcaccccaacgacguccgcugcuccuccacccucgucacccacuccaagggcuacgagaacggcaccaaccgccuccgccuccagaagcagauccucaaguccgagaagaacaagccccucgaccccgagaugcagugccuccuccucuccgacggcaagggcuccauccaccccaaccacgucgucauccuccccggcgacggcggcuccggcaccgccgccaucuccuucaccggcgcccucaagauccccggcgucaucgaguucucccucugccuccucuucgccaagcucgucuccuacaccuuccucuucuggcucccccucuacaucaccaacgucgaccaccucgacgccaagaaggccggcgagcucuccacccucuucgacgucggcggcaucuucggcggcauccucgccggcgucaucuccgaccgccucgagaagcgcgccuccaccugcggccucaugcuccuccucgccgcccccacccucuacaucuucuccaccgucuccaagaugggccucgaggccaccaucgccaugcuccuccucuccggcgcccucgucuccggccccuacacccucaucaccaccgccgucuccgccgaccucggcacccacaagucccucaagggcaacgcccacgcccucuccaccgucaccgccaucaucgacggcaccggcuccgucggcgccgcccucggcccccuccucgccggccuccucucccccuccggcugguccaacgucuucuacaugcucauguucgccgacgccugcgcccuccucuuccucauccgccucauccacaaggagcucuccugccccggcuccgccaccggcgaccagguccccuucaaggagcaguga

SEQ ID NO: 49680 - RNA, 1506 nt, Artificial Sequence
  derived and/or modified sequence opt2 from SLC37A2__Homo_sapiens__NP_001138762
augcgcuccucccucgcccccggcgucugguucuuccgcgccuucucccgcgacuccugguuccgcggccucauccuccuccucaccuuccucaucuacgccugcuaccacaugucccgcaagcccaucuccaucgucaagucccgccuccaccagaacugcuccgagcagaucaagcccaucaacgacacccacucccucaacgacaccauguggugcuccugggcccccuucgacaaggacaacuacaaggagcuccucggcggcgucgacaacgccuuccucaucgccuacgccaucggcauguucaucuccggcgucuucggcgagcgccucccccuccgcuacuaccucuccgccggcaugcuccucuccggccucuucaccucccucuucggccucggcuacuucuggaacauccacgagcucugguacuucgucgucauccaggucugcaacggccucguccagaccaccggcuggcccuccgucgucaccugcgucggcaacugguucggcaagggcaagcgcggcuucaucaugggcaucuggaacucccacaccuccgucggcaacauccucggcucccucaucgccggcaucugggucaacggccaguggggccucuccuucaucguccccggcaucaucaccgccgucaugggcgucaucaccuuccucuuccucaucgagcaccccgaggacgucgacugcgcccccccccagcaccacggcgagcccgccgagaaccaggacaaccccgaggaccccggcaacucccccugcuccauccgcgaguccggccucgagaccgucgccaagugcuccaagggccccugcgaggagcccgccgccaucuccuucuucggcgcccuccgcauccccggcgucgucgaguucucccucugccuccucuucgccaagcucgucuccuacaccuuccucuacuggcucccccucuacaucgccaacgucgcccacuucuccgccaaggaggccggcgaccucuccacccucuucgacgucggcggcaucaucggcggcaucgucgccggccucgucuccgacuacaccaacggccgcgccaccaccugcugcgucaugcucauccucgccgcccccaugauguuccucuacaacuacaucggccaggacggcaucgccuccuccaucgucaugcucaucaucugcggcggccucgucaacggccccuacgcccucaucaccaccgccgucuccgccgaccucggcacccacaagucccucaagggcaacgccaaggcccucuccaccgucaccgccaucaucgacggcaccggcuccaucggcgccgcccucggcccccuccucgccggccucaucucccccaccggcuggaacaacgucuucuacaugcucaucuccgccgacguccucgccugccuccuccucugccgccucgucuacaaggagauccucgccuggaaggucucccucucccgcggcuccggcuacaaggagaucuga

SEQ ID NO: 49681 - RNA, 1290 nt, Artificial Sequence
  derived and/or modified sequence opt2 from SLC37A4__Homo_sapiens__NP_001157749
auggccgcccagggcuacggcuacuaccgcaccgucaucuucuccgccauguucggcggcuacucccucuacuacuucaaccgcaagaccuucuccuucgucaugcccucccucgucgaggagaucccccucgacaaggacgaccucggcuucaucaccuccucccaguccgccgccuacgccaucuccaaguucgucuccggcguccucuccgaccagauguccgcccgcuggcucuucuccuccggccuccuccucgucggccucgucaacaucuucuucgccugguccuccaccguccccgucuucgccgcccucugguuccucaacggccucgcccagggccucggcuggccccccugcggcaagguccuccgcaagugguucgagcccucccaguucggcaccuggugggccauccucuccaccuccaugaaccucgccggcggccucggccccauccucgccaccauccucgcccaguccuacuccuggcgcuccacccucgcccucuccggcgcccucugcgucgucgucuccuuccucugccuccuccucauccacaacgagcccgccgacgucggccuccgcaaccucgaccccaugcccuccgagggcaagaagggcucccucaaggaggaguccacccuccaggagcuccuccucucccccuaccucuggguccucuccaccggcuaccucgucgucuucggcgucaagaccugcugcaccgacuggggccaguucuuccucauccaggagaagggccaguccgcccucgucggcuccuccuacauguccgcccucgaggucggcggccucgucggcuccaucgccgccggcuaccucuccgaccgcgccauggccaaggccggccucuccaacuacggcaacccccgccacggccuccuccucuucaugauggccggcaugaccgucuccauguaccucuuccgcgucaccgucaccuccgacucccccaagcucuggauccucguccucggcgccgucuucggcuucuccuccuacggccccaucgcccucuucggcgucaucgccaacgaguccgccccccccaaccucugcggcaccucccacgccaucgucggccucauggccaacgucggcggcuuccucgccggccuccccuucuccaccaucgccaagcacuacuccugguccaccgccuucugggucgccgaggucaucugcgccgccuccaccgccgccuucuuccuccuccgcaacauccgcaccaagaugggccgcgucuccaagaaggccgaguga

SEQ ID NO: 49682 - RNA, 1464 nt, Artificial Sequence
  derived and/or modified sequence opt2 from SLC38A1__Homo_sapiens__NP_001265316
augaugcacuucaaguccggccucgagcucaccgagcuccagaacaugaccguccccgaggacgacaacaucuccaacgacuccaacgacuucaccgaggucgagaacggccagaucaacuccaaguucaucuccgaccgcgagucccgccgcucccucaccaacucccaccucgagaagaagaagugcgacgaguacauccccggcaccaccucccucggcauguccgucuucaaccucuccaacgccaucaugggcuccggcauccucggccucgccuucgcccucgccaacaccggcauccuccucuuccucguccuccucaccuccgucacccuccucuccaucuacuccaucaaccuccuccucaucugcuccaaggagaccggcugcauggucuacgagaagcucggcgagcaggucuucggcaccaccggcaaguucgucaucuucggcgccaccucccuccagaacaccggcgccaugcucuccuaccucuucaucgucaagaacgagcuccccuccgccaucaaguuccucaugggcaaggaggagaccuucuccgccugguacgucgacggccgcguccucgucgucaucgucaccuucggcaucauccucccccucugccuccucaagaaccucggcuaccucggcuacaccuccggcuucucccucuccugcauggucuucuuccucaucgucgucaucuacaagaaguuccagauccccugcaucguccccgagcucaacuccaccaucuccgccaacuccaccaacgccgacaccugcacccccaaguacgucaccuucaacuccaagaccgucuacgcccuccccaccaucgccuucgccuucgucugccaccccuccguccuccccaucuacuccgagcucaaggaccgcucccagaagaagaugcagauggucuccaacaucuccuucuucgccauguucgucauguacuuccucaccgccaucuucggcuaccucaccuucuacgacaacguccaguccgaccuccuccacaaguaccaguccaaggacgacauccucauccucaccguccgccucgccgucaucgucgccgucauccucaccguccccguccucuucuucaccguccgcuccucccucuucgagcucgccaagaagaccaaguucaaccucugccgccacaccgucgucaccugcauccuccucgucgucaucaaccuccucgucaucuucauccccuccaugaaggacaucuucggcgucgucggcgucaccuccgccaacaugcucaucuucauccuccccuccucccucuaccucaagaucaccgaccaggacggcgacaagggcacccagcgcaucugggccgcccucuuccucggccucggcguccucuucucccucgucuccaucccccucgucaucuacgacugggccugcuccuccuccuccgacgagggccacuga

SEQ ID NO: 49683 - RNA, 1521 nt, Artificial Sequence
  derived and/or modified sequence opt2 from SLC38A2__Homo_sapiens__NP_061849
augaagaaggccgagaugggccgcuucuccaucucccccgacgaggacuccuccuccuacuccuccaacuccgacuucaacuacuccuaccccaccaagcaggccgcccucaagucccacuacgccgacgucgaccccgagaaccagaacuuccuccucgaguccaaccucggcaagaagaaguacgagaccgaguuccaccccggcaccaccuccuucggcauguccgucuucaaccucuccaacgccaucgucggcuccggcauccucggccucuccuacgccauggccaacaccggcaucgcccucuucaucauccuccucaccuucgucuccaucuucucccucuacuccguccaccuccuccucaagaccgccaacgagggcggcucccuccucuacgagcagcucggcuacaaggccuucggccucgucggcaagcucgccgccuccggcuccaucaccaugcagaacaucggcgccauguccuccuaccucuucaucgucaaguacgagcucccccucgucauccaggcccucaccaacaucgaggacaagaccggccucugguaccucaacggcaacuaccucguccuccucgucucccucgucgucauccucccccucucccucuuccgcaaccucggcuaccucggcuacaccuccggccucucccuccucugcauggucuucuuccucaucgucgucaucugcaagaaguuccagguccccugccccgucgaggccgcccucaucaucaacgagaccaucaacaccacccucacccagcccaccgcccucguccccgcccucucccacaacgucaccgagaacgacuccugccgcccccacuacuucaucuucaacucccagaccgucuacgccguccccauccucaucuucuccuucgucugccaccccgccguccuccccaucuacgaggagcucaaggaccgcucccgccgccgcaugaugaacgucuccaagaucuccuucuucgccauguuccucauguaccuccucgccgcccucuucggcuaccucaccuucuacgagcacgucgaguccgagcuccuccacaccuacuccuccauccucggcaccgacauccuccuccucaucguccgccucgccguccucauggccgucacccucaccguccccgucgucaucuuccccauccgcuccuccgucacccaccuccucugcgccuccaaggacuucuccugguggcgccacucccucaucaccgucuccauccucgccuucaccaaccuccucgucaucuucguccccaccauccgcgacaucuucggcuucaucggcgccuccgccgccuccaugcucaucuucauccuccccuccgccuucuacaucaagcucgucaagaaggagcccaugaaguccguccagaagaucggcgcccucuucuuccuccucuccggcguccucgucaugaccggcuccauggcccucaucguccucgacuggguccacaacgcccccggcggcggccacuga

SEQ ID NO: 49684 - RNA, 1644 nt, Artificial Sequence
  derived and/or modified sequence opt2 from SLC38A4__Homo_sapiens__NP_001137296
auggaccccauggagcuccgcaacgucaacaucgagcccgacgacgaguccuccuccggcgaguccgcccccgacuccuacaucggcaucggcaacuccgagaaggccgccauguccucccaguucgccaacgaggacaccgagucccagaaguuccucaccaacggcuuccucggcaagaagaagcucgccgacuacgccgacgagcaccaccccggcaccaccuccuucggcauguccuccuucaaccucuccaacgccaucaugggcuccggcauccucggccucuccuacgccauggccaacaccggcaucauccucuucaucaucaugcuccucgccgucgccauccucucccucuacuccguccaccuccuccucaagaccgccaaggagggcggcucccucaucuacgagaagcucggcgagaaggccuucggcuggcccggcaagaucggcgccuucgucuccaucaccaugcagaacaucggcgccauguccuccuaccucuucaucaucaaguacgagcuccccgaggucauccgcgccuucaugggccucgaggagaacaccggcgagugguaccucaacggcaacuaccucaucaucuucgucuccgucggcaucauccucccccucucccuccucaagaaccucggcuaccucggcuacaccuccggcuucucccucaccugcauggucuucuucgucuccgucgucaucuacaagaaguuccagauccccugcccccuccccguccucgaccacuccgucggcaaccucuccuucaacaacacccuccccaugcacgucgucaugcuccccaacaacuccgaguccuccgacgucaacuucaugauggacuacacccaccgcaaccccgccggccucgacgagaaccaggccaagggcucccuccacgacuccggcgucgaguacgaggcccacuccgacgacaagugcgagcccaaguacuucgucuucaacucccgcaccgccuacgccauccccauccucgucuucgccuucgucugccaccccgagguccuccccaucuacuccgagcucaaggaccgcucccgccgcaagaugcagaccgucuccaacaucuccaucaccggcaugcucgucauguaccuccucgccgcccucuucggcuaccucaccuucuacggcgaggucgaggacgagcuccuccacgccuacuccaaggucuacacccucgacaucccccuccucaugguccgccucgccguccucgucgccgucacccucaccguccccaucguccucuuccccauccgcaccuccgucaucacccuccucuuccccaagcgccccuucuccuggauccgccacuuccucaucgccgccguccucaucgcccucaacaacguccucgucauccucguccccaccaucaaguacaucuucggcuucaucggcgccuccuccgccaccaugcucaucuucauccuccccgccgucuucuaccucaagcucgucaagaaggagaccuuccgcuccccccagaaggucggcgcccucaucuuccucgucgucggcaucuucuucaugaucggcuccauggcccucaucaucaucgacuggaucuacgacccccccaacuccaagcaccacuga

SEQ ID NO: 49685 - RNA, 1419 nt, Artificial Sequence
  derived and/or modified sequence opt2 from SLC38A5__Homo_sapiens__NP_277053
auggagcuccaggaccccaagaugaacggcgcccuccccuccgacgccgucggcuaccgccaggagcgcgagggcuuccuccccucccgcggccccgcccccggcuccaagcccguccaguucauggacuucgagggcaagaccuccuucggcauguccgucuucaaccucuccaacgccaucaugggcuccggcauccucggccucgccuacgccauggcccacaccggcgucaucuucuuccucgcccuccuccucugcaucgcccuccucuccuccuacuccauccaccuccuccucaccugcgccggcaucgccggcauccgcgccuacgagcagcucggccagcgcgccuucggccccgccggcaaggucgucgucgccaccgucaucugccuccacaacgucggcgccauguccuccuaccucuucaucaucaaguccgagcucccccucgucaucggcaccuuccucuacauggaccccgagggcgacugguuccucaagggcaaccuccucaucaucaucgucuccguccucaucauccucccccucgcccucaugaagcaccucggcuaccucggcuacaccuccggccucucccucaccugcaugcucuucuuccucgucuccgucaucuacaagaaguuccagcucggcugcgccaucggccacaacgagaccgccauggaguccgaggcccucgucggccuccccucccagggccucaacuccuccugcgaggcccagauguucaccgucgacucccagauguccuacaccguccccaucauggccuucgccuucgucugccaccccgagguccuccccaucuacaccgagcucugccgccccuccaagcgccgcaugcaggccgucgccaacgucuccaucggcgccauguucugcauguacggccucaccgccaccuucggcuaccucaccuucuacuccuccgucaaggccgagaugcuccacauguacucccagaaggacccccucauccucugcguccgccucgccguccuccucgccgucacccucaccguccccgucguccucuuccccauccgccgcgcccuccagcagcuccucuuccccggcaaggccuucuccuggccccgccacgucgccaucgcccucauccuccucguccucgucaacguccucgucaucugcguccccaccauccgcgacaucuucggcgucaucggcuccaccuccgcccccucccucaucuucauccuccccuccaucuucuaccuccgcaucguccccuccgaggucgagcccuuccucuccuggcccaagauccaggcccucugcuucggcguccucggcguccucuucauggccgucucccucggcuucauguucgccaacugggccaccggccagucccgcauguccggccacuga

SEQ ID NO: 49686 - RNA, 1566 nt, Artificial Sequence
  derived and/or modified sequence opt2 from SLC38A6__Homo_sapiens__NP_001166173
auggaggccuccuggggcuccuucaacgccgagcgcggcugguacgucuccguccagcagcccgaggaggccgaggccgaggagcucuccccccuccucuccaacgagcuccaccgccagcgcucccccggcgucuccuucggccucuccgucuucaaccucaugaacgccaucaugggcuccggcauccucggccucgccuacguccucgccaacaccggcgucuucggcuucuccuuccuccuccucaccgucgcccuccucgccuccuacuccguccaccuccuccucuccaugugcauccagaccgccgucaccuccuacgaggaccucggccucuucgccuucggccuccccggcaagcucgucgucgccggcaccaucaucauccagaacaucggcgccauguccuccuaccuccucaucaucaagaccgagcuccccgccgccaucgccgaguuccucaccggcgacuacucccgcuacugguaccucgacggccagacccuccucaucaucaucugcgucggcaucgucuucccccucgcccuccuccccaagaucggcuuccucggcuacaccuccucccucuccuucuucuucaugauguucuucgcccucgucgucaucaucaagaagugguccauccccugcccccucacccucaacuacgucgagaagggcuuccagaucuccaacgucaccgacgacugcaagcccaagcucuuccacuucuccaaggaguccgccuacgcccuccccaccauggccuucuccuuccucugccacaccuccauccuccccaucuacugcgagcuccagucccccuccaagaagcgcaugcagaacgucaccaacaccgccaucgcccucuccuuccucaucuacuucaucuccgcccucuucggcuaccucaccuucuacgacaaggucgaguccgagcuccucaagggcuacuccaaguaccucucccacgacgucgucgucaugaccgucaagcucugcauccucuucgccguccuccucaccgucccccucauccacuuccccgcccgcaaggccgucaccaugauguucuucuccaacuuccccuucuccuggauccgccacuuccucaucacccucgcccucaacaucaucaucguccuccucgccaucuacguccccgacauccgcaacgucuucggcgucgucggcgccuccaccuccaccugccucaucuucaucuuccccggccucuucuaccucaagcucucccgcgaggacuuccucuccuggaagaagcucggcggccucauccucucccaccgccucgccugcuccggcgucaucuccgcccacugcaaccucugccuccccgacuccuccaacccccccaccuccgccucccgcgucgccgagaccaccggccgcgacaccauggagaugugcacccagcgcaagggccacgcccgcacccagcaggagggcaacugccuccaggccaagggccgcggccuccgccgcaccaagcgcguccacacccucauccuccacuuccccaccucccgcaccgucuccaaguga

SEQ ID NO: 49687 - RNA, 1389 nt, Artificial Sequence
  derived and/or modified sequence opt2 from SLC38A7__Homo_sapiens__NP_060701
auggcccaggucuccaucaacaacgacuacuccgagugggaccucuccaccgacgccggcgagcgcgcccgccuccuccagucccccugcgucgacaccgcccccaaguccgagugggaggccucccccggcggccucgaccgcggcaccaccuccacccucggcgccaucuucaucgucgucaacgccugccucggcgccggccuccucaacuuccccgccgccuucuccaccgccggcggcgucgccgccggcaucgcccuccagaugggcaugcucgucuucaucaucuccggccucgucauccucgccuacugcucccaggccuccaacgagcgcaccuaccaggaggucgucugggccgucugcggcaagcucaccggcguccucugcgaggucgccaucgccgucuacaccuucggcaccugcaucgccuuccucaucaucaucggcgaccagcaggacaagaucaucgccgucauggccaaggagcccgagggcgccuccggccccugguacaccgaccgcaaguucaccaucucccucaccgccuuccucuucauccucccccucuccaucccccgcgagaucggcuuccagaaguacgccuccuuccucuccgucgucggcaccugguacgucaccgccaucgucaucaucaaguacaucuggcccgacaaggagaugacccccggcaacauccucacccgccccgccuccuggauggccgucuucaacgccaugcccaccaucugcuucggcuuccagugccacgucuccuccguccccgucuucaacuccaugcagcagcccgaggucaagaccuggggcggcgucgucaccgccgccauggucaucgcccucgccgucuacaugggcaccggcaucugcggcuuccucaccuucggcgccgccgucgaccccgacguccuccucuccuaccccuccgaggacauggccgucgccgucgcccgcgccuucaucauccucuccguccucaccuccuaccccauccuccacuucugcggccgcgccgucgucgagggccucuggcuccgcuaccagggcguccccgucgaggaggacgucggccgcgagcgccgccgccgcguccuccagacccucgucugguuccuccucacccuccuccucgcccucuucauccccgacaucggcaaggucaucuccgucaucggcggccucgccgccugcuucaucuucgucuuccccggccucugccucauccaggccaagcucuccgagauggaggaggucaagcccgccuccugguggguccucgucuccuacggcguccuccucgucacccucggcgccuucaucuucggccagaccaccgccaacgccaucuucgucgaccuccucgccuga

SEQ ID NO: 49688 - RNA, 1308 nt, Artificial Sequence
  derived and/or modified sequence opt2 from SLC38A8__Homo_sapiens__NP_001073911
auggagggccagacccccggcucccgcggccuccccgagaagccccaccccgccaccgccgccgccacccucuccuccaugggcgccgucuucauccucaugaaguccgcccucggcgccggccuccucaacuuccccugggccuucuccaaggccggcggcgucguccccgccuuccucgucgagcucgucucccucgucuuccucaucuccggccucgucauccucggcuacgccgccgccgucuccggccaggccaccuaccagggcgucguccgcggccucugcggccccgccaucggcaagcucugcgaggccugcuuccuccucaaccuccucaugaucuccgucgccuuccuccgcgucaucggcgaccagcucgagaagcucugcgacucccuccucuccggcaccccccccgccccccagcccugguacgccgaccagcgcuucacccucccccuccucuccguccucgucauccucccccucuccgccccccgcgagaucgccuuccagaaguacaccuccauccucggcacccucgccgccugcuaccucgcccucgucaucaccguccaguacuaccucuggccccagggccucguccgcgagucccaccccucccucucccccgccuccuggaccuccgucuucuccgucuuccccaccaucugcuucggcuuccagugccacgaggccgccgucuccaucuacugcuccaugcgcaagcgcucccucucccacugggcccucgucuccguccucucccuccucgccugcugccucaucuacucccucaccggcgucuacggcuuccucaccuucggcaccgaggucuccgccgacguccucauguccuaccccggcaacgacauggucaucaucgucgcccgcguccucuucgccgucuccaucgucaccgucuaccccaucguccucuuccucggccgcuccgucaugcaggacuucuggcgccgcuccugccucggcggcuggggccccuccgcccucgccgaccccuccggccucuggguccgcaugccccucaccauccucugggucaccgucacccucgccauggcccucuucaugcccgaccucuccgagaucgucuccaucaucggcggcaucuccuccuucuucaucuucaucuuccccggccucugccucaucugcgccaugggcgucgagcccaucggcccccgcgucaagugcugccucgaggucuggggcgucgucuccguccucgucggcaccuucaucuucggccaguccaccgccgccgccgucugggagauguucuga

SEQ ID NO: 49689 - RNA, 1497 nt, Artificial Sequence
  derived and/or modified sequence opt2 from SLC38A9__Homo_sapiens__NP_001245215
augaacaagcgcauccacuacuacucccgccucaccacccccgccgacaaggcccucaucgcccccgaccacgucguccccgcccccgaggagugcuacgucuacuccccccucggcuccgccuacaagcuccaguccuacaccgagggcuacggcaagaacaccucccucgucaccaucuucaugaucuggaacaccaugaugggcaccuccauccucuccauccccuggggcaucaagcaggccggcuucaccaccggcaugugcgucaucauccucaugggccuccucacccucuacugcugcuaccgcgucgucaagucccgcaccaugauguucucccucgacaccaccuccugggaguaccccgacgucugccgccacuacuucggcuccuucggccagugguccucccuccucuucucccucgucucccucaucggcgccaugaucgucuacuggguccucauguccaacuuccucuucaacaccggcaaguucaucuucaacuucauccaccacaucaacgacaccgacaccauccucuccaccaacaacuccaaccccgucaucugccccuccgccggcuccggcggccaccccgacaacuccuccaugaucuucuacgccaacgacaccggcgcccagcaguucgagaaguggugggacaagucccgcaccguccccuucuaccucgucggccuccuccucccccuccucaacuucaagucccccuccuucuucuccaaguucaacauccucggcaccgucuccguccucuaccucaucuuccucgucaccuucaaggccguccgccucggcuuccaccucgaguuccacugguucauccccaccgaguucuucguccccgagauccgcuuccaguucccccagcucaccggcguccucacccucgccuucuucauccacaacugcaucaucacccuccucaagaacaacaagaagcaggagaacaacguccgcgaccucugcaucgccuacaugcucgucacccucaccuaccucuacaucggcguccucgucuucgccuccuuccccucccccccccucuccaaggacugcaucgagcagaacuuccucgacaacuuccccuccuccgacacccucuccuucaucgcccgcaucuuccuccucuuccagaugaugaccgucuacccccuccucggcuaccucgcccgcguccagcuccucggccacaucuucggcgacaucuaccccuccaucuuccacguccucauccucaaccucaucaucgucggcgccggcgucaucauggccugcuucuaccccaacaucggcggcaucauccgcuacuccggcgccgccugcggccucgccuucgucuucaucuaccccucccucaucuacaucaucucccuccaccaggaggagcgccucaccuggcccaagcucaucuuccacgucuucaucaucauccucggcgucgccaaccucaucguccaguucuucauguga

SEQ ID NO: 49690 - RNA, 2496 nt, Artificial Sequence
  derived and/or modified sequence opt2 from SLC39A10__Homo_sapiens__NP_001120729
augaagguccacaugcacaccaaguucugccucaucugccuccucaccuucaucuuccaccacugcaaccacugccacgaggagcacgaccacggccccgaggcccuccaccgccagcaccgcggcaugaccgagcucgagcccuccaaguucuccaagcaggccgccgagaacgagaagaaguacuacaucgagaagcucuucgagcgcuacggcgagaacggccgccucuccuucuucggccucgagaagcuccucaccaaccucggccucggcgagcgcaaggucgucgagaucaaccacgaggaccucggccacgaccacgucucccaccucgacauccucgccguccaggagggcaagcacuuccacucccacaaccaccagcacucccacaaccaccucaacuccgagaaccagaccgucaccuccgucuccaccaagcgcaaccacaagugcgaccccgagaaggagaccgucgaggucuccgucaaguccgacgacaagcacaugcacgaccacaaccaccgccuccgccaccaccaccgccuccaccaccaccucgaccacaacaacacccaccacuuccacaacgacuccaucacccccuccgagcgcggcgagcccuccaacgagcccuccaccgagaccaacaagacccaggagcaguccgacgucaagcuccccaagggcaagcgcaagaagaagggccgcaaguccaacgagaacuccgaggucaucacccccggcuucccccccaaccacgaccagggcgagcaguacgagcacaaccgcguccacaagcccgaccgcguccacaaccccggccacucccacguccaccuccccgagcgcaacggccacgaccccggccgcggccaccaggaccucgaccccgacaacgagggcgagcuccgccacacccgcaagcgcgaggccccccacgucaagaacaacgccaucaucucccuccgcaaggaccucaacgaggacgaccaccaccacgagugccucaacgucacccagcuccucaaguacuacggccacggcgccaacucccccaucuccaccgaccucuucaccuaccucugccccgcccuccucuaccagaucgacucccgccucugcaucgagcacuucgacaagcuccucgucgaggacaucaacaaggacaagaaccucguccccgaggacgaggccaacaucggcgccuccgccuggaucugcggcaucaucuccaucaccgucaucucccuccucucccuccucggcgucauccucguccccaucaucaaccagggcugcuucaaguuccuccucaccuuccucgucgcccucgccgucggcaccauguccggcgacgcccuccuccaccuccucccccacucccagggcggccacgaccacucccaccagcacgcccacggccacggccacucccacggccacgaguccaacaaguuccucgaggaguacgacgccguccucaagggccucgucgcccucggcggcaucuaccuccucuucaucaucgagcacugcauccgcauguucaagcacuacaagcagcagcgcggcaagcagaagugguucaugaagcagaacaccgaggaguccaccaucggccgcaagcucuccgaccacaagcucaacaacacccccgacuccgacuggcuccagcucaagccccucgccggcaccgacgacuccgucgucuccgaggaccgccucaacgagaccgagcucaccgaccucgagggccagcaggaguccccccccaagaacuaccucugcaucgaggaggagaagaucaucgaccacucccacuccgacggccuccacaccauccacgagcacgaccuccacgccgccgcccacaaccaccacggcgagaacaagaccguccuccgcaagcacaaccaccaguggcaccacaagcacucccaccacucccacggccccugccacuccggcuccgaccucaaggagaccggcaucgccaacaucgccuggauggucaucaugggcgacggcauccacaacuucuccgacggccucgccaucggcgccgccuucuccgccggccucaccggcggcaucuccaccuccaucgccgucuucugccacgagcucccccacgagcucggcgacuucgccguccuccucaaggccggcaugaccgucaagcaggccaucgucuacaaccuccucuccgccaugauggccuacaucggcaugcucaucggcaccgccgucggccaguacgccaacaacaucacccucuggaucuucgccgucaccgccggcauguuccucuacgucgcccucgucgacaugcuccccgagaugcuccacggcgacggcgacaacgaggagcacggcuucugccccgucggccaguucauccuccagaaccucggccuccucuucggcuucgccaucaugcucgucaucgcccucuacgaggacaagaucgucuucgacauccaguucuga

SEQ ID NO: 49691 - RNA, 1029 nt, Artificial Sequence
  derived and/or modified sequence opt2 from SLC39A11__Homo_sapiens__NP_001153242
augcuccagggccacuccuccgucuuccaggcccuccucggcaccuucuucaccuggggcaugaccgccgccggcgccgcccucgucuucgucuucuccuccggccagcgccgcauccucgacggcucccucggcuucgccgccggcgucaugcucgccgccuccuacuggucccuccucgcccccgccgucgagauggccaccuccuccggcggcuucggcgccuucgccuucuuccccgucgccgucggcuucacccucggcgccgccuucgucuaccucgccgaccuccucaugccccaccucggcgccgccgaggacccccagaccacccucgcccucaacuucggcuccacccucaugaagaagaaguccgaccccgagggccccgcccuccucuuccccgaguccgagcucuccauccgcaucggccgcgccggccuccucuccgacaaguccgagaacggcgaggccuaccagcgcaagaaggccgccgccaccggccuccccgagggccccgccguccccguccccucccgcggcaaccucgcccagcccggcggcuccuccuggcgccgcaucgcccuccucauccucgccaucaccauccacaacguccccgagggccucgccgucggcgucggcuucggcgccaucgagaagaccgccuccgccaccuucgaguccgcccgcaaccucgccaucggcaucggcauccagaacuuccccgagggccucgccgucucccucccccuccgcggcgccggcuucuccaccuggcgcgccuucugguacggccagcucuccggcauggucgagccccucgccggcgucuucggcgccuucgccgucguccucgccgagcccauccuccccuacgcccucgccuucgccgccggcgccauggucuacgucgucauggacgacaucauccccgaggcccagaucuccggcaacggcaagcucgccuccugggccuccauccucggcuucgucgucaugaugucccucgacgucggccucggcuga

SEQ ID NO: 49692 - RNA, 2076 nt, Artificial Sequence
  derived and/or modified sequence opt2 from SLC39A12__Homo_sapiens__NP_001138667
augugcuuccgcaccaagcucuccgucuccugggucccccucuuccuccuccucucccgcgucuucuccaccgagaccgacaagcccuccgcccaggacucccgcucccgcggcuccuccggccagcccgccgaccuccuccagguccucuccgccggcgaccaccccccccacaaccacucccgcucccucaucaagacccuccucgagaagaccggcugcccccgccgccgcaacggcaugcagggcgacugcaaccucugcuucgagcccgacgcccuccuccucaucgccggcggcaacuucgaggaccagcuccgcgaggaggucguccagcgcgucucccuccuccuccucuacuacaucauccaccaggaggagaucugcuccuccaagcucaacauguccaacaaggaguacaaguucuaccuccacucccuccucucccuccgccaggacgaggacuccuccuuccucucccagaacgagaccgaggacauccucgccuucacccgccaguacuucgacaccucccagucccagugcauggagaccaagacccuccagaagaaguccggcaucgucuccuccgagggcgccaacgaguccacccucccccagcucgccgccaugaucaucacccucucccuccagggcgucugccucggccagggcaaccuccccucccccgacuacuucaccgaguacaucuucuccucccucaaccgcaccaacacccuccgccucuccgagcucgaccagcuccucaacacccucuggacccgcuccaccugcaucaagaacgagaagauccaccaguuccagcgcaagcagaacaacaucaucacccacgaccaggacuacuccaacuucuccuccuccauggagaaggaguccgaggacggccccgucuccugggaccagaccugcuucuccgcccgccagcucgucgagaucuuccuccagaagggccucucccucaucuccaaggaggacuucaagcagaugucccccggcaucauccagcagcuccucuccugcuccugccaccuccccaaggaccagcaggccaagcucccccccaccacccucgagaaguacggcuacuccaccgucgccgucacccuccucacccucggcuccaugcucggcaccgcccucguccucuuccacuccugcgaggagaacuaccgccucauccuccagcucuucgucggccucgccgucggcacccucuccggcgacgcccuccuccaccucaucccccagguccucggccuccacaagcaggaggcccccgaguucggccacuuccacgaguccaagggccacaucuggaagcucaugggccucaucggcggcauccacggcuucuuccucaucgagaagugcuucauccuccucgucucccccaacgacaagcagggccucucccucgucaacggccacgucggccacucccaccaccucgcccucaacuccgagcucuccgaccaggccggccgcggcaaguccgccuccaccauccagcucaagucccccgaggacucccaggccgccgagaugcccaucggcuccaugaccgccuccaaccgcaagugcaaggccaucucccuccucgccaucaugauccucgucggcgacucccuccacaacuucgccgacggccucgccaucggcgccgccuucuccuccuccuccgaguccggcgucaccaccaccaucgccauccucugccacgagaucccccacgagaugggcgacuucgccguccuccucuccuccggccucuccaugaagaccgccauccucaugaacuucaucuccucccucaccgccuucaugggccucuacaucggccucuccgucuccgccgaccccugcguccaggacuggaucuucaccgucaccgccggcauguuccucuaccucucccucgucgagaugcuccccgagaugacccacguccagacccagcgccccuggaugauguuccuccuccagaacuucggccucauccucggcuggcucucccuccuccuccucgccaucuacgagcagaacaucaagaucuga

SEQ ID NO: 49693 - RNA, 1116 nt, Artificial Sequence
  derived and/or modified sequence opt2 from SLC39A13__Homo_sapiens__NP_001121697
augcccggcugccccugccccggcugcggcauggccggcccccgccuccucuuccucaccgcccucgcccucgagcuccucggccgcgccggcggcucccagcccgcccuccgcucccgcggcaccgccaccgccugccgccucgacaacaaggaguccgaguccuggggcgcccuccucuccggcgagcgccucgacaccuggaucugcucccuccucggcucccucauggucggccucuccggcgucuucccccuccucgucaucccccucgagaugggcaccaugcuccgcuccgaggccggcgccuggcgccucaagcagcuccucuccuucgcccucggcggccuccucggcaacgucuuccuccaccuccuccccgaggccugggccuacaccugcuccgccucccccggcggcgagggccagucccuccagcagcagcagcagcucggccucugggucaucgccggcauccucaccuuccucgcccucgagaagauguuccucgacuccaaggaggagggcaccucccaggcccccaacaaggaccccaccgccgccgccgccgcccucaacggcggccacugccucgcccagcccgccgccgagcccggccucggcgccgucguccgcuccaucaaggucuccggcuaccucaaccuccucgccaacaccaucgacaacuucacccacggccucgccgucgccgccuccuuccucgucuccaagaagaucggccuccucaccaccauggccauccuccuccacgagaucccccacgaggucggcgacuucgccauccuccuccgcgccggcuucgaccgcugguccgccgccaagcuccagcucuccaccgcccucggcggccuccucggcgccggcuucgccaucugcacccagucccccaagggcgucgucggcugcucccccgccgccgaggagaccgccgccuggguccuccccuucaccuccggcggcuuccucuacaucgcccucgucaacguccuccccgaccuccucgaggaggaggaccccuggcgcucccuccagcagcuccuccuccucugcgccggcaucgucgucaugguccucuucucccucuucgucgacuga

SEQ ID NO: 49694 - RNA, 1479 nt, Artificial Sequence
  derived and/or modified sequence opt2 from SLC39A14__Homo_sapiens__NP_001121903
augaagcuccuccuccuccaccccgccuuccaguccugccuccuccucacccuccucggccucuggcgcaccacccccgaggcccacgccuccucccucggcgcccccgccaucuccgccgccuccuuccuccaggaccucauccaccgcuacggcgagggcgacucccucacccuccagcagcucaaggcccuccucaaccaccucgacgucggcgucggccgcggcaacgucacccagcacguccagggccaccgcaaccucuccaccugcuucuccuccggcgaccucuucaccgcccacaacuucuccgagcagucccgcaucggcuccuccgagcuccaggaguucugccccaccauccuccagcagcucgacucccgcgccugcaccuccgagaaccaggagaacgaggagaacgagcagaccgaggagggccgccccuccgccgucgaggucuggggcuacggccuccucugcgucaccgucaucucccucugcucccuccucggcgccuccgucguccccuucaugaagaagaccuucuacaagcgccuccuccucuacuucaucgcccucgccaucggcacccucuacuccaacgcccucuuccagcucauccccgaggccuucggcuucaacccccucgaggacuacuacgucuccaaguccgccgucgucuucggcggcuucuaccucuucuucuucaccgagaagauccucaagauccuccucaagcagaagaacgagcaccaccacggccacucccacuacgccuccgagucccuccccuccaagaaggaccaggaggagggcgucauggagaagcuccagaacggcgaccucgaccacaugaucccccagcacugcuccuccgagcucgacggcaaggcccccauggucgacgagaaggucaucgucggcucccucuccguccaggaccuccaggccucccaguccgccugcuacuggcucaagggcguccgcuacuccgacaucggcacccucgccuggaugaucacccucuccgacggccuccacaacuucaucgacggccucgccaucggcgccuccuucaccgucuccgucuuccagggcaucuccaccuccgucgccauccucugcgaggaguucccccacgagcucggcgacuucgucauccuccucaacgccggcauguccauccagcaggcccucuucuucaacuuccucuccgccugcugcugcuaccucggccucgccuucggcauccucgccggcucccacuucuccgccaacuggaucuucgcccucgccggcggcauguuccucuacaucucccucgccgacauguuccccgagaugaacgaggucugccaggaggacgagcgcaagggcuccauccucauccccuucaucauccagaaccucggccuccucaccggcuucaccaucauggucguccucaccauguacuccggccagauccagaucggcuga

SEQ ID NO: 49695 - RNA, 975 nt, Artificial Sequence
  derived and/or modified sequence opt2 from SLC39A1__Homo_sapiens__NP_001258888
augggccccuggggcgagcccgagcuccucgucuggcgccccgaggccgucgccuccgagccccccguccccgucggccucgaggucaagcucggcgcccucguccuccuccucguccucacccuccucugcucccucguccccaucugcguccuccgccgccccggcgccaaccacgagggcuccgccucccgccagaaggcccucucccucgucuccugcuucgccggcggcgucuuccucgccaccugccuccucgaccuccuccccgacuaccucgccgccaucgacgaggcccucgccgcccuccacgucacccuccaguucccccuccaggaguucauccucgccaugggcuucuuccucguccucgucauggagcagaucacccucgccuacaaggagcaguccggccccuccccccucgaggagacccgcgcccuccucggcaccgucaacggcggcccccagcacuggcacgacggccccggcgucccccaggccuccggcgcccccgccacccccuccgcccuccgcgccugcguccucgucuucucccucgcccuccacuccgucuucgagggccucgccgucggccuccagcgcgaccgcgcccgcgccauggagcucugccucgcccuccuccuccacaagggcauccucgccgucucccucucccuccgccuccuccagucccaccuccgcgcccaggucgucgccggcugcggcauccucuucuccugcaugaccccccucggcaucggccucggcgccgcccucgccgaguccgccggcccccuccaccagcucgcccaguccguccucgagggcauggccgccggcaccuuccucuacaucaccuuccucgagauccucccccaggagcucgccuccuccgagcagcgcauccucaaggucauccuccuccucgccggcuucgcccuccucaccggccuccucuucauccagaucuga

SEQ ID NO: 49696 - RNA, 930 nt, Artificial Sequence
  derived and/or modified sequence opt2 from SLC39A2__Homo_sapiens__NP_055394
auggagcagcuccucggcaucaagcucggcugccucuucgcccuccucgcccucacccucggcugcggccucacccccaucugcuucaagugguuccagaucgacgccgcccgcggccaccaccgccucguccuccgccuccucggcugcaucuccgccggcgucuuccucggcgccggcuucaugcacaugaccgccgaggcccucgaggagaucgagucccagauccagaaguucaugguccagaaccgcuccgccuccgagcgcaacuccuccggcgacgccgacuccgcccacauggaguaccccuacggcgagcucaucaucucccucggcuucuucuucgucuucuuccucgagucccucgcccuccagugcugccccggcgccgccggcggcuccaccguccaggacgaggaguggggcggcgcccacaucuucgagcuccacucccacggccaccuccccucccccuccaagggcccccuccgcgcccucguccuccuccucucccucuccuuccacuccgucuucgagggccucgccgucggccuccagcccaccgucgccgccaccguccagcucugccucgccguccucgcccacaagggccucgucgucuucggcgucggcaugcgccucguccaccucggcaccuccucccgcugggccgucuucuccauccuccuccucgcccucauguccccccucggccucgccgucggccucgccgucaccggcggcgacuccgagggcggccgcggccucgcccaggccguccucgagggcgucgccgccggcaccuuccucuacgucaccuuccucgagauccucccccgcgagcucgccucccccgaggccccccucgccaagugguccugcgucgccgccggcuucgccuucauggccuucaucgcccucugggccuga

SEQ ID NO: 49697 - RNA, 945 nt, Artificial Sequence
  derived and/or modified sequence opt2 from SLC39A3__Homo_sapiens__NP_653165
auggucaagcuccucgucgccaagauccucugcauggucggcgucuucuucuucaugcuccucggcucccuccuccccgucaagaucaucgagaccgacuucgagaaggcccaccgcuccaagaagauccucucccucugcaacaccuucggcggcggcgucuuccucgccaccugcuucaacgcccuccuccccgccguccgcgagaagcuccagaagguccucucccucggccacaucuccaccgacuacccccucgccgagaccauccuccuccucggcuucuucaugaccgucuuccucgagcagcucauccucaccuuccgcaaggagaagcccuccuucaucgaccucgagaccuucaacgccggcuccgacgucggcuccgacuccgaguacgagucccccuucaugggcggcgcccgcggccacgcccucuacgucgagccccacggccacggccccucccucuccguccagggccucucccgcgccucccccguccgccuccucucccucgccuucgcccucuccgcccacuccgucuucgagggccucgcccucggccuccaggaggagggcgagaaggucgucucccucuucgucggcgucgccguccacgagacccucgucgccgucgcccucggcaucuccauggcccgcuccgccaugccccuccgcgacgccgccaagcucgccgucaccgucuccgccaugaucccccucggcaucggccucggccucggcaucgaguccgcccagggcguccccggcuccgucgccuccguccuccuccagggccucgccggcggcaccuuccucuucaucaccuuccucgagauccucgccaaggagcucgaggagaaguccgaccgccuccucaagguccucuuccucguccucggcuacaccguccucgccggcauggucuuccucaagugguga

SEQ ID NO: 49698 - RNA, 1869 nt, Artificial Sequence
  derived and/or modified sequence opt2 from SLC39A4__Homo_sapiens__NP_060237
auggucgacgucgucggccucgagcgcgagaccggcccccgcggcucccccuggcccggccucccccuccccucccucgucggccccgccccccuccucaccugccucugcccccagugccucuccgucgaggacgcccucggccucggcgagcccgagggcuccggccucccccccggccccguccucgaggcccgcuacgucgcccgccucuccgccgccgccguccucuaccucuccaaccccgagggcaccugcgaggacgcccgcgccggccucugggccucccacgccgaccaccuccucgcccuccucgagucccccaaggcccucacccccggccucuccuggcuccuccagcgcaugcaggcccgcgccgccggccagacccccaagaccgccugcgucgacaucccccagcuccucgaggaggccgucggcgccggcgcccccggcuccgccggcggcguccucgccgcccuccucgaccacguccgcuccggcuccugcuuccacgcccuccccuccccccaguacuucgucgacuucgucuuccagcagcacuccuccgagguccccaugacccucgccgagcucuccgcccucaugcagcgccucggcgucggccgcgaggcccacuccgaccacucccaccgccaccgcggcgccuccucccgcgaccccgucccccucaucuccuccuccaacuccuccuccgucugggacaccgucugccucuccgcccgcgacgucauggccgccuacggccucuccgagcaggccggcgucacccccgaggccugggcccagcucucccccgcccuccuccagcagcagcucuccggcgccugcaccucccagucccgcccccccguccaggaccagcucucccaguccgagcgcuaccucuacggcucccucgccacccuccucaucugccucugcgccgucuucggccuccuccuccucaccugcaccggcugccgcggcgucacccacuacauccuccagaccuuccucucccucgccgucggcgcccucaccggcgacgccguccuccaccucacccccaagguccucggccuccacacccacuccgaggagggccucuccccccagcccaccuggcgccuccucgccaugcucgccggccucuacgccuucuuccucuucgagaaccucuucaaccuccuccucccccgcgaccccgaggaccucgaggacggccccugcggccacuccucccacucccacggcggccacucccacggcgucucccuccagcucgcccccuccgagcuccgccagcccaagcccccccacgagggcucccgcgccgaccucgucgccgaggagucccccgagcuccucaaccccgagccccgccgccucucccccgagcuccgccuccuccccuacaugaucacccucggcgacgccguccacaacuucgccgacggccucgccgucggcgccgccuucgccuccuccuggaagaccggccucgccaccucccucgccgucuucugccacgagcucccccacgagcucggcgacuucgccgcccuccuccacgccggccucuccguccgccaggcccuccuccucaaccucgccuccgcccucaccgccuucgccggccucuacgucgcccucgccgucggcgucuccgaggaguccgaggccuggauccucgccgucgccaccggccucuuccucuacgucgcccucugcgacaugcuccccgccaugcucaagguccgcgacccccgccccuggcuccucuuccuccuccacaacgucggccuccucggcggcuggaccguccuccuccuccucucccucuacgaggacgacaucaccuucuga

SEQ ID NO: 49699 - RNA, 1302 nt, Artificial Sequence
  derived and/or modified sequence opt2 from SLC39A6__Homo_sapiens__NP_001092876
augggcauccaggucccccucaacgccaccgaguucaacuaccucugccccgccaucaucaaccagaucgacgcccgcuccugccucauccacaccuccgagaagaaggccgagaucccccccaagaccuacucccuccagaucgccugggucggcggcuucaucgccaucuccaucaucuccuuccucucccuccucggcgucauccucgucccccucaugaaccgcgucuucuucaaguuccuccucuccuuccucgucgcccucgccgucggcacccucuccggcgacgccuuccuccaccuccucccccacucccacgccucccaccaccacucccacucccacgaggagcccgccauggagaugaagcgcggcccccucuucucccaccucuccucccagaacaucgaggaguccgccuacuucgacuccaccuggaagggccucaccgcccucggcggccucuacuucauguuccucgucgagcacguccucacccucaucaagcaguucaaggacaagaagaagaagaaccagaagaagcccgagaacgacgacgacgucgagaucaagaagcagcucuccaaguacgagucccagcucuccaccaacgaggagaaggucgacaccgacgaccgcaccgagggcuaccuccgcgccgacucccaggagcccucccacuucgacucccagcagcccgccguccucgaggaggaggaggucaugaucgcccacgcccacccccaggaggucuacaacgaguacgucccccgcggcugcaagaacaagugccacucccacuuccacgacacccucggccaguccgacgaccucauccaccaccaccacgacuaccaccacauccuccaccaccaccaccaccagaaccaccacccccacucccacucccagcgcuacucccgcgaggagcucaaggacgccggcgucgccacccucgccuggauggucaucaugggcgacggccuccacaacuucuccgacggccucgccaucggcgccgccuucaccgagggccucuccuccggccucuccaccuccgucgccgucuucugccacgagcucccccacgagcucggcgacuucgccguccuccucaaggccggcaugaccgucaagcaggccguccucuacaacgcccucuccgccaugcucgccuaccucggcauggccaccggcaucuucaucggccacuacgccgagaacgucuccauguggaucuucgcccucaccgccggccucuucauguacgucgcccucgucgacauggucuccuucuga

SEQ ID NO: 49700 - RNA, 1410 nt, Artificial Sequence
  derived and/or modified sequence opt2 from SLC39A7__Homo_sapiens__NP_001070984
auggcccgcggccucggcgccccccacugggucgccgucggccuccucaccugggccacccucggccuccucgucgccggccucggcggccacgacgaccuccacgacgaccuccaggaggacuuccacggccacucccaccgccacucccacgaggacuuccaccacggccacucccacgcccacggccacggccacacccacgaguccaucuggcacggccacacccacgaccacgaccacggccacucccacgaggaccuccaccacggccacucccacggcuacucccacgagucccucuaccaccgcggccacggccacgaccacgagcacucccacggcggcuacggcgaguccggcgcccccggcaucaagcaggaccucgacgccgucacccucugggccuacgcccucggcgccaccguccucaucuccgccgcccccuucuucguccucuuccucauccccgucgaguccaacuccccccgccaccgcucccuccuccagauccuccucuccuucgccuccggcggccuccucggcgacgccuuccuccaccucaucccccacgcccucgagccccacucccaccacacccucgagcagcccggccacggccacucccacuccggccagggccccauccucuccgucggccucuggguccucuccggcaucgucgccuuccucgucgucgagaaguucguccgccacgucaagggcggccacggccacucccacggccacggccacgcccacucccacacccgcggcucccacggccacggccgccaggagcgcuccaccaaggagaagcaguccuccgaggaggaggagaaggagacccgcggcguccagaagcgccgcggcggcuccaccguccccaaggacggccccguccgcccccagaacgccgaggaggagaagcgcggccucgaccuccgcgucuccggcuaccucaaccucgccgccgaccucgcccacaacuucaccgacggccucgccaucggcgccuccuuccgcggcggccgcggccucggcauccucaccaccaugaccguccuccuccacgaggucccccacgaggucggcgacuucgccauccucguccaguccggcugcuccaagaagcaggccaugcgccuccagcuccucaccgccgucggcgcccucgccggcaccgccugcgcccuccucaccgagggcggcgccgucggcuccgagaucgccggcggcgccggccccggcuggguccuccccuucaccgccggcggcuucaucuacgucgccaccgucuccguccuccccgagcuccuccgcgaggccuccccccuccagucccuccucgagguccucggccuccucggcggcgucaucaugaugguccucaucgcccaccucgaguga

SEQ ID NO: 49701 - RNA, 1383 nt, Artificial Sequence
  derived and/or modified sequence opt2 from SLC39A8__Homo_sapiens__NP_001128618
auggcccccggccgcgccgucgccggccuccuccuccucgccgccgccggccucggcggcgucgccgagggccccggccucgccuucuccgaggacguccucuccgucuucggcgccaaccucucccucuccgccgcccagcuccagcaccuccucgagcagaugggcgccgccucccgcgucggcguccccgagcccggccagcuccacuucaaccagugccucaccgccgaggagaucuucucccuccacggcuucuccaacgccacccagaucaccuccuccaaguucuccgucaucugccccgccguccuccagcagcucaacuuccaccccugcgaggaccgccccaagcacaagacccgccccucccacuccgaggucuggggcuacggcuuccucuccgucaccaucaucaaccucgccucccuccucggccucauccucaccccccucaucaagaaguccuacuuccccaagauccucaccuucuucgucggccucgccaucggcacccucuucuccaacgccaucuuccagcucauccccgaggccuucggcuucgaccccaaggucgacuccuacgucgagaaggccgucgccgucuucggcggcuucuaccuccucuucuucuucgagcgcaugcucaagaugcuccucaagaccuacggccagaacggccacacccacuucggcaacgacaacuucggcccccaggagaagacccaccagcccaaggcccuccccgccaucaacggcgucaccugcuacgccaaccccgccgucaccgaggccaacggccacauccacuucgacaacgucuccgucgucucccuccaggacggcaagaaggagcccuccuccugcaccugccucaagggccccaagcucuccgagaucggcaccaucgccuggaugaucacccucugcgacgcccuccacaacuucaucgacggccucgccaucggcgccuccugcacccucucccuccuccagggccucuccaccuccaucgccauccucugcgaggaguucccccacgagcucggcgacuucgucauccuccucaacgccggcauguccacccgccaggcccuccucuucaacuuccucuccgccugcuccugcuacgucggccucgccuucggcauccucgucggcaacaacuucgcccccaacaucaucuucgcccucgccggcggcauguuccucuacaucucccucgccgacauguuccccgagaugaacgacaugcuccgcgagaaggucaccggccgcaagaccgacuucaccuucuucaugauccagaacgccggcaugcucaccggcuucaccgccauccuccucaucacccucuacgccggcgagaucgagcucgaguga

SEQ ID NO: 49702 - RNA, 699 nt, Artificial Sequence
  derived and/or modified sequence opt2 from SLC39A9__Homo_sapiens__NP_001239079
auggacgacuucaucuccaucucccuccucucccucgccaugcucgucggcugcuacgucgccggcaucaucccccucgccgucaacuucuccgaggagcgccucaagcucgucaccguccucggcgccggccuccucugcggcaccgcccucgccgucaucguccccgagggcguccacgcccucuacgaggacauccucgagggcaagcaccaccaggccuccgagacccacaacgucaucgccuccgacaaggccgccgagaaguccgucguccacgagcacgagcacucccacgaccacacccagcuccacgccuacaucggcgucucccucguccucggcuucgucuucaugcuccucgucgaccagaucggcaacucccacguccacuccaccgacgaccccgaggccgcccgcuccuccaacuccaagaucaccaccacccucggccucgucguccacgccgccgccgacggcgucgcccucggcgccgccgccuccaccucccagaccuccguccagcucaucgucuucgucgccaucaugcuccacaaggcccccgccgccuucggccucgucuccuuccucaugcacgccggccucgagcgcaaccgcauccgcaagcaccuccucgucuucgcccucgccgcccccgucauguccauggucaccuaccucggccucuccaaggacuga

SEQ ID NO: 49703 - RNA, 2058 nt, Artificial Sequence
  derived and/or modified sequence opt2 from SLC3A1__Homo_sapiens__NP_000332
auggccgaggacaaguccaagcgcgacuccaucgagauguccaugaagggcugccagaccaacaacggcuucguccacaacgaggacauccucgagcagacccccgaccccggcuccuccaccgacaaccucaagcacuccacccgcggcauccucggcucccaggagcccgacuucaagggcguccagcccuacgccggcaugcccaaggagguccucuuccaguucuccggccaggcccgcuaccgcaucccccgcgagauccucuucuggcucaccgucgccuccguccucguccucaucgccgccaccaucgccaucaucgcccucucccccaagugccucgacugguggcaggagggccccauguaccagaucuacccccgcuccuucaaggacuccaacaaggacggcaacggcgaccucaagggcauccaggacaagcucgacuacaucaccgcccucaacaucaagaccgucuggaucaccuccuucuacaaguccucccucaaggacuuccgcuacggcgucgaggacuuccgcgaggucgaccccaucuucggcaccauggaggacuucgagaaccucgucgccgccauccacgacaagggccucaagcucaucaucgacuucauccccaaccacaccuccgacaagcacaucugguuccagcucucccgcacccgcaccggcaaguacaccgacuacuacaucuggcacgacugcacccacgagaacggcaagaccaucccccccaacaacuggcucuccgucuacggcaacuccuccuggcacuucgacgagguccgcaaccagugcuacuuccaccaguucaugaaggagcagcccgaccucaacuuccgcaaccccgacguccaggaggagaucaaggagauccuccgcuucuggcucaccaagggcgucgacggcuucucccucgacgccgucaaguuccuccucgaggccaagcaccuccgcgacgagauccaggucaacaagacccagauccccgacaccgucacccaguacuccgagcucuaccacgacuucaccaccacccaggucggcaugcacgacaucguccgcuccuuccgccagaccauggaccaguacuccaccgagcccggccgcuaccgcuucaugggcaccgaggccuacgccgaguccaucgaccgcaccgucauguacuacggccuccccuucauccaggaggccgacuuccccuucaacaacuaccucuccaugcucgacaccgucuccggcaacuccgucuacgaggucaucaccuccuggauggagaacaugcccgagggcaaguggcccaacuggaugaucggcggccccgacuccucccgccucaccucccgccucggcaaccaguacgucaacgucaugaacaugcuccucuucacccuccccggcacccccaucaccuacuacggcgaggagaucggcaugggcaacaucgucgccgccaaccucaacgaguccuacgacaucaacacccuccgcuccaagucccccaugcagugggacaacuccuccaacgccggcuucuccgaggccuccaacaccuggcuccccaccaacuccgacuaccacaccgucaacgucgacguccagaagacccagccccgcuccgcccucaagcucuaccaggaccucucccuccuccacgccaacgagcuccuccucaaccgcggcugguucugccaccuccgcaacgacucccacuacgucgucuacacccgcgagcucgacggcaucgaccgcaucuucaucgucguccucaacuucggcgaguccacccuccucaaccuccacaacaugaucuccggccuccccgccaagaugcgcauccgccucuccaccaacuccgccgacaagggcuccaaggucgacaccuccggcaucuuccucgacaagggcgagggccucaucuucgagcacaacaccaagaaccuccuccaccgccagaccgccuuccgcgaccgcugcuucgucuccaaccgcgccugcuacuccuccguccucaacauccucuacaccuccugcuga

SEQ ID NO: 49704 - RNA, 1896 nt, Artificial Sequence
  derived and/or modified sequence opt2 from SLC3A2__Homo_sapiens__NP_001012680
auggagcuccagccccccgaggccuccaucgccgucgucuccaucccccgccagcuccccggcucccacuccgaggccggcguccagggccucuccgccggcgacgacuccgagaccggcuccgacugcgucacccaggccggccuccagcuccucgccuccuccgacccccccgcccucgccuccaagaacgccgaggucaccgucgagaccggcuuccaccacgucucccaggccgacaucgaguuccucaccuccaucgaccccaccgccuccgccuccggcuccgccggcaucaccggcaccaugucccaggacaccgaggucgacaugaaggaggucgagcucaacgagcucgagcccgagaagcagcccaugaacgccgccuccggcgccgccaugucccucgccggcgccgagaagaacggccucgucaagaucaaggucgccgaggacgaggccgaggccgccgccgccgccaaguucaccggccucuccaaggaggagcuccucaaggucgccggcucccccggcuggguccgcacccgcugggcccuccuccuccucuucuggcucggcuggcucggcaugcucgccggcgccgucgucaucaucguccgcgccccccgcugccgcgagcuccccgcccagaagugguggcacaccggcgcccucuaccgcaucggcgaccuccaggccuuccagggccacggcgccggcaaccucgccggccucaagggccgccucgacuaccucuccucccucaaggucaagggccucguccucggccccauccacaagaaccagaaggacgacgucgcccagaccgaccuccuccagaucgaccccaacuucggcuccaaggaggacuucgacucccuccuccaguccgccaagaagaaguccauccgcgucauccucgaccucacccccaacuaccgcggcgagaacuccugguucuccacccaggucgacaccgucgccaccaaggucaaggacgcccucgaguucuggcuccaggccggcgucgacggcuuccagguccgcgacaucgagaaccucaaggacgccuccuccuuccucgccgaguggcagaacaucaccaagggcuucuccgaggaccgccuccucaucgccggcaccaacuccuccgaccuccagcagauccucucccuccucgaguccaacaaggaccuccuccucaccuccuccuaccucuccgacuccggcuccaccggcgagcacaccaagucccucgucacccaguaccucaacgccaccggcaaccgcuggugcuccuggucccucucccaggcccgccuccucaccuccuuccuccccgcccagcuccuccgccucuaccagcucaugcucuucacccuccccggcacccccgucuucuccuacggcgacgagaucggccucgacgccgccgcccuccccggccagcccauggaggcccccgucaugcucugggacgaguccuccuuccccgacauccccggcgccgucuccgccaacaugaccgucaagggccaguccgaggaccccggcucccuccucucccucuuccgccgccucuccgaccagcgcuccaaggagcgcucccuccuccacggcgacuuccacgccuucuccgccggccccggccucuucuccuacauccgccacugggaccagaacgagcgcuuccucgucguccucaacuucggcgacgucggccucuccgccggccuccaggccuccgaccuccccgccuccgccucccuccccgccaaggccgaccuccuccucuccacccagcccggccgcgaggagggcuccccccucgagcucgagcgccucaagcucgagccccacgagggccuccuccuccgcuuccccuacgccgccuga

SEQ ID NO: 49705 - RNA, 1716 nt, Artificial Sequence
  derived and/or modified sequence opt2 from SLC40A1__Homo_sapiens__NP_055400
augacccgcgccggcgaccacaaccgccagcgcggcugcugcggcucccucgccgacuaccucaccuccgccaaguuccuccucuaccucggccacucccucuccaccuggggcgaccgcauguggcacuucgccgucuccgucuuccucgucgagcucuacggcaacucccuccuccucaccgccgucuacggccucgucgucgccggcuccguccucguccucggcgccaucaucggcgacugggucgacaagaacgcccgccucaaggucgcccagaccucccucgucguccagaacgucuccgucauccucugcggcaucauccucaugauggucuuccuccacaagcacgagcuccucaccauguaccacggcuggguccucaccuccugcuacauccucaucaucaccaucgccaacaucgccaaccucgccuccaccgccaccgccaucaccauccagcgcgacuggaucgucgucgucgccggcgaggaccgcuccaagcucgccaacaugaacgccaccauccgccgcaucgaccagcucaccaacauccucgcccccauggccgucggccagaucaugaccuucggcucccccgucaucggcugcggcuucaucuccggcuggaaccucgucuccaugugcgucgaguacguccuccucuggaaggucuaccagaagacccccgcccucgccgucaaggccggccucaaggaggaggagaccgagcucaagcagcucaaccuccacaaggacaccgagcccaagccccucgagggcacccaccucaugggcgucaaggacuccaacauccacgagcucgagcacgagcaggagcccaccugcgccucccagauggccgagcccuuccgcaccuuccgcgacggcugggucuccuacuacaaccagcccgucuuccucgccggcaugggccucgccuuccucuacaugaccguccucggcuucgacugcaucaccaccggcuacgccuacacccagggccucuccggcuccauccucuccauccucaugggcgccuccgccaucaccggcaucaugggcaccgucgccuucaccuggcuccgccgcaagugcggccucguccgcaccggccucaucuccggccucgcccagcucuccugccucauccucugcgucaucuccgucuucaugcccggcuccccccucgaccucuccgucucccccuucgaggacauccgcucccgcuucauccagggcgaguccaucacccccaccaagauccccgagaucaccaccgagaucuacauguccaacggcuccaacuccgccaacaucguccccgagaccucccccgaguccguccccaucaucuccgucucccuccucuucgccggcgucaucgccgcccgcaucggccucugguccuucgaccucaccgucacccagcuccuccaggagaacgucaucgaguccgagcgcggcaucaucaacggcguccagaacuccaugaacuaccuccucgaccuccuccacuucaucauggucauccucgcccccaaccccgaggccuucggccuccucguccucaucuccgucuccuucgucgccaugggccacaucauguacuuccgcuucgcccagaacacccucggcaacaagcucuucgccugcggccccgacgccaaggagguccgcaaggagaaccaggccaacaccuccgucgucuga

SEQ ID NO: 49706 - RNA, 1542 nt, Artificial Sequence
  derived and/or modified sequence opt2 from SLC41A1__Homo_sapiens__XP_005245126
auguccuccaagcccgagcccaaggacguccaccagcucaacggcaccggccccuccgccucccccugcuccuccgacggccccggccgcgagccccucgccggcaccuccgaguuccucggccccgacggcgccggcgucgaggucgucaucgagucccgcgccaacgccaagggcguccgcgaggaggacgcccuccucgagaacggcucccaguccaacgaguccgacgacgucuccaccgaccgcggccccgccccccccuccccccucaaggagaccuccuucuccaucggccuccagguccucuuccccuuccuccucgccggcuucggcaccgucgccgccggcaugguccucgacaucguccagcacugggaggucuuccagaaggucaccgaggucuucauccucguccccgcccuccucggccucaagggcaaccucgagaugacccucgccucccgccucuccaccgccgccaacaucggccacauggacacccccaaggagcucuggcgcaugaucaccggcaacauggcccucauccagguccaggccaccgucgucggcuuccucgccuccaucgccgccgucgucuucggcuggauccccgacggccacuucuccaucccccacgccuuccuccucugcgccuccuccgucgccaccgccuucaucgccucccucguccucggcaugaucaugaucggcgucaucaucggcucccgcaagaucggcaucaaccccgacaacgucgccacccccaucgccgccucccucggcgaccucaucacccucgcccuccucuccggcaucuccuggggccucuaccucgagcucaaccacuggcgcuacaucuacccccucgucugcgccuucuucgucgcccuccuccccgucugggucguccucgcccgccgcucccccgccacccgcgagguccucuacuccggcugggagcccgucaucaucgccauggccaucuccuccgucggcggccucauccucgacaagaccgucuccgaccccaacuucgccggcauggccgucuucacccccgucaucaacggcgucggcggcaaccucgucgccguccaggccucccgcaucuccaccuuccuccacaugaacggcaugcccggcgagaacuccgagcaggccccccgccgcugccccucccccugcaccaccuucuucucccccgacgucaacucccgcuccgcccgcguccucuuccuccucgucguccccggccaccucgucuuccucuacaccaucuccugcaugcagggcggccacaccacccucacccucaucuucaucaucuucuacaugaccgccgcccuccuccagguccucauccuccucuacaucgccgacuggaugguccacuggauguggggccgcggccucgaccccgacaacuucuccauccccuaccucaccgcccucggcgaccuccucggcaccggccuccucgcccucuccuuccacguccucuggcucaucggcgaccgcgacaccgacgucggcgacuga

SEQ ID NO: 49707 - RNA, 1680 nt, Artificial Sequence
  derived and/or modified sequence opt2 from SLC43A1__Homo_sapiens__NP_001185739
auggcccccacccuccagcaggccuaccgccgccgcugguggauggccugcaccgccguccucgagaaccucuucuucuccgccguccuccucggcuggggcucccuccucaucauccucaagaacgagggcuucuacuccuccaccugccccgccgaguccuccaccaacaccacccaggacgagcagcgccgcuggcccggcugcgaccagcaggacgagaugcucaaccucggcuucaccaucggcuccuucguccucuccgccaccacccucccccucggcauccucauggaccgcuucggcccccgccccguccgccucgucggcuccgccugcuucaccgccuccugcacccucauggcccucgccucccgcgacgucgaggcccucuccccccucaucuuccucgcccucucccucaacggcuucggcggcaucugccucaccuucaccucccucacccuccccaacauguucggcaaccuccgcuccacccucauggcccucaugaucggcuccuacgccuccuccgccaucaccuuccccggcaucaagcucaucuacgacgccggcgucgccuucgucgucaucauguucaccugguccggccucgccugccucaucuuccucaacugcacccucaacuggcccaucgaggccuuccccgcccccgaggaggucaacuacaccaagaagaucaagcucuccggccucgcccucgaccacaaggucaccggcgaccucuucuacacccacgucaccaccaugggccagcgccucucccagaaggcccccucccucgaggacggcuccgacgccuucauguccccccaggacguccgcggcaccuccgagaaccuccccgagcgcuccgucccccuccgcaagucccucugcucccccaccuuccucuggucccuccucaccaugggcaugacccagcuccgcaucaucuucuacauggccgccgucaacaagaugcucgaguaccucgucaccggcggccaggagcacgagaccaacgagcagcagcagaaggucgccgagaccgucggcuucuacuccuccgucuucggcgccaugcagcuccucugccuccucaccugcccccucaucggcuacaucauggacuggcgcaucaaggacugcgucgacgcccccacccagggcaccguccucggcgacgcccgcgacggcgucgccaccaaguccauccgcccccgcuacugcaagauccagaagcucaccaacgccaucuccgccuucacccucaccaaccuccuccucgucggcuucggcaucaccugccucaucaacaaccuccaccuccaguucgucaccuucguccuccacaccaucguccgcggcuucuuccacuccgccugcggcucccucuacgccgccgucuuccccuccaaccacuucggcacccucaccggccuccagucccucaucuccgccgucuucgcccuccuccagcagccccucuucauggccauggucggcccccucaagggcgagcccuucugggucaaccucggccuccuccucuucucccuccucggcuuccuccuccccuccuaccucuucuacuaccgcgcccgccuccagcaggaguacgccgccaacggcaugggcccccucaagguccucuccggcuccgaggucaccgccuga

SEQ ID NO: 49708 - RNA, 1299 nt, Artificial Sequence
  derived and/or modified sequence opt2 from SLC43A2__Homo_sapiens__NP_001271428
augaccuacggcuccccccaggccaacgccucccccuccgacgccgucgcccucgaccacggcgaggucucccgccgccagcagcaggagcuccccaacauguucggcgaccuccgcuccaccuucaucgcccucaugaucggcuccuacgccuccuccgccgucaccuuccccggcaucaagcucaucuacgacgccggcgucuccuucaucgucguccucgucgucugggccggcugcuccggccucgucuuccucaacugcuucuucaacuggccccucgagcccuuccccggccccgaggacauggacuacuccgucaagaucaaguucuccuggcucggcuucgaccacaagaucaccggcaagcaguucuacaagcaggucaccaccgucggccgccgccucuccgucggcuccuccaugcgcuccgccaaggagcaggucgcccuccaggagggccacaagcucugccucuccaccgucgaccucgaggucaagugccagcccgacgccgccgucgcccccuccuucaugcacuccgucuucucccccauccuccuccucucccucgucaccaugugcgucacccagcuccgccucaucuucuacaugggcgccaugaacaacauccucaaguuccucgucuccggcgaccagaagaccgucggccucuacaccuccaucuucggcguccuccagcuccucugccuccucaccgcccccgucaucggcuacaucauggacuggcgccucaaggagugcgaggacgccuccgaggagcccgaggagaaggacgccaaccagggcgagaagaagaagaagaagcgcgaccgccagauccagaagaucaccaacgccaugcgcgccuucgccuucaccaaccuccuccucgucggcuucggcgucaccugccucauccccaaccucccccuccagauccucuccuucauccuccacaccaucguccgcggcuucauccacuccgccgucggcggccucuacgccgccgucuaccccuccacccaguucggcucccucaccggccuccagucccucaucuccgcccucuucgcccuccuccagcagccccucuuccucgccaugaugggcccccuccagggcgacccccucugggucaacgucggccuccuccuccucucccuccucggcuucugccucccccucuaccucaucugcuaccgccgccagcucgagcgccagcuccagcagcgccaggaggacgacaagcucuuccucaagaucaacggcuccuccaaccaggaggccuucgucuga

SEQ ID NO: 49709 - RNA, 1515 nt, Artificial Sequence
  derived and/or modified sequence opt2 from SLC43A3__Homo_sapiens__NP_001265135
auggccggccagggccucccccuccacgucgccacccuccucaccggccuccucgagugccucggcuucgccggcguccucuucggcuggcccucccucgucuucgucuucaagaacgaggacuacuucaaggaccucugcggccccgacgccggccccaucggcaacgccaccggccaggccggccgccucggcugcaugggcgaccucuucuccacccccgacugcaaggcccaggacgagcgcuucucccucaucuucacccucggcuccuucaugaacaacuucaugaccuuccccaccggcuacaucuucgaccgcuucaagaccaccgucgcccgccucaucgccaucuucuucuacaccaccgccacccucaucaucgccuucaccuccgccggcuccgccguccuccucuuccucgccaugcccaugcucaccaucggcggcauccucuuccucaucaccaaccuccagaucggcaaccucuucggccagcaccgcuccaccaucaucacccucuacaacggcgccuucgacuccuccuccgccgucuuccucaucaucaagcuccucuacgagaagggcaucucccuccgcgccuccuucaucuucaucuccgucugcuccaccuggcacgucgcccgcaccuuccuccucaugccccgcggccacauccccuacccccucccccccaacuacuccuacggccucugccccggcaacggcaccaccaaggaggagaaggagaccgccgagcacgagaaccgcgagcuccaguccaaggaguuccucuccgccaaggaggagacccccggcgccggccagaagcaggagcuccgcuccuucugguccuacgccuucucccgccgcuucgccuggcaccucgucuggcucuccgucauccagcucuggcacuaccucuucaucggcacccucaacucccuccucaccaacauggccggcggcgacauggcccgcgucuccaccuacaccaacgccuucgccuucacccaguucggcguccucugcgcccccuggaacggccuccucauggaccgccucaagcagaaguaccagaaggaggcccgcaagaccggcuccuccacccucgccgucgcccucugcuccaccguccccucccucgcccucaccucccuccucugccucggcuucgcccucugcgccuccguccccauccucccccuccaguaccucaccuucauccuccaggucaucucccgcuccuuccucuacggcuccaacgccgccuuccucacccucgccuuccccuccgagcacuucggcaagcucuucggccucgucauggcccucuccgccgucgucucccuccuccaguuccccaucuucacccucaucaagggcucccuccagaacgaccccuucuacgucaacgucauguucaugcucgccauccuccucaccuucuuccaccccuuccucgucuaccgcgagugccgcaccuggaaggagucccccuccgccaucgccuga

SEQ ID NO: 49710 - RNA, 1959 nt, Artificial Sequence
  derived and/or modified sequence opt2 from SLC44A1__Homo_sapiens__NP_001273659
augggcugcugcuccuccgccuccuccgccgcccaguccuccaagcgcgaguggaagccccucgaggaccgcuccugcaccgacauccccuggcuccuccucuucauccucuucugcaucggcaugggcuucaucugcggcuucuccaucgccaccggcgccgccgcccgccucgucuccggcuacgacuccuacggcaacaucugcggccagaagaacaccaagcucgaggccauccccaacuccggcauggaccacacccagcgcaaguacgucuucuuccucgaccccugcaaccucgaccucaucaaccgcaagaucaaguccgucgcccucugcgucgccgccugcccccgccaggagcucaagacccucuccgacguccagaaguucgccgagaucaacggcuccgcccucugcuccuacaaccucaagcccuccgaguacaccaccucccccaaguccuccguccucugccccaagcuccccguccccgccuccgcccccauccccuucuuccaccgcugcgcccccgucaacaucuccugcuacgccaaguucgccgaggcccucaucaccuucgucuccgacaacuccguccuccaccgccucaucuccggcgucaugaccuccaaggagaucauccucggccucugccuccucucccucguccucuccaugauccucauggucaucauccgcuacaucucccgcguccucgucuggauccucaccauccucgucauccucggcucccucggcggcaccggcguccucugguggcucuacgccaagcagcgccgcucccccaaggagaccgucacccccgagcagcuccagaucgccgaggacaaccuccgcgcccuccucaucuacgccaucuccgccaccgucuucaccgucauccucuuccucaucaugcucgucaugcgcaagcgcgucgcccucaccaucgcccucuuccacgucgccggcaaggucuucauccaccucccccuccucgucuuccagcccuucuggaccuucuucgcccucguccucuucugggucuacuggaucaugacccuccucuuccucggcaccaccggcucccccguccagaacgagcagggcuucgucgaguucaagaucuccggcccccuccaguacauguggugguaccacgucgucggccucaucuggaucuccgaguucauccucgccugccagcagaugaccgucgccggcgccgucgucaccuacuacuucacccgcgacaagcgcaaccuccccuucacccccauccucgccuccgucaaccgccucauccgcuaccaccucggcaccgucgccaagggcuccuucaucaucacccucgucaagaucccccgcaugauccucauguacauccacucccagcucaagggcaaggagaacgccugcgcccgcugcguccucaaguccugcaucugcugccucuggugccucgagaagugccucaacuaccucaaccagaacgccuacaccgccaccgccaucaacuccaccaacuucugcaccuccgccaaggacgccuucgucauccucgucgagaacgcccuccgcgucgccaccaucaacaccgucggcgacuucaugcucuuccucggcaagguccucaucgucugcuccaccggccucgccggcaucaugcuccucaacuaccagcaggacuacaccgucuggguccucccccucaucaucgucugccucuucgccuuccucgucgcccacugcuuccucuccaucuacgagauggucgucgacguccucuuccucugcuucgccaucgacaccaaguacaacgacggcucccccggccgcgaguucuacauggacaagguccucauggaguucgucgagaacucccgcaaggccaugaaggaggccggcaagggcggcgucgccgacucccgcgagcucaagcccaugaucaaguga

SEQ ID NO: 49711 - RNA, 2115 nt, Artificial Sequence
  derived and/or modified sequence opt2 from SLC44A2__Homo_sapiens__NP_001138528
auggaggacgagcgcaagaacggcgccuacggcaccccccagaaguacgaccccaccuucaagggccccaucuacaaccgcggcugcaccgacaucaucugcugcgucuuccuccuccucgccaucgucggcuacgucgccgucggcaucaucgccuggacccacggcgacccccgcaaggucaucuaccccaccgacucccgcggcgaguucugcggccagaagggcaccaagaacgagaacaagcccuaccucuucuacuucaacaucgucaagugcgccuccccccucguccuccucgaguuccagugccccaccccccagaucugcgucgagaagugccccgaccgcuaccucaccuaccucaacgcccgcuccucccgcgacuucgaguacuacaagcaguucugcguccccggcuucaagaacaacaagggcgucgccgagguccuccaggacggcgacugccccgccguccucauccccuccaagccccucgcccgccgcugcuuccccgccauccacgccuacaagggcguccucauggucggcaacgagaccaccuacgaggacggccacggcucccgcaagaacaucaccgaccucgucgagggcgccaagaaggccaacggcguccucgaggcccgccagcucgccaugcgcaucuucgaggacuacaccgucuccugguacuggaucaucaucggccucgucaucgccauggccaugucccuccucuucaucauccuccuccgcuuccucgccggcaucauggucugggucaugaucaucauggucauccucguccucggcuacggcaucuuccacugcuacauggaguacucccgccuccgcggcgaggccggcuccgacgucucccucgucgaccucggcuuccagaccgacuuccgcgucuaccuccaccuccgccagaccuggcucgccuucaugaucauccucuccauccucgaggucaucaucauccuccuccucaucuuccuccgcaagcgcauccucaucgccaucgcccucaucaaggaggccucccgcgccgucggcuacgucaugugcucccuccucuacccccucgucaccuucuuccuccucugccucugcaucgccuacugggccuccaccgccgucuuccucuccaccuccaacgaggccgucuacaagaucuucgacgacucccccugccccuucaccgccaagaccugcaaccccgagaccuuccccuccuccaacgagucccgccagugccccaacgcccgcugccaguucgccuucuacggcggcgaguccggcuaccaccgcgcccuccucggccuccagaucuucaacgccuucauguucuucuggcucgccaacuucguccucgcccucggccaggucacccucgccggcgccuucgccuccuacuacugggcccuccgcaagcccgacgaccuccccgccuucccccucuucuccgccuucggccgcgcccuccgcuaccacaccggcucccucgccuucggcgcccucauccucgccaucguccagaucauccgcgucauccucgaguaccucgaccagcgccucaaggccgccgagaacaaguucgccaagugccucaugaccugccucaagugcugcuucuggugccucgagaaguucaucaaguuccucaaccgcaacgccuacaucaugaucgccaucuacggcaccaacuucugcaccuccgcccgcaacgccuucuuccuccucaugcgcaacaucauccgcgucgccguccucgacaaggucaccgacuuccucuuccuccucggcaagcuccucaucgucggcuccgucggcauccucgccuucuucuucuucacccaccgcauccgcaucguccaggacaccgcccccccccucaacuacuacuggguccccauccucaccgucaucgucggcuccuaccucaucgcccacggcuucuucuccgucuacggcaugugcgucgacacccucuuccucugcuuccucgaggaccucgagcgcaacgacggcuccgccgagcgccccuacuucauguccuccacccucaagaagcuccucaacaagaccaacaagaaggccgccgaguccuga

SEQ ID NO: 49712 - RNA, 2007 nt, Artificial Sequence
  derived and/or modified sequence opt2 from SLC44A4__Homo_sapiens__NP_001171515
augggcggcaagcagcgcgacgaggacgacgaggccuacggcaagcccgucaaguacgaccccuccuuccgcggccccaucaagaaccgcuccugcaccgacgucaucugcugcguccucuuccuccucuucauccucggcuacaucgucgucggcaucgucgccuggcucuacggcgacccccgccagguccucuacccccgcaacuccaccggcgccuacugcggcaugggcgagaacaaggacaagcccuaccuccucuacuucaacaucuucuccugcauccucuccuccaacaucaucuccgucgccgagaacggccuccagugccccaccccccagaccgucaucaccucccuccagcaggagcucugccccuccuuccuccuccccuccgcccccgcccucggccgcugcuuccccuggaccaacgucaccccccccgcccuccccggcaucaccaacgacaccaccauccagcagggcaucuccggccucaucgacucccucaacgcccgcgacaucuccgucaagaucuucgaggacuucgcccaguccugguacuggauccucgucgcccucggcgucgcccucguccucucccuccucuucauccuccuccuccgccucgucgccggcccccucguccucguccucauccucggcguccucggcguccucgccuacggcaucuacuacugcugggaggaguaccgcguccuccgcgacaagggcgccuccaucucccagcucggcuucaccaccaaccucuccgccuaccaguccguccaggagaccuggcucgccgcccucaucguccucgccguccucgaggccauccuccuccucaugcucaucuuccuccgccagcgcauccgcaucgccaucgcccuccucaaggaggccuccaaggccgucggccagaugauguccaccauguucuacccccucgucaccuucguccuccuccucaucugcaucgccuacugggccaugaccgcccucuaccucgccaccuccggccagccccaguacguccucugggccuccaacaucuccucccccggcugcgagaagguccccaucaacaccuccugcaaccccaccgcccaccucgucaacuccuccugccccggccucaugugcgucuuccagggcuacuccuccaagggccucauccagcgcuccgucuucaaccuccagaucuacggcguccucggccucuucuggacccucaacuggguccucgcccucggccagugcguccucgccggcgccuucgccuccuucuacugggccuuccacaagccccaggacauccccaccuucccccucaucuccgccuucauccgcacccuccgcuaccacaccggcucccucgccuucggcgcccucauccucacccucguccagaucgcccgcgucauccucgaguacaucgaccacaagcuccgcggcguccagaaccccgucgcccgcugcaucaugugcugcuucaagugcugccucuggugccucgagaaguucaucaaguuccucaaccgcaacgccuacaucaugaucgccaucuacggcaagaacuucugcgucuccgccaagaacgccuucaugcuccucaugcgcaacaucguccgcgucgucguccucgacaaggucaccgaccuccuccucuucuucggcaagcuccucgucgucggcggcgucggcguccucuccuucuucuucuucuccggccgcauccccggccucggcaaggacuucaaguccccccaccucaacuacuacuggcuccccaucaugaccuccauccucggcgccuacgucaucgccuccggcuucuucuccgucuucggcaugugcgucgacacccucuuccucugcuuccucgaggaccucgagcgcaacaacggcucccucgaccgccccuacuacauguccaagucccuccucaagauccucggcaagaagaacgaggccccccccgacaacaagaagcgcaagaaguga

SEQ ID NO: 49713 - RNA, 2169 nt, Artificial Sequence
  derived and/or modified sequence opt2 from SLC44A5__Homo_sapiens__XP_011539285
augggccuccaggcccucuccgagaagcccgccgacacccccuccgaggaggaggacuucggcgacccccgcaccuacgaccccgacuucaagggccccgucgccaaccgcuccugcaccgacguccucugcugcaugaucuuccuccucugcaucaucggcuacaucguccucggccucgucgccuggguccacggcgacccccgccgcgccgccuaccccaccgacucccagggccacuucugcggccagaagggcacccccaacgagaacaagaccauccucuucuacuucaaccuccuccgcugcaccucccccuccguccuccucaaccuccagugccccaccacccagaucugcgucuccaagugccccgagaaguuccucaccuacgucgagaugcagcuccucuacaccaaggacaaguccuacugggaggacuaccgccaguucugcaagaccaccgccaagcccgucaagucccucacccagcuccuccucgacgacgacugccccaccgccaucuuccccuccaagcccuuccuccagcgcugcuuccccgacuucuccaccaagaacggcacccucaccaucggcuccaagaugauguuccaggacggcaacggcggcacccgcuccgucgucgagcucggcaucgccgccaacggcaucaacaagcuccucgacgccaagucccucggccucaaggucuucgaggacuacgcccgcaccugguacuggauccucaucggccucaccaucgccaugguccucuccuggaucuuccucauccuccuccgcuucaucgccggcugccucuucugggucuucaugaucggcgucaucggcaucaucggcuacggcaucuggcacugcuaccagcaguacaccaaccuccaggagcgccccuccuccguccucaccaucuacgacaucggcauccagaccaacaucuccauguacuucgagcuccagcagaccugguucaccuucaugaucauccucugcaucaucgaggucaucgucauccucaugcucaucuuccuccgcaaccgcauccgcgucgccaucauccuccucaaggagggcuccaaggccaucggcuacguccccuccacccucgucuaccccgcccucaccuucauccuccucuccaucugcaucugcuacugggucgucaccgccgucuuccucgccaccuccggcguccccgucuacaaggucaucgcccccggcggccacugcauccacgagaaccagaccugcgaccccgagaucuucaacaccaccgagaucgccaaggccugccccggcgcccucugcaacuucgccuucuacggcggcaagucccucuaccaccaguacauccccaccuuccacgucuacaaccucuucgucuuccucuggcucaucaacuucgucaucgcccucggccagugcgcccucgccggcgccuucgccaccuacuacugggccaugaagaagcccgacgacaucccccgcuacccccucuucaccgccuucggccgcgccauccgcuaccacaccggcucccucgccuucggcucccucaucaucgcccucauccagauguucaagaucguccucgaguaccucgaccaccgccucaagcgcacccagaacacccucuccaaguuccuccagugcugccuccgcugcugcuucuggugccucgagaacgccaucaaguuccucaaccgcaacgccuacaucaugaucgccaucuacggccgcaacuucugccgcuccgccaaggacgccuucaaccuccucaugcgcaacguccucaaggucgccgucaccgacgaggucaccuacuucguccucuuccucggcaagcuccucgucgccggcuccaucggcguccucgccuuccucuucuucacccagcgccuccccgucaucgcccagggccccgccucccucaacuacuacugggucccccuccucaccgucaucuucggcuccuaccucaucgcccacggcuucuucuccgucuacgccaugugcgucgagaccaucuucaucugcuucugcgaggaccucgagcgcaacgacggcuccaccgagaagcccuacuucgucacccccaaccuccacggcauccucaucaagaagcagcucgucccccagaagcagaaggaguga

SEQ ID NO: 49714 - RNA, 1383 nt, Artificial Sequence
  derived and/or modified sequence opt2 from SLC45A2__Homo_sapiens__NP_001012527
augggcuccaacuccggccaggccggccgccacaucuacaagucccucgccgacgacggccccuucgacuccgucgagccccccaagcgccccaccucccgccucaucaugcacuccauggccauguucggccgcgaguucugcuacgccgucgaggccgccuacgucacccccguccuccucuccgucggccuccccuccucccucuacuccaucgucugguuccucucccccauccucggcuuccuccuccagcccgucgucggcuccgccuccgaccacugccgcucccgcuggggccgccgccgccccuacauccucacccucggcgucaugaugcucgucggcauggcccucuaccucaacggcgccaccgucgucgccgcccucaucgccaacccccgccgcaagcucgucugggccaucuccgucaccaugaucggcgucguccucuucgacuucgccgccgacuucaucgacggccccaucaaggccuaccucuucgacgucugcucccaccaggacaaggagaagggccuccacuaccacgcccucuucaccggcuucggcggcgcccucggcuaccuccucggcgccaucgacugggcccaccucgagcucggccgccuccucggcaccgaguuccaggucauguucuucuucuccgcccucguccucacccucugcuucaccguccaccucugcuccaucuccgaggccccccucaccgaggucgccaagggcauccccccccagcagaccccccaggaccccccccucuccuccgacggcauguacgaguacggcuccaucgagaaggucaagaacggcuacgucaaccccgagcucgccaugcagggcgccaagaacaagaaccacgccgagcagacccgccgcgccaugacccucaagucccuccuccgcgcccucgucaacaugcccccccacuaccgcuaccucugcaucucccaccucaucggcuggaccgccuuccucuccaacaugcucuucuucaccgacuucaugggccagaucgucuaccgcggcgaccccuacuccgcccacaacuccaccgaguuccucaucuacgagcgcggcgucgaggucggcugcuggggcuucugcaucaacuccgucuucuccucccucuacuccuacuuccagaagguccucgucuccuacaucggccucaagggccucuacuucaccggcuaccuccucuucggccucggcaccggcuucaucggccucuuccccaacgucuacuccacccucguccucugcucccucuucggcgucauguccuccacccucuacaccguccccuucaaccucaucaccgaguaccaccgcgaggaggagaaggaggucugcugccacuga

SEQ ID NO: 49715 - RNA, 1662 nt, Artificial Sequence
  derived and/or modified sequence opt2 from SLC45A3__Homo_sapiens__NP_149093
augguccagcgccucugggucucccgccuccuccgccaccgcaaggcccagcuccuccucgucaaccuccucaccuucggccucgaggucugccucgccgccggcaucaccuacguccccccccuccuccucgaggucggcgucgaggagaaguucaugaccaugguccucggcaucggccccguccucggccucgucugcgucccccuccucggcuccgccuccgaccacuggcgcggccgcuacggccgccgccgccccuucaucugggcccucucccucggcauccuccucucccucuuccucaucccccgcgccggcuggcucgccggccuccucugccccgacccccgcccccucgagcucgcccuccucauccucggcgucggccuccucgacuucugcggccaggucugcuucaccccccucgaggcccuccucuccgaccucuuccgcgaccccgaccacugccgccaggccuacuccgucuacgccuucaugaucucccucggcggcugccucggcuaccuccuccccgccaucgacugggacaccuccgcccucgcccccuaccucggcacccaggaggagugccucuucggccuccucacccucaucuuccucaccugcgucgccgccacccuccucgucgccgaggaggccgcccucggccccaccgagcccgccgagggccucuccgcccccucccucuccccccacugcugccccugccgcgcccgccucgccuuccgcaaccucggcgcccuccucccccgccuccaccagcucugcugccgcaugccccgcacccuccgccgccucuucgucgccgagcucugcuccuggauggcccucaugaccuucacccucuucuacaccgacuucgucggcgagggccucuaccagggcgucccccgcgccgagcccggcaccgaggcccgccgccacuacgacgagggcguccgcaugggcucccucggccucuuccuccagugcgccaucucccucgucuucucccucgucauggaccgccucguccagcgcuucggcacccgcgccgucuaccucgccuccgucgccgccuuccccgucgccgccggcgccaccugccucucccacuccgucgccgucgucaccgccuccgccgcccucaccggcuucaccuucuccgcccuccagauccuccccuacacccucgccucccucuaccaccgcgagaagcaggucuuccuccccaaguaccgcggcgacaccggcggcgccuccuccgaggacucccucaugaccuccuuccuccccggccccaagcccggcgcccccuuccccaacggccacgucggcgccggcggcuccggccuccucccccccccccccgcccucugcggcgccuccgccugcgacgucuccguccgcgucgucgucggcgagcccaccgaggcccgcgucguccccggccgcggcaucugccucgaccucgccauccucgacuccgccuuccuccucucccaggucgcccccucccucuucaugggcuccaucguccagcucucccaguccgucaccgccuacauggucuccgccgccggccucggccucgucgccaucuacuucgccacccaggucgucuucgacaaguccgaccucgccaaguacuccgccuga

SEQ ID NO: 49716 - RNA, 2397 nt, Artificial Sequence
  derived and/or modified sequence opt2 from SLC45A4__Homo_sapiens__NP_001073900
augggcaaggccucccccgccuccggccucucccgccccaagacccucgucuccccccuccgcuccaaccaguggucccuccagaagggccuccccgagcaguacuacucccucaccugguuccucucccccauccucggccucaucuucaccccccucaucggcuccgccuccgaccgcugcacccucuccuggggccgccgccgccccuucauccucgcccucugcgucggcguccucuucggcgucgcccucuuccucaacggcuccgccaucggccucgcccucggcgacguccccaaccgccagcccaucggcaucguccucaccguccucggcgucgucguccucgacuucuccgccgacgccaccgagggccccauccgcgccuaccuccucgacgucgucgacuccgaggagcaggacauggcccucaacauccacgccuucuccgccggccucggcggcgccaucggcuacguccucggcggccucgacuggacccagaccuuccucggcuccugguuccgcacccagaaccagguccucuucuucuucgccgccaucaucuucaccgucuccgucgcccuccaccucuucuccaucgacgaggagcaguacuccccccagcaggagcgcuccgccgaggagcccggcgcccucgacggcggcgagccccacggcguccccgccuuccccgacgagguccaguccgagcacgagcucgcccucgacuaccccgacgucgacaucaugcgcuccaaguccgacuccgcccuccacguccccgacaccgcccucgaccucgagcccgagcuccucuuccuccacgacaucgagcccuccaucuuccacgacgccuccuaccccgccaccccccgcuccaccucccaggagcucgccaagaccaagcucccccgccucgccaccuuccucaaggaggccgccaaggaggacgagacccuccucgacaaccaccucaacgaggccaagguccccaacggcuccggcucccccaccaaggacgcccucggcggcuacacccgcgucgacaccaagcccuccgccaccuccuccuccaugcgccgccgccgccacgccuuccgccgccaggccuccuccaccuucuccuacuacggcaagcucggcucccacugcuaccgcuaccgccgcgccaacgccgucguccucaucaagcccucccgcuccauguccgaccucuacgacaugcagaagcgccagcgccagcaccgccaccgcaaccaguccggcgccaccaccuccuccggcgacaccgaguccgaggagggcgagggcgagaccaccguccgccuccucuggcucuccaugcucaagaugccccgcgagcucaugcgccucugccucugccaccuccucaccugguucuccgucaucgccgaggccgucuucuacaccgacuucaugggccaggucaucuucgagggcgaccccaaggcccccuccaacuccaccgccuggcaggccuacaacgccggcgucaagaugggcugcuggggccucgucaucuacgccgccaccggcgccaucugcuccgcccuccuccagaaguaccucgacaacuacgaccucuccguccgcgucaucuacguccucggcacccucggcuucuccgucggcaccgccgucauggccauguuccccaacgucuacgucgccauggucaccaucuccaccaugggcaucgucuccauguccaucuccuacugccccuacgcccuccucggccaguaccacgacaucaagcaguacauccaccacucccccggcaacuccaagcgcggcuucggcaucgacugcgccauccucuccugccaggucuacaucucccagauccucgucgccuccgcccucggcggcgucgucgacgccgucggcaccguccgcgucauccccauggucgccuccgucggcuccuuccucggcuuccucaccgccaccuuccucgucaucuaccccaacgucuccgaggaggccaaggaggagcagaagggccucuccuccccccucgccggcgagggccgcgccggcggcaacuccgagaagcccaccguccucaagcucacccgcaaggagggccuccagggccccgucgagaccgagcgccuccagguccucaccuccguccgcucccgccacaucggcuggugccgcuccugcuggcgcgucuucuucuucaugaucauccucgagaagaaguucuccuucccccagugcggcucccuccgccgcaugaccuaccuccucuuccucuccgagcucgacacccucugccccggccagcccugccccugggccgccaccgcccaccaguccugggaggaggccggccccggcggccucggccgccgccaguga

SEQ ID NO: 49717 - RNA, 1296 nt, Artificial Sequence
  derived and/or modified sequence opt2 from SLC46A1__Homo_sapiens__NP_001229295
auggagggcuccgccuccccccccgagaagccccgcgcccgccccgccgccgccguccucugccgcggccccgucgagccccucgucuuccucgccaacuucgcccucguccuccagggcccccucaccacccaguaccucuggcaccgcuucuccgccgaccucggcuacaacggcacccgccagcgcggcggcugcuccaaccgcuccgccgaccccaccaugcaggaggucgagacccucaccucccacuggacccucuacaugaacgucggcggcuuccucgucggccucuucuccuccacccuccucggcgccugguccgacuccgucggccgccgcccccuccucguccucgccucccucggccuccuccuccaggcccucgucuccgucuucgucguccagcuccagcuccacgucggcuacuucguccucggccgcauccucugcgcccuccucggcgacuucggcggccuccucgccgccuccuucgccuccgucgccgacgucuccuccucccgcucccgcaccuuccgcauggcccuccucgaggccuccaucggcgucgccggcaugcucgccucccuccucggcggccacuggcuccgcgcccagggcuacgccaaccccuucuggcucgcccucgcccuccucaucgccaugacccucuacgccgccuucugcuucggcgagacccucaaggagcccaaguccacccgccucuucaccuuccgccaccaccgcuccaucguccagcucuacgucgcccccgcccccgagaagucccgcaagcaccucgcccucuacucccucgccaucuucgucgucaucaccguccacuucggcgcccaggacauccucacccucuacgagcucuccaccccccucugcugggacuccaagcucaucggcuacggcuccgccgcccagcaccuccccuaccucaccucccuccucgcccucaagcuccuccaguacugccucgccgacgccugggucgccgagaucggccucgccuucaacauccucggcauggucgucuucgccuucgccaccaucaccccccucauguucaccggcgcccucuucuccgccgucgccugcgucaacucccucgccaugcucaccgccuccggcaucuucaacucccucuaccccgccacccucaacuucaugaagggcuuccccuuccuccucggcgccggccuccuccucauccccgccguccucaucggcaugcucgagaaggccgacccccaccucgaguuccagcaguucccccagucccccuga

SEQ ID NO: 49718 - RNA, 1428 nt, Artificial Sequence
  derived and/or modified sequence opt2 from SLC46A2__Homo_sapiens__NP_149040
augucccccgaggucaccugcccccgccgcggccaccucccccgcuuccacccccgcaccugggucgagcccgucgucgccuccucccaggucgccgccucccucuacgacgccggccuccuccucgucgucaaggccuccuacggcaccggcggcuccuccaaccacuccgccucccccuccccccgcggcgcccucgaggaccagcagcagcgcgccaucuccaacuucuacaucaucuacaaccucgucgucggccucuccccccuccucuccgccuacggccucggcuggcucuccgaccgcuaccaccgcaagaucuccaucugcaugucccuccucggcuuccuccucucccgccucggccuccuccucaagguccuccucgacuggcccgucgagguccucuacggcgccgccgcccucaacggccucuucggcggcuucuccgccuucugguccggcgucauggcccucggcucccucggcuccuccgagggccgccgcuccguccgccucauccucaucgaccucaugcucggccucgccggcuucugcggcuccauggccuccggccaccucuucaagcagauggccggccacuccggccagggccucauccucaccgccugcuccgucuccugcgccuccuucgcccuccucuacucccuccucguccucaagguccccgaguccgucgccaagcccucccaggagcuccccgccgucgacaccgucuccggcaccgucggcaccuaccgcacccucgaccccgaccagcucgaccagcaguacgccgucggccacccccccucccccggcaaggccaagccccacaagaccaccaucgcccuccucuucgucggcgccaucaucuacgaccucgccgucgucggcaccgucgacgucaucccccucuucguccuccgcgagccccucggcuggaaccagguccaggucggcuacggcauggccgccggcuacaccaucuucaucaccuccuuccucggcguccucgucuucucccgcugcuuccgcgacaccaccaugaucaugaucggcauggucuccuucggcuccggcgcccuccuccucgccuucgucaaggagaccuacauguucuacaucgcccgcgccgucaugcucuucgcccucauccccgucaccaccauccgcuccgccauguccaagcucaucaagggcuccuccuacggcaaggucuucgucauccuccagcucucccucgcccucaccggcgucgucaccuccacccucuacaacaagaucuaccagcucaccauggacauguucgucggcuccugcuucgcccucuccuccuuccucuccuuccucgccaucauccccaucuccaucgucgccuacaagcaggucccccucucccccuacggcgacaucaucgagaaguga

SEQ ID NO: 49719 - RNA, 1713 nt, Artificial Sequence
  derived and/or modified sequence opt2 from SLC47A1__Homo_sapiens__NP_060712
auggaggcccccgaggagcccgcccccguccgcggcggccccgaggccacccucgagguccgcggcucccgcugccuccgccucuccgccuuccgcgaggagcuccgcgcccuccucguccucgccggccccgccuuccucguccagcucauggucuuccucaucuccuucaucuccuccgucuucugcggccaccucggcaagcucgagcucgacgccgucacccucgccaucgccgucaucaacgucaccggcgucuccgucggcuucggccucuccuccgccugcgacacccucaucucccagaccuacggcucccagaaccucaagcacgucggcgucauccuccagcgcuccgcccucguccuccuccucugcugcuuccccugcugggcccucuuccucaacacccagcacauccuccuccucuuccgccaggaccccgacgucucccgccucacccagaccuacgucaccaucuucauccccgcccuccccgccaccuuccucuacaugcuccaggucaaguaccuccucaaccagggcaucguccucccccagaucgucaccggcgucgccgccaaccucgucaacgcccucgccaacuaccucuuccuccaccagcuccaccucggcgucaucggcuccgcccucgccaaccucaucucccaguacacccucgcccuccuccucuuccucuacauccucggcaagaagcuccaccaggccaccuggggcggcuggucccucgagugccuccaggacugggccuccuuccuccgccucgccauccccuccaugcucaugcucugcauggaguggugggccuacgaggucggcuccuuccucuccggcauccucggcauggucgagcucggcgcccaguccaucgucuacgagcucgccaucaucgucuacaugguccccgccggcuucuccgucgccgccuccguccgcgucggcaacgcccucggcgccggcgacauggagcaggcccgcaaguccuccaccgucucccuccucaucaccguccucuucgccgucgccuucuccguccuccuccucuccugcaaggaccacgucggcuacaucuucaccaccgaccgcgacaucaucaaccucgucgcccaggucguccccaucuacgccgucucccaccucuucgaggcccucgccugcaccuccggcggcguccuccgcggcuccggcaaccagaaggucggcgccaucgucaacaccaucggcuacuacgucgucggccuccccaucggcaucgcccucauguucgccaccacccucggcgucaugggccucugguccggcaucaucaucugcaccgucuuccaggccgucugcuuccucggcuucaucauccagcucaacuggaagaaggccugccagcaggcccagguccacgccaaccucaaggucaacaacgucccccgcuccggcaacuccgcccucccccaggacccccuccaccccggcugccccgagaaccucgagggcauccucaccaacgacgucggcaagaccggcgagccccaguccgaccagcagaugcgccaggaggagccccuccccgagcacccccaggacggcgccaagcucucccgcaagcagcucguccuccgccgcggccuccuccuccucggcgucuuccucauccuccucgucggcauccucguccgcuucuacguccgcauccaguga

SEQ ID NO: 49720 - RNA, 441 nt, Artificial Sequence
  derived and/or modified sequence opt2 from SLC48A1__Homo_sapiens__NP_060312
auggcccccucccgccuccagcucggccuccgcgccgccuacuccggcaucuccuccgucgccggcuucuccaucuuccucgucuggaccgucgucuaccgccagcccggcaccgccgccaugggcggccucgccggcguccucgcccucuggguccucgucacccacgucauguacaugcaggacuacuggcgcaccuggcucaagggccuccgcggcuucuucuucgucggcguccucuucuccgccgucuccaucgccgccuucugcaccuuccucguccucgccaucacccgccaccagucccucaccgaccccaccuccuacuaccucuccuccgucugguccuucaucuccuucaagugggccuuccuccucucccucuacgcccaccgcuaccgcgccgacuucgccgacaucuccauccucuccgacuucuga

SEQ ID NO: 49721 - RNA, 3357 nt, Artificial Sequence
  derived and/or modified sequence opt2 from SLC4A10__Homo_sapiens__NP_001171486
auggagaucaaggaccagggcgcccagauggagccccuccuccccacccgcaacgacgaggaggccgucgucgaccgcggcggcacccgcuccauccucaagacccacuucgagaaggaggaccucgagggccaccgcacccucuucaucggcguccacgucccccucggcggccgcaagucccaccgccgccaccgccaccgcggccacaagcaccgcaagcgcgaccgcgagcgcgacuccggccucgaggacggccgcgagucccccuccuucgacacccccucccagcgcguccaguucauccucggcaccgaggacgacgacgaggagcacaucccccacgaccucuucaccgagcucgacgagaucugcuggcgcgagggcgaggacgccgaguggcgcgagaccgcccgcuggcucaaguucgaggaggacgucgaggacggcggcgagcgcugguccaagcccuacgucgccacccucucccuccacucccucuucgagcuccgcuccugcauccucaacggcaccguccuccucgacaugcacgccaacacccucgaggagaucgccgacaugguccucgaccagcaggucuccuccggccagcucaacgaggacguccgccaccgcguccacgaggcccucaugaagcagcaccaccaccagaaccagaagaagcucaccaaccgcauccccaucguccgcuccuucgccgacaucggcaagaagcaguccgagcccaacuccauggacaagaacgccggccaggucgucuccccccaguccgcccccgccugcgucgagaacaagaacgacgucucccgcgagaacuccaccgucgacuucuccaagggccucggcggccagcagaagggccacaccucccccugcggcaugaagcagcgccacgagaagggccccccccaccagcaggagcgcgaggucgaccuccacuucaugaagaagaucccccccggcgccgaggccuccaacauccucgucggcgagcucgaguuccucgaccgcaccgucgucgccuucguccgccucucccccgccguccuccuccagggccucgccgagguccccauccccacccgcuuccucuucauccuccucggcccccucggcaagggccagcaguaccacgagaucggccgcuccaucgccacccucaugaccgacgaggucuuccacgacgucgccuacaaggccaaggaccgcaacgaccucgucuccggcaucgacgaguuccucgaccaggucaccguccucccccccggcgagugggaccccuccauccgcaucgagccccccaagaacguccccucccaggagaagcgcaagauccccgccguccccaacggcaccgccgcccacggcgaggccgagccccacggcggccacuccggccccgagcuccagcgcaccggccgcaucuucggcggccucauccucgacaucaagcgcaaggcccccuacuucugguccgacuuccgcgacgccuucucccuccagugccucgccuccuuccucuuccucuacugcgccugcaugucccccgucaucaccuucggcggccuccucggcgaggccaccgagggccgcaucuccgccaucgagucccucuucggcgccuccaugaccggcaucgccuacucccucuucggcggccagccccucaccauccucggcuccaccggccccguccucgucuucgagaagauccucuucaaguucugcaaggaguacggccucuccuaccucucccuccgcgccuccaucggccucuggaccgccacccucugcaucauccucgucgccaccgacgccuccucccucgucugcuacaucacccgcuucaccgaggaggccuucgccucccucaucugcaucaucuucaucuacgaggcccucgagaagcucuucgagcucuccgaggccuaccccaucaacaugcacaacgaccucgagcuccucacccaguacuccugcaacugcgucgagccccacaaccccuccaacggcacccucaaggaguggcgcgaguccaacaucuccgccuccgacaucaucugggagaaccucaccgucuccgagugcaagucccuccacggcgaguacgucggccgcgccugcggccacgaccaccccuacguccccgacguccucuucugguccgucauccucuucuucuccaccgucacccucuccgccacccucaagcaguucaagaccucccgcuacuuccccaccaagguccgcuccaucgucuccgacuucgccgucuuccucaccauccucugcaugguccucaucgacuacgccaucggcauccccucccccaagcuccagguccccuccgucuucaagcccacccgcgacgaccgcggcugguucgucaccccccucggccccaaccccugguggaccgucaucgccgccaucauccccgcccuccucugcaccauccucaucuucauggaccagcagaucaccgccgucaucaucaaccgcaaggagcacaagcucaagaagggcugcggcuaccaccucgaccuccucauggucgccgucaugcucggcgucugcuccaucaugggccuccccugguucgucgccgccaccguccucuccaucacccacgucaacucccucaagcucgaguccgagugcuccgcccccggcgagcagcccaaguuccucggcauccgcgagcagcgcgucaccggccucaugaucuucauccucaugggcuccuccgucuucaugaccuccauccucaaguucauccccaugcccguccucuacggcgucuuccucuacaugggcgccuccucccucaagggcauccaguucuucgaccgcaucaagcucuucuggaugcccgccaagcaccagcccgacuucaucuaccuccgccacgucccccuccgcaagguccaccucuucaccaucauccagauguccugccucggccuccucuggaucaucaaggucucccgcgccgccaucgucuuccccaugaugguccucgcccucgucuucguccgcaagcucauggaccuccucuucaccaagcgcgagcucuccuggcucgacgaccucaugcccgaguccaagaagaagaagcucgaggacgccgagaaggaggaggagcaguccaugcucgccauggaggacgagggcaccguccagcucccccucgagggccacuaccgcgacgaccccuccgucaucaacaucuccgacgagauguccaagaccgcccucuggcgcaaccuccucaucaccgccgacaacuccaaggacaaggaguccuccuuccccuccaaguccucccccuccuga

SEQ ID NO: 49722 - RNA, 2628 nt, Artificial Sequence
  derived and/or modified sequence opt2 from SLC4A11__Homo_sapiens__NP_001167560
auggccgccgccacccgccgcgucuuccaccuccagcccugcgagaacucccccaccaugucccagaacggcuacuucgaggacuccuccuacuacaagugcgacaccgacgacaccuucgaggcccgcgaggagauccucggcgacgaggccuucgacaccgccaacuccuccaucgucuccggcgaguccauccgcuucuucgucaacgucaaccucgagaugcaggccaccaacaccgagaacgaggccaccuccggcggcugcguccuccuccacaccucccgcaaguaccucaagcucaagaacuucaaggaggagauccgcgcccaccgcgaccucgacggcuuccucgcccaggccuccaucguccucaacgagaccgccaccucccucgacaacguccuccgcaccaugcuccgccgcuucgcccgcgaccccgacaacaacgagcccaacugcaaccucgaccuccucauggccaugcucuucaccgacgccggcgcccccaugcgcggcaagguccaccuccucuccgacaccauccagggcgucaccgccaccgucaccggcguccgcuaccagcaguccuggcucugcaucaucugcaccaugaaggcccuccagaagcgccacgucugcaucucccgccucguccgcccccagaacuggggcgagaacuccugcgagguccgcuucgucauccucguccucgccccccccaagaugaaguccaccaagaccgccauggaggucgcccgcaccuucgccaccauguucuccgacaucgccuuccgccagaagcuccucgagacccgcaccgaggaggaguucaaggaggcccucguccaccagcgccagcuccucaccauggucucccacggccccgucgccccccgcaccaaggagcgcuccaccgucucccuccccgcccaccgccaccccgagccccccaagugcaaggacuucguccccuucggcaagggcauccgcgaggacaucgcccgccgcuucccccucuacccccucgacuucaccgacggcaucaucggcaagaacaaggccgucggcaaguacaucaccaccacccucuuccucuacuucgccugccuccuccccaccaucgccuucggcucccucaacgacgagaacaccgacggcgccaucgacguccagaagaccaucgccggccaguccaucggcggccuccucuacgcccucuucuccggccagccccucgucauccuccucaccaccgccccccucgcccucuacauccaggucauccgcgucaucugcgacgacuacgaccucgacuucaacuccuucuacgccuggaccggccucuggaacuccuucuuccucgcccucuacgccuucuucaaccucucccucgucaugucccucuucaagcgcuccaccgaggagaucaucgcccucuucaucuccaucaccuucguccucgacgccgucaagggcaccgucaagaucuucuggaaguacuacuacggccacuaccucgacgacuaccacaccaagcgcaccuccucccucgucucccucuccggccucggcgccucccucaacgccucccuccacaccgcccucaacgccuccuuccucgccucccccaccgagcuccccuccgccacccacuccggccaggccaccgccguccucucccuccucaucaugcucggcacccucuggcucggcuacacccucuaccaguucaagaagucccccuaccuccaccccugcguccgcgagauccucuccgacugcgcccuccccaucgccguccucgccuucucccucaucuccucccacggcuuccgcgagaucgagauguccaaguuccgcuacaaccccuccgagucccccuucgccauggcccagauccagucccucucccuccgcgccgucuccggcgccaugggccucggcuuccuccucuccaugcucuucuucaucgagcagaaccucgucgccgcccucgucaacgcccccgagaaccgccucgucaagggcaccgccuaccacugggaccuccuccuccucgccaucaucaacaccggccucucccucuucggccuccccuggauccacgccgccuacccccacuccccccuccacguccgcgcccucgcccucgucgaggagcgcgucgagaacggccacaucuacgacaccaucgucaacgucaaggagacccgccucaccucccucggcgccuccguccucgucggccucucccuccuccuccuccccgucccccuccaguggauccccaagcccguccucuacggccucuuccucuacaucgcccucaccucccucgacggcaaccagcucguccagcgcgucgcccuccuccucaaggagcagaccgccuacccccccacccacuacauccgccgcgucccccagcgcaagauccacuacuucaccggccuccagguccuccagcuccuccuccucugcgccuucggcauguccucccuccccuacaugaagaugaucuucccccucaucaugaucgccaugauccccauccgcuacauccuccucccccgcaucaucgaggccaaguaccucgacgucauggacgccgagcaccgccccuga

SEQ ID NO: 49723 - RNA, 2391 nt, Artificial Sequence
  derived and/or modified sequence opt2 from SLC4A1AP__Homo_sapiens__NP_060628
augcucgccccccuccgcaacgcccccggccgcgagggcgccaccucccccuccccccccaccgacgccaccggcucccucggcgagugggacgucgaccgcaacgucaagaccgagggcugggucuccaaggagcgcaucuccaagcuccaccgccuccgcauggccgacauccucucccaguccgagacccucgccucccaggaccucuccggcgacuucaagaagcccgcccuccccgucucccccgccgcccgcuccaaggcccccgccuccuccuccuccaaccccgaggagguccagaaggagggccccaccgcccuccaggacuccaacuccggcgagcccgacaucccccccccccagcccgacugcggcgacuuccgcucccuccaggaggagcagucccgcccccccaccgccgucuccucccccggcggccccgcccgcgccccccccuaccaggagccccccuggggcggccccgccaccgcccccuacucccucgagacccucaagggcggcaccauccucggcacccgcucccucaagggcaccuccuacugccucuucggccgccucuccggcugcgacgucugccucgagcaccccuccgucucccgcuaccacgccguccuccagcaccgcgccuccggccccgacggcgagugcgacuccaacggccccggcuucuaccucuacgaccucggcuccacccacggcaccuuccucaacaagacccgcauccccccccgcaccuacugccgcguccacgucggccacgucguccgcuucggcggcuccacccgccucuucauccuccagggccccgaggaggaccgcgaggccgaguccgagcucaccgucacccagcucaaggagcuccgcaagcagcagcagauccuccucgagaagaagaugcucggcgaggacuccgacgaggaggaggagauggacaccuccgagcgcaagaucaacgccggcucccaggacgacgagaugggcugcaccuggggcaugggcgaggacgccgucgaggacgacgccgaggagaaccccaucguccucgaguuccagcaggagcgcgaggccuucuacaucaaggaccccaagaaggcccuccagggcuucuucgaccgcgagggcgaggagcucgaguacgaguucgacgagcagggccacuccaccuggcucugccgcguccgccuccccgucgacgacuccaccggcaagcagcucgucgccgaggccauccacuccggcaagaagaaggaggccaugauccagugcucccucgaggccugccgcauccucgacacccucggccuccuccgccaggaggccgucucccgcaagcgcaaggccaagaacugggaggacgaggacuucuacgacuccgacgacgacaccuuccucgaccgcaccggccucaucgagaagaagcgccucaaccgcaugaagaaggccggcaagaucgacgagaagcccgagaccuucgagucccucgucgccaagcucaacgacgccgagcgcgagcucuccgagaucuccgagcgccucaaggccuccucccagguccucuccgagucccccucccaggacucccucgacgccuucauguccgagaugaaguccggcuccacccucgacggcgucucccgcaagaagcuccaccuccgcaccuucgagcuccgcaaggagcagcagcgccucaagggccucaucaagaucgucaagcccgccgagauccccgagcucaagaagaccgagacccagaccaccggcgccgagaacaaggccaagaagcucacccucccccucuucggcgccaugaagggcggcuccaaguucaagcucaagaccggcaccgucggcaagcucccccccaagcgccccgagcucccccccacccucaugcgcaugaaggacgagcccgaggucgaggaggaggaggaggaggaggaggaggaggagaaggagaaggaggagcacgagaagaagaagcucgaggacggcucccucucccgcccccagcccgagaucgagcccgaggccgccguccaggagaugcgcccccccaccgaccucacccacuucaaggagacccagacccacgagaacaugucccagcucuccgaggaggagcagaacaaggacuaccaggacugcuccaagaccaccucccucugcgccggccccuccgccuccaagaacgaguacgagaagucccgcggcgagcucaagaagaagaagacccccggccccggcaagcucccccccacccucuccuccaaguaccccgaggacgaccccgacuacugcgucugggucccccccgagggccaguccggcgacggccgcacccaccucaacgacaaguacggcuacuga

SEQ ID NO: 49724 - RNA, 2736 nt, Artificial Sequence
  derived and/or modified sequence opt2 from SLC4A1__Homo_sapiens__NP_000333
auggaggagcuccaggacgacuacgaggacaugauggaggagaaccucgagcaggaggaguacgaggaccccgacauccccgagucccagauggaggagcccgccgcccacgacaccgaggccaccgccaccgacuaccacaccaccucccaccccggcacccacaaggucuacgucgagcuccaggagcucgucauggacgagaagaaccaggagcuccgcuggauggaggccgcccgcuggguccagcucgaggagaaccucggcgagaacggcgccuggggccgcccccaccucucccaccucaccuucuggucccuccucgagcuccgccgcgucuucaccaagggcaccguccuccucgaccuccaggagaccucccucgccggcgucgccaaccagcuccucgaccgcuucaucuucgaggaccagauccgcccccaggaccgcgaggagcuccuccgcgcccuccuccucaagcacucccacgccggcgagcucgaggcccucggcggcgucaagcccgccguccucacccgcuccggcgaccccucccagccccuccucccccagcacuccucccucgagacccagcucuucugcgagcagggcgacggcggcaccgagggccacucccccuccggcauccucgagaagaucccccccgacuccgaggccacccucguccucgucggccgcgccgacuuccucgagcagcccguccucggcuucguccgccuccaggaggccgccgagcucgaggccgucgagcuccccguccccauccgcuuccucuucguccuccucggccccgaggccccccacaucgacuacacccagcucggccgcgccgccgccacccucauguccgagcgcgucuuccgcaucgacgccuacauggcccagucccgcggcgagcuccuccacucccucgagggcuuccucgacugcucccucguccucccccccaccgacgcccccuccgagcaggcccuccucucccucguccccguccagcgcgagcuccuccgccgccgcuaccaguccucccccgccaagcccgacuccuccuucuacaagggccucgaccucaacggcggccccgacgacccccuccagcagaccggccagcucuucggcggccucguccgcgacauccgccgccgcuaccccuacuaccucuccgacaucaccgacgccuucuccccccagguccucgccgccgucaucuucaucuacuucgccgcccucucccccgccaucaccuucggcggccuccucggcgagaagacccgcaaccagaugggcgucuccgagcuccucaucuccaccgccguccagggcauccucuucgcccuccucggcgcccagccccuccucgucgucggcuucuccggcccccuccucgucuucgaggaggccuucuucuccuucugcgagaccaacggccucgaguacaucgucggccgcgucuggaucggcuucuggcucauccuccucgucguccucgucgucgccuucgagggcuccuuccucguccgcuucaucucccgcuacacccaggagaucuucuccuuccucaucucccucaucuucaucuacgagaccuucuccaagcucaucaagaucuuccaggaccacccccuccagaagaccuacaacuacaacguccucaugguccccaagccccagggcccccuccccaacaccgcccuccucucccucguccucauggccggcaccuucuucuucgccaugaugcuccgcaaguucaagaacuccuccuacuuccccggcaagcuccgccgcgucaucggcgacuucggcguccccaucuccauccucaucaugguccucgucgacuucuucauccaggacaccuacacccagaagcucuccguccccgacggcuucaaggucuccaacuccuccgcccgcggcugggucauccacccccucggccuccgcuccgaguuccccaucuggaugauguucgccuccgcccuccccgcccuccucgucuucauccucaucuuccucgagucccagaucaccacccucaucgucuccaagcccgagcgcaagauggucaagggcuccggcuuccaccucgaccuccuccucgucgucggcaugggcggcgucgccgcccucuucggcaugcccuggcucuccgccaccaccguccgcuccgucacccacgccaacgcccucaccgucaugggcaaggccuccacccccggcgccgccgcccagauccaggaggucaaggagcagcgcaucuccggccuccucgucgccguccucgucggccucuccauccucauggagcccauccucucccgcaucccccucgccguccucuucggcaucuuccucuacaugggcgucaccucccucuccggcauccagcucuucgaccgcauccuccuccucuucaagccccccaaguaccaccccgacguccccuacgucaagcgcgucaagaccuggcgcaugcaccucuucaccggcauccagaucaucugccucgccguccucugggucgucaaguccacccccgccucccucgcccuccccuucguccucauccucaccgucccccuccgccgcguccuccucccccucaucuuccgcaacgucgagcuccagugccucgacgccgacgacgccaaggccaccuucgacgaggaggagggccgcgacgaguacgacgaggucgccaugcccgucuga

SEQ ID NO: 49725 - RNA, 3699 nt, Artificial Sequence
  derived and/or modified sequence opt2 from SLC4A2__Homo_sapiens__NP_001186622
auggacuuccuccuccgcccccagcccgagcccgagucccucggccccggcacccccggcuuccccgagcaggaggaggacgagcuccaccgcacccucggcgucgagcgcuucgaggagauccuccaggaggccggcucccgcggcggcgaggagcccggccgcuccuacggcgaggaggacuucgaguaccaccgccaguccucccaccacauccaccacccccucuccacccaccucccccccgacgcccgccgccgcaagaccccccagggccccggccgcaagccccgccgccgccccggcgccucccccaccggcgagacccccaccaucgaggagggcgaggaggacgaggacgaggccuccgaggccgagggcgcccgcgcccucacccagcccucccccgucuccacccccuccuccguccaguucuuccuccaggaggacgacuccgccgaccgcaaggccgagcgcaccucccccuccucccccgccccccucccccaccaggaggccaccccccgcgccuccaagggcgcccaggccggcacccaggucgaggaggccgaggccgaggccgucgccgucgccuccggcaccgccggcggcgacgacggcggcgccuccggccgcccccuccccaaggcccagcccggccaccgcuccuacaaccuccaggagcgccgccgcaucggcuccaugaccggcgccgagcaggcccuccucccccgcguccccaccgacgagaucgaggcccagacccucgccaccgccgaccucgaccucaugaagucccaccgcuucgaggacguccccggcguccgccgccaccucguccgcaagaacgccaagggcuccacccaguccggccgcgagggccgcgagcccggccccaccccccgcgcccgcccccgcgccccccacaagccccacgaggucuucgucgagcucaacgagcuccuccucgacaagaaccaggagccccaguggcgcgagaccgcccgcuggaucaaguucgaggaggacgucgaggaggagaccgagcgcuggggcaagccccacgucgccucccucuccuuccgcucccuccucgagcuccgccgcacccucgcccacggcgccguccuccucgaccucgaccagcagacccuccccggcgucgcccaccaggucgucgagcagauggucaucuccgaccagaucaaggccgaggaccgcgccaacguccuccgcgcccuccuccucaagcacucccaccccuccgacgagaaggacuucuccuucccccgcaacaucuccgccggcucccucggcucccuccucggccaccaccacggccagggcgccgaguccgacccccacgucaccgagccccucaugggcggcguccccgagacccgccucgaggucgagcgcgagcgcgagcuccccccccccgccccccccgccggcaucacccgcuccaaguccaagcacgagcucaagcuccucgagaagauccccgagaacgccgaggccaccgucguccucgucggcugcgucgaguuccucucccgccccaccauggccuucguccgccuccgcgaggccgucgagcucgacgccguccucgagguccccguccccguccgcuuccucuuccuccuccucggccccuccuccgccaacauggacuaccacgagaucggccgcuccaucuccacccucauguccgacaagcaguuccacgaggccgccuaccucgccgacgagcgcgaggaccuccucaccgccaucaacgccuuccucgacugcuccgucguccucccccccuccgagguccagggcgaggagcuccuccgcuccgucgcccacuuccagcgccagaugcucaagaagcgcgaggagcagggccgccuccuccccaccggcgccggccucgagcccaaguccgcccaggacaaggcccuccuccagauggucgaggccgccggcgccgccgaggacgacccccuccgccgcaccggccgccccuucggcggccucauccgcgacguccgccgccgcuacccccacuaccucuccgacuuccgcgacgcccucgacccccagugccucgccgccgucaucuucaucuacuucgccgcccucucccccgccaucaccuucggcggccuccucggcgagaagacccaggaccucaucggcgucuccgagcucaucauguccaccgcccuccagggcgucgucuucugccuccucggcgcccagccccuccucgucaucggcuucuccggcccccuccucgucuucgaggaggccuucuucuccuucugcuccuccaaccaccucgaguaccucgucggccgcgucuggaucggcuucuggcucgucuuccucgcccuccucauggucgcccucgagggcuccuuccucguccgcuucgucucccgcuucacccaggagaucuucgccuuccucaucucccucaucuucaucuacgagaccuucuacaagcucgucaagaucuuccaggagcacccccuccacggcugcuccgccuccaacuccuccgaggucgacggcggcgagaacaugaccugggccggcgcccgccccacccucggccccggcaaccgcucccucgccggccaguccggccagggcaagccccgcggccagcccaacaccgcccuccucucccucguccucauggccggcaccuucuucaucgccuucuuccuccgcaaguucaagaacucccgcuucuuccccggccgcauccgccgcgucaucggcgacuucggcguccccaucgccauccucaucaugguccucgucgacuacuccaucgaggacaccuacacccagaagcucuccguccccuccggcuucuccgucaccgcccccgagaagcgcggcugggucaucaacccccucggcgagaagucccccuuccccgucuggaugauggucgccucccuccuccccgccauccucgucuucauccucaucuucauggagacccagaucaccacccucaucaucuccaagaaggagcgcaugcuccagaagggcuccggcuuccaccucgaccuccuccucaucgucgccaugggcggcaucugcgcccucuucggccuccccuggcucgccgccgccaccguccgcuccgucacccacgccaacgcccucaccgucauguccaaggccgucgcccccggcgacaagcccaagauccaggaggucaaggagcagcgcgucaccggccuccucgucgcccuccucgucggccucuccaucgucaucggcgaccuccuccgccagaucccccucgccguccucuucggcaucuuccucuacaugggcgucaccucccucaacggcauccaguucuacgagcgccuccaccuccuccucaugccccccaagcaccaccccgacgucaccuacgucaagaagguccgcacccuccgcaugcaccucuucaccgcccuccagcuccucugccucgcccuccucugggccgucauguccaccgccgccucccucgccuuccccuucauccucauccucaccgucccccuccgcauggucguccucacccgcaucuucaccgaccgcgagaugaagugccucgacgccaacgaggccgagcccgucuucgacgagcgcgagggcgucgacgaguacaacgagaugcccaugcccgucuga

SEQ ID NO: 49726 - RNA, 3699 nt, Artificial Sequence
  derived and/or modified sequence opt2 from SLC4A3__Homo_sapiens__NP_005061
auggccaacggcgucauccccccccccggcggcgccuccccccucccccagguccgcgucccccucgaggagcccccccucucccccgacgucgaggaggaggacgacgaccucggcaagacccucgccgucucccgcuucggcgaccucaucuccaagccccccgccugggaccccgagaagcccucccgcuccuacuccgagcgcgacuucgaguuccaccgccacaccucccaccacacccaccacccccucuccgcccgccucccccccccccacaagcuccgccgccucccccccaccuccgcccgccacacccgccgcaagcgcaagaaggagaagaccuccgccccccccuccgagggcaccccccccauccaggaggagggcggcgccggcgucgacgaggaggaggaggaggaggaggaggaggagggcgaguccgaggccgagcccgucgagcccccccccuccggcaccccccagaaggccaaguucuccaucggcuccgacgaggacgacucccccggccuccccggccgcgccgccgucaccaagccccuccccuccgucggcccccacaccgacaaguccccccagcacuccuccuccucccccuccccccgcgcccgcgccucccgccucgccggcgagaagucccgccccuggucccccuccgccuccuacgaccuccgcgagcgccucugccccggcuccgcccucggcaaccccggcggccccgagcagcagguccccaccgacgaggccgaggcccagaugcucggcuccgccgaccucgacgacaugaagucccaccgccucgaggacaaccccggcguccgccgccaccucgucaagaagcccucccgcacccagggcggccgcggcucccccuccggccucgcccccauccuccgccgcaagaagaagaagaagaagcucgaccgccgcccccacgaggucuucgucgagcucaacgagcucaugcucgaccgcucccaggagccccacuggcgcgagaccgcccgcuggaucaaguucgaggaggacgucgaggaggagaccgagcgcuggggcaagccccacgucgccucccucuccuuccgcucccuccucgagcuccgccgcaccaucgcccacggcgccgcccuccucgaccucgagcagaccacccuccccggcaucgcccaccucgucgucgagaccaugaucgucuccgaccagauccgccccgaggaccgcgccuccguccuccgcacccuccuccucaagcacucccaccccaacgacgacaaggacuccggcuucuucccccgcaaccccuccuccuccuccaugaacuccguccucggcaaccaccaccccacccccucccacggccccgacggcgccguccccaccauggccgacgaccucggcgagcccgccccccucuggccccacgaccccgacgccaaggagaagccccuccacaugcccggcggcgacggccaccgcggcaagucccucaagcuccucgagaagauccccgaggacgccgaggccaccgucguccucgucggcugcguccccuuccucgagcagcccgccgccgccuucguccgccucaacgaggccguccuccucgaguccguccucgagguccccguccccguccgcuuccucuucgucaugcucggccccucccacaccuccaccgacuaccacgagcucggccgcuccaucgccacccucauguccgacaagcucuuccacgaggccgccuaccaggccgacgaccgccaggaccuccucuccgccaucuccgaguuccucgacggcuccaucgucaucccccccuccgaggucgagggccgcgaccuccuccgcuccgucgccgccuuccagcgcgagcuccuccgcaagcgccgcgagcgcgagcagaccaaggucgagaugaccacccgcggcggcuacaccgcccccggcaaggagcucucccucgagcucggcggcuccgaggccacccccgaggacgacccccuccuccgcaccggcuccgucuucggcggccucguccgcgacguccgccgccgcuacccccacuaccccuccgaccuccgcgacgcccuccacucccagugcgucgccgccguccucuucaucuacuucgccgcccucucccccgccaucaccuucggcggccuccucggcgagaagaccgagggccucaugggcgucuccgagcucaucgucuccaccgccguccucggcguccucuucucccuccucggcgcccagccccuccucgucgucggcuucuccggcccccuccucgucuucgaggaggccuucuucaaguucugccgcgcccaggaccucgaguaccucaccggccgcgucugggucggccucuggcucgucgucuucguccucgcccucgucgccgccgagggcuccuuccucguccgcuacaucucccccuucacccaggagaucuucgccuuccucaucucccucaucuucaucuacgagaccuucuacaagcucuacaaggucuucaccgagcacccccuccuccccuucuacccccccgagggcgcccucgagggcucccucgacgccggccucgagcccaacggcuccgcccucccccccaccgagggcccccccuccccccgcaaccagcccaacaccgcccuccucucccucauccucaugcucggcaccuucuucaucgccuucuuccuccgcaaguuccgcaacucccgcuuccucggcggcaaggcccgccgcaucaucggcgacuucggcauccccaucuccauccucgucaugguccucgucgacuacuccaucaccgacaccuacacccagaagcucaccguccccaccggccucuccgucaccucccccgacaagcgcuccugguucauccccccccucggcuccgcccgccccuucccccccuggaugauggucgccgccgccguccccgcccuccucguccucauccucaucuucauggagacccagaucaccgcccucaucgucucccagaaggcccgccgccuccucaagggcuccggcuuccaccucgaccuccuccucaucggcucccucggcggccucugcggccucuucggccuccccuggcucaccgccgccaccguccgcuccgucacccacgucaacgcccucaccgucaugcgcaccgccaucgcccccggcgacaagccccagauccaggagguccgcgagcagcgcgucaccggcguccucaucgccucccucgucggccucuccaucgucaugggcgccguccuccgccgcaucccccucgccguccucuucggcaucuuccucuacaugggcgucaccucccucuccggcauccagcucucccagcgccuccuccucauccucaugcccgccaagcaccaccccgagcagcccuacgucaccaaggucaagaccuggcgcaugcaccucuucaccugcauccagcucggcugcaucgcccuccucugggucgucaaguccaccgccgccucccucgccuuccccuuccuccuccuccucaccgucccccuccgccacugccuccucccccgccucuuccaggaccgcgagcuccaggcccucgacuccgaggacgccgagcccaacuucgacgaggacggccaggacgaguacaacgagcuccacaugcccgucuga

SEQ ID NO: 49727 - RNA, 3240 nt, Artificial Sequence
  derived and/or modified sequence opt2 from SLC4A4__Homo_sapiens__NP_001091954
auggaggacgaggccguccucgaccgcggcgccuccuuccucaagcacgucugcgacgaggaggaggucgagggccaccacaccaucuacaucggcguccacguccccaaguccuaccgccgccgccgccgccacaagcgcaagaccggccacaaggagaagaaggagaaggagcgcaucuccgagaacuacuccgacaaguccgacaucgagaacgccgacgaguccuccuccuccauccucaagccccucaucucccccgccgccgagcgcauccgcuucauccucggcgaggaggacgacucccccgcccccccccagcucuucaccgagcucgacgagcuccucgccgucgacggccaggagauggaguggaaggagaccgcccgcuggaucaaguucgaggagaaggucgagcagggcggcgagcgcugguccaagccccacgucgccacccucucccuccacucccucuucgagcuccgcaccugcauggagaagggcuccaucaugcucgaccgcgaggccuccucccucccccagcucgucgagaugaucgucgaccaccagaucgagaccggccuccucaagcccgagcucaaggacaaggucaccuacacccuccuccgcaagcaccgccaccagaccaagaaguccaaccuccgcucccucgccgacaucggcaagaccgucuccuccgccucccgcauguucaccaaccccgacaacggcucccccgccaugacccaccgcaaccucaccuccuccucccucaacgacaucuccgacaagcccgagaaggaccagcucaagaacaaguucaugaagaagcucccccgcgacgccgaggccuccaacguccucgucggcgaggucgacuuccucgacacccccuucaucgccuucguccgccuccagcaggccgucaugcucggcgcccucaccgagguccccguccccacccgcuuccucuucauccuccucggccccaagggcaaggccaaguccuaccacgagaucggccgcgccaucgccacccucauguccgacgaggucuuccacgacaucgccuacaaggccaaggaccgccacgaccucaucgccggcaucgacgaguuccucgacgaggucaucguccucccccccggcgagugggaccccgccauccgcaucgagccccccaagucccuccccuccuccgacaagcgcaagaacauguacuccggcggcgagaacguccagaugaacggcgacaccccccacgacggcggccacggcggcggcggccacggcgacugcgaggagcuccagcgcaccggccgcuucugcggcggccucaucaaggacaucaagcgcaaggcccccuucuucgccuccgacuucuacgacgcccucaacauccaggcccucuccgccauccucuucaucuaccucgccaccgucaccaacgccaucaccuucggcggccuccucggcgacgccaccgacaacaugcagggcguccucgaguccuuccucggcaccgccgucuccggcgccaucuucugccucuucgccggccagccccucaccauccucuccuccaccggccccguccucgucuucgagcgccuccucuucaacuucuccaaggacaacaacuucgacuaccucgaguuccgccucuggaucggccucugguccgccuuccucugccucauccucgucgccaccgacgccuccuuccucguccaguacuucacccgcuucaccgaggagggcuucuccucccucaucuccuucaucuucaucuacgacgccuucaagaagaugaucaagcucgccgacuacuaccccaucaacuccaacuucaaggucggcuacaacacccucuucuccugcaccugcgucccccccgaccccgccaacaucuccaucuccaacgacaccacccucgcccccgaguaccuccccaccauguccuccaccgacauguaccacaacaccaccuucgacugggccuuccucuccaagaaggagugcuccaaguacggcggcaaccucgucggcaacaacugcaacuucguccccgacaucacccucauguccuucauccucuuccucggcaccuacaccuccuccauggcccucaagaaguucaagaccucccccuacuuccccaccaccgcccgcaagcucaucuccgacuucgccaucauccucuccauccucaucuucugcgucaucgacgcccucgucggcgucgacacccccaagcucaucguccccuccgaguucaagcccaccucccccaaccgcggcugguucgucccccccuucggcgagaaccccuggugggucugccucgccgccgccauccccgcccuccucgucaccauccucaucuucauggaccagcagaucaccgccgucaucgucaaccgcaaggagcacaagcucaagaagggcgccggcuaccaccucgaccucuucugggucgccauccucauggucaucugcucccucauggcccuccccugguacgucgccgccaccgucaucuccaucgcccacaucgacucccucaagauggagaccgagaccuccgcccccggcgagcagcccaaguuccucggcguccgcgagcagcgcgucaccggcacccucgucuucauccucaccggccucuccgucuucauggcccccauccucaaguucauccccaugcccguccucuacggcgucuuccucuacaugggcgucgccucccucaacggcguccaguucauggaccgccucaagcuccuccucaugccccucaagcaccagcccgacuucaucuaccuccgccacgucccccuccgccgcguccaccucuucaccuuccuccagguccucugccucgcccuccucuggauccucaaguccaccgucgccgccaucaucuuccccgucaugauccucgcccucgucgccguccgcaagggcauggacuaccucuucucccagcacgaccucuccuuccucgacgacgucauccccgagaaggacaagaagaagaaggaggacgagaagaagaagaagaagaagaagggcucccucgacuccgacaacgacgacuccgacugccccuacuccgagaagguccccuccaucaagauccccauggacaucauggagcagcagcccuuccucuccgacuccaagcccuccgaccgcgagcgcucccccaccuuccucgagcgccacaccuccugcuga

SEQ ID NO: 49728 - RNA, 3414 nt, Artificial Sequence
  derived and/or modified sequence opt2 from SLC4A5__Homo_sapiens__NP_067019
augaaggucaaggaggagaaggccggcgucggcaagcucgaccacaccaaccaccgccgccgcuuccccgaccagaaggagugcccccccauccacaucggccuccccguccccaccuacccccagcgcaagaccgaccagaagggccaccucuccggccuccagaagguccacuggggccuccgccccgaccagccccagcaggagcucaccggccccggcuccggcgccuccucccaggacuccuccauggaccucaucucccgcacccgcucccccgccgccgagcagcuccaggacauccucggcgaggaggacgaggcccccaaccccacccucuucaccgagauggacacccuccagcacgacggcgaccagauggaguggaaggaguccgcccgcuggaucaaguucgaggagaaggucgaggagggcggcgagcgcugguccaagccccacgucuccacccucucccuccacucccucuucgagcuccgcaccugccuccagaccggcaccguccuccucgaccucgacuccggcucccucccccagaucaucgacgacgucaucgagaagcagaucgaggacggccuccuccgccccgagcuccgcgagcgcgucuccuacguccuccuccgccgccaccgccaccagaccaagaagcccauccaccgcucccucgccgacaucggcaaguccgucuccaccaccaaccgcucccccgcccgcucccccggcgccggccccucccuccaccacuccaccgaggaccuccgcaugcgccaguccgccaacuacggccgccucugccacgcccagucccgcuccaugaacgacaucucccucacccccaacaccgaccagcgcaagaacaaguucaugaagaagauccccaaggacuccgaggccuccaacguccucgucggcgaggucgacuuccucgaccagcccuucaucgccuucguccgccucauccaguccgccaugcucggcggcgucaccgagguccccguccccacccgcuuccucuucauccuccucggccccuccggccgcgccaaguccuacaacgagaucggccgcgccaucgccacccucauggucgacgaccucuucuccgacgucgccuacaaggcccgcaaccgcgaggaccucaucgccggcaucgacgaguuccucgacgaggucaucguccucccccccggcgagugggaccccaacauccgcaucgagccccccaagaagguccccuccgccgacaagcgcaaguccgucuucucccucgccgagcucggccagaugaacggcuccgucggcggcggcggcggcgcccccggcggcggcaacggcggcggcggcggcggcggcuccggcggcggcgccggcuccggcggcgccggcggcaccuccuccggcgacgacggcgagaugcccgccaugcacgagaucggcgaggagcucaucuggaccggccgcuucuucggcggccucugccucgacaucaagcgcaagcuccccugguuccccuccgacuucuacgacggcuuccacauccaguccaucuccgccauccucuucaucuaccucggcugcaucaccaacgccaucaccuucggcggccuccucggcgacgccaccgacaacuaccagggcgucauggaguccuuccucggcaccgccauggccggcucccucuucugccucuucuccggccagccccucaucauccucuccuccaccggccccauccucaucuucgagaagcuccucuucgacuucuccaagggcaacggccucgacuacauggaguuccgccucuggaucggccuccacuccgccguccagugccucauccucgucgccaccgacgccuccuucaucaucaaguacaucacccgcuucaccgaggagggcuucuccacccucaucuccuucaucuucaucuacgacgccaucaagaagaugaucggcgccuucaaguacuaccccaucaacauggacuucaagcccaacuucaucaccaccuacaagugcgagugcgucgcccccgacaccgucaacaccaccgucuucaacgccuccgccccccucgcccccgacaccaacgccucccucuacaaccuccucaaccucaccgcccucgacuggucccuccucuccaagaaggagugccucuccuacggcggccgccuccucggcaacuccugcaaguucauccccgaccucgcccucauguccuucauccucuucuucggcaccuacuccaugacccucacccucaagaaguucaaguucucccgcuacuuccccaccaagguccgcgcccucgucgccgacuucuccaucgucuucuccauccucauguucugcggcaucgacgccugcuucggccucgagacccccaagcuccacguccccuccgucaucaagcccacccgccccgaccgcggcugguucgucgcccccuucggcaagaaccccuggugggucuaccccgccuccauccuccccgcccuccucgucaccauccucaucuucauggaccagcagaucaccgccgucaucgucaaccgcaaggagaacaagcucaagaaggccgccggcuaccaccucgaccucuucugggucggcauccucauggcccucugcuccuucaugggccuccccugguacgucgccgccaccgucaucuccaucgcccacaucgacucccucaagauggagaccgagaccuccgcccccggcgagcagccccaguuccucggcguccgcgagcagcgcgucaccggcaucaucgucuucauccucaccggcaucuccgucuuccucgcccccauccucaagugcaucccccuccccguccucuacggcgucuuccucuacaugggcgucgccucccucaacggcauccagaugggcaccggcggcuccgaguucaagauccagaagaagcucacccccuucugggagcgcugcaagcucuuccucaugcccgccaagcaccagcccgaccacgccuuccuccgccacgucccccuccgccgcauccaccucuucacccucguccagauccucugccucgccguccucuggauccucaaguccaccgucgccgccaucaucuuccccgucaugauccucggccucaucaucguccgccgccuccucgacuucaucuucucccagcacgaccucgccuggaucgacaacauccuccccgagaaggagaagaaggagaccgacaagaagcgcaagcgcaagaagggcgcccacgaggacugcgacgaggagccccaguuccccccccccuccgucaucaagauccccauggaguccguccaguccgacccccagaacggcauccacugcaucgcccgcaagcgcuccuccuccugguccuacucccucuga

SEQ ID NO: 49729 - RNA, 3396 nt, Artificial Sequence
  derived and/or modified sequence opt2 from SLC4A7__Homo_sapiens__NP_001245308
auggaggccgacggcgccggcgagcagaugcgcccccuccucacccgcggccccgacgaggaggccgucgucgaccucggcaagaccuccuccaccgucaacaccaaguucgagaaggaggagcucgagucccaccgcgccgucuacaucggcguccacguccccuucuccaaggagucccgccgccgccaccgccaccgcggccacaagcaccaccaccgccgccgcaaggacaaggaguccgacaaggaggacggccgcgagucccccuccuacgacacccccucccagcgcguccaguucauccucggcaccgaggacgacgacgaggagcacaucccccacgaccucuucaccgagauggacgagcucugcuaccgcgacggcgaggaguacgaguggaaggagaccgcccgcuggcucaaguucgaggaggacgucgaggacggcggcgaccgcugguccaagcccuacgucgccacccucucccuccacucccucuucgagcuccgcuccugcauccucaacggcaccgucaugcucgacaugcgcgccuccacccucgacgagaucgccgacaugguccucgacaacaugaucgccuccggccagcucgacgaguccauccgcgagaacguccgcgaggcccuccucaagcgccaccaccaccagaacgagaagcgcuucaccucccgcaucccccucguccgcuccuucgccgacaucggcaagaagcacuccgacccccaccuccucgagcgcaacggcauccucgccuccccccaguccgcccccggcaaccucgacaacuccaaguccggcgagaucaagggcaacggcuccggcggcucccgcgagaacuccaccgucgacuucuccaaggucgacaugaacuucaugcgcaagauccccaccggcgccgaggccuccaacguccucgucggcgaggucgacuuccucgagcgccccaucaucgccuucguccgccucgcccccgccguccuccucaccggccucaccgagguccccguccccacccgcuuccucuuccuccuccucggccccgccggcaaggccccccaguaccacgagaucggccgcuccaucgccacccucaugaccgacgagaucuuccacgacgucgccuacaaggccaaggaccgcaacgaccuccucuccggcaucgacgaguuccucgaccaggucaccguccucccccccggcgagugggaccccuccauccgcaucgagccccccaaguccguccccucccaggagaagcgcaagauccccgucuuccacaacggcuccacccccacccucggcgagacccccaaggaggccgcccaccacgccggccccgagcuccagcgcaccggccgccucuucggcggccucauccucgacaucaagcgcaaggcccccuucuuccucuccgacuucaaggacgcccucucccuccagugccucgccuccauccucuuccucuacugcgccugcaugucccccgucaucaccuucggcggccuccucggcgaggccaccgagggccgcaucuccgccaucgagucccucuucggcgccucccucaccggcaucgccuacucccucuucgccggccagccccucaccauccucggcuccaccggccccguccucgucuucgagaagauccucuacaaguucugccgcgacuaccagcucuccuaccucucccuccgcaccuccaucggccucuggaccuccuuccucugcaucguccucgucgccaccgacgccuccucccucgucugcuacaucacccgcuucaccgaggaggccuucgccgcccucaucugcaucaucuucaucuacgaggcccucgagaagcucuucgaccucggcgagaccuacgccuucaacaugcacaacaaccucgacaagcucaccuccuacuccugcgucugcaccgagccccccaaccccuccaacgagacccucgcccaguggaagaaggacaacaucaccgcccacaacaucuccuggcgcaaccucaccgucuccgagugcaagaagcuccgcggcgucuuccucggcuccgccugcggccaccacggccccuacauccccgacguccucuucuggugcgucauccucuucuucaccaccuucuuccucuccuccuuccucaagcaguucaagaccaagcgcuacuuccccaccaagguccgcuccaccaucuccgacuucgccgucuuccucaccaucgucaucauggucaccaucgacuaccucgucggcguccccucccccaagcuccacguccccgagaaguucgagcccacccaccccgagcgcggcuggaucaucuccccccucggcgacaaccccugguggacccuccucaucgccgccauccccgcccuccucugcaccauccucaucuucauggaccagcagaucaccgccgucaucaucaaccgcaaggagcacaagcucaagaagggcgccggcuaccaccucgaccuccucauggucggcgucaugcucggcgucugcuccgucaugggccuccccugguucgucgccgccaccguccucuccaucucccacgucaacucccucaaggucgaguccgagugcuccgcccccggcgagcagcccaaguuccucggcauccgcgagcagcgcgucaccggccucaugaucuucauccucaugggccucuccgucuucaugaccuccguccucaaguucauccccaugcccguccucuacggcgucuuccucuacaugggcgucuccucccucaagggcauccagcucuucgaccgcaucaagcucuucggcaugcccgccaagcaccagcccgaccucaucuaccuccgcuacgucccccucuggaagguccacaucuucaccgucauccagcucaccugccucguccuccucugggucaucaaggucuccgccgccgccgucgucuuccccaugaugguccucgcccucgucuucguccgcaagcucauggaccucugcuucaccaagcgcgagcucuccuggcucgacgaccucaugcccgaguccaagaagaagaaggaggacgacaagaagaagaaggagaaggaggaggccgagcgcaugcuccaggacgacgacgacaccguccaccuccccuucgagggcggcucccuccuccagauccccgucaaggcccucaaguacuccgucgaccccuccaucgucaacaucuccgacgagauggccaagaccgcccaguggaaggcccucuccaugaacaccgagaacgccaaggucacccgcuccaacaugucccccgacaagcccgucuccgucaagaucuccuucgaggacgagccccgcaagaaguacgucgacgccgagaccucccucuga

SEQ ID NO: 49730 - RNA, 2838 nt, Artificial Sequence
  derived and/or modified sequence opt2 from SLC4A9__Homo_sapiens__NP_001245355
auggagaugaagcuccccggccaggagggcuucgaggccuccuccgccccccgcaacauccccuccggcgagcucgacuccaaccccgaccccggcaccggccccucccccgacggccccuccgacaccgaguccaaggagcucggcguccccaaggacccccuccucuucauccagcucaacgagcuccucggcuggccccaggcccucgaguggcgcgagaccggccgcuggguccucuucgaggagaagcucgaggucgccgccggccgcugguccgccccccacguccccacccucgcccuccccucccuccagaagcuccgcucccuccucgccgagggccucguccuccucgacugccccgcccagucccuccucgagcucgucgagcaggucacccgcgucgagucccucucccccgagcuccgcggccagcuccaggcccuccuccuccagcgcccccagcacuacaaccagaccaccggcacccgccccugcuggggcuccacccacccccgcaaggccuccgacaacgaggaggccccccuccgcgagcagugccagaacccccuccgccagaagcucccccccggcgccgaggccggcaccguccucgccggcgagcucggcuuccucgcccagccccucggcgccuucguccgccuccgcaaccccgucguccucggcucccucaccgaggucucccuccccucccgcuucuucugccuccuccucggccccugcaugcucggcaagggcuaccacgagaugggccgcgccgccgccguccuccucuccgacccccaguuccagugguccguccgccgcgccuccaaccuccacgaccuccucgccgcccucgacgccuuccucgaggaggucaccguccucccccccggccgcugggaccccaccgcccgcauccccccccccaagugccuccccucccagcacaagcgccuccccucccagcagcgcgagauccgcggccccgccgucccccgccucaccuccgccgaggaccgccaccgccacggcccccacgcccacucccccgagcuccagcgcaccggccgcaagguccccugguaccccuccgacuuccucgacgcccuccaccuccagugcuucuccgccguccucuacaucuaccucgccaccgucaccaacgccaucaccuucggcggccuccucggcgacgccaccgacggcgcccagggcguccucgaguccuuccucggcaccgccgucgccggcgccgccuucugccucauggccggccagccccucaccauccucuccuccaccggccccguccucgucuucgagcgccuccucuucuccuucucccgcgacuacucccucgacuaccuccccuuccgccucugggucggcaucugggucgccaccuucugccucguccucgucgccaccgaggccuccguccucguccgcuacuucacccgcuucaccgaggagggcuucugcgcccucaucucccucaucuucaucuacgacgccgucggcaagaugcucaaccucacccacaccuaccccauccagaagcccggcuccuccgccuacggcugccucugccaguaccccggccccggcggcaacgagucccaguggauccgcacccgccccaaggaccgcgacgacaucgaccucggccucaucaacgccucccuccuccccccccccgagugcacccgccagggcggccacccccgcggccccggcugccacaccguccccgacaucgccuucuucucccuccuccucuuccucaccuccuucuucuucgccauggcccucaagugcgucaagaccucccgcuucuuccccuccgucguccgcaagggccucuccgacuucuccuccguccucgccauccuccucggcugcggccucgacgccuuccucggccucgccacccccaagcucauggucccccgcgaguucaagcccacccuccccggccgcggcuggcucgucucccccuucggcgccaaccccugguggugguccgucgccgccgcccuccccgcccuccuccucuccauccucaucuucauggaccagcagaucaccgccgucauccucaaccgcauggaguaccgccuccagaagggcgccggcuuccaccucgaccucuucugcgucgccguccucaugcuccucaccuccgcccucggccuccccugguacgucuccgccaccgucaucucccucgcccacauggacucccuccgccgcgagucccgcgccugcgcccccggcgagcgccccaacuuccucggcauccgcgagcagcgccucaccggccucgucgucuucauccucaccggcgccuccaucuuccucgcccccguccucaaguucauccccaugcccguccucuacggcaucuuccucuacaugggcgucgccgcccucuccuccauccaguucaccaaccgcgucaagcuccuccucaugcccgccaagcaccagcccgaccuccuccuccuccgccacgucccccucacccgcguccaccucuucaccgccauccagcucgccugccucggccuccucuggaucaucaaguccacccccgccgccaucaucuucccccucaugcuccucggccucgucggcguccgcaaggcccucgagcgcgucuucuccccccaggagcuccucuggcucgacgagcucaugcccgaggaggagcgcuccauccccgagaagggccucgagcccgagcacuccuucuccggcuccgacuccgaggacuccgagcucauguaccagcccaaggcccccgagaucaacaucuccgucaacuga

SEQ ID NO: 49731 - RNA, 501 nt, Artificial Sequence
  derived and/or modified sequence opt2 from SLC50A1__Homo_sapiens__NP_001116309
augcgcggccuccaccccuggcacguccuccgccgcccccucggcccccaggcccacgccaacgaccccgagugcggccagcgccccguccccgcccucucccaccacggcucccagcgcgucguccuccuccagaccgccacccuccucggcguccuccuccucggcuacggcuacuucuggcuccucguccccaaccccgaggcccgccuccagcagcucggccucuucugcuccgucuucaccaucuccauguaccucuccccccucgccgaccucgccaaggucauccagaccaaguccacccagugccucuccuacccccucaccaucgccacccuccucaccuccgccuccuggugccucuacggcuuccgccuccgcgaccccuacaucauggucuccaacuuccccggcaucgucaccuccuucauccgcuucuggcucuucuggaaguacccccaggagcaggaccgcaacuacuggcuccuccagaccuga

SEQ ID NO: 49732 - RNA, 1023 nt, Artificial Sequence
  derived and/or modified sequence opt2 from SLC51A__Homo_sapiens__NP_689885
auggagcccggccgcacccagaucaagcucgacccccgcuacaccgccgaccuccucgagguccucaagaccaacuacggcauccccuccgccugcuucucccagccccccaccgccgcccagcuccuccgcgcccucggccccgucgagcucgcccucaccuccauccucacccuccucgcccucggcuccaucgccaucuuccucgaggacgccgucuaccucuacaagaacacccucugccccaucaagcgccgcacccuccucuggaaguccuccgcccccaccgucgucuccguccucugcugcuucggccucuggaucccccgcucccucguccucgucgagaugaccaucaccuccuucuacgccgucugcuucuaccuccucaugcucgucauggucgagggcuucggcggcaaggaggccguccuccgcacccuccgcgacacccccaugaugguccacaccggccccugcugcugcugcugccccugcugcccccgccuccuccucacccgcaagaagcuccagcuccucaugcucggccccuuccaguacgccuuccucaagaucacccucacccucgucggccucuuccucguccccgacggcaucuacgaccccgccgacaucuccgagggcuccaccgcccucuggaucaacaccuuccucggcgucuccacccuccucgcccucuggacccucggcaucaucucccgccaggcccgccuccaccucggcgagcagaacaugggcgccaaguucgcccucuuccagguccuccucauccucaccgcccuccagcccuccaucuucuccguccucgccaacggcggccagaucgccugcuccccccccuacuccuccaagacccgcucccaggucaugaacugccaccuccucauccucgagaccuuccucaugaccguccucacccgcauguacuaccgccgcaaggaccacaaggucggcuacgagaccuucuccucccccgaccucgaccucaaccucaaggccuga

SEQ ID NO: 49733 - RNA, 387 nt, Artificial Sequence
  derived and/or modified sequence opt2 from SLC51B__Homo_sapiens__NP_849190
auggagcacuccgagggcgcccccggcgaccccgccggcaccgucgucccccaggagcuccucgaggagaugcucugguucuuccgcgucgaggacgccucccccuggaaccacuccauccucgcccucgccgccgucgucgucaucaucuccaugguccuccucggccgcuccauccaggccucccgcaaggagaagaugcagccccccgagaaggagacccccgagguccuccaccucgacgaggccaaggaccacaacucccucaacaaccuccgcgagacccuccucuccgagaagcccaaccucgcccaggucgagcucgagcucaaggagcgcgacguccucuccgucuuccuccccgacguccccgagaccgaguccuga

SEQ ID NO: 49734 - RNA, 1347 nt, Artificial Sequence
  derived and/or modified sequence opt2 from SLC52A1__Homo_sapiens__NP_060456
auggccgcccccacccucggccgccucguccucacccaccuccucgucgcccucuucggcaugggcuccugggccgccgucaacggcaucugggucgagcuccccgucgucgucaaggaccuccccgagggcuggucccuccccuccuaccucuccgucgucgucgcccucggcaaccucggccuccucgucgucacccucuggcgccagcucgcccccggcaagggcgagcagguccccauccaggucguccagguccucuccgucgucggcaccgcccuccucgccccccucuggcaccacgucgcccccgucgccggccagcuccacuccgucgccuuccucacccucgcccucguccucgccauggccugcugcaccuccaacgucaccuuccuccccuuccucucccaccuccccccccccuuccuccgcuccuucuuccucggccagggccucuccgcccuccuccccugcguccucgcccucguccagggcgucggccgccucgagugcccccccgcccccaccaacggcaccuccggccccccccucgacuuccccgagcgcuuccccgccuccaccuucuucugggcccucaccgcccuccucgucaccuccgccgccgccuuccgcggccuccuccuccuccuccccucccuccccuccgucaccaccggcggcuccggccccgagcuccagcucggcucccccggcgccgaggaggaggagaaggaggaggaggaggcccucccccuccaggagccccccucccaggccgccggcaccauccccggccccgaccccgaggcccaccagcucuucuccgcccacggcgccuuccuccucggccucauggccuucaccuccgccgucaccaacggcguccuccccuccguccaguccuucuccugccuccccuacggccgccucgccuaccaccucgccgucguccucggcuccgccgccaacccccucgccugcuuccucgccaugggcguccucugccgcucccucgccggccucgucggccucucccuccucggcaugcucuucggcgccuaccucauggcccucgccauccucucccccugccccccccucgucggcaccaccgccggcgucguccucgucguccucuccuggguccucugccucugcgucuucuccuacgucaaggucgccgccuccucccuccuccacggcggcggccgccccgcccuccucgccgccggcgucgccauccaggucggcucccuccucggcgccggcgccauguucccccccaccuccaucuaccacgucuuccagucccgcaaggacugcgucgaccccugcggccccuga

SEQ ID NO: 49735 - RNA, 1338 nt, Artificial Sequence
  derived and/or modified sequence opt2 from SLC52A2__Homo_sapiens__NP_001240745
auggccgcccccacccccgcccgccccguccucacccaccuccucgucgcccucuucggcaugggcuccugggccgccgucaacggcaucugggucgagcuccccgucgucgucaaggagcuccccgagggcuggucccuccccuccuacgucuccguccucgucgcccucggcaaccucggccuccucgucgucacccucuggcgccgccucgcccccggcaaggacgagcagguccccauccgcgucguccagguccucggcauggucggcaccgcccuccucgccucccucuggcaccacgucgcccccgucgccggccagcuccacuccgucgccuuccucgcccucgccuucguccucgcccucgccugcugcgccuccaacgucaccuuccuccccuuccucucccaccuccccccccgcuuccuccgcuccuucuuccucggccagggccucuccgcccuccuccccugcguccucgcccucguccagggcgucggccgccucgagugcccccccgcccccaucaacggcacccccggccccccccucgacuuccucgagcgcuuccccgccuccaccuucuucugggcccucaccgcccuccucgucgccuccgccgccgccuuccagggccuccuccuccuccucccccccccccccuccguccccaccggcgagcucggcuccggccuccaggucggcgcccccggcgccgaggaggaggucgaggaguccuccccccuccaggagccccccucccaggccgccggcaccacccccggccccgaccccaaggccuaccagcuccucuccgcccgcuccgccugccuccucggccuccucgccgccaccaacgcccucaccaacggcguccuccccgccguccaguccuucuccugccuccccuacggccgccucgccuaccaccucgccgucguccucggcuccgccgccaacccccucgccugcuuccucgccaugggcguccucugccgcucccucgccggccucggcggccucucccuccucggcgucuucugcggcggcuaccucauggcccucgccguccucucccccugccccccccucgucggcaccuccgccggcgucguccucgucguccucuccuggguccucugccucggcgucuucuccuacgucaaggucgccgccuccucccuccuccacggcggcggccgccccgcccuccucgccgccggcgucgccauccaggucggcucccuccucggcgccgucgccauguucccccccaccuccaucuaccacgucuuccacucccgcaaggacugcgccgaccccugcgacuccuga

SEQ ID NO: 49736 - RNA, 1410 nt, Artificial Sequence
  derived and/or modified sequence opt2 from SLC52A3__Homo_sapiens__XP_011527450
auggccuuccucaugcaccuccucgucugcgucuucggcaugggcuccugggucaccaucaacggccucugggucgagcucccccuccucgucauggagcuccccgagggcugguaccuccccuccuaccucaccgucgucauccagcucgccaacaucggcccccuccucgucacccuccuccaccacuuccgccccuccugccucuccgagguccccaucaucuucacccuccucggcgucggcaccgucaccugcaucaucuucgccuuccucuggaacaugaccuccuggguccucgacggccaccacuccaucgccuuccucguccucaccuucuuccucgcccucgucgacugcaccuccuccgucaccuuccuccccuucaugucccgccuccccaccuacuaccucaccaccuucuucgucggcgagggccucuccggccuccuccccgcccucgucgcccucgcccagggcuccggccucaccaccugcgucaacgucaccgagaucuccgacuccguccccucccccguccccacccgcgagaccgacaucgcccagggcgucccccgcgcccucgucuccgcccuccccggcauggaggccccccucucccaccucgagucccgcuaccuccccgcccacuucuccccccucgucuucuuccuccuccucuccaucaugauggccugcugccucgucgccuucuucguccuccagcgccagccccgcugcugggaggccuccgucgaggaccuccucaacgaccaggucacccuccacuccauccgcccccgcgaggagaacgaccucggccccgccggcaccgucgacuccucccagggccagggcuaccucgaggagaaggccgcccccugcugccccgcccaccucgccuucaucuacacccucgucgccuucgucaacgcccucaccaacggcaugcuccccuccguccagaccuacuccugccucuccuacggccccgucgccuaccaccucgccgccacccucuccaucgucgccaacccccucgccucccucgucuccauguuccuccccaaccgcucccuccucuuccucggcguccucuccguccucggcaccugcuucggcggcuacaacauggccauggccgucaugucccccugcccccuccuccagggccacuggggcggcgagguccucaucgucgccuccuggguccucuucuccggcugccucuccuacgucaaggucaugcucggcgucguccuccgcgaccucucccgcuccgcccuccucuggugcggcgccgccguccagcucggcucccuccucggcgcccuccucauguucccccucgucaacguccuccgccucuucuccuccgccgacuucugcaaccuccacugccccgccuga

SEQ ID NO: 49737 - RNA, 1923 nt, Artificial Sequence
  derived and/or modified sequence opt2 from SLC5A11__Homo_sapiens__NP_001245340
auggaguccggcaccuccuccccccagcccccccagcucgacccccucgacgccuucccccagaagggccucgagcccggcgacaucgccguccucguccucuacuuccucuucguccucgccgucggccucugguccaccgucaagaccaagcgcgacaccgucaagggcuacuuccucgccggcggcgacauggucugguggcccgucggcgccucccucuucgccuccaacgucggcuccggccacuucaucggccucgccggcuccggcgccgccaccggcaucuccgucuccgccuacgagcucaacggccucuucuccguccucaugcucgccuggaucuuccuccccaucuacaucgccggccaggucgacauguacgccggcgccaucuucauccagcagucccuccaccucgaccucuaccucgccaucgucggccuccucgccaucaccgccgucuacaccgucgccggcggccucgccgccgucaucuacaccgacgcccuccagacccucaucaugcucaucggcgcccucacccucaugggcuacuccuucgccgccgucggcggcauggagggccucaaggagaaguacuuccucgcccucgccuccaaccgcuccgagaacuccuccugcggccucccccgcgaggacgccuuccacaucuuccgcgacccccucaccuccgaccuccccuggcccggcguccucuucggcauguccauccccucccucugguacuggugcaccgaccaggucaucguccagcgcacccucgccgccaagaaccucucccacgccaagggcggcgcccucauggccgccuaccucaagguccucccccucuucaucauggucuuccccggcauggucucccgcauccucuuccccgaccaggucgccugcgccgaccccgagaucugccagaagaucugcuccaaccccuccggcugcuccgacaucgccuaccccaagcucguccucgagcuccuccccaccggccuccgcggccucaugauggccgucauggucgccgcccucauguccucccucaccuccaucuucaacuccgccuccaccaucuucaccauggaccucuggaaccaccuccgcccccgcgccuccgagaaggagcucaugaucgucggccgcgucuucguccuccuccucguccucgucuccauccucuggauccccgucguccaggccucccagggcggccagcucuucaucuacauccaguccaucuccuccuaccuccagccccccgucgccgucgucuucaucaugggcugcuucuggaagcgcaccaacgagaagggcgccuucuggggccucaucuccggccuccuccucggccucguccgccucguccucgacuucaucuacguccagccccgcugcgaccagcccgacgagcgccccguccucgucaaguccauccacuaccucuacuucuccaugauccucuccaccgucacccucaucaccgucuccaccgucuccugguucaccgagccccccuccaaggagauggucucccaccucaccugguucacccgccacgaccccgucguccagaaggagcaggccccccccgccgccccccucucccucacccucucccagaacggcaugcccgaggccuccuccuccuccuccguccaguucgagaugguccaggagaacaccuccaagacccacuccugcgacaugacccccaagcaguccaaggucgucaaggccauccucuggcucugcggcauccaggagaagggcaaggaggagcuccccgcccgcgccgaggccaucaucgucucccucgaggagaacccccucgucaagacccuccucgacgucaaccucaucuucugcgucuccugcgccaucuucaucuggggcuacuucgccuga

SEQ ID NO: 49738 - RNA, 1857 nt, Artificial Sequence
  derived and/or modified sequence opt2 from SLC5A12__Homo_sapiens__NP_848593
auggaggucaagaacuucgccgucugggacuacgucgucuucgccgcccucuucuucaucuccuccggcaucggcgucuucuucgccaucaaggagcgcaagaaggccaccucccgcgaguuccucgucggcggccgccagauguccuucggccccgucggccucucccucaccgccuccuucauguccgccgucaccguccucggcacccccuccgaggucuaccgcuucggcgccuccuuccucgucuucuucaucgccuaccucuucgucauccuccucaccuccgagcucuuccuccccgucuucuaccgcuccggcaucaccuccaccuacgaguaccuccagcuccgcuucaacaagcccguccgcuacgccgccaccgucaucuacaucguccagaccauccucuacaccggcgucgucgucuacgcccccgcccucgcccucaaccaggucaccggcuucgaccucuggggcuccgucuucgccaccggcaucgucugcaccuucuacugcacccucggcggccucaaggccgucgucuggaccgacgccuuccagauggucgucaugaucgucggcuuccucaccguccucauccagggcuccacccacgccggcggcuuccacaacguccucgagcaguccaccaacggcucccgccuccacaucuucgacuucgacgucgacccccuccgccgccacaccuucuggaccaucaccgucggcggcaccuucaccuggcucggcaucuacggcgucaaccaguccaccauccagcgcugcaucuccugcaagaccgagaagcacgccaagcucgcccucuacuucaaccuccucggccucuggaucauccucgucugcgccgucuucuccggccucaucauguacucccacuucaaggacugcgaccccuggaccuccggcaucaucuccgcccccgaccagcucaugcccuacuucgucauggagaucuucgccaccaugcccggccuccccggccucuucgucgccugcgccuucuccggcacccucuccaccgucgccuccuccaucaacgcccucgccaccgucaccuucgaggacuucgucaaguccugcuucccccaccucuccgacaagcucuccaccuggaucuccaagggccucugccuccucuucggcgucaugugcaccuccauggccgucgccgccuccgucaugggcggcgucguccaggccucccucuccauccacggcaugugcggcggccccaugcucggccucuucucccucggcaucgucuuccccuucgucaacuggaagggcgcccucggcggccuccucaccggcaucacccucuccuucugggucgccaucggcgccuucaucuaccccgcccccgccuccaagaccuggccccucccccucuccaccgaccagugcaucaaguccaacgucaccgccaccggcccccccguccucuccucccgccccggcaucgccgacaccugguacuccaucuccuaccucuacuacuccgccgucggcugccucggcugcaucgucgccggcgucaucaucucccucaucaccggccgccagcgcggcgaggacauccagccccuccucauccgccccgucugcaaccucuucugcuucugguccaagaaguacaagacccucugcuggugcggcguccagcacgacuccggcaccgagcaggagaaccucgagaacggcuccgcccgcaagcagggcgccgaguccguccuccagaacggccuccgccgcgagucccucguccacguccccggcuacgaccccaaggacaaguccuacaacaacauggccuucgagaccacccacuucuga

SEQ ID NO: 49739 - RNA, 1995 nt, Artificial Sequence
  derived and/or modified sequence opt2 from SLC5A1__Homo_sapiens__NP_000334
auggacuccuccaccuggucccccaagaccaccgccgucacccgccccgucgagacccacgagcucauccgcaacgccgccgacaucuccaucaucgucaucuacuucgucgucgucauggccgucggccucugggccauguucuccaccaaccgcggcaccgucggcggcuucuuccucgccggccgcuccauggucugguggcccaucggcgccucccucuucgccuccaacaucggcuccggccacuucgucggccucgccggcaccggcgccgccuccggcaucgccaucggcggcuucgaguggaacgcccucguccucgucgucguccucggcuggcucuucguccccaucuacaucaaggccggcgucgucaccaugcccgaguaccuccgcaagcgcuucggcggccagcgcauccaggucuaccucucccuccucucccuccuccucuacaucuucaccaagaucuccgccgacaucuucuccggcgccaucuucaucaaccucgcccucggccucaaccucuaccucgccaucuuccuccuccucgccaucaccgcccucuacaccaucaccggcggccucgccgccgucaucuacaccgacacccuccagaccgucaucaugcucgucggcucccucauccucaccggcuucgccuuccacgaggucggcggcuacgacgccuucauggagaaguacaugaaggccauccccaccaucgucuccgacggcaacaccaccuuccaggagaagugcuacaccccccgcgccgacuccuuccacaucuuccgcgacccccucaccggcgaccuccccuggcccggcuucaucuucggcauguccauccucacccucugguacuggugcaccgaccaggucaucguccagcgcugccucuccgccaagaacaugucccacgucaagggcggcugcauccucugcggcuaccucaagcucaugcccauguucaucauggucaugcccggcaugaucucccgcauccucuacaccgagaagaucgccugcgucguccccuccgagugcgagaaguacugcggcaccaaggucggcugcaccaacaucgccuaccccacccucgucgucgagcucaugcccaacggccuccgcggccucaugcucuccgucaugcucgccucccucauguccucccucaccuccaucuucaacuccgccuccacccucuucaccauggacaucuacgccaagguccgcaagcgcgccuccgagaaggagcucaugaucgccggccgccucuucauccucguccucaucggcaucuccaucgccuggguccccaucguccaguccgcccaguccggccagcucuucgacuacauccaguccaucaccuccuaccucggcccccccaucgccgccgucuuccuccucgccaucuucuggaagcgcgucaacgagcccggcgccuucuggggccucauccucggccuccucaucggcaucucccgcaugaucaccgaguucgccuacggcaccggcuccugcauggagcccuccaacugccccaccaucaucugcggcguccacuaccucuacuucgccaucauccucuucgccaucuccuucaucaccaucgucgucaucucccuccucaccaagcccauccccgacguccaccucuaccgccucugcuggucccuccgcaacuccaaggaggagcgcaucgaccucgacgccgaggaggagaacauccaggagggccccaaggagaccaucgagaucgagacccagguccccgagaagaagaagggcaucuuccgccgcgccuacgaccucuucugcggccucgagcagcacggcgcccccaagaugaccgaggaggaggagaaggccaugaagaugaagaugaccgacaccuccgagaagccccucuggcgcaccguccucaacgucaacggcaucauccucgucaccgucgccgucuucugccacgccuacuucgccuga

SEQ ID NO: 49740 - RNA, 2019 nt, Artificial Sequence
  derived and/or modified sequence opt2 from SLC5A2__Homo_sapiens__NP_003032
auggaggagcacaccgaggccggcuccgcccccgagaugggcgcccagaaggcccucaucgacaaccccgccgacauccucgucaucgccgccuacuuccuccucgucaucggcgucggccucugguccaugugccgcaccaaccgcggcaccgucggcggcuacuuccucgccggccgcuccauggucugguggcccgucggcgccucccucuucgccuccaacaucggcuccggccacuucgucggccucgccggcaccggcgccgccuccggccucgccgucgccggcuucgaguggaacgcccucuucgucguccuccuccucggcuggcucuucgcccccgucuaccucaccgccggcgucaucaccaugccccaguaccuccgcaagcgcuucggcggccgccgcauccgccucuaccucuccguccucucccucuuccucuacaucuucaccaagaucuccgucgacauguucuccggcgccgucuucauccagcaggcccucggcuggaacaucuacgccuccgucaucgcccuccucggcaucaccaugaucuacaccgucaccggcggccucgccgcccucauguacaccgacaccguccagaccuucgucauccucggcggcgccugcauccucaugggcuacgccuuccacgaggucggcggcuacuccggccucuucgacaaguaccucggcgccgccaccucccucaccgucuccgaggaccccgccgucggcaacaucuccuccuucugcuaccgcccccgccccgacuccuaccaccuccuccgccaccccgucaccggcgaccuccccuggcccgcccuccuccucggccucaccaucgucuccggcugguacuggugcuccgaccaggucaucguccagcgcugccucgccggcaagucccucacccacaucaaggccggcugcauccucugcggcuaccucaagcucacccccauguuccucauggucaugcccggcaugaucucccgcauccucuaccccgacgaggucgccugcgucguccccgaggucugccgccgcgucugcggcaccgaggucggcugcuccaacaucgccuacccccgccucgucgucaagcucaugcccaacggccuccgcggccucaugcucgccgucaugcucgccgcccucauguccucccucgccuccaucuucaacuccuccuccacccucuucaccauggacaucuacacccgccuccgcccccgcgccggcgaccgcgagcuccuccucgucggccgccucugggucgucuucaucgucgucgucuccgucgccuggcuccccgucguccaggccgcccagggcggccagcucuucgacuacauccaggccgucuccuccuaccucgccccccccgucuccgccgucuucguccucgcccucuucgucccccgcgucaacgagcagggcgccuucuggggccucaucggcggccuccucaugggccucgcccgccucauccccgaguucuccuucggcuccggcuccugcguccagcccuccgccugccccgccuuccucugcggcguccacuaccucuacuucgccaucguccucuucuucugcuccggccuccucacccucaccgucucccucugcaccgcccccaucccccgcaagcaccuccaccgccucgucuucucccuccgccacuccaaggaggagcgcgaggaccucgacgccgacgagcagcagggcuccucccuccccguccagaacggcugccccgaguccgccauggagaugaacgagccccaggcccccgcccccucccucuuccgccagugccuccucugguucugcggcaugucccgcggcggcgucggcuccccccccccccucacccaggaggaggccgccgccgccgcccgccgccucgaggacaucuccgaggaccccuccugggcccgcgucgucaaccucaacgcccuccucaugauggccgucgccgucuuccucuggggcuucuacgccuga

SEQ ID NO: 49741 - RNA, 2157 nt, Artificial Sequence
  derived and/or modified sequence opt2 from SLC5A3__Homo_sapiens__NP_008864
augcgcgccguccucgacaccgccgacaucgccaucgucgcccucuacuucauccucgucaugugcaucggcuucuucgccauguggaaguccaaccgcuccaccgucuccggcuacuuccucgccggccgcuccaugaccugggucgccaucggcgccucccucuucgucuccaacaucggcuccgagcacuucaucggccucgccggcuccggcgccgccuccggcuucgccgucggcgccugggaguucaacgcccuccuccuccuccagcuccucggcugggucuucauccccaucuacauccgcuccggcgucuacaccaugcccgaguaccucuccaagcgcuucggcggccaccgcauccaggucuacuucgccgcccucucccucauccucuacaucuucaccaagcucuccgucgaccucuacuccggcgcccucuucauccaggagucccucggcuggaaccucuacgucuccgucauccuccucaucggcaugaccgcccuccucaccgucaccggcggccucgucgccgucaucuacaccgacacccuccaggcccuccucaugaucaucggcgcccucacccucaugaucaucuccaucauggagaucggcggcuucgaggaggucaagcgccgcuacaugcucgccucccccgacgucaccuccauccuccucaccuacaaccucuccaacaccaacuccugcaacgucucccccaagaaggaggcccucaagaugcuccgcaaccccaccgacgaggacguccccuggcccggcuucauccucggccagacccccgccuccgucugguacuggugcgccgaccaggucaucguccagcgcguccucgccgccaagaacaucgcccacgccaagggcuccacccucauggccggcuuccucaagcuccuccccauguucaucaucgucguccccggcaugaucucccgcauccucuucaccgacgacaucgccugcaucaaccccgagcacugcaugcucgucugcggcucccgcgccggcugcuccaacaucgccuacccccgccucgucaugaagcucguccccgucggccuccgcggccucaugauggccgucaugaucgccgcccucauguccgaccucgacuccaucuucaacuccgccuccaccaucuucacccucgacgucuacaagcucauccgcaaguccgccuccucccgcgagcucaugaucgucggccgcaucuucgucgccuucauggucgucaucuccaucgccuggguccccaucaucgucgagaugcagggcggccagauguaccucuacauccaggaggucgccgacuaccucaccccccccgucgccgcccucuuccuccucgccaucuucuggaagcgcugcaacgagcagggcgccuucuacggcggcauggccggcuucguccucggcgccguccgccucauccucgccuucgccuaccgcgcccccgagugcgaccagcccgacaaccgccccggcuucaucaaggacauccacuacauguacgucgccaccggccucuucugggucaccggccucaucaccgucaucgucucccuccucacccccccccccaccaaggagcagauccgcaccaccaccuucugguccaagaagaaccucgucgucaaggagaacugcucccccaaggaggagcccuacaagaugcaggagaaguccauccuccgcugcuccgagaacaacgagaccaucaaccacaucauccccaacggcaaguccgaggacuccaucaagggccuccagcccgaggacgucaaccuccucgucaccugccgcgaggagggcaaccccgucgccucccucggccacuccgaggccgagacccccgucgacgccuacuccaacggccaggccgcccucaugggcgagaaggagcgcaagaaggagaccgacgacggcggccgcuacuggaaguucaucgacugguucugcggcuucaaguccaagucccucuccaagcgcucccuccgcgaccucauggaggaggaggccgucugccuccagaugcucgaggagacccgccaggucaaggucauccucaacaucggccucuucgccgucugcucccucggcaucuucauguucgucuacuucucccucuga

SEQ ID NO: 49742 - RNA, 1980 nt, Artificial Sequence
  derived and/or modified sequence opt2 from SLC5A4__Homo_sapiens__NP_055042
auggccuccaccgucucccccuccaccaucgccgagacccccgagccccccccccucuccgaccacauccgcaacgccgccgacaucuccgucaucgucaucuacuuccucgucgucauggccgucggccucugggccaugcucaagaccaaccgcggcaccaucggcggcuucuuccucgccggccgcgacauggccugguggcccaugggcgccucccucuucgccuccaacaucggcuccaaccacuacgucggccucgccggcaccggcgccgccuccggcgucgccaccgucaccuucgaguggaccuccuccgucaugcuccucauccucggcuggaucuucguccccaucuacaucaaguccggcgucaugaccaugcccgaguaccucaagaagcgcuucggcggcgagcgccuccaggucuaccucuccauccucucccucuucaucugcgucguccuccucaucuccgccgacaucuucgccggcgccaucuucaucaagcucgcccucggccucgaccucuaccucgccaucuucauccuccucgccaugaccgccgucuacaccaccaccggcggccucgccuccgucaucuacaccgacacccuccagaccaucaucaugcucaucggcuccuucauccucaugggcuucgccuucaacgaggucggcggcuacgaguccuucaccgagaaguacgucaacgccacccccuccgucgucgagggcgacaaccucaccaucuccgccuccugcuacaccccccgcgccgacuccuuccacaucuuccgcgacgccgucaccggcgacauccccuggcccggcaucaucuucggcaugcccaucaccgcccucugguacuggugcaccaaccaggucaucguccagcgcugccucugcggcaaggacaugucccacgucaaggccgccugcaucaugugcgccuaccucaagcuccuccccauguuccucauggucaugcccggcaugaucucccgcauccucuacaccgacauggucgccugcgucguccccuccgagugcgucaagcacugcggcgucgacgucggcugcaccaacuacgccuaccccaccaugguccucgagcucaugccccagggccuccgcggccucaugcucuccgucaugcucgccucccucauguccucccucaccuccaucuucaacuccgccuccacccucuucaccaucgaccucuacaccaagaugcgcaagcaggccuccgagaaggagcuccucaucgccggccgcaucuucguccuccuccucaccgucgucuccaucgucugggucccccucguccaggucucccagaacggccagcucauccacuacaccgaguccaucuccuccuaccucggcccccccaucgccgccgucuucguccucgccaucuucugcaagcgcgucaacgagcagggcgccuucuggggccucauggucggccucgccaugggccucauccgcaugaucaccgaguucgccuacggcaccggcuccugccucgcccccuccaacugccccaagaucaucugcggcguccacuaccucuacuucuccaucguccucuucuucggcuccaugcucgucacccucggcaucucccuccucaccaagcccauccccgacguccaccucuaccgccucugcuggguccuccgcaacuccaccgaggagcgcaucgacaucgacgccgaggagaagucccaggaggagaccgacgacggcgucgaggaggacuaccccgagaagucccgcggcugccucaagaaggccuacgaccucuucugcggccuccagaagggccccaagcucaccaaggaggaggaggaggcccucuccaagaagcucaccgacaccuccgagcgccccuccuggcgcaccaucgucaacaucaacgccauccuccuccucgccgucgucgucuucauccacggcuacuacgccuga

SEQ ID NO: 49743 - RNA, 1932 nt, Artificial Sequence
  derived and/or modified sequence opt2 from SLC5A5__Homo_sapiens__NP_000444
auggaggccgucgagaccggcgagcgccccaccuucggcgccugggacuacggcgucuucgcccucaugcuccucgucuccaccggcaucggccucugggucggccucgcccgcggcggccagcgcuccgccgaggacuucuucaccggcggccgccgccucgccgcccuccccgucggccucucccucuccgccuccuucauguccgccguccagguccucggcguccccuccgaggccuaccgcuacggccucaaguuccucuggaugugccucggccagcuccucaacuccguccucaccgcccuccucuucaugcccgucuucuaccgccucggccucaccuccaccuacgaguaccucgagaugcgcuucucccgcgccguccgccucugcggcacccuccaguacaucgucgccaccaugcucuacaccggcaucgucaucuacgcccccgcccucauccucaaccaggucaccggccucgacaucugggccucccuccucuccaccggcaucaucugcaccuucuacaccgccgucggcggcaugaaggccgucgucuggaccgacgucuuccaggucgucgucaugcucuccggcuucugggucguccucgcccgcggcgucaugcucgucggcggcccccgccagguccucacccucgcccagaaccacucccgcaucaaccucauggacuucaaccccgacccccgcucccgcuacaccuucuggaccuucgucgucggcggcacccucgucuggcucuccauguacggcgucaaccaggcccagguccagcgcuacgucgccugccgcaccgagaagcaggccaagcucgcccuccucaucaaccaggucggccucuuccucaucgucuccuccgccgccugcugcggcaucgucauguucgucuucuacaccgacugcgacccccuccuccucggccgcaucuccgcccccgaccaguacaugccccuccucguccucgacaucuucgaggaccuccccggcguccccggccucuuccucgccugcgccuacuccggcacccucuccaccgccuccaccuccaucaacgccauggccgccgucaccgucgaggaccucaucaagccccgccuccgcucccucgccccccgcaagcucgucaucaucuccaagggccucucccucaucuacggcuccgccugccucaccgucgccgcccucuccucccuccucggcggcggcguccuccagggcuccuucaccgucaugggcgucaucuccggcccccuccucggcgccuucauccucggcauguuccuccccgccugcaacacccccggcguccucgccggccucggcgccggccucgcccucucccucugggucgcccucggcgccacccucuacccccccuccgagcagaccaugcgcguccuccccuccuccgccgcccgcugcgucgcccucuccgucaacgccuccggccuccucgaccccgcccuccuccccgccaacgacuccucccgcgcccccuccuccggcauggacgccucccgccccgcccucgccgacuccuucuacgccaucuccuaccucuacuacggcgcccucggcacccucaccaccguccucugcggcgcccucaucuccugccucaccggccccaccaagcgcuccacccucgcccccggccuccucuggugggaccucgcccgccagaccgccuccgucgcccccaaggaggaggucgccauccucgacgacaaccucgucaagggccccgaggagcuccccaccggcaacaagaagccccccggcuuccuccccaccaacgaggaccgccucuucuuccucggccagaaggagcucgagggcgccggcuccuggacccccugcgucggccacgacggcggccgcgaccagcaggagaccaaccucuga

SEQ ID NO: 49744 - RNA, 1908 nt, Artificial Sequence
  derived and/or modified sequence opt2 from SLC5A6__Homo_sapiens__XP_006712193
auguccgucggcgucuccaccuccgccccccucucccccaccuccggcaccuccgucggcauguccaccuucuccaucauggacuacgucgucuucguccuccuccucguccucucccucgccaucggccucuaccacgccugccgcggcuggggccgccacaccgucggcgagcuccucauggccgaccgcaagaugggcugccuccccgucgcccucucccuccucgccaccuuccaguccgccgucgccauccucggcguccccuccgagaucuaccgcuucggcacccaguacugguuccucggcugcugcuacuuccucggccuccucauccccgcccacaucuucauccccgucuucuaccgccuccaccucaccuccgccuacgaguaccucgagcuccgcuucaacaagaccguccgcgucugcggcaccgucaccuucaucuuccagauggucaucuacaugggcgucguccucuacgcccccucccucgcccucaacgccgucaccggcuucgaccucuggcucuccguccucgcccucggcaucgucugcaccgucuacaccgcccucggcggccucaaggccgucaucuggaccgacgucuuccagacccucgucauguuccucggccagcucgccgucaucaucgucggcuccgccaaggucggcggccucggccgcgucugggccgucgccucccagcacggccgcaucuccggcuucgagcucgaccccgaccccuucguccgccacaccuucuggacccucgccuucggcggcgucuucaugaugcucucccucuacggcgucaaccaggcccagguccagcgcuaccucuccucccgcaccgagaaggccgccguccucuccugcuacgccgucuuccccuuccagcaggucucccucugcgucggcugccucaucggccucgucauguucgccuacuaccaggaguaccccauguccauccagcaggcccaggccgcccccgaccaguucguccucuacuucgucauggaccuccucaagggccuccccggccuccccggccucuucaucgccugccucuucuccggcucccucuccaccaucuccuccgccuucaacucccucgccaccgucaccauggaggaccucauccgccccugguuccccgaguucuccgaggcccgcgccaucaugcucucccgcggccucgccuucggcuacggccuccucugccucggcauggccuacaucuccucccagaugggccccguccuccaggccgccaucuccaucuucggcauggucggcggcccccuccucggccucuucugccucggcauguucuuccccugcgccaacccccccggcgccgucgucggccuccucgccggccucgucauggccuucuggaucggcaucggcuccaucgucaccuccaugggcuccuccaugccccccucccccuccaacggcuccuccuucucccuccccaccaaccucaccgucgccaccgucaccacccucaugccccucaccaccuucuccaagcccaccggccuccagcgcuucuacucccucuccuaccucugguacuccgcccacaacuccaccaccgucaucgucgucggccucaucgucucccuccucaccggccgcaugcgcggccgcucccucaaccccgccaccaucuaccccguccuccccaagcuccucucccuccucccccucuccugccagaagcgccuccacugccgcuccuacggccaggaccaccucgacaccggccucuuccccgagaagccccgcaacggcguccucggcgacucccgcgacaaggaggccauggcccucgacggcaccgccuaccagggcuccuccuccaccugcauccuccaggagaccucccucuga

SEQ ID NO: 49745 - RNA, 1743 nt, Artificial Sequence
  derived and/or modified sequence opt2 from SLC5A7__Homo_sapiens__NP_001291934
auggccuuccacgucgagggccucaucgccaucaucgucuucuaccuccucauccuccucgucggcaucugggccgccuggcgcaccaagaacuccggcuccgccgaggagcgcuccgaggccaucaucgucggcggccgcgacaucggccuccucgucggcggcuucaccaugaccgccaccugggucggcggcggcuacaucaacggcaccgccgaggccgucuacguccccggcuacggccucgccugggcccaggcccccaucggcuacucccucucccucauccucggcggccucuucuucgccaagcccaugcgcuccaagggcuacgucaccaugcucgaccccuuccagcagaucuacggcaagcgcaugggcggccuccucuucauccccgcccucaugggcgagauguucugggccgccgccaucuucuccgcccucggcgccaccaucuccgucaucaucgacgucgacaugcacaucuccgucaucaucuccgcccucaucgccacccucuacacccucgucggcggccucuacuccgucgccuacaccgacgucguccagcucuucugcaucuucgucggccucuggaucuccguccccuucgcccucucccaccccgccgucgccgacaucggcuucaccgccguccacgccaaguaccagaagcccuggcucggcaccgucgacuccuccgaggucuacuccuggcucgacuccuuccuccuccucaugcucggcggcauccccuggcaggccuacuuccagcgcguccucuccuccuccuccgccaccuacgcccagguccucuccuuccucgccgccuucggcugccucgucauggccauccccgccauccucaucggcgccaucggcgccuccaccgacuggaaccagaccgccuacggccuccccgaccccaagaccaccgaggaggccgacaugauccuccccaucguccuccaguaccucugccccgucuacaucuccuucuucggccucggcgccgucuccgccgccgucauguccuccgccgacuccuccauccucuccgccuccuccauguucgcccgcaacaucuaccagcucuccuuccgccagaacgccuccgacaaggagaucgucugggucaugcgcaucaccgucuucgucuucggcgccuccgccaccgccauggcccuccucaccaagaccgucuacggccucugguaccucuccuccgaccucgucuacaucgucaucuucccccagcuccucugcguccucuucgucaagggcaccaacaccuacggcgccgucgccggcuacgucuccggccucuuccuccgcaucaccggcggcgagcccuaccucuaccuccagccccucaucuucuaccccggcuacuaccccgacgacaacggcaucuacaaccagaaguuccccuucaagacccucgccauggucaccuccuuccucaccaacaucugcaucuccuaccucgccaaguaccucuucgaguccggcacccucccccccaagcucgacgucuucgacgccgucgucgcccgccacuccgaggagaacauggacaagaccauccucgucaagaacgagaacaucaagcucgacgagcucgcccucgucaagccccgccaguccaugacccucuccuccaccuucaccaacaaggaggccuuccucgacgucgacuccucccccgagggcuccggcaccgaggacaaccuccaguga

SEQ ID NO: 49746 - RNA, 1833 nt, Artificial Sequence
  derived and/or modified sequence opt2 from SLC5A8__Homo_sapiens__NP_666018
auggacaccccccgcggcaucggcaccuucgucgucugggacuacgucgucuucgccggcaugcucgucaucuccgccgccaucggcaucuacuacgccuucgccggcggcggccagcagaccuccaaggacuuccucaugggcggccgccgcaugaccgccguccccgucgcccucucccucaccgccuccuucauguccgccgucaccguccucggcacccccuccgaggucuaccgcuucggcgccaucuucuccaucuucgccuucaccuacuucuucgucgucgucaucuccgccgaggucuuccuccccgucuucuacaagcucggcaucaccuccaccuacgaguaccucgagcuccgcuucaacaagugcguccgccucugcggcaccguccucuucaucguccagaccauccucuacaccggcaucgucaucuacgcccccgcccucgcccucaaccaggucaccggcuucgaccucuggggcgccgucgucgccaccggcgucgucugcaccuucuacugcacccucggcggccucaaggccgucaucuggaccgacgucuuccaggucggcaucauggucgccggcuucgccuccgucaucauccaggccgucgucaugcagggcggcaucuccaccauccucaacgacgccuacgacggcggccgccucaacuucuggaacuucaaccccaacccccuccagcgccacaccuucuggaccaucaucaucggcggcaccuucaccuggaccuccaucuacggcgucaaccagucccagguccagcgcuacaucuccugcaagucccgcuuccaggccaagcucucccucuacaucaaccucgucggccucugggccauccucaccugcuccgucuucugcggccucgcccucuacucccgcuaccacgacugcgaccccuggaccgccaagaaggucuccgcccccgaccagcucaugcccuaccucguccucgacauccuccaggacuaccccggccuccccggccucuucgucgccugcgccuacuccggcacccucuccaccgucuccuccuccaucaacgcccucgccgccgucaccgucgaggaccucaucaagcccuacuuccgcucccucuccgagcgcucccucuccuggaucucccagggcauguccgucgucuacggcgcccucugcaucggcauggccgcccucgccucccucaugggcgcccuccuccaggccgcccucuccgucuucggcauggucggcggcccccucaugggccucuucgcccucggcauccucguccccuucgccaacuccaucggcgcccucgucggccucauggccggcuucgccaucucccucugggucggcaucggcgcccagaucuaccccccccuccccgagcgcacccucccccuccaccucgacauccagggcugcaacuccaccuacaacgagaccaaccucaugaccaccaccgagaugcccuucaccaccuccgucuuccagaucuacaacguccagcgcaccccccucauggacaacugguacucccucuccuaccucuacuucuccaccgucggcacccucgucacccuccucgucggcauccucgucucccucuccaccggcggccgcaagcagaaccucgacccccgcuacauccucaccaaggaggacuuccucuccaacuucgacaucuucaagaagaagaagcacguccucuccuacaagucccaccccgucgaggacggcggcaccgacaaccccgccuucaaccacaucgagcucaacuccgaccaguccggcaaguccaacggcacccgccucuga

SEQ ID NO: 49747 - RNA, 1899 nt, Artificial Sequence
  derived and/or modified sequence opt2 from SLC6A11__Homo_sapiens__NP_055044
augaccgccgagaaggcccucccccucggcaacggcaaggccgccgaggaggcccgcgaguccgaggcccccggcggcggcugcuccuccggcggcgccgcccccgcccgccacccccgcgucaagcgcgacaaggccguccacgagcgcggccacuggaacaacaaggucgaguucguccucuccgucgccggcgagaucaucggccucggcaacgucuggcgcuuccccuaccucugcuacaagaacggcggcggcgccuuccucauccccuacgucgucuucuucaucugcugcggcauccccgucuucuuccucgagaccgcccucggccaguucaccuccgagggcggcaucaccugcuggcgcaaggucugcccccucuucgagggcaucggcuacgccacccaggucaucgaggcccaccucaacgucuacuacaucaucauccucgccugggccaucuucuaccucuccaacugcuucaccaccgagcuccccugggccaccugcggccacgaguggaacaccgagaacugcgucgaguuccagaagcucaacgucuccaacuacucccacgucucccuccagaacgccaccucccccgucauggaguucugggagcaccgcguccucgccaucuccgacggcaucgagcacaucggcaaccuccgcugggagcucgcccucugccuccucgccgccuggaccaucugcuacuucugcaucuggaagggcaccaaguccaccggcaaggucgucuacgucaccgccaccuuccccuacaucaugcuccucauccuccucauccgcggcgucacccuccccggcgccuccgagggcaucaaguucuaccucuaccccgaccucucccgccucuccgacccccaggucugggucgacgccggcacccagaucuucuucuccuacgccaucugccucggcugccucaccgcccucggcuccuacaacaacuacaacaacaacugcuaccgcgacugcaucaugcucugcugccucaacuccggcaccuccuucgucgccggcuucgccaucuucuccguccucggcuucauggccuacgagcagggcguccccaucgccgaggucgccgaguccggccccggccucgccuucaucgccuaccccaaggccgucaccaugaugccccucuccccccucugggccacccucuucuucaugaugcucaucuuccucggccucgacucccaguucgucugcgucgagucccucgucaccgccgucgucgacauguaccccaaggucuuccgccgcggcuaccgccgcgagcuccucauccucgcccucuccgucaucuccuacuuccucggccucgucaugcucaccgagggcggcauguacaucuuccagcucuucgacuccuacgccgccuccggcaugugccuccucuucgucgccaucuucgagugcaucugcaucggcugggucuacggcuccaaccgcuucuacgacaacaucgaggacaugaucggcuaccgcccccccucccucaucaaguggugcuggaugaucaugacccccggcaucugcgccggcaucuucaucuucuuccucaucaaguacaagccccucaaguacaacaacaucuacaccuaccccgccuggggcuacggcaucggcuggcucauggcccucuccuccaugcucugcaucccccucuggaucugcaucaccgucuggaagaccgagggcacccuccccgagaagcuccagaagcucaccacccccuccaccgaccucaagaugcgcggcaagcucggcgucuccccccgcauggucaccgucaacgacugcgacgccaagcucaaguccgacggcaccaucgccgccaucaccgagaaggagacccacuucuga

SEQ ID NO: 49748 - RNA, 1845 nt, Artificial Sequence
  derived and/or modified sequence opt2 from SLC6A12__Homo_sapiens__XP_005253803
auggacggcaaggucgccguccaggagugcggcccccccgccgucuccuggguccccgaggagggcgagaagcucgaccaggaggacgaggaccaggucaaggaccgcggccaguggaccaacaagauggaguucguccucuccgucgccggcgagaucaucggccucggcaacgucuggcgcuuccccuaccucugcuacaagaacggcggcggcgccuucuucauccccuacuucaucuucuucuucgucugcggcauccccgucuucuuccucgaggucgcccucggccaguacaccucccagggcuccgucaccgccuggcgcaagaucugcccccucuuccagggcaucggccucgccuccgucgucaucgaguccuaccucaacgucuacuacaucaucauccucgccugggcccucuucuaccucuucuccuccuucaccuccgagcuccccuggaccaccugcaacaacuucuggaacaccgagcacugcaccgacuuccucaaccacuccggcgccggcaccgucacccccuucgagaacuucaccucccccgucauggaguucugggagcgccgcguccucggcaucaccuccggcauccacgaccucggcucccuccgcugggagcucgcccucugccuccuccucgccugggucaucugcuacuucugcaucuggaagggcgucaaguccaccggcaaggucgucuacuucaccgccaccuuccccuaccucaugcucgucauccuccucauccgcggcgucacccuccccggcgccuaccagggcaucaucuacuaccucaagcccgaccucuuccgccucaaggacccccaggucuggauggacgccggcacccagaucuucuucuccuucgccaucugccagggcugccucaccgcccucggcuccuacaacaaguaccacaacaacugcuacaaggacugcaucgcccucugcuuccucaacuccgccaccuccuucgucgccggcuucgucgucuucuccauccucggcuucaugucccaggagcagggcguccccaucuccgaggucgccgaguccggccccggccucgccuucaucgccuuccccaaggccgucaccaugaugccccucucccagcucugguccugccucuucuucaucaugcucaucuuccucggccucgacucccaguucgucugcgucgagugccucgucaccgccuccaucgacauguucccccgccagcuccgcaaguccggccgccgcgagcuccucauccucaccaucgccgucaugugcuaccucaucggccucuuccucgucaccgagggcggcauguacaucuuccagcucuucgacuacuacgccuccuccggcaucugccuccucuuccucucccucuucgaggucgucugcaucuccugggucuacggcgccgaccgcuucuacgacaacaucgaggacaugaucggcuaccgccccuggccccucgucaagaucuccuggcucuuccucacccccggccucugccucgccaccuuccucuucucccucuccaaguacaccccccucaaguacaacaacgucuacgucuacccccccuggggcuacuccaucggcugguuccucgcccucuccuccauggucugcgucccccucuucgucgucaucacccuccucaagacccgcggccccuuccgcaagcgccuccgccagcucaucacccccgacuccucccucccccagcccaagcagcaccccugccucgacggcuccgccggccgcaacuucggccccucccccacccgcgagggccucaucgccggcgagaaggagacccaccucuga

SEQ ID NO: 49749 - RNA, 1533 nt, Artificial Sequence
  derived and/or modified sequence opt2 from SLC6A13__Homo_sapiens__NP_001177926
auggacucccgcgucuccggcaccaccuccaacggcgagaccaagcccgucuaccccgucauggagaagaaggaggaggacggcacccucgagcgcggccacuggaacaacaagauggaguucguccucuccgucgccggcgagaucaucggccucggcaacgucuggcgcuuccccuaccucugcuacaagaacggcggcgagcacugcauggaguuccagaagaccaacggcucccucaacggcaccuccgagaacgccaccucccccgucaucgaguucugggagcgccgcguccucaagaucuccgacggcauccagcaccucggcgcccuccgcugggagcucgcccucugccuccuccucgccugggucaucugcuacuucugcaucuggaagggcgucaaguccaccggcaaggucgucuacuucaccgccaccuuccccuaccucaugcucgucguccuccucauccgcggcgucacccuccccggcgccgcccagggcauccaguucuaccucuaccccaaccucacccgccucugggacccccaggucuggauggacgccggcacccagaucuucuucuccuucgccaucugccucggcugccucaccgcccucggcuccuacaacaaguaccacaacaacugcuaccgcgacugcaucgcccucugcuuccucaacuccggcaccuccuucgucgccggcuucgccaucuucuccauccucggcuucaugucccaggagcagggcguccccaucuccgaggucgccgaguccggccccggccucgccuucaucgccuacccccgcgccgucgucaugcuccccuucuccccccucugggccugcugcuucuucuucauggucguccuccucggccucgacucccaguucgucugcgucgagucccucgucaccgcccucgucgacauguacccccacgucuuccgcaagaagaaccgccgcgagguccucauccucggcgucuccgucgucuccuuccucgucggccucaucaugcucaccgagggcggcauguacgucuuccagcucuucgacuacuacgccgccuccggcaugugccuccucuucgucgccaucuucgagucccucugcgucgccugggucuacggcgccaagcgcuucuacgacaacaucgaggacaugaucggcuaccgccccuggccccucaucaaguacugcuggcucuuccucacccccgccgucugcaccgccaccuuccucuucucccucaucaaguacaccccccucaccuacaacaagaaguacaccuaccccugguggggcgacgcccucggcuggcuccucgcccucuccuccauggucugcauccccgccuggucccucuaccgccucggcacccucaagggccccuuccgcgagcgcauccgccagcucaugugccccgccgaggaccucccccagcgcaaccccgccggccccuccgcccccgccaccccccgcaccucccuccuccgccucaccgagcucgagucccacugcuga

SEQ ID NO: 49750 - RNA, 1929 nt, Artificial Sequence
  derived and/or modified sequence opt2 from SLC6A14__Homo_sapiens__NP_009162
auggacaagcucaagugccccuccuucuucaagugccgcgagaaggagaaggucuccgccuccuccgagaacuuccacgucggcgagaacgacgagaaccaggaccgcggcaacugguccaagaaguccgacuaccuccucuccaugaucggcuacgccgucggccucggcaacgucuggcgcuuccccuaccucaccuacuccaacggcggcggcgccuuccucauccccuacgccaucaugcucgcccucgccggccucccccucuucuuccucgagugcucccucggccaguucgccucccucggccccgucuccgucuggcgcauccucccccucuuccagggcgucggcaucaccaugguccucaucuccaucuucgucaccaucuacuacaacgucaucaucgccuacucccucuacuacauguucgccuccuuccaguccgagcuccccuggaagaacugcuccuccugguccgacaagaacugcucccgcucccccaucgucacccacugcaacgucuccaccgucaacaagggcauccaggagaucauccagaugaacaaguccugggucgacaucaacaacuucaccugcaucaacggcuccgagaucuaccagcccggccagcuccccuccgagcaguacuggaacaaggucgcccuccagcgcuccuccggcaugaacgagaccggcgucaucgucugguaccucgcccucugccuccuccucgccuggcucaucgucggcgccgcccucuucaagggcaucaaguccuccggcaaggucgucuacuucaccgcccucuuccccuacgucguccuccucauccuccucguccgcggcgccacccucgagggcgccuccaagggcaucuccuacuacaucggcgcccaguccaacuucaccaagcucaaggaggccgaggucuggaaggacgccgccacccagaucuucuacucccucuccgucgccuggggcggccucgucgcccucuccuccuacaacaaguucaagaacaacugcuucuccgacgccaucgucgucugccucaccaacugccucaccuccgucuucgccggcuucgccaucuucuccauccucggccacauggcccacaucuccggcaaggaggucucccaggucgucaaguccggcuucgaccucgccuucaucgccuaccccgaggcccucgcccagcuccccggcggccccuucugguccauccucuucuucuucaugcuccucacccucggccucgacucccaguucgccuccaucgagaccaucaccaccaccauccaggaccucuuccccaaggucaugaagaagaugcgcguccccaucacccucggcugcugccucguccucuuccuccucggccucgucugcgucacccaggccggcaucuacuggguccaccucaucgaccacuucugcgccggcuggggcauccucaucgccgccauccucgagcucgucggcaucaucuggaucuacggcggcaaccgcuucaucgaggacaccgagaugaugaucggcgccaagcgcuggaucuucuggcucugguggcgcgccugcugguucgucaucacccccauccuccucaucgccaucuucaucuggucccucguccaguuccaccgccccaacuacggcgccauccccuaccccgacuggggcgucgcccucggcuggugcaugaucgucuucugcaucaucuggauccccaucauggccaucaucaagaucauccaggccaagggcaacaucuuccagcgccucaucuccugcugccgccccgccuccaacuggggccccuaccucgagcagcaccgcggcgagcgcuacaaggacauggucgaccccaagaaggaggccgaccacgagauccccaccgucuccggcucccgcaagcccgaguga

SEQ ID NO: 49751 - RNA, 870 nt, Artificial Sequence
  derived and/or modified sequence opt2 from SLC6A15__Homo_sapiens__NP_060527
augcccaagaacuccaaggucgucaagcgcgagcucgacgacgacgucaccgaguccgucaaggaccuccucuccaacgaggacgccgccgacgacgccuucaagaccuccgagcucaucgucgacggccaggaggagaaggacaccgacgucgaggagggcuccgaggucgaggacgagcgccccgccuggaacuccaagcuccaguacauccucgcccaggucggcuucuccgucggccucggcaacgucuggcgcuuccccuaccucugccagaagaacggcggcggcgccuaccuccuccccuaccucauccuccucauggucaucggcaucccccucuucuuccucgagcucuccgucggccagcgcauccgccgcggcuccaucggcgucuggaacuacaucucccccaagcucggcggcaucggcuucgccuccugcgucgucugcuacuucgucgcccucuacuacaacgucaucaucggcuggucccucuucuacuucucccaguccuuccagcagccccuccccugggaccagugcccccucgucaagaacgccucccacaccuucgucgagcccgagugcgagcaguccuccgccaccaccuacuacugguaccgcgaggcccucaacaucuccuccuccaucuccgaguccggcggccucaacuggaagaugaccaucugccuccucgccgccugggucauggucugccucgccaugaucaagggcauccaguccuccggcaaggucuccaugcucgagcccuuccucauccuccucaucaccaucuccggcuucaucccccucuccaacuccgucaccgacuucugcggccagaucacccacaacaccuccuucuga

SEQ ID NO: 49752 - RNA, 1887 nt, Artificial Sequence
  derived and/or modified sequence opt2 from SLC6A18__Homo_sapiens__NP_872438
auggcccacgcccccgagcccgaccccgccgccugcgaccucggcgacgagcgccccaagugggacaacaaggcccaguaccuccucuccugcaccggcuucgccgucggccucggcaacaucuggcgcuuccccuaccucugccagaccuacggcggcggcgccuuccucauccccuacgucaucgcccucgucuucgagggcauccccaucuuccacgucgagcucgccaucggccagcgccuccgcaagggcuccgucggcgucuggaccgccaucucccccuaccucuccggcgucggccucggcugcgucacccucuccuuccucaucucccucuacuacaacaccaucgucgccuggguccucugguaccuccucaacuccuuccagcacccccuccccugguccuccugcccccccgaccucaaccgcaccggcuucgucgaggagugccagggcuccuccgccgucuccuacuucugguaccgccagacccucaacaucaccgccgacaucaacgacuccggcuccauccagugguggcuccucaucugccucgccgccuccugggccgucgucuacaugugcgucauccgcggcaucgagaccaccggcaaggucaucuacuucaccgcccucuuccccuaccucguccucaccaucuuccucauccgcggccucacccuccccggcgccaccaagggccucaucuaccucuucacccccaacaugcacauccuccagaacccccgcgucuggcucgacgccgccacccagaucuucuucucccucucccucgccuucggcggccacaucgccuucgccuccuacaacuccccccgcaacgacugccagaaggacgccgucgucaucgcccucgucaaccgcaugaccucccucuacgccuccaucgccgucuucuccguccucggcuucaaggccaccaacgacuacgagcacugccucgaccgcaacauccucucccucaucaacgacuucgacuuccccgagcaguccaucucccgcgacgacuaccccgccguccucaugcaccucaacgccaccuggcccaagcgcgucgcccagcucccccucaaggccugccuccucgaggacuuccucgacaaguccgccuccggccccggccucgccuucgucgucuucaccgagaccgaccuccacaugcccggcgcccccgucugggccaugcucuucuucggcaugcucuucacccucggccucuccaccauguucggcaccgucgaggccgucaucaccccccuccucgacgucggcguccucccccgcuggguccccaaggaggcccucaccggccucgucugccucgucugcuuccucuccgccaccugcuucacccuccaguccggcaacuacuggcucgagaucuucgacaacuucgccgccucccccaaccuccucaugcucgccuuccucgaggucgucggcgucgucuacgucuacggcaugaagcgcuucugcgacgacaucgccuggaugaccggccgccgccccucccccuacuggcgccucaccuggcgcgucgucuccccccuccuccucaccaucuucgucgccuacaucauccuccucuucuggaagccccuccgcuacaaggccuggaaccccaaguacgagcucuuccccucccgccaggagaagcucuaccccggcugggcccgcgccgccugcguccuccucucccuccuccccguccucuggguccccgucgccgcccucgcccagcuccucacccgccgccgccgcaccuggcgcgaccgcgacgcccgccccgacaccgacaugcgccccgacaccgacacccgccccgacaccgacaugcgccccgacaccgacaugcgcuga

SEQ ID NO: 49753 - RNA, 1905 nt, Artificial Sequence
  derived and/or modified sequence opt2 from SLC6A19__Homo_sapiens__NP_001003841
augguccgccucguccuccccaaccccggccucgacgcccgcauccccucccucgccgagcucgagaccaucgagcaggaggaggccuccucccgccccaagugggacaacaaggcccaguacaugcucaccugccucggcuucugcgucggccucggcaacgucuggcgcuuccccuaccucugccagucccacggcggcggcgccuucaugauccccuuccucauccuccucguccucgagggcaucccccuccucuaccucgaguucgccaucggccagcgccuccgccgcggcucccucggcgucugguccuccauccaccccgcccucaagggccucggccucgccuccaugcucaccuccuucauggucggccucuacuacaacaccaucaucuccuggaucaugugguaccucuucaacuccuuccaggagccccuccccugguccgacugcccccucaacgagaaccagaccggcuacgucgacgagugcgcccgcuccucccccgucgacuacuucugguaccgcgagacccucaacaucuccaccuccaucuccgacuccggcuccauccagugguggaugcuccucugccucgccugcgccugguccguccucuacaugugcaccauccgcggcaucgagaccaccggcaaggccgucuacaucaccuccacccuccccuacgucguccucaccaucuuccucauccgcggccucacccucaagggcgccaccaacggcaucgucuuccucuucacccccaacgucaccgagcucgcccagcccgacaccuggcucgacgccggcgcccaggucuucuucuccuucucccucgccuucggcggccucaucuccuucuccuccuacaacuccguccacaacaacugcgagaaggacuccgucaucgucuccaucaucaacggcuucaccuccgucuacgucgccaucgucgucuacuccgucaucggcuuccgcgccacccagcgcuacgacgacugcuucuccaccaacauccucacccucaucaacggcuucgaccuccccgagggcaacgucacccaggagaacuucgucgacaugcagcagcgcugcaacgccuccgaccccgccgccuacgcccagcucgucuuccagaccugcgacaucaacgccuuccucuccgaggccgucgagggcaccggccucgccuucaucgucuucaccgaggccaucaccaagaugccccucuccccccucugguccguccucuucuucaucaugcucuucugccucggccucuccuccauguucggcaacauggagggcgucgucgucccccuccaggaccuccgcgucaucccccccaaguggcccaaggagguccucaccggccucaucugccucggcaccuuccucaucggcuucaucuucacccucaacuccggccaguacuggcucucccuccucgacuccuacgccggcuccaucccccuccucaucaucgccuucugcgagauguucuccgucgucuacgucuacggcgucgaccgcuucaacaaggacaucgaguucaugaucggccacaagcccaacaucuucuggcaggucaccuggcgcgucgucuccccccuccucaugcucaucaucuuccucuucuucuucgucgucgaggucucccaggagcucaccuacuccaucugggaccccggcuacgaggaguuccccaagucccagaagaucuccuaccccaacugggucuacgucgucgucgucaucgucgccggcguccccucccucaccauccccggcuacgccaucuacaagcucauccgcaaccacugccagaagcccggcgaccaccagggccucgucuccacccucuccaccgccuccaugaacggcgaccucaaguacuga

SEQ ID NO: 49754 - RNA, 1800 nt, Artificial Sequence
  derived and/or modified sequence opt2 from SLC6A1__Homo_sapiens__NP_003033
auggccaccaacggcuccaaggucgccgacggccagaucuccaccgaggucuccgaggcccccgucgccaacgacaagcccaagacccucgucgucaagguccagaagaaggccgccgaccuccccgaccgcgacaccuggaagggccgcuucgacuuccucauguccugcgucggcuacgccaucggccucggcaacgucuggcgcuuccccuaccucugcggcaagaacggcggcggcgccuuccucauccccuacuuccucacccucaucuucgccggcgucccccucuuccuccucgagugcucccucggccaguacaccuccaucggcggccucggcgucuggaagcucgcccccauguucaagggcgucggccucgccgccgccguccucuccuucuggcucaacaucuacuacaucgucaucaucuccugggccaucuacuaccucuacaacuccuucaccaccacccuccccuggaagcagugcgacaaccccuggaacaccgaccgcugcuucuccaacuacuccauggucaacaccaccaacaugaccuccgccgucgucgaguucugggagcgcaacaugcaccagaugaccgacggccucgacaagcccggccagauccgcuggccccucgccaucacccucgccaucgccuggauccucgucuacuucugcaucuggaagggcgucggcuggaccggcaaggucgucuacuucuccgccaccuaccccuacaucaugcucaucauccucuucuuccgcggcgucacccuccccggcgccaaggagggcauccucuucuacaucacccccaacuuccgcaagcucuccgacuccgaggucuggcucgacgccgccacccagaucuucuucuccuacggccucggccucggcucccucaucgcccucggcuccuacaacuccuuccacaacaacgucuaccgcgacuccaucaucgucugcugcaucaacuccugcaccuccauguucgccggcuucgucaucuucuccaucgucggcuucauggcccacgucaccaagcgcuccaucgccgacgucgccgccuccggccccggccucgccuuccucgccuaccccgaggccgucacccagcuccccaucuccccccucugggccauccucuucuucuccaugcuccucaugcucggcaucgacucccaguucugcaccgucgagggcuucaucaccgcccucgucgacgaguacccccgccuccuccgcaaccgccgcgagcucuucaucgccgccgucugcaucaucuccuaccucaucggccucuccaacaucacccagggcggcaucuacgucuucaagcucuucgacuacuacuccgccuccggcaugucccuccucuuccucgucuucuucgagugcgucuccaucuccugguucuacggcgucaaccgcuucuacgacaacauccaggagauggucggcucccgccccugcaucugguggaagcucugcugguccuucuucacccccaucaucgucgccggcgucuucaucuucuccgccguccagaugaccccccucaccaugggcaacuacgucuuccccaaguggggccagggcgucggcuggcucauggcccucuccuccaugguccucauccccggcuacauggccuacauguuccucacccucaagggcucccucaagcagcgcauccaggucaugguccagcccuccgaggacaucguccgccccgagaacggccccgagcagccccaggccggcuccuccaccuccaaggaggccuacaucuga

SEQ ID NO: 49755 - RNA, 1779 nt, Artificial Sequence
  derived and/or modified sequence opt2 from SLC6A20__Homo_sapiens__NP_064593
auggagaaggcccgcccccucugggccaacucccuccaguucgucuucgccugcaucuccuacgccgucggccucggcaacgucuggcgcuuccccuaccucugccagauguacggcggcggcuccuuccucguccccuacaucaucaugcucaucgucgagggcaugccccuccucuaccucgagcucgccgucggccagcgcaugcgccagggcuccaucggcgccuggcgcaccaucucccccuaccucuccggcgucggcgucgccuccgucgucgucuccuucuuccucuccauguacuacaacgucaucaacgccugggccuucugguaccucuuccacuccuuccaggacccccuccccugguccgucugcccccucaacggcaaccacaccggcuacgacgaggagugcgagaaggccuccuccacccaguacuucugguaccgcaagacccucaacaucucccccucccuccaggagaacggcggcguccagugggagcccgcccucugccuccuccucgccuggcucgucgucuaccucugcauccuccgcggcaccgaguccaccggcaaggucgucuacuucaccgccucccuccccuacugcguccucaucaucuaccucauccgcggccucacccuccacggcgccaccaacggccucauguacauguucacccccaagaucgagcagcucgccaaccccaaggccuggaucaacgccgccacccagaucuucuucucccucggccucggcuucggcucccucaucgccuucgccuccuacaacgagcccuccaacaacugccagaagcacgccaucaucgucucccucaucaacuccuucaccuccaucuucgccuccaucgucaccuucuccaucuacggcuucaaggccaccuucaacuacgagaacugccucaagaaggucucccuccuccucaccaacaccuucgaccucgaggacggcuuccucaccgccuccaaccucgagcaggucaagggcuaccucgccuccgccuaccccuccaaguacuccgagauguucccccagaucaagaacugcucccucgaguccgagcucgacaccgccguccagggcaccggccucgccuucaucgucuacaccgaggccaucaagaacauggaggucucccagcucugguccguccucuacuucuucaugcuccucaugcucggcaucggcuccaugcucggcaacaccgccgccauccucaccccccucaccgacuccaagaucaucuccucccaccuccccaaggaggccaucuccggccucgucugccucgucaacugcgccaucggcauggucuucaccauggaggccggcaacuacugguucgacaucuucaacgacuacgccgccacccucucccuccuccucaucguccucgucgagaccaucgccgucugcuacgucuacggccuccgccgcuucgaguccgaccucaaggccaugaccggccgcgccgucuccugguacuggaaggucaugugggccggcgucuccccccuccucaucgucucccucuucgucuucuaccucuccgacuacauccucaccggcacccucaaguaccaggccugggacgccucccagggccagcucgucaccaaggacuaccccgccuacgcccucgccgucaucggccuccucgucgccuccuccaccaugugcaucccccucgccgcccucggcaccuucguccagcgccgccucaagcgcggcgacgccgaccccgucgccuga

SEQ ID NO: 49756 - RNA, 1854 nt, Artificial Sequence
  derived and/or modified sequence opt2 from SLC6A2__Homo_sapiens__NP_001165972
augcuccucgcccgcaugaacccccagguccagcccgagaacaacggcgccgacaccggccccgagcagccccuccgcgcccgcaagaccgccgagcuccucgucgucaaggagcgcaacggcguccagugccuccucgccccccgcgacggcgacgcccagccccgcgagaccuggggcaagaagaucgacuuccuccucuccgucgucggcuucgccgucgaccucgccaacgucuggcgcuuccccuaccucugcuacaagaacggcggcggcgccuuccucauccccuacacccucuuccucaucaucgccggcaugccccucuucuacauggagcucgcccucggccaguacaaccgcgagggcgccgccaccgucuggaagaucugccccuucuucaagggcgucggcuacgccgucauccucaucgcccucuacgucggcuucuacuacaacgucaucaucgccuggucccucuacuaccucuucuccuccuucacccucaaccuccccuggaccgacugcggccacaccuggaacucccccaacugcaccgaccccaagcuccucaacggcuccguccucggcaaccacaccaaguacuccaaguacaaguucacccccgccgccgaguucuacgagcgcggcguccuccaccuccacgaguccuccggcauccacgacaucggccucccccaguggcagcuccuccucugccucauggucgucgucaucguccucuacuucucccucuggaagggcgucaagaccuccggcaaggucgucuggaucaccgccacccuccccuacuucguccucuucguccuccucguccacggcgucacccuccccggcgccuccaacggcaucaacgccuaccuccacaucgacuucuaccgccucaaggaggccaccgucuggaucgacgccgccacccagaucuucuucucccucggcgccggcuucggcguccucaucgccuucgccuccuacaacaaguucgacaacaacugcuaccgcgacgcccuccucaccuccuccaucaacugcaucaccuccuucgucuccggcuucgccaucuucuccauccucggcuacauggcccacgagcacaaggucaacaucgaggacgucgccaccgagggcgccggccucgucuucauccucuaccccgaggccaucuccacccucuccggcuccaccuucugggccgucgucuucuucgucaugcuccucgcccucggccucgacuccuccaugggcggcauggaggccgucaucaccggccucgccgacgacuuccagguccucaagcgccaccgcaagcucuucaccuucggcgucaccuucuccaccuuccuccucgcccucuucugcaucaccaagggcggcaucuacguccucacccuccucgacaccuucgccgccggcaccuccauccucuucgccguccucauggaggccaucggcgucuccugguucuacggcgucgaccgcuucuccaacgacauccagcagaugaugggcuuccgccccggccucuacuggcgccucugcuggaaguucgucucccccgccuuccuccucuucgucgucgucgucuccaucaucaacuucaagccccucaccuacgacgacuacaucuucccccccugggccaacugggucggcuggggcaucgcccucuccuccaugguccucguccccaucuacgucaucuacaaguuccucuccacccagggcucccucugggagcgccucgccuacggcaucacccccgagaacgagcaccaccucgucgcccagcgcgacauccgccaguuccagcuccagcacuggcucgccaucuga

SEQ ID NO: 49757 - RNA, 1893 nt, Artificial Sequence
  derived and/or modified sequence opt2 from SLC6A4__Homo_sapiens__NP_001036
auggagaccaccccccucaacucccagaagcagcucuccgccugcgaggacggcgaggacugccaggagaacggcguccuccagaaggucguccccacccccggcgacaaggucgaguccggccagaucuccaacggcuacuccgccguccccucccccggcgccggcgacgacacccgccacuccauccccgccaccaccaccacccucgucgccgagcuccaccagggcgagcgcgagaccuggggcaagaaggucgacuuccuccucuccgucaucggcuacgccgucgaccucggcaacgucuggcgcuuccccuacaucugcuaccagaacggcggcggcgccuuccuccuccccuacaccaucauggccaucuucggcggcaucccccucuucuacauggagcucgcccucggccaguaccaccgcaacggcugcaucuccaucuggcgcaagaucugccccaucuucaagggcaucggcuacgccaucugcaucaucgccuucuacaucgccuccuacuacaacaccaucauggccugggcccucuacuaccucaucuccuccuucaccgaccagcuccccuggaccuccugcaagaacuccuggaacaccggcaacugcaccaacuacuucuccgaggacaacaucaccuggacccuccacuccaccucccccgccgaggaguucuacacccgccacguccuccagauccaccgcuccaagggccuccaggaccucggcggcaucuccuggcagcucgcccucugcaucaugcucaucuucaccgucaucuacuucuccaucuggaagggcgucaagaccuccggcaaggucgucugggucaccgccaccuuccccuacaucauccucuccguccuccucguccgcggcgccacccuccccggcgccuggcgcggcguccucuucuaccucaagcccaacuggcagaagcuccucgagaccggcgucuggaucgacgccgccgcccagaucuucuucucccucggccccggcuucggcguccuccucgccuucgccuccuacaacaaguucaacaacaacugcuaccaggacgcccucgucaccuccgucgucaacugcaugaccuccuucgucuccggcuucgucaucuucaccguccucggcuacauggccgagaugcgcaacgaggacgucuccgaggucgccaaggacgccggccccucccuccucuucaucaccuacgccgaggccaucgccaacaugcccgccuccaccuucuucgccaucaucuucuuccucaugcucaucacccucggccucgacuccaccuucgccggccucgagggcgucaucaccgccguccucgacgaguucccccacgucugggccaagcgccgcgagcgcuucguccucgccgucgucaucaccugcuucuucggcucccucgucacccucaccuucggcggcgccuacgucgucaagcuccucgaggaguacgccaccggccccgccguccucaccgucgcccucaucgaggccgucgccgucuccugguucuacggcaucacccaguucugccgcgacgucaaggagaugcucggcuucucccccggcugguucuggcgcaucugcugggucgccaucuccccccucuuccuccucuucaucaucugcuccuuccucaugucccccccccagcuccgccucuuccaguacaacuaccccuacugguccaucauccucggcuacugcaucggcaccuccuccuucaucugcauccccaccuacaucgccuaccgccucaucaucacccccggcaccuucaaggagcgcaucaucaaguccaucacccccgagacccccaccgagauccccugcggcgacauccgccucaacgccgucuga

SEQ ID NO: 49758 - RNA, 2394 nt, Artificial Sequence
  derived and/or modified sequence opt2 from SLC6A5__Homo_sapiens__XP_011518775
auggacugcuccgcccccaaggagaugaacaagcuccccgccaacucccccgaggccgccgccgcccagggccaccccgacggccccugcgccccccgcaccucccccgagcaggagcuccccgccgccgccgcccccccccccccccgcgucccccgcuccgccuccaccggcgcccagaccuuccaguccgccgacgcccgcgccugcgaggccgagcgccccggcgucggcuccugcaagcucuccuccccccgcgcccaggccgccuccgccgcccuccgcgaccuccgcgaggcccagggcgcccaggccucccccccccccggcuccuccggccccggcaacgcccuccacugcaagauccccuuccuccgcggccccgagggcgacgccaacgucuccgucggcaagggcacccucgagcgcaacaacacccccgucgucggcugggucaacaugucccaguccaccgucguccucgccaccgacggcaucaccuccguccuccccggcuccgucgccaccgucgccacccaggaggacgagcagggcgacgagaacaaggcccgcggcaacugguccuccaagcucgacuucauccucuccauggucggcuacgccgucggccucggcaacgucuggcgcuuccccuaccucgccuuccagaacggcggcggcgccuuccucauccccuaccucaugaugcucgcccucgccggccuccccaucuucuuccucgaggucucccucggccaguucgccucccagggccccgucuccgucuggaaggccauccccgcccuccagggcugcggcaucgccaugcucaucaucuccguccucaucgccaucuacuacaacgucaucaucugcuacacccucuucuaccucuucgccuccuucgucuccguccuccccuggggcuccugcaacaaccccuggaacacccccgagugcaaggacaagaccaagcuccuccucgacuccugcgucaucuccgaccaccccaagauccagaucaagaacuccaccuucugcaugaccgccuaccccaacgucaccauggucaacuucaccucccaggccaacaagaccuucgucuccggcuccgaggaguacuucaaguacuucguccucaagaucuccgccggcaucgaguaccccggcgagauccgcuggccccucgcccucugccucuuccucgccugggucaucgucuacgccucccucgccaagggcaucaagaccuccggcaaggucgucuacuucaccgccaccuuccccuacgucguccucgucauccuccucauccgcggcgucacccuccccggcgccggcgccggcaucugguacuucaucacccccaagugggagaagcucaccgacgccaccgucuggaaggacgccgccacccagaucuucuucucccucuccgccgccuggggcggccucaucacccucuccuccuacaacaaguuccacaacaacugcuaccgcgacacccucaucgucaccugcaccaacuccgccaccuccaucuucgccggcuucgucaucuucuccgucaucggcuucauggccaacgagcgcaaggucaacaucgagaacgucgccgaccagggccccggcaucgccuucgucgucuaccccgaggcccucacccgccucccccucucccccuucugggccaucaucuucuuccucaugcuccucacccucggccucgacaccauguucgccaccaucgagaccaucgucaccuccaucuccgacgaguuccccaaguaccuccgcacccacaagcccgucuucacccucggcugcugcaucugcuucuucaucaugggcuuccccaugaucacccagggcggcaucuacauguuccagcucgucgacaccuacgccgccuccuacgcccucgucaucaucgccaucuucgagcucgucggcaucuccuacgucuacggccuccagcgcuucugcgaggacaucgagaugaugaucggcuuccagcccaacaucuucuggaaggucugcugggccuucgucacccccaccauccucaccuucauccucugcuucuccuucuaccagugggagcccaugaccuacggcuccuaccgcuaccccaacugguccaugguccucggcuggcucaugcucgccugcuccgucaucuggauccccaucauguucgucaucaagaugcaccucgcccccggccgcuucaucgagcgccucaagcucgucugcuccccccagcccgacuggggccccuuccucgcccagcaccgcggcgagcgcuacaagaacaugaucgacccccucggcaccuccucccucggccucaagcuccccgucaaggaccucgagcucggcacccagugcuga

SEQ ID NO: 49759 - RNA, 2166 nt, Artificial Sequence
  derived and/or modified sequence opt2 from SLC6A6__Homo_sapiens__NP_001127839
augggcgacgccgaguccugccuccuccgccagcagacccgcgagguccgcaagaagccccucaucaacuaccgcuuccuccgcgccgccgccaacgccgagccccgcggcccccaggcccagcgcaccuccugcgccaagcgcgagugcggcgccuucacccagcgcguccgcgagcgcgccggccgccagccccccgccggcggcacccgccacucccgcgccgagcgcggccgccgccgcucccacccccgcucccgcacccgcaccaccgcccuccuccgcuccucccagaccaaggagauggccaccaaggagaagcuccagugccucaaggacuuccacaaggacauccucaagcccucccccggcaagucccccggcacccgccccgaggacgaggccgagggcaagcccccccagcgcgagaagugguccuccaagaucgacuucguccucuccgucgccggcggcuucgucggccucggcaacgucuggcgcuuccccuaccucugcuacaagaacggcggcggcgccuuccucauccccuacuucaucuuccucuucggcuccggccuccccgucuucuuccucgagaucaucaucggccaguacaccuccgagggcggcaucaccugcugggagaagaucugcccccucuucuccggcaucggcuacgccuccgucgucaucgucucccuccucaacgucuacuacaucgucauccucgccugggccaccuacuaccucuuccaguccuuccagaaggagcuccccugggcccacugcaaccacuccuggaacaccccccacugcauggaggacaccaugcgcaagaacaaguccgucuggaucaccaucuccuccaccaacuucaccucccccgucaucgaguucugggagcgcaacguccucucccucucccccggcaucgaccaccccggcucccucaagugggaccucgcccucugccuccuccucgucuggcucgucugcuucuucugcaucuggaagggcguccgcuccaccggcaaggucgucuacuucaccgccaccuuccccuucgccaugcuccucguccuccucguccgcggccucacccuccccggcgccggcgccggcaucaaguucuaccucuaccccgacaucacccgccucgaggacccccaggucuggaucgacgccggcacccagaucuucuucuccuacgccaucugccucggcgccaugaccucccucggcuccuacaacaaguacaaguacaacuccuaccgcgacugcaugcuccucggcugccucaacuccggcaccuccuucgucuccggcuucgccaucuucuccauccucggcuucauggcccaggagcagggcgucgacaucgccgacgucgccgaguccggccccggccucgccuucaucgccuaccccaaggccgucaccaugaugccccuccccaccuucugguccauccucuucuucaucaugcuccuccuccucggccucgacucccaguucgucgaggucgagggccagaucaccucccucgucgaccucuaccccuccuuccuccgcaagggcuaccgccgcgagaucuucaucgccuucgucugcuccaucuccuaccuccucggccucaccauggucaccgagggcggcauguacgucuuccagcucuucgacuacuacgccgccuccggcgucugccuccucugggucgccuucuucgagugcuucgucaucgccuggaucuacggcggcgacaaccucuacgacggcaucgaggacaugaucggcuaccgccccggccccuggaugaaguacuccugggccgucaucacccccguccucugcgucggcugcuucaucuucucccucgucaaguacgucccccucaccuacaacaagaccuacgucuaccccaacugggccaucggccucggcuggucccucgcccucuccuccaugcucugcgucccccucgucaucgucauccgccucugccagaccgagggccccuuccucguccgcgucaaguaccuccucaccccccgcgagcccaaccgcugggccgucgagcgcgagggcgccacccccuacaacucccgcaccgucaugaacggcgcccucgucaagcccacccacaucaucgucgagaccaugauguga

SEQ ID NO: 49760 - RNA, 1911 nt, Artificial Sequence
  derived and/or modified sequence opt2 from SLC6A7__Homo_sapiens__NP_055043
augaagaagcuccagggcgcccaccuccgcaagcccgucacccccgaccuccucaugacccccuccgaccagggcgacgucgaccucgacgucgacuucgccgcccaccgcggcaacuggaccggcaagcucgacuuccuccucuccugcaucggcuacugcgucggccucggcaacgucuggcgcuuccccuaccgcgccuacaccaacggcggcggcgccuuccucguccccuacuuccucaugcucgccaucugcggcaucccccucuucuuccucgagcucucccucggccaguucuccucccucggcccccucgccgucuggaagaucuccccccucuucaagggcgccggcgccgccaugcuccucaucgucggccucgucgccaucuacuacaacaugaucaucgccuacguccucuucuaccucuucgccucccucaccuccgaccuccccugggagcacugcggcaacugguggaacaccgagcucugccucgagcaccgcgucuccaaggacggcaacggcgcccucccccucaaccucaccugcaccgucucccccuccgaggaguacuggucccgcuacguccuccacauccagggcucccagggcaucggcucccccggcgagauccgcuggaaccucugccucugccuccuccucgccugggucaucgucuuccucugcauccucaagggcgucaaguccuccggcaaggucgucuacuucaccgccaccuuccccuaccucauccuccucaugcuccucguccgcggcgucacccuccccggcgccuggaagggcauccaguucuaccucaccccccaguuccaccaccuccucuccuccaaggucuggaucgaggccgcccuccagaucuucuacucccucggcgucggcuucggcggccuccucaccuucgccuccuacaacaccuuccaccagaacaucuaccgcgacaccuucaucgucacccucggcaacgccaucaccuccauccucgccggcuucgccaucuucuccguccucggcuacaugucccaggagcucggcguccccgucgaccaggucgccaaggccggccccggccucgccuucgucgucuacccccaggccaugaccaugcucccccucucccccuucugguccuuccucuucuucuucaugcuccucacccucggccucgacucccaguucgccuuccucgagaccaucgucaccgccgucaccgacgaguuccccuacuaccuccgccccaagaaggccgucuucuccggccucaucugcgucgccauguaccucaugggccucauccucaccaccgacggcggcauguacuggcucguccuccucgacgacuacuccgccuccuucggccucauggucgucgucaucaccaccugccucgccgucacccgcgucuacggcauccagcgcuucugccgcgacauccacaugaugcucggcuucaagcccggccucuacuuccgcgccugcuggcucuuccucucccccgccacccuccucgcccucauggucuacuccaucgucaaguaccagcccuccgaguacggcuccuaccgcuucccccccugggccgagcuccucggcauccucaugggccuccucuccugccucaugauccccgccggcaugcucgucgccguccuccgcgaggagggcucccucugggagcgccuccagcaggccucccgccccgccauggacuggggccccucccucgaggagaaccgcaccggcauguacgucgccacccucgccggcucccagucccccaagccccucaugguccacaugcgcaaguacggcggcaucaccuccuucgagaacaccgccaucgaggucgaccgcgagaucgccgaggaggaggaguccaugauguga

SEQ ID NO: 49761 - RNA, 1878 nt, Artificial Sequence
  derived and/or modified sequence opt2 from SLC6A8__Homo_sapiens__NP_001136277
auggccaagaaguccgccgagaacggcaucuacuccgucuccggcgacgagaagaagggcccccucaucgcccccggccccgacggcgcccccgccaagggcgacggccccgucggccucggcacccccggcggccgccucgccguccccccccgcgagaccuggacccgccagauggacuucaucauguccugcgucggcuucgccgucggccucggcaacgucuggcgcuuccccuaccucugcuacaagaacggcggcggcgucuuccucauccccuacguccucaucgcccucgucggcggcauccccaucuucuuccucgagaucucccucggccaguucaugaaggccggcuccaucaacgucuggaacaucugcccccucuucaagggccucggcuacgccuccauggucaucgucuucuacugcaacaccuacuacaucaugguccucgccuggggcuucuacuaccucgucaaguccuucaccaccacccuccccugggccaccugcggccacaccuggaacacccccgacugcgucgagaucuuccgccacgaggacugcgccaacgccucccucgccaaccucaccugcgaccagcucgccgaccgccgcucccccgucaucgaguucugggagaacaagguccuccgccucuccggcggccucgagguccccggcgcccucaacugggaggucacccucugccuccucgccugcuggguccucgucuacuucugcgucuggaagggcgucaaguccaccggcaagaucgucuacuucaccgccaccuuccccuacgucguccucgucguccuccucguccgcggcguccuccuccccggcgcccucgacggcaucaucuacuaccucaagcccgacugguccaagcucggcuccccccaggucuggaucgacgccggcacccagaucuucuucuccuacgccaucggccucggcgcccucaccgcccucggcuccuacaaccgcuucaacaacaacugcuacaacggcaccuccuucuucgccggcuucgucgucuucuccauccucggcuucauggccgccgagcagggcguccacaucuccaaggucgccgaguccggccccggccucgccuucaucgccuacccccgcgccgucacccucaugcccgucgccccccucugggccgcccucuucuucuucaugcuccuccuccucggccucgacucccaguucgucggcgucgagggcuucaucaccggccuccucgaccuccuccccgccuccuacuacuuccgcuuccagcgcgagaucuccgucgcccucugcugcgcccucugcuucgucaucgaccucuccauggucaccgacggcggcauguacgucuuccagcucuucgacuacuacuccgccuccggcaccacccuccucuggcaggccuucugggagugcgucgucgucgccugggucuacggcgccgaccgcuucauggacgacaucgccugcaugaucggcuaccgccccugccccuggaugaaguggugcugguccuucuucaccccccucgucugcaugggcaucuucaucuucaacgucgucuacuacgagccccucgucuacaacaacaccuacgucuaccccugguggggcgaggccaugggcugggccuucgcccucuccuccaugcucugcgucccccuccaccuccucggcugccuccuccgcgccaagggcaccauggccgagcgcuggcagcaccucacccagcccaucuggggccuccaccaccucgaguaccgcgcccaggacgccgacguccgcggccucaccacccucacccccgucuccgaguccuccaaggucgucgucgucgaguccgucauguga

SEQ ID NO: 49762 - RNA, 1857 nt, Artificial Sequence
  derived and/or modified sequence opt2 from SLC6A9__Homo_sapiens__XP_011540319
auguccggcggcgacacccgcgccgccaucgcccgcccccgcauggccgccgcccacggccccgucgcccccuccucccccgagcaggucacccuccuccccguccagcgcuccuucuuccucccccccuucuccggcgccacccccuccaccucccucgccgaguccguccucaaggucuggcacggcgccuacaacuccggccuccucccccagcucauggcccagcacucccucgccauggcccagaacggcgccguccccuccgaggccaccaagcgcgaccagaaccucaagcgcggcaacuggggcaaccagaucgaguucguccucaccuccgucggcuacgccgucggccucggcaacgucuggcgcuuccccuaccucugcuaccgcaacggcggcggcgccuucauguuccccuacuucaucaugcucaucuucugcggcaucccccucuucuucauggagcucuccuucggccaguucgccucccagggcugccucggcgucuggcgcaucucccccauguucaagggcgucggcuacggcaugauggucgucuccaccuacaucggcaucuacuacaacgucgucaucugcaucgccuucuacuacuucuucuccuccaugacccacguccuccccugggccuacugcaacaaccccuggaacacccacgacugcgccggcguccucgacgccuccaaccucaccaacggcucccgccccgccgcccuccccuccaaccucucccaccuccucaaccacucccuccagcgcaccucccccuccgaggaguacuggcgccucuacguccucaagcucuccgacgacaucggcaacuucggcgagguccgccucccccuccucggcugccucggcgucuccuggcucgucgucuuccucugccucauccgcggcgucaaguccuccggcaaggucgucuacuucaccgccaccuuccccuacgucguccucaccauccucuucguccgcggcgucacccucgagggcgccuucgacggcaucauguacuaccucaccccccagugggacaagauccucgaggccaaggucuggggcgacgccgccucccagaucuucuacucccucggcugcgccuggggcggccucaucaccauggccuccuacaacaaguuccacaacaacugcuaccgcgacuccgucaucaucuccaucaccaacugcgccaccuccgucuacgccggcuucgucaucuucuccauccucggcuucauggccaaccaccucggcgucgacgucucccgcgucgccgaccacggccccggccucgccuucgucgccuaccccgaggcccucacccuccuccccaucuccccccucuggucccuccucuucuucuucaugcucauccuccucggccucggcacccaguucugccuccucgagacccucgucaccgccaucgucgacgaggucggcaacgaguggauccuccagaagaagaccuacgucacccucggcgucgccgucgccggcuuccuccucggcaucccccucaccucccaggccggcaucuacuggcuccuccucauggacaacuacgccgccuccuucucccucgucgucaucuccugcaucaugugcgucgccaucauguacaucuacggccaccgcaacuacuuccaggacauccagaugaugcucggcuucccccccccccucuucuuccagaucugcuggcgcuucgucucccccgccaucaucuucucccuccccacccaccgcgcccccgcccccggccccgccugcuucuuccacggccccgacgucgacuccugccccugcuccgcccccaacgcccucuucuga

SEQ ID NO: 49763 - RNA, 1572 nt, Artificial Sequence
  derived and/or modified sequence opt2 from SLC7A10__Homo_sapiens__NP_062823
auggccggccacacccagcagcccuccggccgcggcaacccccgccccgcccccucccccucccccguccccggcaccguccccggcgccuccgagcgcgucgcccucaagaaggagaucggccuccucuccgccugcaccaucaucaucggcaacaucaucggcuccggcaucuucaucucccccaagggcguccucgagcacuccggcuccgucggccucgcccucuucgucuggguccucggcggcggcgucaccgcccucggcucccucugcuacgccgagcucggcgucgccauccccaaguccggcggcgacuacgccuacgucaccgagaucuucggcggccucgccggcuuccuccuccucugguccgccguccucaucauguaccccaccucccucgccgucaucuccaugaccuucuccaacuacguccuccagcccgucuuccccaacugcaucccccccaccaccgccucccgcguccucuccauggccugccucaugcuccucaccugggucaacuccuccuccguccgcugggccacccgcauccaggacauguucaccggcggcaagcuccucgcccucucccucaucaucggcgucggccuccuccagaucuuccagggccacuucgaggagcuccgccccuccaacgccuucgccuucuggaugacccccuccgucggccaccucgcccucgccuuccuccagggcuccuucgccuucuccggcuggaacuuccucaacuacgucaccgaggagauggucgacgcccgcaagaaccucccccgcgccaucuucaucuccaucccccucgucaccuucgucuacaccuucaccaacaucgccuacuucaccgccauguccccccaggagcuccucuccuccaacgccgucgccgucaccuucggcgagaagcuccucggcuacuucuccugggucaugcccgucuccgucgcccucuccaccuucggcggcaucaacggcuaccucuucaccuacucccgccucugcuucuccggcgcccgcgagggccaccuccccucccuccucgccaugauccacguccgccacugcacccccauccccgcccuccucgucugcugcggcgccaccgccgucaucaugcucgucggcgacaccuacacccucaucaacuacgucuccuucaucaacuaccucugcuacggcgucaccauccucggccuccuccuccuccgcuggcgccgccccgcccuccaccgccccaucaaggucaaccuccucauccccgucgccuaccucgucuucugggccuuccuccucgucuucuccuucaucuccgagcccauggucugcggcgucggcgucaucaucauccucaccggcguccccaucuucuuccucggcgucuucuggcgcuccaagcccaagugcguccaccgccucaccgaguccaugacccacuggggccaggagcucugcuucgucgucuacccccaggacgcccccgaggaggaggagaacggccccugcccccccucccuccuccccgccaccgacaagcccuccaagccccaguga

SEQ ID NO: 49764 - RNA, 1506 nt, Artificial Sequence
  derived and/or modified sequence opt2 from SLC7A11__Homo_sapiens__NP_055146
augguccgcaagcccgucgucuccaccaucuccaagggcggcuaccuccagggcaacgucaacggccgccuccccucccucggcaacaaggagccccccggccaggagaagguccagcucaagcgcaaggucacccuccuccgcggcgucuccaucaucaucggcaccaucaucggcgccggcaucuucaucucccccaagggcguccuccagaacaccggcuccgucggcaugucccucaccaucuggaccgucugcggcguccucucccucuucggcgcccucuccuacgccgagcucggcaccaccaucaagaaguccggcggccacuacaccuacauccucgaggucuucggcccccuccccgccuucguccgcgucugggucgagcuccucaucauccgccccgccgccaccgccgucaucucccucgccuucggccgcuacauccucgagcccuucuucauccagugcgagauccccgagcucgccaucaagcucaucaccgccgucggcaucaccgucgucaugguccucaacuccauguccgucuccugguccgcccgcauccagaucuuccucaccuucugcaagcucaccgccauccucaucaucaucguccccggcgucaugcagcucaucaagggccagacccagaacuucaaggacgccuucuccggccgcgacuccuccaucacccgccucccccucgccuucuacuacggcauguacgccuacgccggcugguucuaccucaacuucgucaccgaggaggucgagaaccccgagaagaccaucccccucgccaucugcaucuccauggccaucgucaccaucggcuacguccucaccaacgucgccuacuucaccaccaucaacgccgaggagcuccuccucuccaacgccgucgccgucaccuucuccgagcgccuccucggcaacuucucccucgccguccccaucuucgucgcccucuccugcuucggcuccaugaacggcggcgucuucgccgucucccgccucuucuacgucgccucccgcgagggccaccuccccgagauccucuccaugauccacguccgcaagcacaccccccuccccgccgucaucguccuccacccccucaccaugaucaugcucuucuccggcgaccucgacucccuccucaacuuccucuccuucgcccgcuggcucuucaucggccucgccgucgccggccucaucuaccuccgcuacaagugccccgacaugcaccgccccuucaaggucccccucuucauccccgcccucuucuccuucaccugccucuucauggucgcccucucccucuacuccgaccccuucuccaccggcaucggcuucgucaucacccucaccggcguccccgccuacuaccucuucaucaucugggacaagaagccccgcugguuccgcaucauguccgagaagaucacccgcacccuccagaucauccucgaggucguccccgaggaggacaagcucuga

SEQ ID NO: 49765 - RNA, 1413 nt, Artificial Sequence
  derived and/or modified sequence opt2 from SLC7A13__Homo_sapiens__NP_620172
auggaccgcggcgagaagauccagcucaagcgcgucuucggcuacugguggggcaccuccuuccuccucaucaacaucaucggcgccggcaucuucgucucccccaagggcguccucgccuacuccugcaugaacgucggcgucucccucugcgucugggccggcugcgccauccucgccaugaccuccacccucugcuccgccgagaucuccaucuccuuccccugcuccggcgcccaguacuacuuccucaagcgcuacuucggcuccaccgucgccuuccucaaccucuggaccucccucuuccucggcuccggcgucgucgccggccaggcccuccuccucgccgaguacuccauccagcccuucuuccccuccugcuccguccccaagcuccccaagaagugccucgcccucgccaugcucuggaucgucggcauccucaccucccgcggcgucaaggaggucaccuggcuccagaucgccuccuccguccucaaggucuccauccucuccuucaucucccucaccggcgucgucuuccucauccgcggcaagaaggagaacgucgagcgcuuccagaacgccuucgacgccgagcuccccgacaucucccaccucauccaggccaucuuccagggcuacuucgccuacuccggcggcgccugcuucacccucaucgccggcgagcucaagaagccccgcaccaccauccccaagugcaucuucaccgcccucccccucgucaccgucgucuaccuccucgucaacaucuccuaccucaccguccucaccccccgcgagauccucuccuccgacgccgucgccaucaccugggccgaccgcgccuuccccucccucgccuggaucaugcccuucgccaucuccaccucccucuucuccaaccuccucaucuccaucuucaaguccucccgccccaucuaccucgccucccaggagggccagcucccccuccucuucaacacccucaacucccacuccucccccuucaccgccguccuccuccucgucacccucggcucccucgccaucauccucaccucccucaucgaccucaucaacuacaucuucuucaccggcucccucugguccauccuccucaugaucggcauccuccgccgccgcuaccaggagcccaaccucuccauccccuacaaggucuuccucuccuucccccucgccaccaucgucaucgacgucggccucgucgucaucccccucgucaagucccccaacguccacuacgucuacguccuccuccucguccucuccggccuccucuucuacaucccccucauccacuucaagauccgccucgccugguucgagaagaugaccugcuaccuccagcuccucuucaacaucugccuccccgacgucuccgaggaguga

SEQ ID NO: 49766 - RNA, 2316 nt, Artificial Sequence
  derived and/or modified sequence opt2 from SLC7A14__Homo_sapiens__NP_066000
auguccggcuucuucaccucccucgacccccgccgcguccaguggggcgccgccugguacgccaugcacucccgcauccuccgcaccaagcccgucgaguccaugcucgagggcaccggcaccaccaccgcccacggcaccaagcucgcccagguccucaccaccgucgaccucaucucccucggcgucggcuccugcgucggcaccggcauguacgucgucuccggccucgucgccaaggagauggccggccccggcgucaucgucuccuucaucaucgccgccgucgccuccauccucuccggcgucugcuacgccgaguucggcguccgcguccccaagaccaccggcuccgccuacaccuacuccuacgucaccgucggcgaguucgucgccuucuucaucggcuggaaccucauccucgaguaccucaucggcaccgccgccggcgccuccgcccucuccuccauguucgacucccucgccaaccacaccaucucccgcuggauggccgacuccgucggcacccucaacggccucggcaagggcgaggaguccuaccccgaccuccucgcccuccucaucgccgucaucgucaccaucaucgucgcccucggcgucaagaacuccaucggcuucaacaacguccucaacguccucaaccucgccgucugggucuucaucaugaucgccggccucuucuucaucaacggcaaguacugggccgagggccaguuccucccccacggcugguccggcguccuccagggcgccgccaccugcuucuacgccuucaucggcuucgacaucaucgccaccaccggcgaggaggccaagaaccccaacaccuccauccccuacgccaucaccgccucccucgucaucugccucaccgccuacgucuccgucuccgucauccucacccucaugguccccuacuacaccaucgacaccgaguccccccucauggagauguucgucgcccacggcuucuacgccgccaaguucgucgucgccaucggcuccgucgccggccucaccgucucccuccucggcucccucuuccccaugccccgcgucaucuacgccauggccggcgacggccuccucuuccgcuuccucgcccacgucuccuccuacaccgagacccccgucgucgccugcaucgucuccggcuuccucgccgcccuccucgcccuccucgucucccuccgcgaccucaucgagaugauguccaucggcacccuccucgccuacacccucgucuccgucugcguccuccuccuccgcuaccagcccgaguccgacaucgacggcuucgucaaguuccucuccgaggagcacaccaagaagaaggagggcauccucgccgacugcgagaaggaggccugcucccccgucuccgagggcgacgaguucuccggccccgccaccaacaccugcggcgccaagaaccuccccucccucggcgacaacgagaugcucaucggcaaguccgacaaguccaccuacaacgucaaccaccccaacuacggcaccgucgacaugaccaccggcaucgaggccgacgaguccgagaacaucuaccucaucaagcucaagaagcucaucggcccccacuacuacaccaugcgcauccgccucggccuccccggcaagauggaccgccccaccgccgccaccggccacaccgucaccaucugcguccuccuccucuucauccucauguucaucuucugcuccuucaucaucuucggcuccgacuacaucuccgagcaguccuggugggccauccuccucgucguccucaugguccuccucaucuccacccucgucuucgucauccuccagcagcccgagaaccccaagaagcuccccuacauggcccccugccuccccuucguccccgccuucgccaugcucgucaacaucuaccucaugcucaagcucuccaccaucaccuggauccgcuucgccgucuggugcuucgucggccuccucaucuacuucggcuacggcaucuggaacuccacccucgagaucuccgcccgcgaggaggcccuccaccaguccaccuaccagcgcuacgacgucgacgaccccuucuccgucgaggagggcuucuccuacgccaccgagggcgagucccaggaggacuggggcggccccaccgaggacaagggcuucuacuaccagcagauguccgacgccaaggccaacggccgcaccuccuccaaggccaaguccaaguccaagcacaagcagaacuccgaggcccucaucgccaacgacgagcucgacuacucccccgaguga

SEQ ID NO: 49767 - RNA, 1890 nt, Artificial Sequence
  derived and/or modified sequence opt2 from SLC7A1__Homo_sapiens__XP_005266564
augggcugcaagguccuccucaacaucggccagcagaugcuccgccgcaaggucgucgacugcucccgcgaggagacccgccucucccgcugccucaacaccuucgaccucgucgcccucggcgucggcuccacccucggcgccggcgucuacguccucgccggcgccgucgcccgcgagaacgccggccccgccaucgucaucuccuuccucaucgccgcccucgccuccguccucgccggccucugcuacggcgaguucggcgcccgcguccccaagaccggcuccgccuaccucuacuccuacgucaccgucggcgagcucugggccuucaucaccggcuggaaccucauccucuccuacaucaucggcaccuccuccgucgcccgcgccugguccgccaccuucgacgagcucaucggccgccccaucggcgaguucucccgcacccacaugacccucaacgcccccggcguccucgccgagaaccccgacaucuucgccgucaucaucauccucauccucaccggccuccucacccucggcgucaaggaguccgccauggucaacaagaucuucaccugcaucaacguccucguccucggcuucaucauggucuccggcuucgucaagggcuccgucaagaacuggcagcucaccgaggaggacuucggcaacaccuccggccgccucugccucaacaacgacaccaaggagggcaagcccggcgucggcggcuucaugcccuucggcuucuccggcguccucuccggcgccgccaccugcuucuacgccuucgucggcuucgacugcaucgccaccaccggcgaggaggucaagaacccccagaaggccauccccgucggcaucgucgccucccuccucaucugcuucaucgccuacuucggcgucuccgccgcccucacccucaugaugcccuacuucugccucgacaacaacuccccccuccccgacgccuucaagcacgucggcugggagggcgccaaguacgccgucgccgucggcucccucugcgcccucuccgccucccuccucggcuccauguuccccaugccccgcgucaucuacgccauggccgaggacggccuccucuucaaguuccucgccaacgucaacgaccgcaccaagacccccaucaucgccacccucgccuccggcgccgucgccgccgucauggccuuccucuucgaccucaaggaccucgucgaccucauguccaucggcacccuccucgccuacucccucgucgccgccugcguccucguccuccgcuaccagcccgagcagcccaaccucgucuaccagauggccuccaccuccgacgagcucgaccccgccgaccagaacgagcucgccuccaccaacgacucccagcucggcuuccuccccgaggccgagauguucucccucaagaccauccucucccccaagaacauggagcccuccaagaucuccggccucaucgucaacaucuccaccucccucaucgccguccucaucaucaccuucugcaucgucaccguccucggccgcgaggcccucaccaagggcgcccucugggccgucuuccuccucgccggcuccgcccuccucugcgccgucgucaccggcgucaucuggcgccagcccgaguccaagaccaagcucuccuucaagguccccuuccuccccguccuccccauccucuccaucuucgucaacgucuaccucaugaugcagcucgaccagggcaccuggguccgcuucgccgucuggaugcucaucggcuucaucaucuacuucggcuacggccucuggcacuccgaggaggccucccucgacgccgaccaggcccgcacccccgacggcaaccucgaccagugcaaguga

SEQ ID NO: 49768 - RNA, 2097 nt, Artificial Sequence
  derived and/or modified sequence opt2 from SLC7A2__Homo_sapiens__NP_001158243
augaagaucgagaccuccggcuacaacuccgacaagcucaucugccgcggcuucaucggcacccccgccccccccgucugcgacuccaaguuccuccucucccccuccuccgacguccgcaugauccccugccgcgccgcccucaccuucgcccgcugccucauccgccgcaagaucgucacccucgacucccucgaggacaccaagcucugccgcugccucuccaccauggaccucaucgcccucggcgucggcuccacccucggcgccggcgucuacguccucgccggcgaggucgccaaggccgacuccggccccuccaucgucgucuccuuccucaucgccgcccucgccuccgucauggccggccucugcuacgccgaguucggcgcccgcguccccaagaccggcuccgccuaccucuacaccuacgucaccgucggcgagcucugggccuucaucaccggcuggaaccucauccucuccuacgucaucggcaccuccuccgucgcccgcgccugguccggcaccuucgacgagcuccucuccaagcagaucggccaguuccuccgcaccuacuuccgcaugaacuacaccggccucgccgaguaccccgacuucuucgccgucugccucauccuccuccucgccggccuccucuccuucggcgucaaggaguccgccugggucaacaaggucuucaccgccgucaacauccucguccuccucuucgucauggucgccggcuucgucaagggcaacgucgccaacuggaagaucuccgaggaguuccucaagaacaucuccgccuccgcccgcgagccccccuccgagaacggcaccuccaucuacggcgccggcggcuucaugcccuacggcuucaccggcacccucgccggcgccgccaccugcuucuacgccuucgucggcuucgacugcaucgccaccaccggcgaggagguccgcaacccccagaaggccauccccaucggcaucgucaccucccuccucgucugcuucauggccuacuucggcgucuccgccgcccucacccucaugaugcccuacuaccuccucgacgagaaguccccccuccccgucgccuucgaguacgucggcuggggccccgccaaguacgucgucgccgccggcucccucugcgcccucuccaccucccuccucggcuccaucuuccccaugccccgcgucaucuacgccauggccgaggacggccuccucuucaagugccucgcccagaucaacuccaagaccaagacccccaucaucgccacccucuccuccggcgccgucgccgcccucauggccuuccucuucgaccucaaggcccucgucgacaugauguccaucggcacccucauggccuacucccucgucgccgccugcguccucauccuccgcuaccagcccggccucuccuacgaccagcccaagugcucccccgagaaggacggccucggcuccuccccccgcgucaccuccaaguccgagucccaggucaccaugcuccagcgccagggcuucuccaugcgcacccucuucugccccucccuccuccccacccagcaguccgccucccucgucuccuuccucgucggcuuccucgccuuccucguccucggccucuccguccucaccaccuacggcguccacgccaucacccgccucgaggccuggucccucgcccuccucgcccucuuccucguccucuucgucgccaucguccucaccaucuggcgccagccccagaaccagcagaaggucgccuucaugguccccuuccuccccuuccuccccgccuucuccauccucgucaacaucuaccucaugguccagcucuccgccgacaccuggguccgcuucuccaucuggauggccaucggcuuccucaucuacuucuccuacggcauccgccacucccucgagggccaccuccgcgacgagaacaacgaggaggacgccuaccccgacaacguccacgccgccgccgaggagaaguccgccauccaggccaacgaccaccacccccgcaaccucuccucccccuucaucuuccacgagaagaccuccgaguucuga

SEQ ID NO: 49769 - RNA, 1860 nt, Artificial Sequence
  derived and/or modified sequence opt2 from SLC7A3__Homo_sapiens__NP_001041629
augcccuggcaggccuuccgccgcuucggccagaagcucguccgccgccgcacccucgaguccggcauggccgagacccgccucgcccgcugccucuccacccucgaccucgucgcccucggcgucggcuccacccucggcgccggcgucuacguccucgccggcgaggucgccaaggacaaggccggccccuccaucgucaucugcuuccucgucgccgcccucuccuccguccucgccggccucugcuacgccgaguucggcgcccgcgucccccgcuccggcuccgccuaccucuacuccuacgucaccgucggcgagcucugggccuucaccaccggcuggaaccucauccucuccuacgucaucggcaccgccuccgucgcccgcgccugguccuccgccuucgacaaccucaucggcaaccacaucuccaagacccuccagggcuccaucgcccuccacgucccccacguccucgccgaguaccccgacuucuucgcccucggccucguccuccuccucaccggccuccucgcccucggcgccuccgaguccgcccucgucaccaaggucuucaccggcgucaaccuccucguccucggcuucgucaugaucuccggcuucgucaagggcgacguccacaacuggaagcucaccgaggaggacuacgagcucgccauggccgagcucaacgacaccuacucccucggcccccucggcuccggcggcuucguccccuucggcuucgagggcauccuccgcggcgccgccaccugcuucuacgccuucgucggcuucgacugcaucgccaccaccggcgaggaggcccagaacccccagcgcuccauccccaugggcaucgucaucucccucuccgucugcuuccucgccuacuucgccgucuccuccgcccucacccucaugaugcccuacuaccagcuccagcccgaguccccccuccccgaggccuuccucuacaucggcugggcccccgcccgcuacgucgucgccgucggcucccucugcgcccucuccaccucccuccucggcuccauguuccccaugccccgcgucaucuacgccauggccgaggacggccuccucuuccgcguccucgcccgcauccacaccggcacccgcacccccaucaucgccaccgucgucuccggcaucaucgccgccuucauggccuuccucuucaagcucaccgaccucgucgaccucauguccaucggcacccuccucgccuacucccucgucuccaucugcguccucauccuccgcuaccagcccgaccaggagaccaagaccggcgaggaggucgagcuccaggaggaggccaucaccaccgaguccgagaagcucacccucuggggccucuucuucccccucaacuccauccccaccccccucuccggccagaucgucuacgucugcuccucccuccucgccguccuccucaccgcccucugccucguccucgcccagugguccgucccccuccucuccggcgaccuccucuggaccgccgucgucguccuccuccuccuccucaucaucggcaucaucgucgucaucuggcgccagccccaguccuccaccccccuccacuucaagguccccgcccucccccuccucccccucauguccaucuucgucaacaucuaccucaugaugcagaugaccgccggcaccugggcccgcuucggcgucuggaugcucaucggcuucgccaucuacuucggcuacggcauccagcacucccucgaggagaucaaguccaaccagcccucccgcaagucccgcgccaagaccgucgaccucgaccccggcacccucuacguccacuccgucuga

SEQ ID NO: 49770 - RNA, 1908 nt, Artificial Sequence
  derived and/or modified sequence opt2 from SLC7A4__Homo_sapiens__NP_004164
auggcccgcggccuccccaccaucgccucccucgcccgccucugccagaagcucaaccgccucaagccccucgaggacuccaccauggagaccucccuccgccgcugccucuccacccucgaccucacccuccucggcgucggcggcauggucggcuccggccucuacguccucaccggcgccgucgccaaggaggucgccggccccgccguccuccucuccuucggcgucgccgccgucgccucccuccucgccgcccucugcuacgccgaguucggcgcccgcgucccccgcaccggcuccgccuaccucuucaccuacgucuccaugggcgagcucugggccuuccucaucggcuggaacguccuccucgaguacaucaucggcggcgccgccgucgcccgcgccugguccggcuaccucgacuccauguucucccacuccauccgcaacuucaccgagacccacgucggcuccuggcaggucccccuccucggccacuaccccgacuuccucgccgccggcaucauccuccucgccuccgccuucgucuccugcggcgcccgcgucuccuccuggcucaaccacaccuucuccgccaucucccuccucgucauccucuucaucgucauccucggcuucauccucgcccagccccacaacugguccgccgacgagggcggcuucgcccccuucggcuucuccggcgucauggccggcaccgccuccugcuucuacgccuucgucggcuucgacgucaucgccgccuccuccgaggaggcccagaacccccgccgcuccgucccccucgccaucgccaucucccucgccaucgccgccggcgccuacauccucgucuccaccguccucacccucaugguccccuggcacucccucgaccccgacuccgcccucgccgacgccuucuaccagcgcggcuaccgcugggccggcuucaucgucgccgccggcuccaucugcgccaugaacaccguccuccucucccuccucuucucccucccccgcaucgucuacgccauggccgccgacggccucuucuuccaggucuucgcccacguccacccccgcacccagguccccgucgccggcacccucgccuucggccuccucaccgccuuccucgcccuccuccucgaccucgagucccucguccaguuccucucccucggcacccuccucgccuacaccuucgucgccaccuccaucaucguccuccgcuuccagaaguccuccccccccuccucccccggccccgccucccccggcccccucaccaagcagcaguccuccuucuccgaccaccuccagcucgucggcaccguccacgccuccguccccgagcccggcgagcucaagcccgcccuccgccccuaccucggcuuccucgacggcuacucccccggcgccgucgucaccugggcccucggcgucaugcucgccuccgccaucaccaucggcugcguccucgucuucggcaacuccacccuccaccucccccacuggggcuacauccuccuccuccuccucaccuccgucauguuccuccucucccuccucguccucggcgcccaccagcagcaguaccgcgaggaccucuuccagauccccauggucccccucauccccgcccucuccaucguccucaacaucugccucaugcucaagcucuccuaccucaccuggguccgcuucuccaucuggcuccucaugggccucgccgucuacuucggcuacggcauccgccacuccaaggagaaccagcgcgagcuccccggccucaacuccacccacuacgucgucuucccccgcggcucccucgaggagaccguccaggccaugcagccccccucccaggcccccgcccaggaccccggccacauggaguga

SEQ ID NO: 49771 - RNA, 1524 nt, Artificial Sequence
  derived and/or modified sequence opt2 from SLC7A5__Homo_sapiens__NP_003477
auggccggcgccggccccaagcgccgcgcccucgccgcccccgccgccgaggagaaggaggaggcccgcgagaagaugcucgccgccaaguccgccgacggcuccgcccccgccggcgagggcgagggcgucacccuccagcgcaacaucacccuccucaacggcgucgccaucaucgucggcaccaucaucggcuccggcaucuucgucacccccaccggcguccucaaggaggccggcucccccggccucgcccucgucgucugggccgccugcggcgucuucuccaucgucggcgcccucugcuacgccgagcucggcaccaccaucuccaaguccggcggcgacuacgccuacaugcucgaggucuacggcucccuccccgccuuccucaagcucuggaucgagcuccucaucauccgccccuccucccaguacaucgucgcccucgucuucgccaccuaccuccucaagccccucuuccccaccugccccguccccgaggaggccgccaagcucgucgccugccucugcguccuccuccucaccgccgucaacugcuacuccgucaaggccgccacccgcguccaggacgccuucgccgccgccaagcuccucgcccucgcccucaucauccuccucggcuucguccagaucggcaagggcgacgucuccaaccucgaccccaacuucuccuucgagggcaccaagcucgacgucggcaacaucguccucgcccucuacuccggccucuucgccuacggcggcuggaacuaccucaacuucgucaccgaggagaugaucaaccccuaccgcaaccucccccucgccaucaucaucucccuccccaucgucacccucgucuacguccucaccaaccucgccuacuucaccacccucuccaccgagcagaugcucuccuccgaggccgucgccgucgacuucggcaacuaccaccucggcgucauguccuggaucauccccgucuucgucggccucuccugcuucggcuccgucaacggcucccucuucaccuccucccgccucuucuucgucggcucccgcgagggccaccuccccuccauccucuccaugauccacccccagcuccucacccccguccccucccucgucuucaccugcgucaugacccuccucuacgccuucuccaaggacaucuucuccgucaucaacuucuucuccuucuucaacuggcucugcgucgcccucgccaucaucggcaugaucuggcuccgccaccgcaagcccgagcucgagcgccccaucaaggucaaccucgcccuccccgucuucuucauccucgccugccucuuccucaucgccgucuccuucuggaagacccccgucgagugcggcaucggcuucaccaucauccucuccggccuccccgucuacuucuucggcgucugguggaagaacaagcccaaguggcuccuccagggcaucuucuccaccaccguccucugccagaagcucaugcaggucgucccccaggagaccuga

SEQ ID NO: 49772 - RNA, 1548 nt, Artificial Sequence
  derived and/or modified sequence opt2 from SLC7A6__Homo_sapiens__NP_003974
auggaggcccgcgagcccggccgccccacccccaccuaccaccucguccccaacaccucccagucccaggucgaggaggacgucuccucccccccccagcgcuccuccgagaccaugcagcucaagaaggagaucucccuccucaacggcgucucccucgucgucggcaacaugaucggcuccggcaucuucgucucccccaagggcguccucguccacaccgccuccuacggcaugucccucaucgucugggccaucggcggccucuucuccgucgucggcgcccucugcuacgccgagcucggcaccaccaucaccaaguccggcgccuccuacgccuacauccucgaggccuucggcggcuucaucgccuucauccgccucugggucucccuccucgucgucgagcccaccggccaggccaucaucgccaucaccuucgccaacuacaucauccagcccuccuuccccuccugcgacccccccuaccucgccugccgccuccucgccgccgccugcaucugccuccucaccuucgucaacugcgccuacgucaaguggggcacccgcguccaggacaccuucaccuacgccaaggucgucgcccucaucgccaucaucgucaugggccucgucaagcucugccagggccacuccgagcacuuccaggacgccuucgagggcuccuccugggacaugggcaaccucucccucgcccucuacuccgcccucuucuccuacuccggcugggacacccucaacuucgucaccgaggagaucaagaaccccgagcgcaaccucccccucgccaucggcaucuccaugcccaucgucacccucaucuacauccucaccaacgucgccuacuacaccguccucaacaucuccgacguccucuccuccgacgccgucgccgucaccuucgccgaccagaccuucggcauguucuccuggaccauccccaucgccgucgcccucuccugcuucggcggccucaacgccuccaucuucgccuccucccgccucuucuucgucggcucccgcgagggccaccuccccgaccuccucuccaugauccacaucgagcgcuucacccccauccccgcccuccucuucaacugcaccauggcccucaucuaccucaucgucgaggacgucuuccagcucaucaacuacuucuccuucuccuacugguucuucgucggccucuccgucgucggccagcucuaccuccgcuggaaggagcccaagcgcccccgcccccucaagcucuccgucuucuuccccaucgucuucugcaucugcuccgucuuccucgucaucgucccccucuucaccgacaccaucaacucccucaucggcaucggcaucgcccucuccggcguccccuucuacuucaugggcgucuaccuccccgagucccgccgcccccucuucauccgcaacguccucgccgccaucacccgcggcacccagcagcucugcuucugcguccucaccgagcucgacgucgccgaggagaagaaggacgagcgcaagaccgacuga

SEQ ID NO: 49773 - RNA, 1536 nt, Artificial Sequence
  derived and/or modified sequence opt2 from SLC7A7__Homo_sapiens__XP_011535601
auggucgacuccaccgaguacgaggucgccucccagcccgaggucgagaccuccccccucggcgacggcgccucccccggccccgagcaggucaagcucaagaaggagaucucccuccucaacggcgucugccucaucgucggcaacaugaucggcuccggcaucuucgucucccccaagggcguccucaucuacuccgccuccuucggccucucccucgucaucugggccgucggcggccucuucuccgucuucggcgcccucugcuacgccgagcucggcaccaccaucaagaaguccggcgccuccuacgccuacauccucgaggccuucggcggcuuccucgccuucauccgccucuggaccucccuccucaucaucgagcccaccucccaggccaucaucgccaucaccuucgccaacuacaugguccagccccucuuccccuccugcuucgcccccuacgccgccucccgccuccucgccgccgccugcaucugccuccucaccuucaucaacugcgccuacgucaaguggggcacccucguccaggacaucuucaccuacgccaagguccucgcccucaucgccgucaucgucgccggcaucguccgccucggccagggcgccuccacccacuucgagaacuccuucgagggcuccuccuucgccgucggcgacaucgcccucgcccucuacuccgcccucuucuccuacuccggcugggacacccucaacuacgucaccgaggagaucaagaaccccgagcgcaaccucccccucuccaucggcaucuccaugcccaucgucaccaucaucuacauccucaccaacgucgccuacuacaccguccucgacaugcgcgacauccucgccuccgacgccgucgccgucaccuucgccgaccagaucuucggcaucuucaacuggaucaucccccucuccgucgcccucuccugcuucggcggccucaacgccuccaucgucgccgccucccgccucuucuucgucggcucccgcgagggccaccuccccgacgccaucugcaugauccacgucgagcgcuucacccccguccccucccuccucuucaacggcaucauggcccucaucuaccucugcgucgaggacaucuuccagcucaucaacuacuacuccuucuccuacugguucuucgucggccucuccaucgucggccagcucuaccuccgcuggaaggagcccgaccgcccccgcccccucaagcucuccgucuucuuccccaucgucuucugccucugcaccaucuuccucgucgccgucccccucuacuccgacaccaucaacucccucaucggcaucgccaucgcccucuccggccuccccuucuacuuccucaucauccgcguccccgagcacaagcgcccccucuaccuccgccgcaucgucggcuccgccacccgcuaccuccagguccucugcauguccgucgccgccgagauggaccucgaggacggcggcgagaugcccaagcagcgcgaccccaaguccaacuga

SEQ ID NO: 49774 - RNA, 1293 nt, Artificial Sequence
  derived and/or modified sequence opt2 from SLC7A8__Homo_sapiens__NP_001253965
augggccaguacggccaggagcucuccuggaagugccucgucaaggccgucugccuccaggagcacucccagcccucccagcuccucugcacccuccuccucugcuggugcguccucggccgcgagcgccccuuccgcaaggcccaguccaccuccuccccccucgagggcgucccccgcuuccucaagcgccuccuccucaccugggucaacugcuccuccguccgcugggccacccgcguccaggacaucuucaccgccggcaagcuccucgcccucgcccucaucaucaucaugggcaucguccagaucugcaagggcgaguacuucuggcucgagcccaagaacgccuucgagaacuuccaggagcccgacaucggccucgucgcccucgccuuccuccagggcuccuucgccuacggcggcuggaacuuccucaacuacgucaccgaggagcucgucgaccccuacaagaaccucccccgcgccaucuucaucuccaucccccucgucaccuucgucuacgucuucgccaacgucgccuacgucaccgccauguccccccaggagcuccucgccuccaacgccgucgccgucaccuucggcgagaagcuccucggcgucauggccuggaucaugcccaucuccgucgcccucuccaccuucggcggcgucaacggcucccucuucaccuccucccgccucuucuucgccggcgcccgcgagggccaccuccccuccguccucgccaugauccacgucaagcgcugcacccccauccccgcccuccucuucaccugcaucuccacccuccucaugcucgucaccuccgacauguacacccucaucaacuacgucggcuucaucaacuaccucuucuacggcgucaccgucgccggccagaucguccuccgcuggaagaagcccgacaucccccgccccaucaagaucaaccuccucuuccccaucaucuaccuccucuucugggccuuccuccucgucuucucccucugguccgagcccgucgucugcggcaucggccucgccaucaugcucaccggcguccccgucuacuuccucggcgucuacuggcagcacaagcccaagugcuucuccgacuucaucgagcuccucacccucgucucccagaagaugugcgucgucgucuaccccgaggucgagcgcggcuccggcaccgaggaggccaacgaggacauggaggagcagcagcagcccauguaccagcccacccccaccaaggacaaggacgucgccggccagccccagcccuga

SEQ ID NO: 49775 - RNA, 1464 nt, Artificial Sequence
  derived and/or modified sequence opt2 from SLC7A9__Homo_sapiens__XP_011524704
augggcgacaccggccuccgcaagcgccgcgaggacgagaaguccauccagucccaggagcccaagaccaccucccuccagaaggagcucggccucaucuccggcaucuccaucaucgucggcaccaucaucggcuccggcaucuucgucucccccaaguccguccucuccaacaccgaggccgucggccccugccucaucaucugggccgccugcggcguccucgccacccucggcgcccucugcuucgccgagcucggcaccaugaucaccaaguccggcggcgaguaccccuaccucauggaggccuacggccccauccccgccuaccucuucuccugggccucccucaucgucaucaagcccaccuccuucgccaucaucugccucuccuucuccgaguacgucugcgcccccuucuacgucggcugcaagcccccccagaucgucgucaagugccucgccgccgccgccauccucuucaucuccaccgucaacucccucuccguccgccucggcuccuacguccagaacaucuucaccgccgccaagcucgucaucgucgccaucaucaucaucuccggccucguccuccucgcccagggcaacaccaagaacuucgacaacuccuucgagggcgcccagcucuccgucggcgccaucucccucgccuucuacaacggccucugggccuacgacggcuggaaccagcucaacuacaucaccgaggagcuccgcaaccccuaccgcaaccucccccucgccaucaucaucggcaucccccucgucaccgccugcuacauccucaugaacgucuccuacuucaccgucaugaccgccaccgagcuccuccagucccaggccgucgccgucaccuucggcgaccgcguccucuaccccgccuccuggaucgucccccucuucgucgccuucuccaccaucggcgccgccaacggcaccugcuucaccgccggccgccucaucuacgucgccggccgcgagggccacaugcucaagguccucuccuacaucuccguccgccgccucacccccgcccccgccaucaucuucuacggcaucaucgccaccaucuacaucauccccggcgacaucaacucccucgucaacuacuucuccuucgccgccuggcucuucuacggccucaccauccucggccucaucgucaugcgcuucacccgcaaggagcucgagcgccccaucaagguccccgucgucauccccguccucaugacccucaucuccgucuuccucguccucgcccccaucaucuccaagcccaccugggaguaccucuacugcguccucuucauccucuccggccuccucuucuacuuccucuucguccacuacaaguucggcugggcccagaagaucuccaagcccaucaccaugcaccuccagaugcucauggaggucgucccccccgaggaggaccccgaguga

SEQ ID NO: 49776 - RNA, 2907 nt, Artificial Sequence
  derived and/or modified sequence opt2 from SLC8A1__Homo_sapiens__NP_001106271
auguacaacaugcgccgccucucccucucccccaccuucuccaugggcuuccaccuccucgucaccgucucccuccucuucucccacgucgaccacgucaucgccgagaccgagauggagggcgagggcaacgagaccggcgagugcaccggcuccuacuacugcaagaagggcgucauccuccccaucugggagccccaggaccccuccuucggcgacaagaucgcccgcgccaccgucuacuucgucgccauggucuacauguuccucggcgucuccaucaucgccgaccgcuucauguccuccaucgaggucaucaccucccaggagaaggagaucaccaucaagaagcccaacggcgagaccaccaagaccaccguccgcaucuggaacgagaccgucuccaaccucacccucauggcccucggcuccuccgcccccgagauccuccucuccgucaucgaggucugcggccacaacuucaccgccggcgaccucggccccuccaccaucgucggcuccgccgccuucaacauguucaucaucaucgcccucugcgucuacgucguccccgacggcgagacccgcaagaucaagcaccuccgcgucuucuucgucaccgccgccugguccaucuucgccuacaccuggcucuacaucauccucuccgucaucucccccggcgucgucgaggucugggagggccuccucaccuucuucuucuuccccaucugcgucgucuucgccugggucgccgaccgccgccuccucuucuacaaguacgucuacaagcgcuaccgcgccggcaagcagcgcggcaugaucaucgagcacgagggcgaccgccccuccuccaagaccgagaucgagauggacggcaaggucgucaacucccacgucgagaacuuccucgacggcgcccucguccucgaggucgacgagcgcgaccaggacgacgaggaggcccgccgcgagauggcccgcauccucaaggagcucaagcagaagcaccccgacaaggagaucgagcagcucaucgagcucgccaacuaccagguccucucccagcagcagaagucccgcgccuucuaccgcauccaggccacccgccucaugaccggcgccggcaacauccucaagcgccacgccgccgaccaggcccgcaaggccgucuccaugcacgaggucaacaccgaggucaccgagaacgaccccgucuccaagaucuucuucgagcagggcaccuaccagugccucgagaacugcggcaccgucgcccucaccaucauccgccgcggcggcgaccucaccaacaccgucuucgucgacuuccgcaccgaggacggcaccgccaacgccggcuccgacuacgaguucaccgagggcaccgucgucuucaagcccggcgacacccagaaggagauccgcgucggcaucaucgacgacgacaucuucgaggaggacgagaacuuccucguccaccucuccaacgucaaggucuccuccgaggccuccgaggacggcauccucgaggccaaccacgucuccacccucgccugccucggcucccccuccaccgccaccgucaccaucuucgacgacgaccacgccggcaucuucaccuucgaggagcccgucacccacgucuccgaguccaucggcaucauggaggucaagguccuccgcaccuccggcgcccgcggcaacgucaucguccccuacaagaccaucgagggcaccgcccgcggcggcggcgaggacuucgaggacaccugcggcgagcucgaguuccagaacgacgagaucgucaagaccaucuccgucaaggucaucgacgacgaggaguacgagaagaacaagaccuucuuccucgagaucggcgagccccgccucgucgagauguccgagaagaaggcccuccuccucaacgagcucggcggcuucaccaucaccggccagcccgucuuccgcaagguccacgcccgcgagcaccccauccucuccaccgucaucaccaucgccgacgaguacgacgacaagcagccccucaccuccaaggaggaggaggagcgccgcaucgccgagaugggccgccccauccucggcgagcacaccaagcucgaggucaucaucgaggaguccuacgaguucaaguccaccgucgacaagcucaucaagaagaccaaccucgcccucgucgucggcaccaacuccuggcgcgagcaguucaucgaggccaucaccgucuccgccggcgaggacgacgacgacgacgagugcggcgaggagaagcuccccuccugcuucgacuacgucaugcacuuccucaccgucuucuggaagguccucuucgccuucgucccccccaccgaguacuggaacggcugggccugcuucaucgucuccauccucaugaucggccuccucaccgccuucaucggcgaccucgccucccacuucggcugcaccaucggccucaaggacuccgucaccgccgucgucuucgucgcccucggcaccuccguccccgacaccuucgccuccaaggucgccgccacccaggaccaguacgccgacgccuccaucggcaacgucaccggcuccaacgccgucaacgucuuccucggcaucggcgucgccugguccaucgccgccaucuaccacgccgccaacggcgagcaguucaaggucucccccggcacccucgccuucuccgucacccucuucaccaucuucgccuucaucaacgucggcguccuccucuaccgccgccgccccgagaucggcggcgagcucggcggcccccgcaccgccaagcuccucaccuccugccucuucguccuccucuggcuccucuacaucuucuucuccucccucgaggccuacugccacaucaagggcuucuga

SEQ ID NO: 49777 - RNA, 2766 nt, Artificial Sequence
  derived and/or modified sequence opt2 from SLC8A2__Homo_sapiens__NP_055878
auggccccccucgcccucgucggcgucacccuccuccucgccgccccccccugcuccggcgccgccacccccacccccucccucccccccccccccgccaacgacuccgacaccuccaccggcggcugccagggcuccuaccgcugccagcccggcguccuccuccccgucugggagcccgacgaccccucccucggcgacaaggccgcccgcgccgucgucuacuucgucgccauggucuacauguuccucggcgucuccaucaucgccgaccgcuucauggccgccaucgaggucaucaccuccaaggagaaggagaucaccaucaccaaggccaacggcgagaccuccgucggcaccguccgcaucuggaacgagaccgucuccaaccucacccucauggcccucggcuccuccgcccccgagauccuccucuccgucaucgaggucugcggccacaacuuccaggccggcgagcucggccccggcaccaucgucggcuccgccgccuucaacauguucgucgucaucgccgucugcaucuacgucauccccgccggcgagucccgcaagaucaagcaccuccgcgucuucuucgucaccgccuccugguccaucuucgccuacgucuggcucuaccucauccucgccgucuucucccccggcgucguccaggucugggaggcccuccucacccucgucuucuuccccgucugcgucgucuucgccuggauggccgacaagcgccuccucuucuacaaguacgucuacaagcgcuaccgcaccgacccccgcuccggcaucaucaucggcgccgagggcgacccccccaaguccaucgagcucgacggcaccuucgucggcgccgaggcccccggcgagcucggcggccucggccccggccccgccgaggcccgcgagcucgacgccucccgccgcgaggucauccagauccucaaggaccucaagcagaagcaccccgacaaggaccucgagcagcucgucggcaucgccaacuacuacgcccuccuccaccagcagaagucccgcgccuucuaccgcauccaggccacccgccucaugaccggcgccggcaacguccuccgccgccacgccgccgacgccucccgccgcgccgcccccgccgagggcgccggcgaggacgaggacgacggcgccucccgcaucuucuucgagcccucccucuaccacugccucgagaacugcggcuccguccuccucuccgucaccugccagggcggcgagggcaacuccaccuucuacgucgacuaccgcaccgaggacggcuccgccaaggccggcuccgacuacgaguacuccgagggcacccucgucuucaagcccggcgagacccagaaggagcuccgcaucggcaucaucgacgacgacaucuucgaggaggacgagcacuucuucguccgccuccucaaccuccgcgucggcgacgcccagggcauguucgagcccgacggcggcggccgccccaagggccgccucgucgccccccuccucgccaccgucaccauccucgacgacgaccacgccggcaucuucuccuuccaggaccgccuccuccacgucuccgagugcaugggcaccgucgacguccgcgucguccgcuccuccggcgcccgcggcaccguccgccuccccuaccgcaccgucgacggcaccgcccgcggcggcggcguccacuacgaggacgccugcggcgagcucgaguucggcgacgacgagaccaugaagacccuccaggucaagaucgucgacgacgaggaguacgagaagaaggacaacuucuucaucgagcucggccagccccaguggcucaagcgcggcaucuccgcccuccuccucaaccagggcgacggcgaccgcaagcucaccgccgaggaggaggaggcccgccgcaucgccgagaugggcaagcccguccucggcgagaacugccgccucgaggucaucaucgaggaguccuacgacuucaagaacaccgucgacaagcucaucaagaagaccaaccucgcccucgucaucggcacccacuccuggcgcgagcaguuccucgaggccaucaccgucuccgccggcgacgaggaggaggaggaggacggcucccgcgaggagcgccuccccuccugcuucgacuacgucaugcacuuccucaccgucuucuggaagguccucuucgccugcgucccccccaccgaguacugccacggcugggccugcuucggcgucuccauccucgucaucggccuccucaccgcccucaucggcgaccucgccucccacuucggcugcaccgucggccucaaggacuccgucaacgccgucgucuucgucgcccucggcaccuccauccccgacaccuucgccuccaaggucgccgcccuccaggaccagugcgccgacgccuccaucggcaacgucaccggcuccaacgccgucaacgucuuccucggccucggcgucgccugguccgucgccgccgucuacugggccguccagggccgccccuucgagguccgcaccggcacccucgccuucuccgucacccucuucaccgucuucgccuucgucggcaucgccguccuccucuaccgccgccgcccccacaucggcggcgagcucggcggcccccgcggccccaagcucgccaccaccgcccucuuccucggccucuggcuccucuacauccucuucgccucccucgaggccuacugccacauccgcggcuucuga

SEQ ID NO: 49778 - RNA, 897 nt, Artificial Sequence
  derived and/or modified sequence opt2 from SLC8A3__Homo_sapiens__NP_001123889
auggagcgcggcaucuccgacgucaccgaccgcaagcucaccauggaggaggaggaggccaagcgcaucgccgagaugggcaagcccguccucggcgagcaccccaagcucgaggucaucaucgaggaguccuacgaguucaagaccaccgucgacaagcucaucaagaagaccaaccucgcccucgucgucggcacccacuccuggcgcgaccaguucauggaggccaucaccgucuccgccgccggcgacgaggacgaggacgaguccggcgaggagcgccuccccuccugcuucgacuacgucaugcacuuccucaccgucuucuggaagguccucuucgccugcgucccccccaccgaguacugccacggcugggccugcuucgccgucuccauccucaucaucggcaugcucaccgccaucaucggcgaccucgccucccacuucggcugcaccaucggccucaaggacuccgucaccgccgucgucuucgucgccuucggcaccuccguccccgacaccuucgccuccaaggccgccgcccuccaggacgucuacgccgacgccuccaucggcaacgucaccggcuccaacgccgucaacgucuuccucggcaucggccucgccugguccgucgccgccaucuacugggcccuccagggccaggaguuccacgucuccgccggcacccucgccuucuccgucacccucuucaccaucuucgccuucgucugcaucuccguccuccucuaccgccgccgcccccaccucggcggcgagcucggcggcccccgcggcugcaagcucgccaccaccuggcucuucgucucccucuggcuccucuacauccucuucgccacccucgaggccuacugcuacaucaagggcuucuga

SEQ ID NO: 49779 - RNA, 2118 nt, Artificial Sequence
  derived and/or modified sequence opt2 from SLC9A1__Homo_sapiens__XP_011540323
augggcaaggacgccugccccggcuuccacgucauccccaccaucuccuccaucguccccgaguccugccuccucaucgucgucggccuccucgucggcggccucaucaagggcgucggcgagaccccccccuuccuccaguccgacgucuucuuccucuuccuccucccccccaucauccucgacgccggcuacuuccucccccuccgccaguucaccgagaaccucggcaccauccucaucuucgccgucgucggcacccucuggaacgccuucuuccucggcggccucauguacgccgucugccucgucggcggcgagcagaucaacaacaucggccuccucgacaaccuccucuucggcuccaucaucuccgccgucgaccccgucgccguccucgccgucuucgaggagauccacaucaacgagcuccuccacauccucgucuucggcgagucccuccucaacgacgccgucaccgucguccucuaccaccucuucgaggaguucgccaacuacgagcacgucggcaucgucgacaucuuccucggcuuccucuccuucuucgucgucgcccucggcggcguccucgucggcgucgucuacggcgucaucgccgccuucaccucccgcuucaccucccacauccgcgucaucgagccccucuucgucuuccucuacuccuacauggccuaccucuccgccgagcucuuccaccucuccggcaucauggcccucaucgccuccggcgucgucaugcgccccuacgucgaggccaacaucucccacaagucccacaccaccaucaaguacuuccucaagaugugguccuccgucuccgagacccucaucuucaucuuccucggcgucuccaccgucgccggcucccaccacuggaacuggaccuucgucaucuccacccuccucuucugccucaucgcccgcguccucggcguccucggccucaccugguucaucaacaaguuccgcaucgucaagcucacccccaaggaccaguucaucaucgccuacggcggccuccgcggcgccaucgccuucucccucggcuaccuccucgacaagaagcacuuccccaugugcgaccucuuccucaccgccaucaucaccgucaucuucuucaccgucuucguccagggcaugaccauccgcccccucgucgaccuccucgccgucaagaagaagcaggagaccaagcgcuccaucaacgaggagauccacacccaguuccucgaccaccuccucaccggcaucgaggacaucugcggccacuacggccaccaccacuggaaggacaagcucaaccgcuucaacaagaaguacgucaagaagugccucaucgccggcgagcgcuccaaggagccccagcucaucgccuucuaccacaagauggagaugaagcaggccaucgagcucgucgaguccggcggcaugggcaagauccccuccgccgucuccaccgucuccaugcagaacauccaccccaagucccuccccuccgagcgcauccuccccgcccucuccaaggacaaggaggaggagauccgcaagauccuccgcaacaaccuccagaagacccgccagcgccuccgcuccuacaaccgccacacccucgucgccgaccccuacgaggaggccuggaaccagaugcuccuccgccgccagaaggcccgccagcucgagcagaagaucaacaacuaccucaccguccccgcccacaagcucgacucccccaccaugucccgcgcccgcaucggcuccgacccccucgccuacgagcccaaggaggaccuccccgucaucaccaucgaccccgccuccccccagucccccgaguccgucgaccucgucaacgaggagcucaagggcaagguccucggccucucccgcgaccccgccaaggucgccgaggaggacgaggacgacgacggcggcaucaugaugcgcuccaaggagaccuccucccccggcaccgacgacgucuucacccccgcccccuccgacucccccuccucccagcgcauccagcgcugccucuccgaccccggcccccaccccgagcccggcgagggcgagcccuucuuccccaagggccaguga

SEQ ID NO: 49780 - RNA, 2439 nt, Artificial Sequence
  derived and/or modified sequence opt2 from SLC9A2__Homo_sapiens__NP_003039
auggagccccucggcaacuggcgcucccuccgcgccccccucccccccaugcuccuccuccuccuccuccaggucgccggccccgucggcgcccucgccgagacccuccucaacgccccccgcgccaugggcaccuccuccuccccccccucccccgccuccgucgucgcccccggcaccacccucuucgaggagucccgccuccccgucuucacccucgacuacccccacguccagauccccuucgagaucacccucuggauccuccucgccucccucgccaagaucggcuuccaccucuaccacaagcuccccaccaucguccccgaguccugccuccucaucauggucggccuccuccucggcggcaucaucuucggcgucgacgagaaguccccccccgccaugaagaccgacgucuucuuccucuaccuccucccccccaucguccucgacgccggcuacuucaugcccacccgccccuucuucgagaacaucggcaccaucuucugguacgccgucgucggcacccucuggaacuccaucggcaucggcgucucccucuucggcaucugccagaucgaggccuucggccucuccgacaucacccuccuccagaaccuccucuucggcucccucaucuccgccgucgaccccgucgccguccucgccgucuucgagaacauccacgucaacgagcagcucuacauccucgucuucggcgagucccuccucaacgacgccgucaccgucguccucuacaaccucuucaaguccuucugccagaugaagaccaucgagaccaucgacgucuucgccggcaucgccaacuucuucgucgucggcaucggcggcguccucaucggcaucuuccucggcuucaucgccgccuucaccacccgcuucacccacaacauccgcgucaucgagccccucuucgucuuccucuacuccuaccucuccuacaucaccgccgagauguuccaccucuccggcaucauggccaucaccgccugcgccaugaccaugaacaaguacgucgaggagaacgucucccagaaguccuacaccaccaucaaguacuucaugaagaugcucuccuccgucuccgagacccucaucuucaucuucaugggcgucuccaccgucggcaagaaccacgaguggaacugggccuucgucugcuucacccucgccuucugccucauguggcgcgcccucggcgucuucguccucacccaggucaucaaccgcuuccgcaccaucccccucaccuucaaggaccaguucaucaucgccuacggcggccuccgcggcgccaucugcuucgcccucgucuuccuccuccccgccgccgucuucccccgcaagaagcucuucaucaccgccgccaucgucgucaucuucuucaccgucuucauccucggcaucaccauccgcccccucgucgaguuccucgacgucaagcgcuccaacaagaagcagcaggccgucuccgaggagaucuacugccgccucuucgaccacgucaagaccggcaucgaggacgucugcggccacuggggccacaacuucuggcgcgacaaguucaagaaguucgacgacaaguaccuccgcaagcuccucauccgcgagaaccagcccaaguccuccaucgucucccucuacaagaagcucgagaucaagcacgccaucgagauggccgagaccggcaugaucuccaccguccccaccuucgccucccucaacgacugccgcgaggagaagauccgcaaggucaccuccuccgagaccgacgagauccgcgagcuccucucccgcaaccucuaccagauccgccagcgcacccucuccuacaaccgccacucccucaccgccgacaccuccgagcgccaggccaaggagauccucauccgccgccgccacucccuccgcgaguccauccgcaaggacuccucccucaaccgcgagcaccgcgccuccaccuccaccucccgcuaccucucccuccccaagaacaccaagcuccccgagaagcuccagaagcgccgcaccaucuccaucgccgacggcaacuccuccgacuccgacgccgacgccggcaccaccguccucaaccuccagccccgcgcccgccgcuuccuccccgagcaguucuccaagaaguccccccaguccuacaagauggaguggaagaacgaggucgacgucgacuccggccgcgacaugcccuccaccccccccaccccccacucccgcgagaagggcacccagaccuccggccuccuccagcagccccuccucuccaaggaccaguccggcuccgagcgcgaggacucccucaccgagggcaucccccccaagccccccccccgccucgucuggcgcgccuccgagcccggcucccgcaaggcccgcuucggcuccgagaagcccuga

SEQ ID NO: 49781 - RNA, 2505 nt, Artificial Sequence
  derived and/or modified sequence opt2 from SLC9A3__Homo_sapiens__NP_004165
auguggggccucggcgcccgcggccccgaccgcggccuccuccucgcccucgcccucggcggccucgcccgcgccggcggcgucgaggucgagcccggcggcgcccacggcgaguccggcggcuuccaggucgucaccuucgagugggcccacguccaggaccccuacgucaucgcccucuggauccucgucgccucccucgccaagaucggcuuccaccucucccacaaggucaccuccgucguccccgaguccgcccuccucaucguccucggccucguccucggcggcaucgucugggccgccgaccacaucgccuccuucacccucacccccaccgucuucuucuucuaccuccucccccccaucguccucgacgccggcuacuucaugcccaaccgccucuucuucggcaaccucggcaccauccuccucuacgccgucgucggcaccgucuggaacgccgccaccaccggccucucccucuacggcgucuuccucuccggccucaugggcgaccuccagaucggccuccucgacuuccuccucuucggcucccucauggccgccgucgaccccgucgccguccucgccgucuucgaggagguccacgucaacgagguccucuucaucaucgucuucggcgagucccuccucaacgacgccgucaccgucguccucuacaacgucuucgaguccuucgucgcccucggcggcgacaacgucaccggcgucgacugcgucaagggcaucgucuccuucuucgucgucucccucggcggcacccucgucggcgucgucuucgccuuccuccucucccucgucacccgcuucaccaagcacguccgcaucaucgagcccggcuucgucuucaucaucuccuaccucuccuaccucaccuccgagaugcucucccucuccgccauccucgccaucaccuucugcggcaucugcugccagaaguacgucaaggccaacaucuccgagcaguccgccaccaccguccgcuacaccaugaagaugcucgccuccuccgccgagaccaucaucuucauguuccucggcaucuccgccgucaaccccuucaucuggaccuggaacaccgccuucguccuccucacccucgucuucaucuccgucuaccgcgccaucggcgucguccuccagaccuggcuccucaaccgcuaccgcaugguccagcucgagcccaucgaccaggucguccucuccuacggcggccuccgcggcgccgucgccuucgcccucgucguccuccucgacggcgacaaggucaaggagaagaaccucuucgucuccaccaccaucaucgucgucuucuucaccgucaucuuccagggccucaccaucaagccccucguccaguggcucaaggucaagcgcuccgagcaccgcgagccccgccucaacgagaagcuccacggccgcgccuucgaccacauccucuccgccaucgaggacaucuccggccagaucggccacaacuaccuccgcgacaaguggucccacuucgaccgcaaguuccucucccgcguccucaugcgccgcuccgcccagaagucccgcgaccgcauccucaacgucuuccacgagcucaaccucaaggacgccaucuccuacgucgccgagggcgagcgccgcggcucccucgccuucauccgcucccccuccaccgacaacgucgucaacgucgacuucaccccccgcuccuccaccgucgaggccuccgucuccuaccuccuccgcgagaacgucuccgccgucugccucgacaugcagucccucgagcagcgccgccgcuccauccgcgacgccgaggacauggucacccaccacacccuccagcaguaccucuacaagccccgccaggaguacaagcaccucuacucccgccacgagcucacccccaccgaggacgagaagcaggaccgcgagaucuuccaccgcaccaugcgcaagcgccucgaguccuucaaguccaccaagcucggccucaaccagaacaagaaggccgccaagcucuacaagcgcgagcgcgcccagaagcgccgcaacuccuccauccccaacggcaagcuccccauggagucccccgcccagaacuucaccaucaaggagaaggaccucgagcucuccgacaccgaggagccccccaacuacgacgaggagauguccggcggcaucgaguuccucgccuccgucaccaaggacaccgccuccgacucccccgccggcaucgacaaccccgucuucucccccgacgaggcccucgaccgcucccuccucgcccgccucccccccuggcucucccccggcgagaccgucguccccucccagcgcgcccgcacccagauccccuacucccccggcaccuucugccgccucaugcccuuccgccucuccuccaaguccgucgacuccuuccuccaggccgacggccccgaggagcgcccccccgccgcccuccccgaguccacccacauguga

SEQ ID NO: 49782 - RNA, 1077 nt, Artificial Sequence
  derived and/or modified sequence opt2 from SLC9A3R1__Homo_sapiens__NP_004243
auguccgccgacgccgccgccggcgccccccucccccgccucugcugccucgagaagggccccaacggcuacggcuuccaccuccacggcgagaagggcaagcucggccaguacauccgccucgucgagcccggcucccccgccgagaaggccggccuccucgccggcgaccgccucgucgaggucaacggcgagaacgucgagaaggagacccaccagcaggucgucucccgcauccgcgccgcccucaacgccguccgccuccucgucgucgaccccgagaccgacgagcagcuccagaagcucggcguccagguccgcgaggagcuccuccgcgcccaggaggcccccggccaggccgagccccccgccgccgccgagguccagggcgccggcaacgagaacgagccccgcgaggccgacaagucccaccccgagcagcgcgagcuccgcccccgccucugcaccaugaagaagggccccuccggcuacggcuucaaccuccacuccgacaaguccaagcccggccaguucauccgcuccgucgaccccgacucccccgccgaggccuccggccuccgcgcccaggaccgcaucgucgaggucaacggcgucugcauggagggcaagcagcacggcgacgucgucuccgccauccgcgccggcggcgacgagaccaagcuccucgucgucgaccgcgagaccgacgaguucuucaagaagugccgcgucauccccucccaggagcaccucaacggcccccuccccguccccuucaccaacggcgagauccagaaggagaacucccgcgaggcccucgccgaggccgcccucgaguccccccgccccgcccucguccgcuccgccuccuccgacaccuccgaggagcucaacucccaggacuccccccccaagcaggacuccaccgcccccuccuccaccuccuccuccgaccccauccucgacuucaacaucucccucgccauggccaaggagcgcgcccaccagaagcgcuccuccaagcgcgccccccagauggacugguccaagaagaacgagcucuucuccaaccucuga

SEQ ID NO: 49783 - RNA, 1014 nt, Artificial Sequence
  derived and/or modified sequence opt2 from SLC9A3R2__Homo_sapiens__NP_001123484
auggccgcccccgagccccuccgcccccgccucugccgccucguccgcggcgagcagggcuacggcuuccaccuccacggcgagaagggccgccgcggccaguucauccgccgcgucgagcccggcucccccgccgaggccgccgcccuccgcgccggcgaccgccucgucgaggucaacggcgucaacgucgagggcgagacccaccaccaggucguccagcgcaucaaggccgucgagggccagacccgccuccucgucgucgaccaggagaccgacgaggagcuccgccgccgccagcucaccugcaccgaggagauggcccagcgcggccucccccccgcccacgaccccugggagcccaagcccgacugggcccacaccggcucccacuccuccgaggccggcaagaaggacgucuccggcccccuccgcgagcuccgcccccgccucugccaccuccgcaagggcccccagggcuacggcuucaaccuccacuccgacaagucccgccccggccaguacauccgcuccgucgaccccggcucccccgccgcccgcuccggccuccgcgcccaggaccgccucaucgaggucaacggccagaacgucgagggccuccgccacgccgaggucgucgccuccaucaaggcccgcgaggacgaggcccgccuccucgucgucgaccccgagaccgacgagcacuucaagcgccuccgcgucacccccaccgaggagcacgucgagggcccccuccccucccccgucaccaacggcaccucccccgcccagcucaacggcggcuccgccugcuccucccgcuccgaccuccccggcuccgacaaggacaccgaggacggcuccgccuggaagcaggaccccuuccaggaguccggccuccaccucucccccaccgccgccgaggccaaggagaaggcccgcgccaugcgcgucaacaagcgcgccccccagauggacuggaaccgcaagcgcgagaucuucuccaacuucuga

SEQ ID NO: 49784 - RNA, 2397 nt, Artificial Sequence
  derived and/or modified sequence opt2 from SLC9A4__Homo_sapiens__NP_001011552
auggcccuccagauguucgucaccuacucccccuggaacugccuccuccuccucgucgcccucgagugcuccgaggccuccuccgaccucaacgaguccgccaacuccaccgcccaguacgccuccaacgccugguucgccgccgccuccuccgagcccgaggagggcaucuccgucuucgagcucgacuacgacuacguccagauccccuacgaggucacccucuggauccuccucgccucccucgccaagaucggcuuccaccucuaccaccgccuccccggccucaugcccgaguccugccuccucauccucgucggcgcccucgucggcggcaucaucuucggcaccgaccacaaguccccccccgucauggacuccuccaucuacuuccucuaccuccucccccccaucguccucgagggcggcuacuucaugcccacccgccccuucuucgagaacaucggcuccauccucuggugggccguccucggcgcccucaucaacgcccucggcaucggccucucccucuaccucaucugccaggucaaggccuucggccucggcgacgucaaccuccuccagaaccuccucuucggcucccucaucuccgccgucgaccccgucgccguccucgccgucuucgaggaggcccgcgucaacgagcagcucuacaugaugaucuucggcgaggcccuccucaacgacggcaucaccgucguccucuacaacaugcucaucgccuucaccaagaugcacaaguucgaggacaucgagaccgucgacauccucgccggcugcgcccgcuucaucgucgucggccucggcggcguccucuucggcaucgucuucggcuucaucuccgccuucaucacccgcuucacccagaacaucuccgccaucgagccccucaucgucuucauguucuccuaccucuccuaccucgccgccgagacccucuaccucuccggcauccucgccaucaccgccugcgccgucaccaugaagaaguacgucgaggagaacgucucccagaccuccuacaccaccaucaaguacuucaugaagaugcucuccuccgucuccgagacccucaucuucaucuucaugggcgucuccaccgucggcaagaaccacgaguggaacugggccuucaucugcuucacccucgccuucugccagaucuggcgcgccaucuccgucuucgcccucuucuacaucuccaaccaguuccgcaccuuccccuucuccaucaaggaccagugcaucaucuucuacuccggcguccgcggcgccggcuccuucucccucgccuuccuccucccccucucccucuucccccgcaagaagauguucgucaccgccacccucgucgucaucuacuucaccgucuucauccagggcaucaccgucggcccccucguccgcuaccucgacgucaagaagaccaacaagaaggaguccaucaacgaggagcuccacauccgccucauggaccaccucaaggccggcaucgaggacgucugcggccacuggucccacuaccagguccgcgacaaguucaagaaguucgaccaccgcuaccuccgcaagauccucauccgcaagaaccuccccaaguccuccaucgucucccucuacaagaagcucgagaugaagcaggccaucgagauggucgagaccggcauccucuccuccaccgccuucuccaucccccaccaggcccagcgcauccagggcaucaagcgccucucccccgaggacgucgaguccauccgcgacauccucaccuccaacauguaccagguccgccagcgcacccucuccuacaacaaguacaaccucaagccccagaccuccgagaagcaggccaaggagauccucauccgccgccagaacacccuccgcgaguccaugcgcaagggccacucccuccccuggggcaagcccgccggcaccaagaacauccgcuaccucuccuaccccuacggcaacccccaguccgccggccgcgacacccgcgccgccggcuucuccgacgacgacuccuccgaccccggcucccccuccaucaccuucuccgccugcucccgcaucggcucccuccagaagcaggaggcccaggagaucauccccaugaagucccuccaccgcggccgcaaggccuucuccuucggcuaccagcgcaacaccucccaggaggaguaccucggcggcguccgccgcgucgcccuccgccccaagccccucuuccacgccgucgacgaggagggcgaguccggcggcgaguccgagggcaaggccucccucgucgagguccgcucccgcuggaccgccgaccacggccacggccgcgaccaccaccgcucccacuccccccuccuccagaagaaguga

SEQ ID NO: 49785 - RNA, 2691 nt, Artificial Sequence
  derived and/or modified sequence opt2 from SLC9A5__Homo_sapiens__NP_004585
augcuccgcgccgcccucucccuccucgcccucccccucgccggcgccgccgaggagcccacccagaagcccgagucccccggcgagcccccccccggccucgagcucuuccgcuggcaguggcacgaggucgaggcccccuaccucgucgcccucuggauccucgucgccucccucgccaagaucgucuuccaccucucccgcaaggucaccucccucguccccgaguccugccuccucauccuccucggccucguccucggcggcaucguccucgccgucgccaagaaggccgaguaccagcucgagcccggcaccuucuuccucuuccuccucccccccaucguccucgacuccggcuacuucaugcccucccgccucuucuucgacaaccucggcgccauccucaccuacgccgucgucggcacccucuggaacgccuucaccaccggcgccgcccucuggggccuccagcaggccggccucgucgccccccgcguccaggccggccuccucgacuuccuccucuucggcucccucaucuccgccgucgaccccgucgccguccucgccgucuucgaggagguccacgucaacgagacccucuucaucaucgucuucggcgagucccuccucaacgacgccgucaccgucguccucuacaaggucugcaacuccuucgucgagaugggcuccgccaacguccaggccaccgacuaccucaagggcgucgccucccucuucgucgucucccucggcggcgccgccgucggccucgucuucgccuuccuccucgcccucaccacccgcuucaccaagcgcguccgcaucaucgagccccuccucgucuuccuccucgccuacgccgccuaccucaccgccgagauggccucccucuccgccauccucgccgucaccaugugcggccucggcugcaagaaguacgucgaggccaacaucucccacaagucccgcaccaccgucaaguacaccaugaagacccucgccuccugcgccgagaccgucaucuucaugcuccucggcaucuccgccgucgacuccuccaagugggccugggacuccggccucguccucggcacccucaucuucauccucuucuuccgcgcccucggcgucguccuccagaccuggguccucaaccaguuccgccucgucccccucgacaagaucgaccaggucgucauguccuacggcggccuccgcggcgccgucgccuucgcccucgucauccuccucgaccgcaccaagguccccgccaaggacuacuucgucgccaccaccaucgucgucgucuucuucaccgucaucguccagggccucaccaucaagccccucgucaaguggcucaaggucaagcgcuccgagcaccacaagcccacccucaaccaggagcuccacgagcacaccuucgaccacauccucgccgccgucgaggacgucgucggccaccacggcuaccacuacuggcgcgaccgcugggagcaguucgacaagaaguaccucucccagcuccucaugcgccgcuccgccuaccgcauccgcgaccagaucugggacgucuacuaccgccucaacauccgcgacgccaucuccuucgucgaccagggcggccacguccucuccuccaccggccucacccuccccuccaugcccucccgcaacuccgucgccgagaccuccgucaccaaccuccuccgcgaguccggcuccggcgccugccucgaccuccaggucaucgacaccguccgcuccggccgcgaccgcgaggacgccgucaugcaccaccuccucugcggcggccucuacaagccccgccgccgcuacaaggccuccugcucccgccacuucaucuccgaggacgcccaggagcgccaggacaaggaggucuuccagcagaacaugaagcgccgccucgaguccuucaaguccaccaagcacaacaucugcuucaccaaguccaagccccgcccccgcaagaccggccgccgcaagaaggacggcgucgccaacgccgaggccaccaacggcaagcaccgcggccucggcuuccaggacaccgccgccgucauccucaccgucgaguccgaggaggaggaggaggaguccgacuccuccgagaccgagaaggaggacgacgagggcaucaucuucgucgcccgcgccaccuccgagguccuccaggagggcaaggucuccggcucccucgaggucugccccuccccccgcaucaucccccccucccccaccugcgccgagaaggagcuccccuggaaguccggccagggcgaccucgccgucuacgucuccuccgagaccaccaagaucguccccgucgacaugcagaccggcuggaaccaguccaucuccucccucgagucccucgccuccccccccugcaaccaggcccccauccucaccugccuccccccccacccccgcggcaccgaggagccccaggucccccuccaccuccccuccgacccccgcuccuccuucgccuucccccccucccucgccaaggccggccgcucccgcuccgaguccuccgccgaccucccccagcagcaggagcuccagccccucaugggccacaaggaccacacccaccucucccccggcaccgccaccucccacuggugcauccaguucaaccgcggcucccgccucuga

SEQ ID NO: 49786 - RNA, 2106 nt, Artificial Sequence
  derived and/or modified sequence opt2 from SLC9A6__Homo_sapiens__NP_001036002
auggcccgccgcggcuggcgccgcgccccccuccgccgcggcgucggcuccuccccccgcgcccgccgccucaugcgcccccucuggcuccuccucgccgucggcgucuucgacugggccggcgccuccgacggcggcggcggcgaggcccgcgccauggacgaggagaucgucuccgagaagcaggccgaggagucccaccgccaggacuccgccaaccuccucaucuucauccuccuccucacccucaccauccucaccaucuggcucuucaagcaccgccgcgcccgcuuccuccacgagaccggccucgccaugaucuacggccuccucgucggccucguccuccgcuacggcauccacguccccuccgacgucaacaacgucacccucuccugcgagguccaguccucccccaccacccuccucgucaacgucuccggcaaguucuacgaguacaugcucaagggcgagaucuccucccacgagcucaacaacguccaggacaacgagaugcuccgcaaggucaccuucgaccccgaggucuucuucaacauccuccucccccccaucaucuucuacgccggcuacucccucaagcgccgccacuucuuccgcaaccucggcuccauccucgccuacgccuuccucggcaccgccaucuccugcuucgucaucggcuccaucauguacggcugcgucacccucaugaaggucaccggccagcucgccggcgacuucuacuucaccgacugccuccucuucggcgccaucgucuccgccaccgaccccgucaccguccucgccaucuuccacgagcuccaggucgacgucgagcucuacgcccuccucuucggcgaguccguccucaacgacgccgucgccaucguccucuccuccuccaucgucgccuaccagcccgccggcgacaacucccacaccuucgacgucaccgccauguucaaguccaucggcaucuuccucggcaucuucuccggcuccuucgccaugggcgccgccaccggcgucgucaccgcccucgucaccaaguucaccaagcuccgcgaguuccagcuccucgagaccggccucuucuuccucauguccugguccaccuuccuccucgccgaggccuggggcuucaccggcgucgucgccguccucuucugcggcaucacccaggcccacuacaccuacaacaaccucuccaccgagucccagcaccgcaccaagcagcucuucgagcuccucaacuuccucgccgagaacuucaucuucuccuacaugggccucacccucuucaccuuccagaaccacgucuucaaccccaccuucgucgucggcgccuucgucgccaucuuccucggccgcgccgccaacaucuacccccucucccuccuccucaaccucggccgccgcuccaagaucggcuccaacuuccagcacaugaugauguucgccggccuccgcggcgccauggccuucgcccucgccauccgcgacaccgccaccuacgcccgccagaugauguucuccaccacccuccucaucgucuucuucaccgucugggucuucggcggcggcaccaccgccaugcucuccugccuccacauccgcgucggcgucgacuccgaccaggagcaccucggcguccccgagaacgagcgccgcaccaccaaggccgaguccgccuggcucuuccgcaugugguacaacuucgaccacaacuaccucaagccccuccucacccacuccggccccccccucaccaccacccuccccgccugcugcggccccaucgcccgcugccucaccuccccccaggccuacgagaaccaggagcagcucaaggacgacgacuccgaccucauccucaacgacggcgacaucucccucaccuacggcgacuccaccgucaacaccgagcccgccaccuccuccgccccccgccgcuucaugggcaacuccuccgaggacgcccucgaccgcgagcucgccuucggcgaccacgagcucgucauccgcggcacccgccucguccuccccauggacgacuccgagcccccccucaaccuccucgacaacacccgccacggccccgccuga

SEQ ID NO: 49787 - RNA, 2178 nt, Artificial Sequence
  derived and/or modified sequence opt2 from SLC9A7__Homo_sapiens__NP_115980
auggagcccggcgacgccgcccgccccggcuccggccgcgccaccggcgccccccccccccgccuccuccuccucccccuccuccucggcuggggccuccgcgucgccgccgccgccuccgccuccuccuccggcgccgccgccgaggacuccuccgccauggaggagcucgccaccgagaaggaggccgaggagucccaccgccaggacuccgucucccuccucaccuucauccuccuccucacccucaccauccucaccaucuggcucuucaagcaccgccgcguccgcuuccuccacgagaccggccucgccaugaucuacggccucaucgucggcgucauccuccgcuacggcacccccgccaccuccggccgcgacaagucccucuccugcacccaggaggaccgcgccuucuccacccuccucgucaacgucuccggcaaguucuucgaguacacccucaagggcgagaucucccccggcaagaucaacuccgucgagcagaacgacaugcuccgcaaggucaccuucgaccccgaggucuucuucaacauccuccucccccccaucaucuuccacgccggcuacucccucaagaagcgccacuucuuccgcaaccucggcuccauccucgccuacgccuuccucggcaccgccgucuccugcuucaucaucggcaaccucauguacggcgucgucaagcucaugaagaucaugggccagcucuccgacaaguucuacuacaccgacugccucuucuucggcgccaucaucuccgccaccgaccccgucaccguccucgccaucuucaacgagcuccacgccgacgucgaccucuacgcccuccucuucggcgaguccguccucaacgacgccgucgccaucguccucuccuccuccaucgucgccuaccagcccgccggccucaacacccacgccuucgacgccgccgccuucuucaaguccgucggcaucuuccucggcaucuucuccggcuccuucaccaugggcgccgucaccggcgucaacgccaacgucaccaaguucaccaagcuccacugcuucccccuccucgagaccgcccucuucuuccucauguccugguccaccuuccuccucgccgaggccugcggcuucaccggcgucgucgccguccucuucugcggcaucacccaggcccacuacaccuacaacaaccucuccgucgagucccgcucccgcaccaagcagcucuucgagguccuccacuuccucgccgagaacuucaucuucuccuacaugggccucgcccucuucaccuuccagaagcacgucuucucccccaucuucaucaucggcgccuucgucgccaucuuccucggccgcgccgcccacaucuacccccucuccuucuuccucaaccucggccgccgccacaagaucggcuggaacuuccagcacaugaugauguucuccggccuccgcggcgccauggccuucgcccucgccauccgcgacaccgccuccuacgcccgccagaugauguucaccaccacccuccucaucgucuucuucaccgucuggaucaucggcggcggcaccacccccaugcucuccuggcucaacauccgcgucggcgucgaggagcccuccgaggaggaccagaacgagcaccacuggcaguacuuccgcgucggcgucgaccccgaccaggaccccccccccaacaacgacuccuuccagguccuccagggcgacggccccgacuccgcccgcggcaaccgcaccaagcaggaguccgccuggaucuuccgccucugguacuccuucgaccacaacuaccucaagcccauccucacccacuccggccccccccucaccaccacccuccccgccuggugcggccuccucgcccgcugccucaccuccccccaggucuacgacaaccaggagccccuccgcgaggaggacuccgacuucauccucaccgagggcgaccucacccucaccuacggcgacuccaccgucaccgccaacggcuccuccuccucccacaccgccuccaccucccucgagggcucccgccgcaccaaguccuccuccgaggagguccucgagcgcgaccucggcaugggcgaccagaaggucuccucccgcggcacccgccucgucuucccccucgaggacaacgccuga

SEQ ID NO: 49788 - RNA, 1794 nt, Artificial Sequence
  derived and/or modified sequence opt2 from SLC9A8__Homo_sapiens__NP_001247420
augggcgagaagauggccgaggaggagcgcuuccccaacaccacccacgagggcuucaacgucacccuccacaccacccucgucgucaccaccaagcucguccuccccacccccggcaagcccauccuccccguccagaccggcgagcaggcccagcaggaggagcaguccuccggcaugaccaucuucuucucccuccucguccucgccaucugcaucauccucguccaccuccucauccgcuaccgccuccacuuccuccccgaguccgucgccgucgucucccucggcauccucaugggcgccgucaucaagaucaucgaguucaagaagcucgccaacuggaaggaggaggagauguuccgccccaacauguucuuccuccuccuccucccccccaucaucuucgaguccggcuacucccuccacaagggcaacuucuuccagaacaucggcuccaucacccucuucgccgucuucggcaccgccaucuccgccuucgucgucggcggcggcaucuacuuccucggccagggcuucuucuucgucugcgucugcgucuucgucugcuucauccuccaggccgacgucaucuccaagcucaacaugaccgacuccuucgccuucggcucccucaucuccgccgucgaccccgucgccaccaucgccaucuucaacgcccuccacgucgaccccguccucaacaugcucgucuucggcgaguccauccucaacgacgccgucuccaucguccucaccaacaccgccgagggccucacccgcaagaacauguccgacgucuccggcuggcagaccuuccuccaggcccucgacuacuuccucaagauguucuucggcuccgccgcccucggcacccucaccggccucaucuccgcccucguccucaagcacaucgaccuccgcaagacccccucccucgaguucggcaugaugaucaucuucgccuaccuccccuacggccucgccgagggcaucucccucuccggcaucauggccauccucuucuccggcaucgucaugucccacuacacccaccacaaccucucccccgucacccagauccucaugcagcagacccuccgcaccgucgccuuccucugcgagaccugcgucuucgccuuccucggccucuccaucuucuccuucccccacaaguucgagaucuccuucgucaucuggugcaucguccucguccucuucggccgcgccgucaacaucuucccccucuccuaccuccucaacuucuuccgcgaccacaagaucacccccaagaugauguucaucaugugguucuccggccuccgcggcgccauccccuacgcccucucccuccaccucgaccucgagcccauggagaagcgccagcucaucggcaccaccaccaucgucaucguccucuucaccauccuccuccucggcggcuccaccaugccccucauccgccucauggacaucgaggacgccaaggcccaccgccgcaacaagaaggacgucaaccucuccaagaccgagaagaugggcaacaccgucgaguccgagcaccucuccgagcucaccgaggaggaguacgaggcccacuacauccgccgccaggaccucaagggcuucgucuggcucgacgccaaguaccucaaccccuucuucacccgccgccucacccaggaggaccuccaccacggccgcauccagaugaagacccucaccaacaagugguacgaggagguccgccagggccccuccggcuccgaggacgacgagcaggagcuccucuga

SEQ ID NO: 49789 - RNA, 1938 nt, Artificial Sequence
  derived and/or modified sequence opt2 from SLC9A9__Homo_sapiens__NP_775924
auggagcgccagucccgcgucauguccgagaaggacgaguaccaguuccagcaccagggcgccgucgagcuccucgucuucaacuuccuccucauccucaccauccucaccaucuggcucuucaagaaccaccgcuuccgcuuccuccacgagaccggcggcgccauggucuacggccucaucaugggccucauccuccgcuacgccaccgcccccaccgacaucgaguccggcaccgucuacgacugcgucaagcucaccuucucccccuccacccuccucgucaacaucaccgaccaggucuacgaguacaaguacaagcgcgagaucucccagcacaacaucaacccccaccagggcaacgccauccucgagaagaugaccuucgaccccgagaucuucuucaacguccuccucccccccaucaucuuccacgccggcuacucccucaagaagcgccacuucuuccagaaccucggcuccauccucaccuacgccuuccucggcaccgccaucuccugcaucgucaucggccucaucauguacggcuucgucaaggccaugauccacgccggccagcucaagaacggcgacuuccacuucaccgacugccucuucuucggcucccucauguccgccaccgaccccgucaccguccucgccaucuuccacgagcuccacgucgaccccgaccucuacacccuccucuucggcgaguccguccucaacgacgccgucgccaucguccucaccuacuccaucuccaucuacucccccaaggagaaccccaacgccuucgacgccgccgccuucuuccaguccgucggcaacuuccucggcaucuucgccggcuccuucgccaugggcuccgccuacgccaucaucaccgcccuccucaccaaguucaccaagcucugcgaguuccccaugcucgagaccggccucuucuuccuccucuccugguccgccuuccucuccgccgaggccgccggccucaccggcaucgucgccguccucuucugcggcgucacccaggcccacuacaccuacaacaaccucuccuccgacuccaagauccgcaccaagcagcucuucgaguucaugaacuuccucgccgagaacgucaucuucugcuacaugggccucgcccucuucaccuuccagaaccacaucuucaacgcccucuucauccucggcgccuuccucgccaucuucgucgcccgcgccugcaacaucuacccccucuccuuccuccucaaccucggccgcaagcagaagauccccuggaacuuccagcacaugaugauguucuccggccuccgcggcgccaucgccuucgcccucgccauccgcaacaccgagucccagcccaagcagaugauguucaccaccacccuccuccucgucuucuucaccgucugggucuucggcggcggcaccacccccaugcucaccuggcuccagauccgcgucggcgucgaccucgacgagaaccucaaggaggaccccuccucccagcaccaggaggccaacaaccucgacaagaacaugaccaaggccgaguccgcccgccucuuccgcaugugguacuccuucgaccacaaguaccucaagcccauccucacccacuccggccccccccucaccaccacccuccccgaguggugcggccccaucucccgccuccucaccuccccccaggccuacggcgagcagcucaaggaggacgacgucgagugcaucgucaaccaggacgagcucgccaucaacuaccaggagcaggccuccucccccugcuccccccccgcccgccucggccucgaccagaaggccuccccccagacccccggcaaggagaacaucuacgagggcgaccucggccucggcggcuacgagcucaagcucgagcagacccucggccagucccagcucaacuga

SEQ ID NO: 49790 - RNA, 1428 nt, Artificial Sequence
  derived and/or modified sequence opt2 from SLC9B1__Homo_sapiens__NP_001094344
augcacaccaccgaguccaagaacgagcaccucgaggacgagaacuuccagaccuccaccaccccccagucccucaucgaccccaacaacaccgcccacgaggagaccaagaccguccucuccgacaccgaggagaucaagccccagaccaagaaggagaccuacaucuccugcccccuccgcggcguccucaacgucaucaucaccaacggcgucauccucuucgucaucuggugcaugaccugguccauccucggcuccgaggcccuccccggcggcaaccucuucggccucuucaucaucuucuacuccgccaucaucggcggcaagauccuccagcucauccgcaucccccucguccccccccuccccccccuccucggcaugcuccucgccggcuucaccauccgcaacguccccuucaucaacgagcacguccacguccccaacaccugguccuccauccuccgcuccaucgcccucaccaucauccucauccgcgccggccucggccucgacccccaggcccuccgccaccucaaggucgucugcuuccgccucgccgucggccccugccucauggaggccuccgccgccgccgucuucucccacuucaucaugaaguuccccuggcagugggccuuccuccucggcuucguccucggcgccgucucccccgccgucgucguccccuacaugaugguccuccaggagaacggcuacggcgucgaggagggcauccccacccuccucauggccgccuccuccauggacgacauccucgccaucaccggcuucaacaccugccucuccaucgucuucuccuccggcggcauccucaacaacgccaucgccuccauccgcaacgucugcaucucccuccucgccggcaucguccucggcuucuucguccgcuacuuccccuccgaggaccagaagaagcucacccucaagcgcggcuuccucguccucaccaugugcgucuccgccguccucggcucccagcgcaucggccuccacggcuccggcggccucugcacccucguccucuccuucaucgccggcaccaaguggucccaggagaagaugaagguccagaagaucaucaccaccgucugggacaucuuccagccccuccucuucggccucgucggcgccgaggucuccgucuccucccucgaguccaacaucgucggcaucuccgucgccacccucucccucgcccucugcguccgcauccucaccaccuaccuccucaugugcuucgccggcuucuccuucaaggagaagaucuucaucgcccucgccuggaugcccaaggccaccguccagaucaaccaggccauccuccuccucuuccuccuccgcgaggaguggaccaacugcaaggucgccaagaagugcgaguacaccaaggagcgccaguga

SEQ ID NO: 49791 - RNA, 1254 nt, Artificial Sequence
  derived and/or modified sequence opt2 from SLC9B2__Homo_sapiens__NP_001287685
augggcgacgaggacaagcgcaucaccuacgaggacuccgagcccuccaccggcaugaacuacacccccuccaugcaccaggaggcccaggaggagaccgucaugaagcucaagggcaucgacgccaacgagcccaccgagggcuccauccuccucaaguccuccgagaagaagcuccaggagacccccaccgaggccaaccacguccagcgccuccgccagaugcucgccugccccccccacggccuccucgaccgcgucaucaccaacggcaugcuccucgccggcuuccucauccgcaacauccccgucaucaacgacaacguccagaucaagcacaagugguccuccucccuccgcuccaucgcccucuccaucauccucguccgcgccggccucggccucgacuccaaggcccucaagaagcucaagggcgucugcguccgccucuccaugggccccugcaucgucgaggccugcaccuccgcccuccucgcccacuaccuccucggccuccccuggcaguggggcuucauccucggcuucguccucggcgccgucucccccgccgucgucguccccuccaugcuccuccuccagggcggcggcuacggcgucgagaagggcguccccacccuccucauggccgccggcuccuucgacgacauccucgccaucaccggcuucaacaccugccucggcaucgccuucuccaccggcuccaccgucuucaacguccuccgcggcguccucgaggucgucaucggcgucgccaccggcuccguccucggcuucuucauccaguacuuccccucccgcgaccaggacaagcucgucugcaagcgcaccuuccucguccucggccucuccguccucgccgucuucuccuccguccacuucggcuuccccggcuccggcggccucugcacccucgucauggccuuccucgccggcaugggcuggaccuccgagaaggccgaggucgagaagaucaucgccgucgccugggacaucuuccagccccuccucuucggccucaucggcgccgaggucuccaucgccucccuccgccccgagaccgucggcugcaaccgcaucugcggcuucggccacuccaaggucaccuggcgcgagaccauccgccgccucuggaacggcugcgucgacuccggcaucuucguccacccccaccacucccccaacuggaaguccgccuacugguucaccggcccccaggccuccgccgaguccuga

SEQ ID NO: 49792 - RNA, 3534 nt, Artificial Sequence
  derived and/or modified sequence opt2 from SLC9C1__Homo_sapiens__NP_898884
auggccggcaucuucaaggaguucuucuucuccaccgaggaccuccccgaggucauccucacccucucccucaucuccuccaucggcgccuuccucaaccgccaccucgaggacuuccccauccccguccccgucauccucuuccuccucggcugcuccuucgagguccucuccuucaccuccucccagguccagcgcuacgccaacgccauccaguggaugucccccgaccucuucuuccgcaucuucacccccgucgucuucuucaccaccgccuucgacauggacaccuacaugcuccagaagcucuucuggcagauccuccucaucuccauccccggcuuccucgucaacuacauccucguccucuggcaccucgccuccgucaaccagcuccuccucaagcccacccaguggcuccucuucuccgccauccucgucuccuccgaccccaugcucaccgccgccgccauccgcgaccucggccucucccgcucccucaucucccucaucaacggcgagucccucaugaccuccgucaucucccucaucaccuucaccuccaucauggacuucgaccagcgccuccaguccaagcgcaaccacacccucgccgaggagaucgucggcggcaucugcuccuacaucaucgccuccuuccucuucggcauccucuccuccaagcucauccaguucuggauguccaccgucuucggcgacgacgucaaccacaucucccucaucuucuccauccucuaccucaucuucuacaucugcgagcucgucggcauguccggcaucuucacccucgccaucgucggccuccuccucaacuccaccuccuucaaggccgccaucgaggagacccuccuccucgaguucuggaccuuccucucccgcaucgccuuccucauggucuucaccuucuucggccuccucauccccgcccacaccuaccucuacaucgaguucgucgacaucuacuacucccucaacaucuaccucacccucaucguccuccgcuuccucacccuccuccucaucucccccguccucucccgcgucggccacgaguucuccuggcgcuggaucuucaucauggucugcuccgagaugaagggcaugcccaacaucaacauggcccuccuccucgccuacuccgaccucuacuucggcuccgacaaggagaagucccagauccucuuccacggcguccucgucugccucaucacccucgucgucaaccgcuucauccuccccgucgccgucaccauccucggccuccgcgacgccaccuccaccaaguacaaguccgucugcugcaccuuccagcacuuccaggagcucaccaaguccgccgccuccgcccucaaguucgacaaggaccucgccaacgccgacuggaacaugaucgagaaggccaucacccucgagaaccccuacaugcucaacgaggaggagaccaccgagcaccagaaggucaagugcccccacugcaacaaggagaucgacgagaucuucaacaccgaggccauggagcucgccaaccgccgccuccucuccgcccagaucgccuccuaccagcgccaguaccgcaacgagauccucucccaguccgccguccagguccucgucggcgccgccgaguccuucggcgagaagaagggcaagugcaugucccucgacaccaucaagaacuacuccgagucccagaagaccgucaccuucgcccgcaagcuccuccucaacugggucuacaacacccgcaaggagaaggagggccccuccaaguacuucuucuuccgcaucugccacaccaucgucuucaccgaggaguucgagcacgucggcuaccucgucauccucaugaacaucuuccccuucaucaucuccuggaucucccagcucaacgucaucuaccacuccgagcucaagcacaccaacuacugcuuccucacccucuacauccucgaggcccuccucaagaucgccgccaugcgcaaggacuucuucucccacgccuggaacaucuucgagcucgccaucacccucaucggcauccuccacgucauccucaucgagaucgacaccaucaaguacaucuucaacgagaccgaggucaucgucuucaucaaggucguccaguucuuccgcauccuccgcaucuucaagcucaucgcccccaagcuccuccagaucaucgacaagcgcaugucccaccagaagaccuucugguacggcauccucaagggcuacguccagggcgaggccgacaucaugaccaucaucgaccagaucaccuccuccaagcagaucaagcagaugcuccucaagcaggucauccgcaacauggagcacgccaucaaggagcucggcuaccucgaguacgaccaccccgagaucgccgucaccgucaagaccaaggaggagaucaacgucaugcucaacauggccaccgagauccucaaggccuucggccucaagggcaucaucuccaagaccgagggcgccggcaucaacaagcucaucauggccaagaagaaggagguccucgacucccaguccaucauccgcccccucaccgucgaggagguccucuaccacauccccuggcucgacaagaacaaggacuacaucaacuucauccaggagaaggccaaggucgucaccuucgacugcggcaacgacaucuucgaggagggcgacgagcccaagggcaucuacaucaucaucuccggcauggucaagcucgagaaguccaagcccggccucggcaucgaccagauggucgaguccaaggagaaggacuuccccaucaucgacaccgacuacaugcucuccggcgagaucaucggcgagaucaacugccucaccaacgagcccaugaaguacuccgccaccugcaagaccgucgucgagaccugcuucauccccaagacccaccucuacgacgccuucgagcagugcuccccccucaucaagcagaagauguggcucaagcucggccucgccaucaccgcccgcaagauccgcgagcaccucuccuacgaggacuggaacuacaacaugcagcucaagcucuccaacaucuacgucgucgacauccccauguccaccaagaccgacaucuacgacgagaaccucaucuacgucauccucauccacggcgccgucgaggacugccuccuccgcaagaccuaccgcgcccccuuccucauccccaucaccugccaccagauccaguccaucgaggacuucaccaaggucgucaucauccagacccccaucaacaugaagaccuuccgccgcaacauccgcaaguucguccccaagcacaaguccuaccucacccccggccucaucggcuccgucggcacccucgaggagggcauccaggaggagcgcaacgucaaggaggacggcgcccacuccgccgccaccgcccgcuccccccagcccugcucccuccucggcaccaaguucaacugcaaggaguccccccgcaucaaccuccgcaagguccgcaaggaguga

SEQ ID NO: 49793 - RNA, 3375 nt, Artificial Sequence
  derived and/or modified sequence opt2 from SLC9C2__Homo_sapiens__NP_848622
auguccuccuacuucugggcccagaacgaguccaaccgccccgaccuccucugcggccagcccgccgacuaccucgucgaggagaagcacuucaccacccucgucugcuucaucgucguccucggcggccuccucaagaugugccucaagaacugcgaggucaucguccucaccauccucucccucuccggcuucgucaucggccacauggccuacaacuccgucgagguccaccagaucgucuacccccuccuccgcaccuccuccuucucccucuacuccuacuucuccccccucaucaucuucauggucgcccucgacgucgaguucuacacccucaagaagauguucuggcagguccuccucaccggccucaucuccuucuccaccgccuccaucaucaucggcuacgucgucaucaaguucaacaaggacuccugggaccuccaguccugccuccucuucuccaucacccucggcaucaucgacccccuccgcuccgucaacucccucaagaccaucggcaucuccaagaucuacaucgaccucauccgcggcgagucccucaucaucugcuccaucgccuccaucuucuucggcaacuuccgcggcaaccgcauccacuucuccaucuuccgcgaccuccacgucggcaucgagcucuccuacgacauccucggcuccaucaucuucggcuacuggugcgccaagaucauccagugcauccucgccgacgucuucuccaacaugcucaccaacaucauccucugcuucuccauggucuacaugaccuucuacaucgucgaguuccucggcauguccggcacccucgcccucgccgccgucggccucaaccucgacucccucaccuucaagcccaagaucgagcucgucaucaccaaguuccuccgcaucuucuccuccgucuacgagcaccucaucuacgccuucuucggcaucgucaucggcugcggcgagcucucccacuacgaguuccacaccauccccuucaucuucauccucuucaccaccgucaaccucguccgccuccucaccauccuccucgucucccccauccucaugcacuccaacuacgaguacaacuggcgcuggggcgucgucaucaccugguccggcaucaagggcgucuucaaccuccucugggcccccgacgucuacaaccucgccgagcgcaaggucgaggucccccagauguucauccucuacguccaggucaucucccuccucaccaugggcaucaacuccuacgucaugacccaguccgcccgcaagcucgaccucugcguccucucccucccccgccagaugauccuccagaacgccacccagcacauccaggagaucguccagaacaccaucacccucuucaagaccgagaagauccucaccaacgucaacuggacccucgucgaggacaagacccgcaucgaguacauccccuucucccacgucucccacaacgacaugaagaccgaguccaccaccgacgaggcccucauggaggaggcccgccuccacgucgccgccauccagauguccuccuucgagaagcagcgcaacaacggcauccucgagaucgaggccgcccgcauccucaucggcgccgccaagugcuacuacuccauccagggcaaguucauguccaucuacgacgucuccaccuacaugcgcacccgcuccuggcucaucaaguucaagaacguccucaccuuccucgaguacugcaucgagaagauccacuucaucccccccgaguccaacaccuuccucaccuucaucuuccacaucgucuucuccgaggaguucgaguacaccggccagaucaucaaccucaucuacaucuaccccaugaucauccaccucuggcccauggcccgcggccucaacgucuccgcccucaucuccaucaacuacuacuucauguuccucuacguccucgaguccacccucaagaucaucauccucaagcgcaaguacuuccagcagugcuggaacacccucgaguucuucauccucgucaucggcaucaucgacaucuucugcgucuacuucgucaagcuccgccccgacaaccucgcccucauccagcucaccgucaucaugggcuaccuccgcaucauccgcuuccucccccucuucaagaucaucguccccauccucauccgcaucgccgacguccagaucaagaagcgccucucccucauguacuccaucaccaagggcuacaucaagucccaggaggacgccaagcuccucaucaagcagaucgccgucugcgaguccaucuaccagaagcucugcgagauccucgagaccaacaagcaggacgccgucaaggagcucguccucauggagcacgagggccgcgacgucgucaucgcccucaagaccaagcaggccauccgcaacgucaucgccaaggcccucaagaaccucaccuuccucugcucccgcggcaucaucgacaagcacgaggucaucgagaucaacaagguccuccucaagaagcucaaggcccucaacaacuuccccaaggccauccccccccccacccccgacaucuaccuccacaacaucaucuggcucgagggcaaggacguccucaucgacuucuucaaggagcgcgccaagcucgccugcuucgacuccggcgacaccaucugcaagggcggcgagaugccccagggcaucuaccucaucaucuccggcauggccauccuccacucccucucccccaccuucggcaucgaguccaaccagcgcugcgaccgcggcucccgcgacauguucaccgaguucugcaccaccggcgacaucaucggcgagcucuccugccuccucaagcgcgagaucgaguacaccgucaucugcgagaccucccuccaggccugcuucaucucccucgaggaccucuacgagggcuucgacgccuucuggcccucccucgaguacaagaucuggcucaagcucgcccucuccaccgccuaccaguacuucgaguccucccucaucgacgaggaccuccgcuuccagaacugcgucauguucaaccaggccuacgucgagacccucuccuccuacuccgacaugaucaucgacaacaugaccaugaaguucgucaucaucgucuacggcuccgucaucgacaccaagaccgaggagcccuacuucgcccccugcaucauccccaccaccugcgagcagguccagggcaccuccgaccucuccaagcuccucaucauccaggccuccgagcucacccagcgcaacuccaacaccaacgucauggccuccgucaacaccgucuucgagcagcccggcaagaacaucaacggccgccagaagauguccuga

SEQ ID NO: 49794 - RNA, 2013 nt, Artificial Sequence
  derived and/or modified sequence opt2 from SLCO1A2__Homo_sapiens__NP_602307
augggcgagaccgagaagcgcaucgagacccaccgcauccgcugccucuccaagcucaagauguuccuccucgccaucaccugcgccuucgucuccaagacccucuccggcuccuacaugaacuccaugcucacccagaucgagcgccaguucaacauccccaccucccucgucggcuucaucaacggcuccuucgagaucggcaaccuccuccucaucaucuucgucuccuacuucggcaccaagcuccaccgccccaucaugaucggcaucggcugcgucgucaugggccucggcugcuuccucaagucccucccccacuuccucaugaaccaguacgaguacgaguccaccgucuccgucuccggcaaccucuccuccaacuccuuccucugcauggagaacggcacccagauccuccgccccacccaggaccccuccgagugcaccaaggaggucaagucccucaugugggucuacguccucgucggcaacaucguccgcggcaugggcgagacccccauccucccccucggcaucuccuacaucgaggacuucgccaaguucgagaacuccccccucuacaucggccucgucgagaccggcgccaucaucggcccccucaucggccuccuccucgccuccuucugcgccaacgucuacgucgacaccggcuucgucaacaccgacgaccucaucaucacccccaccgacacccgcugggucggcgccuggugguucggcuuccucaucugcgccggcgucaacguccucaccgccauccccuucuucuuccuccccaacacccuccccaaggagggccucgagaccaacgccgacaucaucaagaacgagaacgaggacaagcagaaggaggaggucaagaaggagaaguacggcaucaccaaggacuuccuccccuucaugaagucccucuccugcaaccccaucuacaugcucuucauccucgucuccgucauccaguucaacgccuucgucaacaugaucuccuucaugcccaaguaccucgagcagcaguacggcaucuccuccuccgacgccaucuuccucaugggcaucuacaaccucccccccaucugcaucggcuacaucaucggcggccucaucaugaagaaguucaagaucaccgucaagcaggccgcccacaucggcugcuggcucucccuccucgaguaccuccucuacuuccucuccuuccucaugaccugcgagaacuccuccgucgucggcaucaacaccuccuacgagggcaucccccaggaccucuacgucgagaacgacaucuucgccgacugcaacgucgacugcaacugccccuccaagaucugggaccccgucugcggcaacaacggccucuccuaccucuccgccugccucgccggcugcgagaccuccaucggcaccggcaucaacauggucuuccagaacugcuccugcauccagaccuccggcaacuccuccgccguccucggccucugcgacaagggccccgacugcucccucaugcuccaguacuuccucauccucuccgccauguccuccuucaucuacucccucgccgccauccccggcuacaugguccuccuccgcugcaugaaguccgaggagaagucccucggcgucggccuccacaccuucugcacccgcgucuucgccggcauccccgcccccaucuacuucggcgcccucauggacuccaccugccuccacuggggcacccucaagugcggcgaguccggcgccugccgcaucuacgacuccaccaccuuccgcuacaucuaccucggccuccccgccgcccuccgcggcuccuccuucguccccgcccucaucauccucauccuccuccgcaagugccaccuccccggcgagaacgccuccuccggcaccgagcucaucgagaccaaggucaagggcaaggagaacgagugcaaggacaucuaccagaaguccaccguccucaaggacgacgagcucaagaccaagcucuga

SEQ ID NO: 49795 - RNA, 2076 nt, Artificial Sequence
  derived and/or modified sequence opt2 from SLCO1B1__Homo_sapiens__NP_006437
auggaccagaaccagcaccucaacaagaccgccgaggcccagcccuccgagaacaagaagacccgcuacugcaacggccucaagauguuccucgccgcccucucccucuccuucaucgccaagacccucggcgccaucaucaugaaguccuccaucauccacaucgagcgccgcuucgagaucuccuccucccucgucggcuucaucgacggcuccuucgagaucggcaaccuccucgucaucgucuucgucuccuacuucggcuccaagcuccaccgccccaagcucaucggcaucggcugcuucaucaugggcaucggcggcguccucaccgcccucccccacuucuucaugggcuacuaccgcuacuccaaggagaccaacaucaacuccuccgagaacuccaccuccacccucuccaccugccucaucaaccagauccucucccucaaccgcgccucccccgagaucgucggcaagggcugccucaaggaguccggcuccuacauguggaucuacgucuucaugggcaacaugcuccgcggcaucggcgagacccccaucgucccccucggccucuccuacaucgacgacuucgccaaggagggccacuccucccucuaccucggcauccucaacgccaucgccaugaucggccccaucaucggcuucacccucggcucccucuucuccaagauguacgucgacaucggcuacgucgaccucuccaccauccgcaucacccccaccgacucccgcugggucggcgccugguggcucaacuuccucgucuccggccucuucuccaucaucuccuccauccccuucuucuuccucccccagacccccaacaagccccagaaggagcgcaaggccucccucucccuccacguccucgagaccaacgacgagaaggaccagaccgccaaccucaccaaccagggcaagaacaucaccaagaacgucaccggcuucuuccaguccuucaaguccauccucaccaacccccucuacgucauguucguccuccucacccuccuccaggucuccuccuacaucggcgccuucaccuacgucuucaaguacgucgagcagcaguacggccagcccuccuccaaggccaacauccuccucggcgucaucaccauccccaucuucgccuccggcauguuccucggcggcuacaucaucaagaaguucaagcucaacaccgucggcaucgccaaguucuccugcuucaccgccgucaugucccucuccuucuaccuccucuacuucuucauccucugcgagaacaaguccgucgccggccucaccaugaccuacgacggcaacaaccccgucaccucccaccgcgacgucccccucuccuacugcaacuccgacugcaacugcgacgagucccagugggagcccgucugcggcaacaacggcaucaccuacaucucccccugccucgccggcugcaaguccuccuccggcaacaagaagcccaucgucuucuacaacugcuccugccucgaggucaccggccuccagaaccgcaacuacuccgcccaccucggcgagugcccccgcgacgacgccugcacccgcaaguucuacuucuucgucgccauccagguccucaaccucuucuucuccgcccucggcggcaccucccacgucaugcucaucgucaagaucguccagcccgagcucaagucccucgcccucggcuuccacuccauggucauccgcgcccucggcggcauccucgcccccaucuacuucggcgcccucaucgacaccaccugcaucaagugguccaccaacaacugcggcacccgcggcuccugccgcaccuacaacuccaccuccuucucccgcgucuaccucggccucuccuccaugcuccgcgucuccucccucguccucuacaucauccucaucuacgccaugaagaagaaguaccaggagaaggacaucaacgccuccgagaacggcuccgucauggacgaggccaaccucgagucccucaacaagaacaagcacuucguccccuccgccggcgccgacuccgagacccacugcuga

SEQ ID NO: 49796 - RNA, 2109 nt, Artificial Sequence
  derived and/or modified sequence opt2 from SLCO1B3__Homo_sapiens__NP_062818
auggaccagcaccagcaccucaacaagaccgccgaguccgccuccuccgagaagaagaagacccgccgcugcaacggcuucaagauguuccucgccgcccucuccuucuccuacaucgccaaggcccucggcggcaucaucaugaagaucuccaucacccagaucgagcgccgcuucgacaucuccuccucccucgccggccucaucgacggcuccuucgagaucggcaaccuccucgucaucgucuucgucuccuacuucggcuccaagcuccaccgccccaagcucaucggcaucggcugccuccucaugggcaccggcuccauccucaccucccucccccacuucuucaugggcuacuaccgcuacuccaaggagacccacaucaaccccuccgagaacuccaccuccucccucuccaccugccucaucaaccagacccucuccuucaacggcaccucccccgagaucgucgagaaggacugcgucaaggaguccggcucccacauguggaucuacgucuucaugggcaacaugcuccgcggcaucggcgagacccccaucgucccccucggcaucuccuacaucgacgacuucgccaaggagggccacuccucccucuaccucggcucccucaacgccaucggcaugaucggccccgucaucggcuucgcccucggcucccucuucgccaagauguacgucgacaucggcuacgucgaccucuccaccauccgcaucacccccaaggacucccgcugggucggcgccugguggcucggcuuccucgucuccggccucuucuccaucaucuccuccauccccuucuucuuccuccccaagaaccccaacaagccccagaaggagcgcaagaucucccucucccuccacguccucaagaccaacgacgaccgcaaccagaccgccaaccucaccaaccagggcaagaacgucaccaagaacgucaccggcuucuuccagucccucaaguccauccucaccaacccccucuacgucaucuuccuccuccucacccuccuccaggucuccuccuucaucggcuccuucaccuacgucuucaaguacauggagcagcaguacggccaguccgccucccacgccaacuuccuccucggcaucaucaccauccccaccgucgccaccggcauguuccucggcggcuucaucaucaagaaguucaagcucucccucgucggcaucgccaaguucuccuuccucaccuccaugaucuccuuccucuuccagcuccucuacuucccccucaucugcgaguccaaguccgucgccggccucacccucaccuacgacggcaacaacuccgucgccucccacgucgacgucccccucuccuacugcaacuccgagugcaacugcgacgagucccagugggagcccgucugcggcaacaacggcaucaccuaccucucccccugccucgccggcugcaaguccuccuccggcaucaagaagcacaccgucuucuacaacugcuccugcgucgaggucaccggccuccagaaccgcaacuacuccgcccaccucggcgagugcccccgcgacaacaccugcacccgcaaguucuucaucuacgucgccauccaggucaucaacucccucuucuccgccaccggcggcaccaccuucauccuccucaccgucaagaucguccagcccgagcucaaggcccucgccaugggcuuccaguccauggucauccgcacccucggcggcauccucgcccccaucuacuucggcgcccucaucgacaagaccugcaugaagugguccaccaacuccugcggcgcccagggcgccugccgcaucuacaacuccgucuucuucggccgcgucuaccucggccucuccaucgcccuccgcuuccccgcccucguccucuacaucgucuucaucuucgccaugaagaagaaguuccagggcaaggacaccaaggccuccgacaacgagcgcaaggucauggacgaggccaaccucgaguuccucaacaacggcgagcacuucguccccuccgccggcaccgacuccaagaccugcaaccucgacaugcaggacaacgccgccgccaacuga

SEQ ID NO: 49797 - RNA, 1923 nt, Artificial Sequence
  derived and/or modified sequence opt2 from SLCO1B7__Homo_sapiens__NP_001009562
augaagaucuccaccacccagaucgagcgccgcuucgagaucuccuccucccucgucggccucaucgacggcuccuucgagaucggcaaccucuucgucaucgucuucgucuccuacuucggcuccaagcuccaccgccccaagcucaucggcaucggcugcuuccucaugggcaccggcuccauccucauggcccucccccacuucuucaugggcuacuaccgcuacuccaaggagaccaacaucgaccccuccgagaacuccaccuccaaccuccccaacugccucaucaaccagaugcucucccucaaccgcacccccuccgagaucaucgagcgcggcugcgucaaggaguccggcucccacauguggaucuacgucuucaugggcaacaugcuccgcggcaucggcgagacccccaucgucccccucggcaucuccuacaucgacgacuucgccaaggagggccacuccucccucuaccucggcaccgucaacgucaugggcaugaccggccucgucuucgccuucaugcucggcucccucuucgccaagauguacgucgacaucggcuacgucgaccucuccaccauccgcaucacccccaaggacucccgcugggucggcgccugguggcucggcuuccucgucuccggcaucgucuccaucaucuccuccauccccuucuucuuccucccccucaaccccaacaagccccagaaggagcgcaaggucucccucuuccuccacguccucaagaccaacgacaagcgcaaccagaucgccaaccucaccaaccgccgcaaguacaucaccaagaacgucaccggcuucuuccagucccucaaguccauccucaccaacccccucuacgucaucuucgucaucuucacccuccuccacauguccuccuacaucgccucccucaccuacaucaucaagauggucgagcagcaguacggcugguccgccuccaagaccaacuuccuccucggcguccucgcccuccccgccgucgccaucggcauguucuccggcggcuacaucaucaagaaguucaagcucucccucgucggccucgccaagcucgccuucugcuccgccaccguccaccuccucucccagguccucuacuucuuccucaucugcgaguccaaguccgucgccggccucacccucaccuacgacggcaacucccccguccgcucccacgucgacgucccccucuccuacugcaacuccgagugcaacugcgacgagucccagugggagcccgucugcggcaacaacggcaucaccuaccucucccccugccucgccggcugcaaguccuccuccggcaacaaggagcccaucgucuucuacaacugcuccugcgucgaggucaucggccuccagaacaagaacuacuccgcccaccucggcgagugcccccgcgacgacgccugcacccgcaaguccuacgucuacuucgucauccagguccucgacgccuuccucugcgccgucggccucaccuccuacuccguccucgucauccgcaucguccagcccgagcucaaggcccucgccaucggcuuccacuccaugaucaugcgcucccucggcggcauccucguccccaucuacuucggcgcccucaucgacaccaccugcaugaagugguccaccaacuccugcggcgcccgcggcgccugccgcaucuacaacuccaccuaccucggccgcgccuucuucggccucaaggucgcccucaucuuccccguccucguccuccucaccgucuucaucuucgucguccgcaagaagucccacggcaaggacaccaagguccucgagaacgagcgccaggucauggacgaggccaaccucgaguuccucaacgacuccgagcacuucguccccuccgccgaggagcaguga

SEQ ID NO: 49798 - RNA, 1992 nt, Artificial Sequence
  derived and/or modified sequence opt2 from SLCO1C1__Homo_sapiens__NP_001139417
auggacaccuccuccaaggagaacauccagcucuucugcaagaccuccguccagcccgucggccgccccuccuucaagaccgaguaccccuccuccgaggagaagcagcccugcugcggcgagcucaaggucuuccucugcgcccucuccuucgucuacuucgccaaggcccucgccgagggcuaccucaaguccaccaucacccagaucgagcgccgcuucgacauccccuccucccucgucggcgucaucgacggcuccuucgagaucggcaaccuccucgucaucaccuucgucuccuacuucggcgccaagcuccaccgccccaagaucaucggcgccggcugcgucaucaugggcgucggcacccuccucaucgccaugccccaguucuucauggagcaguacaaguacgagcgcuacucccccuccuccaacuccacccucuccaucucccccugccuccucgaguccuccucccagcuccccgucuccgucauggagaaguccaaguccaagaucuccaacggcugcguccagaccgucgccaucaucggccccaucuucggcuuccuccucggcucccucugcgccaagcucuacgucgacaucggcuucgucaaccucgaccacaucaccaucacccccaaggacccccagugggucggcgccugguggcucggcuaccucaucgccggcaucaucucccuccucgccgccguccccuucugguaccuccccaagucccucccccgcucccagucccgcgaggacuccaacuccuccuccgagaaguccaaguucaucaucgacgaccacaccgacuaccagaccccccagggcgagaacgccaagaucauggagauggcccgcgacuuccuccccucccucaagaaccucuucggcaaccccgucuacuuccucuaccucugcaccuccaccguccaguucaacucccucuucggcauggucaccuacaagcccaaguacaucgagcagcaguacggccaguccuccucccgcgccaacuucgucaucggccucaucaacauccccgccgucgcccucggcaucuucuccggcggcaucgucaugaagaaguuccgcaucuccgucugcggcgccgccaagcucuaccucggcuccuccgucuucggcuaccuccucuuccucucccucuucgcccucggcugcgagaacuccgacgucgccggccucaccgucuccuaccagggcaccaagcccgucuccuaccacgagcgcgcccucuucuccgacugcaacucccgcugcaagugcuccgagaccaagugggagcccaugugcggcgagaacggcaucaccuacgucuccgccugccucgccggcugccagaccuccaaccgcuccggcaagaacaucaucuucuacaacugcaccugcgucggcaucgccgccuccaaguccggcaacuccuccggcaucgucggccgcugccagaaggacaacggcugcccccagauguuccucuacuuccucgucaucuccgucaucaccuccuacacccucucccucggcggcauccccggcuacauccuccuccuccgcugcaucaagccccagcucaaguccuucgcccucggcaucuacacccucgccauccgcguccucgccggcauccccgcccccgucuacuucggcguccucaucgacaccuccugccucaaguggggcuucaagcgcugcggcucccgcggcuccugccgccucuacgacuccaacgucuuccgccacaucuaccucggccucaccgucauccucggcaccgucuccauccuccucuccaucgccguccucuucauccucaagaagaacuacgucuccaagcaccgcuccuucaucaccaagcgcgagcgcaccauggucuccacccgcuuccagaaggagaacuacaccaccuccgaccaccuccuccagcccaacuacuggcccggcaaggagacccagcucuga

SEQ ID NO: 49799 - RNA, 1932 nt, Artificial Sequence
  derived and/or modified sequence opt2 from SLCO2A1__Homo_sapiens__NP_005621
augggccuccuccccaagcucggcgccucccagggcuccgacaccuccaccucccgcgccggccgcugcgcccgcuccgucuucggcaacaucaaggucuucguccucugccagggccuccuccagcucugccagcuccucuacuccgccuacuucaaguccucccucaccaccaucgagaagcgcuucggccucuccuccuccuccuccggccucaucuccucccucaacgagaucuccaacgccauccucaucaucuucgucuccuacuucggcucccgcguccaccgcccccgccucaucggcaucggcggccucuuccucgccgccggcgccuucauccucacccucccccacuuccucuccgagcccuaccaguacacccucgccuccaccggcaacaacucccgccuccaggccgagcucugccagaagcacuggcaggaccucccccccuccaagugccacuccaccacccagaacccccagaaggagaccuccuccauguggggccucauggucgucgcccagcuccucgccggcaucggcaccguccccauccagcccuucggcaucuccuacgucgacgacuucuccgagcccuccaacuccccccucuacaucuccauccucuucgccaucuccgucuucggccccgccuucggcuaccuccucggcuccgucaugcuccagaucuucgucgacuacggccgcgucaacaccgccgccgucaaccucguccccggcgacccccgcuggaucggcgccugguggcucggccuccucaucuccuccgcccuccucguccucaccuccuuccccuucuucuucuucccccgcgccaugcccaucggcgccaagcgcgcccccgccaccgccgacgaggcccgcaagcucgaggaggccaagucccgcggcucccucgucgacuucaucaagcgcuuccccugcaucuuccuccgccuccucaugaacucccucuucguccucgucguccucgcccagugcaccuucuccuccgucaucgccggccucuccaccuuccucaacaaguuccucgagaagcaguacggcaccuccgccgccuacgccaacuuccucaucggcgccgucaaccuccccgccgccgcccucggcaugcucuucggcggcauccucaugaagcgcuucgucuucucccuccaggccaucccccgcaucgccaccaccaucaucaccaucuccaugauccucugcgucccccucuucuucaugggcugcuccacccccaccgucgccgaggucuacccccccuccaccuccuccuccauccacccccagucccccgccugccgccgcgacugcuccugccccgacuccaucuuccaccccgucugcggcgacaacggcaucgaguaccucucccccugccacgccggcugcuccaacaucaacauguccuccgccaccuccaagcagcucaucuaccucaacugcuccugcgucaccggcggcuccgccuccgccaagaccggcuccugccccguccccugcgcccacuuccuccuccccgccaucuuccucaucuccuucgucucccucaucgccugcaucucccacaacccccucuacaugaugguccuccgcgucgucaaccaggaggagaaguccuucgccaucggcguccaguuccuccucaugcgccuccucgccuggcuccccucccccgcccucuacggccucaccaucgaccacuccugcauccgcuggaacucccucugccucggccgccgcggcgccugcgccuacuacgacaacgacgcccuccgcgaccgcuaccucggccuccagaugggcuacaaggcccucggcaugcuccuccucugcuucaucuccuggcgcgucaagaagaacaaggaguacaacguccagaaggccgccggccucaucuga

SEQ ID NO: 49800 - RNA, 2064 nt, Artificial Sequence
  derived and/or modified sequence opt2 from SLCO2B1__Homo_sapiens__NP_001138683
augggcaccgagaacacccccggcggcaaggccucccccgacccccaggacguccgccccuccgucuuccacaacaucaagcucuucguccucugccacucccuccuccagcucgcccagcucaugaucuccggcuaccucaaguccuccaucuccaccgucgagaagcgcuucggccucuccucccagaccuccggccuccucgccuccuucaacgaggucggcaacaccgcccucaucgucuucgucuccuacuucggcucccgcguccaccgcccccgcaugaucggcuacggcgccauccucgucgcccucgccggccuccucaugacccucccccacuucaucuccgagcccuaccgcuacgacaacaccucccccgaggacaugccccaggacuucaaggccucccucugccuccccaccaccuccgcccccgccuccgcccccuccaacggcaacugcuccuccuacaccgagacccagcaccucuccgucgucggcaucauguucgucgcccagacccuccucggcgucggcggcguccccauccagcccuucggcaucuccuacaucgacgacuucgcccacaacuccaacuccccccucuaccucggcauccucuucgccgucaccaugaugggccccggccucgccuucggccucggcucccucaugcuccgccucuacgucgacaucaaccagaugcccgagggcggcaucucccucaccaucaaggacccccgcugggucggcgccugguggcucggcuuccucaucgccgccggcgccgucgcccucgccgccauccccuacuucuucuuccccaaggagaugcccaaggagaagcgcgagcuccaguuccgccgcaagguccucgccgucaccgacucccccgcccgcaagggcaaggacucccccuccaagcagucccccggcgaguccaccaagaagcaggacggccucguccagaucgcccccaaccucaccgucauccaguucaucaaggucuucccccgcguccuccuccagacccuccgccaccccaucuuccuccucgucguccucucccaggucugccucuccuccauggccgccggcauggccaccuuccuccccaaguuccucgagcgccaguucuccaucaccgccuccuacgccaaccuccucaucggcugccucuccuuccccuccgucaucgucggcaucgucgucggcggcguccucgucaagcgccuccaccucggccccgucggcugcggcgcccucugccuccucggcaugcuccucugccucuucuucucccucccccucuucuucaucggcugcuccucccaccagaucgccggcaucacccaccagaccuccgcccaccccggccucgagcucucccccuccugcauggaggccugcuccugcccccucgacggcuucaaccccgucugcgaccccuccacccgcgucgaguacaucacccccugccacgccggcugcuccuccugggucguccaggacgcccucgacaacucccaggucuucuacaccaacugcuccugcgucgucgagggcaaccccguccucgccggcuccugcgacuccaccugcucccaccucgucguccccuuccuccuccucgucucccucggcuccgcccucgccugccucacccacacccccuccuucaugcucauccuccgcggcgucaagaaggaggacaagacccucgccgucggcauccaguucauguuccuccgcauccucgccuggaugcccucccccgucauccacggcuccgccaucgacaccaccugcguccacugggcccucuccugcggccgccgcgccgucugccgcuacuacaacaacgaccuccuccgcaaccgcuucaucggccuccaguucuucuucaagaccggcuccgucaucugcuucgcccucguccucgccguccuccgccagcaggacaaggaggcccgcaccaaggagucccgcuccucccccgccgucgagcagcagcuccucgucuccggccccggcaagaagcccgaggacucccgcgucuga

SEQ ID NO: 49801 - RNA, 2079 nt, Artificial Sequence
  derived and/or modified sequence opt2 from SLCO3A1__Homo_sapiens__NP_001138516
augcagggcaagaagcccggcggcuccuccggcggcggccgcuccggcgagcuccagggcgacgaggcccagcgcaacaagaagaagaagaagaaggucuccugcuucuccaacaucaagaucuuccucgucuccgagugcgcccucaugcucgcccagggcaccgucggcgccuaccucgucuccguccucaccacccucgagcgccgcuucaaccuccaguccgccgacgucggcgucaucgccuccuccuucgagaucggcaaccucgcccucauccucuucgucuccuacuucggcgcccgcggccaccgcccccgccucaucggcugcggcggcaucgucauggcccucggcgcccuccucuccgcccuccccgaguuccucacccaccaguacaaguacgaggccggcgagauccgcuggggcgccgagggccgcgacgucugcgccgccaacggcuccggcggcgacgagggccccgaccccgaccucaucugccgcaaccgcaccgccaccaacaugauguaccuccuccucaucggcgcccagguccuccucggcaucggcgccacccccguccagccccucggcgucuccuacaucgacgaccacguccgccgcaaggacuccucccucuacaucggcauccucuucaccaugcucgucuucggccccgccugcggcuucauccucggcuccuucugcaccaagaucuacgucgacgccgucuucaucgacaccuccaaccucgacaucacccccgacgacccccgcuggaucggcgccugguggggcggcuuccuccucugcggcgcccuccucuucuucuccucccuccucauguucggcuucccccagucccuccccccccacuccgagcccgccauggaguccgagcaggccaugcucuccgagcgcgaguacgagcgccccaagcccuccaacggcguccuccgccacccccucgagcccgacuccuccgccuccugcuuccagcagcuccgcgucauccccaaggucaccaagcaccuccucuccaaccccgucuucaccugcaucauccucgccgccugcauggagaucgccgucgucgccggcuucgccgccuuccucggcaaguaccucgagcagcaguucaaccucaccaccuccuccgccaaccagcuccucggcaugaccgccauccccugcgccugccucggcaucuuccucggcggccuccucgucaagaagcucucccucuccgcccucggcgccauccgcauggccaugcucgucaaccucgucuccaccgccugcuacgucuccuuccucuuccucggcugcgacaccggccccgucgccggcgucaccguccccuacggcaacuccaccgcccccggcuccgcccucgaccccuacucccccugcaacaacaacugcgagugccagaccgacuccuucacccccgucugcggcgccgacggcaucaccuaccucuccgccugcuucgccggcugcaacuccaccaaccucaccggcugcgccugccucaccaccguccccgccgagaacgccaccgucguccccggcaagugccccucccccggcugccaggaggccuuccucaccuuccucugcgucaugugcaucugcucccucaucggcgccauggcccagacccccuccgucaucauccucauccgcaccgucucccccgagcucaaguccuacgcccucggcguccucuuccuccuccuccgccuccucggcuucaucccccccccccucaucuucggcgccggcaucgacuccaccugccucuucugguccaccuucugcggcgagcagggcgccugcguccucuacgacaacgucgucuaccgcuaccucuacgucuccaucgccaucgcccucaaguccuucgccuucauccucuacaccaccaccuggcagugccuccgcaagaacuacaagcgcuacaucaagaaccacgagggcggccucuccaccuccaccgaguaccaggacaucgagaccgagaagaccugccccgagucccacucccccuccgaggacuccuucguccgcuccuga

SEQ ID NO: 49802 - RNA, 2169 nt, Artificial Sequence
  derived and/or modified sequence opt2 from SLCO4A1__Homo_sapiens__NP_057438
augccccuccaccagcucggcgacaagccccucaccuuccccucccccaacuccgccauggagaacggccucgaccacaccccccccucccgccgcgccucccccggcaccccccucucccccggcucccuccgcuccgccgcccacuccccccucgacaccuccaagcagccccucugccagcucugggccgagaagcacggcgcccgcggcacccacgagguccgcuacgucuccgccggccaguccgucgccugcggcuggugggccuucgccccccccugccuccagguccucaacacccccaagggcauccucuucuuccucugcgccgccgccuuccuccagggcaugaccgucaacggcuucaucaacaccgucaucaccucccucgagcgccgcuacgaccuccacuccuaccaguccggccucaucgccuccuccuacgacaucgccgccugccucugccucaccuucgucuccuacuucggcggcuccggccacaagccccgcuggcucggcuggggcguccuccucaugggcaccggcucccucgucuucgcccucccccacuucaccgccggccgcuacgaggucgagcucgacgccggcguccgcaccugccccgccaaccccggcgccgucugcgccgacuccaccuccggccucucccgcuaccagcucgucuucaugcucggccaguuccuccacggcgucggcgccaccccccucuacacccucggcgucaccuaccucgacgagaacgucaaguccuccugcucccccgucuacaucgccaucuucuacaccgccgccauccucggccccgccgccggcuaccucaucggcggcgcccuccucaacaucuacaccgagaugggccgccgcaccgagcucaccaccgaguccccccucugggucggcgccuggugggucggcuuccucggcuccggcgccgccgccuucuucaccgccguccccauccucggcuacccccgccagcuccccggcucccagcgcuacgccgucaugcgcgccgccgagaugcaccagcucaaggacuccucccgcggcgaggccuccaaccccgacuucggcaagaccauccgcgaccucccccucuccaucuggcuccuccucaagaaccccaccuucauccuccucugccucgccggcgccaccgaggccacccucaucaccggcauguccaccuucucccccaaguuccucgagucccaguucucccucuccgccuccgaggccgccacccucuucggcuaccucgucguccccgccggcggcggcggcaccuuccucggcggcuucuucgucaacaagcuccgccuccgcggcuccgccgucaucaaguucugccucuucugcaccgucgucucccuccucggcauccucgucuucucccuccacugccccuccguccccauggccggcgucaccgccuccuacggcggcucccuccuccccgagggccaccucaaccucaccgcccccugcaacgccgccugcuccugccagcccgagcacuacucccccgucugcggcuccgacggccucauguacuucucccucugccacgccggcugccccgccgccaccgagaccaacgucgacggccagaaggucuaccgcgacugcuccugcaucccccagaaccucuccuccggcuucggccacgccaccgccggcaagugcaccuccaccugccagcgcaagccccuccuccucgucuucaucuucgucgucaucuucuucaccuuccucuccuccauccccgcccucaccgccacccuccgcugcguccgcgacccccagcgcuccuucgcccucggcauccaguggaucgucguccgcauccucggcggcauccccggccccaucgccuucggcugggucaucgacaaggccugccuccucuggcaggaccagugcggccagcagggcuccugccucgucuaccagaacuccgccaugucccgcuacauccucaucaugggccuccucuacaagguccucggcguccucuucuucgccaucgccugcuuccucuacaagccccucuccgaguccuccgacggccucgagaccugccuccccucccaguccuccgcccccgacuccgccaccgacucccagcuccaguccuccgucuga

SEQ ID NO: 49803 - RNA, 2175 nt, Artificial Sequence
  derived and/or modified sequence opt2 from SLCO4C1__Homo_sapiens__NP_851322
augaaguccgccaagggcaucgagaaccucgccuucguccccuccucccccgacauccuccgccgccucuccgccucccccucccagaucgaggucuccgcccucuccuccgacccccagcgcgagaacucccagccccaggagcuccagaagccccaggagccccagaagucccccgagcccucccuccccuccgccccccccaacgucuccgaggagaagcuccgcucccucucccucuccgaguucgaggagggcuccuacggcuggcgcaacuuccacccccagugccuccagcgcugcaacacccccggcggcuuccuccuccacuacugccuccucgccgucacccagggcaucgucgucaacggccucgucaacaucuccaucuccaccgucgagaagcgcuacgagaugaaguccucccucaccggccucaucuccuccuccuacgacaucuccuucugccuccucucccucuucgucuccuucuucggcgagcgcggccacaagccccgcuggcucgccuucgccgccuucaugaucggccucggcgcccucgucuucucccucccccaguucuucuccggcgaguacaagcucggcucccucuucgaggacaccugcgucaccacccgcaacuccaccuccugcaccuccuccaccuccucccucuccaacuaccucuacgucuucauccucggccagcuccuccucggcgccggcggcaccccccucuacacccucggcaccgccuuccucgacgacuccguccccacccacaaguccucccucuacaucggcaccggcuacgccauguccauccucggccccgccaucggcuacguccucggcggccagcuccucaccaucuacaucgacgucgccaugggcgaguccaccgacgucaccgaggacgacccccgcuggcucggcgccugguggaucggcuuccuccucuccuggaucuucgccuggucccucaucauccccuucuccugcuuccccaagcaccuccccggcaccgccgagauccaggccggcaagaccucccaggcccaccaguccaacuccaacgccgacgucaaguucggcaaguccaucaaggacuuccccgccgcccucaagaaccucaugaagaacgccgucuucaugugccucguccucuccaccuccuccgaggcccucaucaccaccggcuucgccaccuuccuccccaaguucaucgagaaccaguucggccucaccuccuccuucgccgccacccucggcggcgccguccucauccccggcgccgcccucggccagauccucggcggcuuccucgucuccaaguuccgcaugaccugcaagaacaccaugaaguucgcccucuucaccuccggcgucgcccucacccucuccuucgucuucauguacgccaagugcgagaacgagcccuucgccggcgucuccgaguccuacaacggcaccggcgagcucggcaaccucaucgcccccugcaacgccaacugcaacugcucccgcuccuacuacuaccccgucugcggcgacggcguccaguacuucucccccugcuucgccggcugcuccaaccccgucgcccaccgcaagcccaaggucuacuacaacugcuccugcaucgagcgcaagaccgagaucaccuccaccgccgagaccuucggcuucgaggccaaggccggcaagugcgagacccacugcgccaagcuccccaucuuccucugcaucuucuucaucgucaucaucuucaccuucauggccggcacccccaucaccgucuccauccuccgcugcgucaaccaccgccagcgcucccucgcccucggcauccaguucaugguccuccgccuccucggcaccauccccggccccaucaucuucggcuucaccaucgacuccaccugcauccucugggacaucaacgacugcggcaucaagggcgccugcuggaucuacgacaacaucaagauggcccacaugcucgucgccaucuccgucaccugcaaggucaucaccauguucuucaacggcuucgccaucuuccucuacaagcccccccccuccgccaccgacgucuccuuccacaaggagaacgccgucgucaccaacguccucgccgagcaggaccucaacaagaucgucaaggagggcuga

SEQ ID NO: 49804 - RNA, 2064 nt, Artificial Sequence
  derived and/or modified sequence opt2 from SLCO5A1__Homo_sapiens__NP_001139480
auggacgagggcaccggccuccagcccggcgccggcgagcagcucgaggcccccgccaccgccgaggccguccaggagcgcugcgagcccgagacccuccgcuccaagucccuccccguccucuccuccgccuccugccgccccucccucucccccaccuccggcgacgccaaccccgccuucggcugcgucgacuccuccggccaccaggagcucaagcagggccccaacccccucgcccccucccccuccgcccccuccaccuccgccggccucggcgacugcaaccaccgcgucgaccucuccaagaccuucuccgucuccuccgcccucgccaugcuccaggagcgccgcugccucuacgucguccucaccgacucccgcugcuuccucgucugcaugugcuuccucaccuucauccaggcccucauggucuccggcuaccucuccuccgucaucaccaccaucgagcgccgcuacucccucaaguccuccgaguccggccuccucgucuccugcuucgacaucggcaaccucgucgucgucgucuucgucuccuacuucggcggccgcggccgccgcccccucuggcucgccgucggcggccuccucaucgccuucggcgccgcccucuucgcccucccccacuucaucuccccccccuaccagauccaggagcucaacgccuccgcccccaacgacggccucugccagggcggcaacuccaccgccacccucgagccccccgccugccccaaggacuccggcggcaacaaccacugggucuacgucgcccucuucaucugcgcccagauccucaucggcaugggcuccacccccaucuacacccucggccccaccuaccucgacgacaacgucaagaaggagaacuccucccucuaccucgccaucauguacgucaugggcgcccucggccccgccgucggcuaccuccucggcggccuccucaucggcuucuacgucgacccccgcaaccccguccaccucgaccagaacgacccccgcuucaucggcaacuggugguccggcuuccuccucugcgccaucgccauguuccucgucaucuuccccauguucaccuuccccaagaagcuccccccccgccacaagaagaagaagaagaagaaguucuccgucgacgccgucuccgacgacgacguccucaaggagaaguccaacaacuccgagcaggccgacaagaaggucuccuccaugggcuucggcaaggacguccgcgaccucccccgcgccgccguccgcauccucuccaacaugaccuuccucuucgucucccucuccuacaccgccgaguccgccaucgucaccgccuucaucaccuucauccccaaguucaucgagucccaguucggcauccccgccuccaacgccuccaucuacaccggcgucaucaucguccccuccgccggcgucggcaucguccucggcggcuacaucaucaagaagcucaagcucggcgcccgcgaguccgccaagcucgccaugaucugcuccggcgucucccuccucugcuucuccacccucuucaucgucggcugcgaguccaucaaccucggcggcaucaacauccccuacaccaccggccccucccucaccaugccccaccgcaaccucaccggcuccugcaacgucaacugcggcugcaagauccacgaguacgagcccgucugcggcuccgacggcaucaccuacuucaaccccugccucgccggcugcgucaacuccggcaaccucuccaccggcauccgcaacuacaccgagugcaccugcguccagucccgccaggucaucaccccccccaccgucggccagcgcucccagcuccgcgucgucaucgucaagaccuaccucaacgagaacggcuacgccgucuccggcaagugcaagcgcaccugcaacacccucauccccuuccucgucuuccucuucaucgucaccuucaucaccgccugcgcccagcccuccgccaucaucgucacccucuccauccacuccuacuccaaccuccucugguccucccacuga

SEQ ID NO: 49805 - RNA, 2160 nt, Artificial Sequence
  derived and/or modified sequence opt2 from SLCO6A1__Homo_sapiens__NP_001275931
auguucgucggcgucgcccgccacuccggcucccaggacgaggucucccgcggcgucgagccccucgaggccgcccgcgcccagcccgccaaggaccgccgcgccaagggcacccccaaguccuccaagcccggcaagaagcaccgcuaccuccgccuccuccccgaggcccucauccgcuucggcggcuuccgcaagcgcaagaaggccaaguccuccgucuccaagaagcccggcgaggucgacgacucccucgagcagcccugcggccucggcugccucgucuccaccugcugcgagugcugcaacaacauccgcugcuucaugaucuucuacugcauccuccucaucugccagggcgucgucuucggccucaucgacgucuccaucggcgacuuccagaaggaguaccagcucaagaccaucgagaagcucgcccucgagaaguccuacgacaucuccuccggccucgucgccaucuucaucgccuucuacggcgaccgcaagaaggucaucugguucgucgccuccuccuuccucaucggccucggcucccuccucugcgccuuccccuccaucaacgaggagaacaagcaguccaaggucggcaucgaggacaucugcgaggagaucaaggucgucuccggcugccaguccuccggcaucuccuuccaguccaaguaccucuccuucuucauccucggccagaccguccagggcaucgccggcaugccccucuacauccucggcaucaccuucaucgacgagaacgucgccacccacuccgccggcaucuaccucggcaucgccgagugcaccuccaugaucggcuacgcccucggcuacguccucggcgccccccucgucaagguccccgagaacaccaccuccgccaccaacaccaccgucaacaacggcucccccgaguggcucuggaccugguggaucaacuuccucuucgccgccgucgucgccuggugcacccucaucccccucuccugcuuccccaacaacaugcccggcuccacccgcaucaaggcccgcaagcgcaagcagcuccacuucuucgacucccgccucaaggaccucaagcucggcaccaacaucaaggaccucugcgccgcccucuggauccucaugaagaaccccguccucaucugccucgcccucuccaaggccaccgaguaccucgucaucaucggcgccuccgaguuccuccccaucuaccucgagaaccaguucauccucacccccaccgucgccaccacccucgccggccucguccucauccccggcggcgcccucggccagcuccucggcggcgucaucgucuccacccucgagauguccugcaaggcccucaugcgcuucaucauggucaccuccgucaucucccucauccuccucgucuucaucaucuucguccgcugcaaccccguccaguucgccggcaucaacgaggacuacgacggcaccggcaagcucggcaaccucaccgcccccugcaacgagaagugccgcugcuccuccuccaucuacuccuccaucugcggccgcgacgacaucgaguacuucucccccugcuucgccggcugcaccuacuccaaggcccagaaccagaagaagauguacuacaacugcuccugcaucaaggagggccucaucaccgccgacgccgagggcgacuucaucgacgcccgccccggcaagugcgacgccaagugcuacaagcucccccucuucaucgccuucaucuucuccacccucaucuucuccggcuucuccggcguccccaucguccucgccaugacccgcgucguccccgacaagcuccgcucccucgcccucggcgucuccuacgucauccuccgcaucuucggcaccauccccggccccuccaucuucaagauguccggcgagaccuccugcauccuccgcgacgucaacaagugcggccacaccggccgcugcuggaucuacaacaagaccaagauggccuuccuccucgucggcaucugcuuccucugcaagcucugcaccaucaucuucaccaccaucgccuucuucaucuacaagcgccgccucaacgagaacaccgacuuccccgacgucaccgucaagaaccccaaggucaagaagaaggaggagaccgaccucuga

SEQ ID NO: 49806 - RNA, 1737 nt, Artificial Sequence
  derived and/or modified sequence opt2 from SLFN12__Homo_sapiens__NP_001275938
augaacaucuccgucgaccucgagaccaacuacgccgagcucguccucgacgucggccgcgucacccucggcgagaacucccgcaagaagaugaaggacugcaagcuccgcaagaagcagaacgaguccgucucccgcgccaugugcgcccuccucaacuccggcggcggcgucaucaaggccgagaucgagaacgaggacuacuccuacaccaaggacggcaucggccucgaccucgagaacuccuucuccaacauccuccucuucguccccgaguaccucgacuucaugcagaacggcaacuacuuccucaucuucgucaaguccuggucccucaacaccuccggccuccgcaucaccacccucuccuccaaccucuacaagcgcgacaucaccuccgccaaggucaugaacgccaccgccgcccucgaguuccucaaggacaugaagaagacccgcggccgccucuaccuccgccccgagcuccucgccaagcgccccugcgucgacauccaggaggagaacaacaugaaggcccucgccggcgucuucuucgaccgcaccgagcucgaccgcaaggagaagcucaccuucaccgaguccacccacgucgagaucaagaacuucuccaccgagaagcuccuccagcgcaucaaggagauccucccccaguacgucuccgccuucgccaacaccgacggcggcuaccucuucaucggccucaacgaggacaaggagaucaucggcuucaaggccgagauguccgaccucgacgaccucgagcgcgagaucgagaaguccauccgcaagaugcccguccaccacuucugcauggagaagaagaagaucaacuacuccugcaaguuccucggcgucuacgacaagggcucccucugcggcuacgucugcgcccuccgcgucgagcgcuucugcugcgccgucuucgccaaggagcccgacuccuggcacgucaaggacaaccgcgucaugcagcucacccgcaaggaguggauccaguucauggucgaggccgagcccaaguucuccuccuccuacgaggaggucaucucccagaucaacaccucccuccccgccccccacuccuggccccuccucgaguggcagcgccagcgccaccacugccccggccucuccggccgcaucaccuacacccccgagaaccucugccgcaagcucuuccuccagcacgagggccucaagcagcucaucugcgaggagauggacuccguccgcaagggcucccucaucuucucccgcuccugguccgucgaccucggccuccaggagaaccacaagguccucugcgacgcccuccucaucucccaggacuccccccccguccucuacaccuuccacaugguccaggacgaggaguucaagggcuacuccacccagaccgcccucacccucaagcagaagcucgccaagaucggcggcuacaccaagaaggucugcgucaugaccaagaucuucuaccucucccccgagggcaugaccuccugccaguacgaccuccgcucccaggucaucuaccccgaguccuacuacuucacccgccgcaaguaccuccucaaggcccucuucaaggcccucaagcgccucaagucccuccgcgaccaguucuccuucgccgagaaccucuaccagaucaucggcaucgacugcuuccagaagaacgacaagaagauguucaaguccugccgccgccucaccuga

SEQ ID NO: 49807 - RNA, 1767 nt, Artificial Sequence
  derived and/or modified sequence opt2 from SLFN12L__Homo_sapiens__XP_011522471
auggaccucgcccgcaaggaguuccuccgcggcaacggccucgccgccggcaagaugaacaucuccaucgaccucgacaccaacuacgccgagcucguccucaacgucggccgcgucacccucggcgagaacaaccgcaagaagaugaaggacugccagcuccgcaagcagcagaacgagaacgucucccgcgccgucugcgcccuccucaacuccggcggcggcgucaucaaggccgaggucgagaacaagggcuacuccuacaagaaggacggcaucggccucgaccucgagaacuccuucuccaacaugcuccccuucguccccaacuuccucgacuucaugcagaacggcaacuacuuccacaucuucgucaaguccuggucccucgagaccuccggcccccagaucgccacccucuccuccucccucuacaagcgcgacgucaccuccgccaaggucaugaacgccuccgccgcccucgaguuccucaaggacauggagaagaccggcggccgcgccuaccuccgccccgaguuccccgccaagcgcgccugcgucgacguccaggaggaguccaacauggaggcccucgccgccgacuucuucaaccgcaccgagcucggcuacaaggagaagcucaccuucaccgaguccacccacgucgagaucaagaacuucuccaccgagaagcuccuccagcgcaucaccgagauccucccccaguacgucuccgccuucgccaacaccgacggcggcuaccucuucgucggccucaacgaggacaaggaggucaucggcuucaaggccgagaaguccuaccucaccaagcucgaggaggucaccaagaacuccaucggcaagcuccccguccaccacuucugcgucgagaagggcaccaucaacuaccucugcaaguuccucggcgucuacgacaagggccgccucugcggcuacgucuacgcccuccgcgucgagcgcuucugcugcgccgucuucgccaagaagcccgacuccuggcacgucaaggacaaccgcgucaagcagcucaccgagaaggaguggauccaguucauggucgacuccgagcccgucugcgaggagcuccccucccccgccuccaccuccucccccgucucccaguccuacccccuccgcgaguacaucaacuucaagauccagccccuccgcuaccaccuccccggccucuccgagaagaucaccugcgcccccaagaccuucugccgcaaccucuucucccagcacgagggccucaagcagcucaucugcgaggagaugggcuccgucaacaagggcucccucaucuucucccgcuccuggucccucgaccucggccuccaggagaaccacaagguccucugcgacgcccuccucaucucccaggacaagccccccguccucuacaccuuccacaugguccaggacgaggaguucaaggacuacuccacccagaccgcccagacccucaagcagaagcucgccaagaucggcggcuacaccaagaaggucugcgucaugaccaagaucuucuaccucucccccgagggcaagaccuccugccaguacgaccucaacucccaggucaucuaccccgaguccuacuacuggaccaccgcccagaccaugaaggaccucgagaaggcccucuccaacauccuccccaaggagaaccagaucuuccucuucgucugccucuuccgcuucugccucuucgucugcugguucgucugcuucuuccuccgcuga

SEQ ID NO: 49808 - RNA, 2739 nt, Artificial Sequence
  derived and/or modified sequence opt2 from SLFN14__Homo_sapiens__NP_001123292
auggagucccucaagaccgacaccgagaugcccuaccccgaggucaucgucgacgucggccgcgucaucuucggcgaggagaaccgcaagaagaugaccaacuccugccucaagcgcuccgagaacucccgcaucauccgcgccaucugcgcccuccucaacuccggcggcggcgucaucaaggccgagaucgacgacaagaccuacuccuaccagugccacggccucggccaggaccucgagaccuccuuccagaagcuccuccccuccggcucccagaaguaccucgacuacaugcagcagggccacaaccuccucaucuucgucaaguccuggucccccgacgucuucucccucccccuccgcaucugcucccuccgcuccaaccucuaccgccgcgacgucaccuccgccaucaaccucuccgccuccuccgcccucgagcuccuccgcgagaagggcuuccgcgcccagcgcggccgcccccgcgucaagaagcuccacccccagcagguccucaaccgcugcauccaggaggaggaggacaugcgcauccucgccuccgaguucuucaagaaggacaagcucauguacaaggagaagcucaacuucaccgaguccacccacgucgaguucaagcgcuucaccaccaagaaggucaucccccgcaucaaggagaugcucccccacuacgucuccgccuucgccaacacccagggcggcuacguccucaucggcgucgacgacaaguccaaggaggucgucggcugcaagugggagaaggucaaccccgaccuccucaagaaggagaucgagaacugcaucgagaagcuccccaccuuccacuucugcugcgagaagcccaaggucaacuucaccaccaagauccucaacgucuaccagaaggacguccucgacggcuacgucugcgucauccaggucgagcccuucugcugcgucgucuucgccgaggcccccgacuccuggaucaugaaggacaacuccgucacccgccucaccgccgagcagugggucgucaugaugcucgacacccaguccgccccccccucccucgucaccgacuacaacuccugccucaucuccuccgccuccuccgcccgcaagucccccggcuaccccaucaagguccacaaguucaaggaggcccuccagcgccaccucuuccccgucacccaggaggagguccaguucaagcccgagucccucugcaagaagcucuucuccgaccacaaggagcucgagggccucaugaagacccucauccaccccugcucccagggcaucgucaucuucucccgcuccugggccggcgacgucggcuuccgcaaggagcagaacguccucugcgacgcccuccucaucgccgucaacucccccgucguccucuacaccauccucaucgaccccaacuggcccggcggccucgaguacgcccgcaacaccgcccaccagcucaagcagaagcuccagaccgucggcggcuacaccggcaaggucugcaucaucccccgccucauccaccucuccuccacccagucccgccccggcgagaucccccuccgcuacccccgcuccuaccgccucgccgacgaggaggagauggaggaccuccuccaggcccucgucgucgucucccucuccucccgcucccuccucuccgaccagaugggcugcgaguucuucaaccuccucaucauggagcagucccagcuccucuccgagucccuccagaagacccgcgagcucuucaucuacugcuuccccggcguccgcaagaccgcccucgccaucaagaucauggagaagaucaaggaccucuuccacugcaagcccaaggagauccucuacgucugcgaguccgacucccucaaggacuucgucacccagcagaccaccugccaggccgucacccgcaagaccuucaugcagggcgaguuccucaagaucaagcacaucgucauggacgagaccgagaacuucugcuccaaguacggcaacugguacaugaaggccaagaacaucacccaccccaaggccaagggcaccggcuccgagaaccuccaccacggcauccucuggcucuuccucgaccccuuccagauccaccacgccgacgucaacggccuccccccccccuccgcccaguucccccgcaagaccaucaccuccggcauccacugcgcccucgagaucgccaaggucaugaaggaggagaugaagcgcaucaaggagaacccccccuccaacaugucccccgacacccucgcccucuucuccgagaccgccuacgaggaggccaccugcgcccaggcccuccccggcgucugcgagaccaagaccaaccucaccaccgagcagaucgccaacuacgucgcccgcaagugccacucccucuuccagugcggcuaccuccccaaggacaucgccauccucugccgccgcggcgaggaccgcggccgcuaccgccucgcccuccucaaggccauggagcucaucgagacccaccgccccuccgaggucgucuucucccccgccaccggcgucuggggcucccacaucguccucgacuccauccagcaguucuccggccucgagcgcaccgucgucuucggccucucccccgagugcgaccaguccgaggaguuccacaagcucugcuucgccucccgcgccaucaagcaccucuaccuccucuacgagaagcgcgccgccuacuga

SEQ ID NO: 49809 - RNA, 2676 nt, Artificial Sequence
  derived and/or modified sequence opt2 from SLFN5__Homo_sapiens__NP_659412
augucccuccgcaucgacgucgacaccaacuuccccgagugcgucgucgacgccggcaaggucacccucggcacccagcagcgccaggagauggacccccgccuccgcgagaagcagaacgagaucauccuccgcgccgucugcgcccuccucaacuccggcggcggcaucaucaaggccgagaucgagaacaagggcuacaacuacgagcgccacggcgucggccucgacgucccccccaucuuccgcucccaccucgacaagaugcagaaggagaaccacuuccucaucuucgucaaguccuggaacaccgaggccggcgucccccucgccacccucugcuccaaccucuaccaccgcgagcgcaccuccaccgacgucauggacucccaggaggcccucgccuuccucaagugccgcacccagacccccaccaacaucaacgucuccaacucccucggcccccaggccgcccagggcuccguccaguacgagggcaacaucaacgucuccgccgccgcccucuucgaccgcaagcgccuccaguaccucgagaagcucaaccuccccgaguccacccacgucgaguucgucauguucuccaccgacgucucccacugcgucaaggaccgccuccccaagugcgucuccgccuucgccaacaccgagggcggcuacgucuucuucggcguccacgacgagaccugccaggucaucggcugcgagaaggagaagaucgaccucaccucccuccgcgccuccaucgacggcugcaucaagaagcuccccguccaccacuucugcacccagcgccccgagaucaaguacguccucaacuuccucgagguccacgacaagggcgcccuccgcggcuacgucugcgccaucaaggucgagaaguucugcugcgccgucuucgccaagguccccuccuccuggcaggucaaggacaaccgcguccgccagcuccccacccgcgaguggaccgccuggaugauggaggccgaccccgaccucucccgcugccccgagaugguccuccagcucucccucuccuccgccaccccccgcuccaagcccgucugcauccacaagaacuccgagugccucaaggagcagcagaagcgcuacuuccccgucuucuccgaccgcgucgucuacacccccgagucccucuacaaggagcucuucucccagcacaagggccuccgcgaccucaucaacaccgagaugcgccccuucucccagggcauccucaucuucucccaguccugggccgucgaccucggccuccaggagaagcagggcgucaucugcgacgcccuccucaucucccagaacaacacccccauccucuacaccaucuucuccaagugggacgccggcugcaagggcuacuccaugaucgucgccuacucccucaagcagaagcucgucaacaagggcggcuacaccggccgccucugcaucaccccccucgucugcguccucaacuccgaccgcaaggcccaguccgucuacuccuccuaccuccagaucuaccccgaguccuacaacuucaugaccccccagcacauggaggcccuccuccagucccucgucaucguccuccucggcuucaaguccuuccucuccgaggagcucggcuccgagguccucaaccuccucaccaacaagcaguacgagcuccucuccaagaaccuccgcaagacccgcgagcucuucguccacggccuccccggcuccggcaagaccauccucgcccuccgcaucauggagaagauccgcaacgucuuccacugcgagcccgccaacauccucuacaucugcgagaaccagccccucaagaagcucgucuccuucuccaagaagaacaucugccagcccgucacccgcaagaccuucaugaagaacaacuucgagcacauccagcacaucaucaucgacgacgcccagaacuuccgcaccgaggacggcgacugguacggcaaggccaaguucaucacccagaccgcccgcgacggccccggcguccucuggaucuuccucgacuacuuccagaccuaccaccucuccugcuccggccuccccccccccuccgaccaguacccccgcgaggagaucaaccgcgucguccgcaacgccggccccaucgccaacuaccuccagcaggucaugcaggaggcccgccagaaccccccccccaaccucccccccggcucccucgucaugcucuacgagcccaagugggcccagggcguccccggcaaccucgagaucaucgaggaccucaaccucgaggagauccucaucuacgucgccaacaagugccgcuuccuccuccgcaacggcuacucccccaaggacaucgccguccucuucaccaaggccuccgaggucgagaaguacaaggaccgccuccucaccgccaugcgcaagcgcaagcucucccagcuccacgaggaguccgaccuccuccuccagaucggcgacgccuccgacguccucaccgaccacaucguccucgacuccgucugccgcuucuccggccucgagcgcaacaucgucuucggcaucaaccccggcgucgccccccccgccggcgccuacaaccuccuccucugccucgccucccgcgccaagcgccaccucuacauccucaaggccuccgucuga

SEQ ID NO: 49810 - RNA, 4605 nt, Artificial Sequence
  derived and/or modified sequence opt2 from SLIT1__Homo_sapiens__NP_003052
auggcccucacccccggcuggggcuccuccgccggccccguccgccccgagcucuggcuccuccucugggccgccgccuggcgccucggcgccuccgccugccccgcccucugcaccugcaccggcaccaccgucgacugccacggcaccggccuccaggccauccccaagaacaucccccgcaacaccgagcgccucgagcucaacggcaacaacaucacccgcauccacaagaacgacuucgccggccucaagcagcuccgcguccuccagcucauggagaaccagaucggcgccgucgagcgcggcgccuucgacgacaugaaggagcucgagcgccuccgccucaaccgcaaccagcuccacaugcuccccgagcuccucuuccagaacaaccaggcccucucccgccucgaccucuccgagaacgccauccaggccaucccccgcaaggccuuccgcggcgccaccgaccucaagaaccuccagcucgacaagaaccagaucuccugcaucgaggagggcgccuuccgcgcccuccgcggccucgagguccucacccucaacaacaacaacaucaccaccauccccgucuccuccuucaaccacaugcccaagcuccgcaccuuccgccuccacuccaaccaccucuucugcgacugccaccucgccuggcucucccaguggcuccgccagcgccccaccaucggccucuucacccagugcuccggccccgccucccuccgcggccucaacgucgccgagguccagaaguccgaguucuccugcuccggccagggcgaggccggccgcguccccaccugcacccucuccuccggcuccugccccgccaugugcaccugcuccaacggcaucgucgacugccgcggcaagggccucaccgccauccccgccaaccuccccgagaccaugaccgagauccgccucgagcucaacggcaucaaguccaucccccccggcgccuucucccccuaccgcaagcuccgccgcaucgaccucuccaacaaccagaucgccgagaucgcccccgacgccuuccagggccuccgcucccucaacucccucguccucuacggcaacaagaucaccgaccucccccgcggcgucuucggcggccucuacacccuccagcuccuccuccucaacgccaacaagaucaacugcauccgccccgacgccuuccaggaccuccagaaccucucccuccucucccucuacgacaacaagauccagucccucgccaagggcaccuucaccucccuccgcgccauccagacccuccaccucgcccagaaccccuucaucugcgacugcaaccucaaguggcucgccgacuuccuccgcaccaaccccaucgagaccuccggcgcccgcugcgccuccccccgccgccucgccaacaagcgcaucggccagaucaaguccaagaaguuccgcugcuccgccaaggagcaguacuucauccccggcaccgaggacuaccagcucaacuccgagugcaacuccgacgucgucugcccccacaagugccgcugcgaggccaacgucgucgagugcuccucccucaagcucaccaagauccccgagcgcaucccccaguccaccgccgagcuccgccucaacaacaacgagaucuccauccucgaggccaccggcauguucaagaagcucacccaccucaagaagaucaaccucuccaacaacaaggucuccgagaucgaggacggcgccuucgagggcgccgccuccgucuccgagcuccaccucaccgccaaccagcucgaguccauccgcuccggcauguuccgcggccucgacggccuccgcacccucaugcuccgcaacaaccgcaucuccugcauccacaacgacuccuucaccggccuccgcaacguccgccuccucucccucuacgacaaccagaucaccaccgucucccccggcgccuucgacacccuccagucccucuccacccucaaccuccucgccaaccccuucaacugcaacugccagcucgccuggcucggcggcuggcuccgcaagcgcaagaucgucaccggcaacccccgcugccagaaccccgacuuccuccgccagaucccccuccaggacgucgccuuccccgacuuccgcugcgaggagggccaggaggagggcggcugccucccccgcccccagugcccccaggagugcgccugccucgacaccgucguccgcugcuccaacaagcaccuccgcgcccuccccaagggcauccccaagaacgucaccgagcucuaccucgacggcaaccaguucacccucguccccggccagcucuccaccuucaaguaccuccagcucgucgaccucuccaacaacaagaucuccucccucuccaacuccuccuucaccaacaugucccagcucaccacccucauccucuccuacaacgcccuccagugcauccccccccucgccuuccagggccuccgcucccuccgccuccucucccuccacggcaacgacaucuccacccuccaggagggcaucuucgccgacgucaccucccucucccaccucgccaucggcgccaacccccucuacugcgacugccaccuccgcuggcucuccuccugggucaagaccggcuacaaggagcccggcaucgcccgcugcgccggcccccaggacauggagggcaagcuccuccucaccacccccgccaagaaguucgagugccagggcccccccacccucgccguccaggccaagugcgaccucugccucuccucccccugccagaaccagggcaccugccacaacgacccccucgaggucuaccgcugcgccugccccuccggcuacaagggccgcgacugcgaggucucccucgacuccugcuccuccggccccugcgagaacggcggcaccugccacgcccaggagggcgaggacgcccccuucaccugcuccugccccaccggcuucgagggccccaccugcggcgucaacaccgacgacugcgucgaccacgccugcgccaacggcggcgucugcgucgacggcgucggcaacuacaccugccagugcccccuccaguacgagggcaaggccugcgagcagcucgucgaccucugcucccccgaccucaaccccugccagcacgaggcccagugcgucggcacccccgacggcccccgcugcgagugcaugcccggcuacgccggcgacaacugcuccgagaaccaggacgacugccgcgaccaccgcugccagaacggcgcccagugcauggacgaggucaacuccuacuccugccucugcgccgagggcuacuccggccagcucugcgagauccccccccaccuccccgcccccaagucccccugcgagggcaccgagugccagaacggcgccaacugcgucgaccagggcaaccgccccgucugccagugccuccccggcuucggcggccccgagugcgagaagcuccucuccgucaacuucgucgaccgcgacaccuaccuccaguucaccgaccuccagaacuggccccgcgccaacaucacccuccaggucuccaccgccgaggacaacggcauccuccucuacaacggcgacaacgaccacaucgccgucgagcucuaccagggccacguccgcgucuccuacgaccccggcuccuaccccuccuccgccaucuacuccgccgagaccaucaacgacggccaguuccacaccgucgagcucgucgccuucgaccagauggucaaccucuccaucgacggcggcucccccaugaccauggacaacuucggcaagcacuacacccucaacuccgaggccccccucuacgucggcggcaugcccgucgacgucaacuccgccgccuuccgccucuggcagauccucaacggcaccggcuuccacggcugcauccgcaaccucuacaucaacaacgagcuccaggacuucaccaagacccagaugaagcccggcgucguccccggcugcgagcccugccgcaagcucuacugccuccacggcaucugccagcccaacgccacccccggccccaugugccacugcgaggccggcugggucggccuccacugcgaccagcccgccgacggccccugccacggccacaagugcguccacggccagugcgucccccucgacgcccucuccuacuccugccagugccaggacggcuacuccggcgcccucugcaaccaggccggcgcccucgccgagcccugccgcggccuccagugccuccacggccacugccaggccuccggcaccaagggcgcccacugcgucugcgaccccggcuucuccggcgagcucugcgagcaggaguccgagugccgcggcgaccccguccgcgacuuccaccagguccagcgcggcuacgccaucugccagaccacccgcccccucuccugggucgagugccgcggcuccugccccggccagggcugcugccagggccuccgccucaagcgccgcaaguucaccuucgagugcuccgacggcaccuccuucgccgaggaggucgagaagcccaccaagugcggcugcgcccucugcgccuga

SEQ ID NO: 49811 - RNA, 4578 nt, Artificial Sequence
  derived and/or modified sequence opt2 from SLIT2__Homo_sapiens__NP_001276064
augcgcggcgucggcuggcagaugcucucccucucccucggccucguccucgccauccucaacaaggucgccccccaggccugccccgcccagugcuccugcuccggcuccaccgucgacugccacggccucgcccuccgcuccgucccccgcaacaucccccgcaacaccgagcgccucgaccucaacggcaacaacaucacccgcaucaccaagaccgacuucgccggccuccgccaccuccgcguccuccagcucauggagaacaagaucuccaccaucgagcgcggcgccuuccaggaccucaaggagcucgagcgccuccgccucaaccgcaaccaccuccagcucuuccccgagcuccucuuccucggcaccgccaagcucuaccgccucgaccucuccgagaaccagauccaggccaucccccgcaaggccuuccgcggcgccgucgacaucaagaaccuccagcucgacuacaaccagaucuccugcaucgaggacggcgccuuccgcgcccuccgcgaccucgagguccucacccucaacaacaacaacaucacccgccucuccgucgccuccuucaaccacaugcccaagcuccgcaccuuccgccuccacuccaacaaccucuacugcgacugccaccucgccuggcucuccgacuggcuccgccagcgcccccgcgucggccucuacacccagugcaugggccccucccaccuccgcggccacaacgucgccgagguccagaagcgcgaguucgucugcuccgacgaggaggagggccaccaguccuucauggcccccuccugcuccguccuccacugccccgccgccugcaccugcuccaacaacaucgucgacugccgcggcaagggccucaccgagauccccaccaaccuccccgagaccaucaccgagauccgccucgagcagaacaccaucaaggucaucccccccggcgccuucucccccuacaagaagcuccgccgcaucgaccucuccaacaaccagaucuccgagcucgcccccgacgccuuccagggccuccgcucccucaacucccucguccucuacggcaacaagaucaccgagcuccccaagucccucuucgagggccucuucucccuccagcuccuccuccucaacgccaacaagaucaacugccuccgcgucgacgccuuccaggaccuccacaaccucaaccuccucucccucuacgacaacaagcuccagaccaucgccaagggcaccuucuccccccuccgcgccauccagaccaugcaccucgcccagaaccccuucaucugcgacugccaccucaaguggcucgccgacuaccuccacaccaaccccaucgagaccuccggcgcccgcugcaccuccccccgccgccucgccaacaagcgcaucggccagaucaaguccaagaaguuccgcugcuccggcaccgaggacuaccgcuccaagcucuccggcgacugcuucgccgaccucgccugccccgagaagugccgcugcgagggcaccaccgucgacugcuccaaccagaagcucaacaagauccccgagcacaucccccaguacaccgccgagcuccgccucaacaacaacgaguucaccguccucgaggccaccggcaucuucaagaagcucccccagcuccgcaagaucaacuucuccaacaacaagaucaccgacaucgaggagggcgccuucgagggcgccuccggcgucaacgagauccuccucaccuccaaccgccucgagaacguccagcacaagauguucaagggccucgagucccucaagacccucaugcuccgcuccaaccgcaucaccugcgucggcaacgacuccuucaucggccucuccuccguccgccuccucucccucuacgacaaccagaucaccaccgucgcccccggcgccuucgacacccuccacucccucuccacccucaaccuccucgccaaccccuucaacugcaacugcuaccucgccuggcucggcgaguggcuccgcaagaagcgcaucgucaccggcaacccccgcugccagaagcccuacuuccucaaggagauccccauccaggacgucgccauccaggacuucaccugcgacgacggcaacgacgacaacuccugcuccccccucucccgcugccccaccgagugcaccugccucgacaccgucguccgcugcuccaacaagggccucaagguccuccccaagggcaucccccgcgacgucaccgagcucuaccucgacggcaaccaguucacccucguccccaaggagcucuccaacuacaagcaccucacccucaucgaccucuccaacaaccgcaucuccacccucuccaaccaguccuucuccaacaugacccagcuccucacccucauccucuccuacaaccgccuccgcugcauccccccccgcaccuucgacggccucaagucccuccgccuccucucccuccacggcaacgacaucuccgucguccccgagggcgccuucaacgaccucuccgcccucucccaccucgccaucggcgccaacccccucuacugcgacugcaacaugcaguggcucuccgacugggucaaguccgaguacaaggagcccggcaucgcccgcugcgccggccccggcgagauggccgacaagcuccuccucaccacccccuccaagaaguucaccugccagggccccgucgacgucaacauccucgccaagugcaaccccugccucuccaaccccugcaagaacgacggcaccugcaacuccgaccccgucgacuucuaccgcugcaccugccccuacggcuucaagggccaggacugcgacguccccauccacgccugcaucuccaaccccugcaagcacggcggcaccugccaccucaaggagggcgaggaggacggcuucuggugcaucugcgccgacggcuucgagggcgagaacugcgaggucaacgucgacgacugcgaggacaacgacugcgagaacaacuccaccugcgucgacggcaucaacaacuacaccugccucugcccccccgaguacaccggcgagcucugcgaggagaagcucgacuucugcgcccaggaccucaaccccugccagcacgacuccaagugcauccucacccccaagggcuucaagugcgacugcacccccggcuacgucggcgagcacugcgacaucgacuucgacgacugccaggacaacaagugcaagaacggcgcccacugcaccgacgccgucaacggcuacaccugcaucugccccgagggcuacuccggccucuucugcgaguucuccccccccaugguccucccccgcaccucccccugcgacaacuucgacugccagaacggcgcccagugcaucguccgcaucaacgagcccaucugccagugccuccccggcuaccagggcgagaagugcgagaagcucgucuccgucaacuucaucaacaaggaguccuaccuccagauccccuccgccaagguccgcccccagaccaacaucacccuccagaucgccaccgacgaggacuccggcauccuccucuacaagggcgacaaggaccacaucgccgucgagcucuaccgcggccgcguccgcgccuccuacgacaccggcucccaccccgccuccgccaucuacuccgucgagaccaucaacgacggcaacuuccacaucgucgagcuccucgcccucgaccagucccucucccucuccgucgacggcggcaaccccaagaucaucaccaaccucuccaagcaguccacccucaacuucgacuccccccucuacgucggcggcaugcccggcaaguccaacgucgccucccuccgccaggcccccggccagaacggcaccuccuuccacggcugcauccgcaaccucuacaucaacuccgagcuccaggacuuccagaagguccccaugcagaccggcauccuccccggcugcgagcccugccacaagaaggucugcgcccacggcaccugccagcccuccucccaggccggcuucaccugcgagugccaggagggcuggaugggcccccucugcgaccagcgcaccaacgaccccugccucggcaacaagugcguccacggcaccugccuccccaucaacgccuucuccuacuccugcaagugccucgagggccacggcggcguccucugcgacgaggaggaggaccucuucaaccccugccaggccaucaagugcaagcacggcaagugccgccucuccggccucggccagcccuacugcgagugcuccuccggcuacaccggcgacuccugcgaccgcgagaucuccugccgcggcgagcgcauccgcgacuacuaccagaagcagcagggcuacgccgccugccagaccaccaagaaggucucccgccucgagugccgcggcggcugcgccggcggccagugcugcggcccccuccgcuccaagcgccgcaaguacuccuucgagugcaccgacggcuccuccuucgucgacgaggucgagaaggucgucaagugcggcugcacccgcugcgucuccuga

SEQ ID NO: 49812 - RNA, 4572 nt, Artificial Sequence
  derived and/or modified sequence opt2 from SLIT3__Homo_sapiens__NP_003053
auggcccccggcugggccggcgucggcgccgccguccgcgcccgccucgcccucgcccucgcccucgccuccguccucuccggcccccccgccgucgccugccccaccaagugcaccugcuccgccgccuccgucgacugccacggccucggccuccgcgccgucccccgcggcaucccccgcaacgccgagcgccucgaccucgaccgcaacaacaucacccgcaucaccaagauggacuucgccggccucaagaaccuccgcguccuccaccucgaggacaaccaggucuccgucaucgagcgcggcgccuuccaggaccucaagcagcucgagcgccuccgccucaacaagaacaagcuccagguccuccccgagcuccucuuccaguccacccccaagcucacccgccucgaccucuccgagaaccagauccagggcaucccccgcaaggccuuccgcggcaucaccgacgucaagaaccuccagcucgacaacaaccacaucuccugcaucgaggacggcgccuuccgcgcccuccgcgaccucgagauccucacccucaacaacaacaacaucucccgcauccucgucaccuccuucaaccacaugcccaagauccgcacccuccgccuccacuccaaccaccucuacugcgacugccaccucgccuggcucuccgacuggcuccgccagcgccgcaccgucggccaguucacccucugcauggcccccguccaccuccgcggcuucaacgucgccgacguccagaagaaggaguacgucugccccgccccccacuccgagccccccuccugcaacgccaacuccaucuccugccccucccccugcaccugcuccaacaacaucgucgacugccgcggcaagggccucauggagauccccgccaaccuccccgagggcaucgucgagauccgccucgagcagaacuccaucaaggccauccccgccggcgccuucacccaguacaagaagcucaagcgcaucgacaucuccaagaaccagaucuccgacaucgcccccgacgccuuccagggccucaagucccucaccucccucguccucuacggcaacaagaucaccgagaucgccaagggccucuucgacggccucgucucccuccagcuccuccuccucaacgccaacaagaucaacugccuccgcgucaacaccuuccaggaccuccagaaccucaaccuccucucccucuacgacaacaagcuccagaccaucuccaagggccucuucgccccccuccaguccauccagacccuccaccucgcccagaaccccuucgucugcgacugccaccucaaguggcucgccgacuaccuccaggacaaccccaucgagaccuccggcgcccgcugcuccuccccccgccgccucgccaacaagcgcaucucccagaucaaguccaagaaguuccgcugcuccggcuccgaggacuaccgcucccgcuucuccuccgagugcuucauggaccucgucugccccgagaagugccgcugcgagggcaccaucgucgacugcuccaaccagaagcucguccgcauccccucccaccuccccgaguacgucaccgaccuccgccucaacgacaacgaggucuccguccucgaggccaccggcaucuucaagaagcuccccaaccuccgcaagaucaaccucuccaacaacaagaucaaggagguccgcgagggcgccuucgacggcgccgccuccguccaggagcucaugcucaccggcaaccagcucgagaccguccacggccgcgucuuccgcggccucuccggccucaagacccucaugcuccgcuccaaccucaucggcugcgucuccaacgacaccuucgccggccucuccuccguccgccuccucucccucuacgacaaccgcaucaccaccaucacccccggcgccuucaccacccucgucucccucuccaccaucaaccuccucuccaaccccuucaacugcaacugccaccucgccuggcucggcaaguggcuccgcaagcgccgcaucgucuccggcaacccccgcugccagaagcccuucuuccucaaggagauccccauccaggacgucgccauccaggacuucaccugcgacggcaacgaggaguccuccugccagcucuccccccgcugccccgagcagugcaccugcauggagaccgucguccgcugcuccaacaagggccuccgcgcccucccccgcggcaugcccaaggacgucaccgagcucuaccucgagggcaaccaccucaccgccgucccccgcgagcucuccgcccuccgccaccucacccucaucgaccucuccaacaacuccaucuccaugcucaccaacuacaccuucuccaacaugucccaccucuccacccucauccucuccuacaaccgccuccgcugcauccccguccacgccuucaacggccuccgcucccuccgcguccucacccuccacggcaacgacaucuccuccguccccgagggcuccuucaacgaccucaccucccucucccaccucgcccucggcaccaacccccuccacugcgacugcucccuccgcuggcucuccgagugggucaaggccggcuacaaggagcccggcaucgcccgcugcuccucccccgagcccauggccgaccgccuccuccucaccacccccacccaccgcuuccagugcaagggccccgucgacaucaacaucgucgccaagugcaacgccugccucuccucccccugcaagaacaacggcaccugcacccaggaccccgucgagcucuaccgcugcgccugccccuacuccuacaagggcaaggacugcaccguccccaucaacaccugcauccagaaccccugccagcacggcggcaccugccaccucuccgacucccacaaggacggcuucuccugcuccugcccccucggcuucgagggccagcgcugcgagaucaaccccgacgacugcgaggacaacgacugcgagaacaacgccaccugcgucgacggcaucaacaacuacgucugcaucugcccccccaacuacaccggcgagcucugcgacgaggucaucgaccacugcguccccgagcucaaccucugccagcacgaggccaagugcaucccccucgacaagggcuucuccugcgagugcguccccggcuacuccggcaagcucugcgagaccgacaacgacgacugcgucgcccacaagugccgccacggcgcccagugcgucgacaccaucaacggcuacaccugcaccugcccccagggcuucuccggccccuucugcgagcaccccccccccaugguccuccuccagaccucccccugcgaccaguacgagugccagaacggcgcccagugcaucgucguccagcaggagcccaccugccgcugcccccccggcuucgccggcccccgcugcgagaagcucaucaccgucaacuucgucggcaaggacuccuacgucgagcucgccuccgccaagguccgcccccaggccaacaucucccuccaggucgccaccgacaaggacaacggcauccuccucuacaagggcgacaacgacccccucgcccucgagcucuaccagggccacguccgccucgucuacgacucccucuccuccccccccaccaccgucuacuccgucgagaccgucaacgacggccaguuccacuccgucgagcucgucacccucaaccagacccucaaccucgucgucgacaagggcacccccaagucccucggcaagcuccagaagcagcccgccgucggcaucaacuccccccucuaccucggcggcauccccaccuccaccggccucuccgcccuccgccagggcaccgaccgcccccucggcggcuuccacggcugcauccacgagguccgcaucaacaacgagcuccaggacuucaaggcccuccccccccagucccucggcgucucccccggcugcaaguccugcaccgucugcaagcacggccucugccgcuccgucgagaaggacuccgucgucugcgagugccgccccggcuggaccggcccccucugcgaccaggaggcccgcgaccccugccucggccaccgcugccaccacggcaagugcgucgccaccggcaccuccuacaugugcaagugcgccgagggcuacggcggcgaccucugcgacaacaagaacgacuccgccaacgccugcuccgccuucaagugccaccacggccagugccacaucuccgaccagggcgagcccuacugccucugccagcccggcuucuccggcgagcacugccagcaggagaaccccugccucggccaggucguccgcgaggucauccgccgccagaagggcuacgccuccugcgccaccgccuccaagguccccaucauggagugccgcggcggcugcggcccccagugcugccagcccacccgcuccaagcgccgcaaguacgucuuccagugcaccgacggcuccuccuucgucgaggaggucgagcgccaccucgagugcggcugccucgccugcuccuga

SEQ ID NO: 49813 - RNA, 2091 nt, Artificial Sequence
  derived and/or modified sequence opt2 from SLITRK1__Homo_sapiens__NP_001268432
augcuccucuggauccuccuccucgagaccucccucugcuucgccgccggcaacgucaccggcgacgucugcaaggagaagaucugcuccugcaacgagaucgagggcgaccuccacgucgacugcgagaagaagggcuucaccucccuccagcgcuucaccgcccccaccucccaguucuaccaccucuuccuccacggcaacucccucacccgccucuuccccaacgaguucgccaacuucuacaacgccgucucccuccacauggagaacaacggccuccacgagaucguccccggcgccuuccucggccuccagcucgucaagcgccuccacaucaacaacaacaagaucaaguccuuccgcaagcagaccuuccucggccucgacgaccucgaguaccuccaggccgacuucaaccuccuccgcgacaucgaccccggcgccuuccaggaccucaacaagcucgagguccucauccucaacgacaaccucaucuccacccuccccgccaacgucuuccaguacguccccaucacccaccucgaccuccgcggcaaccgccucaagacccuccccuacgaggagguccucgagcagauccccggcaucgccgagauccuccucgaggacaaccccugggacugcaccugcgaccuccucucccucaaggaguggcucgagaacauccccaagaacgcccucaucggccgcgucgucugcgaggcccccacccgccuccagggcaaggaccucaacgagaccaccgagcaggaccucugcccccucaagaaccgcgucgacuccucccuccccgccccccccgcccaggaggagaccuucgcccccggcccccuccccacccccuucaagaccaacggccaggaggaccacgccacccccggcuccgcccccaacggcggcaccaagauccccggcaacuggcagaucaagauccgccccaccgccgccaucgccaccggcuccucccgcaacaagccccucgccaacucccuccccugccccggcggcugcuccugcgaccacauccccggcuccggccucaagaugaacugcaacaaccgcaacgucuccucccucgccgaccucaagcccaagcucuccaacguccaggagcucuuccuccgcgacaacaagauccacuccauccgcaagucccacuucgucgacuacaagaaccucauccuccucgaccucggcaacaacaacaucgccaccgucgagaacaacaccuucaagaaccuccucgaccuccgcuggcucuacauggacuccaacuaccucgacacccucucccgcgagaaguucgccggccuccagaaccucgaguaccucaacgucgaguacaacgccauccagcucauccuccccggcaccuucaacgccaugcccaagcuccgcauccucauccucaacaacaaccuccuccgcucccuccccgucgacgucuucgccggcgucucccucuccaagcucucccuccacaacaacuacuucauguaccuccccgucgccggcguccucgaccagcucaccuccaucauccagaucgaccuccacggcaaccccugggagugcuccugcaccaucguccccuucaagcagugggccgagcgccucggcuccgagguccucauguccgaccucaagugcgagacccccgucaacuucuuccgcaaggacuucaugcuccucuccaacgacgagaucugcccccagcucuacgcccgcaucucccccacccucaccucccacuccaagaacuccaccggccucgccgagaccggcacccacuccaacuccuaccucgacaccucccgcgucuccaucuccguccucguccccggccuccuccucgucuucgucaccuccgccuucaccgucgucggcaugcucgucuucauccuccgcaaccgcaagcgcuccaagcgccgcgacgccaacuccuccgccuccgagaucaacucccuccagaccgucugcgacuccuccuacuggcacaacggccccuacaacgccgacggcgcccaccgcgucuacgacugcggcucccacucccucuccgacuga

SEQ ID NO: 49814 - RNA, 2538 nt, Artificial Sequence
  derived and/or modified sequence opt2 from SLITRK2__Homo_sapiens__NP_115928
augcucuccggcgucugguuccucuccguccucaccgucgccggcauccuccagaccgagucccgcaagaccgccaaggacaucugcaagauccgcugccucugcgaggagaaggagaacguccucaacaucaacugcgagaacaagggcuucaccaccgucucccuccuccagcccccccaguaccgcaucuaccagcucuuccucaacggcaaccuccucacccgccucuaccccaacgaguucgucaacuacuccaacgccgucacccuccaccucggcaacaacggccuccaggagauccgcaccggcgccuucuccggccucaagacccucaagcgccuccaccucaacaacaacaagcucgagauccuccgcgaggacaccuuccucggccucgagucccucgaguaccuccaggccgacuacaacuacaucuccgccaucgaggccggcgccuucuccaagcucaacaagcucaagguccucauccucaacgacaaccuccuccucucccuccccuccaacgucuuccgcuucguccuccucacccaccucgaccuccgcggcaaccgccucaaggucaugcccuucgccggcguccucgagcacaucggcggcaucauggagauccagcucgaggagaaccccuggaacugcaccugcgaccuccucccccucaaggccuggcucgacaccaucaccgucuucgucggcgagaucgucugcgagacccccuuccgccuccacggcaaggacgucacccagcucacccgccaggaccucugcccccgcaaguccgccuccgacuccucccagcgcggcucccacgccgacacccacguccagcgccucucccccaccaugaaccccgcccucaaccccacccgcgcccccaaggccucccgcccccccaagaugcgcaaccgccccaccccccgcgucaccgucuccaaggaccgccaguccuucggccccaucauggucuaccagaccaagucccccgucccccucaccugccccuccuccugcgucugcaccucccaguccuccgacaacggccucaacgucaacugccaggagcgcaaguucaccaacaucuccgaccuccagcccaagcccaccucccccaagaagcucuaccucaccggcaacuaccuccagaccgucuacaagaacgaccuccucgaguacuccucccucgaccuccuccaccucggcaacaaccgcaucgccgucauccaggagggcgccuucaccaaccucaccucccuccgccgccucuaccucaacggcaacuaccucgagguccucuaccccuccauguucgacggccuccagucccuccaguaccucuaccucgaguacaacgucaucaaggagaucaagccccucaccuucgacgcccucaucaaccuccagcuccucuuccucaacaacaaccuccuccgcucccuccccgacaacaucuucggcggcaccgcccucacccgccucaaccuccgcaacaaccacuucucccaccuccccgucaagggcguccucgaccagcuccccgccuucauccagaucgaccuccaggagaaccccugggacugcaccugcgacaucaugggccucaaggacuggaccgagcacgccaacucccccgucaucaucaacgaggucaccugcgagucccccgccaagcacgccggcgagauccucaaguuccucggccgcgaggccaucugccccgacucccccaaccucuccgacggcaccguccucuccaugaaccacaacaccgacaccccccgcucccucuccgucucccccuccuccuaccccgagcuccacaccgaggucccccucuccguccucauccucggccuccucgucgucuucauccucuccgucugcuucggcgccggccucuucgucuucguccucaagcgccgcaagggcguccccuccgucccccgcaacaccaacaaccucgacgucuccuccuuccagcuccaguacggcuccuacaacaccgagacccacgacaagaccgacggccacgucuacaacuacauccccccccccgucggccagaugugccagaaccccaucuacaugcagaaggagggcgaccccgucgccuacuaccgcaaccuccaggaguucuccuacuccaaccucgaggagaagaaggaggagcccgccacccccgccuacaccaucuccgccaccgagcuccucgagaagcaggccaccccccgcgagcccgagcuccucuaccagaacaucgccgagcgcgucaaggagcuccccuccgccggccucguccacuacaacuucugcacccuccccaagcgccaguucgcccccuccuacgagucccgccgccagaaccaggaccgcaucaacaagaccguccucuacggcaccccccgcaagugcuucgucggccaguccaagcccaaccacccccuccuccaggccaagccccaguccgagcccgacuaccucgagguccucgagaagcagaccgccaucucccagcucuga

SEQ ID NO: 49815 - RNA, 2934 nt, Artificial Sequence
  derived and/or modified sequence opt2 from SLITRK3__Homo_sapiens__NP_055741
augaagcccuccaucgccgagaugcuccaccgcggccgcaugcucuggaucauccuccucuccaccaucgcccucggcuggaccacccccaucccccucaucgaggacuccgaggagaucgacgagcccugcuucgaccccugcuacugcgaggucaaggagucccucuuccacauccacugcgacuccaagggcuucaccaacaucucccagaucaccgaguucuggucccgccccuucaagcucuaccuccagcgcaacuccaugcgcaagcucuacaccaacuccuuccuccaccucaacaacgccgucuccaucaaccucggcaacaacgcccuccaggacauccagaccggcgccuucaacggccucaagauccucaagcgccucuaccuccacgagaacaagcucgacgucuuccgcaacgacaccuuccucggccucgagucccucgaguaccuccaggccgacuacaacgucaucaagcgcaucgaguccggcgccuuccgcaaccucuccaagcuccgcguccucauccucaacgacaaccucauccccaugcuccccaccaaccucuucaaggccgucucccucacccaccucgaccuccgcggcaaccgccucaagguccucuucuaccgcggcaugcucgaccacaucggccgcucccucauggagcuccagcucgaggagaaccccuggaacugcaccugcgagaucguccagcucaaguccuggcucgagcgcauccccuacaccgcccucgucggcgacaucaccugcgagacccccuuccacuuccacggcaaggaccuccgcgagauccgcaagaccgagcucugcccccuccucuccgacuccgaggucgaggccucccucggcaucccccacuccuccuccuccaaggagaacgccuggcccaccaagcccuccuccaugcucuccuccguccacuucaccgccuccuccgucgaguacaaguccuccaacaagcagcccaagcccaccaagcagccccgcaccccccgcccccccuccaccucccaggcccucuaccccggccccaaccagccccccaucgcccccuaccagacccgcccccccauccccaucaucugccccaccggcugcaccugcaaccuccacaucaacgaccucggccucaccgucaacugcaaggagcgcggcuucaacaacaucuccgagcuccucccccgcccccucaacgccaagaagcucuaccucuccuccaaccucauccagaagaucuaccgcuccgacuucuggaacuucuccucccucgaccuccuccaccucggcaacaaccgcaucuccuacguccaggacggcgccuucaucaaccuccccaaccucaagucccucuuccucaacggcaacgacaucgagaagcucacccccggcauguuccgcggccuccagucccuccacuaccucuacuucgaguucaacgucauccgcgagauccagcccgccgccuucucccucaugcccaaccucaagcuccucuuccucaacaacaaccuccuccgcacccuccccaccgacgccuucgccggcaccucccucgcccgccucaaccuccgcaagaacuacuuccucuaccuccccgucgccggcguccucgagcaccucaacgccaucguccagaucgaccucaacgagaaccccugggacugcaccugcgaccucguccccuucaagcaguggaucgagaccaucuccuccgucuccgucgucggcgacguccucugccgcucccccgagaaccucacccaccgcgacguccgcaccaucgagcucgagguccucugccccgagaugcuccacgucgcccccgccggcgagucccccgcccagcccggcgacucccaccucaucggcgcccccaccuccgccucccccuacgaguucuccccccccggcggccccgucccccucuccguccucauccucucccuccucguccucuucuucuccgccgucuucgucgccgccggccucuucgccuacguccuccgccgccgccgcaagaagcuccccuuccgcuccaagcgccaggagggcgucgaccucaccggcauccagaugcagugccaccgccucuucgaggacggcggcggcggcggcggcggcuccggcggcggcggccgccccacccucuccucccccgagaaggccccccccgucggccacgucuacgaguacaucccccaccccgucacccagaugugcaacaaccccaucuacaagccccgcgaggaggaggaggucgccgucuccuccgcccaggaggccggcuccgccgagcgcggcggccccggcacccagccccccggcaugggcgaggcccuccucggcuccgagcaguucgccgagacccccaaggagaaccacuccaacuaccgcacccuccucgagaaggagaaggagugggcccucgccgucuccuccucccagcucaacaccaucgucaccgucaaccaccaccacccccaccaccccgccgucggcggcgucuccggcgucgucggcggcaccggcggcgaccucgccggcuuccgccaccacgagaagaacggcggcgucguccucuucccccccggcggcggcugcggcuccggcuccaugcuccucgaccgcgagcgcccccagcccgcccccugcaccgucggcuucgucgacugccucuacggcaccguccccaagcucaaggagcuccacguccacccccccggcaugcaguaccccgaccuccagcaggacgcccgccucaaggagacccuccucuucuccgccggcaagggcuucaccgaccaccagacccagaaguccgacuaccucgagcuccgcgccaagcuccagaccaagcccgacuaccucgagguccucgagaagaccaccuaccgcuucuga

SEQ ID NO: 49816 - RNA, 2877 nt, Artificial Sequence
  derived and/or modified sequence opt2 from SLITRK5__Homo_sapiens__NP_056382
augcacaccugcugcccccccgucacccucgagcaggaccuccaccgcaagaugcacuccuggaugcuccagacccucgccuucgccgucaccucccucguccucuccugcgccgagaccaucgacuacuacggcgagaucugcgacaacgccugccccugcgaggagaaggacggcauccucaccgucuccugcgagaaccgcggcaucaucucccucuccgagaucucccccccccgcuuccccaucuaccaccuccuccucuccggcaaccuccucaaccgccucuaccccaacgaguucgucaacuacaccggcgccuccauccuccaccucggcuccaacgucauccaggacaucgagaccggcgccuuccacggccuccgcggccuccgccgccuccaccucaacaacaacaagcucgagcuccuccgcgacgacaccuuccucggccucgagaaccucgaguaccuccaggucgacuacaacuacaucuccgucaucgagcccaacgccuucggcaagcuccaccuccuccagguccucauccucaacgacaaccuccucuccucccuccccaacaaccucuuccgcuucgucccccucacccaccucgaccuccgcggcaaccgccucaagcuccuccccuacgucggccuccuccagcacauggacaaggucgucgagcuccagcucgaggagaaccccuggaacugcuccugcgagcucaucucccucaaggacuggcucgacuccaucuccuacuccgcccucgucggcgacgucgucugcgagacccccuuccgccuccacggccgcgaccucgacgaggucuccaagcaggagcucugcccccgccgccucaucuccgacuacgagaugcgcccccagaccccccucuccaccaccggcuaccuccacaccacccccgccuccgucaacuccgucgccaccuccuccuccgccgucuacaagcccccccucaagccccccaagggcacccgccagcccaacaagccccgcguccgccccaccucccgccagcccuccaaggaccucggcuacuccaacuacggccccuccaucgccuaccagaccaagucccccgucccccucgagugccccaccgccugcuccugcaaccuccagaucuccgaccucggccucaacgucaacugccaggagcgcaagaucgaguccaucgccgagcuccagcccaagcccuacaaccccaagaagauguaccucaccgagaacuacaucgccgucguccgccgcaccgacuuccucgaggccaccggccucgaccuccuccaccucggcaacaaccgcaucuccaugauccaggaccgcgccuucggcgaccucaccaaccuccgccgccucuaccucaacggcaaccgcaucgagcgccucucccccgagcucuucuacggccuccagucccuccaguaccucuuccuccaguacaaccucauccgcgagauccaguccggcaccuucgaccccguccccaaccuccagcuccucuuccucaacaacaaccuccuccaggccaugcccuccggcgucuucuccggccucacccuccuccgccucaaccuccgcuccaaccacuucaccucccuccccgucuccggcguccucgaccagcucaagucccucauccagaucgaccuccacgacaaccccugggacugcaccugcgacaucgucggcaugaagcucugggucgagcagcucaaggucggcguccucgucgacgaggucaucugcaaggcccccaagaaguucgccgagaccgacaugcgcuccaucaaguccgagcuccucugccccgacuacuccgacgucgucgucuccacccccacccccuccuccauccagguccccgcccgcaccuccgccgucacccccgccguccgccucaacuccaccggcgcccccgccucccucggcgccggcggcggcgccuccuccgucccccucuccguccucauccucucccuccuccucgucuucaucauguccgucuucgucgccgccggccucuucguccucgucaugaagcgccgcaagaagaaccaguccgaccacaccuccaccaacaacuccgacgucuccuccuucaacaugcaguacuccgucuacggcggcggcggcggcaccggcggccacccccacgcccacguccaccaccgcggccccgcccuccccaaggucaagacccccgccggccacgucuacgaguacaucccccacccccucggccacaugugcaagaaccccaucuaccgcucccgcgagggcaacuccgucgaggacuacaaggaccuccacgagcucaaggucaccuacuccuccaaccaccaccuccagcagcagcagcagccccccccccccccccagcagccccagcagcagccccccccccagcuccagcuccagcccggcgaggaggagcgccgcgagucccaccaccuccgcucccccgccuacuccgucuccaccaucgagccccgcgaggaccuccucucccccguccaggacgccgaccgcuucuaccgcggcauccucgagcccgacaagcacugcuccaccacccccgccggcaacucccuccccgaguaccccaaguuccccugcucccccgccgccuacaccuucucccccaacuacgaccuccgccgcccccaccaguaccuccaccccggcgccggcgacucccgccuccgcgagcccguccucuacuccccccccuccgccgucuucgucgagcccaaccgcaacgaguaccucgagcucaaggccaagcucaacgucgagcccgacuaccucgagguccucgagaagcagaccaccuucucccaguucuga

SEQ ID NO: 49817 - RNA, 2526 nt, Artificial Sequence
  derived and/or modified sequence opt2 from SLITRK6__Homo_sapiens__NP_115605
augaagcucuggauccaccucuucuacuccucccuccucgccugcaucucccuccacucccagacccccguccucuccucccgcggcuccugcgacucccucugcaacugcgaggagaaggacggcaccaugcucaucaacugcgaggccaagggcaucaagauggucuccgagaucuccgucccccccucccgccccuuccagcucucccuccucaacaacggccucaccaugcuccacaccaacgacuucuccggccucaccaacgccaucuccauccaccucggcuucaacaacaucgccgacaucgagaucggcgccuucaacggccucggccuccucaagcagcuccacaucaaccacaacucccucgagauccucaaggaggacaccuuccacggccucgagaaccucgaguuccuccaggccgacaacaacuucaucaccgucaucgagcccuccgccuucuccaagcucaaccgccucaagguccucauccucaacgacaacgccaucgagucccucccccccaacaucuuccgcuucgucccccucacccaccucgaccuccgcggcaaccagcuccagacccuccccuacgucggcuuccucgagcacaucggccgcauccucgaccuccagcucgaggacaacaagugggccugcaacugcgaccuccuccagcucaagaccuggcucgagaacaugcccccccaguccaucaucggcgacgucgucugcaacuccccccccuucuucaagggcuccauccucucccgccucaagaaggaguccaucugccccaccccccccgucuacgaggagcacgaggaccccuccggcucccuccaccucgccgccaccuccuccaucaacgacucccgcauguccaccaagaccaccuccauccucaagcuccccaccaaggcccccggccucauccccuacaucaccaagcccuccacccagcuccccggccccuacugccccauccccugcaacugcaagguccucucccccuccggccuccucauccacugccaggagcgcaacaucgagucccucuccgaccuccgcccccccccccagaacccccgcaagcucauccucgccggcaacaucauccacucccucaugaaguccgaccucgucgaguacuucacccucgagaugcuccaccucggcaacaaccgcaucgagguccucgaggagggcuccuucaugaaccucacccgccuccagaagcucuaccucaacggcaaccaccucaccaagcucuccaagggcauguuccucggccuccacaaccucgaguaccucuaccucgaguacaacgccaucaaggagauccuccccggcaccuucaaccccaugcccaagcucaagguccucuaccucaacaacaaccuccuccagguccuccccccccacaucuucuccggcgucccccucaccaaggucaaccucaagaccaaccaguucacccaccuccccgucuccaacauccucgacgaccucgaccuccucacccagaucgaccucgaggacaaccccugggacugcuccugcgaccucgucggccuccagcaguggauccagaagcucuccaagaacaccgucaccgacgacauccucugcaccucccccggccaccucgacaagaaggagcucaaggcccucaacuccgagauccucugccccggccucgucaacaaccccuccaugcccacccagaccuccuaccucauggucaccacccccgccaccaccaccaacaccgccgacaccauccuccgcucccucaccgacgccgucccccucuccguccucauccucggccuccucaucauguucaucaccaucgucuucugcgccgccggcaucgucguccucguccuccaccgccgccgccgcuacaagaagaagcaggucgacgagcagaugcgcgacaacucccccguccaccuccaguacuccauguacggccacaagaccacccaccacaccaccgagcgccccuccgccucccucuacgagcagcacauggucucccccaugguccacgucuaccgcucccccuccuucggccccaagcaccucgaggaggaggaggagcgcaacgagaaggagggcuccgacgccaagcaccuccagcgcucccuccucgagcaggagaaccacuccccccucaccggcuccaacaugaaguacaagaccaccaaccaguccaccgaguuccucuccuuccaggacgccuccucccucuaccgcaacauccucgagaaggagcgcgagcuccagcagcucggcaucaccgaguaccuccgcaagaacaucgcccagcuccagcccgacauggaggcccacuaccccggcgcccacgaggagcucaagcucauggagacccucauguacucccgcccccgcaagguccucgucgagcagaccaagaacgaguacuucgagcucaaggccaaccuccacgccgagcccgacuaccucgagguccucgagcagcagaccuga

SEQ ID NO: 49818 - RNA, 3615 nt, Artificial Sequence
  derived and/or modified sequence opt2 from SLK__Homo_sapiens__NP_001291672
auguccuucuucaacuuccgcaagaucuucaagcucggcuccgagaagaagaagaagcaguacgagcacgucaagcgcgaccucaaccccgaggacuucugggagaucaucggcgagcucggcgacggcgccuucggcaaggucuacaaggcccagaacaaggagaccuccguccucgccgccgccaaggucaucgacaccaaguccgaggaggagcucgaggacuacauggucgagaucgacauccucgccuccugcgaccaccccaacaucgucaagcuccucgacgccuucuacuacgagaacaaccucuggauccucaucgaguucugcgccggcggcgccgucgacgccgucaugcucgagcucgagcgcccccucaccgagucccagauccaggucgucugcaagcagacccucgacgcccucaacuaccuccacgacaacaagaucauccaccgcgaccucaaggccggcaacauccucuucacccucgacggcgacaucaagcucgccgacuucggcgucuccgccaagaacacccgcaccauccagcgccgcgacuccuucaucggcacccccuacuggauggcccccgaggucgucaugugcgagaccuccaaggaccgccccuacgacuacaaggccgacgucuggucccucggcaucacccucaucgagauggccgagaucgagcccccccaccacgagcucaaccccaugcgcguccuccucaagaucgccaaguccgagccccccacccucgcccagcccucccgcugguccuccaacuucaaggacuuccucaagaagugccucgagaagaacgucgacgcccgcuggaccaccucccagcuccuccagcaccccuucgucaccgucgacuccaacaagcccauccgcgagcucaucgccgaggccaaggccgaggucaccgaggaggucgaggacggcaaggaggaggacgaggaggaggagaccgagaacucccuccccauccccgccuccaagcgcgccuccuccgaccucuccaucgccuccuccgaggaggacaagcucucccagaacgccugcauccucgaguccgucuccgagaagaccgagcgcuccaacuccgaggacaagcucaacuccaagauccucaacgagaagcccaccaccgacgagcccgagaaggccgucgaggacaucaacgagcacaucaccgacgcccagcucgaggccaugaccgagcuccacgaccgcaccgccgucaucaaggagaacgagcgcgagaagcgccccaagcucgagaaccuccccgacaccgaggaccaggagaccgucgacaucaacuccgucuccgagggcaaggagaacaacaucaugaucacccucgagaccaacaucgagcacaaccucaaguccgaggaggagaaggaccaggagaagcagcagauguucgagaacaagcucaucaaguccgaggagaucaaggacaccauccuccagaccgucgaccucgucucccaggagaccggcgagaaggaggccaacauccaggccgucgacuccgaggucggccucaccaaggaggacacccaggagaagcucggcgaggacgacaagacccagaaggacgucaucuccaacaccuccgacgucaucggcaccugcgaggccgccgacgucgcccagaaggucgacgaggacuccgccgaggacacccaguccaacgacggcaaggaggucgucgaggucggccagaagcucaucaacaagcccauggucggccccgaggccggcggcaccaaggagguccccaucaaggagaucgucgagaugaacgagaucgaggagggcaagaacaaggagcaggccaucaacuccuccgagaacaucauggacaucaacgaggagcccggcaccaccgagggcgaggagaucaccgaguccuccuccaccgaggagauggagguccgcuccgucgucgccgacaccgaccagaaggcccucggcuccgagguccaggacgccuccaaggucaccacccagaucgacaaggagaagaaggagauccccgucuccaucaagaaggagcccgaggucaccgucgucucccagcccaccgagccccagcccguccucauccccuccaucaacaucaacuccgacuccggcgagaacaaggaggagaucggcucccucuccaagaccgagaccauccucccccccgaguccgagaaccccaaggagaacgacaacgacuccggcaccggcuccaccgccgacaccuccuccaucgaccucaaccucuccaucuccuccuuccucuccaagaccaaggacuccggcuccaucucccuccaggagacccgccgccagaagaagacccucaagaagacccgcaaguucaucgucgacggcgucgaggucuccgucaccaccuccaagaucgucaccgacuccgacuccaagaccgaggagcuccgcuuccuccgccgccaggagcuccgcgagcuccgcuuccuccagaaggaggagcagcgcgcccagcagcagcucaacuccaagcuccagcagcagcgcgagcagaucuuccgccgcuucgagcaggagaugauguccaagaagcgccaguacgaccaggagaucgagaaccucgagaagcagcagaagcagaccaucgagcgccucgagcaggagcacaccaaccgccuccgcgacgaggccaagcgcaucaagggcgagcaggagaaggagcucuccaaguuccagaacaugcucaagaaccgcaagaaggaggagcaggaguucguccagaagcagcagcaggagcucgacggcucccucaagaagaucauccagcagcagaaggccgagcucgccaacaucgagcgcgagugccucaacaacaagcagcagcucaugcgcgcccgcgaggccgccaucugggagcucgaggagcgccaccuccaggagaagcaccagcuccucaagcagcagcucaaggaccaguacuucaugcagcgccaccagcuccucaagcgccacgagaaggagaccgagcagaugcagcgcuacaaccagcgccucaucgaggagcucaagaaccgccagacccaggagcgcgcccgccuccccaagauccagcgcuccgaggccaagacccgcauggccauguucaagaagucccuccgcaucaacuccaccgccacccccgaccaggaccgcgacaagaucaagcaguucgccgcccaggaggagaagcgccagaagaacgagcgcauggcccagcaccagaagcacgagaaccagaugcgcgaccuccagcuccagugcgaggccaacguccgcgagcuccaccagcuccagaacgagaagugccaccuccucgucgagcacgagacccagaagcucaaggagcucgacgaggagcacucccaggagcucaaggaguggcgcgagaagcuccgcccccgcaagaagacccucgaggaggaguucgcccgcaagcuccaggagcaggaggucuucuucaagaugaccggcgaguccgagugccucaaccccuccacccagucccgcaucuccaaguucuaccccauccccucccuccacuccaccggcuccuga

SEQ ID NO: 49819 - RNA, 2487 nt, Artificial Sequence
  derived and/or modified sequence opt2 from SLMAP__Homo_sapiens__NP_001291349
augcccuccgcccucgccaucuucaccugccgccccaacucccaccccuuccaggagcgccacgucuaccucgacgagcccaucaagaucggccgcuccgucgcccgcugccgccccgcccagaacaacgccaccuucgacugcaagguccucucccgcaaccacgcccucgucugguucgaccacaagaccggcaaguucuaccuccaggacaccaaguccuccaacggcaccuucaucaacucccagcgccucucccgcggcuccgaggaguccccccccugcgagauccucuccggcgacaucauccaguucggcgucgacgucaccgagaacacccgcaaggucacccacggcugcaucgucuccaccaucaagcucuuccuccccgacggcauggaggcccgccuccgcuccgacgucauccacgccccccuccccucccccgucgacaaggucgccgccaacacccccuccauguacucccaggagcucuuccagcucucccaguaccuccaggaggcccuccaccgcgagcagaugcucgagcagaagcucgccacccuccagcgccuccucgccaucacccaggaggccuccgacaccuccuggcaggcccucaucgacgaggaccgccuccucucccgccucgaggucaugggcaaccagcuccaggccugcuccaagaaccagaccgaggacucccuccgcaaggagcucaucgcccuccaggaggacaagcacaacuacgagaccaccgccaaggagucccuccgccgcguccuccaggagaagaucgaggucguccgcaagcucuccgaggucgagcgcucccucuccaacaccgaggacgagugcacccaccucaaggagaugaacgagcgcacccaggaggagcuccgcgagcucgccaacaaguacaacggcgccgucaacgagaucaaggaccucuccgacaagcucaaggucgccgagggcaagcaggaggagauccagcagaagggccaggccgagaagaaggagcuccagcacaagaucgacgagauggaggagaaggagcaggagcuccaggccaagaucgaggcccuccaggccgacaacgacuucaccaacgagcgccucaccgcccuccagguccgccucgagcaccuccaggagaagacccucaaggagugcuccucccucgagcaccuccucuccaaguccggcggcgacugcaccuucauccaccaguucaucgagugccagaagaagcucaucgucgagggccaccucaccaaggccgucgaggagaccaagcucuccaaggagaaccagacccgcgccaaggaguccgacuucuccgacacccucucccccuccaaggagaaguccuccgacgacaccaccgacgcccagauggacgagcaggaccucaacgagccccucgccaaggucucccuccucaaggacgaccuccagggcgcccaguccgagaucgaggccaagcaggagauccagcaccuccgcaaggagcucaucgaggcccaggagcucgcccgcaccuccaagcagaagugcuucgagcuccaggcccuccucgaggaggagcgcaaggccuaccgcaaccaggucgaggaguccaccaagcagauccagguccuccaggcccagcuccagcgccuccacaucgacaccgagaaccuccgcgaggagaaggacuccgagaucaccuccacccgcgacgagcuccucuccgcccgcgacgagauccuccuccuccaccaggccgccgccaaggucgccuccgagcgcgacaccgacaucgccucccuccaggaggagcucaagaagguccgcgccgagcucgagcgcuggcgcaaggccgccuccgaguacgagaaggagaucaccucccuccagaacuccuuccagcuccgcugccagcagugcgaggaccagcagcgcgaggaggccacccgccuccagggcgagcucgagaagcuccgcaaggaguggaacgcccucgagaccgagugccacucccucaagcgcgagaacguccuccucuccuccgagcuccagcgccaggagaaggagcuccacaacucccagaagcagucccucgagcucaccuccgaccucuccauccuccagaugucccgcaaggagcucgagaaccaggucggcucccucaaggagcagcaccuccgcgacuccgccgaccucaagacccuccucuccaaggccgagaaccaggccaaggacguccagaaggaguacgagaagacccagaccguccucuccgagcucaagcucaaguucgagaugaccgagcaggagaagcaguccaucaccgacgagcucaagcagugcaagaacaaccucaagcuccuccgcgagaagggcaacaacaagcccuggcccuggaugcccaugcucgccgcccucgucgccgucaccgccaucguccucuacguccccggccucgcccgcgccucccccuga

SEQ ID NO: 49820 - RNA, 585 nt, Artificial Sequence
  derived and/or modified sequence opt2 from SLMO2__Homo_sapiens__NP_057129
augaagaucuggaccuccgagcacgucuucgaccaccccugggagaccgucaccaccgccgccaugcagaaguaccccaaccccaugaaccccuccgucgucggcgucgacguccucgaccgccacaucgaccccuccggcaagcuccacucccaccgccuccucuccaccgaguggggccuccccuccaucgucaagucccucaucggcgccgcccgcaccaagaccuacguccaggagcacuccgucgucgaccccgucgagaagaccauggagcucaaguccaccaacaucuccuucaccaacauggucuccgucgacgagcgccucaucuacaagccccacccccaggaccccgagaagaccguccucacccaggaggccaucaucaccgucaagggcgucucccucuccuccuaccucgagggccucauggccuccaccaucuccuccaacgccuccaagggccgcgaggccauggagugggucauccacaagcucaacgccgagaucgaggagcucaccgccuccgcccgcggcaccauccgcacccccauggccgccgccgccuucgccgagaaguga

SEQ ID NO: 49821 - RNA, 96 nt, Artificial Sequence
  derived and/or modified sequence opt2 from SLN__Homo_sapiens__NP_003054
augggcaucaacacccgcgagcucuuccucaacuucaccaucguccucaucaccgucauccucauguggcuccucguccgcuccuaccaguacuga

SEQ ID NO: 49822 - RNA, 399 nt, Artificial Sequence
  derived and/or modified sequence opt2 from SLPI__Homo_sapiens__NP_003055
augaaguccuccggccucuuccccuuccucguccuccucgcccucggcacccucgcccccugggccgucgagggcuccggcaaguccuucaaggccggcgucugcccccccaagaaguccgcccagugccuccgcuacaagaagcccgagugccaguccgacuggcagugccccggcaagaagcgcugcugccccgacaccugcggcaucaagugccucgaccccgucgacacccccaaccccacccgccgcaagcccggcaagugccccgucaccuacggccagugccucaugcucaacccccccaacuucugcgagauggacggccagugcaagcgcgaccucaagugcugcaugggcaugugcggcaaguccugcgucucccccgucaaggccuga

SEQ ID NO: 49823 - RNA, 3051 nt, Artificial Sequence
  derived and/or modified sequence opt2 from SLTM__Homo_sapiens__NP_001013865
auggccgccgccaccggcgccgucgccgccuccgccgccuccggccaggccgagggcaagaagaucaccgaccuccgcgucaucgaccucaaguccgagcucaagcgccgcaaccucgacaucaccggcgucaagaccguccucaucucccgccucaagcaggccaucgaggaggagggcggcgaccccgacaacaucgagcucaccgucuccaccgacacccccaacaagaagcccaccaagggcaagggcaagaagcacgaggccgacgagcucuccggcgacgccuccgucgaggacgacgccuucaucaaggacugcgagcucgagaaccaggaggcccacgagcaggacggcaacgacgagcucaaggacuccgaggaguucggcgagaacgaggaggagaacguccacuccaaggagcuccucuccgccgaggagaacaagcgcgcccacgagcucaucgaggccgagggcaucgaggacaucgagaaggaggacaucgagucccaggagaucgaggcccaggagggcgaggacgacaccuuccucaccgcccaggacggcgaggaggaggagaacgagaaggagggcucccucgccgaggccgaccacaccgcccacgaggagauggaggcccacaccaccgucaaggaggccgaggacgacaacaucuccgucaccauccaggccgaggacgccaucacccucgacuucgacggcgacgaccuccucgagaccggcaagaacgucaagaucaccgacuccgaggccuccaagcccaaggacggccaggacgccaucgcccagucccccgagaaggaguccaaggacuacgagaugaacgccaaccacaaggacggcaagaaggaggacugcgucaagggcgaccccgucgagaaggaggcccgcgaguccuccaagaaggccgaguccggcgacaaggagaaggacacccucaagaagggccccuccuccaccggcgccuccggccaggccaaguccuccuccaaggaguccaaggacuccaagaccuccuccaaggacgacaagggcuccaccuccuccaccuccggcuccuccggcuccuccaccaagaacaucugggucuccggccucuccuccaacaccaaggccgccgaccucaagaaccucuucggcaaguacggcaagguccucuccgccaaggucgucaccaacgcccgcucccccggcgccaagugcuacggcaucgucaccauguccuccuccaccgaggucucccgcugcaucgcccaccuccaccgcaccgagcuccacggccagcucaucuccgucgagaaggucaagggcgaccccuccaagaaggagaugaagaaggagaacgacgagaaguccuccucccgcuccuccggcgacaagaagaacaccuccgaccgcuccuccaagacccaggccuccgucaagaaggaggagaagcgcuccuccgagaaguccgagaagaaggaguccaaggacaccaagaagaucgagggcaaggacgagaagaacgacaacggcgccuccggccagaccuccgaguccaucaagaaguccgaggagaagaagcgcaucuccuccaagucccccggccacauggucauccucgaccagaccaagggcgaccacugccgccccucccgccgcggccgcuacgagaagauccacggccgcuccaaggagaaggagcgcgccucccucgacaagaagcgcgacaaggacuaccgccgcaaggagauccuccccuucgagaagaugaaggagcagcgccuccgcgagcaccucguccgcuucgagcgccuccgccgcgccauggagcuccgccgccgccgcgagaucgccgagcgcgagcgccgcgagcgcgagcgcauccgcaucauccgcgagcgcgaggagcgcgagcgccuccagcgcgagcgcgagcgccucgagaucgagcgccagaagcucgagcgcgagcgcauggagcgcgagcgccucgagcgcgagcgcauccgcaucgagcaggagcgccgcaaggaggccgagcgcaucgcccgcgagcgcgaggagcuccgccgccagcagcagcagcuccgcuacgagcaggagaagcgcaacucccucaagcgcccccgcgacgucgaccaccgccgcgacgaccccuacugguccgagaacaagaagcucucccucgacaccgacgcccgcuucggccacggcuccgacuacucccgccagcagaaccgcuucaacgacuucgaccaccgcgagcgcggccgcuuccccgaguccuccgccguccaguccuccuccuucgagcgccgcgaccgcuucgucggccaguccgagggcaagaaggcccgccccaccgcccgccgcgaggaccccuccuucgagcgcuaccccaagaacuucuccgacucccgccgcaacgagcccccccccccccgcaacgagcuccgcgaguccgaccgccgcgagguccgcggcgagcgcgacgagcgccgcaccgucaucauccacgaccgccccgacaucacccacccccgccacccccgcgaggccggccccaaccccucccgccccaccuccuggaaguccgagggcuccauguccaccgacaagcgcgagacccgcgucgagcgccccgagcgcuccggccgcgaggucuccggccacuccguccgcggcgccccccccggcaaccgcuccuccgccuccggcuacggcucccgcgagggcgaccgcggcgucaucaccgaccgcggcggcggcucccagcacuaccccgaggagcgccacgucgucgagcgccacggccgcgacaccuccggcccccgcaaggaguggcacggcccccccucccagggccccuccuaccacgacacccgccgcaugggcgacggccgcgccggcgccggcaugaucacccagcacuccuccaacgccucccccaucaaccgcaucguccagaucuccggcaacuccaugccccgcggcuccggcuccggcuucaagcccuucaagggcggccccccccgccgcuucuga

SEQ ID NO: 49824 - RNA, 1761 nt, Artificial Sequence
  derived and/or modified sequence opt2 from SLU7__Homo_sapiens__NP_006416
auguccgccaccgucgucgacgccgucaacgccgccccccucuccggcuccaaggagaugucccucgaggagcccaagaagaugacccgcgaggacuggcgcaagaagaaggagcucgaggagcagcgcaagcucggcaacgcccccgccgaggucgacgaggagggcaaggacaucaacccccacaucccccaguacaucuccuccguccccugguacaucgaccccuccaagcgccccacccucaagcaccagcgcccccagcccgagaagcagaagcaguucuccuccuccggcgagugguacaagcgcggcgucaaggagaacuccaucaucaccaaguaccgcaagggcgccugcgagaacugcggcgccaugacccacaagaagaaggacugcuucgagcgcccccgccgcgucggcgccaaguucaccggcaccaacaucgcccccgacgagcacguccagccccagcucauguucgacuacgacggcaagcgcgaccgcuggaacggcuacaaccccgaggagcacaugaagaucgucgaggaguacgccaaggucgaccucgccaagcgcacccucaaggcccagaagcuccaggaggagcucgccuccggcaagcucgucgagcaggccaacucccccaagcaccaguggggcgaggaggagcccaacucccagauggagaaggaccacaacuccgaggacgaggacgaggacaaguacgccgacgacaucgacaugcccggccagaacuucgacuccaagcgccgcaucaccguccgcaaccuccgcauccgcgaggacaucgccaaguaccuccgcaaccucgaccccaacuccgccuacuacgaccccaagacccgcgccaugcgcgagaaccccuacgccaacgccggcaagaaccccgacgaggucuccuacgccggcgacaacuucguccgcuacaccggcgacaccaucuccauggcccagacccagcucuucgccugggaggccuacgacaagggcuccgagguccaccuccaggccgaccccaccaagcucgagcuccucuacaaguccuucaaggucaagaaggaggacuucaaggagcagcagaaggaguccauccucgagaaguacggcggccaggagcaccucgacgccccccccgccgagcuccuccucgcccagaccgaggacuacgucgaguacucccgccacggcaccgucaucaagggccaggagcgcgccgucgccugcuccaaguacgaggaggacgucaagauccacaaccacacccacaucuggggcuccuacuggaaggagggccgcuggggcuacaagugcugccacuccuucuucaaguacuccuacugcaccggcgaggccggcaaggagaucgucaacuccgaggagugcaucaucaacgagaucaccggcgaggaguccgucaagaagccccagacccucauggagcuccaccaggagaagcucaaggaggagaagaagaagaagaagaagaagaagaagaagcaccgcaaguccuccuccgacuccgacgacgaggagaagaagcacgagaagcucaagaaggcccucaacgccgaggaggcccgccuccuccacgucaaggagaccaugcagaucgacgagcgcaagcgccccuacaacuccauguacgagacccgcgagcccaccgaggaggagauggaggccuaccgcaugaagcgccagcgccccgacgaccccauggccuccuuccucggccaguga

SEQ ID NO: 49825 - RNA, 312 nt, Artificial Sequence
  derived and/or modified sequence opt2 from SLURP1__Homo_sapiens__NP_065160
auggccucccgcugggccguccagcuccuccucgucgccgccugguccaugggcugcggcgaggcccucaagugcuacaccugcaaggagcccaugaccuccgccuccugccgcaccaucacccgcugcaagcccgaggacaccgccugcaugaccacccucgucaccgucgaggccgaguaccccuucaaccagucccccgucgucacccgcuccugcuccuccuccugcgucgccaccgaccccgacuccaucggcgccgcccaccucaucuucugcugcuuccgcgaccucugcaacuccgagcucuga

SEQ ID NO: 49826 - RNA, 5505 nt, Artificial Sequence
  derived and/or modified sequence opt2 from SLX4__Homo_sapiens__NP_115820
augaagcucuccgucaacgaggcccagcucggcuucuaccucggcucccucucccaccucuccgccugccccggcaucgacccccgcuccuccgaggaccagcccgagucccucaagaccggccagaugauggacgaguccgacgaggacuucaaggagcucugcgccuccuucuuccagcgcgucaagaagcacggcaucaaggaggucuccggcgagcgcaagacccagaaggccgccuccaacggcacccagauccgcuccaagcucaagcgcaccaagcagaccgccaccaagaccaagacccuccagggccccgccgagaagaagccccccuccggcucccaggccccccgcaccaagaagcagcgcgucaccaaguggcaggccuccgagcccgcccacuccgucaacggcgagggcggcguccucgccuccgcccccgacccccccguccuccgcgagaccgcccagaacacccagaccggcaaccagcaggagcccucccccaaccucucccgcgagaagacccgcgagaacguccccaacuccgacucccagcccccccccuccugccucaccaccgccguccccucccccuccaagccccgcaccgcccagcucguccuccagcgcaugcagcaguucaagcgcgccgaccccgagcgccuccgccacgccuccgaggagugcucccucgaggccgcccgcgaggagaacguccccaaggacccccaggaggagaugauggccggcaacgucuacggccucggcccccccgcccccgaguccgacgccgccgucgcccucacccuccagcaggaguucgcccgcgucggcgccuccgcccacgacgacucccucgaggagaagggccucuucuucugccagaucugccagaagaaccucuccgccaugaacgucacccgccgcgagcagcacgucaaccgcugccucgacgaggccgagaagacccuccgccccuccgucccccagauccccgagugccccaucugcggcaagcccuuccucacccucaagucccgcaccucccaccucaagcagugcgccgucaagauggaggucggcccccagcuccuccuccaggccguccgccuccagaccgcccagcccgagggcuccuccuccccccccauguucuccuucuccgaccacucccgcggccucaagcgccgcggccccaccuccaagaaggagccccgcaagcgccgcaaggucgacgaggcccccuccgaggaccuccucgucgccauggcccucucccgcuccgagauggagcccggcgccgccguccccgcccuccgccucgaguccgccuucuccgagcgcauccgccccgaggccgagaacaagucccgcaagaagaagccccccgucucccccccccuccuccucguccaggacuccgagaccaccggccgccagaucgaggaccgcgucgcccuccuccucuccgaggaggucgagcucuccuccacccccccccuccccgccucccgcauccucaaggagggcugggagcgcgccggccagugcccccccccccccgagcgcaagcaguccuuccucugggagggcuccgcccucaccggcgccugggccauggaggacuucuacaccgcccgccucguccccccccucgucccccagcgccccgcccagggccucaugcaggagcccguccccccccucgucccccccgagcacuccgagcucuccgagcgccgcucccccgcccuccacggcacccccaccgccggcugcggcucccgcggccccucccccuccgccucccagcgcgagcaccaggcccuccaggaccucgucgaccucgcccgcgagggccucuccgccucccccuggcccggcuccggcggccucgccggcuccgagggcaccgccggccucgacgucguccccggcggccucccccucaccggcuucgucguccccucccaggacaagcaccccgaccgcggcggccgcacccuccucucccucggccuccucgucgccgacuucggcgccauggucaacaacccccaccucuccgacguccaguuccagaccgacuccggcgagguccucuacgcccacaaguucguccucuacgcccgcugcccccuccucauccaguacgucaacaacgagggcuucuccgccgucgaggacggcguccucacccagcgcguccuccucggcgacgucuccaccgaggccgcccgcaccuuccuccacuaccucuacaccgccgacaccggccucccccccggccucuccuccgagcucuccucccucgcccaccgcuucggcgucuccgagcucguccaccucugcgagcagguccccaucgccaccgacuccgagggcaagcccugggaggagaaggaggccgagaacugcgagucccgcgccgagaacuuccaggagcuccuccgcuccaugugggccgacgaggaggaggaggccgagacccuccucaaguccaaggaccacgaggaggaccaggagaacgucaacgaggccgagauggaggagaucuacgaguucgccgccacccagcgcaagcuccuccaggaggagcgcgccgccggcgccggcgaggacgccgacuggcucgagggcggcucccccgucuccggccagcuccucgccggcguccagguccagaagcagugggacaaggucgaggagauggagccccucgagcccggccgcgacgaggccgccaccaccugggagaagaugggccagugcgcccucccccccccccagggccagcacuccggcgcccgcggcgccgaggcccccgagcaggaggcccccgaggaggcccucggccacuccuccugcuccucccccucccgcgacugccaggccgagcgcaaggagggcucccucccccacuccgacgacgccggcgacuacgagcagcucuucuccuccacccagggcgagaucuccgagcccucccagaucaccuccgagcccgaggagcaguccggcgccguccgcgagcgcggccucgaggucucccaccgccucgcccccuggcaggccucccccccccaccccugccgcuuccuccucggccccccccagggcggcuccccccgcggcucccaccacaccuccggcuccucccucuccaccccccgcucccgcggcggcaccucccaggucggcucccccacccuccucucccccgccguccccuccaagcagaagcgcgaccgcuccauccucacccucuccaaggagcccggccaccagaagggcaaggagcgccgcuccguccucgagugccgcaacaagggcguccucauguuccccgagaagucccccuccaucgaccucacccaguccaaccccgaccacuccuccucccgcucccagaaguccuccuccaagcucaacgaggaggacgaggucauccuccuccucgacuccgacgaggagcucgagcucgagcagaccaagaugaaguccaucuccuccgacccccucgaggagaagaaggcccucgagaucuccccccgcuccugcgagcucuucuccaucaucgacgucgacgccgaccaggagcccucccagucccccccccgcuccgaggccguccuccagcaggaggacgagggcgcccuccccgagaaccgcggcucccucggccgccgcggcgcccccuggcucuucugcgaccgcgaguccucccccuccgaggccuccaccaccgacaccuccuggcucguccccgccaccccccucgccucccgcucccgcgacugcuccucccagacccagaucuccucccuccgcuccggccucgccguccaggccgucacccagcacaccccccgcgccuccgucggcaaccgcgagggcaacgaggucgcccagaaguucuccgucauccgcccccagaccccccccccccagacccccuccuccugccucacccccgucucccccggcaccuccgacggccgccgccagggccaccgcucccccucccgcccccaccccggcggccacccccacuccuccccccucgccccccaccccaucuccggcgaccgcgcccacuucucccgccgcuuccucaagcacuccccccccggccccuccuuccucaaccagacccccgccggcgaggucgucgaggucggcgacuccgacgacgagcaggaggucgccucccaccaggccaaccgcucccccccccucgacuccgacccccccauccccaucgacgacugcugcuggcacauggagccccucucccccauccccaucgaccacuggaaccucgagcgcaccggcccccucuccaccuccucccccucccgccgcaugaacgaggccgccgacucccgcgacugccgcucccccggccuccucgacaccacccccauccgcggcuccugcaccacccagcgcaagcuccaggagaaguccuccggcgccggcucccucggcaacucccgccccuccuuccucaacuccgcccucugggacgucugggacggcgaggagcagcgcccccccgagacccccccccccgcccagaugcccuccgccggcggcgcccagaagcccgagggccucgagacccccaagggcgccaaccgcaagaagaaccucccccccaagguccccaucacccccaugccccaguacuccaucauggagacccccguccucaagaaggagcucgaccgcuucggcguccgcccccuccccaagcgccagaugguccucaagcucaaggagaucuuccaguacacccaccagacccucgacuccgacuccgaggacgagucccaguccucccagccccuccuccaggccccccacugccagacccucgccucccagaccuacaagcccucccgcgccggcguccacgcccagcaggaggccaccaccggccccggcgcccaccgccccaagggccccgccaagaccaagggcccccgccaccagcgcaagcaccacgaguccaucaccccccccucccgcucccccaccaaggaggccccccccggccucaacgacgacgcccagauccccgccucccaggaguccgucgccaccuccgucgacggcuccgacuccucccucuccucccaguccuccuccuccugcgaguucggcgccgccuucgaguccgccggcgaggaggagggcgagggcgaggucuccgccucccaggccgccguccaggccgccgacaccgacgaggcccuccgcugcuacauccgcuccaagcccgcccucuaccagaagguccuccucuaccagcccuucgagcuccgcgagcuccaggccgagcuccgccagaacggccuccgcgucuccucccgccgccuccucgacuuccucgacacccacugcaucaccuucaccaccgccgccacccgccgcgagaagcuccagggccgccgccgccagccccgcggcaagaagaaggucgagcgcaacuga

SEQ ID NO: 49827 - RNA, 1227 nt, Artificial Sequence
  derived and/or modified sequence opt2 from SLX4IP__Homo_sapiens__NP_001009608
auggccuccaagaaguucgccgucaagugcggcaacuucgccguccucgucgaccuccacauccucccccagggcuccaacaaggacaccuccugguucuccgagcagaagaaggaggaggucugccuccuccucaaggagaccaucgacucccgcguccaggaguaccucgagguccgcaagcagcaccgccccuccaacgccgaguucacccgcuccaacccccucucccucaagggcuacggcuuccagaucaccgccuacuuccucaagcgcggcauccgccuccgcugcauccgcuccacccagaacgccgagcucugcgucuuccccgaccgcuucgucgucugcgucucccagcucgccuucucccgcgaccuccucgccucccagaacgaggaccucaccgagcgcguccuccacggcgucuccgacuacuucgccgagugcgccgaguccucccucccccccuccgccaagcuccgccgcaacgcccucaaggagaucgucaagcgcaccgagaccaaguccuccgucaccuccaagucccagacccgccgcgacaccgucgagaccuccuccgacuccgucaucgccgagaucgcccgccgccgcaacgacggccaggccuccuccuccccccccuccgaguccaugggccaggccaaggacuccaucaaggccgccgagucccacuggggccuccccguccagaagcucgagaaggucaaccagacccagcccgaggacaccuccggccagcagaagccccaccccggcgagcgccucaagaccggccuccucucccgcucccccgucugcuccugcgaguccgccucccccugccccaagcaguccccccgcgucgccaagacccagcagaagcgccgcaacugcuccuccgccgaggacuucgaccaccacggccgcgucucccucggcuccgaccgccucgucccccgcgagaucaucgucgagaaguccaaggccguccgcguccuccccgccuccgagcucuccgaccccggccuccuccucaagcaggaccucgccaagaccaccuccaaggaggagcuccacguccucgagucccucuccucccgccaccucaugaagaacaaccccggccaggcccagcagaccggccucgccaccaacaccgagcgccucuccaccauccagaacucccccaccaagaagcgcaagaaguacgagcgcggccacuga

SEQ ID NO: 49828 - RNA, 1398 nt, Artificial Sequence
  derived and/or modified sequence opt2 from SMAD1__Homo_sapiens__NP_005891
augaacgucaccucccucuucuccuucaccucccccgccgucaagcgccuccucggcuggaagcagggcgacgaggaggagaagugggccgagaaggccgucgacgcccucgucaagaagcucaagaagaagaagggcgccauggaggagcucgagaaggcccucuccugccccggccagcccuccaacugcgucaccaucccccgcucccucgacggccgccuccaggucucccaccgcaagggccucccccacgucaucuacugccgcgucuggcgcuggcccgaccuccagucccaccacgagcucaagccccucgagugcugcgaguuccccuucggcuccaagcagaaggaggucugcaucaaccccuaccacuacaagcgcgucgagucccccguccucccccccguccucgucccccgccacuccgaguacaacccccagcacucccuccucgcccaguuccgcaaccucggccagaacgagccccacaugccccucaacgccaccuuccccgacuccuuccagcagcccaacucccaccccuucccccacucccccaacuccuccuaccccaacucccccggcuccuccuccuccaccuacccccacucccccaccuccuccgaccccggcucccccuuccagaugcccgccgacacccccccccccgccuaccucccccccgaggaccccaugacccaggacggcucccagcccauggacaccaacaugauggcccccccccuccccuccgagaucaaccgcggcgacguccaggccgucgccuacgaggagcccaagcacuggugcuccaucgucuacuacgagcucaacaaccgcgucggcgaggccuuccacgccuccuccaccuccguccucgucgacggcuucaccgaccccuccaacaacaagaaccgcuucugccucggccuccucuccaacgucaaccgcaacuccaccaucgagaacacccgccgccacaucggcaagggcguccaccucuacuacgucggcggcgaggucuacgccgagugccucuccgacuccuccaucuucguccagucccgcaacugcaacuaccaccacggcuuccaccccaccaccgucugcaagauccccuccggcugcucccucaagaucuucaacaaccaggaguucgcccagcuccucgcccaguccgucaaccacggcuucgagaccgucuacgagcucaccaagaugugcaccauccgcauguccuucgucaagggcuggggcgccgaguaccaccgccaggacgucaccuccacccccugcuggaucgagauccaccuccacggcccccuccaguggcucgacaagguccucacccagaugggcuccccccacaaccccaucuccuccgucuccuga

SEQ ID NO: 49829 - RNA, 1404 nt, Artificial Sequence
  derived and/or modified sequence opt2 from SMAD2__Homo_sapiens__XP_006722514
auguccuccauccuccccuucaccccccccgucgucaagcgccuccucggcuggaagaaguccgccggcggcuccggcggcgccggcggcggcgagcagaacggccaggaggagaaguggugcgagaaggccgucaagucccucgucaagaagcucaagaagaccggccgccucgacgagcucgagaaggccaucaccacccagaacugcaacaccaagugcgucaccauccccuccaccugcuccgagaucuggggccucuccacccccaacaccaucgaccagugggacaccaccggccucuacuccuucuccgagcagacccgcucccucgacggccgccuccaggucucccaccgcaagggccucccccacgucaucuacugccgccucuggcgcuggcccgaccuccacucccaccacgagcucaaggccaucgagaacugcgaguacgccuucaaccucaagaaggacgaggucugcgucaaccccuaccacuaccagcgcgucgagacccccguccucccccccguccucgucccccgccacaccgagauccucaccgagcuccccccccucgacgacuacacccacuccauccccgagaacaccaacuuccccgccggcaucgagccccaguccaacuacauccccgagacccccccccccggcuacaucuccgaggacggcgagaccuccgaccagcagcucaaccaguccauggacaccggcucccccgccgagcucucccccaccacccucucccccgucaaccacucccucgaccuccagcccgucaccuacuccgagcccgccuucuggugcuccaucgccuacuacgagcucaaccagcgcgucggcgagaccuuccacgccucccagcccucccucaccgucgacggcuucaccgaccccuccaacuccgagcgcuucugccucggccuccucuccaacgucaaccgcaacgccaccgucgagaugacccgccgccacaucggccgcggcguccgccucuacuacaucggcggcgaggucuucgccgagugccucuccgacuccgccaucuucguccagucccccaacugcaaccagcgcuacggcuggcaccccgccaccgucugcaagaucccccccggcugcaaccucaagaucuucaacaaccaggaguucgccgcccuccucgcccaguccgucaaccagggcuucgaggccgucuaccagcucacccgcaugugcaccauccgcauguccuucgucaagggcuggggcgccgaguaccgccgccagaccgucaccuccacccccugcuggaucgagcuccaccucaacggcccccuccaguggcucgacaagguccucacccagaugggcucccccuccguccgcugcuccuccauguccuga

SEQ ID NO: 49830 - RNA, 963 nt, Artificial Sequence
  derived and/or modified sequence opt2 from SMAD3__Homo_sapiens__NP_001138574
auggagcucugcgaguucgccuucaacaugaagaaggacgaggucugcgucaaccccuaccacuaccagcgcgucgagacccccguccucccccccguccucgucccccgccacaccgagauccccgccgaguuccccccccucgacgacuacucccacuccauccccgagaacaccaacuuccccgccggcaucgagccccaguccaacauccccgagacccccccccccggcuaccucuccgaggacggcgagaccuccgaccaccagaugaaccacuccauggacgccggcucccccaaccucucccccaaccccaugucccccgcccacaacaaccucgaccuccagcccgucaccuacugcgagcccgccuucuggugcuccaucuccuacuacgagcucaaccagcgcgucggcgagaccuuccacgccucccagcccuccaugaccgucgacggcuucaccgaccccuccaacuccgagcgcuucugccucggccuccucuccaacgucaaccgcaacgccgccgucgagcucacccgccgccacaucggccgcggcguccgccucuacuacaucggcggcgaggucuucgccgagugccucuccgacuccgccaucuucguccagucccccaacugcaaccagcgcuacggcuggcaccccgccaccgucugcaagaucccccccggcugcaaccucaagaucuucaacaaccaggaguucgccgcccuccucgcccaguccgucaaccagggcuucgaggccgucuaccagcucacccgcaugugcaccauccgcauguccuucgucaagggcuggggcgccgaguaccgccgccagaccgucaccuccacccccugcuggaucgagcuccaccucaacggcccccuccaguggcucgacaagguccucacccagaugggcucccccuccauccgcugcuccuccgucuccuga

SEQ ID NO: 49831 - RNA, 1659 nt, Artificial Sequence
  derived and/or modified sequence opt2 from SMAD4__Homo_sapiens__NP_005350
auggacaacauguccaucaccaacacccccaccuccaacgacgccugccucuccaucguccacucccucaugugccaccgccagggcggcgaguccgagaccuucgccaagcgcgccaucgagucccucgucaagaagcucaaggagaagaaggacgagcucgacucccucaucaccgccaucaccaccaacggcgcccaccccuccaagugcgucaccauccagcgcacccucgacggccgccuccaggucgccggccgcaagggcuucccccacgucaucuacgcccgccucuggcgcuggcccgaccuccacaagaacgagcucaagcacgucaaguacugccaguacgccuucgaccucaagugcgacuccgucugcgucaaccccuaccacuacgagcgcgucgucucccccggcaucgaccucuccggccucacccuccaguccaacgcccccuccuccaugauggucaaggacgaguacguccacgacuucgagggccagcccucccucuccaccgagggccacuccauccagaccauccagcacccccccuccaaccgcgccuccaccgagaccuacuccacccccgcccuccucgcccccuccgaguccaacgccaccuccaccgccaacuuccccaacauccccgucgccuccaccucccagcccgccuccauccucggcggcucccacuccgagggccuccuccagaucgccuccggcccccagcccggccagcagcagaacggcuucaccggccagcccgccaccuaccaccacaacuccaccaccaccuggaccggcucccgcaccgcccccuacacccccaaccucccccaccaccagaacggccaccuccagcaccacccccccaugcccccccaccccggccacuacuggcccguccacaacgagcucgccuuccagccccccaucuccaaccaccccgcccccgaguacuggugcuccaucgccuacuucgagauggacguccaggucggcgagaccuucaagguccccuccuccugccccaucgucaccgucgacggcuacgucgaccccuccggcggcgaccgcuucugccucggccagcucuccaacguccaccgcaccgaggccaucgagcgcgcccgccuccacaucggcaagggcguccagcucgagugcaagggcgagggcgacgucuggguccgcugccucuccgaccacgccgucuucguccaguccuacuaccucgaccgcgaggccggccgcgcccccggcgacgccguccacaagaucuaccccuccgccuacaucaaggucuucgaccuccgccagugccaccgccagaugcagcagcaggccgccaccgcccaggccgccgccgccgcccaggccgccgccgucgccggcaacauccccggccccggcuccgucggcggcaucgcccccgccaucucccucuccgccgccgccggcaucggcgucgacgaccuccgccgccucugcauccuccgcauguccuucgucaagggcuggggccccgacuacccccgccaguccaucaaggagacccccugcuggaucgagauccaccuccaccgcgcccuccagcuccucgacgagguccuccacaccaugcccaucgccgacccccagccccucgacuga

SEQ ID NO: 49832 - RNA, 1398 nt, Artificial Sequence
  derived and/or modified sequence opt2 from SMAD5__Homo_sapiens__NP_001001420
augaccuccauggccucccucuucuccuucaccucccccgccgucaagcgccuccucggcuggaagcagggcgacgaggaggagaagugggccgagaaggccgucgacgcccucgucaagaagcucaagaagaagaagggcgccauggaggagcucgagaaggcccucuccucccccggccagcccuccaagugcgucaccaucccccgcucccucgacggccgccuccaggucucccaccgcaagggccucccccacgucaucuacugccgcgucuggcgcuggcccgaccuccagucccaccacgagcucaagccccucgacaucugcgaguuccccuucggcuccaagcagaaggaggucugcaucaaccccuaccacuacaagcgcgucgagucccccguccucccccccguccucgucccccgccacaacgaguucaacccccagcacucccuccucguccaguuccgcaaccucucccacaacgagccccacaugccccagaacgccaccuuccccgacuccuuccaccagcccaacaacacccccuucccccucucccccaacucccccuacccccccucccccgccuccuccaccuaccccaacucccccgccuccuccggccccggcucccccuuccagcuccccgccgacacccccccccccgccuacaugccccccgacgaccagaugggccaggacaacucccagcccauggacaccuccaacaacaugaucccccagaucaugcccuccaucuccucccgcgacguccagcccgucgccuacgaggagcccaagcacuggugcuccaucgucuacuacgagcucaacaaccgcgucggcgaggccuuccacgccuccuccaccuccguccucgucgacggcuucaccgaccccuccaacaacaagucccgcuucugccucggccuccucuccaacgucaaccgcaacuccaccaucgagaacacccgccgccacaucggcaagggcguccaccucuacuacgucggcggcgaggucuacgccgagugccucuccgacuccuccaucuucguccagucccgcaacugcaacuuccaccacggcuuccaccccaccaccgucugcaagauccccuccuccugcucccucaagaucuucaacaaccaggaguucgcccagcuccucgcccaguccgucaaccacggcuucgaggccgucuacgagcucaccaagaugugcaccauccgcauguccuucgucaagggcuggggcgccgaguaccaccgccaggacgucaccuccacccccugcuggaucgagauccaccuccacggcccccuccaguggcucgacaagguccucacccagaugggcuccccccucaaccccaucuccuccgucuccuga

SEQ ID NO: 49833 - RNA, 1491 nt, Artificial Sequence
  derived and/or modified sequence opt2 from SMAD6__Homo_sapiens__NP_005576
auguuccgcuccaagcgcuccggccucguccgccgccucuggcgcucccgcgucguccccgaccgcgaggagggcggcuccggcggcggcggcggcggcgacgaggacggcucccucggcucccgcgccgagcccgccccccgcgcccgcgagggcggcggcugcggccgcuccgagguccgccccgucgccccccgccgcccccgcgacgccgucggccagcgcggcgcccagggcgccggccgccgccgccgcgccggcggccccccccgccccauguccgagcccggcgccggcgccggcuccucccuccucgacgucgccgagcccggcggccccggcuggcuccccgaguccgacugcgagaccgucaccugcugccucuucuccgagcgcgacgccgccggcgccccccgcgacgccuccgacccccucgccggcgccgcccucgagcccgccggcggcggccgcucccgcgaggcccgcucccgccuccuccuccucgagcaggagcucaagaccgucaccuacucccuccucaagcgccucaaggagcgcucccucgacacccuccucgaggccgucgagucccgcggcggcguccccggcggcugcguccucgucccccgcgccgaccuccgccucggcggccagcccgcccccccccagcuccuccucggccgccucuuccgcuggcccgaccuccagcacgccgucgagcucaagccccucugcggcugccacuccuucgccgccgccgccgacggccccaccgucugcugcaaccccuaccacuucucccgccucugcggccccgaguccccccccccccccuacucccgccucuccccccgcgacgaguacaagccccucgaccucuccgacuccacccucuccuacaccgagaccgaggccaccaacucccucaucaccgcccccggcgaguucuccgacgccuccaugucccccgacgccaccaagcccucccacuggugcuccgucgccuacugggagcaccgcacccgcgucggccgccucuacgccgucuacgaccaggccgucuccaucuucuacgaccucccccagggcuccggcuucugccucggccagcucaaccucgagcagcgcuccgaguccguccgccgcacccgcuccaagaucggcuucggcauccuccucuccaaggagcccgacggcgucugggccuacaaccgcggcgagcaccccaucuucgucaacucccccacccucgacgcccccggcggccgcgcccucgucguccgcaaggucccccccggcuacuccaucaaggucuucgacuucgagcgcuccggccuccagcacgcccccgagcccgacgccgccgacggccccuacgaccccaacuccguccgcaucuccuucgccaagggcuggggccccugcuacucccgccaguucaucaccuccugccccugcuggcucgagauccuccucaacaacccccgcuga

SEQ ID NO: 49834 - RNA, 636 nt, Artificial Sequence
  derived and/or modified sequence opt2 from SMAD7__Homo_sapiens__NP_001177751
auggacuuccucaagcccaccgccgacugccccgacgccguccccuccuccgccgagaccggcggcaccaacuaccucgcccccggcggccucuccgacucccagcuccuccucgagcccggcgaccgcucccacuggugcgucgucgccuacugggaggagaagacccgcgucggccgccucuacugcguccaggagcccucccucgacaucuucuacgaccucccccagggcaacggcuucugccucggccagcucaacuccgacaacaagucccagcucguccagaagguccgcuccaagaucggcugcggcauccagcucacccgcgaggucgacggcgucugggucuacaaccgcuccuccuaccccaucuucaucaaguccgccacccucgacaaccccgacucccgcacccuccucguccacaaggucuuccccggcuucuccaucaaggccuucgacuacgagaaggccuacucccuccagcgccccaacgaccacgaguucaugcagcagcccuggaccggcuucaccguccagaucuccuucgucaagggcuggggccagugcuacacccgccaguucaucuccuccugccccugcuggcucgaggucaucuucaacucccgcuga

SEQ ID NO: 49835 - RNA, 1404 nt, Artificial Sequence
  derived and/or modified sequence opt2 from SMAD9__Homo_sapiens__NP_001120689
augcacuccaccacccccaucuccucccucuucuccuucaccucccccgccgucaagcgccuccucggcuggaagcagggcgacgaggaggagaagugggccgagaaggccgucgacucccucgucaagaagcucaagaagaagaagggcgccauggacgagcucgagcgcgcccucuccugccccggccagcccuccaagugcgucaccaucccccgcucccucgacggccgccuccaggucucccaccgcaagggccucccccacgucaucuacugccgcgucuggcgcuggcccgaccuccagucccaccacgagcucaagccccucgagugcugcgaguuccccuucggcuccaagcagaaggaggucugcaucaaccccuaccacuaccgccgcgucgagacccccguccucccccccguccucgucccccgccacuccgaguacaacccccagcucucccuccucgccaaguuccgcuccgccucccuccacuccgagccccucaugccccacaacgccaccuaccccgacuccuuccagcagccccccugcuccgcccucccccccucccccucccacgccuucucccagucccccugcaccgccuccuacccccacucccccggcucccccuccgagcccgagucccccuaccagcacuccgucgacacccccccccuccccuaccacgccaccgaggccuccgagacccaguccggccagcccgucgacgccaccgccgaccgccacgucguccucuccauccccaacggcgacuuccgccccgucugcuacgaggagccccagcacuggugcuccgucgccuacuacgagcucaacaaccgcgucggcgagaccuuccaggccuccucccgcuccguccucaucgacggcuucaccgaccccuccaacaaccgcaaccgcuucugccucggccuccucuccaacgucaaccgcaacuccaccaucgagaacacccgccgccacaucggcaagggcguccaccucuacuacgucggcggcgaggucuacgccgagugcgucuccgacuccuccaucuucguccagucccgcaacugcaacuaccagcacggcuuccaccccgccaccgucugcaagauccccuccggcugcucccucaaggucuucaacaaccagcucuucgcccagcuccucgcccaguccguccaccacggcuucgaggucgucuacgagcucaccaagaugugcaccauccgcauguccuucgucaagggcuggggcgccgaguaccaccgccaggacgucaccuccacccccugcuggaucgagauccaccuccacggcccccuccaguggcucgacaagguccucacccagaugggcuccccccacaaccccaucuccuccgucuccuga

SEQ ID NO: 49836 - RNA, 294 nt, Artificial Sequence
  derived and/or modified sequence opt2 from SMAGP__Homo_sapiens__NP_001029045
augaccucccuccucaccacccccuccccccgcgaggagcucaugaccacccccauccuccagcccaccgaggcccucucccccgaggacggcgccuccaccgcccucaucgccgucgucaucaccgucgucuuccucacccuccucuccgucgucauccucaucuucuucuaccucuacaagaacaagggcuccuacgucaccuacgagcccaccgagggcgagcccuccgccaucguccagauggaguccgaccucgccaagggcuccgagaaggaggaguacuucaucuga

SEQ ID NO: 49837 - RNA, 1404 nt, Artificial Sequence
  derived and/or modified sequence opt2 from SMAP1__Homo_sapiens__NP_001037770
auggccacccgcuccugccgcgagaaggcccagaagcucaacgagcagcaccagcucauccucuccaagcuccuccgcgaggaggacaacaaguacugcgccgacugcgaggccaagggcccccgcugggccuccuggaacaucggcgucuucaucugcauccgcugcgccggcauccaccgcaaccucggcguccacaucucccgcgucaaguccgucaaccucgaccaguggaccgccgagcagauccagugcaugcaggacaugggcaacaccaaggcccgccuccucuacgaggccaaccuccccgagaacuuccgccgcccccagaccgaccaggccgucgaguucuucauccgcgacaaguacgagaagaagaaguacuacgacaagaacgccaucgccaucaccaacaucuccuccuccgacgccccccuccagccccucgucuccucccccucccuccaggccgccgucgacaagaacaagcucgagaaggagaaggagaagaagaaggaggagaagaagcgcgagaaggagcccgagaagcccgccaagccccucaccgccgagaagcuccagaagaaggaccagcagcucgagcccaagaaguccaccucccccaagaaggccgccgagcccaccgucgaccuccucggccucgacggccccgccgucgcccccgucaccaacggcaacaccaccguccccccccucaacgacgaccucgacaucuucggccccaugaucuccaacccccuccccgccaccgucaugccccccgcccagggcacccccuccgcccccgccgccgccacccucuccaccgucaccuccggcgaccucgaccucuucaccgagcagaccaccaaguccgaggaggucgccaagaagcagcucuccaaggacuccauccucucccucuacggcaccggcaccauccagcagcaguccacccccggcgucuucaugggccccaccaacauccccuucaccucccaggcccccgccgccuuccagggcuuccccuccaugggcguccccguccccgccgcccccggccucaucggcaacgucaugggccagucccccuccaugauggucggcaugcccaugcccaacggcuucaugggcaacgcccagaccggcgucaugccccucccccagaacgucgucggcccccagggcggcauggucggccagaugggcgccccccaguccaaguucggccucccccaggcccagcagccccaguggucccucucccagaugaaccagcagauggccggcauguccaucuccuccgccacccccaccgccggcuucggccagcccuccuccaccaccgccggcugguccggcuccuccuccggccagacccucuccacccagcucuggaaguga

SEQ ID NO: 49838 - RNA, 3213 nt, Artificial Sequence
  derived and/or modified sequence opt2 from SMARCA1__Homo_sapiens__NP_001269803
auggagcaggacaccgccgccgucgccgccaccgucgccgccgccgacgccaccgccaccaucgucgucaucgaggacgagcagcccggccccuccaccucccaggaggagggcgccgccgccgccgccaccgaggccaccgccgccaccgagaagggcgagaagaagaaggagaagaacgucuccuccuuccagcucaagcucgccgccaaggcccccaaguccgagaaggagauggaccccgaguacgaggagaagaugaaggccgaccgcgccaagcgcuucgaguuccuccucaagcagaccgagcucuucgcccacuucauccagcccuccgcccagaagucccccaccuccccccucaacaugaagcucggccgcccccgcaucaagaaggacgagaagcagucccucaucuccgccggcgacuaccgccaccgccgcaccgagcaggaggaggacgaggagcuccucuccgagucccgcaagaccuccaacgucugcauccgcuucgaggucucccccuccuacgucaagggcggcccccuccgcgacuaccagauccgcggccucaacuggcucaucucccucuacgagaacggcgucaacggcauccucgccgacgagaugggccucggcaagacccuccagaccaucgcccuccucggcuaccucaagcacuaccgcaacauccccggcccccacaugguccucguccccaaguccacccuccacaacuggaugaacgaguucaagcgcuggguccccucccuccgcgucaucugcuucgucggcgacaaggacgcccgcgccgccuucauccgcgacgagaugaugcccggcgagugggacgucugcgucaccuccuacgagauggucaucaaggagaaguccgucuucaagaaguuccacuggcgcuaccucgucaucgacgaggcccaccgcaucaagaacgagaaguccaagcucuccgagaucguccgcgaguucaaguccaccaaccgccuccuccucaccggcaccccccuccagaacaaccuccacgagcucugggcccuccucaacuuccuccuccccgacgucuucaacuccgccgacgacuucgacuccugguucgacaccaagaacugccucggcgaccagaagcucgucgagcgccuccacgccguccucaagcccuuccuccuccgccgcaucaagaccgacgucgagaagucccucccccccaagaaggagaucaagaucuaccucggccucuccaagaugcagcgcgagugguacaccaagauccucaugaaggacaucgacguccucaacuccuccggcaagauggacaagaugcgccuccucaacauccucaugcagcuccgcaagugcugcaaccaccccuaccucuucgacggcgccgagcccggcccccccuacaccaccgacgagcacaucgucuccaacuccggcaagauggucguccucgacaagcuccucgccaagcucaaggagcagggcucccgcguccucaucuucucccagaugacccgccuccucgacauccucgaggacuacugcauguggcgcggcuacgaguacugccgccucgacggccagaccccccacgaggagcgcgaggacaaguuccucgaggucgaguuccucggccagcgcgaggccaucgaggccuucaacgcccccaacuccuccaaguucaucuucaugcucuccacccgcgccggcggccucggcaucaaccucgccuccgccgacgucgucauccucuacgacuccgacuggaacccccaggucgaccuccaggccauggaccgcgcccaccgcaucggccagaagaagcccguccgcgucuuccgccucaucaccgacaacaccgucgaggagcgcaucgucgagcgcgccgagaucaagcuccgccucgacuccaucgucauccagcagggccgccucaucgaccagcaguccaacaagcucgccaaggaggagaugcuccagaugauccgccacggcgccacccacgucuucgccuccaaggaguccgagcucaccgacgaggacaucaccaccauccucgagcgcggcgagaagaagaccgccgagaugaacgagcgccuccagaagaugggcgaguccucccuccgcaacuuccgcauggacaucgagcagucccucuacaaguucgagggcgaggacuaccgcgagaagcagaagcucggcauggucgaguggaucgagccccccaagcgcgagcgcaaggccaacuacgccgucgacgccuacuuccgcgaggcccuccgcgucuccgagcccaagauccccaaggccccccgcccccccaagcagcccaacguccaggacuuccaguucuuccccccccgccucuucgagcuccucgagaaggagauccucuacuaccgcaagaccaucggcuacaaggucccccgcaaccccgacauccccaaccccgcccucgcccagcgcgaggagcagaagaagaucgacggcgccgagccccucacccccgaggagaccgaggagaaggagaagcuccucacccagggcuucaccaacuggaccaagcgcgacuucaaccaguucaucaaggccaacgagaaguacggccgcgacgacaucgacaacaucgcccgcgaggucgagggcaagucccccgaggaggucauggaguacuccgccgucuucugggagcgcugcaacgagcuccaggacaucgagaagaucauggcccagaucgagcgcggcgaggcccgcauccagcgccgcaucuccaucaagaaggcccucgacgccaagaucgcccgcuacaaggcccccuuccaccagcuccgcauccaguacggcaccuccaagggcaagaacuacaccgaggaggaggaccgcuuccucaucugcaugcuccacaagaugggcuucgaccgcgagaacgucuacgaggagcuccgccagugcguccgcaacgccccccaguuccgcuucgacugguucaucaagucccgcaccgccauggaguuccagcgccgcugcaacacccucaucucccucaucgagaaggagaacauggagaucgaggagcgcgagcgcgccgagaagaagaagcgcgccaccaagacccccaugucccagaagcgcaaggccgaguccgccaccgaguccuccggcaagaaggacgucaagaaggucaaguccuga

SEQ ID NO: 49839 - RNA, 4545 nt, Artificial Sequence
  derived and/or modified sequence opt2 from SMARCA2__Homo_sapiens__NP_001276326
auguccacccccaccgaccccggcgccaugccccaccccggccccucccccggccccggccccucccccggccccauccucggccccucccccggccccggccccucccccggcuccguccacuccaugaugggccccucccccggcccccccuccgucucccaccccaugcccaccaugggcuccaccgacuucccccaggagggcaugcaccagaugcacaagcccaucgacggcauccacgacaagggcaucgucgaggacauccacugcggcuccaugaagggcaccggcaugcgccccccccaccccggcaugggccccccccagucccccauggaccagcacucccagggcuacauguccccccaccccuccccccucggcgcccccgagcacgucuccucccccauguccggcggcggccccacccccccccagaugccccccucccagcccggcgcccucauccccggcgacccccaggccaugucccagcccaaccgcggccccucccccuucucccccguccagcuccaccagcuccgcgcccagauccucgccuacaagaugcucgcccgcggccagccccuccccgagacccuccagcucgccguccagggcaagcgcacccuccccggccuccagcagcagcagcagcagcagcagcagcagcagcagcagcagcagcagcagcagcagcagcagcagcagccccagcagcagcccccccagccccagacccagcagcagcagcagcccgcccucgucaacuacaaccgccccuccggccccggccccgagcucuccggccccuccaccccccagaagcuccccguccccgcccccggcggccgccccucccccgccccccccgccgccgcccagccccccgccgccgccguccccggccccuccgucccccagcccgcccccggccagcccucccccguccuccagcuccagcagaagcagucccgcaucucccccauccagaagccccagggccucgaccccgucgagauccuccaggagcgcgaguaccgccuccaggcccgcaucgcccaccgcauccaggagcucgagaaccuccccggcucccucccccccgaccuccgcaccaaggccaccgucgagcucaaggcccuccgccuccucaacuuccagcgccagcuccgccaggaggucgucgccugcaugcgccgcgacaccacccucgagaccgcccucaacuccaaggccuacaagcgcuccaagcgccagacccuccgcgaggcccgcaugaccgagaagcucgagaagcagcagaagaucgagcaggagcgcaagcgccgccagaagcaccaggaguaccucaacuccauccuccagcacgccaaggacuucaaggaguaccaccgcuccgucgccggcaagauccagaagcucuccaaggccgucgccaccuggcacgccaacaccgagcgcgagcagaagaaggagaccgagcgcaucgagaaggagcgcaugcgccgccucauggccgaggacgaggagggcuaccgcaagcucaucgaccagaagaaggaccgccgccucgccuaccuccuccagcagaccgacgaguacgucgccaaccucaccaaccucgucugggagcacaagcaggcccaggccgccaaggagaagaagaagcgccgccgccgcaagaagaaggccgaggagaacgccgagggcggcgaguccgcccucggccccgacggcgagcccaucgacgaguccucccagauguccgaccuccccgucaaggucacccacaccgagaccggcaagguccucuucggccccgaggcccccaaggccucccagcucgacgccuggcucgagaugaaccccggcuacgaggucgccccccgcuccgacuccgaggaguccgacuccgacuacgaggaggaggacgaggaggaggaguccucccgccaggagaccgaggagaagauccuccucgaccccaacuccgaggaggucuccgagaaggacgccaagcagaucaucgagaccgccaagcaggacgucgacgacgaguacuccaugcaguacuccgcccgcggcucccaguccuacuacaccgucgcccacgccaucuccgagcgcgucgagaagcaguccgcccuccucaucaacggcacccucaagcacuaccagcuccagggccucgaguggauggucucccucuacaacaacaaccucaacggcauccucgccgacgagaugggccucggcaagaccauccagaccaucgcccucaucaccuaccucauggagcacaagcgccucaacggccccuaccucaucaucgucccccucuccacccucuccaacuggaccuacgaguucgacaagugggcccccuccgucgucaagaucuccuacaagggcacccccgccaugcgccgcucccucgucccccagcuccgcuccggcaaguucaacguccuccucaccaccuacgaguacaucaucaaggacaagcacauccucgccaagauccgcuggaaguacaugaucgucgacgagggccaccgcaugaagaaccaccacugcaagcucacccaggucgaccucaacgaggaggagaccauccucaucauccgccgccuccacaagguccuccgccccuuccuccuccgccgccucaagaaggaggucgagucccagcuccccgagaaggucgaguacgucaucaagugcgacauguccgcccuccagaagauccucuaccgccacaugcaggccaagggcauccuccucaccgacggcuccgagaaggacaagaagggcaagggcggcgccaagacccucaugaacaccaucaugcagcuccgcaagaucugcaaccaccccuacauguuccagcacaucgaggaguccuucgccgagcaccucggcuacuccaacggcgucaucaacggcgccgagcucuaccgcgccuccggcaaguucgagcuccucgaccgcauccuccccaagcuccgcgccaccaaccaccgcguccuccucuucugccagaugaccucccucaugaccaucauggaggacuacuucgccuuccgcaacuuccucuaccuccgccucgacggcaccaccaaguccgaggaccgcgccgcccuccucaagaaguucaacgagcccggcucccaguacuucaucuuccuccucuccacccgcgccggcggccucggccucaaccuccaggccgccgacaccgucgucaucuucgacuccgacuggaacccccaccaggaccuccaggcccaggaccgcgcccaccgcaucggccagcagaacgagguccgcguccuccgccucugcaccgucaacuccgucgaggagaagauccucgccgccgccaaguacaagcucaacgucgaccagaaggucauccaggccggcauguucgaccagaaguccuccucccacgagcgccgcgccuuccuccaggccauccucgagcacgaggaggagaacgaggaggaggacgagguccccgacgacgagacccucaaccagaugaucgcccgccgcgaggaggaguucgaccucuucaugcgcauggacauggaccgccgccgcgaggacgcccgcaaccccaagcgcaagccccgccucauggaggaggacgagcuccccuccuggaucaucaaggacgacgccgaggucgagcgccucaccugcgaggaggaggaggagaagaucuucggccgcggcucccgccagcgccgcgacgucgacuacuccgacgcccucaccgagaagcaguggcuccgcgccaucgaggacggcaaccucgaggagauggaggaggagguccgccucaagaagcgcaagcgccgccgcaacgucgacaaggaccccgccaaggaggacgucgagaaggccaagaagcgccgcggccgcccccccgccgagaagcucucccccaacccccccaagcucaccaagcagaugaacgccaucaucgacaccgucaucaacuacaaggacuccuccggccgccagcucuccgaggucuucauccagcuccccucccgcaaggagcuccccgaguacuacgagcucauccgcaagcccgucgacuucaagaagaucaaggagcgcauccgcaaccacaaguaccgcucccucggcgaccucgagaaggacgucaugcuccucugccacaacgcccagaccuucaaccucgagggcucccagaucuacgaggacuccaucguccuccaguccgucuucaaguccgcccgccagaagaucgccaaggaggaggaguccgaggacgaguccaacgaggaggaggaggaggaggacgaggaggaguccgaguccgaggccaaguccgucaaggucaagaucaagcucaacaagaaggacgacaagggccgcgacaagggcaagggcaagaagcgccccaaccgcggcaaggccaagcccgucgucuccgacuucgacuccgacgaggagcaggacgagcgcgagcaguccgagggcuccggcaccgacgacgaguga

SEQ ID NO: 49840 - RNA, 4944 nt, Artificial Sequence
  derived and/or modified sequence opt2 from SMARCA4__Homo_sapiens__NP_001122316
auguccacccccgaccccccccucggcggcaccccccgccccggccccucccccggccccggccccucccccggcgccaugcucggccccucccccggccccucccccggcuccgcccacuccaugaugggccccucccccggcccccccuccgccggccaccccauccccacccagggccccggcggcuacccccaggacaacaugcaccagaugcacaagcccauggaguccaugcacgagaagggcauguccgacgacccccgcuacaaccagaugaagggcaugggcaugcgcuccggcggccacgccggcaugggccccccccccucccccauggaccagcacucccagggcuaccccuccccccucggcggcuccgagcacgccuccucccccguccccgccuccggccccuccuccggcccccagauguccuccggccccggcggcgccccccucgacggcgccgacccccaggcccucggccagcagaaccgcggccccacccccuucaaccagaaccagcuccaccagcuccgcgcccagaucauggccuacaagaugcucgcccgcggccagccccuccccgaccaccuccagauggccguccagggcaagcgccccaugcccggcaugcagcagcagaugcccacccuccccccccccuccgucuccgccaccggccccggccccggccccggccccggccccggccccggccccggccccgccccccccaacuacucccgcccccacggcaugggcggccccaacaugcccccccccggccccuccggcgucccccccggcaugcccggccagccccccggcggcccccccaagcccuggcccgagggccccauggccaacgccgccgcccccaccuccaccccccagaagcucauccccccccagcccaccggccgccccucccccgccccccccgccgucccccccgccgccucccccgucaugcccccccagacccagucccccggccagcccgcccagcccgcccccauggucccccuccaccagaagcagucccgcaucacccccauccagaagccccgcggccucgaccccgucgagauccuccaggagcgcgaguaccgccuccaggcccgcaucgcccaccgcauccaggagcucgagaaccuccccggcucccucgccggcgaccuccgcaccaaggccaccaucgagcucaaggcccuccgccuccucaacuuccagcgccagcuccgccaggaggucgucgucugcaugcgccgcgacaccgcccucgagaccgcccucaacgccaaggccuacaagcgcuccaagcgccagucccuccgcgaggcccgcaucaccgagaagcucgagaagcagcagaagaucgagcaggagcgcaagcgccgccagaagcaccaggaguaccucaacuccauccuccagcacgccaaggacuucaaggaguaccaccgcuccgucaccggcaagauccagaagcucaccaaggccgucgccaccuaccacgccaacaccgagcgcgagcagaagaaggagaacgagcgcaucgagaaggagcgcaugcgccgccucauggccgaggacgaggagggcuaccgcaagcucaucgaccagaagaaggacaagcgccucgccuaccuccuccagcagaccgacgaguacgucgccaaccucaccgagcucguccgccagcacaaggccgcccaggucgccaaggagaagaagaagaagaagaagaagaagaaggccgagaacgccgagggccagacccccgccaucggccccgacggcgagccccucgacgagaccucccagauguccgaccuccccgucaaggucauccacgucgaguccggcaagauccucaccggcaccgacgcccccaaggccggccagcucgaggccuggcucgagaugaaccccggcuacgaggucgccccccgcuccgacuccgaggaguccggcuccgaggaggaggaggaggaggaggaggaggagcagccccaggccgcccagccccccacccuccccgucgaggagaagaagaagauccccgaccccgacuccgacgacgucuccgaggucgacgcccgccacaucaucgagaacgccaagcaggacgucgacgacgaguacggcgucucccaggcccucgcccgcggccuccaguccuacuacgccgucgcccacgccgucaccgagcgcgucgacaagcaguccgcccucauggucaacggcguccucaagcaguaccagaucaagggccucgaguggcucgucucccucuacaacaacaaccucaacggcauccucgccgacgagaugggccucggcaagaccauccagaccaucgcccucaucaccuaccucauggagcacaagcgcaucaacggccccuuccucaucaucgucccccucuccacccucuccaacugggccuacgaguucgacaagugggcccccuccgucgucaaggucuccuacaagggcucccccgccgcccgccgcgccuucgucccccagcuccgcuccggcaaguucaacguccuccucaccaccuacgaguacaucaucaaggacaagcacauccucgccaagauccgcuggaaguacaugaucgucgacgagggccaccgcaugaagaaccaccacugcaagcucacccagguccucaacacccacuacgucgccccccgccgccuccuccucaccggcaccccccuccagaacaagcuccccgagcucugggcccuccucaacuuccuccuccccaccaucuucaaguccugcuccaccuucgagcagugguucaacgcccccuucgccaugaccggcgagaaggucgaccucaacgaggaggagaccauccucaucauccgccgccuccacaagguccuccgccccuuccuccuccgccgccucaagaaggaggucgaggcccagcuccccgagaaggucgaguacgucaucaagugcgacauguccgcccuccagcgcguccucuaccgccacaugcaggccaagggcguccuccucaccgacggcuccgagaaggacaagaagggcaagggcggcaccaagacccucaugaacaccaucaugcagcuccgcaagaucugcaaccaccccuacauguuccagcacaucgaggaguccuucuccgagcaccucggcuucaccggcggcaucguccagggccucgaccucuaccgcgccuccggcaaguucgagcuccucgaccgcauccuccccaagcuccgcgccaccaaccacaagguccuccucuucugccagaugaccucccucaugaccaucauggaggacuacuucgccuaccgcggcuucaaguaccuccgccucgacggcaccaccaaggccgaggaccgcggcaugcuccucaagaccuucaacgagcccggcuccgaguacuucaucuuccuccucuccacccgcgccggcggccucggccucaaccuccaguccgccgacaccgucaucaucuucgacuccgacuggaacccccaccaggaccuccaggcccaggaccgcgcccaccgcaucggccagcagaacgagguccgcguccuccgccucugcaccgucaacuccgucgaggagaagauccucgccgccgccaaguacaagcucaacgucgaccagaaggucauccaggccggcauguucgaccagaaguccuccucccacgagcgccgcgccuuccuccaggccauccucgagcacgaggagcaggacgagucccgccacugcuccaccggcuccggcuccgccuccuucgcccacaccgcccccccccccgccggcgucaaccccgaccucgaggagcccccccucaaggaggaggacgagguccccgacgacgagaccgucaaccagaugaucgcccgccacgaggaggaguucgaccucuucaugcgcauggaccucgaccgccgccgcgaggaggcccgcaaccccaagcgcaagccccgccucauggaggaggacgagcuccccuccuggaucaucaaggacgacgccgaggucgagcgccucaccugcgaggaggaggaggagaagauguucggccgcggcucccgccaccgcaaggaggucgacuacuccgacucccucaccgagaagcaguggcucaaggccaucgaggagggcacccucgaggagaucgaggaggagguccgccagaagaaguccucccgcaagcgcaagcgcgacuccgacgccggcuccuccacccccaccaccuccacccgcucccgcgacaaggacgacgaguccaagaagcagaagaagcgcggccgcccccccgccgagaagcucucccccaacccccccaaccucaccaagaagaugaagaagaucgucgacgccgucaucaaguacaaggacuccuccuccggccgccagcucuccgaggucuucauccagcuccccucccgcaaggagcuccccgaguacuacgagcucauccgcaagcccgucgacuucaagaagaucaaggagcgcauccgcaaccacaaguaccgcucccucaacgaccucgagaaggacgucaugcuccucugccagaacgcccagaccuucaaccucgagggcucccucaucuacgaggacuccaucguccuccaguccgucuucaccuccguccgccagaagaucgagaaggaggacgacuccgagggcgaggaguccgaggaggaggaggagggcgaggaggagggcuccgaguccgagucccgcuccgucaaggucaagaucaagcucggccgcaaggagaaggcccaggaccgccucaagggcggccgccgccgccccucccgcggcucccgcgccaagcccgucgucuccgacgacgacuccgaggaggagcaggaggaggaccgcuccggcuccggcuccgaggaggacuga

SEQ ID NO: 49841 - RNA, 3159 nt, Artificial Sequence
  derived and/or modified sequence opt2 from SMARCA5__Homo_sapiens__NP_003592
auguccuccgccgccgagcccccccccccccccccccccgaguccgcccccuccaagcccgccgccuccaucgccuccggcggcuccaacuccuccaacaagggcggccccgagggcgucgccgcccaggccgucgccuccgccgccuccgccggccccgccgacgccgagauggaggagaucuucgacgacgccucccccggcaagcagaaggagauccaggagcccgaccccaccuacgaggagaagaugcagaccgaccgcgccaaccgcuucgaguaccuccucaagcagaccgagcucuucgcccacuucauccagcccgccgcccagaagacccccaccuccccccucaagaugaagcccggccgcccccgcaucaagaaggacgagaagcagaaccuccucuccgucggcgacuaccgccaccgccgcaccgagcaggaggaggacgaggagcuccucaccgaguccuccaaggccaccaacgucugcacccgcuucgaggacucccccuccuacgucaaguggggcaagcuccgcgacuaccagguccgcggccucaacuggcucaucucccucuacgagaacggcaucaacggcauccucgccgacgagaugggccucggcaagacccuccagaccaucucccuccucggcuacaugaagcacuaccgcaacauccccggcccccacaugguccucguccccaaguccacccuccacaacuggauguccgaguucaagcgcuggguccccacccuccgcuccgucugccucaucggcgacaaggagcagcgcgccgccuucguccgcgacguccuccuccccggcgagugggacgucugcgucaccuccuacgagaugcucaucaaggagaaguccgucuucaagaaguucaacuggcgcuaccucgucaucgacgaggcccaccgcaucaagaacgagaaguccaagcucuccgagaucguccgcgaguucaagaccaccaaccgccuccuccucaccggcaccccccuccagaacaaccuccacgagcucuggucccuccucaacuuccuccuccccgacgucuucaacuccgccgacgacuucgacuccugguucgacaccaacaacugccucggcgaccagaagcucgucgagcgccuccacaugguccuccgccccuuccuccuccgccgcaucaaggccgacgucgagaagucccucccccccaagaaggaggucaagaucuacgucggccucuccaagaugcagcgcgagugguacacccgcauccucaugaaggacaucgacauccucaacuccgccggcaagauggacaagaugcgccuccucaacauccucaugcagcuccgcaagugcugcaaccaccccuaccucuucgacggcgccgagcccggcccccccuacaccaccgacaugcaccucgucaccaacuccggcaagauggucguccucgacaagcuccuccccaagcucaaggagcagggcucccgcguccucaucuucucccagaugacccgcguccucgacauccucgaggacuacugcauguggcgcaacuacgaguacugccgccucgacggccagaccccccacgacgagcgccaggacuccaucaacgccuacaacgagcccaacuccaccaaguucgucuucaugcucuccacccgcgccggcggccucggcaucaaccucgccaccgccgacgucgucauccucuacgacuccgacuggaacccccaggucgaccuccaggccauggaccgcgcccaccgcaucggccagaccaagaccguccgcgucuuccgcuucaucaccgacaacaccgucgaggagcgcaucgucgagcgcgccgagaugaagcuccgccucgacuccaucgucauccagcagggccgccucgucgaccagaaccucaacaagaucggcaaggacgagaugcuccagaugauccgccacggcgccacccacgucuucgccuccaaggaguccgagaucaccgacgaggacaucgacggcauccucgagcgcggcgccaagaagaccgccgagaugaacgagaagcucuccaagaugggcgaguccucccuccgcaacuucaccauggacaccgaguccuccgucuacaacuucgagggcgaggacuaccgcgagaagcagaagaucgccuucaccgaguggaucgagccccccaagcgcgagcgcaaggccaacuacgccgucgacgccuacuuccgcgaggcccuccgcgucuccgagcccaaggcccccaaggccccccgcccccccaagcagcccaacguccaggacuuccaguucuuccccccccgccucuucgagcuccucgagaaggagauccucuucuaccgcaagaccaucggcuacaaggucccccgcaaccccgagcuccccaacgccgcccaggcccagaaggaggagcagcucaagaucgacgaggccgagucccucaacgacgaggagcucgaggagaaggagaagcuccucacccagggcuucaccaacuggaacaagcgcgacuucaaccaguucaucaaggccaacgagaaguggggccgcgacgacaucgagaacaucgcccgcgaggucgagggcaagacccccgaggaggucaucgaguacuccgccgucuucugggagcgcugcaacgagcuccaggacaucgagaagaucauggcccagaucgagcgcggcgaggcccgcauccagcgccgcaucuccaucaagaaggcccucgacaccaagaucggccgcuacaaggcccccuuccaccagcuccgcaucuccuacggcaccaacaagggcaagaacuacaccgaggaggaggaccgcuuccucaucugcaugcuccacaagcucggcuucgacaaggagaacgucuacgacgagcuccgccagugcauccgcaacuccccccaguuccgcuucgacugguuccucaagucccgcaccgccauggagcuccagcgccgcugcaacacccucaucacccucaucgagcgcgagaacauggagcucgaggagaaggagaaggccgagaagaagaagcgcggccccaagcccuccacccagaagcgcaagauggacggcgcccccgacggccgcggccgcaagaagaagcucaagcucuga

SEQ ID NO: 49842 - RNA, 3087 nt, Artificial Sequence
  derived and/or modified sequence opt2 from SMARCAD1__Homo_sapiens__NP_001121901
augaaccucuucaaccucgaccgcuuccgcuucgagaagcgcaacaagaucgaggaggcccccgaggccaccccccagcccucccagcccggccccuccucccccaucucccucuccgccgaggaggagaacgccgagggcgaggucucccgcgccaacacccccgacuccgacaucaccgagaagaccgaggacuccuccguccccgagacccccgacaacgagcgcaaggccuccaucuccuacuucaagaaccagcgcggcauccaguacaucgaccucuccuccgacuccgaggacgucgucucccccaacugcuccaacaccguccaggagaagaccuucaacaaggacaccgucaucaucgucuccgagcccuccgaggacgaggagucccagggccuccccaccauggcccgccgcaacgacgacaucuccgagcucgaggaccucuccgagcucgaggaccucaaggacgccaagcuccagacccucaaggagcucuucccccagcgcuccgacaacgaccuccucaagcucaucgaguccaccuccaccauggacggcgccaucgccgccgcccuccucauguucggcgacgccggcggcggcccccgcaagcgcaagcucuccuccuccuccgagcccuacgaggaggacgaguucaacgacgaccaguccaucaagaagacccgccucgaccacggcgaggaguccaacgaguccgccgaguccuccuccaacugggagaagcaggaguccaucguccucaagcuccagaaggaguuccccaacuucgacaagcaggagcuccgcgagguccucaaggagcacgaguggauguacaccgaggcccucgagucccucaaggucuucgccgaggaccaggacaugcaguacgucucccaguccgagguccccaacggcaaggaggucuccucccgcucccagaacuaccccaagaacgccaccaagaccaagcucaagcagaaguucuccaugaaggcccagaacggcuucaacaagaagcgcaagaagaacgucuucaaccccaagcgcgucgucgaggacuccgaguacgacuccggcuccgacgucggcuccucccucgacgaggacuacuccuccggcgaggaggucauggaggacggcuacaagggcaagauccuccacuuccuccaggacgccuccaucggcgagcucacccucaucccccagugcucccagaagaaggcccagaagaucaccgagcuccgccccuucaacuccugggaggcccucuucaccaagauguccaagaccaacggccucuccgaggaccucaucuggcacugcaagacccucauccaggagcgcgacgucgucauccgccucaugaacaagugcgaggacaucuccaacaagcucaccaagcaggucaccaugcucaccggcaacggcggcggcuggaacaucgagcagcccuccauccucaaccagucccucucccucaagcccuaccagaaggucggccucaacuggcucgcccucguccacaagcacggccucaacggcauccucgccgacgagaugggccucggcaagaccauccaggccaucgccuuccucgccuaccucuaccaggagggcaacaacggcccccaccucaucgucguccccgccuccaccaucgacaacuggcuccgcgaggucaaccucuggugccccacccucaagguccucugcuacuacggcucccaggaggagcgcaagcagauccgcuucaacauccacucccgcuacgaggacuacaacgucaucgucaccaccuacaacugcgccaucuccuccuccgacgaccgcucccucuuccgccgccucaagcucaacuacgccaucuucgacgagggccacaugcucaagaacaugggcuccauccgcuaccagcaccucaugaccaucaacgccaacaaccgccuccuccucaccggcacccccguccagaacaaccuccucgagcucaugucccuccucaacuucgucaugccccacauguucuccuccuccaccuccgagauccgccgcauguucuccuccaagaccaaguccgccgacgagcaguccaucuacgagaaggagcgcaucgcccacgccaagcagaucaucaagcccuucauccuccgccgcgucaaggaggagguccucaagcagcucccccccaagaaggaccgcaucgagcucugcgccauguccgagaagcaggagcagcucuaccucggccucuucaaccgccucaagaaguccaucaacaaccucgucaccgagaagaacaccgagaugugcaacgucaugaugcagcuccgcaagauggccaaccacccccuccuccaccgccaguacuacaccgccgagaagcucaaggagaugucccagcucaugcucaaggagcccacccacugcgaggccaaccccgaccucaucuucgaggacauggaggucaugaccgacuucgagcuccacguccucugcaagcaguaccgccacaucaacaacuuccagcucgacauggaccucauccucgacuccggcaaguuccgcguccucggcugcauccucuccgagcucaagcagaagggcgaccgcgucguccucuucucccaguucaccaugaugcucgacauccucgagguccuccucaagcaccaccagcaccgcuaccuccgccucgacggcaagacccagaucuccgagcgcauccaccucaucgacgaguucaacaccgacauggacaucuucgucuuccuccucuccaccaaggccggcggccucggcaucaaccucaccuccgccaacgucgucauccuccacgacaucgacugcaaccccuacaacgacaagcaggccgaggaccgcugccaccgcgucggccagaccaaggagguccucgucaucaagcucaucucccagggcaccaucgaggaguccaugcucaagaucaaccagcagaagcucaagcucgagcaggacaugaccaccgucgacgagggcgacgagggcuccaugcccgccgacaucgccacccuccucaagaccuccaugggccucuga

SEQ ID NO: 49843 - RNA, 2865 nt, Artificial Sequence
  derived and/or modified sequence opt2 from SMARCAL1__Homo_sapiens__XP_005246688
augucccucccccucaccgaggagcagcgcaagaagaucgaggagaaccgccagaaggcccucgcccgccgcgccgagaagcuccucgccgagcagcaccagcgcaccuccuccggcaccuccaucgccggcaaccccuuccaggccaagcagggccccucccagaacuucccccgcgaguccugcaagcccgucucccacggcgucaucuucaagcagcagaaccucuccuccuccuccaacgccgaccagcgcccccacgacucccacuccuuccaggccaagggcaucuggaagaagcccgaggagaugcccaccgccugccccggccacuccccccgcucccagauggcccucaccggcaucucccccccccucgcccaguccccccccgagguccccaagcagcagcuccucuccuacgagcucggccagggccacgcccaggccucccccgagauccgcuucacccccuucgccaaccccacccacaagccccucgccaagcccaaguccucccaggagacccccgcccacuccuccggccagcccccccgcgacgccaagcucgaggccaagaccgccaaggccucccccuccggccagaacaucuccuacauccacuccuccuccgaguccgucaccccccgcaccgagggccgccuccagcagaaguccggcuccuccguccagaagggcgucaacucccagaagggcaagugcguccgcaacggcgaccgcuuccagguccucaucggcuacaacgccgagcucaucgccgucuucaagacccuccccuccaagaacuacgaccccgacaccaagaccuggaacuucuccaugaacgacuacuccgcccucaugaaggccgcccagucccuccccaccgucaaccuccagccccucgagugggccuacggcuccuccgagucccccuccaccuccuccgagggccaggccggccuccccuccgcccccucccucuccuucgucaagggccgcugcaugcucaucucccgcgccuacuucgaggccgacaucuccuacucccaggaccucaucgcccucuucaagcagauggacucccgccgcuacgacgucaagacccgcaagugguccuuccuccucgaggagcacuccaagcucaucgccaagguccgcugccucccccagguccagcucgacccccuccccaccacccucacccucgccuucgccucccagcucaagaagaccucccucucccucacccccgacguccccgaggccgaccucuccgaggucgaccccaagcucgucuccaaccucaugcccuuccagcgcgccggcgucaacuucgccaucgccaagggcggccgccuccuccucgccgacgacaugggccucggcaagaccauccaggccaucugcaucgccgccuucuaccgcaaggaguggccccuccucgucgucguccccuccuccguccgcuucaccugggagcaggccuuccuccgcuggcuccccucccucucccccgacugcaucaacgucgucgucaccggcaaggaccgccucaccgccggccucaucaacaucgucuccuucgaccuccucuccaagcucgagaagcagcucaagacccccuucaaggucgucaucaucgacgagucccacuuccucaagaacucccgcaccgcccgcugccgcgccgccaugcccguccucaaggucgccaagcgcgucauccuccucuccggcacccccgccaugucccgccccgccgagcucuacacccagaucaucgccgucaagcccaccuucuucccccaguuccacgccuucggccuccgcuacugcgacgccaagcgcaugcccuggggcugggacuacuccggcuccuccaaccucggcgagcucaagcuccuccucgaggaggccgucaugcuccgccgccucaaguccgacguccucucccagcuccccgccaagcagcgcaagaucgucgucaucgcccccggccgcaucaacgcccgcacccgcgccgcccucgacgccgccgccaaggagaugaccaccaaggacaagaccaagcagcagcagaaggacgcccucauccucuucuucaaccgcaccgccgaggccaagauccccuccgucaucgaguacauccucgaccuccucgaguccggccgcgagaaguuccucgucuucgcccaccacaaggucguccucgacgccaucacccaggagcucgagcgcaagcacguccagcacauccgcaucgacggcuccaccuccuccgccgagcgcgaggaccucugccagcaguuccagcucuccgagcgccacgccgucgccguccucuccaucaccgccgccaacaugggccucaccuucuccuccgccgaccucgucgucuucgccgagcucuucuggaaccccggcguccucauccaggccgaggaccgcguccaccgcaucggccagaccuccuccgucggcauccacuaccucgucgccaagggcaccgccgacgacuaccucuggccccucauccaggagaagaucaagguccucgccgaggccggccucuccgagaccaacuucuccgagaugaccgaguccaccgacuaccucuacaaggaccccaagcagcagaagaucuacgaccucuuccagaaguccuucgagaaggagggcuccgacauggagcuccucgaggccgccgaguccuucgaccccggcuccgccuccggcaccuccggcuccuccucccagaacaugggcgacacccucgacgaguccucccucaccgccuccccccagaagaagcgccgcuucgaguucuucgacaacugggacuccuucaccuccccccucuga

SEQ ID NO: 49844 - RNA, 1131 nt, Artificial Sequence
  derived and/or modified sequence opt2 from SMARCB1__Homo_sapiens__NP_001007469
augaugaugauggcccucuccaagaccuucggccagaagcccgucaaguuccagcucgaggacgacggcgaguucuacaugaucggcuccgaggucggcaacuaccuccgcauguuccgcggcucccucuacaagcgcuaccccucccucuggcgccgccucgccaccgucgaggagcgcaagaagaucgucgccuccucccacgaccacggcuacaccacccucgccaccuccgucacccuccucaaggccuccgaggucgaggagauccucgacggcaacgacgagaaguacaaggccgucuccaucuccaccgagccccccaccuaccuccgcgagcagaaggccaagcgcaacucccaguggguccccacccuccccaacuccucccaccaccucgacgccguccccugcuccaccaccaucaaccgcaaccgcaugggccgcgacaagaagcgcaccuucccccucugcuucgacgaccacgaccccgccgucauccacgagaacgccucccagcccgagguccucguccccauccgccucgacauggagaucgacggccagaagcuccgcgacgccuucaccuggaacaugaacgagaagcucaugacccccgagauguucuccgagauccucugcgacgaccucgaccucaacccccucaccuucguccccgccaucgccuccgccauccgccagcagaucgaguccuaccccaccgacuccauccucgaggaccaguccgaccagcgcgucaucaucaagcucaacauccacgucggcaacaucucccucgucgaccaguucgagugggacauguccgagaaggagaacucccccgagaaguucgcccucaagcucugcuccgagcucggccucggcggcgaguucgucaccaccaucgccuacuccauccgcggccagcucuccuggcaccagaagaccuacgccuucuccgagaacccccuccccaccgucgagaucgccauccgcaacaccggcgacgccgaccaguggugcccccuccucgagacccucaccgacgccgagauggagaagaagauccgcgaccaggaccgcaacacccgccgcaugcgccgccucgccaacaccgcccccgccugguga

SEQ ID NO: 49845 - RNA, 3318 nt, Artificial Sequence
  derived and/or modified sequence opt2 from SMARCC1__Homo_sapiens__NP_003065
auggccgccgccgccggcggcggcggccccggcaccgccgucggcgccaccggcuccggcaucgccgccgccgccgccggccucgccgucuaccgccgcaaggacggcggccccgccaccaaguucugggagucccccgagaccgucucccagcucgacuccguccgcgucuggcucggcaagcacuacaagaaguacguccacgccgacgcccccaccaacaagacccucgccggccucgucguccagcuccuccaguuccaggaggacgccuucggcaagcacgucaccaaccccgccuucaccaagcuccccgccaagugcuucauggacuucaaggccggcggcgcccucugccacauccucggcgccgccuacaaguacaagaacgagcagggcuggcgccgcuucgaccuccagaaccccucccgcauggaccgcaacgucgagauguucaugaacaucgagaagacccucguccagaacaacugccucacccgccccaacaucuaccucauccccgacaucgaccucaagcucgccaacaagcucaaggacaucaucaagcgccaccagggcaccuucaccgacgagaaguccaaggccucccaccacaucuaccccuacuccuccucccaggacgacgaggaguggcuccgccccgucaugcgcaaggagaagcagguccucguccacuggggcuucuaccccgacuccuacgacaccuggguccacuccaacgacgucgacgccgagaucgaggacccccccauccccgagaagcccuggaagguccacgucaaguggauccucgacaccgacaucuucaacgaguggaugaacgaggaggacuacgaggucgacgagaaccgcaagcccgucuccuuccgccagcgcaucuccaccaagaacgaggagcccguccgcucccccgagcgccgcgaccgcaaggccuccgccaacgcccgcaagcgcaagcacucccccuccccccccccccccacccccaccgagucccgcaagaaguccggcaagaagggccaggccucccucuacggcaagcgccgcucccagaaggaggaggacgagcaggaggaccucaccaaggacauggaggaccccacccccguccccaacaucgaggaggucguccuccccaagaacgucaaccucaagaaggacuccgagaacacccccgucaagggcggcaccgucgccgaccucgacgagcaggacgaggagaccgucaccgccggcggcaaggaggacgaggaccccgccaagggcgaccagucccgcuccgucgaccucggcgaggacaacgucaccgagcagaccaaccacaucaucauccccuccuacgccuccugguucgacuacaacugcauccacgucaucgagcgccgcgcccuccccgaguucuucaacggcaagaacaaguccaagacccccgagaucuaccucgccuaccgcaacuucaugaucgacaccuaccgccucaacccccaggaguaccucaccuccaccgccugccgccgcaaccucaccggcgacgucugcgccgucaugcgcguccacgccuuccucgagcaguggggccucgucaacuaccaggucgaccccgagucccgccccauggccaugggccccccccccaccccccacuucaacguccucgccgacacccccuccggccucgucccccuccaccuccgcuccccccagguccccgccgcccagcagaugcucaacuuccccgagaagaacaaggagaagcccgucgaccuccagaacuucggccuccgcaccgacaucuacuccaagaagacccucgccaaguccaagggcgccuccgccggccgcgaguggaccgagcaggagacccuccuccuccucgaggcccucgagauguacaaggacgacuggaacaaggucuccgagcacgucggcucccgcacccaggacgagugcauccuccacuuccuccgccuccccaucgaggaccccuaccucgagaacuccgacgccucccucggcccccucgccuaccagcccguccccuucucccaguccggcaaccccgucauguccaccgucgccuuccucgccuccgucgucgacccccgcgucgccuccgccgccgccaaggccgcccucgaggaguucucccgcguccgcgaggaggucccccucgagcucgucgaggcccacgucaagaagguccaggaggccgcccgcgccuccggcaaggucgaccccaccuacggccucgaguccuccugcaucgccggcaccggccccgacgagcccgagaagcucgagggcgccgaggaggagaagauggaggccgaccccgacggccagcagcccgagaaggccgagaacaaggucgagaacgagaccgacgagggcgacaaggcccaggacggcgagaacgagaagaacuccgagaaggagcaggacuccgaggucuccgaggacaccaaguccgaggagaaggagaccgaggagaacaaggagcucaccgacaccugcaaggagcgcgaguccgacaccggcaagaagaaggucgagcacgagaucuccgagggcaacgucgccaccgccgccgccgccgcccucgccuccgccgccaccaaggccaagcaccucgccgccgucgaggagcgcaagaucaagucccucgucgcccuccucgucgagacccagaugaagaagcucgagaucaagcuccgccacuucgaggagcucgagaccaucauggaccgcgagaaggaggcccucgagcagcagcgccagcagcuccucaccgagcgccagaacuuccacauggagcagcucaaguacgccgagcuccgcgcccgccagcagauggagcagcagcagcacggccagaacccccagcaggcccaccagcacuccggcggccccggccucgccccccucggcgccgccggccaccccggcaugaugccccaccagcagcccccccccuacccccucaugcaccaccagaugccccccccccaccccccccagcccggccagauccccggccccggcuccaugaugcccggccagcacaugcccggccgcaugauccccaccgucgccgccaacauccaccccuccggcuccggccccaccccccccggcaugccccccaugcccggcaacauccucggcccccgcgucccccucaccgcccccaacggcauguaccccccccccccccagcagcagccccccccccccccccccgccgacggcgucccccccccccccgcccccggcccccccgccuccgccgcccccuga

SEQ ID NO: 49846 - RNA, 3459 nt, Artificial Sequence
  derived and/or modified sequence opt2 from SMARCC2__Homo_sapiens__NP_001123892
auggccguccgcaagaaggacggcggccccaacgucaaguacuacgaggccgccgacaccgucacccaguucgacaacguccgccucuggcucggcaagaacuacaagaaguacauccaggccgagccccccaccaacaagucccucuccucccucgucguccagcuccuccaguuccaggaggaggucuucggcaagcacgucuccaacgccccccucaccaagcuccccaucaagugcuuccucgacuucaaggccggcggcucccucugccacauccucgccgccgccuacaaguucaaguccgaccagggcuggcgccgcuacgacuuccagaaccccucccgcauggaccgcaacgucgagauguucaugaccaucgagaagucccucguccagaacaacugccucucccgccccaacaucuuccucugccccgagaucgagcccaagcuccucggcaagcucaaggacaucaucaagcgccaccagggcaccgucaccgaggacaagaacaacgccucccacgucgucuaccccguccccggcaaccucgaggaggaggaguggguccgccccgucaugaagcgcgacaagcagguccuccuccacuggggcuacuaccccgacuccuacgacaccuggauccccgccuccgagaucgaggccuccgucgaggacgcccccacccccgagaagccccgcaagguccacgccaaguggauccucgacaccgacaccuucaacgaguggaugaacgaggaggacuacgaggucaacgacgacaagaaccccgucucccgccgcaagaagaucuccgccaagacccucaccgacgaggucaacucccccgacuccgaccgccgcgacaagaagggcggcaacuacaagaagcgcaagcgcucccccucccccucccccacccccgaggccaagaagaagaacgccaagaagggccccuccacccccuacaccaaguccaagcgcggccaccgcgaggaggagcaggaggaccucaccaaggacauggacgagcccucccccguccccaacgucgaggaggucacccuccccaagaccgucaacaccaagaaggacuccgaguccgcccccgucaagggcggcaccaugaccgaccucgacgagcaggaggacgaguccauggagaccaccggcaaggacgaggacgagaacuccaccggcaacaagggcgagcagaccaagaaccccgaccuccacgaggacaacgucaccgagcagacccaccacaucaucauccccuccuacgccgccugguucgacuacaacuccguccacgccaucgagcgccgcgcccuccccgaguucuucaacggcaagaacaaguccaagacccccgagaucuaccucgccuaccgcaacuucaugaucgacaccuaccgccucaacccccaggaguaccucaccuccaccgccugccgccgcaaccucgccggcgacgucugcgccaucaugcgcguccacgccuuccucgagcaguggggccucaucaacuaccaggucgacgccgagucccgccccacccccaugggccccccccccaccucccacuuccacguccucgccgacacccccuccggccucgucccccuccagcccaagaccccccagggccgccaggucgacgccgacaccaaggccggccgcaagggcaaggagcucgacgaccucguccccgagaccgccaagggcaagcccgagcuccagaccuccgccucccagcagaugcucaacuuccccgacaagggcaaggagaagcccaccgacaugcagaacuucggccuccgcaccgacauguacaccaagaagaacguccccuccaaguccaaggccgccgccuccgccacccgcgaguggaccgagcaggagacccuccuccuccucgaggcccucgagauguacaaggacgacuggaacaaggucuccgagcacgucggcucccgcacccaggacgagugcauccuccacuuccuccgccuccccaucgaggaccccuaccucgaggacuccgaggccucccucggcccccucgccuaccagcccauccccuucucccaguccggcaaccccgucauguccaccgucgccuuccucgccuccgucgucgacccccgcgucgccuccgccgccgccaaguccgcccucgaggaguucuccaagaugaaggaggagguccccaccgcccucgucgaggcccacguccgcaaggucgaggaggccgccaaggucaccggcaaggccgaccccgccuucggccucgaguccuccggcaucgccggcaccaccuccgacgagcccgagcgcaucgaggaguccggcaacgacgaggcccgcgucgagggccaggccaccgacgagaagaaggagcccaaggagccccgcgagggcggcggcgccaucgaggaggaggccaaggagaagaccuccgaggcccccaagaaggacgaggagaagggcaaggagggcgacuccgagaaggaguccgagaaguccgacggcgaccccaucgucgaccccgagaaggagaaggagcccaaggagggccaggaggagguccucaaggaggucgucgaguccgagggcgagcgcaagaccaaggucgagcgcgacaucggcgagggcaaccucuccaccgccgccgccgccgcccucgccgccgccgccgucaaggccaagcaccucgccgccgucgaggagcgcaagaucaagucccucgucgcccuccucgucgagacccagaugaagaagcucgagaucaagcuccgccacuucgaggagcucgagaccaucauggaccgcgagcgcgaggcccucgaguaccagcgccagcagcuccucgccgaccgccaggccuuccacauggagcagcucaaguacgccgagaugcgcgcccgccagcagcacuuccagcagaugcaccagcagcagcagcagcccccccccgcccucccccccggcucccagcccaucccccccaccggcgccgccggcccccccgccguccacggccucgccgucgcccccgccuccgucguccccgcccccgccggcuccggcgccccccccggcucccucggccccuccgagcagaucggccaggccggcuccaccgccggcccccagcagcagcagcccgccggcgccccccagcccggcgccgucccccccggcguccccccccccggcccccacggccccucccccuuccccaaccagcagaccccccccuccaugaugcccggcgccguccccggcuccggccaccccggcgucgccgcccagucccccgccaucgucgccgccguccagggcaaccuccuccccuccgccuccccccuccccgaccccggcaccccccucccccccgaccccaccgcccccucccccggcaccgucacccccgucccccccccccaguga

SEQ ID NO: 49847 - RNA, 1548 nt, Artificial Sequence
  derived and/or modified sequence opt2 from SMARCD1__Homo_sapiens__NP_003067
auggccgcccgcgccggcuuccaguccgucgcccccuccggcggcgccggcgccuccggcggcgccggcgccgccgccgcccucggccccggcggcacccccggcccccccguccgcaugggccccgcccccggccagggccucuaccgcucccccaugcccggcgccgccuacccccgccccggcaugcuccccggcucccgcaugaccccccagggccccuccaugggcccccccggcuacggcggcaaccccuccguccgccccggccucgcccaguccggcauggaccagucccgcaagcgccccgccccccagcagauccagcagguccagcagcaggccguccagaaccgcaaccacaacgccaagaagaagaagauggccgacaagauccucccccagcgcauccgcgagcucguccccgagucccaggccuacauggaccuccucgccuucgagcgcaagcucgaccagaccaucaugcgcaagcgccucgacauccaggaggcccucaagcgccccaucaagcagaagcgcaagcuccgcaucuucaucuccaacaccuucaaccccgccaaguccgacgccgaggacggcgagggcaccgucgccuccugggagcuccgcgucgagggccgccuccucgaggacuccgcccucuccaaguacgacgccaccaagcagaagcgcaaguucuccuccuucuucaagucccucgucaucgagcucgacaaggaccucuacggccccgacaaccaccucgucgaguggcaccgcaccgccaccacccaggagaccgacggcuuccaggucaagcgccccggcgacgucaacguccgcugcaccguccuccucaugcucgacuaccagcccccccaguucaagcucgacccccgccucgcccgccuccucggcauccacacccagacccgccccgucaucauccaggcccucuggcaguacaucaagacccacaagcuccaggacccccacgagcgcgaguucgucaucugcgacaaguaccuccagcagaucuucgagucccagcgcaugaaguucuccgagaucccccagcgccuccacgcccuccucaugccccccgagcccaucaucaucaaccacgucaucuccgucgaccccaacgaccagaagaagaccgccugcuacgacaucgacgucgaggucgacgacacccucaagacccagaugaacuccuuccuccucuccaccgccucccagcaggagaucgccacccucgacaacaagauccacgagaccaucgagaccaucaaccagcucaagacccagcgcgaguucaugcucuccuucgcccgcgacccccagggcuucaucaacgacuggcuccagucccagugccgcgaccucaagaccaugaccgacgucgucggcaaccccgaggaggagcgccgcgccgaguucuacuuccagcccugggcccaggaggccgucugccgcuacuucuacuccaagguccagcagcgccgccaggagcucgagcaggcccucggcauccgcaacaccuga

SEQ ID NO: 49848 - RNA, 1452 nt, Artificial Sequence
  derived and/or modified sequence opt2 from SMARCD3__Homo_sapiens__NP_001003801
auggccgccgacgaggucgccggcggcgcccgcaaggccaccaaguccaagcucuucgaguuccucguccacggcguccgccccggcaugcccuccggcgcccgcaugccccaccagggcgcccccaugggcccccccggcucccccuacaugggcucccccgccguccgccccggccucgcccccgccggcauggagcccgcccgcaagcgcgccgcccccccccccggccagucccaggcccagucccagggccagcccguccccaccgcccccgcccgcucccgcuccgccaagcgccgcaagauggccgacaagauccucccccagcgcauccgcgagcucguccccgagucccaggccuacauggaccuccucgccuucgagcgcaagcucgaccagaccaucaugcgcaagcgcgucgacauccaggaggcccucaagcgccccaugaagcagaagcgcaagcuccgccucuacaucuccaacaccuucaaccccgccaagcccgacgccgaggacuccgacggcuccaucgccuccugggagcuccgcgucgagggcaagcuccucgacgaccccuccaagcagaagcgcaaguucuccuccuucuucaagucccucgucaucgagcucgacaaggaccucuacggccccgacaaccaccucgucgaguggcaccgcacccccaccacccaggagaccgacggcuuccaggucaagcgccccggcgaccucuccguccgcugcacccuccuccucaugcucgacuaccagcccccccaguucaagcucgacccccgccucgcccgccuccucggccuccacacccagucccgcuccgccaucguccaggcccucuggcaguacgucaagaccaaccgccuccaggacucccacgacaaggaguacaucaacggcgacaaguacuuccagcagaucuucgacugcccccgccucaaguucuccgagaucccccagcgccucaccgcccuccuccucccccccgaccccaucgucaucaaccacgucaucuccgucgaccccuccgaccagaagaagaccgccugcuacgacaucgacgucgaggucgaggagccccucaagggccagauguccuccuuccuccucuccaccgccaaccagcaggagaucuccgcccucgacuccaagauccacgagaccaucgaguccaucaaccagcucaagauccagcgcgacuucaugcucuccuucucccgcgaccccaagggcuacguccaggaccuccuccgcucccagucccgcgaccucaaggucaugaccgacgucgccggcaaccccgaggaggagcgccgcgccgaguucuaccaccagcccuggucccaggaggccgucucccgcuacuucuacugcaagauccagcagcgccgccaggagcucgagcagucccucgucguccgcaacaccuga

SEQ ID NO: 49849 - RNA, 1236 nt, Artificial Sequence
  derived and/or modified sequence opt2 from SMARCE1__Homo_sapiens__NP_003070
auguccaagcgccccuccuacgcccccccccccacccccgcccccgccacccagaugcccuccacccccggcuucgucggcuacaaccccuacucccaccucgccuacaacaacuaccgccucggcggcaaccccggcaccaacucccgcgucaccgccuccuccggcaucaccauccccaagccccccaagccccccgacaagccccucaugcccuacaugcgcuacucccgcaaggucugggaccaggucaaggccuccaaccccgaccucaagcucugggagaucggcaagaucaucggcggcauguggcgcgaccucaccgacgaggagaagcaggaguaccucaacgaguacgaggccgagaagaucgaguacaacgaguccaugaaggccuaccacaacucccccgccuaccucgccuacaucaacgccaagucccgcgccgaggccgcccucgaggaggagucccgccagcgccagucccgcauggagaagggcgagcccuacauguccauccagcccgccgaggaccccgacgacuacgacgacggcuucuccaugaagcacaccgccaccgcccgcuuccagcgcaaccaccgccucaucuccgagauccucuccgaguccgucguccccgacguccgcuccgucgucaccaccgcccgcaugcagguccucaagcgccagguccagucccucaugguccaccagcgcaagcucgaggccgagcuccuccagaucgaggagcgccaccaggagaagaagcgcaaguuccucgaguccaccgacuccuucaacaacgagcucaagcgccucugcggccucaaggucgaggucgacauggagaagaucgccgccgagaucgcccaggccgaggagcaggcccgcaagcgccaggaggagcgcgagaaggaggccgccgagcaggccgagcgcucccaguccuccaucguccccgaggaggagcaggccgccaacaagggcgaggagaagaaggacgacgagaacauccccauggagaccgaggagacccaccucgaggagaccaccgagucccagcagaacggcgaggagggcaccuccacccccgaggacaaggaguccggccaggagggcgucgacuccauggccgaggagggcaccuccgacuccaacaccggcuccgaguccaacuccgccaccgucgaggagccccccaccgaccccauccccgaggacgagaagaaggaguga

SEQ ID NO: 49850 - RNA, 3636 nt, Artificial Sequence
  derived and/or modified sequence opt2 from SMC1A__Homo_sapiens__NP_001268392
augcucgaggucuccauccccaccccccaccgcuacguccgcggcaaguccaaccucauggacgccaucuccuucguccucggcgagaagaccuccaaccuccgcgucaagacccuccgcgaccucauccacggcgcccccgucggcaagcccgccgccaaccgcgccuucgucuccauggucuacuccgaggagggcgccgaggaccgcaccuucgcccgcgucaucgucggcggcuccuccgaguacaagaucaacaacaaggucguccagcuccacgaguacuccgaggagcucgagaagcucggcauccucaucaaggcccgcaacuuccucgucuuccagggcgccgucgaguccaucgccaugaagaaccccaaggagcgcaccgcccucuucgaggagaucucccgcuccggcgagcucgcccaggaguacgacaagcgcaagaaggagauggucaaggccgaggaggacacccaguucaacuaccaccgcaagaagaacaucgccgccgagcgcaaggaggccaagcaggagaaggaggaggccgaccgcuaccagcgccucaaggacgaggucguccgcgcccagguccagcuccagcucuucaagcucuaccacaacgaggucgagaucgagaagcucaacaaggagcucgccuccaagaacaaggagaucgagaaggacaagaagcgcauggacaaggucgaggacgagcucaaggagaagaagaaggagcucggcaagaugaugcgcgagcagcagcagaucgagaaggagaucaaggagaaggacuccgagcucaaccagaagcgcccccaguacaucaaggccaaggagaacaccucccacaagaucaagaagcucgaggccgccaagaagucccuccagaacgcccagaagcacuacaagaagcgcaagggcgacauggacgagcucgagaaggagaugcucuccgucgagaaggcccgccaggaguucgaggagcgcauggaggaggagucccagucccagggccgcgaccucacccucgaggagaaccaggucaagaaguaccaccgccucaaggaggaggccuccaagcgcgccgccacccucgcccaggagcucgagaaguucaaccgcgaccagaaggccgaccaggaccgccucgaccucgaggagcgcaagaaggucgagaccgaggccaagaucaagcagaagcuccgcgagaucgaggagaaccagaagcgcaucgagaagcucgaggaguacaucaccaccuccaagcagucccucgaggagcagaagaagcucgagggcgagcucaccgaggaggucgagauggccaagcgccgcaucgacgagaucaacaaggagcucaaccaggucauggagcagcucggcgacgcccgcaucgaccgccaggaguccucccgccagcagcgcaaggccgagaucauggaguccaucaagcgccucuaccccggcuccgucuacggccgccucaucgaccucugccagcccacccagaagaaguaccagaucgccgucaccaagguccucggcaagaacauggacgccaucaucgucgacuccgagaagaccggccgcgacugcauccaguacaucaaggagcagcgcggcgagcccgagaccuuccucccccucgacuaccucgaggucaagcccaccgacgagaagcuccgcgagcucaagggcgccaagcucgucaucgacgucauccgcuacgagcccccccacaucaagaaggcccuccaguacgccugcggcaacgcccucgucugcgacaacgucgaggacgcccgccgcaucgccuucggcggccaccagcgccacaagaccgucgcccucgacggcacccucuuccagaaguccggcgucaucuccggcggcgccuccgaccucaaggccaaggcccgccgcugggacgagaaggccgucgacaagcucaaggagaagaaggagcgccucaccgaggagcucaaggagcagaugaaggccaagcgcaaggaggccgagcuccgccagguccagucccaggcccacggccuccagaugcgccucaaguacucccaguccgaccucgagcagaccaagacccgccaccucgcccucaaccuccaggagaaguccaagcucgaguccgagcucgccaacuucggcccccgcaucaacgacaucaagcgcaucauccagucccgcgagcgcgagaugaaggaccucaaggagaagaugaaccaggucgaggacgaggucuucgaggaguucugccgcgagaucggcguccgcaacauccgcgaguucgaggaggagaaggucaagcgccagaacgagaucgccaagaagcgccucgaguucgagaaccagaagacccgccucggcauccagcucgacuucgagaagaaccagcucaaggaggaccaggacaagguccacaugugggagcagaccgucaagaaggacgagaacgagaucgagaagcucaagaaggaggagcagcgccacaugaagaucaucgacgagaccauggcccagcuccaggaccucaagaaccagcaccucgccaagaaguccgaggucaacgacaagaaccacgagauggaggagauccgcaagaagcucggcggcgccaacaaggagaugacccaccuccagaaggaggucaccgccaucgagaccaagcucgagcagaagcgcuccgaccgccacaaccuccuccaggccugcaagaugcaggacaucaagcucccccucuccaagggcaccauggacgacaucucccaggaggagggcuccucccagggcgaggacuccgucuccggcucccagcgcaucuccuccaucuacgcccgcgaggcccucaucgagaucgacuacggcgaccucugcgaggaccucaaggacgcccaggccgaggaggagaucaagcaggagaugaacacccuccagcagaagcucaacgagcagcaguccguccuccagcgcaucgccgcccccaacaugaaggccauggagaagcucgaguccguccgcgacaaguuccaggagaccuccgacgaguucgaggccgcccgcaagcgcgccaagaaggccaagcaggccuucgagcagaucaagaaggagcgcuucgaccgcuucaacgccugcuucgaguccgucgccaccaacaucgacgagaucuacaaggcccucucccgcaacuccuccgcccaggccuuccucggccccgagaaccccgaggagcccuaccucgacggcaucaacuacaacugcgucgcccccggcaagcgcuuccgccccauggacaaccucuccggcggcgagaagaccgucgccgcccucgcccuccucuucgccauccacuccuacaagcccgcccccuucuucguccucgacgagaucgacgccgcccucgacaacaccaacaucggcaaggucgccaacuacaucaaggagcaguccaccugcaacuuccaggccaucgucaucucccucaaggaggaguucuacaccaaggccgagucccucaucggcgucuaccccgagcagggcgacugcgucaucuccaagguccucaccuucgaccucaccaaguaccccgacgccaaccccaaccccaacgagcaguga

SEQ ID NO: 49851 - RNA, 3486 nt, Artificial Sequence
  derived and/or modified sequence opt2 from SMC1B__Homo_sapiens__NP_001278430
auggcccaccucgagcuccuccucgucgagaacuucaaguccuggcgcggccgccaggucaucggccccuuccgccgcuucaccugcaucaucggccccaacggcuccggcaaguccaacgucauggacgcccucuccuucgucaugggcgagaagaucgccaaccuccgcgucaagaacauccaggagcucauccacggcgcccacaucggcaagcccaucuccuccuccgccuccgucaagaucaucuacgucgaggaguccggcgaggagaagaccuucgcccgcaucauccgcggcggcugcuccgaguuccgcuucaacgacaaccucgucucccgcuccgucuacaucgccgagcucgagaagaucggcaucaucgucaaggcccagaacugccucgucuuccagggcaccgucgaguccaucuccgucaagaagcccaaggagcgcacccaguucuucgaggagaucuccaccuccggcgagcucaucggcgaguacgaggagaagaagcgcaagcuccagaaggccgaggaggacgcccaguucaacuucaacaagaagaagaacaucgccgccgagcgccgccaggccaagcucgagaaggaggaggccgagcgcuaccagucccuccucgaggagcucaagaugaacaagauccagcuccagcucuuccagcucuaccacaacgagaagaagauccaccuccucaacaccaagcucgagcacgucaaccgcgaccucuccgucaagcgcgagucccucucccaccacgagaacaucgucaaggcccgcaagaaggagcacggcaugcucacccgccagcuccagcagaccgagaaggagcucaaguccgucgagacccuccucaaccagaagcgcccccaguacaucaaggccaaggagaacaccucccaccaccucaagaagcucgacgucgccaagaaguccaucaaggacuccgagaagcagugcuccaagcaggaggacgacaucaaggcccucgagaccgagcucgccgaccucgacgccgccuggcgcuccuucgagaagcagaucgaggaggagauccuccacaagaagcgcgacaucgagcucgaggccucccagcucgaccgcuacaaggagcucaaggagcagguccgcaagaaggucgccaccaugacccagcagcucgagaagcuccagugggagcagaagaccgacgaggagcgccucgccuucgagaagcgccgccacggcgagguccagggcaaccucaagcagaucaaggagcagaucgaggaccacaagaagcgcaucgagaagcucgaggaguacaccaagaccugcauggacugccucaaggagaagaagcagcaggaggagacccucgucgacgagaucgagaagaccaagucccgcauguccgaggucaacgaggagcucaaccucauccgcuccgagcuccagaacgccggcaucgacacccacgagggcaagcgccagcagaagcgcgccgagguccucgagcaccucaagcgccucuaccccgacuccgucuucggccgccucuucgaccucugccaccccauccacaagaaguaccagcucgccgucaccaaggucuucggccgcuucaucaccgccaucgucgucgccuccgagaaggucgccaaggacugcauccgcuuccucaaggaggagcgcgccgagcccgagaccuuccucgcccucgacuaccucgacaucaagcccaucaacgagcgccuccgcgagcucaagggcugcaagauggucaucgacgucaucaagacccaguucccccagcucaagaaggucauccaguucgucugcggcaacggccucgucugcgagaccauggaggaggcccgccacaucgcccucuccggccccgagcgccagaagaccgucgcccucgacggcacccucuuccucaaguccggcgucaucuccggcggcuccuccgaccucaaguacaaggcccgcugcugggacgagaaggagcucaagaaccuccgcgaccgccgcucccagaagauccaggagcucaagggccucaugaagacccuccgcaaggagaccgaccucaagcagauccagacccucauccagggcacccagacccgccucaaguacucccagaacgagcucgagaugaucaagaagaagcaccucgucgccuucuaccaggagcagucccagcuccaguccgagcuccucaacaucgagucccagugcaucaugcucuccgagggcaucaaggagcgccagcgccgcaucaaggaguuccaggagaagaucgacaaggucgaggacgacaucuuccagcacuucugcgaggagaucggcgucgagaacauccgcgaguucgagaacaagcacgucaagcgccagcaggagaucgaccagaagcgccucgaguucgagaagcagaagacccgccucaacguccagcucgaguacucccgcucccaccucaagaagaagcucaacaagaucaacacccucaaggagaccauccagaagggcuccgaggacaucgaccaccucaagaaggccgaggagaacugccuccagaccgucaacgagcucauggccaagcagcagcagcucaaggacauccgcgucacccagaacuccuccgccgagaagguccagacccagaucgaggaggagcgcaagaaguuccucgccgucgaccgcgaggucggcaagcuccagaaggaggucgucuccauccagaccucccucgagcagaagcgccucgagaagcacaaccuccuccucgacugcaagguccaggacaucgagaucauccuccucuccggcucccucgacgacaucaucgaggucgagaugggcaccgaggccgaguccacccaggccaccaucgacaucuacgagaaggaggaggccuucgagaucgacuacuccucccucaaggaggaccucaaggcccuccaguccgaccaggagaucgaggcccaccuccgccuccuccuccagcaggucgccucccaggaggacauccuccucaagaccgccgcccccaaccuccgcgcccucgagaaccucaagaccguccgcgacaaguuccaggaguccaccgacgccuucgaggccucccgcaaggaggcccgccucugccgccaggaguucgagcaggucaagaagcgccgcuacgaccucuucacccagugcuucgagcacgucuccaucuccaucgaccagaucuacaagaagcucugccgcaacaacuccgcccaggucuccuccuacaucaaggagcagacccaggaccaguuccagaugaucgucaucucccucaaggaggaguucuacucccgcgccgacgcccucaucggcaucuaccccgaguacgacgacugcauguucucccgcguccucacccucgaccucucccaguaccccgacaccgagggccaggaguccuccaagcgccacggcgagucccgcuga

SEQ ID NO: 49852 - RNA, 3594 nt, Artificial Sequence
  derived and/or modified sequence opt2 from SMC2__Homo_sapiens__XP_011516451
augcacaucaaguccaucauccucgagggcuucaaguccuacgcccagcgcaccgaggucaacggcuucgacccccucuucaacgccaucaccggccucaacggcuccggcaaguccaacauccucgacuccaucugcuuccuccucggcaucuccaaccucucccagguccgcgccuccaaccuccaggaccucgucuacaagaacggccaggccggcaucaccaaggccuccgucuccaucaccuucgacaacuccgacaagaagcaguccccccucggcuucgagguccacgacgagaucaccgucacccgccaggucgucaucggcggccgcaacaaguaccucaucaacggcgucaacgccaacaacacccgcguccaggaccucuucugcuccgucggccucaacgucaacaacccccacuuccucaucaugcagggccgcaucaccaagguccucaacaugaagccccccgagauccucuccaugaucgaggaggccgccggcacccgcauguacgaguacaagaagaucgccgcccagaagaccaucgagaagaaggaggccaagcucaaggagaucaagaccauccucgaggaggagaucacccccaccauccagaagcucaaggaggagcgcuccuccuaccucgaguaccagaaggucaugcgcgagaucgagcaccucucccgccucuacaucgccuaccaguuccuccucgccgaggacaccaagguccgcuccgccgaggagcucaaggagaugcaggacaaggucaucaagcuccaggaggagcucuccgagaacgacaagaagaucaaggcccucaaccacgagaucgaggagcucgagaagcgcaaggacaaggagaccggcggcauccuccgcucccucgaggacgcccucgccgaggcccagcgcgucaacaccaagucccaguccgccuucgaccucaagaagaagaaccucgccugcgaggaguccaagcgcaaggagcucgagaagaacauggucgaggacuccaagacccucgccgccaaggagaaggaggucaagaagaucaccgacggccuccacgcccuccaggaggccuccaacaaggacgccgaggcccucgccgccgcccagcagcacuucaacgccgucuccgccggccucuccuccaacgaggacggcgccgaggccacccucgccggccagaugauggccugcaagaacgacaucuccaaggcccagaccgaggccaagcaggcccagaugaagcucaagcacgcccagcaggagcucaagaacaagcaggccgaggucaagaagauggacuccggcuaccgcaaggaccaggaggcccucgaggccgucaagcgccucaaggagaagcucgaggccgagaugaagaagcucaacuacgaggagaacaaggaggagucccuccucgagaagcgccgccagcucucccgcgacaucggccgccucaaggagaccuacgaggcccuccucgcccgcuuccccaaccuccgcuucgccuacaaggaccccgagaagaacuggaaccgcaacugcgucaagggccucgucgccucccucaucuccgucaaggacaccuccgccaccaccgcccucgagcucgucgccggcgagcgccucuacaacgucgucgucgacaccgaggucaccggcaagaagcuccucgagcgcggcgagcucaagcgccgcuacaccaucaucccccucaacaagaucuccgcccgcugcaucgcccccgagacccuccgcgucgcccagaaccucgucggccccgacaacguccacgucgcccucucccucgucgaguacaagcccgagcuccagaaggccauggaguucgucuucggcaccaccuucgucugcgacaacauggacaacgccaagaaggucgccuucgacaagcgcaucaugacccgcaccgucacccucggcggcgacgucuucgacccccacggcacccucuccggcggcgcccgcucccaggccgccuccauccucaccaaguuccaggagcucaaggacguccaggacgagcuccgcaucaaggagaacgagcuccgcgcccucgaggaggagcucgccggccucaagaacaccgccgagaaguaccgccagcucaagcagcagugggagaugaagaccgaggaggccgaccuccuccagaccaagcuccagcaguccuccuaccacaagcagcaggaggagcucgacgcccucaagaagaccaucgaggaguccgaggagacccucaagaacaccaaggagauccagcgcaaggccgaggagaaguacgagguccucgagaacaagaugaagaacgccgaggccgagcgcgagcgcgagcucaaggacgcccagaagaagcucgacugcgccaagaccaaggccgacgccuccuccaagaagaugaaggagaagcagcaggaggucgaggccaucacccucgagcucgaggagcucaagcgcgagcacaccuccuacaagcagcagcucgaggccgucaacgaggccaucaaguccuacgagucccagaucgaggucauggccgccgaggucgccaagaacaaggaguccgucaacaaggcccaggaggaggucaccaagcagaaggaggucaucaccgcccaggacaccgucaucaaggccaaguacgccgaggucgccaagcacaaggagcagaacaacgacucccagcucaagaucaaggagcucgaccacaacaucuccaagcacaagcgcgaggccgaggacggcgccgccaaggucuccaagaugcucaaggacuacgacuggaucaacgccgagcgccaccucuucggccagcccaacuccgccuacgacuucaagaccaacaaccccaaggaggccggccagcgccuccagaagcuccaggagaugaaggagaagcucggccgcaacgucaacaugcgcgccaugaacguccucaccgaggccgaggagcgcuacaacgaccucaugaagaagaagcgcaucgucgagaacgacaaguccaagauccucaccaccaucgaggaccucgaccagaagaagaaccaggcccucaacaucgccuggcagaaggucaacaaggacuucggcuccaucuucuccacccuccuccccggcgccaacgccaugcucgccccccccgagggccagaccguccucgacggccucgaguucaaggucgcccucggcaacaccuggaaggagaaccucaccgagcucuccggcggccagcgcucccucgucgcccucucccucauccucuccaugcuccucuucaagcccgcccccaucuacauccucgacgaggucgacgccgcccucgaccucucccacacccagaacaucggccagaugcuccgcacccacuucacccacucccaguucaucgucgucucccucaaggagggcauguucaacaacgccaacguccucuucaagaccaaguucgucgacggcgucuccaccgucgcccgcuucacccagugccagaacggcaagaucuccaaggaggccaaguccaaggccaagccccccaagggcgcccacgucgaggucuga

SEQ ID NO: 49853 - RNA, 3654 nt, Artificial Sequence
  derived and/or modified sequence opt2 from SMC3__Homo_sapiens__NP_005436
auguacaucaagcaggucaucauccagggcuuccgcuccuaccgcgaccagaccaucgucgaccccuucuccuccaagcacaacgucaucgucggccgcaacggcuccggcaaguccaacuucuucuacgccauccaguucguccucuccgacgaguucucccaccuccgccccgagcagcgccucgcccuccuccacgagggcaccggcccccgcgucaucuccgccuucgucgagaucaucuucgacaacuccgacaaccgccuccccaucgacaaggaggaggucucccuccgccgcgucaucggcgccaagaaggaccaguacuuccucgacaagaagauggucaccaagaacgacgucaugaaccuccucgaguccgccggcuucucccgcuccaaccccuacuacaucgucaagcagggcaagaucaaccagauggccaccgcccccgacucccagcgccucaagcuccuccgcgaggucgccggcacccgcgucuacgacgagcgcaaggaggaguccaucucccucaugaaggagaccgagggcaagcgcgagaagaucaacgagcuccucaaguacaucgaggagcgccuccacacccucgaggaggagaaggaggagcucgcccaguaccagaagugggacaagaugcgccgcgcccucgaguacaccaucuacaaccaggagcucaacgagacccgcgccaagcucgacgagcucuccgccaagcgcgagaccuccggcgagaagucccgccagcuccgcgacgcccagcaggacgcccgcgacaagauggaggacaucgagcgccagguccgcgagcucaagaccaagaucuccgccaugaaggaggagaaggagcagcucuccgccgagcgccaggagcagaucaagcagcgcaccaagcucgagcucaaggccaaggaccuccaggacgagcucgccggcaacuccgagcagcgcaagcgccuccucaaggagcgccagaagcuccucgagaagaucgaggagaagcagaaggagcucgccgagaccgagcccaaguucaacuccgucaaggagaaggaggagcgcggcaucgcccgccucgcccaggccacccaggagcgcaccgaccucuacgccaagcagggccgcggcucccaguucaccuccaaggaggagcgcgacaaguggaucaagaaggagcucaagucccucgaccaggccaucaacgacaagaagcgccagaucgccgccauccacaaggaccucgaggacaccgaggccaacaaggagaagaaccucgagcaguacaacaagcucgaccaggaccucaacgaggucaaggcccgcgucgaggagcucgaccgcaaguacuacgaggucaagaacaagaaggacgagcuccaguccgagcgcaacuaccucuggcgcgaggagaacgccgagcagcaggcccucgccgccaagcgcgaggaccucgagaagaagcagcagcuccuccgcgccgccaccggcaaggccauccucaacggcaucgacuccaucaacaagguccucgaccacuuccgccgcaagggcaucaaccagcacguccagaacggcuaccacggcaucgucaugaacaacuucgagugcgagcccgccuucuacaccugcgucgaggucaccgccggcaaccgccucuucuaccacaucgucgacuccgacgaggucuccaccaagauccucauggaguucaacaagaugaaccuccccggcgaggucaccuuccucccccucaacaagcucgacguccgcgacaccgccuaccccgagaccaacgacgccauccccaugaucuccaagcuccgcuacaacccccgcuucgacaaggccuucaagcacgucuucggcaagacccucaucugccgcuccauggaggucuccacccagcucgcccgcgccuucaccauggacugcaucacccucgagggcgaccaggucucccaccgcggcgcccucaccggcggcuacuacgacacccgcaagucccgccucgagcuccagaaggacguccgcaaggccgaggaggagcucggcgagcucgaggccaagcucaacgagaaccuccgccgcaacaucgagcgcaucaacaacgagaucgaccagcucaugaaccagaugcagcagaucgagacccagcagcgcaaguucaaggccucccgcgacuccauccucuccgagaugaagaugcucaaggagaagcgccagcaguccgagaagaccuucaugcccaagcagcgcucccuccagucccucgaggccucccuccacgccauggaguccacccgcgagucccucaaggccgagcucggcaccgaccuccucucccagcucucccucgaggaccagaagcgcgucgacgcccucaacgacgagauccgccagcuccagcaggagaaccgccagcuccucaacgagcgcaucaagcucgagggcaucaucacccgcgucgagaccuaccucaacgagaaccuccgcaagcgccucgaccaggucgagcaggagcucaacgagcuccgcgagaccgagggcggcaccguccucaccgccaccaccuccgagcucgaggccaucaacaagcgcgucaaggacaccauggcccgcuccgaggaccucgacaacuccaucgacaagaccgaggccggcaucaaggagcuccagaaguccauggagcgcuggaagaacauggagaaggagcacauggacgccaucaaccacgacaccaaggagcucgagaagaugaccaaccgccagggcaugcuccucaagaagaaggaggagugcaugaagaagauccgcgagcucggcucccucccccaggaggccuucgagaaguaccagacccucucccucaagcagcucuuccgcaagcucgagcagugcaacaccgagcucaagaaguacucccacgucaacaagaaggcccucgaccaguucgucaacuucuccgagcagaaggagaagcucaucaagcgccaggaggagcucgaccgcggcuacaaguccaucauggagcucaugaacguccucgagcuccgcaaguacgaggccauccagcucaccuucaagcaggucuccaagaacuucuccgaggucuuccagaagcucguccccggcggcaaggccacccucgucaugaagaagggcgacgucgagggcucccagucccaggacgagggcgagggcuccggcgaguccgagcgcggcuccggcucccaguccuccguccccuccgucgaccaguucaccggcgucggcauccgcgucuccuucaccggcaagcagggcgagaugcgcgagaugcagcagcucuccggcggccagaagucccucgucgcccucgcccucaucuucgccauccagaagugcgaccccgcccccuucuaccucuucgacgagaucgaccaggcccucgacgcccagcaccgcaaggccgucuccgacaugaucauggagcucgccguccacgcccaguucaucaccaccaccuuccgccccgagcuccucgaguccgccgacaaguucuacggcgucaaguuccgcaacaaggucucccacaucgacgucaucaccgccgagauggccaaggacuucgucgaggacgacaccacccacggcuga

SEQ ID NO: 49854 - RNA, 3867 nt, Artificial Sequence
  derived and/or modified sequence opt2 from SMC4__Homo_sapiens__NP_005487
augccccgcaagggcacccagcccuccaccgcccgccgccgcgaggagggcccccccccccccucccccgacggcgccuccuccgacgccgagcccgagccccccuccggccgcaccgagucccccgccaccgccgccgagaccgccuccgaggagcucgacaaccgcucccucgaggagauccucaacuccaucccccccccccccccccccgccaugaccaacgaggccggcgccccccgccucaugaucacccacaucgucaaccagaacuucaaguccuacgccggcgagaagauccucggccccuuccacaagcgcuucuccugcaucaucggccccaacggcuccggcaaguccaacgucaucgacuccaugcucuucgucuucggcuaccgcgcccagaagauccgcuccaagaagcucuccguccucauccacaacuccgacgagcacaaggacauccaguccugcaccgucgagguccacuuccagaagaucaucgacaaggagggcgacgacuacgaggucauccccaacuccaacuucuacgucucccgcaccgccugccgcgacaacaccuccgucuaccacaucuccggcaagaagaagaccuucaaggacgucggcaaccuccuccgcucccacggcaucgaccucgaccacaaccgcuuccucauccuccagggcgaggucgagcagaucgccaugaugaagcccaagggccagaccgagcacgacgagggcaugcucgaguaccucgaggacaucaucggcugcggccgccucaacgagcccaucaagguccucugccgccgcgucgagauccucaacgagcaccgcggcgagaagcucaaccgcgucaagauggucgagaaggagaaggacgcccucgagggcgagaagaacaucgccaucgaguuccucacccucgagaacgagaucuuccgcaagaagaaccacgucugccaguacuacaucuacgagcuccagaagcgcaucgccgagauggagacccagaaggagaagauccacgaggacaccaaggagaucaacgagaaguccaacauccucuccaacgagaugaaggccaagaacaaggacgucaaggacaccgagaagaagcucaacaagaucaccaaguucaucgaggagaacaaggagaaguucacccagcucgaccucgaggacguccagguccgcgagaagcucaagcacgccaccuccaaggccaagaagcucgagaagcagcuccagaaggacaaggagaaggucgaggaguucaaguccauccccgccaaguccaacaacaucaucaacgagaccaccacccgcaacaacgcccucgagaaggagaaggagaaggaggagaagaagcucaaggaggucauggacucccucaagcaggagacccagggccuccagaaggagaaggagucccgcgagaaggagcucaugggcuucuccaaguccgucaacgaggcccgcuccaagauggacgucgcccaguccgagcucgacaucuaccucucccgccacaacaccgccgucucccagcucaccaaggccaaggaggcccucaucgccgccuccgagacccucaaggagcgcaaggccgccauccgcgacaucgagggcaagcucccccagaccgagcaggagcucaaggagaaggagaaggagcuccagaagcucacccaggaggagaccaacuucaagucccucguccacgaccucuuccagaaggucgaggaggccaaguccucccucgccaugaaccgcucccgcggcaagguccucgacgccaucauccaggagaagaaguccggccgcauccccggcaucuacggccgccucggcgaccucggcgccaucgacgagaaguacgacgucgccaucuccuccugcugccacgcccucgacuacaucgucgucgacuccaucgacaucgcccaggagugcgucaacuuccucaagcgccagaacaucggcgucgccaccuucaucggccucgacaagauggccgucugggccaagaagaugaccgagauccagacccccgagaacaccccccgccucuucgaccucgucaaggucaaggacgagaagauccgccaggccuucuacuucgcccuccgcgacacccucgucgccgacaaccucgaccaggccacccgcgucgccuaccagaaggaccgccgcuggcgcgucgucacccuccagggccagaucaucgagcaguccggcaccaugaccggcggcggcuccaaggucaugaagggccgcaugggcuccucccucgucaucgagaucuccgaggaggaggucaacaagauggagucccagcuccagaacgacuccaagaaggccaugcagauccaggagcagaagguccagcucgaggagcgcgucgucaagcuccgccacuccgagcgcgagaugcgcaacacccucgagaaguucaccgccuccauccagcgccucaucgagcaggaggaguaccucaacguccaggucaaggagcucgaggccaacguccucgccaccgcccccgacaagaagaagcagaagcuccucgaggagaacgucuccgccuucaagaccgaguacgacgccgucgccgagaaggccggcaaggucgaggccgaggucaagcgccuccacaacaccaucgucgagaucaacaaccacaagcucaaggcccagcaggacaagcucgacaagaucaacaagcagcucgacgagugcgccuccgccaucaccaaggcccaggucgccaucaagaccgccgaccgcaaccuccagaaggcccaggacuccguccuccgcaccgagaaggagaucaaggacaccgagaaggaggucgacgaccucaccgccgagcucaagucccucgaggacaaggccgccgaggucgucaagaacaccaacgccgccgaggagucccuccccgagauccagaaggagcaccgcaaccuccuccaggagcucaaggucauccaggagaacgagcacgcccuccagaaggacgcccucuccaucaagcucaagcucgagcagaucgacggccacaucgccgagcacaacuccaagaucaaguacuggcacaaggagaucuccaagaucucccuccaccccaucgaggacaaccccaucgaggagaucuccguccucucccccgaggaccucgaggccaucaagaaccccgacuccaucaccaaccagaucgcccuccucgaggcccgcugccacgagaugaagcccaaccucggcgccaucgccgaguacaagaagaaggaggagcucuaccuccagcgcgucgccgagcucgacaagaucaccuacgagcgcgacuccuuccgccaggccuacgaggaccuccgcaagcagcgccucaacgaguucauggccggcuucuacaucaucaccaacaagcucaaggagaacuaccagaugcucacccucggcggcgacgccgagcucgagcucgucgacucccucgaccccuucuccgagggcaucauguucuccguccgcccccccaagaaguccuggaagaagaucuucaaccucuccggcggcgagaagacccucuccucccucgcccucgucuucgcccuccaccacuacaagcccaccccccucuacuucauggacgagaucgacgccgcccucgacuucaagaacgucuccaucgucgccuucuacaucuacgagcagaccaagaacgcccaguucaucaucaucucccuccgcaacaacauguucgagaucuccgaccgccucaucggcaucuacaagaccuacaacaucaccaaguccgucgccgucaaccccaaggagaucgccuccaagggccucugcuga

SEQ ID NO: 49855 - RNA, 3306 nt, Artificial Sequence
  derived and/or modified sequence opt2 from SMC5__Homo_sapiens__NP_055925
auggccacccccuccaagaagaccuccacccccuccccccagcccuccaagcgcgcccucccccgcgaccccuccuccgagguccccuccaagcgcaagaacuccgccccccagcucccccuccuccaguccuccggccccuucgucgagggcuccaucguccgcaucuccauggagaacuuccucaccuacgacaucugcgaggucucccccggcccccaccucaacaugaucgucggcgccaacggcaccggcaaguccuccaucgucugcgccaucugccucggccucgccggcaagcccgccuucaugggccgcgccgacaaggucggcuucuucgucaagcgcggcugcucccgcggcauggucgagaucgagcucuuccgcgccuccggcaaccucgucaucacccgcgagaucgacgucgccaagaaccaguccuucugguucaucaacaagaaguccaccacccagaagaucgucgaggagaaggucgccgcccucaacauccaggucggcaaccucugccaguuccucccccaggacaaggucggcgaguucgccaagcucuccaagaucgagcuccucgaggccaccgagaaguccaucggcccccccgagaugcacaaguaccacugcgagcucaagaaccuccgcgagaaggagaagcagcucgagaccuccugcaaggagaagaccgaguaccuccagaagaugguccagcgcaacgagcgcuacaagcaggacgucgagcgcuucuacgagcgcaagcgccaccucgaccucaucgagaugcucgaggccaagcgccccugggucgaguacgagaacguccgccaggaguacgaggaggucaagcucguccgcgaccgcgucaaggaggagguccgcaagcucaaggagggccagauccccgucaccugccgcaucgaggagauggagaacgagcgccacaaccucgaggcccgcaucaaggagaaggccaccgacaucaaggaggccucccagaagugcaagcagaagcaggacgucaucgagcgcaaggacaagcacaucgaggagcuccagcaggcccucaucgucaagcagaacgaggagcucgaccgccagcgccgcaucggcaacacccgcaagaugaucgaggaccuccagaacgagcucaagaccaccgagaacugcgagaaccuccagccccagaucgacgccaucaccaacgaccuccgccgcauccaggacgagaaggcccucugcgagggcgagaucaucgacaagcgccgcgagcgcgagacccucgagaaggagaagaaguccgucgacgaccacaucguccgcuucgacaaccucaugaaccagaaggaggacaagcuccgccagcgcuuccgcgacaccuacgacgccguccucuggcuccgcaacaaccgcgacaaguucaagcagcgcgucugcgagcccaucaugcucaccaucaacaugaaggacaacaagaacgccaaguacaucgagaaccacauccccuccaacgaccuccgcgccuucgucuucgagucccaggaggacauggaggucuuccucaaggagguccgcgacaacaagaagcuccgcgucaacgccgucaucgcccccaaguccuccuacgccgacaaggcccccucccgcucccucaacgagcucaagcaguacggcuucuucuccuaccuccgcgagcucuucgacgcccccgaccccgucauguccuaccucugcugccaguaccacauccacgagguccccgucggcaccgagaagacccgcgagcgcaucgagcgcgucauccaggagacccgccucaagcagaucuacaccgccgaggagaaguacgucgucaagaccuccuucuacuccaacaaggucaucuccuccaacaccucccucaaggucgcccaguuccucaccgucaccgucgaccucgagcagcgccgccaccucgaggagcagcucaaggagauccaccgcaagcuccaggccgucgacuccggccucaucgcccuccgcgagaccuccaagcaccucgagcacaaggacaacgagcuccgccagaagaagaaggagcuccucgagcgcaagaccaagaagcgccagcucgagcagaagaucuccuccaagcucggcucccucaagcucauggagcaggacaccugcaaccucgaggaggaggagcgcaaggccuccaccaagaucaaggagaucaacguccagaaggccaagcucgucaccgagcucaccaaccucaucaagaucugcaccucccuccacauccagaaggucgaccucauccuccagaacaccaccgucaucuccgagaagaacaagcucgaguccgacuacauggccgccuccucccagcuccgccucaccgagcagcacuucaucgagcucgacgagaaccgccagcgccuccuccagaagugcaaggagcucaugaagcgcgcccgccaggucugcaaccucggcgccgagcagacccucccccaggaguaccagacccagguccccaccauccccaacggccacaacuccucccuccccauggucuuccaggaccuccccaacacccucgacgagaucgacgcccuccucaccgaggagcgcucccgcgccuccugcuucaccggccucaaccccaccaucguccaggaguacaccaagcgcgaggaggagaucgagcagcucaccgaggagcucaagggcaagaaggucgagcucgaccaguaccgcgagaacaucucccaggucaaggagcgcuggcucaacccccucaaggagcucgucgagaagaucaacgagaaguucuccaacuucuucuccuccaugcagugcgccggcgaggucgaccuccacaccgagaacgaggaggacuacgacaaguacggcauccgcauccgcgucaaguuccgcuccuccacccagcuccacgagcucaccccccaccaccaguccggcggcgagcgcuccgucuccaccaugcucuaccucauggcccuccaggagcucaaccgcugccccuuccgcgucgucgacgagaucaaccagggcauggaccccaucaacgagcgccgcgucuucgagauggucgucaacaccgccugcaaggagaacaccucccaguacuucuucaucacccccaagcuccuccagaaccuccccuacuccgagaagaugaccguccucuucgucuacaacggcccccacaugcucgagcccaacaccuggaaccucaaggccuuccagcgccgccgccgccgcaucaccuucacccagcccuccuga

SEQ ID NO: 49856 - RNA, 3276 nt, Artificial Sequence
  derived and/or modified sequence opt2 from SMC6__Homo_sapiens__NP_001135758
auggccaagcgcaaggaggagaacuucuccucccccaagaacgccaagcgcccccgccaggaggagcucgaggacuucgacaaggacggcgacgaggacgagugcaagggcaccacccucaccgccgccgaggucggcaucaucgaguccauccaccucaagaacuucaugugccacuccaugcucggccccuucaaguucggcuccaacgucaacuucgucgucggcaacaacggcuccggcaaguccgccguccucaccgcccucaucgucggccucggcggccgcgccgucgccaccaaccgcggcuccucccucaagggcuucgucaaggacggccagaacuccgccgacaucuccaucacccuccgcaaccgcggcgacgacgccuucaaggccuccgucuacggcaacuccauccucauccagcagcacaucuccaucgacggcucccgcuccuacaagcucaaguccgccaccggcuccgucgucuccacccgcaaggaggagcucaucgccauccucgaccacuucaacauccaggucgacaaccccgucuccguccucacccaggagauguccaagcaguuccuccaguccaagaacgagggcgacaaguacaaguucuucaugaaggccacccagcucgagcagaugaaggaggacuacuccuacaucauggagaccaaggagcgcaccaaggagcagauccaccagggcgaggagcgccucaccgagcucaagcgccagugcgucgagaaggaggagcgcuuccaguccaucgccggccucuccaccaugaagaccaaccucgagucccucaagcacgagauggccugggccgucgucaacgagaucgagaagcagcucaacgccauccgcgacaacaucaagaucggcgaggaccgcgccgcccgccucgaccgcaagauggaggagcagcagguccgccucaacgaggccgagcagaaguacaaggacauccaggacaagcucgagaagaucuccgaggagaccaacgcccgcgcccccgagugcauggcccucaaggccgacgucgucgccaagaagcgcgccuacaacgaggccgagguccucuacaaccgcucccucaacgaguacaaggcccucaagaaggacgacgagcagcucugcaagcgcaucgaggagcucaagaaguccaccgaccagucccucgagcccgagcgccucgagcgccagaagaagaucuccuggcucaaggagcgcgucaaggccuuccagaaccaggagaacuccgucaaccaggagaucgagcaguuccagcaggccaucgagaaggacaaggaggagcacggcaagaucaagcgcgaggagcucgacgucaagcacgcccucuccuacaaccagcgccagcucaaggagcucaaggacuccaagaccgaccgccucaagcgcuucggccccaacguccccgcccuccucgaggccaucgacgacgccuaccgccagggccacuucaccuacaagcccgucggcccccucggcgccugcauccaccuccgcgaccccgagcucgcccucgccaucgaguccugccucaagggccuccuccaggccuacugcugccacaaccacgccgacgagcgcguccuccaggcccucaugaagcgcuucuaccuccccggcaccucccgcccccccaucaucgucuccgaguuccgcaacgagaucuacgacguccgccaccgcgccgccuaccaccccgacuuccccaccguccucaccgcccucgagaucgacaacgccgucgucgccaacucccucaucgacaugcgcggcaucgagaccguccuccucaucaagaacaacuccgucgcccgcgccgucaugcagucccagaagccccccaagaacugccgcgaggccuucaccgccgacggcgaccaggucuucgccggccgcuacuacuccuccgagaacacccgccccaaguuccucucccgcgacgucgacuccgagaucuccgaccucgagaacgaggucgagaacaagaccgcccagauccucaaccuccagcagcaccucuccgcccucgagaaggacaucaagcacaacgaggagcuccucaagcgcugccagcuccacuacaaggagcucaagaugaagauccgcaagaacaucuccgagauccgcgagcucgagaacaucgaggagcaccaguccgucgacaucgccacccucgaggacgaggcccaggagaacaaguccaagaugaagauggucgaggagcacauggagcagcagaaggagaacauggagcaccucaagucccucaagaucgaggccgagaacaaguacgacgccaucaaguucaagaucaaccagcucuccgagcucgccgacccccucaaggacgagcucaaccucgccgacuccgaggucgacaaccagaagcgcggcaagcgccacuacgaggagaagcagaaggagcaccucgacacccucaacaagaagaagcgcgagcucgacaugaaggagaaggagcucgaggagaagaugucccaggcccgccagaucugccccgagcgcaucgaggucgagaaguccgccuccauccucgacaaggagaucaaccgccuccgccagaagauccaggccgagcacgccucccacggcgaccgcgaggagaucaugcgccaguaccaggaggcccgcgagaccuaccucgaccucgacuccaagguccgcacccucaagaaguucaucaagcuccucggcgagaucauggagcaccgcuucaagaccuaccagcaguuccgccgcugccucacccuccgcugcaagcucuacuucgacaaccuccucucccagcgcgccuacugcggcaagaugaacuucgaccacaagaacgagacccucuccaucuccguccagcccggcgagggcaacaaggccgccuucaacgacaugcgcgcccucuccggcggcgagcgcuccuucuccaccgucugcuucauccucucccucugguccaucgccgagucccccuuccgcugccucgacgaguucgacgucuacauggacauggucaaccgccgcaucgccauggaccucauccucaagauggccgacucccagcgcuuccgccaguucauccuccucaccccccaguccauguccucccuccccuccuccaagcucauccgcauccuccgcauguccgaccccgagcgcggccagaccacccuccccuuccgccccgucacccaggaggaggacgacgaccagcgcuga

SEQ ID NO: 49857 - RNA, 6018 nt, Artificial Sequence
  derived and/or modified sequence opt2 from SMCHD1__Homo_sapiens__NP_056110
auggccgccgccgacggcggcggccccggcggcgccuccgucggcaccgaggaggacggcggcggcgucggccaccgcaccgucuaccucuucgaccgccgcgagaaggaguccgagcucggcgaccgcccccuccaggucggcgagcgcuccgacuacgccggcuuccgcgccugcgucugccagacccucggcaucucccccgaggagaaguucgucaucaccaccaccucccgcaaggagaucaccugcgacaacuucgacgagaccgucaaggacggcgucacccucuaccuccuccaguccgucaaccagcuccuccucaccgccaccaaggagcgcaucgacuuccucccccacuacgacacccucgucaaguccggcauguacgaguacuacgccuccgagggccagaacccccuccccuucgcccucgccgagcucaucgacaacucccucuccgccaccucccgcaacaucggcguccgccgcauccagaucaagcuccucuucgacgagacccagggcaagcccgccgucgccgucaucgacaacggccgcggcaugaccuccaagcagcucaacaacugggccgucuaccgccucuccaaguucacccgccagggcgacuucgaguccgaccacuccggcuacguccgccccguccccgucccccgcucccucaacuccgacaucuccuacuucggcgucggcggcaagcaggccgucuucuucgucggccaguccgcccgcaugaucuccaagcccgccgacucccaggacguccacgagcucguccucuccaaggaggacuucgagaagaaggagaagaacaaggaggccaucuacuccggcuacauccgcaaccgcaagcccuccgacuccguccacaucaccaacgacgacgagcgcuuccuccaccaccucaucaucgaggagaaggagaaggacuccuucaccgccgucgucaucaccggcguccagcccgagcacauccaguaccucaagaacuacuuccaccucuggacccgccagcucgcccacaucuaccacuacuacauccacggccccaagggcaacgagauccgcaccuccaaggaggucgagcccuucaacaacaucgacaucgagaucuccauguucgagaagggcaagguccccaagaucgucaaccuccgcgagauccaggacgacaugcagacccucuacgucaacaccgccgccgacuccuucgaguucaaggcccacgucgagggcgacggcgucgucgagggcaucauccgcuaccaccccuuccucuacgaccgcgagaccuaccccgacgaccccugcuuccccuccaagcucaaggacgaggacgacgaggacgacugcuucauccucgagaaggccgcccgcggcaagcgccccaucuucgagugcuucuggaacggccgccucauccccuacaccuccgucgaggacuucgacuggugcaccccccccaagaagcgcggccucgcccccaucgagugcuacaaccgcaucuccggcgcccucuucaccaacgacaaguuccaggucuccaccaacaagcucaccuucauggaccucgagcucaagcucaaggacaagaacacccucuucacccgcauccucaacggccaggagcagcgcaugaagaucgaccgcgaguucgcccucuggcucaaggacugccacgagaaguacgacaagcagaucaaguucacccucuucaagggcgucaucacccgccccgaccuccccuccaagaagcagggccccugggccaccuacgccgccaucgagugggacggcaagaucuacaaggccggccagcucgucaagaccaucaagacccucccccucuucuacggcuccaucguccgcuucuuccucuacggcgaccacgacggcgaggucuacgccaccggcggcgagguccagaucgccauggagccccaggcccucuacgacgagguccgcaccguccccaucgccaagcucgaccgcaccgucgccgagaaggccgucaagaaguacgucgaggacgagauggcccgccuccccgaccgccucuccgucaccuggcccgagggcgacgagcuccuccccaacgagguccgccccgccggcacccccaucggcgcccuccgcaucgagauccucaacaagaagggcgaggccaugcagaagcuccccggcaccucccacggcggcuccaagaagcuccucgucgagcucaaggucauccuccacuccuccuccggcaacaaggagaucaucucccacaucucccagcacggcggcaaguggcccuacugguucaagaagauggagaacauccagaagcucggcaacuacacccucaagcuccaggucguccucaacgaguccaacgccgacaccuacgccggccgcccccuccccuccaaggccaucaaguucuccgucaaggagggcaagcccgagaaguucuccuucggccuccucgaccuccccuuccgcgucggcguccccuucaacaucccccucgaguuccaggacgaguucggccacaccucccagcucgucaccgacauccagcccguccucgaggccuccggccucucccuccacuacgaggagaucaccaagggccccaacugcgucauccgcggcgucaccgccaagggccccgucaacuccugccagggcaagaacuacaaccucaaggucacccuccccggccucaaggaggacucccagauccucaagauccgccuccuccccggccacccccgccgccucaaggucaagcccgacuccgagauccucgucaucgagaacggcaccgccuuccccuuccaggucgagguccucgacgaguccgacaacaucaccgcccagcccaagcucaucguccacugcaaguucuccggcgcccccaaccuccccgucuacgucgucgacugcuccuccuccggcaccuccauccucaccggcuccgccauccagguccagaacaucaagaaggaccagacccucaaggcccgcaucgagauccccuccugcaaggacgucgcccccgucgagaagaccaucaagcuccuccccuccucccacgucgcccgccuccagaucuucuccgucgagggccagaaggccauccagaucaagcaccaggacgaggucaacuggaucgccggcgacaucaugcacaaccucaucuuccagauguacgacgagggcgagcgcgagaucaacaucaccuccgcccucgccgagaagaucaaggucaacuggacccccgagaucaacaaggagcaccuccuccagggccuccuccccgacguccagguccccaccuccgucaaggacaugcgcuacugccaggucuccuuccaggacgaccacgucucccucgaguccgccuucaccguccgcccccuccccgacgagcccaagcaccucaagugcgagaugaagggcggcaagaccguccagaugggccaggagcuccagggcgaggucgucaucaucaucaccgaccaguacggcaaccagauccaggccuucucccccuccucccucuccucccucuccaucgccggcgucggccucgacuccuccaaccucaagaccaccuuccaggagaacacccaguccaucuccguccgcggcaucaaguucauccccggcccccccggcaacaaggaccucugcuucaccuggcgcgaguucuccgacuucauccgcguccagcucaucuccggcccccccgccaagcuccuccucaucgacuggcccgagcucaaggaguccauccccgucaucaacggccgcgaccuccagaaccccaucaucguccagcucugcgaccagugggacaaccccgcccccguccagcacgucaagaucucccucaccaaggccuccaaccucaagcucaugcccuccaaccagcagcacaagaccgacgagaagggccgcgccaaccucggcgucuucuccgucuucgccccccgcggcgagcacacccuccaggucaaggccaucuacaacaaguccaucaucgagggccccaucaucaagcucaugauccuccccgaccccgagaagcccguccgccucaacgucaaguacgacaaggacgccuccuuccucgccggcggccucuucaccgacuucaugaucuccgucaucuccgaggacgacuccaucaucaagaacaucaaccccgcccgcaucuccaugaagauguggaagcucuccaccuccggcaaccgcccccccgccaacgccgagaccuucuccugcaacaagaucaaggacaacgacaaggaggacggcugcuucuacuuccgcgacaaggucauccccaacaaggucggcaccuacugcauccaguucggcuucaugauggacaagaccaacauccucaacuccgagcaggucaucgucgagguccuccccaaccagcccgucaagcucguccccaagaucaagccccccacccccgccgucuccaacguccgcuccgucgccucccgcacccucguccgcgaccuccaccucuccaucaccgacgacuacgacaaccacaccggcaucgaccucgucggcaccaucaucgccaccaucaagggcuccaacgaggaggacaccgacaccccccucuucaucggcaagguccgcacccucgaguuccccuucgucaacggcuccgccgagaucaugucccucguccucgccgaguccucccccggccgcgacuccaccgaguacuucaucgucuucgagccccgccucccccuccucucccgcacccucgagcccuacauccuccccuucauguucuacaacgacgucaagaagcagcagcagauggccgcccucaccaaggagaaggaccagcucucccaguccaucgucauguacaagucccucuucgaggccucccagcagcuccucaacgagaugaagugccaggucgaggaggcccgccucaaggaggcccagcuccgcaacgagcucaagauccacaacaucgacauccccaccacccagcaggucccccacaucgaggcccuccucaagcgcaagcucuccgagcaggaggagcucaagaagaagccccgccgcuccugcacccuccccaacuacaccaagggcuccggcgacguccucggcaagaucgcccaccucgcccagaucgaggacgaccgcgccgccauggucaucuccuggcaccucgccuccgacauggacugcgucgucacccucaccaccgacgccgcccgccgcaucuacgacgagacccagggccgccagcagguccucccccucgacuccaucuacaagaagacccuccccgacuggaagcgcucccucccccacuuccgcaacggcaagcucuacuucaagcccaucggcgaccccgucuucgcccgcgaccuccucaccuuccccgacaacgucgagcacugcgagaccgucuucggcaugcuccucggcgacaccaucauccucgacaaccucgacgccgccaaccacuaccgcaaggaggucgucaagaucacccacugccccacccuccucacccgcgacggcgaccgcauccgcuccaacggcaaguucggcggccuccagaacaaggccccccccauggacaagcuccgcggcauggucuucggcgcccccguccccaagcagugccucauccucggcgagcagaucgaccuccuccagcaguaccgcuccgccgucugcaagcucgacuccgucaacaaggaccucaacucccagcucgaguaccuccgcacccccgacaugcgcaagaagaagcaggagcucgacgagcacgagaagaaccucaagcucaucgaggagaagcucggcaugacccccauccgcaagugcaacgacucccuccgccacucccccaaggucgagaccaccgacugccccgucccccccaagcgcaugcgccgcgaggccacccgccagaaccgcaucaucaccaagaccgacgucuga

SEQ ID NO: 49858 - RNA, 180 nt, Artificial Sequence
  derived and/or modified sequence opt2 from SMCO4__Homo_sapiens__NP_064564
augcgccagcucaagggcaagcccaagaaggagaccuccaaggacaagaaggagcgcaagcaggccaugcaggaggcccgccagcagaucaccaccgucguccuccccacccucgccgucgucguccuccucaucgucgucuucgucuacgucgccacccgccccaccaucaccgaguga

SEQ ID NO: 49859 - RNA, 351 nt, Artificial Sequence
  derived and/or modified sequence opt2 from SMCP__Homo_sapiens__NP_109588
augugcgaccagaccaagcacuccaagugcugccccgccaagggcaaccagugcugccccccccagcagaaccagugcugccaguccaagggcaaccagugcugcccccccaagcagaaccagugcugccagcccaagggcucccagugcugcccccccaagcacaaccacugcugccagcccaagccccccugcugcauccaggcccgcugcugcggccucgagaccaagcccgaggucuccccccucaacauggaguccgagcccaacuccccccagacccaggacaagggcugccagacccagcagcagccccacuccccccagaacgagucccgccccuccaaguga

SEQ ID NO: 49860 - RNA, 2463 nt, Artificial Sequence
  derived and/or modified sequence opt2 from SMEK1__Homo_sapiens__NP_001271209
augaccgacacccgccgccgcgucaaggucuacacccucaacgaggaccgccagugggacgaccgcggcaccggccacgucuccuccggcuacgucgagcgccucaagggcaugucccuccucguccgcgccgaguccgacggcucccuccuccucgaguccaagaucaaccccaacaccgccuaccagaagcagcaggacacccucaucgucugguccgaggccgagaacuacgaccucgcccucuccuuccaggagaaggccggcugcgacgagaucugggagaagaucugccagguccagggcaaggaccccuccgucgacaucacccaggaccucgucgacgaguccgaggaggagcgcuucgacgacauguccucccccggccucgagcuccccuccugcgagcucucccgccucgaggagaucgccgagcucgucgccuccucccuccccuccccccuccgccgcgagaagcucgcccucgcccucgagaacgagggcuacaucaagaagcuccucgagcucuuccacgucugcgaggaccucgagaacaucgagggccuccaccaccucuacgagaucaucaagggcaucuuccuccucaaccgcaccgcccucuucgaggucauguucuccgaggagugcaucauggacgucaucggcugccucgaguacgaccccgcccucucccagccccgcaagcaccgcgaguuccucaccaagaccgccaaguucaaggaggucauccccaucuccgaccccgagcucaagcagaagauccaccagaccuaccgcguccaguacauccaggacaugguccuccccacccccuccgucuucgaggagaacaugcucuccacccuccacuccuucaucuucuucaacaaggucgagaucgucggcaugcuccaggaggacgagaaguuccucaccgaccucuucgcccagcucaccgacgaggccaccgacgaggagaagcgccaggagcucgucaacuuccucaaggaguucugcgccuucucccagacccuccagccccagaaccgcgacgccuucuucaagacccucuccaacaugggcauccuccccgcccucgaggucauccucggcauggacgacacccagguccgcuccgccgccaccgacaucuucuccuaccucgucgaguacaaccccuccaugguccgcgaguucgucaugcaggaggcccagcagaacgacgacgacauccuccucaucaaccucaucaucgagcacaugaucugcgacaccgaccccgagcucggcggcgccguccagcucaugggccuccuccgcacccucgucgaccccgagaacaugcucgccaccgccaacaagaccgagaagaccgaguuccucggcuucuucuacaagcacugcaugcacguccucaccgccccccuccucgccaacaccaccgaggacaagcccuccaaggacgacuuccagaccgcccagcuccucgcccucguccucgagcuccucaccuucugcgucgagcaccacaccuaccacaucaagaacuacaucaucaacaaggacauccuccgccgcguccucguccucauggccuccaagcacgccuuccucgcccucugcgcccuccgcuucaagcgcaagaucaucggccucaaggacgaguucuacaaccgcuacaucaugaaguccuuccucuucgagcccgucgucaaggccuuccucaacaacggcucccgcuacaaccucaugaacuccgccaucaucgagauguucgaguucauccgcgucgaggacaucaagucccucaccgcccacgucaucgagaacuacuggaaggcccucgaggacgucgacuacguccagaccuucaagggccucaagcuccgcuucgagcagcagcgcgagcgccaggacaaccccaagcucgacuccaugcgcuccauccuccgcaaccaccgcuaccgccgcgacgcccgcacccucgaggacgaggaggagaugugguucaacaccgacgaggacgacauggaggacggcgaggccgucgucucccccuccgacaagaccaagaacgacgacgacaucauggaccccaucuccaaguucauggagcgcaagaagcucaaggaguccgaggagaaggagguccuccucaagaccaaccucuccggccgccagucccccuccuucaagcucucccucuccuccggcaccaagaccaaccucaccucccaguccuccaccaccaaccuccccggcucccccggcucccccggcucccccggcucccccggcucccccggcuccguccccaagaacaccucccagaccgccgccaucaccaccaagggcggccucgucggccucgucgacuaccccgacgacgacgaggacgacgacgaggacgaggacaaggaggacacccucccccucuccaagaaggccaaguucgacuccuga

SEQ ID NO: 49861 - RNA, 2550 nt, Artificial Sequence
  derived and/or modified sequence opt2 from SMEK2__Homo_sapiens__NP_001116436
auguccgacacccgccgccgcgucaaggucuacacccucaacgaggaccgccagugggacgaccgcggcaccggccacgucuccuccaccuacgucgaggagcucaagggcaugucccuccucguccgcgccgaguccgacggcucccuccuccucgaguccaagaucaaccccaacaccgccuaccagaagcagcaggacacccucaucgucugguccgaggccgagaacuacgaccucgcccucuccuuccaggagaaggccggcugcgacgagaucugggagaagaucugccagguccagggcaaggaccccuccgucgaggucacccaggaccucaucgacgaguccgaggaggagcgcuucgaggagaugcccgagaccucccaccucaucgaccuccccaccugcgagcucaacaagcucgaggagaucgccgaccucgucaccuccguccucuccucccccauccgccgcgagaagcucgcccucgcccucgagaacgagggcuacaucaagaagcuccuccagcucuuccaggccugcgagaaccucgagaacaccgagggccuccaccaccucuacgagaucauccgcggcauccucuuccucaacaaggccacccucuucgaggucauguucuccgacgagugcaucauggacgucgucggcugccucgaguacgaccccgcccucgcccagcccaagcgccaccgcgaguuccucaccaagaccgccaaguucaaggaggucauccccaucaccgacuccgagcuccgccagaagauccaccagaccuaccgcguccaguacauccaggacaucauccuccccacccccuccgucuucgaggagaacuuccucuccacccucaccuccuucaucuucuucaacaaggucgagaucgucuccaugcuccaggaggacgagaaguuccucuccgaggucuucgcccagcucaccgacgaggccaccgacgacgacaagcgccgcgagcucgucaacuucuucaaggaguucugcgccuucucccagacccuccagccccagaaccgcgacgccuucuucaagacccucgccaagcucggcauccuccccgcccucgagaucgucaugggcauggacgaccuccagguccgcuccgccgccaccgacaucuucuccuaccucgucgaguucucccccuccaugguccgcgaguucgucaugcaggaggcccagcaguccgacgacgacauccuccucaucaacgucgucaucgagcagaugaucugcgacaccgaccccgagcucggcggcgccguccagcucaugggccuccuccgcacccucaucgaccccgagaacaugcucgccaccaccaacaagaccgagaaguccgaguuccucaacuucuucuacaaccacugcaugcacguccucaccgccccccuccucaccaacaccuccgaggacaagugcgagaaggacuucuuccucaagcacuaccgcuacuccugguccuucgucugcacccccucccacucccacucccacuccacccccuccuccuccaucucccaggacaacaucgucggcuccaacaagaacaacaccaucugccccgacaacuaccagaccgcccagcuccucgcccucauccucgagcuccucaccuucugcgucgagcaccacaccuaccacaucaagaacuacaucaugaacaaggaccuccuccgccgcguccucguccucaugaacuccaagcacaccuuccucgcccucugcgcccuccgcuucaugcgccgcaucaucggccucaaggacgaguucuacaaccgcuacaucaccaagggcaaccucuucgagcccgucaucaacgcccuccucgacaacggcacccgcuacaaccuccucaacuccgccgucaucgagcucuucgaguucauccgcgucgaggacaucaagucccucaccgcccacaucgucgagaacuucuacaaggcccucgaguccaucgaguacguccagaccuucaagggccucaagaccaaguacgagcaggagaaggaccgccagaaccagaagcucaacuccguccccuccauccuccgcuccaaccgcuuccgccgcgacgccaaggcccucgaggaggacgaggagaugugguucaacgaggacgaggaggaggagggcaaggccgucgucgcccccgucgagaagcccaagcccgaggacgacuuccccgacaacuacgagaaguucauggagaccaagaaggccaaggaguccgaggacaaggagaaccuccccaagcgcaccucccccggcggcuucaaguucaccuucucccacuccgccuccgccgccaacggcaccaacuccaaguccgucgucgcccagaucccccccgccaccuccaacggcuccuccuccaagaccaccaaccuccccaccuccgucaccgccaccaagggcucccucgucggccucgucgacuaccccgacgacgaggaggaggacgaggaggaggaguccuccccccgcaagcgcccccgccucggcuccuga

SEQ ID NO: 49862 - RNA, 10986 nt, Artificial Sequence
  derived and/or modified sequence opt2 from SMG1__Homo_sapiens__NP_055907
augucccgccgcgcccccggcucccgccucuccuccggcggcggcggcggcggcaccaaguacccccgcuccuggaacgacuggcagccccgcaccgacuccgccuccgccgaccccgacaaccucaaguacuccuccucccgcgaccgcggcggcuccuccuccuacggccuccagcccuccaacuccgccgucgucucccgccagcgccacgacgacacccgcguccacgccgacauccagaacgacgagaagggcggcuacuccgucaacggcggcuccggcgagaacaccuacggccgcaagucccucggccaggagcuccgcgucaacaacgucaccucccccgaguucaccuccguccagcacggcucccgcgcccucgccaccaaggacaugcgcaagucccaggagcgcuccauguccuacuccgacgagucccgccucuccaaccuccuccgccgcaucacccgcgaggacgaccgcgaccgccgccucgccaccgucaagcagcucaaggaguucauccagcagcccgagaacaagcucguccucgucaagcagcucgacaacauccucgccgccguccacgacguccucaacgaguccuccaagcuccuccaggagcuccgccaggagggcgccugcugccucggccuccucugcgccucccucuccuacgaggccgagaagaucuucaaguggaucuucuccaaguucuccuccuccgccaaggacgaggucaagcuccucuaccucugcgccaccuacaaggcccucgagaccgucggcgagaagaaggccuucuccuccgucaugcagcucgucaugaccucccuccaguccauccucgagaacgucgacacccccgagcuccucugcaagugcgucaagugcauccuccucgucgcccgcugcuacccccacaucuucuccaccaacuuccgcgacaccgucgacauccucgucggcuggcacaucgaccacacccagaagcccucccucacccagcaggucuccggcuggcuccagucccucgagcccuucugggucgccgaccucgccuucuccaccacccuccucggccaguuccucgaggacauggaggccuacgccgaggaccucucccacgucgccuccggcgaguccgucgacgaggacguccccccccccuccgucucccuccccaagcucgccgcccuccuccgcgucuucuccaccgucguccgcuccaucggcgagcgcuucucccccauccgcggcccccccaucaccgaggccuacgucaccgacguccucuaccgcgucaugcgcugcgucaccgccgccaaccaggucuucuucuccgaggccguccucaccgccgccaacgagugcgucggcguccuccucggcucccucgaccccuccaugaccauccacugcgacauggucaucaccuacggccucgaccagcucgagaacugccagaccugcggcaccgacuacaucaucuccguccucaaccuccucacccucaucgucgagcagaucaacaccaagcuccccuccuccuucgucgagaagcucuucauccccuccuccaagcuccucuuccuccgcuaccacaaggagaaggaggucgucgccgucgcccacgccgucuaccaggccguccucucccucaagaacauccccguccucgagaccgccuacaagcucauccucggcgagaugaccugcgcccucaacaaccuccuccacucccuccagcuccccgaggccugcuccgagaucaagcacgaggccuucaagaaccacgucuucaacgucgacaacgccaaguucgucgucaucuucgaccucuccgcccucaccaccaucggcaacgccaagaacucccucaucggcaugugggcccucucccccaccgucuucgcccuccucuccaagaaccucaugaucguccacuccgaccucgccguccacuuccccgccauccaguacgccguccucuacacccucuacucccacugcacccgccacgaccacuucaucuccuccucccucuccuccuccucccccucccucuucgacggcgccgucaucuccaccgucaccaccgccaccaagaagcacuucuccaucauccucaaccuccucggcauccuccucaagaaggacaaccucaaccaggacacccgcaagcuccucaugaccugggcccucgaggccgccguccucaugaagaaguccgagaccuacgccccccucuucucccuccccuccuuccacaaguucugcaagggccuccucgccaacacccucgucgaggacgucaacaucugccuccaggccugcuccucccuccacgcccucuccuccucccuccccgacgaccuccuccagcgcugcgucgacgucugccgcguccagcucguccacuccggcacccgcauccgccaggccuucggcaagcuccucaaguccaucccccucgacgucguccucuccaacaacaaccacaccgagauccaggagaucucccucgcccuccgcucccacauguccaaggcccccuccaacaccuuccacccccaggacuucuccgacgucaucuccuucauccucuacggcaacucccaccgcaccggcaaggacaacuggcucgagcgccucuucuacuccugccagcgccucgacaagcgcgaccaguccaccaucccccgcaaccuccucaagaccgacgccguccucuggcagugggccaucugggaggccgcccaguucaccguccucuccaagcuccgcaccccccucggccgcgcccaggacaccuuccagaccaucgagggcaucauccgcucccucgccgcccacacccucaaccccgaccaggacgucucccaguggaccaccgccgacaacgacgagggccacggcaacaaccagcuccgccucguccuccuccuccaguaccucgagaaccucgagaagcucauguacaacgccuacgagggcugcgccaacgcccucaccuccccccccaaggucauccgcaccuucuucuacaccaaccgccagaccugccaggacuggcucacccgcauccgccucuccaucaugcgcgucggccuccucgccggccagcccgccgucaccguccgccacggcuucgaccuccucaccgagaugaagaccaccucccucucccagggcaacgagcucgaggucaccaucaugauggucgucgaggcccucugcgagcuccacugccccgaggccauccagggcaucgccgucugguccuccuccaucgucggcaagaaccuccucuggaucaacuccgucgcccagcaggccgagggccgcuucgagaaggccuccgucgaguaccaggagcaccucugcgccaugaccggcgucgacugcugcaucuccuccuucgacaaguccguccucacccucgccaacgccggccgcaacuccgccucccccaagcacucccucaacggcgagucccgcaagaccguccucuccaagcccaccgacuccucccccgaggucaucaacuaccucggcaacaaggccugcgagugcuacaucuccaucgccgacugggccgccguccaggaguggcagaacgccauccacgaccucaagaaguccaccuccuccaccucccucaaccucaaggccgacuucaacuacaucaagucccucuccuccuucgaguccggcaaguucgucgagugcaccgagcagcucgagcuccuccccggcgagaacaucaaccuccucgccggcggcuccaaggagaagaucgacaugaagaagcuccuccccaacaugcucucccccgacccccgcgagcuccagaaguccaucgagguccagcuccuccgcuccuccgucugccucgccaccgcccucaaccccaucgagcaggaccagaaguggcaguccaucaccgagaacgucgucaaguaccucaagcagaccucccgcaucgccaucggcccccuccgccucuccacccucaccgucucccagucccuccccguccucuccacccuccagcucuacugcuccuccgcccucgagaacaccgucuccaaccgccucuccaccgaggacugccucaucccccucuucuccgaggcccuccgcuccugcaagcagcacgacguccgccccuggaugcaggcccuccgcuacaccauguaccagaaccagcuccucgagaagaucaaggagcagaccguccccauccgcucccaccucauggagcucggccucaccgccgccaaguucgcccgcaagcgcggcaacgucucccucgccacccgccuccucgcccagugcuccgagguccagcucggcaagaccaccaccgcccaggaccucguccagcacuucaagaagcucuccacccagggccaggucgacgagaaguggggccccgagcucgacaucgagaagaccaagcuccucuacaccgccggccaguccacccacgccauggagaugcucuccuccugcgccaucuccuucugcaaguccgucaaggccgaguacgccgucgccaaguccauccucacccucgccaaguggauccaggccgaguggaaggagaucuccggccagcucaagcaggucuaccgcgcccagcaccagcagaacuucaccggccucuccacccucuccaagaacauccucacccucaucgagcuccccuccgucaacaccauggaggaggaguacccccgcaucgaguccgaguccaccguccacaucggcgucggcgagcccgacuucauccucggccagcucuaccaccucuccuccguccaggcccccgaggucgccaaguccugggccgcccucgccuccugggccuaccgcuggggccgcaaggucgucgacaacgccucccagggcgagggcguccgccuccucccccgcgagaaguccgagguccagaaccuccuccccgacaccaucaccgaggaggagaaggagcgcaucuacggcauccucggccaggccgucugccgccccgccggcauccaggacgaggacaucacccuccagaucaccgaguccgaggacaacgaggaggacgacauggucgacgucaucuggcgccagcucaucuccuccugccccuggcucuccgagcucgacgaguccgccaccgagggcgucaucaaggucuggcgcaaggucgucgaccgcaucuucucccucuacaagcucuccugcuccgccuacuucaccuuccucaagcucaacgccggccagaucccccucgacgaggacgacccccgccuccaccucucccaccgcgucgagcaguccaccgacgacaugaucgucauggccacccuccgccuccuccgccuccucgucaagcacgccggcgagcuccgccaguaccucgagcacggccucgagaccacccccaccgcccccuggcgcggcaucaucccccagcucuucucccgccucaaccaccccgaggucuacguccgccaguccaucugcaaccuccucugccgcgucgcccaggacuccccccaccucauccucuaccccgccaucgucggcaccaucucccucuccuccgagucccaggccuccggcaacaaguucuccaccgccauccccacccuccucggcaacauccagggcgaggagcuccucgucuccgagugcgagggcggcuccccccccgccucccaggacuccaacaaggacgagcccaaguccggccucaacgaggaccaggccaugaugcaggacugcuacuccaagaucgucgacaagcucuccuccgccaaccccaccaugguccuccagguccagaugcucgucgccgagcuccgccgcgucaccguccucugggacgagcucuggcucggcguccuccuccagcagcacauguacguccuccgccgcauccagcagcucgaggacgaggucaagcgcguccagaacaacaacacccuccgcaaggaggagaagaucgccaucaugcgcgagaagcacaccgcccucaugaagcccaucgucuucgcccucgagcacguccgcuccaucaccgccgcccccgccgagaccccccacgagaagugguuccaggacaacuacggcgacgccaucgagaacgcccucgagaagcucaagaccccccucaaccccgccaagcccggcuccuccuggauccccuucaaggagaucaugcucucccuccagcagcgcgcccagaagcgcgccuccuacauccuccgccucgaggagaucucccccuggcucgccgccaugaccaacaccgagaucgcccuccccggcgaggucuccgcccgcgacaccgucaccauccacuccgucggcggcaccaucaccauccuccccaccaagaccaagcccaagaagcuccucuuccucggcuccgacggcaaguccuaccccuaccucuucaagggccucgaggaccuccaccucgacgagcgcaucaugcaguuccucuccaucgucaacaccauguucgccaccaucaaccgccaggagaccccccgcuuccacgcccgccacuacuccgucaccccccucggcacccgcuccggccucauccagugggucgacggcgccaccccccucuucggccucuacaagcgcuggcagcagcgcgaggccgcccuccaggcccagaaggcccaggacuccuaccagaccccccagaaccccggcaucgucccccgccccuccgagcucuacuacuccaagaucggccccgcccucaagaccgucggccucucccucgacgucucccgccgcgacuggccccuccacgucaugaaggccguccucgaggagcucauggaggccaccccccccaaccuccucgccaaggagcucugguccuccugcaccacccccgacgagugguggcgcgucacccaguccuacgcccgcuccaccgccgucauguccauggucggcuacaucaucggccucggcgaccgccaccucgacaacguccucaucgacaugaccaccggcgaggucguccacaucgacuacaacgucugcuucgagaagggcaagucccuccgcguccccgagaagguccccuuccgcaugacccagaacaucgagaccgcccucggcgucaccggcgucgagggcgucuuccgccucuccugcgagcagguccuccacaucaugcgccgcggccgcgagacccuccucacccuccucgaggccuucgucuacgacccccucgucgacuggaccgccggcggcgaggccggcuucgccggcgccgucuacggcggcggcggccagcaggccgaguccaagcaguccaagcgcgagauggagcgcgagaucacccgcucccucuucuccucccgcgucgccgagaucaaggucaacugguucaagaaccgcgacgagaugcucgucguccuccccaagcucgacggcucccucgacgaguaccucucccuccaggagcagcucaccgacgucgagaagcuccagggcaagcuccucgaggagaucgaguuccucgagggcgccgagggcgucgaccaccccucccacacccuccagcaccgcuacuccgagcacacccagcuccagacccagcagcgcgccguccaggaggccauccaggucaagcucaacgaguucgagcaguggaucacccacuaccaggccgccuucaacaaccucgaggccacccagcucgccucccuccuccaggagaucuccacccagauggaccucggcccccccuccuacguccccgccaccgccuuccuccagaacgccggccaggcccaccucaucucccagugcgagcagcucgagggcgaggucggcgcccuccuccagcagcgccgcuccguccuccgcggcugccucgagcagcuccaccacuacgccaccgucgcccuccaguaccccaaggccaucuuccagaagcaccgcaucgagcaguggaagaccuggauggaggagcucaucugcaacaccaccgucgagcgcugccaggagcucuaccgcaaguacgagaugcaguacgccccccagcccccccccaccgucugccaguucaucaccgccaccgagaugacccuccagcgcuacgccgccgacaucaacucccgccucauccgccaggucgagcgccucaagcaggaggccgucaccguccccgucugcgaggaccagcucaaggagaucgagcgcugcaucaaggucuuccuccacgagaacggcgaggagggcucccucucccucgccuccgucaucaucuccgcccucugcacccucacccgccgcaaccucaugauggagggcgccgccuccuccgccggcgagcagcucgucgaccucaccucccgcgacggcgccugguuccucgaggagcucugcuccauguccggcaacgucaccugccucguccagcuccucaagcagugccaccucgucccccaggaccucgacauccccaaccccauggaggccuccgagaccguccaccucgccaacggcgucuacaccucccuccaggagcucaacuccaacuuccgccagaucaucuuccccgaggcccuccgcugccucaugaagggcgaguacacccucgaguccaugcuccacgagcucgacggccucaucgagcagaccaccgacggcgucccccuccagacccucgucgagucccuccaggccuaccuccgcaacgccgccaugggccucgaggaggagacccacgcccacuacaucgacgucgcccgccuccuccacgcccaguacggcgagcucauccagccccgcaacggcuccgucgacgagacccccaagauguccgccggccagaugcuccucgucgccuucgacggcauguucgcccaggucgagaccgccuucucccuccucgucgagaagcucaacaagauggagauccccaucgccuggcgcaagaucgacaucauccgcgaggcccgcuccacccaggucaacuucuucgacgacgacaaccaccgccagguccucgaggagaucuucuuccucaagcgccuccagaccaucaaggaguucuuccgccucugcggcaccuucuccaagacccucuccggcuccuccucccucgaggaccagaacaccgucaacggccccguccagaucgucaacgucaagacccucuuccgcaacuccugcuucuccgaggaccagauggccaagcccaucaaggccuucaccgccgacuucguccgccagcuccucaucggccuccccaaccaggcccucggccucacccucugcuccuucaucuccgcccucggcgucgacaucaucgcccaggucgaggccaaggacuucggcgccgaguccaaggucuccgucgacgaccucugcaagaaggccgucgagcacaacauccagaucggcaaguucucccagcucgucaugaaccgcgccaccguccucgccuccuccuacgacaccgccuggaagaagcacgaccucguccgccgccucgagaccuccaucuccuccugcaagaccucccuccagcgcguccagcuccacaucgccauguuccaguggcagcacgaggaccuccucaucaaccgcccccaggccauguccgucaccccccccccccgcuccgccauccucaccuccaugaagaagaagcuccacacccucucccagaucgagaccuccaucgccaccguccaggagaagcucgccgcccucgaguccuccaucgagcagcgccucaagugggccggcggcgccaaccccgcccucgcccccguccuccaggacuucgaggccaccaucgccgagcgccgcaaccucguccucaaggagucccagcgcgccucccaggucaccuuccucugcuccaacaucauccacuucgagucccuccgcacccgcaccgccgaggcccucaaccucgacgccgcccucuucgagcucaucaagcgcugccagcagaugugcuccuucgccucccaguucaacuccuccgucuccgagcucgagcuccgccuccuccagcgcgucgacaccggccucgagcaccccaucggcuccuccgaguggcuccucuccgcccacaagcagcucacccaggacauguccacccagcgcgccauccagaccgagaaggagcagcagaucgagaccgucugcgagaccauccagaaccucgucgacaacaucaagaccguccucaccggccacaaccgccagcucggcgacgucaagcaccuccucaaggccauggccaaggacgaggaggccgcccucgccgacggcgaggacguccccuacgagaacuccguccgccaguuccucggcgaguacaaguccuggcaggacaacauccagaccguccucuucacccucguccaggccaugggccagguccgcucccaggagcacgucgagaugcuccaggagaucacccccacccucaaggagcucaagacccagucccaguccaucuacaacaaccucgucuccuucgccuccccccucgucaccgacgccaccaacgagugcuccucccccaccuccuccgccaccuaccagcccuccuucgccgccgccguccgcuccaacaccggccagaagacccagcccgacgucaugucccagaacgcccgcaagcucauccagaagaaccucgccaccuccgccgacaccccccccuccaccguccccggcaccggcaaguccgucgccugcucccccaagaaggccguccgcgaccccaagaccggcaaggccguccaggagcgcaacuccuacgccgucuccgucuggaagcgcgucaaggccaagcucgagggccgcgacgucgaccccaaccgccgcauguccgucgccgagcaggucgacuacgucaucaaggaggccaccaaccucgacaaccucgcccagcucuacgagggcuggaccgccugggucuga

SEQ ID NO: 49863 - RNA, 993 nt, Artificial Sequence
  derived and/or modified sequence opt2 from SMG6__Homo_sapiens__NP_001269255
augcgcuuccgccucugccaccagcgcggcugcugcccccacgagcgcgagaacaccugcaccugcaagaugaucaucuccucccuccaggucaucgccgccgacugcaagcgcgucaccguccucaaguacuuccucgaggcccucugcggccaggaggagccccuccucgccuucaagggcggcaaguacgucuccgucgcccccguccccgacaccaugggcaaggagaugggcucccaggagggcacccgccucgaggacgaggaggaggacgucgucaucgaggacuucgaggaggacuccgaggccgagggcuccggcggcgaggacgacauccgcgagcuccgcgccaagaagcucgcccucgcccgcaagaucgccgagcagcagcgccgccaggagaagauccaggccguccucgaggaccacucccagaugcgccagauggagcucgagauccgcccccucuuccucguccccgacaccaacggcuucaucgaccaccucgccucccucgcccgccuccucgagucccgcaaguacauccucgucgucccccucaucgucaucaacgagcucgacggccucgccaagggccaggagaccgaccaccgcgccggcggcuacgcccgcgucguccaggagaaggcccgcaaguccaucgaguuccucgagcagcgcuucgagucccgcgacuccugccuccgcgcccucaccucccgcggcaacgagcucgaguccaucgccuuccgcuccgaggacaucaccggccagcucggcaacaacgacgaccucauccucuccugcugccuccacuacugcaaggacaaggccaaggacuucaugcccgccuccaaggaggagcccauccgccuccuccgcgaggucguccuccucaccgacgaccgcaaccuccgcgucaaggcccucacccgcaacguccccguccgcgacauccccgccuuccucaccugggcccaggucggcuga

SEQ ID NO: 49864 - RNA, 2976 nt, Artificial Sequence
  derived and/or modified sequence opt2 from SMG8__Homo_sapiens__NP_060619
auggccggccccgucucccuccgcgaccuccucaugggcgccuccgccuggaugggcuccgagucccccggcggcucccccaccgagggcggcggcuccgccgccggcggccccgagccccccuggcgcgaggacgagaucugcgucgucggcaucuucggcaagaccgcccuccgccucaacuccgagaaguucucccucgucaacaccgucugcgaccgccaggucuucccccucuuccgccaccaggaccccggcgaccccggccccggcauccgcaccgaggccggcgccgucggcgaggccggcggcgccgaggaccccggcgccgccgccggcggcuccguccgcggcuccggcgccgucgccgagggcaaccgcaccgaggccggcucccaggacuacucccuccuccaggccuacuacucccaggaguccaagguccucuaccuccuccucaccuccaucugcgacaacucccagcuccuccgcgccugccgcgcccuccaguccggcgaggccggcggcggccucucccucccccacgccgaggcccacgaguucuggaagcaccaggagaagcuccagugccucucccuccucuaccucuucuccgucugccacauccuccuccucguccaccccaccugcuccuucgacaucaccuacgaccgcgucuuccgcgcccucgacggccuccgccagaagguccucccccuccucaagaccgccaucaaggacugccccgucggcaaggacuggaagcucaacugccgccccugccccccccgccuccucuuccucuuccagcucaacggcgcccucaaggucgagcccccccgcaaccaggaccccgcccaccccgacaagcccaagaagcacucccccaagcgccgccuccagcacgcccucgaggaccagaucuaccgcaucuuccgcaagucccgcguccucaccaaccaguccaucaacugccucuucaccguccccgccaaccaggccuucgucuacaucguccccggcucccaggaggaggaccccgucggcaugcuccucgaccagcuccgcucccacugcaccgucaaggaccccgagucccuccucguccccgccccccucuccggcccccgccgcuaccaggucaugcgccagcacucccgccagcagcucuccuuccacaucgacuccuccuccuccuccuccuccggccagcucgucgacuucacccuccgcgaguuccucuggcagcacgucgagcucguccucuccaagaagggcuucgacgacuccgucggccgcaacccccagcccucccacuucgagcuccccaccuaccagaaguggaucuccgccgccuccaagcucuacgaggucgccaucgacggcaaggaggaggaccucggcucccccaccggcgagcucaccuccaagauccucuccuccaucaagguccucgagggcuuccucgacaucgacaccaaguucuccgagaaccgcugccagaaggcccuccccauggcccacuccgccuaccaguccaaccucccccacaacuacaccaugaccguccacaagaaccagcucgcccaggcccuccgcgucuacucccagcacgcccgcggccccgccuuccacaaguacgccaugcagcuccacgaggacugcuacaaguucugguccaacggccaccagcucugcgaggagcgcucccucaccgaccagcacugcguccacaaguuccacucccuccccaaguccggcgagaagcccgaggccgaccgcaacccccccguccucuaccacaacucccgcgcccgcuccaccggcgccugcaacugcggccgcaagcaggccccccgcgacgaccccuucgacaucaaggccgccaacuacgacuucuaccagcuccucgaggagaagugcugcggcaagcucgaccacaucaacuuccccgucuucgagcccuccacccccgaccccgcccccgccaagaacgaguccucccccgccccccccgacuccgacgccgacaagcucaaggagaaggagccccagacccagggcgaguccaccucccucucccucgcccucucccucggccaguccaccgacucccucggcaccuaccccgccgacccccaggccggcggcgacaaccccgagguccacggccaggucgaggucaagaccgagaagcgccccaacuucgucgaccgccaggccuccaccgucgaguaccuccccggcaugcuccacuccaacugccccaagggccuccuccccaaguucuccuccuggucccucgucaagcucggccccgccaaguccuacaacuuccacaccggccucgaccagcagggcuucauccccggcaccaacuaccucaugcccugggacaucgucauccgcacccgcgccgaggacgagggcgaccucgacaccaacuccuggcccgcccccaacaaggccauccccggcaagcgcuccgccgucgucaugggccgcggccgccgccgcgacgacaucgcccgcgccuucgucggcuucgaguacgaggacucccgcggccgccgcuucaugugcuccggccccgacaaggucaugaaggucaugggcuccggccccaaggaguccgcccucaaggcccucaacuccgacaugccccucuacauccucuccuccucccagggccgcggccucaagccccacuacgcccagcucaugcgccucuucgucgucguccccgacgccccccuccagaucauccucaugccccagguccagcccggccccccccccugccccgucuucuaccccgagaagcaggagaucacccucccccccgacggccucuggguccuccgcuuccccuacgccuacgucaccgagcgcggccccugcuucccccccaaggagaacguccagcucauguccuacaagguccuccgcggcguccucaaggccgucacccaguga

SEQ ID NO: 49865 - RNA, 225 nt, Artificial Sequence
  derived and/or modified sequence opt2 from SMIM15__Homo_sapiens__NP_001041714
auguucgacaucaaggccugggccgaguacgucgucgagugggccgccaaggaccccuacggcuuccucaccaccgucauccucgcccucaccccccucuuccucgccuccgccguccucuccuggaagcucgccaagaugaucgaggcccgcgagaaggagcagaagaagaagcagaagcgccaggagaacaucgccaaggccaagcgccucaagaaggacuga

SEQ ID NO: 49866 - RNA, 324 nt, Artificial Sequence
  derived and/or modified sequence opt2 from SMIM19__Homo_sapiens__NP_001129148
auggccggcggcuacggcgucaugggcgacgacggcuccaucgacuacaccguccacgaggccuggaacgaggccaccaacgucuaccucaucgucauccucgucuccuucggccucuucauguacgccaagcgcaacaagcgccgcaucaugcgcaucuucuccgucccccccaccgaggagacccucuccgagcccaacuucuacgacaccaucuccaagauccgccuccgccagcagcucgagauguacuccaucucccgcaaguacgacuaccagcagccccagaaccaggccgacuccguccagcucucccucgaguga

SEQ ID NO: 49867 - RNA, 204 nt, Artificial Sequence
  derived and/or modified sequence opt2 from SMIM20__Homo_sapiens__NP_001138904
augucccgcaaccuccgcaccgcccucaucuucggcggcuucaucucccucaucggcgccgccuucuaccccaucuacuuccgcccccucaugcgccucgaggaguacaagaaggagcaggccaucaaccgcgccggcaucguccaggaggacguccagccccccggccucaaggucugguccgaccccuucggccgcaaguga

SEQ ID NO: 49868 - RNA, 306 nt, Artificial Sequence
  derived and/or modified sequence opt2 from SMIM21__Homo_sapiens__NP_001032408
auggaccaguacgucuccaccgcccccccccgcuuccccaucgcccagcucggcaccuucaagcaggacuccgccggcaugggccgcaucuucaagggcaaccuccuccagaagaaggcccucaccaccuucgagaacgagcaccacauccgcuucuucacccuccucguccucuuccacgucaugguccuccuccgcaaccacucccgcauccagggcgucuccgaggacuggaagcgcgccaacuccaucuuccgcaacuuccuccgccucaaguccucccgcaacaccgccgaggccgaguga

SEQ ID NO: 49869 - RNA, 519 nt, Artificial Sequence
  derived and/or modified sequence opt2 from SMIM23__Homo_sapiens__NP_001276899
auggccacccagcaggucgacucccgccgccaggucgccgccgagcaggucgccgcccagcuccucgagcgccgccgcggcucccacugcgacgacgagaagcagacccuccucgcccuccucauccucguccucuaccucuccaccgagaucuggggcuccuccugggaggucuccgagcgcauccgcgagugcaacuacuaccagaaccucgccgucccccagggccucgaguaccagaccaacgagcccuccgaggagcccaucaagaccauccgcaacuggcucaaggagaagcuccacgucuucuccgagaagcucgaggaggagguccagcagcucgagcagcucgccugggaccucgagcucuggcucgacgcccuccucggcgagccccaccaggaggagcacugcuccaccuacaagucccaccucugggagugggccugggcccucggccgcgagcacaagggcggcgagggccuccucgagaucucccucuccggcgccgagcucuga

SEQ ID NO: 49870 - RNA, 720 nt, Artificial Sequence
  derived and/or modified sequence opt2 from SMIM5__Homo_sapiens__XP_011523418
augcgccgccucgccggccgcgccggccacucccaggucacccaggacuccaaguucucccccaagacccccuccgacgccgagcgccacaagggccucccccgcgacuggcuccagucccuccuccucucccuccgcggcccccccgccccccacugccuccuccucuuccuccgcgaggcccgcggccgcgaccagcccggcuccggccagcgcgaccgccgcggcggccuccccgagggccgcgucggcgcccccgaccuccgcgcccuccaggacucccccccccaggcccaggucgagcccccccagggcccccccggccaggagggccgcgagcccaccuccuucuucuccucccagccccgccccuccccccgccgcggcucccgcggcgagggcgaggaggaggagggcggcggcgagcgcgagcucguccucucccucuccuccgcccuccgcgccgaggacgaccagcagcagaagucccaggccgagaccgccgccggcugccagcagcgcuccugggccgaggccccccgcggcgccgccgcccccaccaaggagguccgcggccagcacgucgaggccccccgcuggggcaccgccgcccagccccccacccccgagcuccccggcgccuggcccacccacugcuggugcucccagcucaccgcccagcccggcuccuccucccucggccccucccgcacccccuga

SEQ ID NO: 49871 - RNA, 885 nt, Artificial Sequence
  derived and/or modified sequence opt2 from SMN2__Homo_sapiens__NP_059107
auggccauguccuccggcggcuccggcggcggcguccccgagcaggaggacuccguccucuuccgccgcggcaccggccaguccgacgacuccgacaucugggacgacaccgcccucaucaaggccuacgacaaggccgucgccuccuucaagcacgcccucaagaacggcgacaucugcgagaccuccggcaagcccaagaccacccccaagcgcaagcccgccaagaagaacaagucccagaagaagaacaccgccgccucccuccagcaguggaaggucggcgacaagugcuccgccaucugguccgaggacggcugcaucuaccccgccaccaucgccuccaucgacuucaagcgcgagaccugcgucgucgucuacaccggcuacggcaaccgcgaggagcagaaccucuccgaccuccucucccccaucugcgaggucgccaacaacaucgagcagaacgcccaggagaacgagaacgagucccaggucuccaccgacgaguccgagaacucccgcucccccggcaacaaguccgacaacaucaagcccaaguccgcccccuggaacuccuuccuccccccccccccccccaugcccggcccccgccucggccccggcaagcccggccucaaguucaacggccccccccccccccccccccccccccccccccaccuccucuccugcuggcucccccccuuccccuccggcccccccaucauccccccccccccccccaucugccccgacucccucgacgacgccgacgcccucggcuccaugcucaucuccugguacauguccggcuaccacaccggcuacuacaugggcuuccgccagaaccagaaggagggccgcugcucccacucccucaacuga

SEQ ID NO: 49872 - RNA, 1308 nt, Artificial Sequence
  derived and/or modified sequence opt2 from SMOC1__Homo_sapiens__NP_001030024
augcuccccgcccgcugcgcccgccuccucaccccccaccuccuccucguccucguccagcucucccccgcccgcggccaccgcaccaccggcccccgcuuccucaucuccgaccgcgacccccagugcaaccuccacugcucccgcacccagcccaagcccaucugcgccuccgacggccgcuccuacgaguccaugugcgaguaccagcgcgccaagugccgcgaccccacccucggcgucguccaccgcggccgcugcaaggacgccggccaguccaagugccgccucgagcgcgcccaggcccucgagcaggccaagaagccccaggaggccgucuucguccccgagugcggcgaggacggcuccuucacccagguccagugccacaccuacaccggcuacugcuggugcgucacccccgacggcaagcccaucuccggcuccuccguccagaacaagacccccgucugcuccggcuccgucaccgacaagccccucucccagggcaacuccggccgcaaggacgacggcuccaagcccacccccaccauggagacccagcccgucuucgacggcgacgagaucaccgcccccacccucuggaucaagcaccucgucaucaaggacuccaagcucaacaacaccaacauccgcaacuccgagaaggucuacuccugcgaccaggagcgccaguccgcccucgaggaggcccagcagaacccccgcgagggcaucgucauccccgagugcgcccccggcggccucuacaagcccguccagugccaccaguccaccggcuacugcuggugcguccucgucgacaccggccgcccccuccccggcaccuccacccgcuacgucaugcccuccugcgaguccgacgcccgcgccaagaccaccgaggccgacgaccccuucaaggaccgcgagcuccccggcugccccgagggcaagaagauggaguucaucaccucccuccucgacgcccucaccaccgacaugguccaggccaucaacuccgccgcccccaccggcggcggccgcuucuccgagcccgaccccucccacacccucgaggagcgcgucguccacugguacuucucccagcucgacuccaacuccuccaacgacaucaacaagcgcgagaugaagcccuucaagcgcuacgucaagaagaaggccaagcccaagaagugcgcccgccgcuucaccgacuacugcgaccucaacaaggacaaggucaucucccuccccgagcucaagggcugccucggcgucuccaaggaggucggccgccucgucuga

SEQ ID NO: 49873 - RNA, 1341 nt, Artificial Sequence
  derived and/or modified sequence opt2 from SMOC2__Homo_sapiens__NP_001159884
augcuccucccccagcucugcuggcucccccuccucgccggccuccucccccccguccccgcccagaaguucuccgcccucaccuuccuccgcgucgaccaggacaaggacaaggacugcucccucgacugcgccggcuccccccagaagccccucugcgccuccgacggccgcaccuuccucucccgcugcgaguuccagcgcgccaagugcaaggacccccagcucgagaucgccuaccgcggcaacugcaaggacgucucccgcugcgucgccgagcgcaaguacacccaggagcaggcccgcaaggaguuccagcaggucuucauccccgagugcaacgacgacggcaccuacucccagguccagugccacuccuacaccggcuacugcuggugcgucacccccaacggccgccccaucuccggcaccgccgucgcccacaagaccccccgcugccccggcuccgucaacgagaagcucccccagcgcgagggcaccggcaagaccgacgacgccgccgcccccgcccucgagacccagccccagggcgacgaggaggacaucgccucccgcuaccccacccucuggaccgagcaggucaagucccgccagaacaagaccaacaagaacuccgucuccuccugcgaccaggagcaccaguccgcccucgaggaggccaagcagcccaagaacgacaacgucgucauccccgagugcgcccacggcggccucuacaagcccguccagugccaccccuccaccggcuacugcuggugcguccucgucgacaccggccgccccauccccggcaccuccacccgcuacgagcagcccaagugcgacaacaccgcccgcgcccaccccgccaaggcccgcgaccucuacaagggccgccagcuccagggcugccccggcgccaagaagcacgaguuccucaccuccguccucgacgcccucuccaccgacaugguccacgccgccuccgaccccuccuccuccuccggccgccucuccgagcccgaccccucccacacccucgaggagcgcgucguccacugguacuucaagcuccucgacaagaacuccuccggcgacaucggcaagaaggagaucaagcccuucaagcgcuuccuccgcaagaaguccaagcccaagaagugcgucaagaaguucgucgaguacugcgacgucaacaacgacaaguccaucuccguccaggagcucaugggcugccucggcgucgccaaggaggacggcaaggccgacaccaagaagcgccacaccccccgcggccacgccgaguccaccuccaaccgccagccccgcaagcagggcuga

SEQ ID NO: 49874 - RNA, 2364 nt, Artificial Sequence
  derived and/or modified sequence opt2 from SMO__Homo_sapiens__NP_005622
auggccgccgcccgccccgcccgcggccccgagcucccccuccucggccuccuccuccuccuccuccucggcgaccccggccgcggcgccgccuccuccggcaacgccaccggccccggcccccgcuccgccggcggcuccgcccgccgcuccgccgccgucaccggccccccccccccccucucccacugcggccgcgccgcccccugcgagccccuccgcuacaacgucugccucggcuccguccuccccuacggcgccaccuccacccuccucgccggcgacuccgacucccaggaggaggcccacggcaagcucguccucugguccggccuccgcaacgccccccgcugcugggccgucauccagccccuccucugcgccgucuacaugcccaagugcgagaacgaccgcgucgagcuccccucccgcacccucugccaggccacccgcggccccugcgccaucgucgagcgcgagcgcggcuggcccgacuuccuccgcugcacccccgaccgcuuccccgagggcugcaccaacgagguccagaacaucaaguucaacuccuccggccagugcgaggucccccucguccgcaccgacaaccccaaguccugguacgaggacgucgagggcugcggcauccagugccagaacccccucuucaccgaggccgagcaccaggacaugcacuccuacaucgccgccuucggcgccgucaccggccucugcacccucuucacccucgccaccuucgucgccgacuggcgcaacuccaaccgcuaccccgccgucauccucuucuacgucaacgccugcuucuucgucggcuccaucggcuggcucgcccaguucauggacggcgcccgccgcgagaucgucugccgcgccgacggcaccaugcgccucggcgagcccaccuccaacgagacccucuccugcgucaucaucuucgucaucgucuacuacgcccucauggccggcgucgucugguucgucguccucaccuacgccuggcacaccuccuucaaggcccucggcaccaccuaccagccccucuccggcaagaccuccuacuuccaccuccucaccuggucccuccccuucguccucaccgucgccauccucgccgucgcccaggucgacggcgacuccgucuccggcaucugcuucgucggcuacaagaacuaccgcuaccgcgccggcuucguccucgcccccaucggccucguccucaucgucggcggcuacuuccucauccgcggcgucaugacccucuucuccaucaaguccaaccaccccggccuccucuccgagaaggccgccuccaagaucaacgagaccaugcuccgccucggcaucuucggcuuccucgccuucggcuucguccucaucaccuucuccugccacuucuacgacuucuucaaccaggccgagugggagcgcuccuuccgcgacuacguccucugccaggccaacgucaccaucggccuccccaccaagcagcccauccccgacugcgagaucaagaaccgccccucccuccucgucgagaagaucaaccucuucgccauguucggcaccggcaucgccauguccaccugggucuggaccaaggccacccuccucaucuggcgccgcaccuggugccgccucaccggccaguccgacgacgagcccaagcgcaucaagaaguccaagaugaucgccaaggccuucuccaagcgccacgagcuccuccagaaccccggccaggagcucuccuucuccaugcacaccgucucccacgacggccccgucgccggccucgccuucgaccucaacgagcccuccgccgacgucuccuccgccugggcccagcacgucaccaagauggucgcccgccgcggcgccauccucccccaggacaucuccgucacccccgucgccacccccgucccccccgaggagcaggccaaccucuggcucgucgaggccgagaucucccccgagcuccagaagcgccucggccgcaagaagaagcgccgcaagcgcaagaaggaggucugcccccucgcccccccccccgagcuccacccccccgcccccgcccccuccaccaucccccgccucccccagcucccccgccagaagugccucgucgccgccggcgccuggggcgccggcgacuccugccgccagggcgccuggacccucgucuccaaccccuucugccccgagcccucccccccccaggaccccuuccuccccuccgcccccgcccccgucgccugggcccacggccgccgccagggccucggccccauccacucccgcaccaaccucauggacaccgagcucauggacgccgacuccgacuucuga

SEQ ID NO: 49875 - RNA, 1668 nt, Artificial Sequence
  derived and/or modified sequence opt2 from SMOX__Homo_sapiens__NP_787033
augcaguccugcgaguccuccggcgacuccgccgacgacccccucucccgcggccuccgccgccgcggccagccccgcgucgucgucaucggcgccggccucgccggccucgccgccgccaaggcccuccucgagcagggcuucaccgacgucaccguccucgaggccuccucccacaucggcggccgcguccaguccgucaagcucggccacgccaccuucgagcucggcgccaccuggauccacggcucccacggcaaccccaucuaccaccucgccgaggccaacggccuccucgaggagaccaccgacggcgagcgcuccgucggccgcaucucccucuacuccaagaacggcgucgccugcuaccucaccaaccacggccgccgcauccccaaggacgucgucgaggaguucuccgaccucuacaacgaggucuacaaccucacccaggaguucuuccgccacgacaagcccgucaacgccgagucccagaacuccgucggcgucuucacccgcgaggagguccgcaaccgcauccgcaacgaccccgacgaccccgaggccaccaagcgccucaagcucgccaugauccagcaguaccucaaggucgaguccugcgaguccuccucccacuccauggacgaggucucccucuccgccuucggcgaguggaccgagauccccggcgcccaccacaucauccccuccggcuucaugcgcgucgucgagcuccucgccgagggcauccccgcccacgucauccagcucggcaagcccguccgcugcauccacugggaccaggccuccgcccgcccccgcggccccgagaucgagccccgcggcgagggcgaccacaaccacgacaccggcgagggcggccagggcggcgaggagccccgcggcggccgcugggacgaggacgagcagugguccgucgucgucgagugcgaggacugcgagcucauccccgccgaccacgucaucgucaccgucucccucggcguccucaagcgccaguacaccuccuucuuccgccccggccuccccaccgagaaggucgccgccauccaccgccucggcaucggcaccaccgacaagaucuuccucgaguucgaggagcccuucuggggccccgagugcaacucccuccaguucgucugggaggacgaggccgagucccacacccucaccuacccccccgagcucugguaccgcaagaucugcggcuucgacguccucuacccccccgagcgcuacggccacguccucuccggcuggaucugcggcgaggaggcccucgucauggagaagugcgacgacgaggccgucgccgagaucugcaccgagaugcuccgccaguucaccggcaaccccaacauccccaagccccgccgcauccuccgcuccgccuggggcuccaaccccuacuuccgcggcuccuacuccuacacccaggucggcuccuccggcgccgacgucgagaagcucgccaagccccuccccuacaccgaguccuccaagaccgcccccaugcagguccucuucuccggcgaggccacccaccgcaaguacuacuccaccacccacggcgcccuccucuccggccagcgcgaggccgcccgccucaucgagauguaccgcgaccucuuccagcagggcaccuga

SEQ ID NO: 49876 - RNA, 1896 nt, Artificial Sequence
  derived and/or modified sequence opt2 from SMPD1__Homo_sapiens__NP_000534
augccccgcuacggcgccucccuccgccaguccugcccccgcuccggccgcgagcagggccaggacggcaccgccggcgcccccggccuccucuggaugggccucguccucgcccucgcccucgcccucgcccucgcccucgcccucuccgacucccgcguccucugggcccccgccgaggcccacccccucuccccccagggccaccccgcccgccuccaccgcaucgucccccgccuccgcgacgucuucggcuggggcaaccucaccugccccaucugcaagggccucuucaccgccaucaaccucggccucaagaaggagcccaacgucgcccgcgucggcuccgucgccaucaagcucugcaaccuccucaagaucgccccccccgccgucugccaguccaucguccaccucuucgaggacgacauggucgaggucuggcgccgcuccguccucucccccuccgaggccugcggccuccuccucggcuccaccugcggccacugggacaucuucuccuccuggaacaucucccuccccaccguccccaagcccccccccaagccccccuccccccccgcccccggcgcccccgucucccgcauccucuuccucaccgaccuccacugggaccacgacuaccucgagggcaccgaccccgacugcgccgacccccucugcugccgccgcggcuccggccucccccccgccucccgccccggcgccggcuacuggggcgaguacuccaagugcgaccucccccuccgcacccucgagucccuccucuccggccucggccccgccggccccuucgacauggucuacuggaccggcgacauccccgcccacgacgucuggcaccagacccgccaggaccagcuccgcgcccucaccaccgucaccgcccucguccgcaaguuccucggccccguccccgucuaccccgccgucggcaaccacgaguccacccccgucaacuccuuccccccccccuucaucgagggcaaccacuccucccgcuggcucuacgaggccauggccaaggccugggagcccuggcuccccgccgaggcccuccgcacccuccgcaucggcggcuucuacgcccucucccccuaccccggccuccgccucaucucccucaacaugaacuucugcucccgcgagaacuucuggcuccucaucaacuccaccgaccccgccggccagcuccaguggcucgucggcgagcuccaggccgccgaggaccgcggcgacaagguccacaucaucggccacaucccccccggccacugccucaaguccugguccuggaacuacuaccgcaucgucgcccgcuacgagaacacccucgccgcccaguucuucggccacacccacgucgacgaguucgaggucuucuacgacgaggagacccucucccgcccccucgccgucgccuuccucgcccccuccgccaccaccuacaucggccucaaccccggcuaccgcgucuaccagaucgacggcaacuacuccggcuccucccacgucguccucgaccacgagaccuacauccucaaccucacccaggccaacauccccggcgccaucccccacuggcagcuccucuaccgcgcccgcgagaccuacggccuccccaacacccuccccaccgccuggcacaaccucgucuaccgcaugcgcggcgacaugcagcucuuccagaccuucugguuccucuaccacaagggccacccccccuccgagcccugcggcacccccugccgccucgccacccucugcgcccagcucuccgcccgcgccgacucccccgcccucugccgccaccucaugcccgacggcucccuccccgaggcccagucccucuggccccgcccccucuucugcuga

SEQ ID NO: 49877 - RNA, 1272 nt, Artificial Sequence
  derived and/or modified sequence opt2 from SMPD2__Homo_sapiens__NP_003071
augaagcccaacuucucccuccgccuccgcaucuucaaccucaacugcuggggcauccccuaccucuccaagcaccgcgccgaccgcaugcgccgccucggcgacuuccucaaccaggaguccuucgaccucgcccuccucgaggaggucugguccgagcaggacuuccaguaccuccgccagaagcucucccccaccuaccccgccgcccaccacuuccgcuccggcaucaucggcuccggccucugcgucuucuccaagcaccccauccaggagcucacccagcacaucuacacccucaacggcuaccccuacaugauccaccacggcgacugguucuccggcaaggccgucggccuccucguccuccaccucuccggcaugguccucaacgccuacgucacccaccuccacgccgaguacaaccgccagaaggacaucuaccucgcccaccgcgucgcccaggccugggagcucgcccaguucauccaccacaccuccaagaaggccgacgucguccuccucugcggcgaccucaacaugcaccccgaggaccucggcugcugccuccucaaggaguggaccggccuccacgacgccuaccucgagacccgcgacuucaagggcuccgaggagggcaacaccaugguccccaagaacugcuacgucucccagcaggagcucaagcccuuccccuucggcguccgcaucgacuacguccucuacaaggccgucuccggcuucuacaucuccugcaaguccuucgagaccaccaccggcuucgacccccaccgcggcaccccccucuccgaccacgaggcccucauggccacccucuucguccgccacucccccccccagcagaaccccuccuccacccacggccccgccgagcgcuccccccucaugugcguccucaaggaggccuggaccgagcucggccucggcauggcccaggcccgcuggugggccaccuucgccuccuacgucaucggccucggccuccuccuccucgcccuccucugcguccucgccgccggcggcggcgccggcgaggccgccauccuccucuggacccccuccgucggccucguccucugggccggcgccuucuaccucuuccacguccaggaggucaacggccucuaccgcgcccaggccgagcuccagcacguccucggccgcgcccgcgaggcccaggaccucggccccgagccccagcccgcccuccuccucggccagcaggagggcgaccgcaccaaggagcaguga

SEQ ID NO: 49878 - RNA, 1968 nt, Artificial Sequence
  derived and/or modified sequence opt2 from SMPD3__Homo_sapiens__NP_061137
augguccucuacaccacccccuuccccaacuccugccucuccgcccuccacugcgucuccugggcccucaucuuccccugcuacuggcucgucgaccgccucgccgccuccuucauccccaccaccuacgagaagcgccagcgcgccgacgaccccugcugccuccagcuccucugcaccgcccucuucacccccaucuaccucgcccuccucgucgccucccuccccuucgccuuccucggcuuccucuucugguccccccuccaguccgcccgccgccccuacaucuacucccgccucgaggacaagggccucgccggcggcgccgcccuccucuccgaguggaagggcaccggccccggcaaguccuucugcuucgccaccgccaacgucugccuccuccccgacucccucgcccgcgucaacaaccucuucaacacccaggcccgcgccaaggagaucggccagcgcauccgcaacggcgccgcccgcccccagaucaagaucuacaucgacucccccaccaacaccuccaucuccgccgccuccuucuccucccucgucuccccccagggcggcgacggcgucgcccgcgccguccccggcuccaucaagcgcaccgccuccgucgaguacaagggcgacggcggccgccaccccggcgacgaggccgccaacggccccgccuccggcgaccccgucgacuccuccucccccgaggacgccugcaucguccgcaucggcggcgaggagggcggccgcccccccgaggccgacgaccccguccccggcggccaggcccgcaacggcgccggcggcggcccccgcggccagacccccaaccacaaccagcaggacggcgacuccggcucccucggcucccccuccgccucccgcgagucccucgucaagggccgcgccggccccgacaccuccgccuccggcgagcccggcgccaacuccaagcuccucuacaaggccuccgucgucaagaaggccgccgcccgccgccgccgccaccccgacgaggccuucgaccacgaggucuccgccuucuuccccgccaaccucgacuuccucugccuccaggaggucuucgacaagcgcgccgccaccaagcucaaggagcagcuccacggcuacuucgaguacauccucuacgacgucggcgucuacggcugccagggcugcugcuccuucaagugccucaacuccggccuccucuucgccucccgcuaccccaucauggacgucgccuaccacugcuaccccaacaagugcaacgacgacgcccucgccuccaagggcgcccucuuccucaagguccaggucggcuccaccccccaggaccagcgcaucgucggcuacaucgccugcacccaccuccacgccccccaggaggacuccgccauccgcugcggccagcucgaccuccuccaggacuggcucgccgacuuccgcaaguccaccuccuccuccuccgccgccaaccccgaggagcucgucgccuucgacgucgucugcggcgacuucaacuucgacaacugcuccuccgacgacaagcucgagcagcagcacucccucuucacccacuaccgcgaccccugccgccucggccccggcgaggagaagcccugggccaucggcacccuccucgacaccaacggccucuacgacgaggacgucugcacccccgacaaccuccagaagguccucgaguccgaggagggccgccgcgaguaccucgccuuccccaccuccaaguccuccggccagaagggccgcaaggagcuccucaagggcaacggccgccgcaucgacuacaugcuccacgccgaggagggccucugccccgacuggaaggccgaggucgaggaguucuccuucaucacccagcucuccggccucaccgaccaccuccccgucgccaugcgccucauggucuccuccggcgaggaggaggccuga

SEQ ID NO: 49879 - RNA, 969 nt, Artificial Sequence
  derived and/or modified sequence opt2 from SMPDL3A__Homo_sapiens__NP_001273067
augaccaccaccauccagucccucuuccccaaccuccaggucuuccccgcccucggcaaccacgacuacuggccccaggaccagcuccccgucgucaccuccaaggucuacaacgccgucgccaaccucuggaagcccuggcucgacgaggaggccaucuccacccuccgcaagggcggcuucuacucccagaaggucaccaccaaccccaaccuccgcaucaucucccucaacaccaaccucuacuacggccccaacaucaugacccucaacaagaccgaccccgccaaccaguucgaguggcucgaguccacccucaacaacucccagcagaacaaggagaaggucuacaucaucgcccacguccccgucggcuaccuccccuccucccagaacaucaccgccaugcgcgaguacuacaacgagaagcucaucgacaucuuccagaaguacuccgacgucaucgccggccaguucuacggccacacccaccgcgacuccaucaugguccucuccgacaagaagggcucccccgucaacucccucuucgucgcccccgccgucacccccgucaaguccguccucgagaagcagaccaacaaccccggcauccgccucuuccaguacgacccccgcgacuacaagcuccucgacaugcuccaguacuaccucaaccucaccgaggccaaccucaagggcgaguccaucuggaagcucgaguacauccucacccagaccuacgacaucgaggaccuccagcccgagucccucuacggccucgccaagcaguucaccauccucgacuccaagcaguucaucaaguacuacaacuacuucuucgucuccuacgacuccuccgucaccugcgacaagaccugcaaggccuuccagaucugcgccaucaugaaccucgacaacaucuccuacgccgacugccucaagcagcucuacaucaagcacaacuacuga

SEQ ID NO: 49880 - RNA, 1458 nt, Artificial Sequence
  derived and/or modified sequence opt2 from SMPDL3B__Homo_sapiens__XP_011539561
augcgccuccucgccuggcucaucuuccucgccaacuggggcggcgcccgcgccgagcccgaggaggcccagggccccugcgcccaggagaagggcaagggccccccccccaccuccauccucgccucccucgcccccggccucgaggccggcaaguucuggcacaucgccgaccuccaccucgaccccgacuacaaggucuccaaggaccccuuccaggucugccccuccgccggcucccagcccguccccgacgccggccccuggggcgacuaccucugcgacucccccugggcccucaucaacuccuccaucuacgccaugaaggagaucgagcccgagcccgacuucauccucuggaccggcgacgacaccccccacguccccgacgagaagcucggcgaggccgccguccucgagaucgucgagcgccucaccaagcucauccgcgaggucuuccccgacaccaaggucuacgccgcccucggcaaccacgacuuccaccccaagaaccaguuccccgccggcuccaacaacaucuacaaccagaucgccgagcucuggaagcccuggcucuccaacgaguccaucgcccucuucaagaagggcgccuucuacugcgagaagcuccccggccccuccggcgccggccgcaucgucguccucaacaccaaccucuacuacaccuccaacgcccucaccgccgacauggccgaccccggccagcaguuccaguggcucgaggacguccucaccgacgccuccaaggccggcgacauggucuacaucgucggccacgucccccccggcuucuucgagaagacccagaacaaggccugguuccgcgagggcuucaacgagaaguaccucaaggucguccgcaagcaccaccgcgucaucgccggccaguucuucggccaccaccacaccgacuccuuccgcaugcucuacgacgacgccggcguccccaucuccgccauguucaucacccccggcgucacccccuggaagaccacccuccccggcgucgucaacggcgccaacaaccccgccauccgcgucuucgaguacgaccgcgccacccucucccucaaggacauggucaccuacuucaugaaccucucccaggccaacgcccagggcaccccccgcugggagcucgaguaccagcucaccgaggccuacggcguccccgacgccuccgcccacuccaugcacaccguccucgaccgcaucgccggcgaccaguccacccuccagcgcuacuacgucuacaacuccgucuccuacuccgccggcgucugcgacgaggccugcuccaugcagcacgucugcgccaugcgccaggucgacaucgacgccuacaccaccugccucuacgccuccggcaccacccccgucccccagcucccccuccuccucauggcccuccucggccucugcacccucguccucuga

SEQ ID NO: 49881 - RNA, 267 nt, Artificial Sequence
  derived and/or modified sequence opt2 from SMPX__Homo_sapiens__NP_055147
augaacauguccaagcagcccgucuccaacguccgcgccauccaggccaacaucaacauccccaugggcgccuuccgccccggcgccggccagcccccccgccgcaaggagugcacccccgaggucgaggagggcgucccccccaccuccgacgaggagaagaagcccauccccggcgccaagaagcuccccggccccgccgucaaccucuccgagauccagaacaucaaguccgagcucaaguacguccccaaggccgagcaguga

SEQ ID NO: 49882 - RNA, 240 nt, Artificial Sequence
  derived and/or modified sequence opt2 from SMR3B__Homo_sapiens__NP_006676
augaagucccucaccuggauccucggccucugggcccucgccgccugcuucacccccggcgagucccagcgcggcccccgcggccccuacccccccggcccccucgcccccccccagcccuucggccccggcuucguccccccccccccccccccccccuacggccccggccgcauccccccccccccccccgcccccuacggccccggcaucuucccccccccccccccccagcccuga

SEQ ID NO: 49883 - RNA, 942 nt, Artificial Sequence
  derived and/or modified sequence opt2 from SMS__Homo_sapiens__NP_001245352
auggccgccgcccgccacuccacccucgacuucaugcucggcgccaaggccgacggcgagaccauccucaagggccuccaguccaucuuccaggagcagggcauggccgaguccguccacaccuggcaggaccacggcuaccucgccaccuacaccaacaagaacggccgccucccccccaucguccgcggcggcgccaucgaccgcuacuggcccaccgccgacggccgccucgucgaguacgacaucgacgaggucgucuacgacgaggacucccccuaccagaacaucaagauccuccacuccaagcaguucggcaacauccucauccucuccggcgacgucaaccucgccgaguccgaccucgccuacacccgcgccaucaugggcuccggcaaggaggacuacaccggcaaggacguccucauccucggcggcggcgacggcggcauccucugcgagaucgucaagcucaagcccaagauggucaccauggucgagaucgaccagauggucaucgacggcugcaagaaguacaugcgcaagaccugcggcgacguccucgacaaccucaagggcgacugcuaccagguccucaucgaggacugcauccccguccucaagcgcuacgccaaggagggccgcgaguucgacuacgucaucaacgaccucaccgccguccccaucuccaccucccccgaggaggacuccaccugggaguuccuccgccucauccucgaccucuccaugaagguccucaagcaggacggcaaguacuucacccagggcaacugcgucaaccucaccgaggcccucucccucuacgaggagcagcucggccgccucuacugccccgucgaguucuccaaggagaucgucugcguccccuccuaccucgagcucugggucuucuacaccgucuggaagaaggccaagcccuga

SEQ ID NO: 49884 - RNA, 2754 nt, Artificial Sequence
  derived and/or modified sequence opt2 from SMTN__Homo_sapiens__NP_008863
auggccgacgaggcccucgccggccucgacgagggcgcccuccgcaagcuccucgaggucaccgccgaccucgccgagcgccgccgcauccgcuccgccauccgcgagcuccagcgccaggagcucgagcgcgaggaggaggcccucgccuccaagcgcuuccgcgccgagcgccaggacaacaaggagaacuggcuccacucccagcagcgcgaggccgagcagcgcgccgcccucgcccgccucgccggccagcucgaguccaugaacgacgucgaggagcucaccgcccuccuccgcuccgccggcgaguacgaggagcgcaagcucauccgcgccgccauccgccgcguccgcgcccaggagaucgaggccgccacccucgccggccgccucuacuccggccgccccaacuccggcucccgcgaggacuccaagggccucgccgcccaccgccucgagcagugcgagguccccgagcgcgaggagcaggagcagcaggccgaggucuccaagcccacccccacccccgagggcaccucccaggacgucaccaccgucacccuccuccuccgcgccccccccggcuccaccuccuccucccccgccucccccuccuccucccccacccccgccucccccgagcccccccucgagcccgccgaggcccagugccucaccgccgagguccccggcucccccgagcccccccccuccccccccaagaccaccucccccgagccccaggagucccccacccuccccuccaccgagggccaggucgucaacaagcuccucuccggccccaaggagacccccgccgcccagucccccacccgcggccccuccgacaccaagcgcgccgacgucgccggcccccgccccugccagcgcucccucuccguccucuccccccgccagcccgcccagaaccgcgaguccaccccccucgccuccggccccuccuccuuccagcgcgccggcuccguccgcgaccgcguccacaaguucaccuccgacucccccauggccgcccgccuccaggacggcaccccccaggccgcccucuccccccucacccccgcccgccuccucggccccucccucaccuccaccacccccgccuccuccuccuccggcuccuccucccgcggccccuccgacaccuccucccgcuucuccaaggagcagcgcggcgucgcccagccccucgcccagcuccgcuccugcccccaggaggagggcccccgcggccgcggccucgccgcccgcccccucgagaaccgcgccggcggccccgucgcccgcuccgaggagcccggcgccccccuccccgucgccgucggcaccgccgagcccggcggcuccaugaagaccaccuucaccaucgagaucaaggacggccgcggccaggccuccaccggccgcguccuccuccccaccggcaaccagcgcgccgagcucacccucggccuccgcgccccccccacccuccucuccaccuccuccggcggcaaguccaccaucacccgcgucaacucccccggcacccucgcccgccucggcuccgucacccacgucaccuccuucucccacgccccccccuccucccgcggcggcugcuccaucaagauggaggccgagcccgccgagccccucgccgccgccgucgaggccgccaacggcgccgagcagacccgcgucaacaaggcccccgagggccgcuccccccucuccgccgaggagcucaugaccaucgaggacgagggcguccucgacaagaugcucgaccaguccaccgacuucgaggagcgcaagcucauccgcgccgcccuccgcgagcuccgccagcgcaagcgcgaccagcgcgacaaggagcgcgagcgccgccuccaggaggcccgcggccgccccggcgagggccgcggcaacaccgccaccgagaccaccacccgccacucccagcgcgccgccgacggcuccgccgucuccaccgucaccaagaccgagcgccucguccacuccaacgacggcacccgcaccgcccgcaccaccaccgucgaguccuccuucguccgccgcuccgagaacggcuccggcuccaccaugaugcagaccaagaccuucuccuccuccuccuccuccaagaagaugggcuccaucuucgaccgcgaggaccaggccuccccccgcgccggcucccucgccgcccucgagaagcgccaggccgagaagaagaaggagcucaugaaggcccagucccuccccaagaccuccgccucccaggcccgcaaggccaugaucgagaagcucgagaaggagggcgccgccggcucccccggcggcccccgcgccgccguccagcgcuccaccuccuucggcguccccaacgccaacuccaucaagcagaugcuccucgacuggugccgcgccaagacccgcggcuacgagcacgucgacauccagaacuucuccuccuccugguccgacggcauggccuucugcgcccucguccacaacuucuuccccgaggccuucgacuacggccagcucuccccccagaaccgccgccagaacuucgaggucgccuucuccuccgccgagaugcucgucgacugcgucccccucgucgaggucgacgacaugaugaucaugggcaagaagcccgaccccaagugcgucuucaccuacguccagucccucuacaaccaccuccgccgccacgagcuccgccuccgcggcaagaacgucuga

SEQ ID NO: 49885 - RNA, 1485 nt, Artificial Sequence
  derived and/or modified sequence opt2 from SMTNL1__Homo_sapiens__NP_001099035
auggagcagaaggagggcaagcucuccgaggacggcaccaccgucucccccgccgccgacaaccccgagauguccggcggcggcgcccccgccgaggagaccaagggcaccgccggcaaggccaucaacgagggcccccccaccgaguccggcaagcaggagaaggcccccgccgaggacggcauguccgccgagcuccagggcgaggccaacggccucgacgaggucaaggucgagucccagcgcgaggccggcggcaaggaggacgccgaggccgagcucaagaaggaggacggcgagaaggaggagaccaccgucggcucccaggagaugaccggccgcaaggaggagaccaaguccgagcccaaggaggccgaggagaaggaguccacccucgccuccgagaagcagaaggccgaggagaaggaggccaagcccgaguccggccagaaggccgacgccaacgaccgcgacaagcccgagcccaaggccaccgucgaggaggaggacgccaagaccgccucccaggaggagaccggccagcgcaaggagugcuccaccgagcccaaggagaaggccaccgacgaggaggccaaggccgagucccagaaggccgucgucgaggacgaggccaaggccgagcccaaggagcccgacggcaaggaggaggccaagcacggcgccaaggaggaggccgacgccaaggaggaggccgaggacgccgaggaggccgagcccggcucccccuccgaggagcaggagcaggacgucgagaaggagcccgagggcggcgccggcgucauccccuccucccccgaggaguggcccgagucccccaccggcgagggccacaaccucuccaccgacggccucggccccgacugcgucgccuccggccagaccucccccuccgccuccgaguccucccccuccgacgucccccaguccccccccgagucccccuccuccggcgagaagaaggagaaggcccccgagcgccgcgucuccgcccccgcccgcccccgcggcccccgcgcccagaaccgcaaggccaucgucgacaaguucggcggcgccgccuccggccccaccgcccucuuccgcaacaccaaggccgccggcgccgccaucggcggcgucaagaacaugcuccucgaguggugccgcgccaugaccaagaaguacgagcacgucgacauccagaacuucuccuccuccugguccuccggcauggccuucugcgcccucauccacaaguucuuccccgacgccuucgacuacgccgagcucgaccccgccaagcgccgccacaacuucacccucgccuucuccaccgccgagaagcucgccgacugcgcccagcuccucgacgucgacgacaugguccgccucgccguccccgacuccaagugcgucuacaccuacauccaggagcucuaccgcucccucguccagaagggccucgucaagaccaagaagaaguga

SEQ ID NO: 49886 - RNA, 1542 nt, Artificial Sequence
  derived and/or modified sequence opt2 from SMU1__Homo_sapiens__NP_060695
auguccaucgagaucgaguccuccgacgucauccgccucaucaugcaguaccucaaggagaacucccuccaccgcgcccucgccacccuccaggaggagaccaccgucucccucaacaccgucgacuccaucgaguccuucgucgccgacaucaacuccggccacugggacaccguccuccaggccauccagucccucaagcuccccgacaagacccucaucgaccucuacgagcaggucguccucgagcucaucgagcuccgcgagcucggcgccgcccgcucccuccuccgccagaccgaccccaugaucaugcucaagcagacccagcccgagcgcuacauccaccucgagaaccuccucgcccgcuccuacuucgacccccgcgaggccuaccccgacggcuccuccaaggagaagcgccgcgccgccaucgcccaggcccucgccggcgaggucuccgucgucccccccucccgccucauggcccuccucggccaggcccucaaguggcagcagcaccagggccuccucccccccggcaugaccaucgaccucuuccgcggcaaggccgccgucaaggacgucgaggaggagaaguuccccacccagcucucccgccacaucaaguucggccagaagucccacgucgagugcgcccgcuucucccccgacggccaguaccucgucaccggcuccgucgacggcuucaucgaggucuggaacuucaccaccggcaagauccgcaaggaccucaaguaccaggcccaggacaacuucaugaugauggacgacgccguccucugcaugugcuucucccgcgacaccgagaugcucgccaccggcgcccaggacggcaagaucaaggucuggaagauccaguccggccagugccuccgccgcuucgagcgcgcccacuccaagggcgucaccugccucuccuucuccaaggacuccucccagauccucuccgccuccuucgaccagaccauccgcauccacggccucaaguccggcaagacccucaaggaguuccgcggccacuccuccuucgucaacgaggccaccuucacccaggacggccacuacaucaucuccgccuccuccgacggcaccgucaagaucuggaacaugaagaccaccgagugcuccaacaccuucaagucccucggcuccaccgccggcaccgacaucaccgucaacuccgucauccuccuccccaagaaccccgagcacuucgucgucugcaaccgcuccaacaccgucgucaucaugaacaugcagggccagaucguccgcuccuucuccuccggcaagcgcgagggcggcgacuucgucugcugcgcccucuccccccgcggcgaguggaucuacugcgucggcgaggacuucguccucuacugcuucuccaccgucaccggcaagcucgagcgcacccucaccguccacgagaaggacgucaucggcaucgcccaccacccccaccagaaccucaucgccaccuacuccgaggacggccuccucaagcucuggaagcccuga

SEQ ID NO: 49887 - RNA, 534 nt, Artificial Sequence
  derived and/or modified sequence opt2 from SMUG1__Homo_sapiens__XP_006719385
augccccaggccuuccuccucggcuccauccacgagcccgccggcgcccucauggagccccagcccugccccggcucccucgccgaguccuuccucgaggaggagcuccgccucaacgccgagcucucccagcuccaguucuccgagcccgucggcaucaucuacaaccccgucgaguacgccugggagccccaccgcaacuacgucacccgcuacugccagggccccaaggagguccucuuccucggcaugaaccccggccccuucggcauggcccagaccggcguccccuucggcgaggucuccaugguccgcgacuggcucggcaucgucggccccguccucacccccccccaggagcaccccaagcgccccguccucggccucgagugcccccaguccgagggcccccgccaguccaugggccacgagaucaaguccgagcuccucaugggcggcugcuccuggauccgcggcaagauccagugcgaccgcguccagguccgccgccccggcuucuccucccagcucuga

SEQ ID NO: 49888 - RNA, 2274 nt, Artificial Sequence
  derived and/or modified sequence opt2 from SMURF1__Homo_sapiens__NP_065162
auguccaaccccggcacccgccgcaacggcuccuccaucaagauccgccucaccguccucugcgccaagaaccucgccaagaaggacuucuuccgccuccccgaccccuucgccaagaucgucgucgacggcuccggccagugccacuccaccgacaccgucaagaacacccucgaccccaaguggaaccagcacuacgaccucuacgucggcaagaccgacuccaucaccaucuccgucuggaaccacaagaagauccacaagaagcagggcgccggcuuccucggcugcguccgccuccucuccaacgccaucucccgccucaaggacaccggcuaccagcgccucgaccucugcaagcucaaccccuccgacaccgacgccguccgcggccagaucgucgucucccuccagacccgcgaccgcaucggcaccggcggcuccgucgucgacugccgcggccuccucgagaacgagggcaccgucuacgaggacuccggccccggccgcccccucuccugcuucauggaggagcccgcccccuacaccgacuccaccggcgccgccgccggcggcggcaacugccgcuucgucgagucccccucccaggaccagcgccuccaggcccagcgccuccgcaaccccgacguccgcggcucccuccagaccccccagaaccgcccccacggccaccagucccccgagcuccccgagggcuacgagcagcgcaccaccguccagggccaggucuacuuccuccacacccagaccggcgucuccaccuggcacgacccccgcauccccucccccuccggcaccauccccggcggcgacgccgccuuccucuacgaguuccuccuccagggccacaccuccgagccccgcgaccucaacuccgucaacugcgacgagcucggcccccucccccccggcugggagguccgcuccaccgucuccggccgcaucuacuucgucgaccacaacaaccgcaccacccaguucaccgacccccgccuccaccacaucaugaaccaccagugccagcucaaggagcccucccagccccucccccuccccuccgagggcucccucgaggacgaggagcuccccgcccagcgcuacgagcgcgaccucguccagaagcucaagguccuccgccacgagcucucccuccagcagccccaggccggccacugccgcaucgaggucucccgcgaggagaucuucgaggaguccuaccgccagaucaugaagaugcgccccaaggaccucaagaagcgccucauggucaaguuccgcggcgaggagggccucgacuacggcggcgucgcccgcgaguggcucuaccuccucugccacgagaugcucaaccccuacuacggccucuuccaguacuccaccgacaacaucuacaugcuccagaucaaccccgacuccuccaucaaccccgaccaccucuccuacuuccacuucgucggccgcaucaugggccucgccgucuuccacggccacuacaucaacggcggcuucaccguccccuucuacaagcagcuccucggcaagcccauccagcucuccgaccucgaguccgucgaccccgagcuccacaagucccucgucuggauccucgagaacgacaucacccccguccucgaccacaccuucugcgucgagcacaacgccuucggccgcauccuccagcacgagcucaagcccaacggccgcaacguccccgucaccgaggagaacaagaaggaguacguccgccucuacgucaacuggcgcuucaugcgcggcaucgaggcccaguuccucgcccuccagaagggcuucaacgagcucaucccccagcaccuccucaagcccuucgaccagaaggagcucgagcucaucaucggcggccucgacaagaucgaccucaacgacuggaaguccaacacccgccucaagcacugcgucgccgacuccaacaucguccgcugguucuggcaggccgucgagaccuucgacgaggagcgccgcgcccgccuccuccaguucgucaccggcuccacccgcgucccccuccagggcuucaaggcccuccagggcuccaccggcgccgccggcccccgccucuucaccauccaccucaucgacgccaacaccgacaaccuccccaaggcccacaccugcuucaaccgcaucgacaucccccccuacgaguccuacgagaagcucuacgagaagcuccucaccgccgucgaggagaccugcggcuucgccgucgaguga

SEQ ID NO: 49889 - RNA, 2247 nt, Artificial Sequence
  derived and/or modified sequence opt2 from SMURF2__Homo_sapiens__NP_073576
auguccaaccccggcggccgccgcaacggccccgucaagcuccgccucaccguccucugcgccaagaaccucgucaagaaggacuucuuccgccuccccgaccccuucgccaaggucgucgucgacggcuccggccagugccacuccaccgacaccgucaagaacacccucgaccccaaguggaaccagcacuacgaccucuacaucggcaaguccgacuccgucaccaucuccgucuggaaccacaagaagauccacaagaagcagggcgccggcuuccucggcugcguccgccuccucuccaacgccaucaaccgccucaaggacaccggcuaccagcgccucgaccucugcaagcucggccccaacgacaacgacaccguccgcggccagaucgucgucucccuccagucccgcgaccgcaucggcaccggcggccaggucgucgacugcucccgccucuucgacaacgaccuccccgacggcugggaggagcgccgcaccgccuccggccgcauccaguaccucaaccacaucacccgcaccacccagugggagcgccccacccgccccgccuccgaguacuccucccccggccgcccccucuccugcuucgucgacgagaacacccccaucuccggcaccaacggcgccaccugcggccaguccuccgacccccgccucgccgagcgccgcguccgcucccagcgccaccgcaacuacaugucccgcacccaccuccacaccccccccgaccuccccgagggcuacgagcagcgcaccacccagcagggccaggucuacuuccuccacacccagaccggcgucuccaccuggcacgacccccgcgucccccgcgaccucuccaacaucaacugcgaggagcucggcccccucccccccggcugggagauccgcaacaccgccaccggccgcgucuacuucgucgaccacaacaaccgcaccacccaguucaccgacccccgccucuccgccaaccuccaccucguccucaaccgccagaaccagcucaaggaccagcagcagcagcaggucgucucccucugccccgacgacaccgagugccucaccgucccccgcuacaagcgcgaccucguccagaagcucaagauccuccgccaggagcucucccagcagcagccccaggccggccacugccgcaucgaggucucccgcgaggagaucuucgaggaguccuaccgccaggucaugaagaugcgccccaaggaccucuggaagcgccucaugaucaaguuccgcggcgaggagggccucgacuacggcggcgucgcccgcgaguggcucuaccuccucucccacgagaugcucaaccccuacuacggccucuuccaguacucccgcgacgacaucuacacccuccagaucaaccccgacuccgccgucaaccccgagcaccucuccuacuuccacuucgucggccgcaucaugggcauggccgucuuccacggccacuacaucgacggcggcuucacccuccccuucuacaagcagcuccucggcaaguccaucacccucgacgacauggagcucgucgaccccgaccuccacaacucccucgucuggauccucgagaacgacaucaccggcguccucgaccacaccuucugcgucgagcacaacgccuacggcgagaucauccagcacgagcucaagcccaacggcaaguccauccccgucaacgaggagaacaagaaggaguacguccgccucuacgucaacuggcgcuuccuccgcggcaucgaggcccaguuccucgcccuccagaagggcuucaacgaggucaucccccagcaccuccucaagaccuucgacgagaaggagcucgagcucaucaucugcggccucggcaagaucgacgucaacgacuggaaggucaacacccgccucaagcacugcacccccgacuccaacaucgucaagugguucuggaaggccgucgaguucuucgacgaggagcgccgcgcccgccuccuccaguucgucaccggcuccucccgcgucccccuccagggcuucaaggcccuccagggcgccgccggcccccgccucuucaccauccaccagaucgacgccugcaccaacaaccuccccaaggcccacaccugcuucaaccgcaucgacaucccccccuacgaguccuacgagaagcucuacgagaagcuccucaccgccaucgaggagaccugcggcuucgccgucgaguga

SEQ ID NO: 49890 - RNA, 1473 nt, Artificial Sequence
  derived and/or modified sequence opt2 from SMYD1__Homo_sapiens__NP_938015
augaccaucggccgcauggagaacgucgaggucuucaccgccgagggcaagggccgcggccucaaggccaccaaggaguucugggccgccgacaucaucuucgccgagcgcgccuacuccgccgucgucuucgacucccucgucaacuucgucugccacaccugcuucaagcgccaggagaagcuccaccgcugcggccagugcaaguucgcccacuacugcgaccgcaccugccagaaggacgccuggcucaaccacaagaacgagugcuccgccaucaagcgcuacggcaagguccccaacgagaacauccgccucgccgcccgcaucauguggcgcgucgagcgcgagggcaccggccucaccgagggcugccucgucuccgucgacgaccuccagaaccacgucgagcacuucggcgaggaggagcagaaggaccuccgcgucgacgucgacaccuuccuccaguacuggcccccccagucccagcaguucuccaugcaguacaucucccacaucuucggcgucaucaacugcaacggcuucacccucuccgaccagcgcggccuccaggccgucggcgucggcaucuuccccaaccucggccucgucaaccacgacugcuggcccaacugcaccgucaucuucaacaacggcaaccacgaggccgucaaguccauguuccacacccagaugcgcaucgagcuccgcgcccucggcaagaucuccgagggcgaggagcucaccgucuccuacaucgacuuccucaacgucuccgaggagcgcaagcgccagcucaagaagcaguacuacuucgacugcaccugcgagcacugccagaagaagcucaaggacgaccucuuccucggcgucaaggacaaccccaagcccucccaggaggucgucaaggagaugauccaguucuccaaggacacccucgagaagaucgacaaggcccgcuccgagggccucuaccacgaggucgucaagcucugccgcgagugccucgagaagcaggagcccgucuucgccgacaccaacaucuacaugcuccgcaugcucuccaucgucuccgagguccucuccuaccuccaggccuucgaggaggccuccuucuacgcccgccgcauggucgacggcuacaugaagcucuaccaccccaacaacgcccagcucggcauggccgucaugcgcgccggccucaccaacuggcacgccggcaacaucgaggucggccacggcaugaucugcaaggccuacgccauccuccucgucacccacggccccucccaccccaucaccaaggaccucgaggccaugcgcguccagaccgagauggagcuccgcauguuccgccagaacgaguucauguacuacaagaugcgcgaggccgcccucaacaaccagcccaugcaggucauggccgagcccuccaacgagcccucccccgcccucuuccacaagaagcaguga

SEQ ID NO: 49891 - RNA, 1302 nt, Artificial Sequence
  derived and/or modified sequence opt2 from SMYD2__Homo_sapiens__NP_064582
augcgcgccgagggccucggcggccucgagcgcuucugcucccccggcaagggccgcggccuccgcgcccuccagcccuuccaggucggcgaccuccucuucuccugccccgccuacgccuacguccucaccgucaacgagcgcggcaaccacugcgaguacugcuucacccgcaaggagggccucuccaagugcggccgcugcaagcaggccuucuacugcaacgucgagugccagaaggaggacuggcccaugcacaagcucgagugcucccccauggucgucuucggcgagaacuggaaccccuccgagaccguccgccucaccgcccgcauccucgccaagcagaagauccaccccgagcgcacccccuccgagaagcuccucgccgucaaggaguucgagucccaccucgacaagcucgacaacgagaagaaggaccucauccaguccgacaucgccgcccuccaccacuucuacuccaagcaccucggcuuccccgacaacgacucccucgucguccucuucgcccaggucaacugcaacggcuucaccaucgaggacgaggagcucucccaccucggcuccgccaucuuccccgacgucgcccucaugaaccacuccugcugccccaacgucaucgucaccuacaagggcacccucgccgagguccgcgccguccaggagaucaagcccggcgaggaggucuucaccuccuacaucgaccuccucuaccccaccgaggaccgcaacgaccgccuccgcgacuccuacuucuucaccugcgagugccaggagugcaccaccaaggacaaggacaaggccaaggucgagauccgcaagcucuccgacccccccaaggccgaggccauccgcgacaugguccgcuacgcccgcaacgucaucgaggaguuccgccgcgccaagcacuacaagucccccuccgagcuccucgagaucugcgagcucucccaggagaagauguccuccgucuucgaggacuccaacgucuacaugcuccacaugauguaccaggccaugggcgucugccucuacaugcaggacugggagggcgcccuccaguacggccagaagaucaucaagcccuacuccaagcacuacccccucuacucccucaacgucgccuccauguggcucaagcucggccgccucuacaugggccucgagcacaaggccgccggcgagaaggcccucaagaaggccaucgccaucauggaggucgcccacggcaaggaccaccccuacaucuccgagaucaagcaggagaucgagucccacuga

SEQ ID NO: 49892 - RNA, 1287 nt, Artificial Sequence
  derived and/or modified sequence opt2 from SMYD3__Homo_sapiens__NP_001161212
auggagccccucaaggucgagaaguucgccaccgccaagcgcggcaacggccuccgcgccgucaccccccuccgccccggcgagcuccucuuccgcuccgacccccucgccuacaccgucugcaagggcucccgcggcgucgucugcgaccgcugccuccucggcaaggagaagcucaugcgcugcucccagugccgcgucgccaaguacugcuccgccaagugccagaagaaggccuggcccgaccacaagcgcgagugcaagugccucaaguccugcaagccccgcuacccccccgacuccguccgccuccucggccgcgucgucuucaagcucauggacggcgcccccuccgaguccgagaagcucuacuccuucuacgaccucgaguccaacaucaacaagcucaccgaggacaagaaggagggccuccgccagcucgucaugaccuuccagcacuucaugcgcgaggagauccaggacgccucccagcucccccccgccuucgaccucuucgaggccuucgccaaggucaucugcaacuccuucaccaucugcaacgccgagaugcaggaggucggcgucggccucuaccccuccaucucccuccucaaccacuccugcgaccccaacugcuccaucgucuucaacggcccccaccuccuccuccgcgccguccgcgacaucgaggucggcgaggagcucaccaucugcuaccucgacaugcucaugaccuccgaggagcgccgcaagcagcuccgcgaccaguacugcuucgagugcgacugcuuccgcugccagacccaggacaaggacgccgacaugcucaccggcgacgagcaggucuggaaggagguccaggagucccucaagaagaucgaggagcucaaggcccacuggaagugggagcagguccucgccaugugccaggccaucaucuccuccaacuccgagcgccuccccgacaucaacaucuaccagcucaagguccucgacugcgccauggacgccugcaucaaccucggccuccucgaggaggcccucuucuacggcacccgcaccauggagcccuaccgcaucuucuuccccggcucccaccccguccgcggcguccaggucaugaaggucggcaagcuccagcuccaccagggcauguucccccaggccaugaagaaccuccgccucgccuucgacaucaugcgcgucacccacggccgcgagcacucccucaucgaggaccucauccuccuccucgaggagugcgacgccaacauccgcgccuccuga

SEQ ID NO: 49893 - RNA, 2415 nt, Artificial Sequence
  derived and/or modified sequence opt2 from SMYD4__Homo_sapiens__NP_443160
auggaccuccccgucgacgaguggaaguccuaccuccuccagaagugggccucccuccccaccuccguccaggucaccaucuccaccgccgagacccuccgcgacaucuuccuccacuccuccucccuccuccagcccgaggacgagcucuuccucaagcgccucuccaagggcuaccucgucggcaaggacuccgacgccccccucuucuaccgcgaggagggcaacaagaaguuccaggagaaggacuacaccggcgccgccguccucuacuccaagggcgucucccacucccgccccaacaccgaggacaugucccucugccacgccaaccgcuccgccgcccucuuccaccucggccaguacgagaccugccucaaggacaucaaccgcgcccagacccacggcuaccccgagcgccuccagcccaagaucaugcuccgcaaggccgagugccucgucgcccucggccgccuccaggaggccucccagaccaucuccgaccucgagcgcaacuucaccgccacccccgcccucgccgacguccucccccagacccuccagcgcaaccuccaccgccucaagaugaagaugcaggagaaggacucccucaccgaguccuuccccgccgcccucgccaagacccucgaggacgccgcccuccgcgaggagaacgagcagcucuccaacgccuccuccuccaucggccucugcgucgacccccucaagggccgcugccucgucgccaccaaggacauccuccccggcgagcuccucguccaggaggacgccuucgucuccguccucaaccccggcgagcucccccccccccaccacggccucgacuccaagugggacacccgcgucaccaacggcgaccucuacugccaccgcugccucaagcacacccucgccaccguccccugcgacggcugcuccuacgccaaguacugcucccaggagugccuccagcaggccugggagcucuaccaccgcaccgagugcccccucggcggccuccuccucacccucggcgucuucugccacaucgcccuccgccucacccuccucgucggcuucgaggacguccgcaagaucaucaccaagcucugcgacaagaucuccaacaaggacaucugccuccccgaguccaacaaccaggucaagacccucaacuacggccucggcgaguccgagaagaacggcaacaucgucgagacccccauccccggcugcgacaucaacggcaaguacgagaacaacuacaacgccgucuucaaccuccucccccacaccgagaaccacucccccgagcacaaguuccucugcgcccucugcgucuccgcccucugccgccagcucgaggccgccucccuccaggccauccccaccgagcgcaucgucaacuccucccagcucaaggccgccgucacccccgagcucugccccgacgucaccaucuggggcgucgccaugcuccgccacaugcuccagcuccagugcaacgcccaggccaugaccaccauccagcacaccggccccaagggcuccaucgucaccgacucccgccagguccgccucgccaccggcaucuuccccgucaucucccuccucaaccacuccugcucccccaacaccuccgucuccuucaucuccaccgucgccaccauccgcgccucccagcgcauccgcaagggccaggagauccuccacugcuacggcccccacaagucccgcaugggcgucgccgagcgccagcagaagcuccgcucccaguacuucuucgacugcgccugccccgccugccagaccgaggcccaccgcauggccgccggcccccgcugggaggccuucugcugcaacuccugcggcgcccccaugcagggcgacgacguccuccgcugcggcucccgcuccugcgccgaguccgccgucucccgcgaccaccucgucucccgccuccaggaccuccagcagcagguccgcgucgcccagaagcuccuccgcgacggcgagcucgagcgcgccguccagcgccucuccggcugccagcgcgacgccgaguccuuccucugggccgagcacgccgucgucggcgagaucgccgacggccucgcccgcgccugcgccgcccucggcgacuggcagaaguccgccacccaccuccagcgcucccucuacgucgucgagguccgccacggccccuccuccgucgagaugggccacgagcucuucaagcucgcccagaucuucuucaacggcuucgccguccccgaggcccucuccaccauccagaaggccgaggagguccucucccuccacugcggccccugggacgacgagauccaggagcuccagaagaugaaguccugccuccucgaccucccccccacccccgucggccccgcccucuga

SEQ ID NO: 49894 - RNA, 1257 nt, Artificial Sequence
  derived and/or modified sequence opt2 from SMYD5__Homo_sapiens__NP_006053
auggccgccuccaugugcgacgucuucuccuucugcgucggcgucgccggccgcgcccgcgucuccgucgagguccgcuucgucuccuccgccaagggcaagggccucuucgccacccagcucauccgcaagggcgagaccaucuucgucgagcgcccccucgucgccgcccaguuccucuggaacgcccucuaccgcuaccgcgccugcgaccacugccuccgcgcccucgagaaggccgaggagaacgcccagcgccucaccggcaagcccggccagguccucccccaccccgagcucugcaccguccgcaaggaccuccaccagaacugcccccacugccaggucauguacugcuccgccgagugccgccucgccgccaccgagcaguaccaccagguccucugccccggccccucccaggacgacccccuccacccccucaacaagcuccaggaggccuggcgcuccauccacuacccccccgagaccgccuccaucaugcucauggcccgcauggucgccaccgucaagcaggccaaggacaaggaccgcuggauccgccucuucucccaguucugcaacaagaccgccaacgaggaggaggagaucguccacaagcuccucggcgacaaguucaagggccagcucgagcuccuccgccgccucuucaccgaggcccucuacgaggaggccgucucccagugguucacccccgacggcuuccgcucccucuucgcccucgucggcaccaacggccagggcaucggcaccuccucccucucccaguggguccacgccugcgacacccucgagcucaagccccaggaccgcgagcagcucgacgccuucaucgaccagcucuacaaggacaucgaggccgccaccggcgaguuccucaacugcgagggcuccggccucuucguccuccaguccugcugcaaccacuccugcguccccaacgccgagaccuccuuccccgagaacaacuuccuccuccacgucaccgcccucgaggacaucaagcccggcgaggagaucugcaucuccuaccucgacugcugccagcgcgagcgcucccgccacucccgccacaagauccuccgcgagaacuaccucuucgucugcuccugccccaagugccucgccgaggccgacgagcccaacgucaccuccgaggaggaggaggaggaggaggaggaggaggagggcgagcccgaggacgccgagcucggcgacgagaugaccgacgucuga

SEQ ID NO: 49895 - RNA, 795 nt, Artificial Sequence
  derived and/or modified sequence opt2 from SNAI1__Homo_sapiens__NP_005976
augccccgcuccuuccucguccgcaagcccuccgaccccaaccgcaagcccaacuacuccgagcuccaggacuccaaccccgaguucaccuuccagcagcccuacgaccaggcccaccuccucgccgccauccccccccccgagauccucaaccccaccgccucccuccccaugcucaucugggacuccguccucgccccccaggcccagcccaucgccugggccucccuccgccuccaggaguccccccgcgucgccgagcucaccucccucuccgacgaggacuccggcaagggcucccagccccccuccccccccucccccgcccccuccuccuucuccuccaccuccgucuccucccucgaggccgaggccuacgccgccuuccccggccucggccagguccccaagcagcucgcccagcucuccgaggccaaggaccuccaggcccgcaaggccuucaacugcaaguacugcaacaaggaguaccucucccucggcgcccucaagaugcacauccgcucccacacccuccccugcgucugcggcaccugcggcaaggccuucucccgccccuggcuccuccagggccacguccgcacccacaccggcgagaagcccuucuccugcccccacugcucccgcgccuucgccgaccgcuccaaccuccgcgcccaccuccagacccacuccgacgucaagaaguaccagugccaggccugcgcccgcaccuucucccgcaugucccuccuccacaagcaccaggaguccggcugcuccggcugcccccgcuga

SEQ ID NO: 49896 - RNA, 807 nt, Artificial Sequence
  derived and/or modified sequence opt2 from SNAI2__Homo_sapiens__NP_003059
augccccgcuccuuccucgucaagaagcacuucaacgccuccaagaagcccaacuacuccgagcucgacacccacaccgucaucaucucccccuaccucuacgaguccuacuccaugcccgucaucccccagcccgagauccucuccuccggcgccuacucccccaucaccgucuggaccaccgccgcccccuuccacgcccagcuccccaacggccucuccccccucuccggcuacuccuccucccucggccgcgucuccccccccccccccuccgacaccuccuccaaggaccacuccggcuccgagucccccaucuccgacgaggaggagcgccuccaguccaagcucuccgacccccacgccaucgaggccgagaaguuccagugcaaccucugcaacaagaccuacuccaccuucuccggccucgccaagcacaagcagcuccacugcgacgcccagucccgcaaguccuucuccugcaaguacugcgacaaggaguacgucucccucggcgcccucaagaugcacauccgcacccacacccuccccugcgucugcaagaucugcggcaaggccuucucccgccccuggcuccuccagggccacauccgcacccacaccggcgagaagcccuucuccugcccccacugcaaccgcgccuucgccgaccgcuccaaccuccgcgcccaccuccagacccacuccgacgucaagaaguaccagugcaagaacugcuccaagaccuucucccgcaugucccuccuccacaagcacgaggaguccggcugcugcgucgcccacuga

SEQ ID NO: 49897 - RNA, 879 nt, Artificial Sequence
  derived and/or modified sequence opt2 from SNAI3__Homo_sapiens__NP_840101
augccccgcuccuuccucgucaagacccacuccucccaccgcguccccaacuaccgccgccucgagacccagcgcgagaucaacggcgccugcuccgccugcggcggccucgucgucccccuccucccccgcgacaaggaggcccccuccguccccggcgaccucccccagcccugggaccgcuccuccgccgucgccugcaucucccucccccuccucccccgcaucgaggaggcccucggcgccuccggccucgacgcccucgaggucuccgaggucgacccccgcgccucccgcgccgccaucgucccccucaaggacucccucaaccaccucaaccuccccccccuccucguccuccccacccgcuggucccccacccucggccccgaccgccacggcgcccccgagaagcuccucggcgccgagcgcaugccccgcgcccccggcggcuucgagugcuuccacugccacaagcccuaccacacccucgccggccucgcccgccaccgccagcuccacugccaccuccaggucggccgcgucuucaccugcaaguacugcgacaaggaguacaccucccucggcgcccucaagaugcacauccgcacccacacccuccccugcaccugcaagaucugcggcaaggccuucucccgccccuggcuccuccagggccacguccgcacccacaccggcgagaagcccuacgccugcucccacugcucccgcgccuucgccgaccgcuccaaccuccgcgcccaccuccagacccacuccgacgccaagaaguaccgcugccgccgcugcaccaagaccuucucccgcaugucccuccucgcccgccacgaggaguccggcugcugccccggccccuga

SEQ ID NO: 49898 - RNA, 636 nt, Artificial Sequence
  derived and/or modified sequence opt2 from SNAP23__Homo_sapiens__NP_003816
auggacaaccucuccuccgaggagauccagcagcgcgcccaccagaucaccgacgagucccucgaguccacccgccgcauccucggccucgccaucgagucccaggacgccggcaucaagaccaucaccaugcucgacgagcagaaggagcagcucaaccgcaucgaggagggccucgaccagaucaacaaggacaugcgcgagaccgagaagacccucaccgagcucaacaagugcugcggccucugcgucugccccugcaaccgcaccaagaacuucgaguccggcaaggccuacaagaccaccuggggcgacggcggcgagaacucccccugcaacgucgucuccaagcagcccggccccgucaccaacggccagcuccagcagcccaccaccggcgccgccuccggcggcuacaucaagcgcaucaccaacgacgcccgcgaggacgagauggaggagaaccucacccaggucggcuccauccucggcaaccucaaggacauggcccucaacaucggcaacgagaucgacgcccagaacccccagaucaagcgcaucaccgacaaggccgacaccaaccgcgaccgcaucgacaucgccaacgcccgcgccaagaagcucaucgacuccuga

SEQ ID NO: 49899 - RNA, 621 nt, Artificial Sequence
  derived and/or modified sequence opt2 from SNAP25__Homo_sapiens__NP_003072
auggccgaggacgccgacaugcgcaacgagcucgaggagaugcagcgccgcgccgaccagcucgccgacgagucccucgaguccacccgccgcaugcuccagcucgucgaggaguccaaggacgccggcauccgcacccucgucaugcucgacgagcagggcgagcagcucgaccgcgucgaggagggcaugaaccacaucaaccaggacaugaaggaggccgagaagaaccucaaggaccucggcaagugcugcggccucuucaucugccccugcaacaagcucaaguccuccgacgccuacaagaaggccuggggcaacaaccaggacggcgucgucgccucccagcccgcccgcgucgucgacgagcgcgagcagauggccaucuccggcggcuucauccgccgcgucaccaacgacgcccgcgagaacgagauggacgagaaccucgagcaggucuccggcaucaucggcaaccuccgccacauggcccucgacaugggcaacgagaucgacacccagaaccgccagaucgaccgcaucauggagaaggccgacuccaacaagacccgcaucgacgaggccaaccagcgcgccaccaagaugcucggcuccggcuga

SEQ ID NO: 49900 - RNA, 777 nt, Artificial Sequence
  derived and/or modified sequence opt2 from SNAP29__Homo_sapiens__NP_004773
auguccgccuaccccaaguccuacaaccccuucgacgacgacggcgaggacgagggcgcccgccccgcccccuggcgcgacgcccgcgaccuccccgacggccccgacgcccccgccgaccgccagcaguaccuccgccaggagguccuccgccgcgccgaggccaccgccgccuccaccucccgcucccucgcccucauguacgaguccgagaaggucggcgucgccuccuccgaggagcucgcccgccagcgcggcguccucgagcgcaccgagaagauggucgacaagauggaccaggaccucaagaucucccagaagcacaucaacuccaucaaguccgucuucggcggccucgucaacuacuucaaguccaagcccgucgagaccccccccgagcagaacggcacccucaccucccagcccaacaaccgccucaaggaggccaucuccaccuccaaggagcaggaggccaaguaccaggccucccaccccaaccuccgcaagcucgacgacaccgaccccgucccccgcggcgccggcuccgccauguccaccgacgccuaccccaagaacccccaccuccgcgccuaccaccagaagaucgacuccaaccucgacgagcucuccaugggccucggccgccucaaggacaucgcccucggcaugcagaccgagaucgaggagcaggacgacauccucgaccgccucaccaccaaggucgacaagcucgacgucaacaucaaguccaccgagcgcaagguccgccagcucuga

SEQ ID NO: 49901 - RNA, 1395 nt, Artificial Sequence
  derived and/or modified sequence opt2 from SNAP47__Homo_sapiens__NP_444280
augcgcgccgcccgccgcggccuccacugcgccggcgccgagcgcccccgccgccgcggccgccucugggacuccuccggcgucccccagcgccagaagcgccccggccccuggcgcacccagacccaggagcagaugucccgcgacgucugcauccacaccuggcccugcaccuacuaccucgagcccaagcgccgcugggucaccggccagcucucccucaccucccucucccuccgcuucaugaccgacuccaccggcgagauccucgucuccuucccccucuccuccaucgucgagaucaagaaggaggccucccacuucaucuucuccuccaucaccauccucgagaagggccacgccaagcacugguucuccucccuccgccccucccgcaacgucgucuucuccaucaucgagcacuucuggcgcgagcuccuccucucccagcccggcgccgucgccgacgccuccgucccccgcacccgcggcgaggagcucaccggccucauggccggcucccagaagcgccucgaggacaccgcccgcguccuccaccaccagggccagcagcucgacuccgucaugcgcggccucgacaagauggaguccgaccucgaggucgccgaccgccuccucaccgagcucgagucccccgccugguggcccuucuccuccaagcucuggaagaccccccccgagaccaagccccgcgaggacgucuccaugaccuccugcgagcccuucggcaaggagggcauccucaucaagauccccgccgucaucucccaccgcaccgagucccacgucaagcccggccgccucaccguccucgucuccggccucgagauccacgacuccuccucccuccucaugcaccgcuucgagcgcgaggacgucgacgacaucaagguccacucccccuacgagaucuccauccgccagcgcuucaucggcaagcccgacauggccuaccgccucaucuccgccaagaugcccgaggucauccccauccucgagguccaguucuccaagaagauggagcuccucgaggacgcccucguccuccgcuccgcccgcaccuccucccccgccgagaaguccugcuccgucuggcacgccgccuccggccucaugggccgcacccuccaccgcgagccccccgccggcgaccaggagggcaccgcccuccaccuccagaccucccuccccgcccucuccgaggccgacacccaggagcucacccagauccuccgccgcaugaagggccucgcccucgaggccgaguccgagcucgagcgccaggacgaggcccucgacggcgucgccgccgccgucgaccgcgccacccucaccaucgacaagcacaaccgccgcaugaagcgccucaccuga

SEQ ID NO: 49902 - RNA, 2724 nt, Artificial Sequence
  derived and/or modified sequence opt2 from SNAP91__Homo_sapiens__NP_001229721
auguccggccagacccucaccgaccgcaucgccgccgcccaguacuccgucaccggcuccgccgucgcccgcgccgucugcaaggccaccacccacgaggucaugggccccaagaagaagcaccucgacuaccucauccaggccaccaacgagaccaacgucaacaucccccagauggccgacacccucuucgagcgcgccaccaacuccuccugggucgucgucuucaaggcccucgucaccacccaccaccucaugguccacggcaacgagcgcuucauccaguaccucgccucccgcaacacccucuucaaccucuccaacuuccucgacaaguccggcucccacggcuacgacauguccaccuucauccgccgcuacucccgcuaccucaacgagaaggccuucuccuaccgccagauggccuucgacuucgcccgcgucaagaagggcgccgacggcgucaugcgcaccauggcccccgagaagcuccucaaguccaugcccauccuccagggccagaucgacgcccuccucgaguucgacguccaccccaacgagcucaccaacggcgucaucaacgccgccuucaugcuccucuucaaggaccucaucaagcucuucgccugcuacaacgacggcgucaucaaccuccucgagaaguucuucgagaugaagaagggccagugcaaggacgcccucgagaucuacaagcgcuuccucacccgcaugacccgcgucuccgaguuccucaaggucgccgagcaggucggcaucgacaagggcgacauccccgaccucacccaggcccccuccucccucauggagacccucgagcagcaccucaacacccucgagggcaagaagcccggcaacaacgagggcuccggcgcccccuccccccucuccaaguccucccccgccaccaccgucaccucccccaacuccacccccgccaagaccaucgacaccuccccccccgucgaccucuucgccaccgccuccgccgccguccccgucuccaccuccaagcccuccuccgaccuccucgaccuccagcccgacuucuccuccggcggcgccgccgccgccgccgcccccgccccccccccccccgccggcggcgccaccgccuggggcgaccuccucggcgaggacucccucgccgcccucuccuccguccccuccgaggcccagaucuccgaccccuucgcccccgagcccaccccccccaccaccaccgccgagaucgccaccgccuccgccuccgccuccaccaccaccaccgucaccgccgucaccgccgaggucgaccucuucggcgacgccuucgccgccucccccggcgaggcccccgccgccuccgagggcgccgccgcccccgccacccccacccccgucgccgccgcccucgacgccugcuccggcaacgaccccuucgcccccuccgagggcuccgccgaggccgcccccgagcucgaccucuucgccaugaagccccccgagaccuccguccccgucgucacccccaccgccuccaccgccccccccguccccgccaccgcccccucccccgcccccgccgucgccgccgccgccgccgccaccaccgccgccaccgccgccgccaccaccaccaccaccaccuccgccgccaccgccaccaccgccccccccgcccucgacaucuucggcgaccucuucgaguccacccccgaggucgccgccgcccccaagcccgacgccgcccccuccaucgaccucuucuccaccgacgccuucuccucccccccccagggcgccucccccguccccgaguccucccucaccgccgaccuccucuccgucgacgccuucgccgcccccucccccgccaccaccgccucccccgccaaggucgacuccuccggcgucaucgaccucuucggcgacgccuucggcuccuccgccuccgagccccagcccgccucccaggccgccuccuccuccuccgccuccgccgaccuccucgccggcuucggcggcuccuucauggcccccucccccucccccgucacccccgcccagaacaaccuccuccagcccaacuucgaggccgccuucggcaccacccccuccaccuccuccuccuccuccuucgaccccuccgucuucgacggccucggcgaccuccucaugcccaccauggcccccgccggccagcccgcccccgucuccauggucccccccucccccgccauggccgccuccaaggcccucggcuccgaccucgacuccucccucgccucccucgucggcaaccucggcaucuccggcaccaccaccaagaagggcgaccuccaguggaacgccggcgagaagaagcucaccggcggcgccaacuggcagcccaaggucgcccccgccaccugguccgccggcgucccccccuccgccccccuccagggcgccgucccccccaccuccuccgucccccccgucgccggcgcccccuccgucggccagcccggcgccggcuucggcaugccccccgccggcaccggcaugcccaugaugccccagcagcccgucauguucgcccagcccaugaugcgcccccccuucggcgccgccgccguccccggcacccagcucucccccucccccacccccgccucccagucccccaagaagccccccgccaaggacccccucgccgaccucaacaucaaggacuuccucuga

SEQ ID NO: 49903 - RNA, 1107 nt, Artificial Sequence
  derived and/or modified sequence opt2 from SNAPC1__Homo_sapiens__NP_003073
augggcaccccccccggccuccagaccgacugcgaggcccuccucucccgcuuccaggagaccgacuccguccgcuucgaggacuucaccgagcucuggcgcaacaugaaguucggcaccaucuucugcggccgcaugcgcaaccucgagaagaacauguucaccaaggaggcccucgcccucgccuggcgcuacuuccucccccccuacaccuuccagauccgcgucggcgcccucuaccuccucuacggccucuacaacacccagcucugccagcccaagcagaagauccgcgucgcccucaaggacugggacgagguccucaaguuccagcaggaccucgucaacgcccagcacuucgacgccgccuacaucuuccgcaagcuccgccucgaccgcgccuuccacuucaccgccaugcccaagcuccucuccuaccgcaugaagaagaagauccaccgcgccgaggucaccgaggaguucaaggaccccuccgaccgcgucaugaagcucaucaccuccgacguccucgaggagaugcucaacguccacgaccacuaccagaacaugaagcacgucaucuccgucgacaaguccaagcccgacaaggcccucucccucaucaaggacgacuucuucgacaacaucaagaacaucguccucgagcaccagcaguggcacaaggaccgcaagaaccccucccucaaguccaagaccaacgacggcgaggagaagauggagggcaacucccaggagaccgagcgcugcgagcgcgccgagucccucgccaagaucaaguccaaggccuucuccgucgucauccaggccuccaagucccgccgccaccgccaggucaagcucgacuccuccgacuccgacuccgccuccggccagggccaggucaaggccacccgcaagaaggagaagaaggagcgccucaagcccgccggccgcaagaugucccuccgcaacaagggcaacguccagaacauccacaaggaggacaagccccucucccucuccaugcccgucaucaccgaggaggaggagaacgagucccucuccggcaccgaguucaccgccuccaagaagcgccgcaagcacuga

SEQ ID NO: 49904 - RNA, 4410 nt, Artificial Sequence
  derived and/or modified sequence opt2 from SNAPC4__Homo_sapiens__NP_003077
auggacgucgacgccgagcgcgagaagaucacccaggagaucaaggagcucgagcgcauccucgaccccggcuccuccggcucccacgucgagaucuccgaguccucccucgaguccgacuccgaggccgacucccuccccuccgaggaccucgaccccgccgacccccccaucuccgaggaggagcgcuggggcgaggccuccaacgacgaggacgaccccaaggacaagacccuccccgaggaccccgagaccugccuccagcucaacauggucuaccaggaggucauccaggagaagcucgccgaggccaaccuccuccucgcccagaaccgcgagcagcaggaggagcucaugcgcgaccucgccggcuccaagggcaccaaggucaaggacggcaagucccucccccccuccaccuacaugggccacuucaugaagcccuacuucaaggacaaggucaccggcgucggcccccccgccaacgaggacacccgcgagaaggccgcccagggcaucaaggccuucgaggagcuccucgucaccaaguggaagaacugggagaaggcccuccuccgcaaguccgucgucuccgaccgccuccagcgccuccuccagcccaagcuccucaagcucgaguaccuccaccagaagcaguccaaggucuccuccgagcucgagcgccaggcccucgagaagcagggccgcgaggccgagaaggagauccaggacaucaaccagcuccccgaggaggcccuccucggcaaccgccucgacucccacgacugggagaagaucuccaacaucaacuucgagggcucccgcuccgccgaggagauccgcaaguucuggcagaacuccgagcaccccuccaucaacaagcaggaguggucccgcgaggaggaggagcgccuccaggccaucgccgccgcccacggccaccucgaguggcagaagaucgccgaggagcucggcaccucccgcuccgccuuccagugccuccagaaguuccagcagcacaacaaggcccucaagcgcaaggaguggaccgaggaggaggaccgcaugcucacccagcucguccaggagaugcgcgucggcucccacauccccuaccgccgcaucgucuacuacauggagggccgcgacuccaugcagcucaucuaccgcuggaccaagucccucgaccccggccucaagaagggcuacugggcccccgaggaggacgccaagcuccuccaggccgucgccaaguacggcgagcaggacugguucaagauccgcgaggagguccccggccgcuccgacgcccagugccgcgaccgcuaccuccgccgccuccacuucucccucaagaagggccgcuggaaccucaaggaggaggagcagcucaucgagcucaucgagaaguacggcgucggccacugggccaagaucgccuccgagcucccccaccgcuccggcucccagugccucuccaaguggaagaucaugaugggcaagaagcagggccuccgccgccgccgccgccgcgcccgccacuccguccgcugguccuccaccuccuccuccggcuccuccuccggcuccuccggcggcuccuccuccuccuccuccuccuccuccgaggaggacgagcccgagcaggcccaggccggcgagggcgaccgcgcccuccucuccccccaguacaugguccccgacauggaccucuggguccccgcccgccaguccaccucccagcccuggcgcggcggcgccggcgccuggcucggcggccccgccgccucccucuccccccccaagggcuccuccgccucccagggcggcuccaaggaggccuccaccaccgccgccgcccccggcgaggagaccucccccguccagguccccgcccgcgcccacggccccgucccccgcuccgcccaggccucccacuccgccgacacccgccccgccggcgccgagaagcaggcccucgagggcggccgccgccuccucaccguccccgucgagaccguccuccgcguccuccgcgccaacaccgccgcccgcuccugcacccagaaggagcagcuccgccagcccccccuccccaccuccucccccggcgucuccuccggcgacuccgucgcccgcucccacguccaguggcuccgccaccgcgccacccaguccggccagcgccgcuggcgccacgcccuccaccgccgccuccucaaccgccgccuccuccucgccgucacccccugggucggcgacgucgucguccccugcacccaggccucccagcgccccgccgucguccagacccaggccgacggccuccgcgagcagcuccagcaggcccgccucgccuccacccccgucuucacccucuucacccagcucuuccacaucgacaccgccggcugccucgaggucguccgcgagcgcaaggcccuccccccccgccucccccaggccggcgcccgcgacccccccguccaccuccuccaggccuccuccuccgcccaguccacccccggccaccucuuccccaacguccccgcccaggaggccuccaaguccgccucccacaagggcucccgccgccucgccuccucccgcgucgagcgcacccucccccaggccucccuccucgccuccaccggcccccgccccaagcccaagaccgucuccgagcuccuccaggagaagcgccuccaggaggcccgcgcccgcgaggccacccgcggccccgucguccuccccucccagcuccucgucuccuccuccgucauccuccagcccccccucccccacaccccccacggccgccccgcccccggccccaccguccucaacgucccccucuccggccccggcgcccccgccgccgccaagcccggcaccuccggcuccuggcaggaggccggcaccuccgccaaggacaagcgccucuccaccaugcaggcccucccccucgcccccgucuucuccgaggccgagggcaccgcccccgccgccucccaggcccccgcccucggccccggccagaucuccgucuccugccccgaguccggccucggccagucccaggcccccgccgccucccgcaagcagggccuccccgaggccccccccuuccuccccgccgcccccucccccaccccccuccccguccagccccucucccucacccacaucggcggcccccacgucgccaccuccgucccccuccccgucaccuggguccucaccgcccagggccuccuccccguccccguccccgccgucgucucccucccccgccccgccggcacccccggccccgccggccuccucgccacccuccuccccccccucaccgagacccgcgccgcccagggcccccgcgcccccgcccucuccuccuccuggcagccccccgccaacaugaaccgcgagcccgagcccuccugccgcaccgacacccccgccccccccacccacgcccucucccagucccccgccgaggccgacggcuccgucgccuucguccccggcgaggcccaggucgcccgcgagauccccgagccccgcaccuccucccacgccgacccccccgaggccgagccccccugguccggccgccuccccgccuucggcggcgucauccccgccaccgagccccgcggcacccccggcucccccuccggcacccaggagccccgcggcccccucggccucgagaagcucccccuccgccagcccggccccgagaagggcgcccucgaccucgagaagcccccccucccccagcccggccccgagaagggcgcccucgaccucggccuccucucccaggagggcgaggccgccacccagcaguggcucggcggccagcgcggcguccgcgucccccuccucggcucccgccuccccuaccagccccccgcccucugcucccuccgcgcccucuccggccuccuccuccacaagaaggcccucgagcacaaggccaccucccucgucgucggcggcgaggccgagcgccccgccggcgcccuccaggccucccucggccucguccgcggccagcuccaggacaaccccgccuaccuccuccuccgcgcccgcuuccucgccgccuucacccuccccgcccuccucgccacccucgccccccagggcguccgcaccacccucuccguccccucccgcgucggcuccgaguccgaggacgaggaccuccucuccgagcucgagcucgccgaccgcgacggccagcccggcugcaccaccgccaccugccccauccagggcgcccccgacuccggcaagugcuccgccuccuccugccucgacaccuccaacgaccccgacgaccucgacguccuccgcacccgccacgcccgccacacccgcaagcgccgccgccucgucuga

SEQ ID NO: 49905 - RNA, 297 nt, Artificial Sequence
  derived and/or modified sequence opt2 from SNAPC5__Homo_sapiens__NP_006040
augcucucccgccuccaggagcuccgcaaggaggaggagacccuccuccgccucaaggccgcccuccacgaccagcucaaccgccucaaggucgaggagcucgcccuccaguccaugaucuccucccgccgcggcgacgagaugcucuccucccacaccguccccgagcagucccacgacaugcucguccacgucgacaacgaggccuccaucaaccagaccacccucgagcucuccaccaagucccacgucaccgaggaggaggaggaggaggaggaggaggaguccgacuccuga

SEQ ID NO: 49906 - RNA, 339 nt, Artificial Sequence
  derived and/or modified sequence opt2 from SNCA__Homo_sapiens__NP_009292
auggacgucuucaugaagggccucuccaaggccaaggagggcgucgucgccgccgccgagaagaccaagcagggcgucgccgaggccgccggcaagaccaaggagggcguccucuacgucggcuccaagaccaaggagggcgucguccacggcgucgccaccgucgccgagaagaccaaggagcaggucaccaacgucggcggcgccgucgucaccggcgucaccgccgucgcccagaagaccgucgagggcgccggcuccaucgccgccgccaccggcuucgucaagaaggaccagcucggcaaggagggcuaccaggacuacgagcccgaggccuga

SEQ ID NO: 49907 - RNA, 1812 nt, Artificial Sequence
  derived and/or modified sequence opt2 from SNCAIP__Homo_sapiens__NP_001229864
augaccuaccucauccagucccaccacucccgccgcucccagaacugcgccgaggacgucauccgcaagaccaagaccgaccagaacggccagcucgagugcguccgcuggauggucuccgagaccgaggccaucgccgagcucuccugcuccaaggacuuccccucccucauccacuacgccggcugcuacggccaggagaagauccuccucuggcuccuccaguucaugcaggagcagggcaucucccucgacgaggucgaccaggacggcaacuccgccguccacgucgccucccagcacggcuaccucggcugcauccagacccucgucgaguacggcgccaacgucaccaugcagaaccacgccggcgagaagcccucccaguccgccgagcgccagggccacacccucugcucccgcuaccucgucgucgucgagaccugcaugucccucgccucccaggucgucaagcucaccaagcagcucaaggagcagaccgucgagcgcgucacccuccagaaccagcuccagcaguuccucgaggcccagaaguccgagggcaagucccuccccuccucccccuccucccccuccucccccgccucccgcaagucccaguggaagucccccgacgccgacgacgacuccgucgccaaguccaagcccggcguccaggagggcauccagguccucggcucccucuccgccuccucccgcgcccgccccaaggccaaggacgaggacuccgacaagauccuccgccagcuccucggcaaggagaucuccgagaacgucugcacccaggagaagcucucccucgaguuccaggacgcccaggccuccucccgcaacuccaagaagaucccccucgagaagcgcgagcucaagcucgcccgccuccgccagcucaugcagcgcucccucuccgaguccgacaccgacuccaacaacuccgaggaccccaagaccacccccguccgcaaggccgaccgcccccgcccccagcccaucgucgaguccgucgaguccauggacuccgccgagucccuccaccucaugaucaagaagcacacccucgccuccggcggccgccgcuuccccuucuccaucaaggccuccaagucccucgacggccacucccccucccccaccuccgaguccuccgagcccgaccucgagucccaguaccccggcuccggcuccaucccccccaaccagcccuccggcgacccccagcagcccucccccgacuccaccgccgcccagaaggucgccaccucccccaaguccgcccucaagucccccuccuccaagcgccgcaccucccagaaccucaagcuccgcgucaccuucgaggagcccgucguccagauggagcagcccucccucgagcucaacggcgagaaggacaaggacaagggccgcacccuccagcgcaccuccaccuccaacgaguccggcgaccagcucaagcgccccuucggcgccuuccgcuccaucauggagacccucuccggcaaccagaacaacaacaacaacuaccaggccgccaaccagcucaagaccuccacccucccccucaccucccucggccgcaagaccgacgccaagggcaaccccgccuccuccgccuccaagggcaagaacaaggccgagauguacuccuccugcaucaaccucuccuccaacaugcucaucgaggagcaccucugcaacgacacccgccacaacgacaucaaccgcaagaugaagaaguccuacuccaucaagcacaucgccgagcccgaguccaaggagcucuuccucuga

SEQ ID NO: 49908 - RNA, 405 nt, Artificial Sequence
  derived and/or modified sequence opt2 from SNCB__Homo_sapiens__NP_003076
auggacgucuucaugaagggccucuccauggccaaggagggcgucgucgccgccgccgagaagaccaagcagggcgucaccgaggccgccgagaagaccaaggagggcguccucuacgucggcuccaagacccgcgagggcgucguccagggcgucgccuccgucgccgagaagaccaaggagcaggccucccaccucggcggcgccgucuucuccggcgccggcaacaucgccgccgccaccggccucgucaagcgcgaggaguuccccaccgaccucaagcccgaggaggucgcccaggaggccgccgaggagccccucaucgagccccucauggagcccgagggcgaguccuacgaggaccccccccaggaggaguaccaggaguacgagcccgaggccuga

SEQ ID NO: 49909 - RNA, 384 nt, Artificial Sequence
  derived and/or modified sequence opt2 from SNCG__Homo_sapiens__NP_003078
auggacgucuucaagaagggcuucuccaucgccaaggagggcgucgucggcgccgucgagaagaccaagcagggcgucaccgaggccgccgagaagaccaaggagggcgucauguacgucggcgccaagaccaaggagaacgucguccaguccgucaccuccgucgccgagaagaccaaggagcaggccaacgccgucuccgaggccgucgucuccuccgucaacaccgucgccaccaagaccgucgaggaggccgagaacaucgccgucaccuccggcgucguccgcaaggaggaccuccgccccuccgccccccagcaggagggcgaggccuccaaggagaaggaggaggucgccgaggaggcccaguccggcggcgacuga

SEQ ID NO: 49910 - RNA, 2733 nt, Artificial Sequence
  derived and/or modified sequence opt2 from SND1__Homo_sapiens__NP_055205
auggccuccuccgcccaguccggcggcuccuccggcggccccgccguccccaccguccagcgcggcaucaucaagaugguccucuccggcugcgccaucaucguccgcggccagccccgcggcggccccccccccgagcgccagaucaaccucuccaacauccgcgccggcaaccucgcccgccgcgccgccgccacccagcccgacgccaaggacacccccgacgagcccugggccuuccccgcccgcgaguuccuccgcaagaagcucaucggcaaggaggucugcuucaccaucgagaacaagaccccccagggccgcgaguacggcaugaucuaccucggcaaggacaccaacggcgagaacaucgccgagucccucgucgccgagggccucgccacccgccgcgagggcaugcgcgccaacaaccccgagcagaaccgccucuccgagugcgaggagcaggccaaggccgccaagaagggcaugugguccgagggcaacggcucccacaccauccgcgaccucaaguacaccaucgagaacccccgccacuucgucgacucccaccaccagaagcccgucaacgccaucaucgagcacguccgcgacggcuccgucguccgcgcccuccuccuccccgacuacuaccucgucaccgucaugcucuccggcaucaagugccccaccuuccgccgcgaggccgacggcuccgagacccccgagcccuucgccgccgaggccaaguucuucaccgagucccgccuccuccagcgcgacguccagaucauccucgaguccugccacaaccagaacauccucggcaccauccuccaccccaacggcaacaucaccgagcuccuccucaaggagggcuucgcccgcugcgucgacugguccaucgccgucuacacccgcggcgccgagaagcuccgcgccgccgagcgcuucgccaaggagcgccgccuccgcaucuggcgcgacuacgucgcccccaccgccaaccucgaccagaaggacaagcaguucgucgccaaggucaugcagguccucaacgccgacgccaucgucgucaagcucaacuccggcgacuacaagaccauccaccucuccuccauccgccccccccgccucgagggcgagaacacccaggacaagaacaagaagcuccgcccccucuacgacauccccuacauguucgaggcccgcgaguuccuccgcaagaagcucaucggcaagaaggucaacgucaccgucgacuacauccgccccgccucccccgccaccgagaccguccccgccuucuccgagcgcaccugcgccaccgucaccaucggcggcaucaacaucgccgaggcccucgucuccaagggccucgccaccgucauccgcuaccgccaggacgacgaccagcgcuccucccacuacgacgagcuccucgccgccgaggcccgcgccaucaagaacggcaagggccuccacuccaagaaggagguccccauccaccgcgucgccgacaucuccggcgacacccagaaggccaagcaguuccuccccuuccuccagcgcgccggccgcuccgaggccgucgucgaguacgucuucuccggcucccgccucaagcucuaccuccccaaggagaccugccucaucaccuuccuccucgccggcaucgagugcccccgcggcgcccgcaaccuccccggccucguccaggagggcgagcccuucuccgaggaggccacccucuucaccaaggagcucguccuccagcgcgaggucgaggucgaggucgaguccauggacaaggccggcaacuucaucggcuggcuccacaucgacggcgccaaccucuccguccuccucgucgagcacgcccucuccaagguccacuucaccgccgagcgcuccuccuacuacaagucccuccucuccgccgaggaggccgccaagcagaagaaggagaaggucugggcccacuacgaggagcagcccgucgaggaggucaugcccguccucgaggagaaggagcgcuccgccuccuacaagcccgucuucgucaccgagaucaccgacgaccuccacuucuacguccaggacgucgagaccggcacccagcucgagaagcucauggagaacaugcgcaacgacaucgccucccacccccccgucgagggcuccuacgccccccgccgcggcgaguucugcaucgccaaguucgucgacggcgagugguaccgcgcccgcgucgagaaggucgagucccccgccaagauccacgucuucuacaucgacuacggcaaccgcgagguccuccccuccacccgccucggcacccucucccccgccuucuccacccgcguccuccccgcccaggccaccgaguacgccuucgccuucauccaggucccccaggacgacgacgcccgcaccgacgccgucgacuccgucguccgcgacauccagaacacccagugccuccucaacgucgagcaccucuccgccggcugcccccacgucacccuccaguucgccgacuccaagggcgacgucggccucggccucgucaaggagggccucgucauggucgagguccgcaaggagaagcaguuccagaaggucaucaccgaguaccucaacgcccaggaguccgccaaguccgcccgccucaaccucuggcgcuacggcgacuuccgcgccgacgacgccgacgaguucggcuacucccgcuga

SEQ ID NO: 49911 - RNA, 4242 nt, Artificial Sequence
  derived and/or modified sequence opt2 from SNED1__Homo_sapiens__NP_001073906
augcgccacggcgucgccugggcccuccucgucgccgccgcccucggccucggcgcccgcggcguccgcggcgccgucgcccucgccgacuucuaccccuucggcgccgagcgcggcgacgccgucacccccaagcaggacgacggcggcuccggccuccgcccccucuccguccccuuccccuucuucggcgccgagcacuccggccucuacgucaacaacaacggcaucaucuccuuccucaaggaggucucccaguucacccccgucgccuuccccaucgccaaggaccgcugcgucgucgccgccuucugggccgacgucgacaaccgccgcgccggcgacgucuacuaccgcgaggccaccgaccccgccaugcuccgccgcgccaccgaggacguccgccacuacuuccccgagcuccucgacuucaacgccaccugggucuucgucgccaccugguaccgcgucaccuucuucggcggcuccuccuccucccccgucaacaccuuccagaccguccucaucaccgacggcaagcucuccuucaccaucuucaacuacgaguccaucgucuggaccaccggcacccacgccuccuccggcggcaacgccaccggccucggcggcaucgccgcccaggccggcuucaacgccggcgacggccagcgcuacuucuccauccccggcucccgcaccgccgacauggccgaggucgagaccaccaccaacgucggcguccccggccgcugggccuuccgcaucgacgacgcccagguccgcgucggcggcugcggccacaccaccuccgucugccucgcccuccgccccugccucaacggcggcaagugcaucgacgacugcgucaccggcaaccccuccuacaccugcuccugccucuccggcuucaccggccgccgcugccaccucgacgucaacgagugcgccucccagcccugccagaacggcggcaccugcacccacggcaucaacuccuuccgcugccagugccccgccggcuucggcggccccaccugcgagaccgcccagucccccugcgacaccaaggagugccagcacggcggccagugccaggucgagaacggcuccgccgucugcgucugccaggccggcuacaccggcgccgccugcgagauggacgucgacgacugcucccccgaccccugccucaacggcggcuccugcgucgaccucgucggcaacuacaccugccucugcgccgagcccuucaagggccuccgcugcgagaccggcgaccaccccguccccgacgccugccucuccgcccccugccacaacggcggcaccugcgucgacgccgaccagggcuacgucugcgagugccccgagggcuucaugggccucgacugccgcgagcgcguccccgacgacugcgagugccgcaacggcggccgcugccucggcgccaacaccacccucugccagugcccccucggcuucuucggccuccucugcgaguucgagaucaccgccaugcccugcaacaugaacacccagugccccgacggcggcuacugcauggagcacggcggcuccuaccucugcgucugccacaccgaccacaacgccucccacucccuccccucccccugcgacuccgaccccugcuucaacggcggcuccugcgacgcccacgacgacuccuacaccugcgagugcccccgcggcuuccacggcaagcacugcgagaaggcccgcccccaccucugcuccuccggccccugccgcaacggcggcaccugcaaggaggccggcggcgaguaccacugcuccugccccuaccgcuucaccggccgccacugcgagaucggcaagcccgacuccugcgccuccggccccugccacaacggcggcaccugcuuccacuacaucggcaaguacaagugcgacugcccccccggcuucuccggccgccacugcgagaucgcccccucccccugcuuccgcucccccugcgucaacggcggcaccugcgaggaccgcgacaccgacuucuucugccacugccaggccggcuacaugggccgccgcugccaggccgaggucgacugcggcccccccgaggaggucaagcacgccacccuccgcuucaacggcacccgccucggcgccgucgcccucuacgccugcgaccgcggcuacucccucuccgcccccucccgcauccgcgucugccagccccacggcgucugguccgagcccccccagugccucgagaucgacgagugccgcucccagcccugccuccacggcggcuccugccaggaccgcgucgccggcuaccucugccucugcuccaccggcuacgagggcgcccacugcgagcucgagcgcgacgagugccgcgcccaccccugccgcaacggcggcuccugccgcaaccuccccggcgccuacgucugccgcugccccgccggcuucgucggcguccacugcgagaccgaggucgacgccugcgacuccucccccugccagcacggcggccgcugcgaguccggcggcggcgccuaccucugcgucugccccgaguccuucuucggcuaccacugcgagaccgucuccgaccccugcuucuccucccccugcggcggccgcggcuacugccucgccuccaacggcucccacuccugcaccugcaaggucggcuacaccggcgaggacugcgccaaggagcucuucccccccaccgcccucaagauggagcgcgucgaggaguccggcgucuccaucuccuggaacccccccaacggccccgccgcccgccagaugcucgacggcuacgccgucaccuacgucuccuccgacggcuccuaccgccgcaccgacuucgucgaccgcacccgcuccucccaccagcuccaggcccucgccgccggccgcgccuacaacaucuccgucuucuccgucaagcgcaacuccaacaacaagaacgacaucucccgccccgccguccuccucgcccgcacccgcccccgccccgucgagggcuucgaggucaccaacgucaccgccuccaccaucuccguccagugggcccuccaccgcauccgccacgccaccgucuccggcguccgcgucuccauccgccaccccgaggcccuccgcgaccaggccaccgacgucgaccgcuccgucgaccgcuucaccuuccgcgcccuccuccccggcaagcgcuacaccauccagcucaccacccucuccggccuccgcggcgaggagcaccccaccgagucccucgccaccgcccccacccacgucuggacccgcccccucccccccgccaaccucaccgccgcccgcgucaccgccaccuccgcccacgucgucugggacgcccccacccccggcucccuccucgaggccuacgucaucaacgucaccaccucccaguccaccaagucccgcuacguccccaacggcaagcucgccuccuacaccguccgcgaccuccuccccggccgccgcuaccagcucuccgucaucgccguccaguccaccgagcucggcccccagcacuccgagcccgcccaccucuacaucaucaccuccccccgcgacggcgccgaccgccgcuggcaccagggcggccaccacccccgcguccucaagaaccgccccccccccgcccgccuccccgagcuccgccuccucaacgaccacuccgcccccgagacccccacccagcccccccgcuucuccgagcucgucgacggccgcggccgcgucuccgcccgcuucggcggcucccccuccaaggccgccaccguccgcucccagcccaccgccuccgcccagcucgagaacauggaggaggcccccaagcgcgucucccucgcccuccagcuccccgagcacggcuccaaggacaucggcaacguccccggcaacugcuccgagaaccccugccagaacggcggcaccugcguccccggcgccgacgcccacuccugcgacugcggccccggcuucaagggccgccgcugcgagcucgccugcaucaaggucucccgccccugcacccgccucuucuccgagaccaaggccuuccccgucugggagggcggcgucugccaccacgucuacaagcgcgucuaccgcguccaccaggacaucugcuucaaggaguccugcgaguccaccucccucaagaagacccccaaccgcaagcaguccaagucccagacccucgagaaguccuga

SEQ ID NO: 49912 - RNA, 777 nt, Artificial Sequence
  derived and/or modified sequence opt2 from SNF8__Homo_sapiens__NP_009172
augcaccgccgcggcgucggcgccggcgccaucgccaagaagaagcucgccgaggccaaguacaaggagcgcggcaccguccucgccgaggaccagcucgcccagauguccaagcagcucgacauguucaagaccaaccucgaggaguucgccuccaagcacaagcaggagauccgcaagaaccccgaguuccgcguccaguuccaggacaugugcgccaccaucggcgucgacccccucgccuccggcaagggcuucugguccgagaugcucggcgucggcgacuucuacuacgagcucggcguccagaucaucgaggucugccucgcccucaagcaccgcaacggcggccucaucacccucgaggagcuccaccagcagguccucaagggccgcggcaaguucgcccaggacgucucccaggacgaccucauccgcgccaucaagaagcucaaggcccucggcaccggcuucggcaucauccccgucggcggcaccuaccucauccaguccguccccgccgagcucaacauggaccacaccgucguccuccagcucgccgagaagaacggcuacgucaccgucuccgagaucaaggccucccucaagugggagaccgagcgcgcccgccagguccucgagcaccuccucaaggagggccucgccuggcucgaccuccaggcccccggcgaggcccacuacuggcuccccgcccucuucaccgaccucuacucccaggagaucaccgccgaggaggcccgcgaggcccuccccuga

SEQ ID NO: 49913 - RNA, 948 nt, Artificial Sequence
  derived and/or modified sequence opt2 from SNIP1__Homo_sapiens__XP_011540462
auggaccuccaguuccacauggccggcgaggccucccaguccuggugggaggcccgccgcuccaagucccacggcuggcgccaggagcgcgaggaccacccccgccgcggccgcgaggaccgccagcaccgcgagcccuccgagcaggagcaccgccgcgcccgcaacuccgaccgcgaccgccaccgcggccacucccaccagcgccgcaccuccaacgagcgccccggcuccggccagggccagggccgcgaccgcgacacccagaaccuccaggcccaggaggaggagcgcgaguucuacaacgcccgccgccgcgagcaccgccagcgcaacgacgucggcggcggcggcuccgagucccaggagcucgucccccgccccggcggcaacaacaaggagaaggagguccccgccaaggagaagcccuccuucgagcucuccggcgcccuccucgaggacaccaacaccuuccgcggcgucgucaucaaguacuccgagccccccgaggcccgcauccccaagaagcgcuggcgccucuaccccuucaagaacgacgagguccuccccgucauguacauccaccgccaguccgccuaccuccucggccgccaccgccgcaucgccgacauccccaucgaccaccccuccugcuccaagcagcacgccgucuuccaguaccgccucgucgaguacacccgcgccgacggcaccgucggccgccgcgucaagcccuacaucaucgaccucggcuccggcaacggcaccuuccucaacaacaagcgcaucgagccccagcgcuacuacgagcucaaggagaaggacguccucaaguucggcuucuccucccgcgaguacguccuccuccacgaguccuccgacaccuccgagaucgaccgcaaggacgacgaggacgaggaggaggaggaggaggucuccgacuccuga

SEQ ID NO: 49914 - RNA, 2298 nt, Artificial Sequence
  derived and/or modified sequence opt2 from SNRK__Homo_sapiens__NP_001094064
auggccggcuucaagcgcggcuacgacggcaagaucgccggccucuacgaccucgacaagacccucggccgcggccacuucgccgucgucaagcucgcccgccacgucuucaccggcgagaaggucgccgucaaggucaucgacaagaccaagcucgacacccucgccaccggccaccucuuccaggagguccgcugcaugaagcucguccagcaccccaacaucguccgccucuacgaggucaucgacacccagaccaagcucuaccucauccucgagcucggcgacggcggcgacauguucgacuacaucaugaagcacgaggagggccucaacgaggaccucgccaagaaguacuucgcccagaucguccacgccaucuccuacugccacaagcuccacgucguccaccgcgaccucaagcccgagaacgucgucuucuucgagaagcagggccucgucaagcucaccgacuucggcuucuccaacaaguuccagcccggcaagaagcucaccaccuccugcggcucccucgccuacuccgcccccgagauccuccucggcgacgaguacgacgcccccgccgucgacaucuggucccucggcgucauccucuucaugcucgucugcggccagccccccuuccaggaggccaacgacuccgagacccucaccaugaucauggacugcaaguacaccguccccucccacgucuccaaggagugcaaggaccucaucacccgcaugcuccagcgcgaccccaagcgccgcgccucccucgaggagaucgagaaccaccccuggcuccagggcgucgaccccucccccgccaccaaguacaacaucccccucgucuccuacaagaaccucuccgaggaggagcacaacuccaucauccagcgcaugguccucggcgacaucgccgaccgcgacgccaucgucgaggcccucgagaccaaccgcuacaaccacaucaccgccaccuacuuccuccucgccgagcgcauccuccgcgagaagcaggagaaggagauccagacccgcuccgccucccccuccaacaucaaggcccaguuccgccaguccuggcccaccaagaucgacgucccccaggaccucgaggacgaccucaccgccaccccccucucccacgccaccgucccccagucccccgcccgcgccgccgacuccguccucaacggccaccgcuccaagggccucugcgacuccgccaagaaggacgaccuccccgagcucgccggccccgcccucuccaccgucccccccgccucccucaagcccaccgccuccggccgcaagugccucuuccgcgucgaggaggacgaggaggaggacgaggaggacaagaagcccaugucccucuccacccaggucguccuccgccgcaagcccuccgucaccaaccgccucaccucccgcaaguccgcccccguccucaaccagaucuucgaggagggcgaguccgacgacgaguucgacauggacgagaaccucccccccaagcucucccgccucaagaugaacaucgccucccccggcaccguccacaagcgcuaccaccgccgcaagucccagggccgcggcuccuccugcuccuccuccgagaccuccgacgacgacuccgagucccgccgccgccucgacaaggacuccggcuucaccuacuccuggcaccgccgcgacuccuccgagggcccccccggcuccgagggcgacggcggcggccaguccaagcccuccaacgccuccggcggcgucgacaaggccucccccuccgagaacaacgccggcggcggcucccccuccuccggcuccggcggcaaccccaccaacaccuccggcaccacccgccgcugcgccggccccuccaacuccaugcagcucgccucccgcuccgccggcgagcucgucgagucccucaagcucaugucccucugccucggcucccagcuccacggcuccaccaaguacaucaucgacccccagaacggccucuccuucuccuccgucaagguccaggagaaguccaccuggaagaugugcaucuccuccaccggcaacgccggccagguccccgccgucggcggcaucaaguucuucuccgaccacauggccgacaccaccaccgagcucgagcgcaucaaguccaagaaccucaagaacaacguccuccagcucccccucugcgagaagaccaucuccgucaacauccagcgcaaccccaaggagggccuccucugcgccuccucccccgccuccugcugccacgucaucuga

SEQ ID NO: 49915 - RNA, 6411 nt, Artificial Sequence
  derived and/or modified sequence opt2 from SNRNP200__Homo_sapiens__NP_054733
auggccgacgucaccgcccgcucccuccaguacgaguacaaggccaacuccaaccucguccuccaggccgaccgcucccucaucgaccgcacccgccgcgacgagcccaccggcgagguccucucccucgucggcaagcucgagggcacccgcaugggcgacaaggcccagcgcaccaagccccagaugcaggaggagcgccgcgccaagcgccgcaagcgcgacgaggaccgccacgacaucaacaagaugaagggcuacacccuccucuccgagggcaucgacgagauggucggcaucaucuacaagcccaagaccaaggagacccgcgagaccuacgagguccuccucuccuucauccaggccgcccucggcgaccagccccgcgacauccucugcggcgccgccgacgagguccucgccguccucaagaacgagaagcuccgcgacaaggagcgccgcaaggagaucgaccuccuccucggccagaccgacgacacccgcuaccacguccucgucaaccucggcaagaagaucaccgacuacggcggcgacaaggagauccagaacauggacgacaacaucgacgagaccuacggcgucaacguccaguucgaguccgacgaggaggagggcgacgaggacgucuacggcgagguccgcgaggaggccuccgacgacgacauggagggcgacgaggccgucguccgcugcacccucuccgccaaccucgucgccuccggcgagcucauguccuccaagaagaaggaccuccacccccgcgacaucgacgccuucuggcuccagcgccagcucucccgcuucuacgacgacgccaucgucucccagaagaaggccgacgagguccucgagauccucaagaccgccuccgacgaccgcgagugcgagaaccagcucguccuccuccucggcuucaacaccuucgacuucaucaagguccuccgccagcaccgcaugaugauccucuacugcacccuccucgccuccgcccaguccgaggccgagaaggagcgcaucaugggcaagauggaggccgaccccgagcucuccaaguuccucuaccagcuccacgagaccgagaaggaggaccucauccgcgaggagcgcucccgccgcgagcgcguccgccagucccgcauggacaccgaccucgagaccauggaccucgaccagggcggcgaggcccucgccccccgccagguccucgaccucgaggaccucgucuucacccagggcucccacuucauggccaacaagcgcugccagcuccccgacggcuccuuccgccgccagcgcaagggcuacgaggagguccacguccccgcccucaagcccaagcccuucggcuccgaggagcagcuccuccccgucgagaagcuccccaaguacgcccaggccggcuucgagggcuucaagacccucaaccgcauccaguccaagcucuaccgcgccgcccucgagaccgacgagaaccuccuccucugcgcccccaccggcgccggcaagaccaacgucgcccucaugugcaugcuccgcgagaucggcaagcacaucaacauggacggcaccaucaacgucgacgacuucaagaucaucuacaucgcccccaugcgcucccucguccaggagauggucggcuccuucggcaagcgccucgccaccuacggcaucaccgucgccgagcucaccggcgaccaccagcucugcaaggaggagaucuccgccacccagaucaucgucugcacccccgagaagugggacaucaucacccgcaagggcggcgagcgcaccuacacccagcucguccgccucaucauccucgacgagauccaccuccuccacgacgaccgcggccccguccucgaggcccucgucgcccgcgccauccgcaacaucgagaugacccaggaggacguccgccucaucggccucuccgccacccuccccaacuacgaggacgucgccaccuuccuccgcgucgaccccgccaagggccucuucuacuucgacaacuccuuccgccccgucccccucgagcagaccuacgucggcaucaccgagaagaaggccaucaagcgcuuccagaucaugaacgagaucgucuacgagaagaucauggagcacgccggcaagaaccagguccucgucuucguccacucccgcaaggagaccggcaagaccgcccgcgccauccgcgacaugugccucgagaaggacacccucggccucuuccuccgcgagggcuccgccuccaccgagguccuccgcaccgaggccgagcagugcaagaaccucgagcucaaggaccuccuccccuacggcuucgccauccaccacgccggcaugacccgcgucgaccgcacccucgucgaggaccucuucgccgacaagcacauccagguccucgucuccaccgccacccucgccuggggcgucaaccuccccgcccacaccgucaucaucaagggcacccaggucuacucccccgagaagggccgcuggaccgagcucggcgcccucgacauccuccagaugcucggccgcgccggccgcccccaguacgacaccaagggcgagggcauccucaucaccucccacggcgagcuccaguacuaccucucccuccucaaccagcagcuccccaucgagucccagauggucuccaagcuccccgacaugcucaacgccgagaucguccucggcaacguccagaacgccaaggacgccgucaacuggcucggcuacgccuaccucuacauccgcaugcuccgcucccccacccucuacggcaucucccacgacgaccucaagggcgacccccuccucgaccagcgccgccucgaccucguccacaccgccgcccucaugcucgacaagaacaaccucgucaaguacgacaagaagaccggcaacuuccaggucaccgagcucggccgcaucgccucccacuacuacaucaccaacgacaccguccagaccuacaaccagcuccucaagcccacccucuccgagaucgagcucuuccgcgucuucucccucuccuccgaguucaagaacaucaccguccgcgaggaggagaagcucgagcuccagaagcuccucgagcgcguccccauccccgucaaggaguccaucgaggagcccuccgccaagaucaacguccuccuccaggccuucaucucccagcucaagcucgagggcuucgcccucauggccgacauggucuacgucacccaguccgccggccgccucaugcgcgccaucuucgagaucguccucaaccgcggcugggcccagcucaccgacaagacccucaaccucugcaagaugaucgacaagcgcauguggcaguccaugugcccccuccgccaguuccgcaagcuccccgaggaggucgucaagaagaucgagaagaagaacuuccccuucgagcgccucuacgaccucaaccacaacgagaucggcgagcucauccgcaugcccaagaugggcaagaccauccacaaguacguccaccucuuccccaagcucgagcucuccguccaccuccagcccaucacccgcuccacccucaaggucgagcucaccaucacccccgacuuccagugggacgagaagguccacggcuccuccgaggccuucuggauccucgucgaggacgucgacuccgaggucauccuccaccacgaguacuuccuccucaaggccaaguacgcccaggacgagcaccucaucaccuucuucguccccgucuucgagccccuccccccccaguacuucauccgcgucgucuccgaccgcuggcucuccugcgagacccagcuccccgucuccuuccgccaccucauccuccccgagaaguaccccccccccaccgagcuccucgaccuccagccccuccccgucuccgcccuccgcaacuccgccuucgagucccucuaccaggacaaguuccccuucuucaaccccauccagacccaggucuucaacaccgucuacaacuccgacgacaacgucuucgucggcgcccccaccggcuccggcaagaccaucugcgccgaguucgccauccuccgcaugcuccuccaguccuccgagggccgcugcgucuacaucacccccauggaggcccucgccgagcaggucuacauggacugguacgagaaguuccaggaccgccucaacaagaaggucguccuccucaccggcgagaccuccaccgaccucaagcuccucggcaagggcaacaucaucaucuccacccccgagaagugggacauccucucccgccgcuggaagcagcgcaagaacguccagaacaucaaccucuucgucgucgacgagguccaccucaucggcggcgagaacggccccguccucgaggucaucugcucccgcaugcgcuacaucuccucccagaucgagcgccccauccgcaucgucgcccucuccuccucccucuccaacgccaaggacgucgcccacuggcucggcugcuccgccaccuccaccuucaacuuccaccccaacguccgccccgucccccucgagcuccacauccagggcuucaacaucucccacacccagacccgccuccucuccauggccaagcccgucuaccacgccaucaccaagcacucccccaagaagcccgucaucgucuucguccccucccgcaagcagacccgccucaccgccaucgacauccucaccaccugcgccgccgacauccagcgccagcgcuuccuccacugcaccgagaaggaccucauccccuaccucgagaagcucuccgacuccacccucaaggagacccuccucaacggcgucggcuaccuccacgagggccucucccccauggagcgccgccucgucgagcagcucuucuccuccggcgccauccaggucgucgucgccucccgcucccucugcuggggcaugaacgucgccgcccaccucgucaucaucauggacacccaguacuacaacggcaagauccacgccuacgucgacuaccccaucuacgacguccuccagauggucggccacgccaaccgcccccuccaggacgacgagggccgcugcgucaucaugugccagggcuccaagaaggacuucuucaagaaguuccucuacgagccccuccccgucgagucccaccucgaccacugcaugcacgaccacuucaacgccgagaucgucaccaagaccaucgagaacaagcaggacgccgucgacuaccucaccuggaccuuccucuaccgccgcaugacccagaaccccaacuacuacaaccuccagggcaucucccaccgccaccucuccgaccaccucuccgagcucgucgagcagacccucuccgaccucgagcaguccaagugcaucuccaucgaggacgagauggacgucgccccccucaaccucggcaugaucgccgccuacuacuacaucaacuacaccaccaucgagcucuucuccaugucccucaacgccaagaccaagguccgcggccucaucgagaucaucuccaacgccgccgaguacgagaacauccccauccgccaccacgaggacaaccuccuccgccagcucgcccagaaggucccccacaagcucaacaaccccaaguucaacgacccccacgucaagaccaaccuccuccuccaggcccaccucucccgcaugcagcucuccgccgagcuccaguccgacaccgaggagauccucuccaaggccauccgccucauccaggccugcgucgacguccucuccuccaacggcuggcucucccccgcccucgccgccauggagcucgcccagauggucacccaggccaugugguccaaggacuccuaccucaagcagcucccccacuucaccuccgagcacaucaagcgcugcaccgacaagggcgucgaguccgucuucgacaucauggagauggaggacgaggagcgcaacgcccuccuccagcucaccgacucccagaucgccgacgucgcccgcuucugcaaccgcuaccccaacaucgagcucuccuacgaggucgucgacaaggacuccauccgcuccggcggccccgucgucguccucguccagcucgagcgcgaggaggaggucaccggccccgucaucgccccccucuucccccagaagcgcgaggagggcuggugggucgucaucggcgacgccaaguccaacucccucaucuccaucaagcgccucacccuccagcagaaggccaaggucaagcucgacuucgucgcccccgccaccggcgcccacaacuacacccucuacuucauguccgacgccuacaugggcugcgaccaggaguacaaguucuccgucgacgucaaggaggccgagaccgacuccgacuccgacuga

SEQ ID NO: 49916 - RNA, 468 nt, Artificial Sequence
  derived and/or modified sequence opt2 from SNRNP27__Homo_sapiens__NP_006848
augggccgcucccgcucccgcuccccccgccgcgagcgccgccgcucccgcuccaccucccgcgagcgcgagcgccgccgccgcgagcgcucccgcucccgcgagcgcgaccgccgccgcucccgcucccgcuccccccaccgccgccgcucccgcuccccccgccgccaccgcuccaccucccccucccccucccgccucaaggagcgccgcgacgaggagaagaaggagaccaaggagaccaaguccaaggagcgccagaucaccgaggaggaccucgagggcaagaccgaggaggagaucgagaugaugaagcucaugggcuucgccuccuucgacuccaccaagggcaagaaggucgacggcuccgucaacgccuacgccaucaacgucucccagaagcgcaaguaccgccaguacaugaaccgcaagggcggcuucaaccgcccccucgacuucaucgccuga

SEQ ID NO: 49917 - RNA, 1287 nt, Artificial Sequence
  derived and/or modified sequence opt2 from SNRNP70__Homo_sapiens__NP_001287998
augacccaguuccucccccccaaccuccucgcccucuucgccccccgcgaccccauccccuaccuccccccccucgagaagcucccccacgagaagcaccacaaccagcccuacugcggcaucgcccccuacauccgcgaguucgaggacccccgcgacgcccccccccccacccgcgccgagacccgcgaggagcgcauggagcgcaagcgccgcgagaagaucgagcgccgccagcaggaggucgagaccgagcucaagaugugggacccccacaacgaccccaacgcccagggcgacgccuucaagacccucuucgucgcccgcgucaacuacgacaccaccgaguccaagcuccgccgcgaguucgaggucuacggccccaucaagcgcauccacauggucuacuccaagcgcuccggcaagccccgcggcuacgccuucaucgaguacgagcacgagcgcgacaugcacuccgccuacaagcacgccgacggcaagaagaucgacggccgccgcguccucgucgacgucgagcgcggccgcaccgucaagggcuggcgcccccgccgccucggcggcggccucggcggcacccgccgcggcggcgccgacgucaacauccgccacuccggccgcgacgacaccucccgcuacgacgagcgcgaccgcgaccgcgaccgcgagcgcgagcgccgcgagcgcucccgcgagcgcgacaaggagcgcgagcgccgccgcucccgcucccgcgaccgccgccgccgcucccgcucccgcgacaaggaggagcgccgccgcucccgcgagcgcuccaaggacaaggaccgcgaccgcaagcgccgcuccucccgcucccgcgagcgcgcccgccgcgagcgcgagcgcaaggaggagcuccgcggcggcggcggcgacauggccgagcccuccgaggccggcgacgccccccccgacgacggcccccccggcgagcucggccccgacggccccgacggccccgaggagaagggccgcgaccgcgaccgcgagcgccgccgcucccaccgcuccgagcgcgagcgccgccgcgaccgcgaccgcgaccgcgaccgcgaccgcgagcacaagcgcggcgagcgcggcuccgagcgcggccgcgacgaggcccgcggcggcggcggcggccaggacaacggccucgagggccucggcaacgacucccgcgacauguacauggaguccgagggcggcgacggcuaccucgcccccgagaacggcuaccucauggaggccgcccccgaguga

SEQ ID NO: 49918 - RNA, 849 nt, Artificial Sequence
  derived and/or modified sequence opt2 from SNRPA__Homo_sapiens__NP_004587
auggccguccccgagacccgccccaaccacaccaucuacaucaacaaccucaacgagaagaucaagaaggacgagcucaagaagucccucuacgccaucuucucccaguucggccagauccucgacauccucgucucccgcucccucaagaugcgcggccaggccuucgucaucuucaaggaggucuccuccgccaccaacgcccuccgcuccaugcagggcuuccccuucuacgacaagcccaugcgcauccaguacgccaagaccgacuccgacaucaucgccaagaugaagggcaccuucgucgagcgcgaccgcaagcgcgagaagcgcaagcccaagucccaggagacccccgccaccaagaaggccguccagggcggcggcgccacccccgucgucggcgccguccagggccccguccccggcaugccccccaugacccaggccccccgcaucaugcaccacaugcccggccagccccccuacaugcccccccccggcaugauccccccccccggccucgcccccggccagaucccccccggcgccaugcccccccagcagcucaugcccggccagaugccccccgcccagccccucuccgagaacccccccaaccacauccucuuccucaccaaccuccccgaggagaccaacgagcucaugcucuccaugcucuucaaccaguuccccggcuucaaggagguccgccucguccccggccgccacgacaucgccuucgucgaguucgacaacgagguccaggccggcgccgcccgcgacgcccuccagggcuucaagaucacccagaacaacgccaugaagaucuccuucgccaagaaguga

SEQ ID NO: 49919 - RNA, 696 nt, Artificial Sequence
  derived and/or modified sequence opt2 from SNRPB__Homo_sapiens__NP_003082
augaccgucggcaaguccuccaagaugcuccagcacaucgacuaccgcaugcgcugcauccuccaggacggccgcaucuucaucggcaccuucaaggccuucgacaagcacaugaaccucauccucugcgacugcgacgaguuccgcaagaucaagcccaagaacuccaagcaggccgagcgcgaggagaagcgcguccucggccucguccuccuccgcggcgagaaccucgucuccaugaccgucgagggccccccccccaaggacaccggcaucgcccgcgucccccucgccggcgccgccggcggccccggcaucggccgcgccgccggccgcggcauccccgccggcguccccaugccccaggcccccgccggccucgccggccccguccgcggcgucggcggccccucccagcaggucaugaccccccagggccgcggcaccgucgccgccgccgccgccgccgccaccgccuccaucgccggcgcccccacccaguacccccccggccgcggcggcccccccccccccaugggccgcggcgcccccccccccggcaugaugggccccccccccggcaugcgcccccccaugggcccccccaugggcaucccccccggccgcggcacccccaugggcaugcccccccccggcaugcgcccccccccccccggcaugcgcggccuccucuga

SEQ ID NO: 49920 - RNA, 480 nt, Artificial Sequence
  derived and/or modified sequence opt2 from SNRPC__Homo_sapiens__NP_003084
augcccaaguucuacugcgacuacugcgacaccuaccucacccacgacucccccuccguccgcaagacccacugcuccggccgcaagcacaaggagaacgucaaggacuacuaccagaaguggauggaggagcaggcccagucccucaucgacaagaccaccgccgccuuccagcagggcaagaucccccccacccccuucuccgcccccccccccgccggcgccaugaucccccccccccccucccuccccggccccccccgccccggcaugaugcccgccccccacaugggcggcccccccaugaugcccaugaugggcccccccccccccggcaugaugcccgucggccccgcccccggcaugcgcccccccaugggcggccacaugcccaugaugcccggcccccccaugaugcgcccccccgcccgccccaugaugguccccacccgccccggcaugacccgccccgaccgcuga

SEQ ID NO: 49921 - RNA, 360 nt, Artificial Sequence
  derived and/or modified sequence opt2 from SNRPD1__Homo_sapiens__NP_008869
augaagcucguccgcuuccucaugaagcucucccacgagaccgucaccaucgagcucaagaacggcacccagguccacggcaccaucaccggcgucgacgucuccaugaacacccaccucaaggccgucaagaugacccucaagaaccgcgagcccguccagcucgagacccucuccauccgcggcaacaacauccgcuacuucauccuccccgacucccucccccucgacacccuccucgucgacgucgagcccaaggucaaguccaagaagcgcgaggccgucgccggccgcggccgcggccgcggccgcggccgcggccgcggccgcggccgcggccgcggcggcccccgccgcuga

SEQ ID NO: 49922 - RNA, 381 nt, Artificial Sequence
  derived and/or modified sequence opt2 from SNRPD3__Homo_sapiens__NP_004166
auguccaucggcguccccaucaagguccuccacgaggccgagggccacaucgucaccugcgagaccaacaccggcgaggucuaccgcggcaagcucaucgaggccgaggacaacaugaacugccagauguccaacaucaccgucaccuaccgcgacggccgcgucgcccagcucgagcaggucuacauccgcggcuccaagauccgcuuccucauccuccccgacaugcucaagaacgcccccaugcucaaguccaugaagaacaagaaccagggcuccggcgccggccgcggcaaggccgccauccucaaggcccaggucgccgcccgcggccgcggccgcggcaugggccgcggcaacaucuuccagaagcgccgcuga

SEQ ID NO: 49923 - RNA, 255 nt, Artificial Sequence
  derived and/or modified sequence opt2 from SNRPE__Homo_sapiens__NP_001291393
auguccggccucggcgccaccgucguccagaaccucaucuuccgcuaccuccagaaccgcucccgcauccaggucuggcucuacgagcaggucaacaugcgcaucgagggcugcaucaucggcuucgacgaguacaugaaccucguccucgacgacgccgaggagauccacuccaagaccaagucccgcaagcagcucggccgcaucaugcucaagggcgacaacaucacccuccuccaguccgucuccaacuga

SEQ ID NO: 49924 - RNA, 261 nt, Artificial Sequence
  derived and/or modified sequence opt2 from SNRPF__Homo_sapiens__NP_003086
augucccucccccucaaccccaagcccuuccucaacggccucaccggcaagcccgucauggucaagcucaaguggggcauggaguacaagggcuaccucgucuccgucgacggcuacaugaacaugcagcucgccaacaccgaggaguacaucgacggcgcccucuccggccaccucggcgagguccucauccgcugcaacaacguccucuacauccgcggcgucgaggaggaggaggaggacggcgagaugcgcgaguga

SEQ ID NO: 49925 - RNA, 723 nt, Artificial Sequence
  derived and/or modified sequence opt2 from SNRPN__Homo_sapiens__NP_073719
augaccgucggcaaguccuccaagaugcuccagcacaucgacuaccgcaugcgcugcauccuccaggacggccgcaucuucaucggcaccuucaaggccuucgacaagcacaugaaccucauccucugcgacugcgacgaguuccgcaagaucaagcccaagaacgccaagcagcccgagcgcgaggagaagcgcguccucggccucguccuccuccgcggcgagaaccucgucuccaugaccgucgagggccccccccccaaggacaccggcaucgcccgcgucccccucgccggcgccgccggcggccccggcgucggccgcgccgccggccgcggcguccccgccggcguccccaucccccaggcccccgccggccucgccggccccguccgcggcgucggcggccccucccagcaggucaugaccccccagggccgcggcaccgucgccgccgccgccgucgccgccaccgccuccaucgccggcgcccccacccaguacccccccggccgcggcaccccccccccccccgucggccgcgccacccccccccccggcaucauggcccccccccccggcaugcgcccccccaugggcccccccaucggccucccccccgcccgcggcacccccaucggcaugcccccccccggcaugcgcccccccccccccggcauccgcggcccccccccccccggcaugcgccccccccgccccuga

SEQ ID NO: 49926 - RNA, 1518 nt, Artificial Sequence
  derived and/or modified sequence opt2 from SNTA1__Homo_sapiens__NP_003089
auggccuccggccgccgcgccccccgcaccggccuccucgagcuccgcgccggcgccggcuccggcgccggcggcgagcgcuggcagcgcguccuccucucccucgccgaggacguccucaccgucucccccgccgacggcgaccccggccccgagcccggcgccccccgcgagcaggagcccgcccagcucaacggcgccgccgagcccggcgccggccccccccagcuccccgaggcccuccuccuccagcgccgccgcgucaccguccgcaaggccgacgccggcggccucggcaucuccaucaagggcggccgcgagaacaagaugcccauccucaucuccaagaucuucaagggccucgccgccgaccagaccgaggcccucuucgucggcgacgccauccucuccgucaacggcgaggaccucuccuccgccacccacgacgaggccguccagguccucaagaagaccggcaaggaggucguccucgaggucaaguacaugaaggacgucucccccuacuucaagaacuccaccggcggcaccuccgucggcugggacuccccccccgccuccccccuccagcgccagcccuccucccccggccccaccccccgcaacuucuccgaggccaagcacaugucccucaagauggccuacgucuccaagcgcugcacccccaacgaccccgagccccgcuaccucgagaucugcuccgccgacggccaggacacccucuuccuccgcgccaaggacgaggccuccgcccgcuccugggccaccgccauccaggcccaggucaacacccucaccccccgcgucaaggacgagcuccaggcccuccucgccgccaccuccaccgccggcucccaggacaucaagcagaucggcuggcucaccgagcagcuccccuccggcggcaccgcccccacccucgcccuccucaccgagaaggagcuccuccucuaccucucccuccccgagacccgcgaggcccucucccgccccgcccgcaccgccccccucaucgccacccgccucguccacuccggccccuccaagggcuccguccccuacgacgccgagcucuccuucgcccuccgcaccggcacccgccacggcgucgacacccaccucuucuccgucgaguccccccaggagcucgccgccuggacccgccagcucgucgacggcugccaccgcgccgccgagggcguccaggaggucuccaccgccugcaccuggaacggccgccccugcucccucuccguccacaucgacaagggcuucacccucugggccgccgagcccggcgccgcccgcgccguccuccuccgccagcccuucgagaagcuccagauguccuccgacgacggcgccucccuccucuuccucgacuucggcggcgccgagggcgagauccagcucgaccuccacuccugccccaagaccaucgucuucaucauccacuccuuccucuccgccaaggucacccgccucggccuccucgccuga

SEQ ID NO: 49927 - RNA, 1617 nt, Artificial Sequence
  derived and/or modified sequence opt2 from SNTB1__Homo_sapiens__NP_066301
auggccgucgccgccgccgccgccgccgccggccccgccggcgccggcggcggccgcgcccagcgcuccggccuccucgagguccucguccgcgaccgcuggcacaagguccucgucaaccucuccgaggacgcccucguccucuccuccgaggagggcgccgccgccuacaacggcaucggcaccgccaccaacggcuccuucugccgcggcgccggcgccggccaccccggcgccggcggcgcccagccccccgacucccccgccggcguccgcaccgccuucaccgaccuccccgagcagguccccgaguccaucuccaaccagaagcgcggcgucaagguccucaagcaggagcucggcggccucggcaucuccaucaagggcggcaaggagaacaagaugcccauccucaucuccaagaucuucaagggccucgccgccgaccagacccaggcccucuacgucggcgacgccauccucuccgucaacggcgccgaccuccgcgacgccacccacgacgaggccguccaggcccucaagcgcgccggcaaggagguccuccucgaggucaaguacaugcgcgaggccacccccuacgucaagaagggcucccccgucuccgagaucggcugggagacccccccccccgaguccccccgccucggcggcuccaccuccgacccccccuccucccaguccuucuccuuccaccgcgaccgcaaguccaucccccucaagaugugcuacgucacccgcuccauggcccucgccgaccccgagaaccgccagcucgagauccacucccccgacgccaagcacaccgucauccuccgcuccaaggacuccgccaccgcccaggccugguucuccgccauccacuccaacgucaacgaccuccucacccgcgucaucgccgagguccgcgagcagcucggcaagaccggcaucgccggcucccgcgagauccgccaccucggcuggcucgccgagaagguccccggcgaguccaagaagcaguggaagcccgcccucgucguccucaccgagaaggaccuccucaucuacgacuccaugccccgccgcaaggaggccugguucucccccguccacaccuacccccuccucgccacccgccucguccacuccggccccggcaagggcuccccccaggccggcgucgaccucuccuucgccacccgcaccggcacccgccagggcaucgagacccaccucuuccgcgccgagaccucccgcgaccucucccacuggacccgcuccaucguccagggcugccacaacuccgccgagcucaucgccgagaucuccaccgccugcaccuacaagaaccaggagugccgccucaccauccacuacgagaacggcuucuccaucaccaccgagccccaggagggcgccuuccccaagaccaucauccagucccccuacgagaagcucaagauguccuccgacgacggcauccgcaugcucuaccucgacuucggcggcaaggacggcgagauccagcucgaccuccacuccugccccaagcccaucgucuucaucauccacuccuuccucuccgccaagaucacccgccucggccucgucgccuga

SEQ ID NO: 49928 - RNA, 1443 nt, Artificial Sequence
  derived and/or modified sequence opt2 from SNTG1__Homo_sapiens__NP_001274743
auggacuuccgcaccgccugcgaggagaccaagaccggcaucugccuccuccaggacggcaaccaggagcccuucaagguccgccuccaccucgccaaggacauccucaugauccaggagcaggacgucaucugcgucuccggcgagcccuucuacuccggcgagcgcaccgucaccauccgccgccagaccgucggcggcuucggccucuccaucaagggcggcgccgagcacaacauccccgucgucgucuccaagaucuccaaggagcagcgcgccgagcucuccggccuccucuucaucggcgacgccauccuccagaucaacggcaucaacguccgcaagugccgccacgaggaggucguccagguccuccgcaacgccggcgaggaggucacccucaccgucuccuuccucaagcgcgcccccgccuuccucaagcucccccucaacgaggacugcgccugcgcccccuccgaccaguccuccggcaccuccuccccccucugcgacuccggccuccaccucaacuaccaccccaacaacaccgacacccucuccugcuccuccuggcccaccucccccggccuccgcugggagaagcgcuggugcgaccuccgccucaucccccuccuccacucccgcuucucccaguacguccccggcaccgaccucucccgccagaacgccuuccaggucaucgccgucgacggcgucugcaccggcaucauccagugccucuccgccgaggacugcgucgacuggcuccaggccaucgccaccaacaucuccaaccucaccaagcacaacaucaagaagaucaaccgcaacuuccccgucaaccagcagaucgucuacaugggcuggugcgaggcccgcgagcaggacccccuccaggaccgcgucuacucccccaccuuccucgcccuccgcggcuccugccucuacaaguuccucgccccccccgucaccaccugggacuggacccgcgccgagaagaccuucuccgucuacgagaucaugugcaagauccucaaggacuccgaccuccucgaccgccgcaagcagugcuucaccguccaguccgaguccggcgaggaccucuacuucuccgucgagcucgaguccgaccucgcccagugggagcgcgccuuccagaccgccaccuuccucgaggucgagcgcauccagugcaagaccuacgccugcguccucgagucccaccucaugggccucaccaucgacuucuccaccggcuucaucugcuucgacgccgccaccaaggagcucgaguucuccaaccucuucgccguccuccacugcauccacuccuucuucgccgccaaggucgccugccucgacccccucuuccucggcaaccaggccaccgccuccaccgccgccuccuccgccaccaccuccaaggccaaguacaccaccuga

SEQ ID NO: 49929 - RNA, 1620 nt, Artificial Sequence
  derived and/or modified sequence opt2 from SNTG2__Homo_sapiens__NP_061841
augggcaccgagggcccccccccccccgccgccucccgcggccgccagggcugccuccucguccccgcccgcaccaagaccaccaucgcccuccucuacgacgaggaguccgagaacgccuacgacauccgccucaagcucaccaaggagguccucaccauccagaagcaggacgucgucugcgucggcggcucccaccagggccgcaaccgccgcaccgucacccuccgccgccagcccgucggcggccucggccucuccaucaagggcggcuccgagcacaacguccccgucgucaucuccaagaucuucgaggaccaggccgccgaccagaccggcaugcucuucgucggcgacgccguccuccaggucaacggcauccacgucgagaacgccacccacgaggaggucguccaccuccuccgcaacgccggcgacgaggucaccaucaccgucgaguaccuccgcgaggcccccgccuuccucaagcucccccucggcucccccggccccuccuccgaccacuccuccggcgccuccuccccccucuucgacuccggccuccaccucaacggcaacuccuccaccaccgcccccuccucccccuccucccccaucgccaaggacccccgcuacgagaagcgcuggcucgacacccucuccgucccccucuccauggcccgcaucucccgcuacaaggccggcaccgagaagcuccgcuggaacgccuucgagguccucgcccucgacggcgucuccuccggcauccuccgcuucuacaccgcccaggacggcaccgacuggcuccgcgccgucuccgccaacauccgcgagcucacccuccagaacaugaagauggccaacaagugcugcucccccuccgaccaggucguccacaugggcugggucaacgagaagcuccagggcgccgacuccucccagaccuuccgccccaaguuccucgcccucaagggccccuccuucuacgucuucuccaccccccccgucuccaccuucgacuggguccgcgccgagcgcaccuaccaccucugcgagguccucuucaagguccacaaguucuggcucaccgaggacugcuggcuccaggccaaccucuaccucggccuccaggacuucgacuucgaggaccagcgccccuacugcuucuccaucgucgccggccacggcaagucccacgucuucaacgucgagcucggcuccgagcucgccaugugggagaaguccuuccagcgcgccaccuucauggagguccagcgcaccggcucccgcaccuacaugugcuccuggcagggcgagaugcucugcuucaccgucgacuucgcccucggcuucaccugcuucgaguccaagaccaagaacguccucuggcgcuucaaguucucccagcucaagggcuccuccgacgacggcaagacccgcgucaagcuccucuuccagaaccucgacaccaagcagaucgagaccaaggagcucgaguuccaggaccuccgcgccguccuccacugcauccacuccuucaucgccgccaaggucgccuccgucgaccccggcuucauggacucccagucccucgcccgcaaguacauguacuccuccuga

SEQ ID NO: 49930 - RNA, 1083 nt, Artificial Sequence
  derived and/or modified sequence opt2 from SNUPN__Homo_sapiens__NP_005692
auggaggagcucucccaggcccucgccuccuccuucuccgucucccaggaccucaacuccaccgccgccccccacccccgccucucccaguacaaguccaaguacuccucccucgagcaguccgagcgccgccgccgccuccucgagcuccagaaguccaagcgccucgacuacgucaaccacgcccgccgccucgccgaggacgacuggaccggcauggaguccgaggaggagaacaagaaggacgacgaggagauggacaucgacaccgucaagaagcuccccaagcacuacgccaaccagcucaugcucuccgaguggcucaucgacguccccuccgaccucggccaggaguggaucgucgucgucugccccgucggcaagcgcgcccucaucgucgccucccgcggcuccaccuccgccuacaccaaguccggcuacugcgucaaccgcuucuccucccuccuccccggcggcaaccgccgcaacuccaccgccaaggacuacaccauccucgacugcaucuacaacgaggucaaccagaccuacuacguccucgacgucaugugcuggcgcggccaccccuucuacgacugccagaccgacuuccgcuucuacuggaugcacuccaagcuccccgaggaggagggccucggcgagaagaccaagcucaaccccuucaaguucgucggccucaagaacuuccccugcacccccgagucccucugcgacguccucuccauggacuuccccuucgaggucgacggccuccucuucuaccacaagcagacccacuacucccccggcuccaccccccucgucggcuggcuccgccccuacauggucuccgacguccucggcgucgccguccccgccggcccccucaccaccaagcccgacuacgccggccaccagcuccagcagaucauggagcacaagaagucccagaaggagggcaugaaggagaagcucacccacaaggccuccgagaacggccacuacgagcucgagcaccucuccacccccaagcucaagggcuccucccacucccccgaccaccccggcugccucauggagaacuga

SEQ ID NO: 49931 - RNA, 216 nt, Artificial Sequence
  derived and/or modified sequence opt2 from SNURF__Homo_sapiens__NP_005669
auggagcgcgcccgcgaccgccuccaccuccgccgcaccaccgagcagcacguccccgaggucgagguccaggucaagcgccgccgcaccgccucccucuccaaccaggagugccagcucuacccccgccgcucccagcagcagcagguccccgucgucgacuuccaggccgagcuccgccaggccuuccucgccgagaccccccgcggcggcuga

SEQ ID NO: 49932 - RNA, 1611 nt, Artificial Sequence
  derived and/or modified sequence opt2 from SNW1__Homo_sapiens__NP_036377
auggcccucaccuccuuccuccccgcccccacccagcucucccaggaccagcucgaggccgaggagaaggcccgcucccagcgcucccgccagaccucccucgucuccucccgccgcgagcccccccccuacggcuaccgcaagggcuggaucccccgccuccucgaggacuucggcgacggcggcgccuuccccgagauccacgucgcccaguacccccucgacaugggccgcaagaagaagauguccaacgcccucgccauccaggucgacuccgagggcaagaucaaguacgacgccaucgcccgccagggccaguccaaggacaaggucaucuacuccaaguacaccgaccucguccccaaggaggucaugaacgccgacgaccccgaccuccagcgccccgacgaggaggccaucaaggagaucaccgagaagacccgcgucgcccucgagaaguccgucucccagaaggucgccgccgccaugcccguccgcgccgccgacaagcucgcccccgcccaguacauccgcuacacccccucccagcagggcgucgccuucaacuccggcgccaagcagcgcgucauccgcauggucgagaugcagaaggaccccauggagcccccccgcuucaagaucaacaagaagaucccccgcggcccccccuccccccccgcccccgucaugcacucccccucccgcaagaugaccgucaaggagcagcaggaguggaagaucccccccugcaucuccaacuggaagaacgccaagggcuacaccaucccccucgacaagcgccucgccgccgacggccgcggccuccagaccguccacaucaacgagaacuucgccaagcucgccgaggcccucuacaucgccgaccgcaaggcccgcgaggccgucgagaugcgcgcccaggucgagcgcaagauggcccagaaggagaaggagaagcacgaggagaagcuccgcgagauggcccagaaggcccgcgagcgccgcgccggcaucaagacccacgucgagaaggaggacggcgaggcccgcgagcgcgacgagauccgccacgaccgccgcaaggagcgccagcacgaccgcaaccucucccgcgccgcccccgacaagcgcuccaagcuccagcgcaacgagaaccgcgacaucuccgaggucaucgcccucggcguccccaacccccgcaccuccaacgagguccaguacgaccagcgccucuucaaccaguccaagggcauggacuccggcuucgccggcggcgaggacgagaucuacaacgucuacgaccaggccuggcgcggcggcaaggacauggcccaguccaucuaccgccccuccaagaaccucgacaaggacauguacggcgacgaccucgaggcccgcaucaagaccaaccgcuucguccccgacaaggaguucuccggcuccgaccgccgccagcgcggccgcgagggccccguccaguucgaggaggaccccuucggccucgacaaguuccucgaggaggccaagcagcacggcggcuccaagcgccccuccgacuccucccgccccaaggagcacgagcacgagggcaagaagcgccgcaaggaguga

SEQ ID NO: 49933 - RNA, 606 nt, Artificial Sequence
  derived and/or modified sequence opt2 from SNX10__Homo_sapiens__NP_001186764
auguuccccgagcagcagaaggaggaguucgucuccgucuggguccgcgacccccgcauccagaaggaggacuucuggcacuccuacaucgacuacgagaucugcauccacaccaacuccaugugcuucaccaugaagaccuccugcguccgccgccgcuaccgcgaguucgucuggcuccgccagcgccuccaguccaacgcccuccucguccagcuccccgagcuccccuccaagaaccucuucuucaacaugaacaaccgccagcacgucgaccagcgccgccagggccucgaggacuuccuccgcaagguccuccagaacgcccuccuccucuccgacuccucccuccaccucuuccuccagucccaccucaacuccgaggacaucgaggccugcgucuccggccagaccaaguacuccgucgaggaggccauccacaaguucgcccucaugaaccgccgcuuccccgaggaggacgaggagggcaagaaggagaacgacaucgacuacgacuccgaguccuccuccuccggccucggccacuccuccgacgacuccuccucccacggcugcaaggucaacaccgccccccaggaguccuga

SEQ ID NO: 49934 - RNA, 477 nt, Artificial Sequence
  derived and/or modified sequence opt2 from SNX12__Homo_sapiens__NP_001243117
auguccgacaccgccgucgccgacacccgccgccucaacuccaagccccaggaccucaccgacgccuacggcccccccuccaacuuccucgagaucgacaucuucaacccccagaccgucggcgucggccgcgcccgcuucaccaccuacgagaccaaccuccccaucuucaagcucaaggaguccugcguccgccgccgcuacuccgacuucgaguggcucaagaacgagcucgagcgcgacuccaagaucgucguccccccccuccccggcaaggcccucaagcgccagcuccccuuccgcggcgacgagggcaucuucgaggaguccuucaucgaggagcgccgccagggccucgagcaguucaucaacaagaucgccggccacccccucgcccagaacgagcgcugccuccacauguuccuccaggaggaggccaucgaccgcaacuacguccccggcaagguccgccaguga

SEQ ID NO: 49935 - RNA, 2814 nt, Artificial Sequence
  derived and/or modified sequence opt2 from SNX14__Homo_sapiens__NP_001284543
augguccccuggguccgcaccaugggccagaagcucaagcagcgccuccgccucgacgucggccgcgagaucugccgccaguacccccucuucugcuuccuccuccucugccucuccgccgccucccuccuccucaaccgcuacauccacauccucaugaucuucugguccuucgucgccggcgucgucaccuucuacugcucccucggccccgacucccuccuccccaacaucuucuucaccaucaaguacaagcccaagcagcucggccuccaggagcucuucccccagggccacuccugcgccgucugcggcaaggucaagugcaagcgccaccgccccucccuccuccucgagaacuaccagcccuggcucgaccucaagaucuccuccaaggucgacgccucccucuccgagguccucgagcucguccucgagaacuucgucuaccccugguaccgcgacgucaccgacgacgaguccuucgucgacgagcuccgcaucacccuccgcuucuucgccuccguccucauccgccgcauccacaaggucgacauccccuccaucaucaccaagaagcuccucaaggccgccaugaagcacaucgaggucaucgucaaggcccgccagaaggucaagaacaccgaguuccuccagcaggccgcccucgaggaguacggccccgagcuccacgucgcccuccgcucccgccgcgacgagcuccacuaccuccgcaagcucaccgagcuccucuuccccuacauccucccccccaaggccaccgacugccgcucccucacccuccucauccgcgagauccucuccggcuccgucuuccuccccucccucgacuuccucgccgaccccgacaccgucaaccaccuccucaucaucuucaucgacgacuccccccccgagaaggccaccgagcccgccuccccccucguccccuuccuccagaaguucgccgagccccgcaacaagaagcccuccguccucaagcucgagcucaagcagauccgcgagcagcaggaccuccucuuccgcuucaugaacuuccucaagcaggagggcgccguccacguccuccaguucugccucaccgucgaggaguucaacgaccgcauccuccgccccgagcucuccaacgacgagaugcucucccuccacgaggagcuccagaagaucuacaagaccuacugccucgacgaguccaucgacaagauccgcuucgaccccuucaucgucgaggagauccagcgcaucgccgagggccccuacaucgacgucgucaagcuccagaccaugcgcugccucuucgaggccuacgagcacguccucucccuccucgagaacgucuucacccccauguucugccacuccgacgaguacuuccgccagcuccuccgcggcgccgagucccccacccgcaacuccaagcucaaccgcaacacccagaagcgcggcgaguccuucggcaucucccgcaucggcuccaagaucaagggcgucuucaaguccaccaccauggagggcgccaugcuccccaacuacggcgucgccgagggcgaggacgacuucaucgaggagggcaucgucgucauggaggacgacucccccgucgaggccgucuccacccccaacaccccccgcaaccucgccgccuggaagaucuccauccccuacgucgacuucuucgaggaccccuccuccgagcgcaaggagaagaaggagcgcauccccgucuucugcaucgacgucgagcgcaacgaccgccgcgccgucggccacgagcccgagcacugguccgucuaccgccgcuaccucgaguucuacguccucgaguccaagcucaccgaguuccacggcgccuuccccgacgcccagcuccccuccaagcgcaucaucggccccaagaacuacgaguuccucaaguccaagcgcgaggaguuccaggaguaccuccagaagcuccuccagcaccccgagcucuccaacucccagcuccucgccgacuuccucucccccaacggcggcgagacccaguuccucgacaagauccuccccgacgucaaccucggcaagaucaucaaguccguccccggcaagcucaugaaggagaagggccagcaccucgagcccuucaucaugaacuucaucaacuccugcgagucccccaagcccaagcccucccgccccgagcucaccauccucucccccaccuccgagaacaacaagaagcucuucaacgaccucuucaagaacaacgccaaccgcgccgagaacaccgagcgcaagcagaaccagaacuacuucauggaggucaugaccgucgagggcgucuacgacuaccucauguacgucggccgcgucgucuuccagguccccgacuggcuccaccaccuccucaugggcacccgcauccucuucaagaacacccucgagauguacaccgacuacuaccuccagugcaagcucgagcagcucuuccaggagcaccgccucgucucccucaucacccuccuccgcgacgccaucuucugcgagaacaccgagccccgcucccuccaggacaagcagaagggcgccaagcagaccuucgaggagaugaugaacuacauccccgaccuccucgucaagugcaucggcgaggagaccaaguacgaguccauccgccuccucuucgacggccuccagcagcccguccucaacaagcagcucaccuacguccuccucgacaucgucauccaggagcucuuccccgagcucaacaagguccagaaggaggucaccuccgucaccuccuggauguga

SEQ ID NO: 49936 - RNA, 1035 nt, Artificial Sequence
  derived and/or modified sequence opt2 from SNX16__Homo_sapiens__NP_690049
auggccacccccuacguccccguccccaugcccaucggcaacuccgccuccuccuucaccaccaaccgcaaccagcgcuccuccuccuucggcuccgucuccaccuccuccaacuccuccaagggccagcucgaggacuccaacaugggcaacuucaagcagaccuccguccccgaccagauggacaacaccuccuccgucugcuccuccccccucauccgcaccaaguucaccggcaccgccuccuccaucgaguacuccacccgcccccgcgacaccgaggagcagaaccccgagaccgucaacugggaggaccgccccuccacccccaccauccucggcuacgaggucauggaggagcgcgccaaguucaccgucuacaagauccucgucaagaagacccccgaggaguccugggucgucuuccgccgcuacaccgacuucucccgccucaacgacaagcucaaggagauguuccccggcuuccgccucgcccucccccccaagcgcugguucaaggacaacuacaacgccgacuuccucgaggaccgccagcucggccuccaggccuuccuccagaaccucgucgcccacaaggacaucgccaacugccucgccguccgcgaguuccucugccucgacgacccccccggccccuucgacucccucgaggagucccgcgccuucugcgagacccucgaggagaccaacuaccgccuccagaaggagcuccucgagaagcagaaggagauggagucccucaagaagcuccucuccgagaagcagcuccacaucgacacccucgagaaccgcauccgcacccucucccucgagcccgaggagucccucgacgucuccgagaccgagggcgagcagauccucaaggucgaguccuccgcccucgaggucgaccaggacguccucgacgaggagucccgcgccgacaacaagcccugccucuccuucuccgagcccgagaacgccgucuccgagaucgaggucgccgaggucgccuacgacgccgaggaggacuga

SEQ ID NO: 49937 - RNA, 1875 nt, Artificial Sequence
  derived and/or modified sequence opt2 from SNX18__Homo_sapiens__NP_001096045
auggcccuccgcgcccgcgcccucuacgacuuccgcuccgagaaccccggcgagaucucccuccgcgagcacgagguccucucccucugcuccgagcaggacaucgagggcuggcucgagggcgucaacucccgcggcgaccgcggccucuuccccgccuccuacguccaggucauccgcgcccccgagcccggccccgccggcgacggcggccccggcgcccccgcccgcuacgccaacgucccccccggcggcuucgagccccuccccgucgccccccccgccuccuucaagcccccccccgacgccuuccaggcccuccuccagccccagcaggcccccccccccuccaccuuccagccccccggcgccggcuuccccuacggcggcggcgcccuccagcccuccccccagcagcucuacggcggcuaccaggccucccagggcuccgacgacgacugggacgacgagugggacgacuccuccaccgucgccgacgagcccggcgcccucggcuccggcgccuaccccgaccucgacggcuccuccuccgccggcgucggcgccgccggccgcuaccgccucuccacccgcuccgaccucucccucggcucccgcggcggcuccguccccccccagcaccaccccuccggccccaaguccuccgccaccgucucccgcaaccucaaccgcuucuccaccuucgucaaguccggcggcgaggccuucguccucggcgaggccuccggcuucgucaaggacggcgacaagcucugcgucguccucggccccuacggccccgaguggcaggagaaccccuaccccuuccagugcaccaucgacgaccccaccaagcagaccaaguucaagggcaugaaguccuacaucuccuacaagcucguccccacccacacccagguccccguccaccgccgcuacaagcacuucgacuggcucuacgcccgccucgccgagaaguuccccgucaucuccgucccccaccuccccgagaagcaggccaccggccgcuucgaggaggacuucaucuccaagcgccgcaagggccucaucugguggaugaaccacauggccucccaccccguccucgcccagugcgacgucuuccagcacuuccucaccugccccuccuccaccgacgagaaggccuggaagcagggcaagcgcaaggccgagaaggacgagauggucggcgccaacuucuuccucacccucuccaccccccccgccgccgcccucgaccuccaggaggucgaguccaagaucgacggcuucaagugcuucaccaagaagauggacgacuccgcccuccagcucaaccacaccgccaacgaguucgcccgcaagcaggucaccggcuucaagaaggaguaccagaaggucggccaguccuuccgcggccucucccaggccuucgagcucgaccagcaggccuucuccgucggccucaaccaggccaucgccuucaccggcgacgccuacgacgccaucggcgagcucuucgccgagcagccccgccaggaccucgaccccgucauggaccuccucgcccucuaccagggccaccucgccaacuuccccgacaucauccacguccagaagggcgcccucaccaaggucaaggagucccgccgccacgucgaggagggcaagauggagguccagaaggccgacggcauccaggaccgcugcaacaccaucuccuucgccacccucgccgagauccaccacuuccaccagauccgcguccgcgacuucaagucccagaugcagcacuuccuccagcagcagaucaucuucuuccagaaggucacccagaagcucgaggaggcccuccacaaguacgacuccgucuga

SEQ ID NO: 49938 - RNA, 1119 nt, Artificial Sequence
  derived and/or modified sequence opt2 from SNX19__Homo_sapiens__NP_001288018
auggacuccgaccgcgucgaggcccgcaagucccuccucgaguccuuccucaagcagcucugcgccauccccgagaucgccaacuccgaggagguccaggaguuccucgcccucaacaccgacgcccgcaucgccuucgucaagaagcccuucauggucucccgcaucgacaagauggucgucuccgccaucgucgacacccucaagaccgccuucccccgcuccgagccccagucccccaccgaggagcucuccgaggccgagaccgaguccaagccccagaccgagggcaagaaggccuccaagucccgccuccgcuucuccuccuccaagaucucccccgcccucuccgucaccgaggcccaggacaagauccucuacugccuccaggagggcaacgucgaguccgagacccucuccauguccgccauggaguccuucaucgagaagcagaccaagcuccucgagaugcagcccaccaaggcccccgagaaggaccccgagcagccccccaagggccgcgucgacuccugcgucuccgacgccgccguccccgcccaggaccccuccaacuccgaccccggcaccgagaccgagcucgccgacaccgcccucgaccuccuccuccuccuccucaccgagcaguggaaguggcucugcaccgagaacaugcagaaguuccuccgccucaucuucggcacccucguccagcgcuggcucgagguccaggucgccaaccucaccuccccccagcgcuggguccaguaccuccuccuccuccaggaguccaucuggcccggcggcguccuccccaaguucccccgccccguccgcacccaggagcagaagcucgccgccgagaagcaggcccuccagucccucaugggcguccuccccgaccucgucgucgagauccucggcgucaacaagugccgccucuccuggggccucguccucgagucccuccagcagccccucaucaaccgccaccucaucuacugccucggcgacaucauccucgaguuccucgaccucuccgccuccgucgaggaguccgccgccaccaccuccgccuccgacacccccggcaacuccaagcgcaugggcgucuccuccuga

SEQ ID NO: 49939 - RNA, 1569 nt, Artificial Sequence
  derived and/or modified sequence opt2 from SNX1__Homo_sapiens__NP_003090
auggccuccggcggcggcggcugcuccgccuccgagcgccuccccccccccuuccccggccucgagcccgaguccgagggcgccgccggcggcuccgagcccgaggccggcgacuccgacaccgagggcgaggacaucuucaccggcgccgccgucgucuccaagcaccagucccccaagaucaccaccucccuccuccccaucaacaacggcuccaaggagaacggcauccacgaggagcaggaccaggagccccaggaccucuucgccgacgccaccgucgagcucucccucgacuccacccagaacaaccagaagaagguccucgccaagacccucaucucccuccccccccaggaggccaccaacuccuccaagccccagcccaccuacgaggagcucgaggaggaggagcaggaggaccaguucgaccucaccgucggcaucaccgaccccgagaagaucggcgacggcaugaacgccuacgucgccuacaaggucaccacccagaccucccucccccucuuccgcuccaagcaguucgccgucaagcgccgcuucuccgacuuccucggccucuacgagaagcucuccgagaagcacucccagaacggcuucaucgucccccccccccccgagaagucccucaucggcaugaccaaggucaaggucggcaaggaggacuccuccuccgccgaguuccucgagaagcgccgcgccgcccucgagcgcuaccuccagcgcaucgucaaccaccccaccaugcuccaggaccccgacguccgcgaguuccucgagaaggaggagcucccccgcgccgucggcacccagacccucuccggcgccggccuccucaagauguucaacaaggccaccgacgccgucuccaagaugaccaucaagaugaacgaguccgacaucugguucgaggagaagcuccaggaggucgagugcgaggagcagcgccuccgcaagcuccacgccgucgucgagacccucgucaaccaccgcaaggagcucgcccucaacaccgcccaguucgccaagucccucgccaugcucggcuccuccgaggacaacaccgcccucucccgcgcccucucccagcucgccgaggucgaggagaagaucgagcagcuccaccaggagcaggccaacaacgacuucuuccuccucgccgagcuccucuccgacuacauccgccuccucgccaucguccgcgccgccuucgaccagcgcaugaagaccuggcagcgcuggcaggacgcccaggccacccuccagaagaagcgcgaggccgaggcccgccuccucugggccaacaagcccgacaagcuccagcaggccaaggacgagauccucgagugggagucccgcgucacccaguacgagcgcgacuucgagcgcaucuccaccgucguccgcaaggaggucauccgcuucgagaaggagaaguccaaggacuucaagaaccacgucaucaaguaccucgagacccuccucuacucccagcagcagcucgccaaguacugggaggccuuccuccccgaggccaaggccaucuccuga

SEQ ID NO: 49940 - RNA, 309 nt, Artificial Sequence
  derived and/or modified sequence opt2 from SNX20__Homo_sapiens__NP_001138444
auggccucccccgagcaccccggcucccccggcugcaugggccccaucacccagugcaccgcccgcacccagcaggaggcccccgccaccggccccgaccucccccaccccggccccgacggccaccucgacacccacuccggccucuccuccaacuccuccaugaccacccgcgagcuccagcaguacuggcagaaccagaagugccgcuggaagcacgucaagcuccucuucgagaucgccuccgcccgcaucgaggagcgcaaggucuccaaguucgucgcccccgcccccgacgccacccccuga

SEQ ID NO: 49941 - RNA, 510 nt, Artificial Sequence
  derived and/or modified sequence opt2 from SNX24__Homo_sapiens__NP_054754
auggaggucuacauccccuccuuccgcuacgaggaguccgaccucgagcgcggcuacaccgucuucaagaucgagguccucaugaacggccgcaagcacuucgucgagaagcgcuacuccgaguuccacgcccuccacaagaagcucaagaagugcaucaagacccccgagauccccuccaagcacguccgcaacuggguccccaagguccucgagcagcgccgccagggccucgagaccuaccuccaggccgucauccucgagaacgaggagcuccccaagcucuuccucgacuuccucaacguccgccaccuccccucccuccccaaggccgaguccugcggcuccuucgacgagaccgaguccgaggaguccuccaagcucucccaccagcccguccuccucuuccuccgcgaccccuacguccuccccgccgccuccgacuuccccaacgucgucaucgagggcguccuccacggcaucuucuacccccaccuccagccccgcuga

SEQ ID NO: 49942 - RNA, 3015 nt, Artificial Sequence
  derived and/or modified sequence opt2 from SNX25__Homo_sapiens__XP_005263324
augcaccccgacgccaccgacuccggcggcgccggccccucccccgcccgcgccgccggcgccggcggccgccccgucuccggcuuccgcggcgagcgccgccccgagucccccggcgacgccgaggccgccgccgccgccgcccccggcgcccccggcggccgcuccugguggaagcccgucgccgucgccgcccucgccgccgucgcccucuccuuccucggccccggcuccggcgaggccgccggcgccgccggccucuccuccguccucuuccgccucucccucuaccucuccugcgccgccgccgccuuccuccucggcauccucuucgcccucgucugccgcuccccccgcgcccagccccccgacuucgccgccgccuggucccgccucgccgccaccuccgccgcccgccgcccccccggcucccccgucuacggcaacucccacgaguccgcccagucccgccgcgucgucaucucccacaacauggacaaggcccucaaggaggucuucgacuacuccuaccgcgacuacauccucuccugguacggcaaccucucccgcgacgagggccagcucuaccaccuccuccucgaggacuucugggagaucgcccgccagcuccaccaccgccucucccacgucgacgucgucaaggucgucugcaacgacgucguccgcacccuccucacccacuucugcgaccucaaggccgccaacgcccgccacgaggagcagccccgccccuucguccuccacgccugccuccgcaacuccgacgacgagguccgcuuccuccagaccugcucccgcguccucgucuucugccuccuccccuccaaggacguccagucccucucccuccgcaucaugcucgccgagauccucaccaccaagguccucaagcccgucgucgagcuccucuccaaccccgacuacaucaaccagaugcuccucgcccagcucgccuaccgcgagcagaugaacgagcaccacaagcgcgccuacaccuacgcccccuccuacgaggacuucaucaagcucaucaacuccaacuccgacgucgaguuccucaagcagcuccgcuaccagaucgucgucgagaucauccaggccaccaccaucuccuccuucccccagcucaagcgccacaagggcaaggagaccgccgccaugaaggccgaccuccuccgcgcccgcaacaugaagcgcuacaucaaccagcucaccgucgccaagaagcagugcgagaagcgcauccgcauccucggcggccccgccuacgaccagcaggaggacggcgcccucgacgagggcgagggcccccagucccagaagauccuccaguucgaggacauccucgccaacaccuucuaccgcgagcacuucggcauguacauggagcgcauggacaagcgcgcccucaucuccuucugggaguccgucgagcaccucaagaacgccaacaagaacgagaucccccagcucgucggcgagaucuaccagaacuucuucgucgaguccaaggagaucuccgucgagaagucccucuacaaggagauccagcagugccucgucggcaacaagggcaucgaggucuucuacaagauccaggaggacgucuacgagacccucaaggaccgcuacuaccccuccuucaucgucuccgaccucuacgagaagcuccucaucaaggaggaggagaagcacgccucccagaugaucuccaacaaggacgagaugggcccccgcgacgaggccggcgaggaggccgucgacgacggcaccaaccagaucaacgagcaggccuccuucgccgucaacaagcuccgcgagcucaacgagaagcucgaguacaagcgccaggcccucaacuccauccagaacgcccccaagcccgacaagaagaucgucuccaagcucaaggacgagaucauccucaucgagaaggagcgcaccgaccuccagcuccacauggcccgcaccgacugguggugcgagaaccucggcauguggaaggccuccaucaccuccggcgaggucaccgaggagaacggcgagcagcuccccugcuacuucgucauggucucccuccaggaggucggcggcgucgagaccaagaacuggaccgucccccgccgccucuccgaguuccagaaccuccaccgcaagcucuccgagugcguccccucccucaagaagguccagcuccccucccucuccaagcuccccuucaaguccaucgaccagaaguucauggagaaguccaagaaccagcucaacaaguuccuccagaaccuccucuccgacgagcgccucugccaguccgaggcccucuacgccuuccucucccccucccccgacuaccucaaggucaucgacguccagggcaagaagaacuccuucucccucuccuccuuccucgagcgccucccccgcgacuucuucucccaccaggaggaggagaccgaggaggacuccgaccucuccgacuacggcgacgacgucgacggccgcaaggacgcccucgccgagcccugcuucaugcucaucggcgagaucuucgagcuccgcggcauguucaaguggguccgccgcacccucaucgcccucguccaggucaccuucggccgcaccaucaacaagcagauccgcgacaccgucuccuggaucuucuccgagcagaugcucgucuacuacaucaacaucuuccgcgacgccuucuggcccaacggcaagcucgccccccccaccaccauccgcuccaaggagcagucccaggagaccaagcagcgcgcccagcagaagcuccucgagaacauccccgacaugcuccagucccucgucggccagcagaacgcccgccacggcaucaucaagaucuucaacgcccuccaggagacccgcgccaacaagcaccuccucuacgcccucauggagcuccuccucaucgagcucugccccgagcuccgcguccaccucgaccagcucaaggccggccaggucuga

SEQ ID NO: 49943 - RNA, 2442 nt, Artificial Sequence
  derived and/or modified sequence opt2 from SNX29__Homo_sapiens__NP_115543
auguccggcucccagaacaacgacaagcgccaguuccuccucgagcgccuccucgacgccgucaagcagugccagauccgcuucggcggccgcaaggagaucgccuccgacuccgacucccgcgucaccugccucugcgcccaguucgaggccguccuccagcacggccucaagcgcucccgcggccucgcccucaccgccgccgccaucaagcaggccgccggcuucgccuccaagaccgagaccgagcccgucuucugguacuacgucaaggagguccucaacaagcacgagcuccagcgcuucuacucccuccgccacaucgccuccgacgucggccgcggccgcgccuggcuccgcugcgcccucaacgagcacucccucgagcgcuaccuccacaugcuccucgccgaccgcugccgccucuccaccuucuacgaggacugguccuucgucauggacgaggagcgcuccuccaugcuccccaccauggccgccggccucaacuccauccucuucgccaucaacaucgacaacaaggaccucaacggccaguccaaguucgcccccaccgucuccgaccuccucaaggaguccacccagaacgucaccucccuccucaaggaguccacccagggcgucuccucccucuuccgcgagaucaccgccuccuccgccgucuccauccucaucaagcccgagcaggagaccgacccccuccccgucgucucccgcaacgucuccgccgacgccaagugcaagaaggagcgcaagaagaagaagaaggucaccaacaucaucuccuucgacgacgaggaggacgagcagaacuccggcgacgucuucaagaagacccccggcgccggcgaguccuccgaggacaacuccgaccgcuccuccgucaacaucauguccgccuucgagucccccuucggccccaacuccaacggcucccaguccuccaacuccuggaagaucgacucccucucccucaacggcgaguucggcuaccagaagcucgacgucaaguccaucgacgacgaggacgucgacgagaacgaggacgacgucuacggcaacuccuccggccgcaagcaccgcggccacuccgagucccccgagaagccccucgagggcaacaccugccucucccagaugcacuccugggccccccucaagguccuccacaacgacuccgacauccucuuccccgucuccggcgucggcuccuacucccccgccgacgccccccucggcucccucgagaacggcaccggccccgaggaccacguccuccccgaccccggccuccgcuacuccgucgaggccuccucccccggccacggcuccccccucuccucccuccuccccuccgccuccguccccgaguccaugaccaucuccgagcuccgccaggccaccgucgccaugaugaaccgcaaggacgagcucgaggaggagaaccgcucccuccgcaaccuccucgacggcgagauggagcacuccgccgcccuccgccaggaggucgacacccucaagcgcaaggucgccgagcaggaggagcgccagggcaugaagguccaggcccucgcccgcgagaacgagguccucaagguccagcucaagaaguacgucggcgccguccagaugcucaagcgcgagggccagaccgccgagguccccaaccucugguccgucgacggcgaggucaccgucgccgagcagaagcccggcgagaucgccgaggagcucgccuccuccuacgagcgcaagcucaucgaggucgccgagaugcacggcgagcucaucgaguucaacgagcgccuccaccgcgcccucgucgccaaggaggcccucgucucccagaugcgccaggagcucaucgaccuccgcggccccguccccggcgaccucucccagaccuccgaggaccagucccucuccgacuucgagaucuccaaccgcgcccucaucaacgucuggauccccuccgucuuccuccgcggcaaggccgccaacgccuuccacgucuaccaggucuacauccgcaucaaggacgacgaguggaacaucuaccgccgcuacaccgaguuccgcucccuccaccacaagcuccagaacaaguacccccagguccgcgccuacaacuucccccccaagaaggccaucggcaacaaggacgccaaguucgucgaggagcgccgcaagcagcuccagaacuaccuccgcuccgucaugaacaaggucauccagaugguccccgaguucgccgccucccccaagaaggagacccucauccagcucaugcccuucuucgucgacaucaccccccccggcgagcccgucaacucccgccccaaggccgccucccgcuuccccaagcucucccgcggccagccccgcgagacccgcaacgucgagccccaguccggcgaccucuga

SEQ ID NO: 49944 - RNA, 1560 nt, Artificial Sequence
  derived and/or modified sequence opt2 from SNX2__Homo_sapiens__NP_003091
auggccgccgagcgcgagccccccccccucggcgacggcaagcccaccgacuucgaggaccucgaggacggcgaggaccucuucaccuccaccgucuccacccucgaguccucccccuccucccccgagcccgccucccuccccgccgaggacaucuccgccaacuccaacggccccaagcccaccgaggucguccucgacgacgaccgcgaggaccucuucgccgaggccaccgaggaggucucccucgacucccccgagcgcgagcccauccucuccuccgagcccucccccgccgucacccccgucacccccaccacccucaucgccccccgcaucgaguccaaguccauguccgcccccgucaucuucgaccgcucccgcgaggagaucgaggaggaggccaacggcgacaucuucgacaucgagaucggcgucuccgaccccgagaaggucggcgacggcaugaacgccuacauggccuaccgcgucaccaccaagaccucccucuccauguucuccaaguccgaguucuccgucaagcgccgcuucuccgacuuccucggccuccacuccaagcucgccuccaaguaccuccacgucggcuacaucgucccccccgcccccgagaaguccaucgucggcaugaccaaggucaaggucggcaaggaggacuccuccuccaccgaguucgucgagaagcgccgcgccgcccucgagcgcuaccuccagcgcaccgucaagcaccccacccuccuccaggaccccgaccuccgccaguuccucgaguccuccgagcucccccgcgccgucaacacccaggcccucuccggcgccggcauccuccgcauggucaacaaggccgccgacgccgucaacaagaugaccaucaagaugaacgaguccgacgccugguucgaggagaagcagcagcaguucgagaaccucgaccagcagcuccgcaagcuccacgucuccgucgaggcccucgucugccaccgcaaggagcucuccgccaacaccgccgccuucgccaaguccgccgccaugcucggcaacuccgaggaccacaccgcccucucccgcgcccucucccagcucgccgaggucgaggagaagaucgaccagcuccaccaggagcaggccuucgccgacuucuacauguucuccgagcuccucuccgacuacauccgccucaucgccgccgucaagggcgucuucgaccaccgcaugaagugcuggcagaagugggaggacgcccagaucacccuccucaagaagcgcgaggccgaggccaagaugauggucgccaacaagcccgacaagauccagcaggccaagaacgagauccgcgagugggaggccaagguccagcagggcgagcgcgacuucgagcagaucuccaagaccauccgcaaggaggucggccgcuucgagaaggagcgcgucaaggacuucaagaccgucaucaucaaguaccucgagucccucguccagacccagcagcagcucaucaaguacugggaggccuuccuccccgaggccaaggccaucgccuga

SEQ ID NO: 49945 - RNA, 1314 nt, Artificial Sequence
  derived and/or modified sequence opt2 from SNX30__Homo_sapiens__NP_001013012
auggccggcggcccccccaaggcccuccccuccaccggcccccacucccuccgcgacaugccccacccccucgccggcuccuccuccgaggaggccgucggcggcgacuccacccccucccccgaccuccucauggcccgcuccuucggcgacaaggaccucauccuccccaacggcggcacccccgccggcaccuccucccccgccuccuccuccucccuccucaaccgccuccagcucgacgacgacaucgacggcgagacccgcgaccucuucgucaucgucgacgaccccaagaagcacgucugcaccauggagaccuacaucaccuaccgcaucaccaccaaguccacccgcgucgaguucgaccuccccgaguacuccguccgccgccgcuaccaggacuucgacuggcuccgcuccaagcucgaggagucccagcccacccaccucauccccccccuccccgagaaguucgucgucaagggcgucgucgaccgcuucuccgaggaguucgucgagacccgccgcaaggcccucgacaaguuccucaagcgcaucaccgaccaccccguccucuccuucaacgagcacuucaacaucuuccucaccgccaaggaccucaacgccuacaagaagcagggcaucgcccuccucacccgcaugggcgaguccgucaagcacgucaccggcggcuacaagcuccgcacccgcccccucgaguucgccgccaucggcgacuaccucgacaccuucgcccucaagcucggcaccaucgaccgcaucgcccagcgcaucaucaaggaggagaucgaguaccucgucgagcuccgcgaguacggccccgucuacuccaccugguccgcccucgagggcgagcucgccgagccccucgagggcgucuccgccugcaucggcaacugcuccaccgcccucgaggagcucaccgacgacaugaccgaggacuuccuccccguccuccgcgaguacauccucuacuccgacuccaugaaguccguccucaagaagcgcgaccagguccaggccgaguacgaggccaagcucgaggccgucgcccuccgcaaggaggaccgccccaagguccccgccgacgucgagaagugccaggaccgcauggagugcuucaacgccgaccucaaggccgacauggagcgcuggcagaacaacaagcgccaggacuuccgccagcuccucaugggcauggccgacaagaacauccaguacuacgagaagugccucauggccugggaguccaucaucccccuccuccaggagaagcaggaggccaaguga

SEQ ID NO: 49946 - RNA, 318 nt, Artificial Sequence
  derived and/or modified sequence opt2 from SNX3__Homo_sapiens__NP_001287857
auggccgagaccgucgccgacacccgccgccucaucaccaagccccagaaccucaacgacgccuacggcccccccuccaacuuccucgagaucgacgucuccaacccccagaccgucggcgucggccgcggccgcuucaccaccuacgagauccgcgucaagaccaaccuccccaucuucaagcucaaggaguccaccguccgccgccgcuacuccgacuucgaguggcuccgcuccgagcucgagcgcgaguccaagggccgcugguccuccuccggcaccgagcgcacccucuccucccacgucuucacccgcuga

SEQ ID NO: 49947 - RNA, 1215 nt, Artificial Sequence
  derived and/or modified sequence opt2 from SNX5__Homo_sapiens__NP_689413
auggccgccguccccgagcuccuccagcagcaggaggaggaccgcuccaagcuccgcuccgucuccgucgaccucaacgucgaccccucccuccagaucgacauccccgacgcccucuccgagcgcgacaaggucaaguucaccguccacaccaagaccacccuccccaccuuccagucccccgaguucuccgucacccgccagcacgaggacuucgucuggcuccacgacacccucaucgagaccaccgacuacgccggccucaucaucccccccgcccccaccaagcccgacuucgacggcccccgcgagaagaugcagaagcucggcgagggcgagggcuccaugaccaaggaggaguucgccaagaugaagcaggagcucgaggccgaguaccucgccgucuucaagaagaccgucuccucccacgaggucuuccuccagcgccucuccucccaccccguccucuccaaggaccgcaacuuccacgucuuccucgaguacgaccaggaccucuccguccgccgcaagaacaccaaggagauguucggcggcuucuucaaguccgucgucaaguccgccgacgagguccucuucaccggcgucaaggaggucgacgacuucuucgagcaggagaagaacuuccucaucaacuacuacaaccgcaucaaggacuccugcgucaaggccgacaagaugacccgcucccacaagaacgucgccgacgacuacauccacaccgccgccugccuccacucccucgcccucgaggagcccaccgucaucaagaaguaccuccucaaggucgccgagcucuucgagaagcuccgcaaggucgagggccgcgucuccuccgacgaggaccucaagcucaccgagcuccuccgcuacuacaugcucaacaucgaggccgccaaggaccuccucuaccgccgcaccaaggcccucaucgacuacgagaacuccaacaaggcccucgacaaggcccgccucaaguccaaggacgucaagcucgccgaggcccaccagcaggagugcugccagaaguucgagcagcucuccgaguccgccaaggaggagcucaucaacuucaagcgcaagcgcgucgccgccuuccgcaagaaccucaucgagauguccgagcucgagaucaagcacgcccgcaacaacgucucccuccuccaguccugcaucgaccucuucaagaacaacuga

SEQ ID NO: 49948 - RNA, 1788 nt, Artificial Sequence
  derived and/or modified sequence opt2 from SNX9__Homo_sapiens__NP_057308
auggccaccaaggcccgcgucauguacgacuucgccgccgagcccggcaacaacgagcucaccgucaacgagggcgagaucaucaccaucaccaaccccgacgucggcggcggcuggcucgagggccgcaacaucaagggcgagcgcggccucguccccaccgacuacgucgagauccuccccuccgacggcaaggaccaguucuccugcggcaacuccgucgccgaccaggccuuccucgacucccucuccgccuccaccgcccaggccuccuccuccgccgccuccaacaaccaccaggucggcuccggcaacgaccccugguccgccugguccgccuccaaguccggcaacugggaguccuccgagggcuggggcgcccagcccgagggcgccggcgcccagcgcaacaccaacacccccaacaacugggacaccgccuucggccacccccaggccuaccagggccccgccaccggcgacgacgacgacugggacgaggacugggacggccccaaguccuccuccuacuucaaggacuccgaguccgccgacgccggcggcgcccagcgcggcaacucccgcgccuccuccuccuccaugaagaucccccucaacaaguuccccggcuucgccaagcccggcaccgagcaguaccuccucgccaagcagcucgccaagcccaaggagaagauccccaucaucgucggcgacuacggccccaugugggucuaccccaccuccaccuucgacugcgucgucgccgacccccgcaagggcuccaagauguacggccucaaguccuacaucgaguaccagcucacccccaccaacaccaaccgcuccgucaaccaccgcuacaagcacuucgacuggcucuacgagcgccuccucgucaaguucggcuccgccauccccauccccucccuccccgacaagcaggucaccggccgcuucgaggaggaguucaucaagaugcgcauggagcgccuccaggccuggaugacccgcaugugccgccaccccgucaucuccgaguccgaggucuuccagcaguuccucaacuuccgcgacgagaaggaguggaagaccggcaagcgcaaggccgagcgcgacgagcucgccggcgucaugaucuucuccaccauggagcccgaggcccccgaccucgaccucgucgagaucgagcagaagugcgaggccgucggcaaguucaccaaggccauggacgacggcgucaaggagcuccucaccgucggccaggagcacuggaagcgcugcaccggcccccuccccaaggaguaccagaagaucggcaaggcccuccagucccucgccaccgucuucuccuccuccggcuaccagggcgagaccgaccucaacgacgccaucaccgaggccggcaagaccuacgaggagaucgccucccucgucgccgagcagcccaagaaggaccuccacuuccucauggagugcaaccacgaguacaagggcuuccucggcugcuuccccgacaucaucggcacccacaagggcgccaucgagaaggucaaggaguccgacaagcucgucgccaccuccaagaucacccuccaggacaagcagaacauggucaagcgcgucuccaucauguccuacgcccuccaggccgagaugaaccacuuccacuccaaccgcaucuacgacuacaacuccgucauccgccucuaccucgagcagcagguccaguucuacgagaccaucgccgagaagcuccgccaggcccucucccgcuuccccgucauguga

SEQ ID NO: 49949 - RNA, 1479 nt, Artificial Sequence
  derived and/or modified sequence opt2 from SOAT1__Homo_sapiens__NP_001239440
auggagcucaagcccuucuucaugaaggaggucggcucccacuucgacgacuucgucaccaaccucaucgagaaguccgccucccucgacaacggcggcugcgcccucaccaccuucuccguccucgagggcgagaagaacaaccaccgcgccaaggaccuccgcgccccccccgagcagggcaagaucuucaucgcccgccgcucccuccucgacgagcuccucgaggucgaccacauccgcaccaucuaccacauguucaucgcccuccucauccucuucauccucuccacccucgucgucgacuacaucgacgagggccgccucguccucgaguucucccuccucuccuacgccuucggcaaguuccccaccgucgucuggaccugguggaucauguuccucuccaccuucuccguccccuacuuccucuuccagcacugggccaccggcuacuccaaguccucccacccccucauccgcucccucuuccacggcuuccucuucaugaucuuccagaucggcguccucggcuucggccccaccuacgucguccucgccuacacccucccccccgccucccgcuucaucaucaucuucgagcagauccgcuucgucaugaaggcccacuccuucguccgcgagaacgucccccgcguccucaacuccgccaaggagaaguccuccaccguccccauccccaccgucaaccaguaccucuacuuccucuucgcccccacccucaucuaccgcgacuccuacccccgcaaccccaccguccgcuggggcuacgucgccaugaaguucgcccaggucuucggcugcuucuucuacgucuacuacaucuucgagcgccucugcgccccccucuuccgcaacaucaagcaggagcccuucuccgcccgcguccucguccucugcgucuucaacuccauccuccccggcguccucauccucuuccucaccuucuucgccuuccuccacugcuggcucaacgccuucgccgagaugcuccgcuucggcgaccgcauguucuacaaggacugguggaacuccaccuccuacuccaacuacuaccgcaccuggaacgucgucguccacgacuggcucuacuacuacgccuacaaggacuuccucugguucuucuccaagcgcuucaaguccgccgccaugcucgccgucuucgccgucuccgccgucguccacgaguacgcccucgccgucugccucuccuucuucuaccccguccucuucguccucuucauguucuucggcauggccuucaacuucaucgucaacgacucccgcaagaagcccaucuggaacguccucauguggaccucccucuuccucggcaacggcguccuccucugcuucuacucccaggagugguacgcccgccagcacugcccccucaagaaccccaccuuccucgacuacguccgcccccgcuccuggaccugccgcuacgucuucuga

SEQ ID NO: 49950 - RNA, 1569 nt, Artificial Sequence
  derived and/or modified sequence opt2 from SOAT2__Homo_sapiens__NP_003569
auggagcccggcggcgcccgccuccgccuccagcgcaccgagggccucggcggcgagcgcgagcgccagcccugcggcgacggcaacaccgagacccaccgcgcccccgaccucguccaguggacccgccacauggaggccgucaaggcccagcuccucgagcaggcccagggccagcuccgcgagcuccucgaccgcgccaugcgcgaggccauccaguccuaccccucccaggacaagccccuccccccccccccccccggcucccucucccgcacccaggagcccucccucggcaagcagaaggucuucaucauccgcaagucccuccucgacgagcucauggagguccagcacuuccgcaccaucuaccacauguucaucgccggccucugcgucuucaucaucuccacccucgccaucgacuucaucgacgagggccgccuccuccucgaguucgaccuccucaucuucuccuucggccagcucccccucgcccucgucaccuggguccccauguuccucuccacccuccucgcccccuaccaggcccuccgccucugggcccgcggcaccuggacccaggccaccggccucggcugcgcccuccucgccgcccacgccgucguccucugcgcccuccccguccacgucgccgucgagcaccagcucccccccgccucccgcugcguccucgucuucgagcagguccgcuuccucaugaaguccuacuccuuccuccgcgaggccguccccggcacccuccgcgcccgccgcggcgagggcauccaggcccccuccuucuccuccuaccucuacuuccucuucugccccacccucaucuaccgcgagaccuacccccgcacccccuacguccgcuggaacuacgucgccaagaacuucgcccaggcccucggcugcguccucuacgccugcuucauccucggccgccucugcguccccgucuucgccaacaugucccgcgagcccuucuccacccgcgcccucguccucuccauccuccacgccacccuccccggcaucuucaugcuccuccucaucuucuucgccuuccuccacugcuggcucaacgccuucgccgagaugcuccgcuucggcgaccgcauguucuaccgcgacugguggaacuccaccuccuucuccaacuacuaccgcaccuggaacgucgucguccacgacuggcucuacuccuacgucuaccaggacggccuccgccuccucggcgcccgcgcccgcggcgucgccaugcucggcgucuuccucgucuccgccgucgcccacgaguacaucuucugcuucguccucggcuucuucuaccccgucaugcucauccucuuccucgucaucggcggcaugcucaacuucaugaugcacgaccagcgcaccggccccgccuggaacguccucauguggaccaugcucuuccucggccagggcauccaggucucccucuacugccaggagugguacgcccgccgccacugcccccucccccaggccaccuucuggggccucgucaccccccgcuccugguccugccacaccuga

SEQ ID NO: 49951 - RNA, 2622 nt, Artificial Sequence
  derived and/or modified sequence opt2 from SOBP__Homo_sapiens__NP_060483
auggccgagauggagaaggagggccgcccccccgagaacaagcgcucccgcaagcccgcccaccccgucaagcgcgagaucaacgaggagaugaagaacuucgccgagaacaccaugaacgagcuccucggcugguacggcuacgacaaggucgagcucaaggacggcgaggacaucgaguuccgcuccuaccccaccgacggcgagucccgccagcacaucuccguccucaaggagaacucccuccccaagcccaagcuccccgaggacuccgucaucucccccuacaacaucuccaccggcuacuccggccucgccaccggcaacggccucuccgacucccccgccggcuccaaggaccacggcuccguccccaucaucgucccccucauccccccccccuucaucaagccccccgccgaggacgacgucuccaacguccagaucaugugcgccuggugccagaaggucggcaucaagcgcuacucccucuccaugggcuccgaggucaaguccuucugcuccgagaagugcuucgccgccugccgccgcgccuacuucaagcgcaacaaggcccgcgacgaggacggccacgccgagaacuucccccagcagcacuacgccaaggagaccccccgccucgccuucaagaacaacugcgagcuccucgucugcgacuggugcaagcacauccgccacaccaaggaguaccucgacuucggcgacggcgagcgccgccuccaguucugcuccgccaagugccucaaccaguacaagauggacaucuucuacaaggagacccaggccaaccuccccgccggccucugcuccacccuccacccccccauggagaacaaggccgagggcaccggcguccagcuccucacccccgacuccuggaacaucccccucaccgacgcccgccgcaaggcccccucccccgucgccaccgccggccagucccagggccccggccccuccgccuccaccaccgucucccccuccgacaccgccaacugcuccgucaccaagauccccacccccguccccaaguccauccccaucuccgagacccccaacaucccccccgucuccguccagccccccgccuccaucggccccccccucggcguccccccccgcuccccccccauggucaugaccaaccgcggccccgucccccuccccaucuucauggagcagcagaucaugcagcagauccgcccccccuucauccgcggccccccccaccacgccuccaaccccaacuccccccucuccaaccccaugcuccccggcaucggccccccccccggcggcccccgcaaccucggccccaccuccucccccaugcaccgccccaugcucuccccccacauccacccccccuccacccccaccaugcccggcaacccccccggccuccuccccccccccccccccggcgccccccuccccucccuccccuucccccccgucuccaugaugcccaacggccccaugcccgucccccagaugaugaacuucggccuccccucccucgccccccucguccccccccccacccuccucguccccuaccccgucaucgucccccuccccguccccauccccauccccauccccaucccccacgucuccgacuccaagccccccaacggcuucuccuccaacggcgagaacuucauccccaacgcccccggcgacuccgccgccgccggcggcaagcccuccggccacucccucuccccccgcgacuccaagcagggcuccuccaaguccgccgacuccccccccggcugcuccggccaggcccucucccucgcccccacccccgccgagcacggccgcuccgaggucgucgaccucacccgccgcgccggcuccccccccggcccccccggcgccggcggccagcucggcuuccccggcguccuccagggcccccaggacggcgucaucgaccucaccgucggccaccgcgcccgccuccacaacgucauccaccgcgcccuccacgcccacgucaaggccgagcgcgagcccuccgccgccgagcgccgcaccugcggcggcugccgcgacggccacugcuccccccccgccgccggcgaccccggccccggcgcccccgccggccccgaggccgccgccgccugcaacgucaucgucaacggcacccgcggcgccgccgccgagggcgccaaguccgccgagcccccccccgagcagcccccccccccccccccccccgccccccccaagaagcuccucucccccgaggagcccgccgucuccgagcucgaguccgucaaggagaacaacugcgccuccaacugccaccucgacggcgaggccgccaagaagcucaugggcgaggaggcccucgccggcggcgacaaguccgaccccaaccucaacaaccccgccgacgaggaccacgccuacgcccuccgcaugcuccccaagaccggcugcgucauccagcccguccccaagcccgccgagaaggccgccauggcccccugcaucaucuccucccccaugcucuccgccggccccgaggaccucgagcccccccucaagcgccgcugccuccgcauccgcaaccagaacaaguga

SEQ ID NO: 49952 - RNA, 636 nt, Artificial Sequence
  derived and/or modified sequence opt2 from SOCS1__Homo_sapiens__NP_003736
auggucgcccacaaccaggucgccgccgacaacgccgucuccaccgccgccgagccccgccgccgccccgagcccuccuccuccuccuccuccucccccgccgcccccgcccgcccccgccccugccccgccguccccgcccccgcccccggcgacacccacuuccgcaccuuccgcucccacgccgacuaccgccgcaucacccgcgccuccgcccuccucgacgccugcggcuucuacuggggcccccucuccguccacggcgcccacgagcgccuccgcgccgagcccgucggcaccuuccucguccgcgacucccgccagcgcaacugcuucuucgcccucuccgucaagauggccuccggccccaccuccauccgcguccacuuccaggccggccgcuuccaccucgacggcucccgcgaguccuucgacugccucuucgagcuccucgagcacuacgucgccgccccccgccgcaugcucggcgccccccuccgccagcgccgcguccgcccccuccaggagcucugccgccagcgcaucgucgccaccgucggccgcgagaaccucgcccgcaucccccucaaccccguccuccgcgacuaccucuccuccuuccccuuccagaucuga

SEQ ID NO: 49953 - RNA, 597 nt, Artificial Sequence
  derived and/or modified sequence opt2 from SOCS2__Homo_sapiens__NP_001257400
augacccuccgcugccucgagcccuccggcaacggcggcgagggcacccgcucccaguggggcaccgccggcuccgccgaggagcccuccccccaggccgcccgccucgccaaggcccuccgcgagcucggccagaccggcugguacuggggcuccaugaccgucaacgaggccaaggagaagcucaaggaggcccccgagggcaccuuccucauccgcgacuccucccacuccgacuaccuccucaccaucuccgucaagaccuccgccggccccaccaaccuccgcaucgaguaccaggacggcaaguuccgccucgacuccaucaucugcgucaaguccaagcucaagcaguucgacuccgucguccaccucaucgacuacuacguccagaugugcaaggacaagcgcaccggccccgaggccccccgcaacggcaccguccaccucuaccucaccaagccccucuacaccuccgcccccucccuccagcaccucugccgccucaccaucaacaagugcaccggcgccaucuggggccucccccuccccacccgccucaaggacuaccucgaggaguacaaguuccaggucuga

SEQ ID NO: 49954 - RNA, 678 nt, Artificial Sequence
  derived and/or modified sequence opt2 from SOCS3__Homo_sapiens__NP_003946
auggucacccacuccaaguuccccgccgccggcaugucccgcccccucgacaccucccuccgccucaagaccuucuccuccaaguccgaguaccagcucgucgucaacgccguccgcaagcuccaggaguccggcuucuacugguccgccgucaccggcggcgaggccaaccuccuccucuccgccgagcccgccggcaccuuccucauccgcgacuccuccgaccagcgccacuucuucacccucuccgucaagacccaguccggcaccaagaaccuccgcauccagugcgagggcggcuccuucucccuccaguccgacccccgcuccacccagcccgucccccgcuucgacugcguccucaagcucguccaccacuacaugcccccccccggcgcccccuccuuccccuccccccccaccgagcccuccuccgagguccccgagcagcccuccgcccagccccuccccggcucccccccccgccgcgccuacuacaucuacuccggcggcgagaagaucccccucguccucucccgcccccucuccuccaacgucgccacccuccagcaccucugccgcaagaccgucaacggccaccucgacuccuacgagaaggucacccagcuccccggccccauccgcgaguuccucgaccaguacgacgccccccucuga

SEQ ID NO: 49955 - RNA, 1323 nt, Artificial Sequence
  derived and/or modified sequence opt2 from SOCS4__Homo_sapiens__NP_543143
auggccgagaacaacgagaacaucuccaagaacgucgacguccgccccaagaccucccgcucccgcuccgccgaccgcaaggacggcuacgucugguccggcaagaagcucuccugguccaagaaguccgaguccuacuccgacgccgagaccgucaacggcaucgagaagaccgaggucucccuccgcaaccaggagcgcaagcacuccugcuccuccaucgagcucgaccucgaccacuccugcggccaccgcuuccucggccgcucccucaagcagaagcuccaggacgccgucggccagugcuuccccaucaagaacugcuccucccgccacuccuccggccuccccuccaagcgcaagauccacaucuccgagcucaugcucgacaagugccccuuccccccccgcuccgaccucgccuuccgcuggcacuucaucaagcgccacaccgcccccaucaacuccaaguccgacgagugggucuccaccgaccucucccagaccgagcuccgcgacggccagcucaagcgccgcaacauggaggagaacaucaacugcuucucccacaccaacguccagcccugcgucaucaccaccgacaacgcccucugccgcgagggccccaugaccggcuccgucaugaaccucgucuccaacaacuccaucgaggacuccgacauggacuccgacgacgagauccucacccucugcaccuccucccgcaagcgcaacaagcccaagugggaccucgacgacgagauccuccagcucgagaccccccccaaguaccacacccagaucgacuacguccacugccucguccccgaccuccuccagaucaacaacaaccccugcuacuggggcgucauggacaaguacgccgccgaggcccuccucgagggcaagcccgagggcaccuuccuccuccgcgacuccgcccaggaggacuaccucuucuccgucuccuuccgccgcuacucccgcucccuccacgcccgcaucgagcaguggaaccacaacuucuccuucgacgcccacgaccccugcgucuuccacucccccgacaucaccggccuccucgagcacuacaaggaccccuccgccugcauguucuucgagccccuccucuccaccccccucauccgcaccuuccccuucucccuccagcacaucugccgcaccgucaucugcaacugcaccaccuacgacggcaucgacgcccuccccauccccuccuccaugaagcucuaccucaaggaguaccacuacaaguccaagguccgcguccuccgcaucgacgcccccgagcagcagugcuga

SEQ ID NO: 49956 - RNA, 1611 nt, Artificial Sequence
  derived and/or modified sequence opt2 from SOCS5__Homo_sapiens__NP_659198
auggacaaggucggcaagauguggaacaacuucaaguaccgcugccagaaccucuucggccacgagggcggcucccgcuccgagaacgucgacaugaacuccaaccgcugccucuccgucaaggagaagaacaucuccaucggcgacuccaccccccagcagcaguccuccccccuccgcgagaacaucgcccuccagcucggccucucccccuccaagaacuccucccgccgcaaccagaacugcgccaccgagaucccccagaucgucgagaucuccaucgagaaggacaacgacuccugcgucacccccggcacccgccucgcccgccgcgacuccuacucccgccacgcccccuggggcggcaagaagaagcacuccugcuccaccaagacccaguccucccucgacgccgacaagaaguucggccgcacccgcuccggccuccagcgccgcgagcgccgcuacggcgucuccuccguccacgacauggacuccgucuccucccgcaccgucggcucccgcucccuccgccagcgccuccaggacaccgucggccucugcuuccccaugcgcaccuacuccaagcaguccaagccccucuucuccaacaagcgcaagauccaccucuccgagcucaugcucgagaagugccccuuccccgccggcuccgaccucgcccagaaguggcaccucaucaagcagcacaccgcccccgucuccccccacuccaccuucuucgacaccuucgaccccucccucgucuccaccgaggacgaggaggaccgccuccgcgagcgccgccgccucuccaucgaggagggcgucgaccccccccccaacgcccagauccacaccuucgaggccaccgcccaggucaacccccucuacaagcucggccccaagcucgcccccggcaugaccgagaucuccggcgacuccuccgccaucccccaggccaacugcgacuccgaggaggacaccaccacccucugccuccagucccgccgccagaagcagcgccagaucuccggcgacucccacacccacgucucccgccagggcgccuggaagguccacacccagaucgacuacauccacugccucguccccgaccuccuccagaucaccggcaaccccugcuacuggggcgucauggaccgcuacgaggccgaggcccuccucgagggcaagcccgagggcaccuuccuccuccgcgacuccgcccaggaggacuaccucuucuccgucuccuuccgccgcuacaaccgcucccuccacgcccgcaucgagcaguggaaccacaacuucuccuucgacgcccacgaccccugcgucuuccacuccuccaccgucaccggccuccucgagcacuacaaggaccccuccuccugcauguucuucgagccccuccucaccaucucccucaaccgcaccuuccccuucucccuccaguacaucugccgcgccgucaucugccgcugcaccaccuacgacggcaucgacggccucccccuccccuccaugcuccaggacuuccucaaggaguaccacuacaagcagaagguccgcguccgcuggcucgagcgcgagcccgucaaggccaaguga

SEQ ID NO: 49957 - RNA, 1608 nt, Artificial Sequence
  derived and/or modified sequence opt2 from SOCS6__Homo_sapiens__XP_005266840
augaagaagaucucccucaagacccuccgcaaguccuucaaccucaacaaguccaaggaggagaccgacuucauggucguccagcagcccucccucgccuccgacuucggcaaggacgacucccucuucggcuccugcuacggcaaggacauggccuccugcgacaucaacggcgaggacgagaagggcggcaagaaccgcuccaaguccgagucccucaugggcacccucaagcgccgccucuccgccaagcagaaguccaagggcaaggccggcacccccuccggcuccuccgccgacgaggacaccuucuccuccuccuccgcccccaucgucuucaaggacguccgcgcccagcgccccauccgcuccaccucccuccgcucccaccacuacucccccgcccccuggccccuccgccccaccaacuccgaggagaccugcaucaagauggagguccgcgucaaggcccucguccacuccuccucccccucccccgcccucaacggcguccgcaaggacuuccacgaccuccaguccgagaccaccugccaggagcaggccaacucccucaaguccuccgccucccacaacggcgaccuccaccuccaccucgacgagcacguccccgucgucaucggccucaugccccaggacuacauccaguacaccgucccccucgacgagggcauguacccccucgagggcucccgcuccuacugccucgacuccuccucccccauggaggucuccgccguccccccccaggucggcggccgcgccuuccccgaggacgagucccaggucgaccaggaccucgucgucgcccccgagaucuucgucgaccaguccgucaacggccuccucaucggcaccaccggcgucaugcuccaguccccccgcgccggccacgacgacguccccccccucuccccccuccucccccccaugcagaacaaccagauccagcgcaacuucuccggccucaccggcaccgaggcccacgucgccgaguccaugcgcugccaccucaacuucgaccccaacuccgcccccggcgucgcccgcgucuacgacuccguccaguccuccggccccauggucgucaccucccucaccgaggagcucaagaagcucgccaagcagggcugguacuggggccccaucacccgcugggaggccgagggcaagcucgccaacguccccgacggcuccuuccucguccgcgacuccuccgacgaccgcuaccuccucucccucuccuuccgcucccacggcaagacccuccacacccgcaucgagcacuccaacggccgcuucuccuucuacgagcagcccgacgucgagggccacaccuccaucgucgaccucaucgagcacuccauccgcgacuccgagaacggcgccuucugcuacucccgcucccgccuccccggcuccgccaccuaccccguccgccucaccaaccccgucucccgcuucaugcagguccgcucccuccaguaccucugccgcuucgucauccgccaguacacccgcaucgaccucauccagaagcucccccuccccaacaagaugaaggacuaccuccaggagaagcacuacuga

SEQ ID NO: 49958 - RNA, 1746 nt, Artificial Sequence
  derived and/or modified sequence opt2 from SOCS7__Homo_sapiens__NP_055413
auggucuuccgcaacgucggccgcccccccgaggaggaggacgucgaggccgcccccgagcccggccccuccgagcuccucugcccccgccaccgcugcgcccucgaccccaaggcccucccccccggccucgcccucgagcgcaccuggggccccgccgccggccucgaggcccagcucgccgcccucggccucggccagcccgccggccccggcgucaagaccgucggcggcggcugcugccccugccccugccccccccagcccccccccccccagccccagccccccgccgccgccccccaggccggcgaggaccccaccgagaccuccgacgcccuccucguccucgagggccucgaguccgaggccgagucccucgagaccaacuccugcuccgaggaggagcucuccucccccggccgcggcggcggcggcggcggccgccuccuccuccagccccccggccccgagcucccccccguccccuucccccuccaggaccucgucccccucggccgccucucccgcggcgagcagcagcagcagcagcagcagcagccccccccccccccccccccccccggcccccuccgcccccucgccggccccucccgcaagggcuccuucaagauccgccucucccgccucuuccgcaccaaguccugcaacggcggcuccggcggcggcgacggcaccggcaagcgccccuccggcgagcucgccgccuccgccgccucccucaccgacaugggcggcuccgccggccgcgagcucgacgccggccgcaagcccaagcucacccgcacccaguccgccuucucccccgucuccuucuccccccucuucaccggcgagaccgucucccucgucgacgucgacaucucccagcgcggccucaccuccccccacccccccaccccccccccccccccccgccgcucccucucccuccucgacgacaucuccggcacccuccccaccuccguccucgucgcccccaugggcuccucccuccaguccuucccccuccccccccccccccccccccacgcccccgacgccuucccccgcaucgcccccauccgcgccgccgagucccuccacucccagcccccccagcaccuccagugcccccucuaccgccccgacuccuccuccuucgccgccucccuccgcgagcucgagaagugcggcugguacuggggccccaugaacugggaggacgccgagaugaagcucaagggcaagcccgacggcuccuuccucguccgcgacuccuccgacccccgcuacauccucucccucuccuuccgcucccagggcaucacccaccacacccgcauggagcacuaccgcggcaccuucucccucuggugccaccccaaguucgaggaccgcugccaguccgucgucgaguucaucaagcgcgccaucaugcacuccaagaacggcaaguuccucuacuuccuccgcucccgcguccccggccucccccccacccccguccagcuccucuaccccgucucccgcuucuccaacgucaagucccuccagcaccucugccgcuuccgcauccgccagcucguccgcaucgaccacauccccgaccucccccuccccaagccccucaucuccuacauccgcaaguucuacuacuacgacccccaggaggaggucuaccucucccucaaggaggcccagcucaucuccaagcagaagcaggaggucgagcccuccaccuga

SEQ ID NO: 49959 - RNA, 465 nt, Artificial Sequence
  derived and/or modified sequence opt2 from SOD1__Homo_sapiens__NP_000445
auggccaccaaggccgucugcguccucaagggcgacggccccguccagggcaucaucaacuucgagcagaaggaguccaacggccccgucaaggucuggggcuccaucaagggccucaccgagggccuccacggcuuccacguccacgaguucggcgacaacaccgccggcugcaccuccgccggcccccacuucaacccccucucccgcaagcacggcggccccaaggacgaggagcgccacgucggcgaccucggcaacgucaccgccgacaaggacggcgucgccgacgucuccaucgaggacuccgucaucucccucuccggcgaccacugcaucaucggccgcacccucgucguccacgagaaggccgacgaccucggcaagggcggcaacgaggaguccaccaagaccggcaacgccggcucccgccucgccugcggcgucaucggcaucgcccaguga

SEQ ID NO: 49960 - RNA, 669 nt, Artificial Sequence
  derived and/or modified sequence opt2 from SOD2__Homo_sapiens__NP_001019636
augcucucccgcgccgucugcggcaccucccgccagcucgcccccguccucggcuaccucggcucccgccagaagcacucccuccccgaccuccccuacgacuacggcgcccucgagccccacaucaacgcccagaucaugcagcuccaccacuccaagcaccacgccgccuacgucaacaaccucaacgucaccgaggagaaguaccaggaggcccucgccaagggcgacgucaccgcccagaucgcccuccagcccgcccucaaguucaacggcggcggccacaucaaccacuccaucuucuggaccaaccucucccccaacggcggcggcgagcccaagggcgagcuccucgaggccaucaagcgcgacuucggcuccuucgacaaguucaaggagaagcucaccgccgccuccgucggcguccagggcuccggcuggggcuggcucggcuucaacaaggagcgcggccaccuccagaucgccgccugccccaaccaggacccccuccagggcaccaccggccucaucccccuccucggcaucgacgucugggagcacgccuacuaccuccaguacaagaacguccgccccgacuaccucaaggccaucuggaacgucaucaacugggagaacgucaccgagcgcuacauggccugcaagaaguga

SEQ ID NO: 49961 - RNA, 723 nt, Artificial Sequence
  derived and/or modified sequence opt2 from SOD3__Homo_sapiens__NP_003093
augcucgcccuccucugcuccugccuccuccucgccgccggcgccuccgacgccuggaccggcgaggacuccgccgagcccaacuccgacuccgccgaguggauccgcgacauguacgccaaggucaccgagaucuggcaggaggucaugcagcgccgcgacgacgacggcgcccuccacgccgccugccagguccagcccuccgccacccucgacgccgcccagccccgcgucaccggcgucguccucuuccgccagcucgccccccgcgccaagcucgacgccuucuucgcccucgagggcuuccccaccgagcccaacuccuccucccgcgccauccacguccaccaguucggcgaccucucccagggcugcgaguccaccggcccccacuacaacccccucgccgucccccacccccagcaccccggcgacuucggcaacuucgccguccgcgacggcucccucuggcgcuaccgcgccggccucgccgccucccucgccggcccccacuccaucgucggccgcgccgucgucguccacgccggcgaggacgaccucggccgcggcggcaaccaggccuccgucgagaacggcaacgccggccgccgccucgccugcugcgucgucggcgucugcggccccggccucugggagcgccaggcccgcgagcacuccgagcgcaagaagcgccgccgcgaguccgagugcaaggccgccuga

SEQ ID NO: 49962 - RNA, 987 nt, Artificial Sequence
  derived and/or modified sequence opt2 from SOHLH1__Homo_sapiens__NP_001012415
auggccucccgcugcuccgagcccuaccccgaggucucccgcauccccaccguccgcggcugcaacggcucccucuccggcgcccucuccugcugcgaggacuccgcccagggcuccggcccccccaaggcccccaccgucgccgagggccccuccuccugccuccgccgcaacgucaucuccgagcgcgagcgccgcaagcgcaugucccucuccugcgagcgccuccgcgcccuccucccccaguucgacggccgccgcgaggacauggccuccguccucgagauguccguccaguuccuccgccucgccuccgcccucggccccucccaggagcagcacgccauccucgccuccuccaaggagauguggcacucccuccaggaggacguccuccagcucacccucuccucccagauccaggccggcguccccgaccccggcaccggcgccuccuccggcacccgcacccccgacgucaaggccuuccucgagucccccuggucccucgaccccgccuccgccucccccgagcccgucccccacauccucgccuccucccgccagugggaccccgccuccugcaccucccucggcaccgacaagugcgaggcccuccucggccucugccagguccgcggcggccucccccccuucuccgagcccuccucccucguccccuggccccccggccgcucccuccccaaggccguccgccccccccucuccuggccccccuucucccagcagcagacccuccccgucauguccggcgaggcccucggcuggcucggccaggccggcccccucgccaugggcgccgccccccucggcgagcccgccaaggaggaccccaugcucgcccaggaggccggcuccgcccucggcuccgacgucgacgacggcaccuccuuccuccucaccgccggccccuccuccuggcccggcgaguggggccccggcuuccgcgccggcccccccgccuga

SEQ ID NO: 49963 - RNA, 1278 nt, Artificial Sequence
  derived and/or modified sequence opt2 from SOHLH2__Homo_sapiens__NP_060296
auggccuccuccaucaucugccaggagcacugccagaucuccggccaggccaagaucgacauccuccucgucggcgacgucaccgucggcuaccucgccgacaccguccagaagcucuucgccaacaucgccgaggucaccaucaccaucuccgacaccaaggaggccgccgcccuccucgacgacugcaucuucaacaugguccuccucaagguccccuccucccucuccgccgaggagcucgaggccaucaagcucauccgcuucggcaagaagaagaacacccacucccucuucgucuucaucauccccgagaacuucaagggcugcaucuccggccacggcauggacaucgcccucaccgagccccucaccauggagaagauguccaacgucgucaaguacuggaccaccugccccuccaacaccgucaagaccgagaacgccaccggccccgaggagcucggccucccccuccagcgcuccuacuccgagcaccucggcuacuuccccaccgaccucuucgccugcuccgagucccuccgcaacggcaacggccucgagcucaacgccucccucuccgaguucgagaagaacaagaagaucucccuccuccacuccuccaaggagaagcuccgccgcgagcgcaucaaguacugcugcgagcagcuccgcacccuccuccccuacgucaagggccgcaagaacgacgccgccuccguccucgaggccaccgucgacuacgucaaguacauccgcgagaagaucucccccgccgucauggcccagaucaccgaggcccuccaguccaacaugcgcuucugcaagaagcagcagacccccaucgagcucucccuccccggcaccgucauggcccagcgcgagaacuccgucauguccaccuacucccccgagcgcggccuccaguuccucaccaacaccugcuggaacggcugcuccacccccgacgccgaguccucccucgacgaggccguccgcguccccuccuccuccgccuccgagaacgccaucggcgaccccuacaagacccacaucuccuccgccgcccucucccucaacucccuccacaccguccgcuacuacuccaaggucacccccuccuacgacgccaccgccgucaccaaccagaacaucuccauccaccuccccuccgccaugccccccgucuccaagcuccucccccgccacugcaccuccggccucggccagaccugcaccacccaccccaacugccuccagcaguucugggccuacuga

SEQ ID NO: 49964 - RNA, 6327 nt, Artificial Sequence
  derived and/or modified sequence opt2 from SON__Homo_sapiens__NP_001278340
auggccaccaacaucgagcagaucuuccgcuccuucgucgucuccaaguuccgcgagauccagcaggagcucuccuccggccgcaacgagggccagcucaacggcgagaccaacacccccaucgagggcaaccaggccggcgacgccgccgccuccgcccgcucccuccccaacgaggagaucguccagaagaucgaggagguccucuccggcguccucgacaccgagcuccgcuacaagcccgaccucaaggagggcucccgcaagucccgcugcgucuccguccagaccgaccccaccgacgagauccccaccaagaaguccaagaagcacaagaagcacaagaacaagaagaagaagaagaagaaggagaaggagaagaaguacaagcgccagcccgaggaguccgaguccaagaccaagucccacgacgacggcaacaucgaccucgaguccgacuccuuccucaaguucgacuccgagcccuccgccgucgcccucgagcuccccacccgcgccuucggccccuccgagaccaacgagucccccgccgucguccucgagccccccgucgucuccauggaggucuccgagccccacauccucgagacccucaagcccgccaccaagaccgccgagcucuccgucgucuccaccuccgucaucuccgagcaguccgagcaguccgucgccgucaugcccgagcccuccaugaccaagauccucgacuccuucgccgccgcccccguccccaccaccacccucguccucaaguccuccgagcccgucgucaccauguccgucgaguaccagaugaaguccguccucaaguccgucgaguccaccucccccgagcccuccaagaucaugcucgucgagccccccgucgccaagguccucgagcccuccgagacccucgucgucuccuccgagacccccaccgaggucuaccccgagcccuccaccuccaccaccauggacuuccccgaguccuccgccaucgaggcccuccgccuccccgagcagcccgucgacguccccuccgagaucgccgacuccuccaugacccgcccccaggagcuccccgagcuccccaagaccaccgcccucgagcuccaggaguccuccgucgccuccgccauggagcuccccggcccccccgccaccuccaugcccgagcuccagggcccccccgucacccccguccucgagcuccccggccccuccgccacccccguccccgagcuccccggcccccucuccacccccguccccgagcuccccggcccccccgccaccgccguccccgagcuccccggccccuccgucacccccgucccccagcucucccaggagcuccccggccuccccgcccccuccaugggccucgagcccccccaggagguccccgagccccccgucauggcccaggagcuccccggccucccccucgucaccgccgccgucgagcuccccgagcagcccgccgucaccgucgccauggagcucaccgagcagcccgucaccaccaccgagcucgagcagcccgucggcaugaccaccgucgagcaccccggccaccccgaggucaccaccgccaccggccuccucggccagcccgaggccaccaugguccucgagcuccccggccagcccgucgccaccaccgcccucgagcuccccggccagcccuccgucaccggcguccccgagcuccccggccuccccuccgccacccgcgcccucgagcucuccggccagcccgucgccaccggcgcccucgagcuccccggcccccucauggccgccggcgcccucgaguucuccggccaguccggcgccgccggcgcccucgagcuccucggccagccccucgccaccggcguccucgagcuccccggccagcccggcgcccccgagcuccccggccagcccgucgccaccgucgcccucgagaucuccguccaguccgucgucaccaccuccgagcucuccaccaugaccgucucccagucccucgagguccccuccaccaccgcccucgaguccuacaacaccgucgcccaggagcuccccaccacccucgucggcgagaccuccgucaccgucggcgucgacccccucauggcccccgagucccacauccucgccuccaacaccauggagacccacauccucgccuccaacaccauggacucccagaugcucgccuccaacaccauggacucccagaugcucgccuccaacaccauggacucccagaugcucgccuccuccaccauggacucccagaugcucgccaccuccuccauggacucccagaugcucgccaccuccuccauggacucccagaugcucgccaccuccaccauggacucccagaugcucgccaccuccuccauggacucccagaugcucgccaccuccuccauggacucccagaugcucgccaccuccuccauggacucccagaugcucgccaccuccuccauggacucccagaugcucgccaccuccaccauggacucccagaugcucgccaccuccaccauggacucccagaugcucgccaccuccuccauggacucccagaugcucgccuccggcaccauggacucccagaugcucgccuccggcaccauggacgcccagaugcucgccuccggcaccauggacgcccagaugcucgccuccuccacccaggacuccgccaugcucggcuccaagucccccgaccccuaccgccucgcccaggaccccuaccgccucgcccaggaccccuaccgccucggccacgaccccuaccgccucggccacgacgccuaccgccucggccaggaccccuaccgccucggccacgaccccuaccgccucacccccgaccccuaccgcauguccccccgccccuaccgcaucgccccccgcuccuaccgcaucgccccccgccccuaccgccucgccccccgcccccucaugcucgccucccgccgcuccaugaugauguccuacgccgccgagcgcuccaugauguccuccuacgagcgcuccaugauguccuacgagcgcuccaugaugucccccauggccgagcgcuccaugauguccgccuacgagcgcuccaugauguccgccuacgagcgcuccaugaugucccccauggccgagcgcuccaugauguccgccuacgagcgcuccaugauguccgccuacgagcgcuccaugaugucccccauggccgaccgcuccaugauguccaugggcgccgaccgcuccaugauguccuccuacuccgccgccgaccgcuccaugauguccuccuacuccgccgccgaccgcuccaugauguccuccuacaccgccgaccgcuccaugauguccauggccgccgacuccuacaccgacuccuacaccgacaccuacaccgaggccuacaugguccccccccucccccccgaggagccccccaccaugcccccccucccccccgaggagccccccaugacccccccccucccccccgaggagccccccgagggccccgcccuccccaccgagcaguccgcccucaccgccgagaacaccuggcccaccgagguccccucccuccccuccgaggaguccgucucccagcccgagccccccgucucccaguccgagaucuccgagcccuccgccguccccaccgacuacuccgucuccgccuccgaccccuccguccucgucuccgaggccgccgucaccguccccgagcccccccccgagcccgaguccuccaucacccucacccccgucgaguccgccgucgucgccgaggagcacgaggucguccccgagcgccccgucaccugcauggucuccgagacccccgccauguccgccgagcccaccguccucgccuccgagccccccgucauguccgagaccgccgagaccuucgacuccaugcgcgccuccggccacgucgccuccgaggucuccaccucccuccucguccccgccgucaccacccccguccucgccgaguccauccucgagccccccgccauggccgcccccgaguccuccgccauggccguccucgaguccuccgccgucaccguccucgaguccuccaccgucaccguccucgaguccuccaccgucaccguccucgagcccuccgucgucaccguccccgagccccccgucgucgccgagcccgacuacgucaccauccccguccccgucgucuccgcccucgagcccuccguccccguccucgagcccgccgucuccguccuccagcccuccaugaucgucuccgagcccuccgucuccguccaggaguccaccgucaccgucuccgagcccgccgucaccgucuccgagcagacccaggucauccccaccgaggucgccaucgaguccacccccaugauccucgaguccuccaucauguccucccacgucaugaagggcaucaaccucuccuccggcgaccagaaccucgcccccgagaucggcaugcaggagaucgcccuccacuccggcgaggagccccacgccgaggagcaccucaagggcgacuucuacgaguccgagcacggcaucaacaucgaccucaacaucaacaaccaccucaucgccaaggagauggagcacaacaccgucugcgccgccggcaccucccccgucggcgagaucggcgaggagaagauccuccccaccuccgagaccaagcagcgcaccguccucgacaccuaccccggcgucuccgaggccgacgccggcgagacccucuccuccaccggccccuucgcccucgagcccgacgccaccggcaccuccaagggcaucgaguucaccaccgccuccacccucucccucgucaacaaguacgacgucgaccucucccucaccacccaggacaccgagcacgacauggucaucuccaccucccccuccggcggcuccgaggccgacaucgagggcccccuccccgccaaggacauccaccucgaccuccccuccaacaacaaccucgucuccaaggacaccgaggagccccuccccgucaaggaguccgaccagacccucgccgcccuccucucccccaaggaguccuccggcggcgagaaggaggucccccccccccccaaggagacccuccccgacuccggcuucuccgccaacaucgaggacaucaacgaggccgaccucguccgcccccuccuccccaaggacauggagcgccucaccucccuccgcgccggcaucgagggcccccuccucgccuccgacgucggccgcgaccgcuccgccgccucccccgucgucuccuccaugcccgagcgcgccuccgaguccuccuccgaggagaaggacgacuacgagaucuucgucaaggucaaggacacccacgagaaguccaagaagaacaagaaccgcgacaagggcgagaaggagaagaagcgcgacuccucccuccgcucccgcuccaagcgcuccaaguccuccgagcacaagucccgcaagcgcaccuccgagucccgcucccgcgcccgcaagcgcuccuccaaguccaagucccaccgcucccagacccgcucccgcucccgcucccgccgccgccgccgcuccucccgcucccgcuccaagucccgcggccgccgcuccgucuccaaggagaagcgcaagcgcucccccaagcaccgcuccaagucccgcgagcgcaagcgcaagcgcuccuccucccgcgacaaccgcaagaccguccgcgcccgcucccgcacccccucccgccgcucccgcucccacacccccucccgccgccgccgcucccgcuccgucggccgccgccgcuccuucuccaucucccccucccgccgcucccgcacccccucccgccgcucccgcacccccucccgccgcucccgcacccccucccgccgcucccgcacccccucccgccgcucccgcacccccucccgccgcucccgcacccccucccgccgccgccgcucccgcuccgucguccgccgccgcuccuucuccaucucccccguccgccuccgccgcucccgcaccccccuccgccgccgcuucucccgcucccccauccgccgcaagcgcucccgcuccuccgagcgcggccgcucccccaagcgccucaccgaccucgacaaggcccagcuccucgagaucgccaaggccaacgccgccgccaugugcgccaaggccggcgucccccucccccccaaccucaagcccgcccccccccccaccaucgaggagaaggucgccaagaaguccggcggcgccaccaucgaggagcucaccgaguucuga

SEQ ID NO: 49965 - RNA, 3456 nt, Artificial Sequence
  derived and/or modified sequence opt2 from SORBS1__Homo_sapiens__NP_001030127
auguccuccgagugcgacggcggcuccaaggccgucaugaacggccucgcccccggcuccaacggccaggacaaggccaccgccgacccccuccgcgcccgcuccaucuccgccgucaagaucauccccgucaagaccgucaagaacgccuccggccucguccuccccaccgacauggaccccaccaagaucugcaccggcaagggcgccgucacccuccgcgccuccuccuccuaccgcgagacccccuccuccucccccgccuccccccaggagacccgccagcacgaguccaagcccggccucgagcccgagcccuccuccgccgacgaguggcgccucuccuccuccgccgacgccaacggcaacgcccagcccuccucccucgccgccaagggcuaccgcuccguccaccccaaccuccccuccgacaagucccaggacgccaccuccuccuccgccgcccagcccgaggucaucgucgucccccucuaccucgucaacaccgaccgcggccaggagggcaccgcccgcccccccaccccccucggcccccucggcugcguccccaccauccccgccaccgccuccgccgccuccccccucaccuuccccacccucgacgacuucauccccccccaccuccagcgcuggccccaccacucccagcccgcccgcgccuccggcuccuucgcccccaucucccagaccccccccuccuucucccccccccccccccucgucccccccgcccccgaggaccuccgccgcgucuccgagcccgaccucaccggcgccgucuccuccaccgacuccuccccccuccucaacgaggucuccuccucccucaucggcaccgacucccaggccuuccccuccgucuccaagcccuccuccgccuaccccuccaccaccaucgucaaccccaccaucguccuccuccagcacaaccgcgagcagcagaagcgccucuccucccucuccgaccccgucuccgagcgccgcgucggcgagcaggacuccgcccccacccaggagaagcccaccucccccggcaaggccaucgagaagcgcgccaaggacgacucccgccgcgucgucaaguccacccaggaccucuccgacgucuccauggacgaggucggcaucccccuccgcaacaccgagcgcuccaaggacugguacaagaccauguucaagcagauccacaagcucaaccgcgacacccccgaggagaaccccuacuuccccaccuacaaguuccccgagcuccccgagauccagcagaccuccgaggagaccaaguccugcuccgucauguccccccgccucgagugcuccggcaccgucaucgcccacugcucccucaagcuccucgacuccuccaacccccccaccuccgccucccaggucgccggcaccgccgacgacgacuccgaccucuacuccccccgcuacuccuucuccgaggacaccaaguccccccucuccgucccccgcuccaaguccgagauguccuacaucgacggcgagaaggucgucaagcgcuccgccacccucccccuccccgcccgcuccuccucccucaaguccuccuccgagcgcaacgacugggagccccccgacaagaaggucgacacccgcaaguaccgcgccgagcccaaguccaucuacgaguaccagcccggcaaguccuccguccucaccaacgagaagaugucccgcgacaucucccccgaggagaucgaccucaagaacgagcccugguacaaguucuucuccgagcucgaguucggcaagcccccccccaagaagaucugggacuacacccccggcgacugcuccauccucccccgcgaggaccgcaagaccaaccucgacaaggaccucucccucugccagaccgagcucgaggccgaccucgagaagauggagacccucaacaaggcccccuccgccaacgucccccaguccuccgccaucucccccacccccgagaucuccuccgagacccccggcuacaucuacuccuccaacuuccacgccgucaagcgcgaguccgacggcgcccccggcgaccucaccucccucgagaacgagcgccagaucuacaaguccguccucgagggcggcgacaucccccuccagggccucuccggccucaagcgccccuccuccuccgccuccaccaaggacuccgaguccccccgccacuucauccccgccgacuaccucgaguccaccgaggaguucauccgccgccgccacgacgacaaggagaagcuccucgccgaccagcgccgccucaagcgcgagcaggaggaggccgacaucgccgcccgccgccacaccggcgucauccccacccaccaccaguucaucaccaacgagcgcuucggcgaccuccucaacaucgacgacaccgccaagcgcaaguccggcuccgagaugcgccccgcccgcgccaaguucgacuucaaggcccagacccucaaggagcucccccuccagaagggcgacaucgucuacaucuacaagcagaucgaccagaacugguacgagggcgagcaccacggccgcgucggcaucuucccccgcaccuacaucgagcuccucccccccgccgagaaggcccagcccaagaagcucacccccguccagguccucgaguacggcgaggccaucgccaaguucaacuucaacggcgacacccaggucgagauguccuuccgcaagggcgagcgcaucacccuccuccgccaggucgacgagaacugguacgagggccgcauccccggcaccucccgccagggcaucuuccccaucaccuacgucgacgucaucaagcgcccccucgucaagaaccccgucgacuacauggaccuccccuucuccuccucccccucccgcuccgccaccgccuccccccagcccuggcgcgaggaguccggccaguacgagcgcaaggccgagcgcggcgccggcgagcgcggccccggcggccccaagaucuccaagaaguccugccucaagcccuccgacgucguccgcugccucuccaccgagcagcgccucuccgaccucaacacccccgaggagucccgccccggcaagccccucggcuccgccuuccccggcuccgaggccgagcagaccgagcgccaccgcggcggcgagcaggccggccgcaaggccgcccgccgcggcggcucccagcagccccaggcccagcagcgccgcgucacccccgaccgcucccagaccucccaggaccucuucuccuaccaggcccucuacuccuacaucccccagaacgacgacgagcucgagcuccgcgacggcgacaucgucgacgucauggagaagugcgacgacggcugguucgucggcaccucccgccgcaccaagcaguucggcaccuuccccggcaacuacgucaagccccucuaccucuga

SEQ ID NO: 49966 - RNA, 1935 nt, Artificial Sequence
  derived and/or modified sequence opt2 from SORBS2__Homo_sapiens__NP_001139142
auguccgucacccucaccuccgucaagcgcguccaguccucccccaaccuccucgccgccggccgcgacucccagucccccgacuccgccuggcgcuccuacaacgacggcaaccaggagacccucaacggcgacgccaccuacuccucccucgccgccaagggcuuccgcuccguccgccccaaccuccaggacaagcgcucccccacccagucccagaucaccgucaacggcaacuccggcggcgccgucucccccauguccuacuaccagcgccccuucucccccuccgccuacucccuccccgccucccucaacuccuccaucgucaugcagcacggcaccucccucgacuccaccgacaccuacccccagcacgcccagucccucgacggcaccaccuccuccuccaucccccucuaccgcuccuccgaggaggagaagcgcgucaccgucaucaaggccccccacuaccccggcaucggccccgucgacgaguccggcauccccaccgccauccgcaccaccgucgaccgccccaaggacugguacaagaccauguucaagcagauccacaugguccacaagcccggccucuacaacccccccuacuccgcccagucccaccccgccgccaagacccagaccuaccgcccccucuccaagucccacuccgacaacucccccaacgccuucaaggacgccuccucccccgucccccccccccacguccccccccccguccccccccuccgcccccgcgaccgcuccuccaccgagaagcacgacugggacccccccgaccgcaaggucgacacccgcaaguuccgcuccgagccccgcuccaucuucgaguacgagcccggcaaguccuccauccuccagcacgagcgccccgccucccucuaccaguccuccaucgaccgcucccucgagcgccccauguccuccgccuccauggccuccgacuuccgcaagcgccgcaaguccgagcccgccgucggccccccccgcggccucggcgaccaguccgccucccgcaccucccccggccgcgucgaccuccccggcuccuccaccacccucaccaaguccuucaccuccuccucccccuccucccccucccgcgccaaggaccgcgaguccccccgcuccuacuccuccacccucaccgacaugggccgcuccgccccccgcgagcgccgcggcacccccgagaaggagaagcuccccgccaaggccgucuacgacuucaaggcccagaccuccaaggagcucuccuucaagaagggcgacaccgucuacauccuccgcaagaucgaccagaacugguacgagggcgagcaccacggccgcgucggcaucuuccccaucuccuacgucgagaagcucaccccccccgagaaggcccagcccgcccgcccccccccccccgcccagcccggcgagaucggcgaggccaucgccaaguacaacuucaacgccgacaccaacgucgagcucucccuccgcaagggcgaccgcgucauccuccucaagcgcgucgaccagaacugguacgagggcaagauccccggcaccaaccgccagggcaucuuccccgucuccuacgucgaggucgucaagaagaacaccaagggcgccgaggacuaccccgacccccccaucccccacuccuacuccuccgaccgcauccacucccucuccuccaacaagccccagcgccccgucuucacccacgagaacauccagggcggcggcgagcccuuccaggcccucuacaacuacaccccccgcaacgaggacgagcucgagcuccgcgaguccgacgucaucgacgucauggagaagugcgacgacggcugguucgucggcaccucccgccgcaccaaguucuucggcaccuuccccggcaacuacgucaagcgccucuga

SEQ ID NO: 49967 - RNA, 2016 nt, Artificial Sequence
  derived and/or modified sequence opt2 from SORBS3__Homo_sapiens__NP_005766
augcagggccccccccgcucccuccgcgccggccucucccucgacgacuucauccccggccaccuccagucccacaucggcuccuccucccgcggcacccgcguccccgucauccgcaacggcggcuccaacacccucaacuuccaguuccacgaccccgccccccgcaccgucugcaacggcggcuacaccccccgccgcgacgccucccagcaccccgaccccgccugguaccagaccuggcccggccccggcuccaagcccuccgccuccaccaagauccccgccucccagcacacccagaacugguccgccaccuggaccaaggacuccaagcgccgcgacaagcgcugggucaaguacgagggcaucggccccgucgacgaguccggcaugcccaucgccccccgcuccuccgucgaccgcccccgcgacugguaccgccgcauguuccagcagauccaccgcaagaugcccgaccuccagcucgacuggaccuucgaggagcccccccgcgacccccgccaccucggcgcccagcagcgccccgcccaccgccccggccccgccaccuccuccuccggccgcuccugggaccacuccgaggagcucccccgcuccaccuucaacuaccgccccggcgccuucuccaccguccuccagcccuccaaccagguccuccgccgccgcgagaaggucgacaacgucuggaccgaggaguccuggaaccaguuccuccaggagcucgagaccggccagcgccccaagaagccccucgucgacgaccccggcgagaagcccucccagcccaucgagguccuccucgagcgcgagcucgccgagcucuccgccgagcucgacaaggaccuccgcgccaucgagacccgccuccccucccccaaguccucccccgccccccgccgcgcccccgagcagcgcccccccgccggccccgccuccgccugguccuccuccuacccccacgcccccuaccucggcuccgcccgcucccucuccccccacaagauggccgacggcggcucccccuuccucggccgccgcgacuucgucuaccccuccuccacccgcgaccccuccgccuccaacggcggcggcucccccgcccgccgcgaggagaagaagcgcaaggccgcccgccucaaguucgacuuccaggcccagucccccaaggagcucacccuccagaagggcgacaucgucuacauccacaaggaggucgacaagaacuggcucgagggcgagcaccacggccgccucggcaucuuccccgccaacuacgucgagguccuccccgccgacgagauccccaagcccaucaagccccccaccuaccagguccucgaguacggcgaggccgucgcccaguacaccuucaagggcgaccucgaggucgagcucuccuuccgcaagggcgagcacaucugccucauccgcaaggucaacgagaacugguacgagggccgcaucaccggcaccggccgccagggcaucuuccccgccuccuacguccaggucucccgcgagccccgccuccgccucugcgacgacggcccccagcuccccaccuccccccgccucaccgccgccgcccgcuccgcccgccaccccuccucccccuccgcccuccgcucccccgccgaccccaucgaccucggcggccagaccuccccccgccgcaccggcuucuccuuccccacccaggagccccgcccccagacccagaaccucggcacccccggccccgcccucucccacucccgcggccccucccacccccucgaccucggcaccuccucccccaacaccucccagauccacuggacccccuaccgcgccauguaccaguaccgcccccagaacgaggacgagcucgagcuccgcgagggcgaccgcgucgacgucaugcagcagugcgacgacggcugguucgucggcgucucccgccgcacccagaaguucggcaccuuccccggcaacuacgucgcccccgucuga

SEQ ID NO: 49968 - RNA, 3597 nt, Artificial Sequence
  derived and/or modified sequence opt2 from SORCS1__Homo_sapiens__NP_001013049
augggcaaggucggcgccggcggcggcucccaggcccgccucuccgcccuccucgccggcgccggccuccucauccucugcgcccccggcgucugcggcggcggcuccugcugccccuccccccaccccuccuccgccccccgcuccgccuccaccccccgcggcuucucccaccagggccgccccggccgcgcccccgccaccccccucccccucgucguccgcccccucuucuccgucgcccccggcgaccgcgcccucucccucgagcgcgcccgcggcaccggcgccuccauggccgucgccgcccgcuccggccgccgccgccgcuccggcgccgaccaggagaaggccgagcgcggcgagggcgccucccgcuccccccgcggcguccuccgcgacggcggccagcaggagcccggcacccgcgagcgcgaccccgacaaggccacccgcuuccgcauggaggagcuccgccucaccuccaccaccuucgcccucaccggcgacuccgcccacaaccaggccaugguccacugguccggccacaacuccuccgucauccucauccucaccaagcucuacgacuacaaccucggcuccaucaccgaguccucccucuggcgcuccaccgacuacggcaccaccuacgagaagcucaacgacaaggucggccucaagaccauccucuccuaccucuacgucugccccaccaacaagcgcaagaucaugcuccucaccgaccccgagaucgaguccucccuccucaucuccuccgacgagggcgccaccuaccagaaguaccgccucaacuucuacauccagucccuccucuuccaccccaagcaggaggacuggauccucgccuacucccaggaccagaagcucuacuccuccgccgaguucggccgccgcuggcagcucauccaggagggcgucguccccaaccgcuucuacugguccgucaugggcuccaacaaggagcccgaccucguccaccucgaggcccgcaccgucgacggccacucccacuaccucaccugccgcaugcagaacugcaccgaggccaaccgcaaccagcccuuccccggcuacaucgaccccgacucccucaucguccaggaccacuacgucuucguccagcucaccuccggcggccgcccccacuacuacgucuccuaccgccgcaacgccuucgcccagaugaagcuccccaaguacgcccuccccaaggacaugcacgucaucuccaccgacgagaaccaggucuucgccgccguccaggaguggaaccagaacgacaccuacaaccucuacaucuccgacacccgcggcgucuacuucacccucgcccucgagaacguccaguccucccgcggccccgagggcaacaucaugaucgaccucuacgaggucgccggcaucaagggcauguuccucgccaacaagaagaucgacaaccaggucaagaccuucaucaccuacaacaagggccgcgacuggcgccuccuccaggcccccgacaccgaccuccgcggcgaccccguccacugccuccuccccuacugcucccuccaccuccaccucaaggucuccgagaaccccuacaccuccggcaucaucgccuccaaggacaccgcccccuccaucaucgucgccuccggcaacaucggcuccgagcucuccgacaccgacaucuccauguucgucuccuccgacgccggcaacaccuggcgccagaucuucgaggaggagcacuccguccucuaccucgaccagggcggcguccucgucgccaugaagcacaccucccuccccauccgccaccucuggcucuccuucgacgagggccgcuccugguccaaguacuccuucaccuccaucccccucuucgucgacggcguccucggcgagcccggcgaggagacccucaucaugaccgucuucggccacuucucccaccgcuccgaguggcagcucgucaaggucgacuacaaguccaucuucgaccgccgcugcgccgaggaggacuaccgccccuggcagcuccacucccagggcgaggccugcaucaugggcgccaagcgcaucuacaagaagcgcaaguccgagcgcaagugcaugcagggcaaguacgccggcgccauggaguccgagcccugcgucugcaccgaggccgacuucgacugcgacuacggcuacgagcgccacuccaacggccagugccuccccgccuucugguucaaccccuccucccucuccaaggacugcucccucggccaguccuaccucaacuccaccggcuaccgcaaggucgucuccaacaacugcaccgacggcguccgcgagcaguacaccgccaagccccagaagugccccggcaaggccccccgcggccuccgcaucgucaccgccgacggcaagcucaccgccgagcagggccacaacgucacccucaugguccagcucgaggagggcgacguccagcgcacccucauccaggucgacuucggcgacggcaucgccgucuccuacgucaaccucuccuccauggaggacggcaucaagcacgucuaccagaacgucggcaucuuccgcgucaccguccaggucgacaacucccucggcuccgacuccgccguccucuaccuccacgucaccugcccccucgagcacguccaccucucccuccccuucgucaccaccaagaacaaggaggucaacgccaccgccguccucuggcccucccaggucggcacccucaccuacgucuggugguacggcaacaacaccgagccccucaucacccucgagggcuccaucuccuuccgcuucaccuccgagggcaugaacaccaucaccguccaggucuccgccggcaacgccauccuccaggacaccaagaccaucgccgucuacgaggaguuccgcucccuccgccucuccuucucccccaaccucgacgacuacaaccccgacauccccgaguggcgccgcgacaucggccgcgucaucaagaagucccucgucgaggccaccggcguccccggccagcacauccucgucgccguccuccccggccuccccaccaccgccgagcucuucguccuccccuaccaggaccccgccggcgagaacaagcgcuccaccgacgaccucgagcagaucuccgagcuccucauccacacccucaaccagaacuccguccacuucgagcucaagcccggcguccgcguccucguccacgccgcccaccucaccgccgccccccucgucgaccucacccccacccacuccggcuccgccaugcucaugcuccucuccgucgucuucgucggccucgccgucuucgucaucuacaaguucaagcgcaagauccccggcaucaacgucuacgcccagaugcagaacgagaaggagcaggagaugaucucccccgucucccacuccgagucccgccccaacgucccccagaccgagcuccgccgccccggccagcucaucgacgagaaggucgagucccagcucaucggcuccaucuccaucgucgccgagaaccaguccaccaaggagauccccaccuacgucaacgucuga

SEQ ID NO: 49969 - RNA, 3480 nt, Artificial Sequence
  derived and/or modified sequence opt2 from SORCS2__Homo_sapiens__NP_065828
auggcccaccgcggccccucccgcgccuccaagggccccggccccaccgcccgcgcccccucccccggcgcccccccccccccccgcuccccccgcucccgcccccuccuccuccuccuccuccuccucggcgccugcggcgccgccggccgcucccccgagcccggccgccucggcccccacgcccagcucacccgcgucccccgcuccccccccgccggccgcgccgagcccggcggcggcgaggaccgccaggcccgcggcaccgagcccggcgcccccggccccucccccggccccgcccccggccccggcgaggacggcgcccccgccgccggcuaccgccgcugggagcgcgccgccccccucgccggcgucgccucccgcgcccaggucucccucaucuccaccuccuucguccucaagggcgacgccacccacaaccaggccaugguccacuggaccggcgagaacuccuccgucauccucauccucaccaaguacuaccacgccgacaugggcaagguccucgaguccucccucuggcgcuccuccgacuucggcaccuccuacaccaagcucacccuccagcccggcgucaccaccgucaucgacaacuucuacaucugccccaccaacaagcgcaaggucauccucgucuccuccucccucuccgaccgcgaccagucccucuuccucuccgccgacgagggcgccaccuuccagaagcagcccauccccuucuucgucgagacccucaucuuccaccccaaggaggaggacaagguccucgccuacaccaaggaguccaagcucuacgucuccuccgaccucggcaagaaguggacccuccuccaggagcgcgucaccaaggaccacgucuucugguccgucuccggcgucgacgccgaccccgaccucguccacgucgaggcccaggaccucggcggcgacuuccgcuacgucaccugcgccauccacaacugcuccgagaagaugcucaccgcccccuucgccggccccaucgaccacggcucccucaccguccaggacgacuacaucuucuucaaggccaccuccgccaaccagaccaaguacuacgucuccuaccgccgcaacgaguucguccucaugaagcuccccaaguacgcccuccccaaggaccuccagaucaucuccaccgacgagucccaggucuucgucgccguccaggagugguaccagauggacaccuacaaccucuaccaguccgacccccgcggcguccgcuacgcccucguccuccaggacguccgcuccucccgccaggccgaggaguccguccucaucgacauccucgagguccgcggcgucaagggcgucuuccucgccaaccagaagaucgacggcaaggucaugacccucaucaccuacaacaagggccgcgacugggacuaccuccgcccccccuccauggacaugaacggcaagcccaccaacugcaagccccccgacugccaccuccaccuccaccuccgcugggccgacaaccccuacgucuccggcaccguccacaccaaggacaccgcccccggccucaucaugggcgccggcaaccucggcucccagcucgucgaguacaaggaggagauguacaucaccuccgacugcggccacaccuggcgccaggucuucgaggaggagcaccacauccucuaccucgaccacggcggcgucaucgucgccaucaaggacaccuccaucccccucaagauccucaaguucuccgucgacgagggccucaccugguccacccacaacuucaccuccaccuccgucuucgucgacggccuccucuccgagcccggcgacgagacccucgucaugaccgucuucggccacaucuccuuccgcuccgacugggagcucgucaaggucgacuuccgccccuccuucucccgccagugcggcgaggaggacuacuccuccugggagcucuccaaccuccagggcgaccgcugcaucaugggccagcagcgcuccuuccgcaagcgcaaguccaccuccuggugcaucaagggccgcuccuucaccuccgcccucaccucccgcgucugcgagugccgcgacuccgacuuccucugcgacuacggcuucgagcgcuccuccuccuccgaguccuccaccaacaagugcuccgccaacuucugguucaacccccucuccccccccgacgacugcgcccucggccagaccuacaccuccucccucggcuaccgcaaggucgucuccaacgucugcgagggcggcgucgacaugcagcagucccagguccagcuccagugcccccucacccccccccgcggccuccaggucuccauccagggcgaggccgucgccguccgccccggcgaggacguccucuucgucguccgccaggagcagggcgacguccucaccaccaaguaccaggucgaccucggcgacggcuucaaggccauguacgucaaccucacccucaccggcgagcccauccgccaccgcuacgagucccccggcaucuaccgcgucuccguccgcgccgagaacaccgccggccacgacgaggccguccucuucguccaggucaacuccccccuccaggcccucuaccucgaggucguccccgucaucggccucaaccaggaggucaaccucaccgccguccuccucccccucaaccccaaccucaccgucuucuacugguggaucggccacucccuccagccccuccucucccucgacaacuccgucaccacccgcuucuccgacaccggcgacguccgcgucaccguccaggccgccugcggcaacuccguccuccaggacucccgcguccuccgcguccucgaccaguuccaggucaugccccuccaguucuccaaggagcucgacgccuacaaccccaacacccccgaguggcgcgaggacgucggccucgucgucacccgccuccucuccaaggagaccuccgucccccaggagcuccucgucaccgucgucaagcccggccuccccacccucgccgaccucuacguccuccucccccccccccgccccacccgcaagcgcucccucuccuccgacaagcgccucgccgccauccagcagguccucaacgcccagaagaucuccuuccuccuccgcggcggcguccgcguccucgucgcccuccgcgacaccggcaccggcgccgagcagcucggcggcggcggcggcuacugggccgucgucguccucuucgucaucggccucuucgccgccggcgccuucauccucuacaaguucaagcgcaagcgccccggccgcaccgucuacgcccagaugcacaacgagaaggagcaggagaugaccucccccgucucccacuccgaggacguccagggcgccguccagggcaaccacuccggcgucguccucuccaucaacucccgcgagaugcacuccuaccucgucuccuga

SEQ ID NO: 49970 - RNA, 3669 nt, Artificial Sequence
  derived and/or modified sequence opt2 from SORCS3__Homo_sapiens__NP_055793
auggaggccgcccgcaccgagcgccccgccggccgccccggcgccccccucguccgcaccggccuccuccuccucuccaccuggguccucgccggcgccgagaucaccugggacgccaccggcggccccggccgccccgccgcccccgccucccgcccccccgcccucuccccccucuccccccgcgccgucgccucccaguggcccgaggagcucgccuccgcccgccgcgccgccguccucggccgccgcgccggccccgagcuccucccccagcagggcggcggccgcggcggcgagaugcaggucgaggccggcggcaccucccccgccggcgagcgccgcggccgcggcauccccgcccccgccaagcucggcggcgcccgccgcucccgccgcgcccagccccccaucacccaggagcgcggcgacgccugggccaccgcccccgccgacggcucccgcggcucccgcccccucgccaagggcucccgcgaggaggucaaggccccccgcgccggcggcuccgccgccgaggaccuccgccuccccuccaccuccuucgcccucaccggcgacuccgcccacaaccaggccaugguccacugguccggccacaacuccuccgucauccucauccucaccaagcucuacgacuucaaccucggcuccgucaccgaguccucccucuggcgcuccaccgacuacggcaccaccuacgagaagcucaacgacaaggucggccucaagaccguccucuccuaccucuacgucaaccccaccaacaagcgcaagaucaugcuccucuccgaccccgagauggaguccuccauccucaucuccuccgacgagggcgccaccuaccagaaguaccgccucaccuucuacauccagucccuccucuuccaccccaagcaggaggacuggguccucgccuacucccucgaccagaagcucuacuccuccauggacuucggccgccgcuggcagcucaugcacgagcgcaucacccccaaccgcuucuacugguccgucgccggccucgacaaggaggccgaccucguccacauggagguccgcaccaccgacggcuacgcccacuaccucaccugccgcauccaggagugcgccgagaccacccgcuccggccccuucgcccgcuccaucgacaucuccucccucgucguccaggacgaguacaucuucauccaggucaccaccuccggccgcgccuccuacuacgucuccuaccgccgcgaggccuucgcccagaucaagcuccccaaguacucccuccccaaggacaugcacaucaucuccaccgacgagaaccaggucuucgccgccguccaggaguggaaccagaacgacaccuacaaccucuacaucuccgacacccgcggcaucuacuucacccucgccauggagaacaucaaguccucccgcggccucaugggcaacaucaucaucgagcucuacgaggucgccggcaucaagggcaucuuccucgccaacaagaaggucgacgaccaggucaagaccuacaucaccuacaacaagggccgcgacuggcgccuccuccaggcccccgacgucgaccuccgcggcucccccguccacugccuccuccccuucugcucccuccaccuccaccuccagcucuccgagaaccccuacuccuccggccgcaucuccuccaaggagaccgcccccggccucgucgucgccaccggcaacaucggccccgagcucuccuacaccgacaucggcgucuucaucuccuccgacggcggcaacaccuggcgccagaucuucgacgaggaguacaacgucugguuccucgacuggggcggcgcccucgucgccaugaagcacaccccccuccccguccgccaccucugggucuccuucgacgagggccacuccugggacaaguacggcuucaccuccgucccccucuucgucgacggcgcccucgucgaggccggcauggagacccacaucaugaccgucuucggccacuucucccuccgcuccgaguggcagcucgucaaggucgacuacaaguccaucuucucccgccacugcaccaaggaggacuaccagaccuggcaccuccucaaccagggcgagcccugcgucaugggcgagcgcaagaucuucaagaagcgcaagcccggcgcccagugcgcccucggccgcgaccacuccggcuccgucgucuccgagcccugcgucugcgccaacugggacuucgagugcgacuacggcuacgagcgccacggcgagucccagugcguccccgccuucugguacaaccccgccucccccuccaaggacugcucccucggccaguccuaccucaacuccaccggcuaccgccgcaucgucuccaacaacugcaccgacggccuccgcgagaaguacaccgccaaggcccagaugugccccggcaaggccccccgcggccuccacgucgucaccaccgacggccgccucgucgccgagcagggccacaacgccaccuucaucauccucauggaggagggcgaccuccagcgcaccaacauccagcucgacuucggcgacggcaucgccgucuccuacgccaacuucucccccaucgaggacggcaucaagcacgucuacaaguccgccggcaucuuccaggucaccgccuacgccgagaacaaccucggcuccgacaccgccguccucuuccuccacgucgucugccccgucgagcacguccaccuccgcguccccuucgucgccauccgcaacaaggaggucaacaucuccgccgucgucuggcccucccagcucggcacccucaccuacuucuggugguucggcaacuccaccaagccccucaucacccucgacuccuccaucuccuucaccuuccucgccgagggcaccgacaccaucaccguccaggucgccgccggcaacgcccucauccaggacaccaaggagaucgccguccacgaguacuuccagucccagcuccucuccuucucccccaaccucgacuaccacaaccccgacauccccgaguggcgcaaggacaucggcaacgucaucaagcgcgcccucgucaaggucaccuccguccccgaggaccagauccucaucgccgucuuccccggccuccccaccuccgccgagcucuucauccucccccccaagaaccucaccgagcgccgcaagggcaacgagggcgaccucgagcagaucgucgagacccucuucaacgcccucaaccagaaccucguccaguucgagcucaagcccggcguccaggucaucgucuacgucacccagcucacccucgccccccucgucgacuccuccgccggccacuccuccuccgccaugcucaugcuccucuccgucgucuucgucggccucgccgucuuccucaucuacaaguucaagcgcaagauccccuggaucaacaucuacgcccagguccagcacgacaaggagcaggagaugaucggcuccgucucccaguccgagaacgcccccaagaucacccucuccgacuucaccgagcccgaggagcuccucgacaaggagcucgacacccgcgucaucggcggcaucgccaccaucgccaacuccgaguccaccaaggagauccccaacugcaccuccgucuga

SEQ ID NO: 49971 - RNA, 1074 nt, Artificial Sequence
  derived and/or modified sequence opt2 from SORD__Homo_sapiens__NP_003095
auggccgccgccgccaagcccaacaaccucucccucgucguccacggccccggcgaccuccgccucgagaacuaccccauccccgagcccggccccaacgagguccuccuccgcaugcacuccgucggcaucugcggcuccgacguccacuacugggaguacggccgcaucggcaacuucaucgucaagaagcccaugguccucggccacgaggccuccggcaccgucgagaaggucggcuccuccgucaagcaccucaagcccggcgaccgcgucgccaucgagcccggcgccccccgcgagaacgacgaguucugcaagaugggccgcuacaaccucucccccuccaucuucuucugcgccaccccccccgacgacggcaaccucugccgcuucuacaagcacaacgccgccuucugcuacaagcuccccgacaacgucaccuucgaggagggcgcccucaucgagccccucuccgucggcauccacgccugccgccgcggcggcgucacccucggccacaagguccucgucugcggcgccggccccaucggcauggucacccuccucgucgccaaggccaugggcgccgcccaggucgucgucaccgaccucuccgccacccgccucuccaaggccaaggagaucggcgccgaccucguccuccagaucuccaaggaguccccccaggagaucgcccgcaaggucgagggccagcucggcugcaagcccgaggucaccaucgagugcaccggcgccgaggccuccauccaggccggcaucuacgccacccgcuccggcggcaaccucguccucgucggccucggcuccgagaugaccaccgucccccuccuccacgccgccauccgcgaggucgacaucaagggcgucuuccgcuacugcaacaccuggcccgucgccaucuccaugcucgccuccaaguccgucaacgucaagccccucgucacccaccgcuucccccucgagaaggcccucgaggccuucgagaccuucaagaagggccucggccucaagaucaugcucaagugcgaccccuccgaccagaaccccuga

SEQ ID NO: 49972 - RNA, 6645 nt, Artificial Sequence
  derived and/or modified sequence opt2 from SORL1__Homo_sapiens__NP_003096
auggccacccgcuccucccgccgcgagucccgccuccccuuccucuucacccucgucgcccuccucccccccggcgcccucugcgaggucuggacccagcgccuccacggcggcuccgccccccucccccaggaccgcggcuuccucgucguccagggcgacccccgcgagcuccgccucugggcccgcggcgacgcccgcggcgccucccgcgccgacgagaagccccuccgccgcaagcgcuccgccgcccuccagcccgagcccaucaaggucuacggccaggucucccucaacgacucccacaaccagauggucguccacugggccggcgagaaguccaacgucaucgucgcccucgcccgcgacucccucgcccucgcccgccccaaguccuccgacgucuacgucuccuacgacuacggcaaguccuucaagaagaucuccgacaagcucaacuucggccucggcaaccgcuccgaggccgucaucgcccaguucuaccacucccccgccgacaacaagcgcuacaucuucgccgacgccuacgcccaguaccucuggaucaccuucgacuucugcaacacccuccagggcuucuccauccccuuccgcgccgccgaccuccuccuccacuccaaggccuccaaccuccuccucggcuucgaccgcucccaccccaacaagcagcucuggaaguccgacgacuucggccagaccuggaucaugauccaggagcacgucaaguccuucuccuggggcaucgaccccuacgacaagcccaacaccaucuacaucgagcgccacgagcccuccggcuacuccaccgucuuccgcuccaccgacuucuuccagucccgcgagaaccaggaggucauccucgaggagguccgcgacuuccagcuccgcgacaaguacauguucgccaccaaggucguccaccuccucggcuccgagcagcaguccuccguccagcucugggucuccuucggccgcaagcccaugcgcgccgcccaguucgucacccgccaccccaucaacgaguacuacaucgccgacgccuccgaggaccaggucuucgucugcgucucccacuccaacaaccgcaccaaccucuacaucuccgaggccgagggccucaaguucucccucucccucgagaacguccucuacuacucccccggcggcgccggcuccgacacccucguccgcuacuucgccaacgagcccuucgccgacuuccaccgcgucgagggccuccagggcgucuacaucgccacccucaucaacggcuccaugaacgaggagaacaugcgcuccgucaucaccuucgacaagggcggcaccugggaguuccuccaggcccccgccuucaccggcuacggcgagaagaucaacugcgagcucucccagggcugcucccuccaccucgcccagcgccucucccagcuccucaaccuccagcuccgccgcaugcccauccucuccaaggaguccgcccccggccucaucaucgccaccggcuccgucggcaagaaccucgccuccaagaccaacgucuacaucuccuccuccgccggcgcccgcuggcgcgaggcccuccccggcccccacuacuacaccuggggcgaccacggcggcaucaucaccgccaucgcccagggcauggagaccaacgagcucaaguacuccaccaacgagggcgagaccuggaagaccuucaucuucuccgagaagcccgucuucgucuacggccuccucaccgagcccggcgagaaguccaccgucuucaccaucuucggcuccaacaaggagaacguccacuccuggcucauccuccaggucaacgccaccgacgcccucggcguccccugcaccgagaacgacuacaagcucuggucccccuccgacgagcgcggcaacgagugccuccucggccacaagaccgucuucaagcgccgcaccccccacgccaccugcuucaacggcgaggacuucgaccgccccgucgucgucuccaacugcuccugcacccgcgaggacuacgagugcgacuucggcuucaagauguccgaggaccucucccucgaggucugcguccccgaccccgaguucuccggcaaguccuacuccccccccguccccugccccgucggcuccaccuaccgccgcacccgcggcuaccgcaagaucuccggcgacaccugcuccggcggcgacgucgaggcccgccucgagggcgagcucguccccugcccccucgccgaggagaacgaguucauccucuacgccguccgcaaguccaucuaccgcuacgaccucgccuccggcgccaccgagcagcucccccucaccggccuccgcgccgccgucgcccucgacuucgacuacgagcacaacugccucuacugguccgaccucgcccucgacgucauccagcgccucugccucaacggcuccaccggccaggaggucaucaucaacuccggccucgagaccgucgaggcccucgccuucgagccccucucccagcuccucuacugggucgacgccggcuucaagaagaucgaggucgccaaccccgacggcgacuuccgccucaccaucgucaacuccuccguccucgaccgcccccgcgcccucguccucgucccccaggagggcgucauguucuggaccgacuggggcgaccucaagcccggcaucuaccgcuccaacauggacggcuccgccgccuaccaccucgucuccgaggacgucaaguggcccaacggcaucuccgucgacgaccaguggaucuacuggaccgacgccuaccucgagugcaucgagcgcaucaccuucuccggccagcagcgcuccgucauccucgacaaccucccccaccccuacgccaucgccgucuucaagaacgagaucuacugggacgacuggucccagcucuccaucuuccgcgccuccaaguacuccggcucccagauggagauccucgccaaccagcucaccggccucauggacaugaagaucuucuacaagggcaagaacaccggcuccaacgccugcgucccccgccccugcucccuccucugccuccccaaggccaacaacucccgcuccugccgcugccccgaggacgucuccuccuccguccuccccuccggcgaccucaugugcgacugcccccagggcuaccagcucaagaacaacaccugcgucaaggaggagaacaccugccuccgcaaccaguaccgcugcuccaacggcaacugcaucaacuccaucugguggugcgacuucgacaacgacugcggcgacauguccgacgagcgcaacugccccaccaccaucugcgaccucgacacccaguuccgcugccaggaguccggcaccugcaucccccucuccuacaagugcgaccucgaggacgacugcggcgacaacuccgacgagucccacugcgagaugcaccagugccgcuccgacgaguacaacugcuccuccggcaugugcauccgcuccuccugggucugcgacggcgacaacgacugccgcgacugguccgacgaggccaacugcaccgccaucuaccacaccugcgaggccuccaacuuccagugccgcaacggccacugcaucccccagcgcugggccugcgacggcgacaccgacugccaggacggcuccgacgaggaccccgucaacugcgagaagaagugcaacggcuuccgcugccccaacggcaccugcauccccuccuccaagcacugcgacggccuccgcgacugcuccgacggcuccgacgagcagcacugcgagccccucugcacccacuucauggacuucgucugcaagaaccgccagcagugccucuuccacuccauggucugcgacggcaucauccagugccgcgacggcuccgacgaggacgccgccuucgccggcugcucccaggaccccgaguuccacaaggucugcgacgaguucggcuuccagugccagaacggcgucugcaucucccucaucuggaagugcgacggcauggacgacugcggcgacuacuccgacgaggccaacugcgagaaccccaccgaggcccccaacugcucccgcuacuuccaguuccgcugcgagaacggccacugcauccccaaccgcuggaagugcgaccgcgagaacgacugcggcgacugguccgacgagaaggacugcggcgacucccacauccuccccuucuccacccccggccccuccaccugccuccccaacuacuaccgcugcuccuccggcaccugcgucauggacaccugggucugcgacggcuaccgcgacugcgccgacggcuccgacgaggaggccugcccccuccucgccaacgucaccgccgccuccacccccacccagcucggccgcugcgaccgcuucgaguucgagugccaccagcccaagaccugcauccccaacuggaagcgcugcgacggccaccaggacugccaggacggccgcgacgaggccaacugccccacccacuccacccucaccugcaugucccgcgaguuccagugcgaggacggcgaggccugcaucguccucuccgagcgcugcgacggcuuccucgacugcuccgacgaguccgacgagaaggccugcuccgacgagcucaccgucuacaagguccagaaccuccaguggaccgccgacuucuccggcgacgucacccucaccuggaugcgccccaagaagaugcccuccgccuccugcgucuacaacgucuacuaccgcgucgucggcgaguccaucuggaagacccucgagacccacuccaacaagaccaacaccguccucaagguccucaagcccgacaccaccuaccaggucaagguccagguccagugccucuccaaggcccacaacaccaacgacuucgucacccuccgcacccccgagggccuccccgacgccccccgcaaccuccagcucucccucccccgcgaggccgagggcgucaucgucggccacugggccccccccauccacacccacggccucauccgcgaguacaucgucgaguacucccgcuccggcuccaagaugugggccucccagcgcgccgccuccaacuucaccgagaucaagaaccuccucgucaacacccucuacaccguccgcgucgccgccgucaccucccgcggcaucggcaacugguccgacuccaaguccaucaccaccaucaagggcaaggucauccccccccccgacauccacaucgacuccuacggcgagaacuaccucuccuucacccucaccauggaguccgacaucaaggucaacggcuacgucgucaaccucuucugggccuucgacacccacaagcaggagcgccgcacccucaacuuccgcggcuccauccucucccacaaggucggcaaccucaccgcccacaccuccuacgagaucuccgccugggccaagaccgaccucggcgacuccccccucgccuucgagcacgucaugacccgcggcguccgcccccccgcccccucccucaaggccaaggccaucaaccagaccgccgucgagugcaccuggaccggcccccgcaacgucgucuacggcaucuucuacgccaccuccuuccucgaccucuaccgcaaccccaagucccucaccaccucccuccacaacaagaccgucaucgucuccaaggacgagcaguaccucuuccucguccgcgucgucguccccuaccagggccccuccuccgacuacgucgucgucaagaugauccccgacucccgccuccccccccgccaccuccacgucguccacaccggcaagaccuccgucgucaucaagugggagucccccuacgacucccccgaccaggaccuccucuacgccaucgccgucaaggaccucauccgcaagaccgaccgcuccuacaaggucaagucccgcaacuccaccgucgaguacacccucaacaagcucgagcccggcggcaaguaccacaucaucguccagcucggcaacauguccaaggacuccuccaucaagaucaccaccgucucccucuccgcccccgacgcccucaagaucaucaccgagaacgaccacguccuccucuucuggaagucccucgcccucaaggagaagcacuucaacgagucccgcggcuacgagauccacauguucgacuccgccaugaacaucaccgccuaccucggcaacaccaccgacaacuucuucaagaucuccaaccucaagaugggccacaacuacaccuucaccguccaggcccgcugccucuucggcaaccagaucugcggcgagcccgccauccuccucuacgacgagcucggcuccggcgccgacgccuccgccacccaggccgcccgcuccaccgacgucgccgccgucgucguccccauccucuuccucauccuccucucccucggcgucggcuucgccauccucuacaccaagcaccgccgccuccaguccuccuucaccgccuucgccaacucccacuacuccucccgccucggcuccgccaucuucuccuccggcgacgaccucggcgaggacgacgaggacgcccccaugaucaccggcuucuccgacgacguccccauggucaucgccuga

SEQ ID NO: 49973 - RNA, 4002 nt, Artificial Sequence
  derived and/or modified sequence opt2 from SOS1__Homo_sapiens__NP_005624
augcaggcccagcagcuccccuacgaguucuucuccgaggagaacgcccccaaguggcgcggccuccucguccccgcccucaagaagguccagggccagguccaccccacccucgaguccaacgacgacgcccuccaguacgucgaggagcucauccuccagcuccucaacaugcucugccaggcccagccccgcuccgccuccgacgucgaggagcgcguccagaaguccuucccccaccccaucgacaagugggccaucgccgacgcccaguccgccaucgagaagcgcaagcgccgcaacccccucucccuccccgucgagaagauccacccccuccucaaggagguccucggcuacaagaucgaccaccaggucuccgucuacaucgucgccguccucgaguacaucuccgccgacauccucaagcucgucggcaacuacguccgcaacauccgccacuacgagaucaccaagcaggacaucaaggucgccaugugcgccgacaagguccucauggacauguuccaccaggacgucgaggacaucaacauccucucccucaccgacgaggagcccuccaccuccggcgagcagaccuacuacgaccucgucaaggccuucauggccgagauccgccaguacauccgcgagcucaaccucaucaucaaggucuuccgcgagcccuucgucuccaacuccaagcucuucuccgccaacgacgucgagaacaucuucucccgcaucgucgacauccacgagcucuccgucaagcuccucggccacaucgaggacaccgucgagaugaccgacgagggcuccccccacccccucgucggcuccugcuucgaggaccucgccgaggagcucgccuucgaccccuacgaguccuacgcccgcgacauccuccgccccggcuuccacgaccgcuuccucucccagcucuccaagcccggcgccgcccucuaccuccaguccaucggcgagggcuucaaggaggccguccaguacguccucccccgccuccuccucgcccccgucuaccacugccuccacuacuucgagcuccucaagcagcucgaggagaaguccgaggaccaggaggacaaggagugccucaagcaggccaucaccgcccuccucaacguccaguccggcauggagaagaucugcuccaagucccucgccaagcgccgccucuccgaguccgccugccgcuucuacucccagcagaugaagggcaagcagcucgccaucaagaagaugaacgagauccagaagaacaucgacggcugggagggcaaggacaucggccagugcugcaacgaguucaucauggagggcacccucacccgcgucggcgccaagcacgagcgccacaucuuccucuucgacggccucaugaucugcugcaaguccaaccacggccagccccgccuccccggcgccuccaacgccgaguaccgccucaaggagaaguucuucaugcgcaagguccagaucaacgacaaggacgacaccaacgaguacaagcacgccuucgagaucauccucaaggacgagaacuccgucaucuucuccgccaaguccgccgaggagaagaacaacuggauggccgcccucaucucccuccaguaccgcuccacccucgagcgcaugcucgacgucaccaugcuccaggaggagaaggaggagcagaugcgccuccccuccgccgacgucuaccgcuucgccgagcccgacuccgaggagaacaucaucuucgaggagaacaugcagcccaaggccggcauccccaucaucaaggccggcaccgucaucaagcucaucgagcgccucaccuaccacauguacgccgaccccaacuucguccgcaccuuccucaccaccuaccgcuccuucugcaagccccaggagcuccucucccucaucaucgagcgcuucgagauccccgagcccgagcccaccgaggccgaccgcaucgccaucgagaacggcgaccagccccucuccgccgagcucaagcgcuuccgcaaggaguacauccagcccguccagcuccgcguccucaacgucugccgccacugggucgagcaccacuucuacgacuucgagcgcgacgccuaccuccuccagcgcauggaggaguucaucggcaccguccgcggcaaggccaugaagaagugggucgaguccaucaccaagaucauccagcgcaagaagaucgcccgcgacaacggccccggccacaacaucaccuuccaguccuccccccccaccgucgaguggcacaucucccgccccggccacaucgagaccuucgaccuccucacccuccaccccaucgagaucgcccgccagcucacccuccucgaguccgaccucuaccgcgccguccagcccuccgagcucgucggcuccgucuggaccaaggaggacaaggagaucaacucccccaaccuccucaagaugauccgccacaccaccaaccucacccucugguucgagaagugcaucgucgagaccgagaaccucgaggagcgcgucgccgucgucucccgcaucaucgagauccuccaggucuuccaggagcucaacaacuucaacggcguccucgaggucgucuccgccaugaacuccucccccgucuaccgccucgaccacaccuucgagcagauccccucccgccagaagaagauccucgaggaggcccacgagcucuccgaggaccacuacaagaaguaccucgccaagcuccgcuccaucaacccccccugcguccccuucuucggcaucuaccucaccaacauccucaagaccgaggagggcaaccccgagguccucaagcgccacggcaaggagcucaucaacuucuccaagcgccgcaaggucgccgagaucaccggcgagauccagcaguaccagaaccagcccuacugccuccgcgucgaguccgacaucaagcgcuucuucgagaaccucaaccccaugggcaacuccauggagaaggaguucaccgacuaccucuucaacaagucccucgagaucgagccccgcaaccccaagccccucccccgcuuccccaagaaguacuccuacccccucaagucccccggcguccgccccuccaacccccgccccggcaccaugcgccaccccaccccccuccagcaggagccccgcaagaucuccuacucccgcauccccgaguccgagaccgaguccaccgccuccgcccccaacuccccccgcaccccccucacccccccccccgccuccggcgccuccuccaccaccgacgucugcuccgucuucgacuccgaccacuccucccccuuccacuccuccaacgacaccgucuucauccaggucacccucccccacggcccccgcuccgccuccgucuccuccaucucccucaccaagggcaccgacgagguccccguccccccccccguccccccccgccgccgccccgaguccgcccccgccgaguccucccccuccaagaucauguccaagcaccucgacuccccccccgccauccccccccgccagcccaccuccaaggccuacuccccccgcuacuccaucuccgaccgcaccuccaucuccgacccccccgagucccccccccuccuccccccccgcgagcccguccgcacccccgacgucuucuccuccuccccccuccaccuccagccccccccccucggcaagaaguccgaccacggcaacgccuucuuccccaacucccccucccccuucacccccccccccccccagacccccuccccccacggcacccgccgccaccuccccucccccccccucacccaggaggucgaccuccacuccaucgccggcccccccguccccccccgccaguccaccucccagcacauccccaagcucccccccaagaccuacaagcgcgagcacacccaccccuccaugcaccgcgacggccccccccuccucgagaacgcccacuccuccuga

SEQ ID NO: 49974 - RNA, 3999 nt, Artificial Sequence
  derived and/or modified sequence opt2 from SOS2__Homo_sapiens__NP_008870
augcagcaggccccccagcccuacgaguucuucuccgaggagaacucccccaaguggcgcggccuccucgucuccgcccuccgcaagguccaggagcagguccaccccacccucuccgccaacgaggagucccucuacuacaucgaggagcucaucuuccagcuccucaacaagcucugcauggcccagccccgcaccguccaggacgucgaggagcgcguccagaagaccuucccccaccccaucgacaagugggccaucgccgacgcccaguccgccaucgagaagcgcaagcgccgcaacccccuccuccuccccgucgacaagauccaccccucccucaaggagguccucggcuacaaggucgacuaccacgucucccucuacaucgucgccguccucgaguacaucuccgccgacauccucaagcucgccggcaacuacgucuucaacauccgccacuacgagaucucccagcaggacaucaaggucuccaugugcgccgacaagguccucauggacauguucgaccaggacgacaucggccucgucucccucugcgaggacgagcccuccuccuccggcgagcucaacuacuacgaccucguccgcaccgagaucgccgaggagcgccaguaccuccgcgagcucaacaugaucaucaaggucuuccgcgaggccuuccucuccgaccgcaagcucuucaagcccuccgacaucgagaagaucuucuccaacaucuccgacauccacgagcucaccgucaagcuccucggccucaucgaggacaccgucgagaugaccgacgaguccuccccccacccccucgccggcuccugcuucgaggaccucgccgaggagcaggccuucgaccccuacgagacccucucccaggacauccucucccccgaguuccacgagcacuucaacaagcucauggcccgccccgccgucgcccuccacuuccaguccaucgccgacggcuucaaggaggccguccgcuacguccucccccgccucaugcucguccccgucuaccacugcuggcacuacuucgagcuccucaagcagcucaaggccugcuccgaggagcaggaggaccgcgagugccucaaccaggccaucaccgcccucaugaaccuccagggcuccauggaccgcaucuacaagcaguacuccccccgccgccgccccggcgaccccgucugccccuucuacucccaccagcuccgcuccaagcaccucgccaucaagaagaugaacgagauccagaagaacaucgacggcugggagggcaaggacaucggccagugcugcaacgaguucaucauggagggcccccucacccgcaucggcgccaagcacgagcgccacaucuuccucuucgacggccucaugaucuccugcaagcccaaccacggccagacccgccuccccggcuacuccuccgccgaguaccgccucaaggagaaguucgucaugcgcaagauccagaucugcgacaaggaggacaccugcgagcacaagcacgccuucgagcucgucuccaaggacgagaacuccaucaucuucgccgccaaguccgccgaggagaagaacaacuggauggccgcccucaucucccuccacuaccgcuccacccucgaccgcaugcucgacuccguccuccucaaggaggagaacgagcagccccuccgccuccccucccccgaggucuaccgcuucgucgucaaggacuccgaggagaacaucgucuucgaggacaaccuccagucccgcuccggcauccccaucaucaagggcggcaccgucgucaagcucaucgagcgccucaccuaccacauguacgccgaccccaacuucguccgcaccuuccucaccaccuaccgcuccuucugcaagccccaggagcuccucucccuccucaucgagcgcuucgagauccccgagcccgagcccaccgacgccgacaagcucgccaucgagaagggcgagcagcccaucuccgccgaccucaagcgcuuccgcaaggaguacguccagcccguccagcuccgcauccucaacgucuuccgccacugggucgagcaccacuucuacgacuucgagcgcgaccucgagcuccucgagcgccucgaguccuucaucuccuccguccgcggcaaggccaugaagaagugggucgaguccaucgccaagaucauccgccgcaagaagcaggcccaggccaacggcgucucccacaacaucaccuucgaguccccccccccccccaucgaguggcacaucuccaagcccggccaguucgagaccuucgaccucaugacccuccaccccaucgagaucgcccgccagcucacccuccucgaguccgaccucuaccgcaagguccagcccuccgagcucgucggcuccgucuggaccaaggaggacaaggagaucaacucccccaaccuccucaagaugauccgccacaccaccaaccucacccucugguucgagaagugcaucgucgaggccgagaacuucgaggagcgcgucgccguccucucccgcaucaucgagauccuccaggucuuccaggaccucaacaacuucaacggcguccucgagaucgucuccgccgucaacuccgucuccgucuaccgccucgaccacaccuucgaggcccuccaggagcgcaagcgcaagauccucgacgaggccgucgagcucucccaggaccacuucaagaaguaccucgucaagcucaaguccaucaacccccccugcguccccuucuucggcaucuaccucaccaacauccucaagaccgaggagggcaacaacgacuuccucaagaagaagggcaaggaccucaucaacuucuccaagcgccgcaaggucgccgagaucaccggcgagauccagcaguaccagaaccagcccuacugccuccgcaucgagcccgacaugcgccgcuucuucgagaaccucaaccccaugggcuccgccuccgagaaggaguucaccgacuaccucuucaacaagucccucgagaucgagccccgcaacugcaagcagcccccccgcuucccccgcaaguccaccuucucccucaagucccccggcauccgccccaacaccggccgccacggcuccaccuccggcacccuccgcggccaccccaccccccucgagcgcgagcccugcaagaucuccuucucccgcaucgccgagaccgagcucgaguccaccgucuccgcccccaccucccccaacacccccuccaccccccccgucuccgccuccuccgaccucuccgucuuccucgacgucgaccucaacuccuccugcggcuccaacuccaucuucgcccccguccuccucccccacuccaaguccuucuucuccuccugcggcucccuccacaagcucuccgaggagccccucaucccccccccccuccccccccgcaagaaguucgaccacgacgccuccaacuccaagggcaacaugaaguccgacgacgacccccccgccauccccccccgccagccccccccccccaaggucaagccccgcguccccguccccaccggcgccuucgacggcccccuccacucccccccccccccccccccccgcgacccccuccccgacacccccccccccgucccccuccgcccccccgagcacuucaucaacugccccuucaaccuccagccccccccccucggccaccuccaccgcgacuccgacuggcuccgcgacaucuccaccugccccaacucccccuccaccccccccuccacccccuccccccgcgucccccgccgcugcuacguccucuccuccucccagaacaaccucgcccacccccccgccccccccguccccccccgccagaacuccuccccccaccuccccaagcucccccccaagaccuacaagcgcgagcucucccaccccccccucuaccgccucccccuccucgagaacgccgagaccccccaguga

SEQ ID NO: 49975 - RNA, 621 nt, Artificial Sequence
  derived and/or modified sequence opt2 from SOSTDC1__Homo_sapiens__NP_056279
augcucccccccgccauccacuucuaccuccucccccucgccugcauccucaugaaguccugccucgccuucaagaacgacgccaccgagauccucuacucccacgucgucaagcccguccccgcccaccccuccuccaacuccacccucaaccaggcccgcaacggcggccgccacuucuccaacaccggccucgaccgcaacacccgcguccaggucggcugccgcgagcuccgcuccaccaaguacaucuccgacggccagugcaccuccaucuccccccucaaggagcucgucugcgccggcgagugccucccccuccccguccuccccaacuggaucggcggcggcuacggcaccaaguacuggucccgccgcuccucccaggaguggcgcugcgucaacgacaagacccgcacccagcgcauccagcuccagugccaggacggcuccacccgcaccuacaagaucaccgucgucaccgccugcaagugcaagcgcuacacccgccagcacaacgaguccucccacaacuucgaguccaugucccccgccaagcccguccagcaccaccgcgagcgcaagcgcgccuccaaguccuccaagcacuccauguccuga

SEQ ID NO: 49976 - RNA, 642 nt, Artificial Sequence
  derived and/or modified sequence opt2 from SOST__Homo_sapiens__NP_079513
augcagcucccccucgcccucugccucgucugccuccucguccacaccgccuuccgcgucgucgagggccagggcuggcaggccuucaagaacgacgccaccgagaucauccccgagcucggcgaguaccccgagcccccccccgagcucgagaacaacaagaccaugaaccgcgccgagaacggcggccgccccccccaccaccccuucgagaccaaggacgucuccgaguacuccugccgcgagcuccacuucacccgcuacgucaccgacggccccugccgcuccgccaagcccgucaccgagcucgucugcuccggccagugcggccccgcccgccuccuccccaacgccaucggccgcggcaagugguggcgccccuccggccccgacuuccgcugcauccccgaccgcuaccgcgcccagcgcguccagcuccucugccccggcggcgaggccccccgcgcccgcaagguccgccucgucgccuccugcaagugcaagcgccucacccgcuuccacaaccaguccgagcucaaggacuucggcaccgaggccgcccgcccccagaagggccgcaagccccgcccccgcgcccgcuccgccaaggccaaccaggccgagcucgagaacgccuacuga

SEQ ID NO: 49977 - RNA, 1401 nt, Artificial Sequence
  derived and/or modified sequence opt2 from SOX10__Homo_sapiens__NP_008872
auggccgaggagcaggaccucuccgaggucgagcucucccccgucggcuccgaggagccccgcugccucucccccggcuccgcccccucccucggccccgacggcggcggcggcggcuccggccuccgcgccucccccggccccggcgagcucggcaaggucaagaaggagcagcaggacggcgaggccgacgacgacaaguuccccgucugcauccgcgaggccgucucccagguccucuccggcuacgacuggacccucguccccaugcccguccgcgucaacggcgccuccaaguccaagccccacgucaagcgccccaugaacgccuucauggucugggcccaggccgcccgccgcaagcucgccgaccaguacccccaccuccacaacgccgagcucuccaagacccucggcaagcucuggcgccuccucaacgaguccgacaagcgccccuucaucgaggaggccgagcgccuccgcaugcagcacaagaaggaccaccccgacuacaaguaccagccccgccgccgcaagaacggcaaggccgcccagggcgaggccgagugccccggcggcgaggccgagcagggcggcaccgccgccauccaggcccacuacaaguccgcccaccucgaccaccgccaccccggcgagggcucccccauguccgacggcaaccccgagcaccccuccggccagucccacggcccccccaccccccccaccacccccaagaccgagcuccaguccggcaaggccgaccccaagcgcgacggccgcuccaugggcgagggcggcaagccccacaucgacuucggcaacgucgacaucggcgagaucucccacgaggucauguccaacauggagaccuucgacgucgccgagcucgaccaguaccucccccccaacggccaccccggccacgucuccuccuacuccgccgccggcuacggccucggcuccgcccucgccgucgccuccggccacuccgccuggaucuccaagccccccggcgucgcccuccccaccgucuccccccccggcgucgacgccaaggcccaggucaagaccgagaccgccggcccccagggccccccccacuacaccgaccagcccuccaccucccagaucgccuacaccucccucucccucccccacuacggcuccgccuuccccuccaucucccgcccccaguucgacuacuccgaccaccagcccuccggccccuacuacggccacuccggccaggccuccggccucuacuccgccuucuccuacaugggccccucccagcgcccccucuacaccgccaucuccgaccccucccccuccggcccccagucccacucccccacccacugggagcagcccgucuacaccacccucucccgccccuga

SEQ ID NO: 49978 - RNA, 1326 nt, Artificial Sequence
  derived and/or modified sequence opt2 from SOX11__Homo_sapiens__NP_003099
augguccagcaggccgagucccucgaggccgaguccaaccucccccgcgaggcccucgacaccgaggagggcgaguucauggccugcucccccgucgcccucgacgaguccgaccccgacuggugcaagaccgccuccggccacaucaagcgccccaugaacgccuucauggucugguccaagaucgagcgccgcaagaucauggagcagucccccgacaugcacaacgccgagaucuccaagcgccucggcaagcgcuggaagaugcucaaggacuccgagaagauccccuucauccgcgaggccgagcgccuccgccucaagcacauggccgacuaccccgacuacaaguaccgcccccgcaagaagcccaagauggaccccuccgccaagcccuccgccucccagucccccgagaaguccgccgccggcggcggcggcggcuccgccggcggcggcgccggcggcgccaagaccuccaagggcuccuccaagaagugcggcaagcucaaggcccccgccgccgccggcgccaaggccggcgccggcaaggccgcccaguccggcgacuacggcggcgccggcgacgacuacguccucggcucccuccgcgucuccggcuccggcggcggcggcgccggcaagaccgucaagugcgucuuccucgacgaggacgacgacgacgacgacgacgacgacgagcuccagcuccagaucaagcaggagcccgacgaggaggacgaggagcccccccaccagcagcuccuccagccccccggccagcagcccucccagcuccuccgccgcuacaacgucgccaagguccccgccucccccacccucuccuccuccgccgagucccccgagggcgccucccucuacgacgagguccgcgccggcgccaccuccggcgccggcggcggcucccgccucuacuacuccuucaagaacaucaccaagcagcacccccccccccucgcccagcccgcccucucccccgccuccucccgcuccgucuccaccuccuccuccuccuccuccggcuccuccuccggcuccuccggcgaggacgccgacgaccucauguucgaccucucccucaacuucucccaguccgcccacuccgccuccgagcagcagcucggcggcggcgccgccgccggcaaccucucccucucccucgucgacaaggaccucgacuccuucuccgagggcucccucggcucccacuucgaguuccccgacuacugcacccccgagcucuccgagaugaucgccggcgacuggcucgaggccaacuucuccgaccucgucuucaccuacuga

SEQ ID NO: 49979 - RNA, 948 nt, Artificial Sequence
  derived and/or modified sequence opt2 from SOX12__Homo_sapiens__NP_008874
augguccagcagcgcggcgcccgcgccaagcgcgacggcggcccccccccccccggccccggccccgccgaggagggcgcccgcgagcccggcuggugcaagacccccuccggccacaucaagcgccccaugaacgccuucauggucuggucccagcacgagcgccgcaagaucauggaccaguggcccgacaugcacaacgccgagaucuccaagcgccucggccgccgcuggcagcuccuccaggacuccgagaagauccccuucguccgcgaggccgagcgccuccgccucaagcacauggccgacuaccccgacuacaaguaccgcccccgcaagaaguccaagggcgcccccgccaaggcccgcccccgcccccccggcggcuccggcggcggcucccgccucaagcccggcccccagcuccccggccgcggcggccgccgcgccgccggcggcccccucggcggcggcgccgccgcccccgaggacgacgacgaggacgacgacgaggagcuccucgagguccgccucgucgagacccccggccgcgagcucuggcgcaugguccccgccggccgcgccgcccgcggccaggccgagcgcgcccagggccccuccggcgagggcgccgccgccgccgccgccgccucccccacccccuccgaggacgaggagcccgaggaggaggaggaggaggccgccgccgccgaggagggcgaggaggagaccgucgccuccggcgaggagucccucggcuuccucucccgccucccccccggccccgccggccucgacugcuccgcccucgaccgcgaccccgaccuccagccccccuccggcaccucccacuucgaguuccccgacuacugcacccccgaggucaccgagaugaucgccggcgacuggcgccccuccuccaucgccgaccucgucuucaccuacuga

SEQ ID NO: 49980 - RNA, 1869 nt, Artificial Sequence
  derived and/or modified sequence opt2 from SOX13__Homo_sapiens__NP_005677
auguccaugcgcucccccaucuccgcccagcucgcccucgacggcgucggcaccauggucaacugcaccaucaaguccgaggagaagaaggagcccugccacgaggccccccagggcuccgccaccgccgccgagccccagcccggcgaccccgcccgcgccucccaggacuccgccgacccccaggcccccgcccagggcaacuuccgcggcuccugggacugcuccucccccgagggcaacggcucccccgagcccaagcgccccggcgucuccgaggccgccuccggcucccaggagaagcucgacuucaaccgcaaccucaaggaggucguccccgccaucgagaagcuccucuccuccgacuggaaggagcgcuuccucggccgcaacuccauggaggccaaggacgucaagggcacccaggagucccucgccgagaaggagcuccagcuccucgucaugauccaccagcucuccacccuccgcgaccagcuccucaccgcccacuccgagcagaagaacauggccgccaugcucuucgagaagcagcagcagcagauggagcucgcccgccagcagcaggagcagaucgccaagcagcagcagcagcucauccagcagcagcacaagaucaaccuccuccagcagcagauccagcaggucaacaugcccuacgucaugauccccgccuucccccccucccaccagccccuccccgucacccccgacucccagcucgcccuccccauccagcccauccccugcaagcccgucgaguacccccuccagcuccuccacuccccccccgcccccgucgucaagcgccccggcgccauggccacccaccacccccuccaggagcccucccagccccucaaccucaccgccaagcccaaggcccccgagcuccccaacaccuccuccucccccucccucaagauguccuccugcgucccccgcccccccucccacggcggccccacccgcgaccuccaguccuccccccccucccucccccucggcuuccucggcgagggcgacgccgucaccaaggccauccaggacgcccgccagcuccuccacucccacuccggcgcccucgacggcucccccaacacccccuuccgcaaggaccucaucucccucgacuccucccccgccaaggagcgccucgaggacggcugcguccacccccucgaggaggccaugcucuccugcgacauggacggcucccgccacuuccccgagucccgcaacuccucccacaucaagcgccccaugaacgccuucauggucugggccaaggacgagcgccgcaagauccuccaggccuuccccgacaugcacaacuccuccaucuccaagauccucggcucccgcuggaaguccaugaccaaccaggagaagcagcccuacuacgaggagcaggcccgccucucccgccagcaccucgagaaguaccccgacuacaaguacaagccccgccccaagcgcaccugcaucgucgagggcaagcgccuccgcgucggcgaguacaaggcccucaugcgcacccgccgccaggacgcccgccaguccuacgucauccccccccaggccggccagguccagauguccuccuccgacguccucuacccccgcgccgccggcaugccccucgcccagccccucgucgagcacuacgucccccgcucccucgaccccaacaugcccgucaucgucaacaccugcucccuccgcgaggagggcgagggcaccgacgaccgccacuccgucgccgacggcgagauguaccgcuacuccgaggacgaggacuccgagggcgaggagaaguccgacggcgagcucgucguccucaccgacuga

SEQ ID NO: 49981 - RNA, 723 nt, Artificial Sequence
  derived and/or modified sequence opt2 from SOX14__Homo_sapiens__NP_004180
auguccaagcccuccgaccacaucaagcgccccaugaacgccuucauggucuggucccgcggccagcgccgcaagauggcccaggagaaccccaagaugcacaacuccgagaucuccaagcgccucggcgccgaguggaagcuccucuccgaggccgagaagcgccccuacaucgacgaggccaagcgccuccgcgcccagcacaugaaggagcaccccgacuacaaguaccgcccccgccgcaagcccaagaaccuccucaagaaggaccgcuacgucuucccccuccccuaccucggcgacaccgacccccucaaggccgccggccuccccgucggcgccuccgacggccuccucuccgcccccgagaaggcccgcgccuuccucccccccgccuccgcccccuacucccuccucgaccccgcccaguucuccuccuccgccauccagaagaugggcgaggucccccacacccucgccaccggcgcccuccccuacgccuccacccucggcuaccagaacggcgccuucggcucccucuccugccccucccagcacacccacacccaccccucccccaccaaccccggcuacgucguccccugcaacugcaccgccugguccgccuccacccuccagccccccgucgccuacauccucuuccccggcaugaccaagaccggcaucgaccccuacuccuccgcccacgccaccgccauguga

SEQ ID NO: 49982 - RNA, 702 nt, Artificial Sequence
  derived and/or modified sequence opt2 from SOX15__Homo_sapiens__NP_008873
auggcccuccccggcuccucccaggaccaggccuggucccucgagccccccgccgccaccgccgccgccuccuccuccuccggcccccaggagcgcgagggcgccggcucccccgccgcccccggcacccucccccucgagaaggucaagcgccccaugaacgccuucauggucugguccuccgcccagcgccgccagauggcccagcagaaccccaagaugcacaacuccgagaucuccaagcgccucggcgcccaguggaagcuccucgacgaggacgagaagcgccccuucgucgaggaggccaagcgccuccgcgcccgccaccuccgcgacuaccccgacuacaaguaccgcccccgccgcaaggccaaguccuccggcgccggccccucccgcugcggccagggccgcggcaaccucgccuccggcggcccccucuggggccccggcuacgccaccacccagcccucccgcggcuucggcuaccgcccccccuccuacuccaccgccuaccuccccggcuccuacggcuccucccacugcaagcucgaggcccccucccccugcucccucccccaguccgacccccgccuccagggcgagcuccuccccaccuacacccacuaccucccccccggcucccccacccccuacaaccccccccucgccggcgcccccaugccccucacccaccucuga

SEQ ID NO: 49983 - RNA, 1245 nt, Artificial Sequence
  derived and/or modified sequence opt2 from SOX17__Homo_sapiens__NP_071899
auguccucccccgacgccggcuacgccuccgacgaccagucccagacccaguccgcccuccccgccgucauggccggccucggccccugccccugggccgagucccucucccccaucggcgacaugaaggucaagggcgaggcccccgccaacuccggcgcccccgccggcgccgccggccgcgccaagggcgagucccgcauccgccgccccaugaacgccuucauggucugggccaaggacgagcgcaagcgccucgcccagcagaaccccgaccuccacaacgccgagcucuccaagaugcucggcaaguccuggaaggcccucacccucgccgagaagcgccccuucgucgaggaggccgagcgccuccgcguccagcacaugcaggaccaccccaacuacaaguaccgcccccgccgccgcaagcaggucaagcgccucaagcgcgucgagggcggcuuccuccacggccucgccgagccccaggccgccgcccucggccccgagggcggccgcgucgccauggacggccucggccuccaguuccccgagcagggcuuccccgccggccccccccuccuccccccccacaugggcggccacuaccgcgacugccagucccucggcgcccccccccucgacggcuacccccuccccacccccgacaccuccccccucgacggcgucgaccccgaccccgccuucuucgccgcccccaugcccggcgacugccccgccgccggcaccuacuccuacgcccaggucuccgacuacgccggcccccccgagccccccgccggccccaugcacccccgccucggccccgagcccgccggccccuccauccccggccuccucgccccccccuccgcccuccacgucuacuacggcgccaugggcucccccggcgccggcggcggccgcggcuuccagaugcagccccagcaccagcaccagcaccagcaccagcaccacccccccggccccggccagcccucccccccccccgaggcccuccccugccgcgacggcaccgaccccucccagcccgccgagcuccucggcgaggucgaccgcaccgaguucgagcaguaccuccacuucgucugcaagcccgagaugggccuccccuaccagggccacgacuccggcgucaaccuccccgacucccacggcgccaucuccuccgucgucuccgacgccuccuccgccgucuacuacugcaacuaccccgacgucuga

SEQ ID NO: 49984 - RNA, 1155 nt, Artificial Sequence
  derived and/or modified sequence opt2 from SOX18__Homo_sapiens__NP_060889
augcagcgcuccccccccggcuacggcgcccaggacgacccccccgcccgccgcgacugcgccugggcccccggccacggcgccgccgccgacacccgcggccucgccgccggccccgccgcccucgccgcccccgccgcccccgccuccccccccuccccccagcgcucccccccccgcucccccgagcccggccgcuacggccucucccccgccggccgcggcgagcgccaggccgccgacgagucccgcauccgccgccccaugaacgccuucauggucugggccaaggacgagcgcaagcgccucgcccagcagaaccccgaccuccacaacgccguccucuccaagaugcucggcaaggccuggaaggagcucaacgccgccgagaagcgccccuucgucgaggaggccgagcgccuccgcguccagcaccuccgcgaccaccccaacuacaaguaccgcccccgccgcaagaagcaggcccgcaaggcccgccgccucgagcccggccuccuccuccccggccucgcccccccccagcccccccccgagcccuuccccgccgccuccggcuccgcccgcgccuuccgcgagcuccccccccucggcgccgaguucgacggccucggccuccccacccccgagcgcuccccccucgacggccucgagcccggcgaggccgccuucuuccccccccccgccgcccccgaggacugcgcccuccgccccuuccgcgcccccuacgcccccaccgagcucucccgcgaccccggcggcugcuacggcgccccccucgccgaggcccuccgcaccgccccccccgccgccccccucgccggccucuacuacggcacccucggcacccccggccccuaccccggcccccucucccccccccccgaggcccccccccucgaguccgccgagccccucggccccgccgccgaccucugggccgacgucgaccucaccgaguucgaccaguaccucaacugcucccgcacccgccccgacgcccccggccuccccuaccacgucgcccucgccaagcucggcccccgcgccauguccugccccgaggaguccucccucaucuccgcccucuccgacgccuccuccgccgucuacuacuccgccugcaucuccggcuga

SEQ ID NO: 49985 - RNA, 1176 nt, Artificial Sequence
  derived and/or modified sequence opt2 from SOX1__Homo_sapiens__NP_005977
auguacuccaugaugauggagaccgaccuccacucccccggcggcgcccaggcccccaccaaccucuccggccccgccggcgccggcggcggcggcggcggcggcggcggcggcggcggcggcggcggcgccaaggccaaccaggaccgcgucaagcgccccaugaacgccuucauggucuggucccgcggccagcgccgcaagauggcccaggagaaccccaagaugcacaacuccgagaucuccaagcgccucggcgccgaguggaaggucauguccgaggccgagaagcgccccuucaucgacgaggccaagcgccuccgcgcccuccacaugaaggagcaccccgacuacaaguaccgcccccgccgcaagaccaagacccuccucaagaaggacaaguacucccucgccggcggccuccucgccgccggcgccggcggcggcggcgccgccgucgccaugggcgucggcgucggcgucggcgccgccgccgucggccagcgccucgagucccccggcggcgccgccggcggcggcuacgcccacgucaacggcugggccaacggcgccuaccccggcuccgucgccgccgccgccgccgccgccgccaugaugcaggaggcccagcucgccuacggccagcaccccggcgccggcggcgcccacccccacgcccaccccgcccacccccacccccaccacccccacgcccacccccacaacccccagcccaugcaccgcuacgacaugggcgcccuccaguacucccccaucuccaacucccagggcuacauguccgccucccccuccggcuacggcggccuccccuacggcgccgccgccgccgccgccgccgccgccggcggcgcccaccagaacuccgccgucgccgccgccgccgccgccgccgccgccuccuccggcgcccucggcgcccucggcucccucgucaaguccgagcccuccggcuccccccccgcccccgcccacucccgcgcccccugccccggcgaccuccgcgagaugaucuccauguaccuccccgccggcgagggcggcgaccccgccgccgccgccgccgccgccgcccagucccgccuccacucccucccccagcacuaccagggcgccggcgccggcgucaacggcaccgucccccucacccacaucuga

SEQ ID NO: 49986 - RNA, 831 nt, Artificial Sequence
  derived and/or modified sequence opt2 from SOX21__Homo_sapiens__NP_009015
auguccaagcccgucgaccacgucaagcgccccaugaacgccuucauggucuggucccgcgcccagcgccgcaagauggcccaggagaaccccaagaugcacaacuccgagaucuccaagcgccucggcgccgaguggaagcuccucaccgaguccgagaagcgccccuucaucgacgaggccaagcgccuccgcgccaugcacaugaaggagcaccccgacuacaaguaccgcccccgccgcaagcccaagacccuccucaagaaggacaaguucgccuuccccguccccuacggccucggcggcgucgccgacgccgagcaccccgcccucaaggccggcgccggccuccacgccggcgccggcggcggccucguccccgagucccuccucgccaaccccgagaaggccgccgccgccgccgccgccgccgccgcccgcgucuucuucccccaguccgccgccgccgccgccgccgccgccgccgccgccgccgccggcucccccuacucccuccucgaccucggcuccaagauggccgagaucuccuccuccuccuccggccuccccuacgccuccucccucggcuaccccaccgccggcgccggcgccuuccacggcgccgccgccgccgccgccgccgccgccgccgccgccggcggccacacccacucccaccccucccccggcaaccccggcuacaugauccccugcaacugcuccgccuggcccucccccggccuccagcccccccucgccuacauccuccuccccggcaugggcaagccccagcucgaccccuaccccgccgccuacgccgccgcccucuga

SEQ ID NO: 49987 - RNA, 954 nt, Artificial Sequence
  derived and/or modified sequence opt2 from SOX2__Homo_sapiens__NP_003097
auguacaacaugauggagaccgagcucaagccccccggcccccagcagaccuccggcggcggcggcggcaacuccaccgccgccgccgccggcggcaaccagaagaacucccccgaccgcgucaagcgccccaugaacgccuucauggucuggucccgcggccagcgccgcaagauggcccaggagaaccccaagaugcacaacuccgagaucuccaagcgccucggcgccgaguggaagcuccucuccgagaccgagaagcgccccuucaucgacgaggccaagcgccuccgcgcccuccacaugaaggagcaccccgacuacaaguaccgcccccgccgcaagaccaagacccucaugaagaaggacaaguacacccuccccggcggccuccucgcccccggcggcaacuccauggccuccggcgucggcgucggcgccggccucggcgccggcgucaaccagcgcauggacuccuacgcccacaugaacggcugguccaacggcuccuacuccaugaugcaggaccagcucggcuacccccagcaccccggccucaacgcccacggcgccgcccagaugcagcccaugcaccgcuacgacgucuccgcccuccaguacaacuccaugaccuccucccagaccuacaugaacggcucccccaccuacuccauguccuacucccagcagggcacccccggcauggcccucggcuccaugggcuccgucgucaaguccgaggccuccuccuccccccccgucgucaccuccuccucccacucccgcgcccccugccaggccggcgaccuccgcgacaugaucuccauguaccuccccggcgccgagguccccgagcccgccgcccccucccgccuccacaugucccagcacuaccaguccggccccguccccggcaccgccaucaacggcacccucccccucucccacauguga

SEQ ID NO: 49988 - RNA, 1341 nt, Artificial Sequence
  derived and/or modified sequence opt2 from SOX3__Homo_sapiens__NP_005625
augcgccccguccgcgagaacuccuccggcgcccgcuccccccgcguccccgccgaccucgcccgcuccauccucaucucccuccccuucccccccgacucccucgcccaccgcccccccuccuccgcccccaccgagucccagggccucuucaccgucgccgcccccgcccccggcgcccccuccccccccgccacccucgcccaccuccuccccgcccccgccauguacucccuccucgagaccgagcucaagaaccccgucggcacccccacccaggccgccggcaccggcggccccgccgcccccggcggcgccggcaaguccuccgccaacgccgccggcggcgccaacuccggcggcggcuccuccggcggcgccuccggcggcggcggcggcaccgaccaggaccgcgucaagcgccccaugaacgccuucauggucuggucccgcggccagcgccgcaagauggcccucgagaaccccaagaugcacaacuccgagaucuccaagcgccucggcgccgacuggaagcuccucaccgacgccgagaagcgccccuucaucgacgaggccaagcgccuccgcgccguccacaugaaggaguaccccgacuacaaguaccgcccccgccgcaagaccaagacccuccucaagaaggacaaguacucccuccccuccggccuccucccccccggcgccgccgccgccgccgccgccgccgccgccgccgccgccgccgccuccucccccgucggcgucggccagcgccucgacaccuacacccacgucaacggcugggccaacggcgccuacucccucguccaggagcagcucggcuacgcccagccccccuccauguccucccccccccccccccccgcccucccccccaugcaccgcuacgacauggccggccuccaguacucccccaugaugccccccggcgcccaguccuacaugaacgucgccgccgccgccgccgccgccuccggcuacggcggcauggcccccuccgccaccgccgccgccgccgccgccuacggccagcagcccgccaccgccgccgccgccgccgccgccgccgccgccaugucccucggccccaugggcuccgucgucaaguccgagcccuccucccccccccccgccaucgccucccacucccagcgcgccugccucggcgaccuccgcgacaugaucuccauguaccucccccccggcggcgacgccgccgacgccgccuccccccuccccggcggccgccuccacggcguccaccagcacuaccagggcgccggcaccgccgucaacggcaccgucccccucacccacaucuga

SEQ ID NO: 49989 - RNA, 1425 nt, Artificial Sequence
  derived and/or modified sequence opt2 from SOX4__Homo_sapiens__NP_003098
augguccagcagaccaacaacgccgagaacaccgaggcccuccucgccggcgaguccuccgacuccggcgccggccucgagcucggcaucgccuccucccccacccccggcuccaccgccuccaccggcggcaaggccgacgaccccuccuggugcaagacccccuccggccacaucaagcgccccaugaacgccuucauggucuggucccagaucgagcgccgcaagaucauggagcagucccccgacaugcacaacgccgagaucuccaagcgccucggcaagcgcuggaagcuccucaaggacuccgacaagauccccuucauccgcgaggccgagcgccuccgccucaagcacauggccgacuaccccgacuacaaguaccgcccccgcaagaaggucaaguccggcaacgccaacuccuccuccuccgccgccgccuccuccaagcccggcgagaagggcgacaaggucggcggcuccggcggcggcggccacggcggcggcggcggcggcggcuccuccaacgccggcggcggcggcggcggcgccuccggcggcggcgccaacuccaagcccgcccagaagaaguccugcggcuccaaggucgccggcggcgccggcggcggcgucuccaagccccacgccaagcucauccucgccggcggcggcggcggcggcaaggccgccgccgccgccgccgccuccuucgccgccgagcaggccggcgccgccgcccuccucccccucggcgccgccgccgaccaccacucccucuacaaggcccgcacccccuccgccuccgccuccgccuccuccgccgccuccgccuccgccgcccucgccgcccccggcaagcaccucgccgagaagaaggucaagcgcgucuaccucuucggcggccucggcaccuccuccucccccgucggcggcgucggcgccggcgccgaccccuccgacccccucggccucuacgaggaggagggcgccggcugcucccccgacgcccccucccucuccggccgcuccuccgccgccuccucccccgccgccggccgcucccccgccgaccaccgcggcuacgccucccuccgcgccgccucccccgcccccuccuccgcccccucccacgccuccuccuccgccuccucccacuccuccuccuccuccuccuccggcuccuccuccuccgacgacgaguucgaggacgaccuccucgaccucaaccccuccuccaacuucgaguccaugucccucggcuccuucuccuccuccuccgcccucgaccgcgaccucgacuucaacuucgagcccggcuccggcucccacuucgaguuccccgacuacugcacccccgaggucuccgagaugaucuccggcgacuggcucgaguccuccaucuccaaccucgucuucaccuacuga

SEQ ID NO: 49990 - RNA, 1929 nt, Artificial Sequence
  derived and/or modified sequence opt2 from SOX5__Homo_sapiens__NP_001248343
auguccuccaagcgccccgccucccccuacggcgaggccgacggcgaggucgccauggucaccucccgccagaaggucgaggaggaggaguccgacggccuccccgccuuccaccucccccuccacgucuccuuccccaacaagccccacuccgaggaguuccagcccgucucccuccucacccaggagaccugcggccaccgcacccccaccucccagcacaacaccauggaggucgacggcaacaaggucauguccuccuucgccccccacaacuccuccaccuccccccagaaggccgaggagggcggccgccaguccggcgagucccucuccuccaccgcccucggcacccccgagcgccgcaagggcucccucgccgacgucgucgacacccucaagcagcgcaagauggaggagcucaucaagaacgagcccgaggagacccccuccaucgagaagcuccucuccaaggacuggaaggacaagcuccucgccaugggcuccggcaacuucggcgagaucaagggcacccccgagucccucgccgagaaggagcgccagcucaugggcaugaucaaccagcucaccucccuccgcgagcagcuccucgccgcccacgacgagcagaagaagcucgccgccucccagaucgagaagcagcgccagcagauggagcucgccaagcagcagcaggagcagaucgcccgccagcagcagcagcuccuccagcagcagcacaagaucaaccuccuccagcagcagauccagguccagggccagcuccccccccucaugauccccgucuucccccccgaccagcgcacccucgccgccgccgcccagcagggcuuccuccucccccccggcuucuccuacaaggccggcugcuccgaccccuaccccguccagcucauccccaccaccauggccgccgccgccgccgccacccccggccucggcccccuccagcuccagcagcucuacgccgcccagcucgccgccaugcaggucucccccggcggcaagcuccccggcaucccccagggcaaccucggcgccgccgucucccccaccuccauccacaccgacaaguccaccaacucccccccccccaaguccaaggagaagaccacccucgagucccucacccagcagcucgccgucaagcagaacgaggagggcaaguucucccacgccaugauggacuucaaccucuccggcgacuccgacggcuccgccggcgucuccgagucccgcaucuaccgcgagucccgcggccgcggcuccaacgagccccacaucaagcgccccaugaacgccuucauggucugggccaaggacgagcgccgcaagauccuccaggccuuccccgacaugcacaacuccaacaucuccaagauccucggcucccgcuggaaggccaugaccaaccucgagaagcagcccuacuacgaggagcaggcccgccucuccaagcagcaccucgagaaguaccccgacuacaaguacaagccccgccccaagcgcaccugccucgucgacggcaagaagcuccgcaucggcgaguacaaggccaucaugcgcaaccgccgccaggagaugcgccaguacuucaacgucggccagcaggcccagauccccaucgccaccgccggcgucgucuaccccggcgccaucgccauggccggcaugcccuccccccaccuccccuccgagcacuccuccgucuccuccucccccgagcccggcaugcccgucauccaguccaccuacggcgucaagggcgaggagccccacaucaaggaggagauccaggccgaggacaucaacggcgagaucuacgacgaguacgacgaggaggaggacgaccccgacgucgacuacggcuccgacuccgagaaccacaucgccggccaggccaacuga

SEQ ID NO: 49991 - RNA, 2406 nt, Artificial Sequence
  derived and/or modified sequence opt2 from SOX6__Homo_sapiens__NP_001139283
auguccuccaagcaggccaccucccccuucgccugcgccgccgacggcgaggacgccaugacccaggaccucaccucccgcgagaaggaggagggcuccgaccagcacgucgccucccaccucccccuccaccccaucaugcacaacaagccccacuccgaggagcuccccacccucgucuccaccauccagcaggacgccgacugggacuccguccucuccucccagcagcgcauggaguccgagaacaacaagcucugcucccucuacuccuuccgcaacaccuccaccuccccccacaagcccgacgagggcucccgcgaccgcgagaucaugaccuccgucaccuucggcacccccgagcgccgcaagggcucccucgccgacgucgucgacacccucaagcagaagaagcucgaggagaugacccgcaccgagcaggaggacuccuccugcauggagaagcuccucuccaaggacuggaaggagaagauggagcgccucaacaccuccgagcuccucggcgagaucaagggcacccccgagucccucgccgagaaggagcgccagcucuccaccaugaucacccagcucaucucccuccgcgagcagcuccucgccgcccacgacgagcagaagaagcucgccgccucccagaucgagaagcagcgccagcagauggaccucgcccgccagcagcaggagcagaucgcccgccagcagcagcagcuccuccagcagcagcacaagaucaaccuccuccagcagcagauccagguccagggccacaugcccccccucaugauccccaucuucccccacgaccagcgcacccucgccgccgccgccgccgcccagcagggcuuccucuucccccccggcaucaccuacaagcccggcgacaacuaccccguccaguucauccccuccaccauggccgccgccgccgccuccggccucuccccccuccagcuccagcagcucuacgccgcccagcucgccuccaugcaggucucccccggcgccaagaugcccuccaccccccagccccccaacaccgccggcaccgucucccccaccggcaucaagaacgagaagcgcggcaccucccccgucacccaggucaaggacgaggccgccgcccagccccucaaccucuccucccgccccaagaccgccgagcccgucaagucccccaccucccccacccagaaccucuuccccgccuccaagaccucccccgucaaccuccccaacaaguccuccauccccucccccaucggcggcucccucggccgcggcuccucccucggcaaguggaagucccagcaccaggaggagaccuacgagcucgacauccucuccucccucaacucccccgcccucuucggcgaccaggacaccgucaugaaggccauccaggaggcccgcaagaugcgcgagcagauccagcgcgagcagcagcagcagcagccccacggcgucgacggcaagcucuccuccaucaacaacaugggccucaacuccugccgcaacgagaaggagcgcacccgcuucgagaaccucggcccccagcucaccggcaaguccaacgaggacggcaagcucggccccggcgucaucgaccucacccgccccgaggacgccgagggcuccaaggccaugaacggcuccgccgccaagcuccagcaguacuacugcuggcccaccggcggcgccaccgucgccgaggcccgcgucuaccgcgacgcccgcggccgcgccuccuccgagccccacaucaagcgccccaugaacgccuucauggucugggccaaggacgagcgccgcaagauccuccaggccuuccccgacaugcacaacuccaacaucuccaagauccucggcucccgcuggaaguccauguccaaccaggagaagcagcccuacuacgaggagcaggcccgccucuccaagauccaccucgagaaguaccccaacuacaaguacaagccccgccccaagcgcaccugcaucgucgacggcaagaagcuccgcaucggcgaguacaagcagcucaugcgcucccgccgccaggagaugcgccaguucuucaccgucggccagcagccccagauccccaucaccaccggcaccggcgucgucuaccccggcgccaucaccauggccaccaccacccccuccccccagaugaccuccgacugcuccuccaccuccgccucccccgagcccucccuccccgucauccaguccaccuacggcaugaagaccgacggcggcucccucgccggcaacgagaugaucaacggcgaggacgagauggagauguacgacgacuacgaggacgaccccaaguccgacuacuccuccgagaacgaggcccccgaggccgucuccgccaacuga

SEQ ID NO: 49992 - RNA, 1167 nt, Artificial Sequence
  derived and/or modified sequence opt2 from SOX7__Homo_sapiens__NP_113627
auggccucccuccucggcgccuaccccuggcccgagggccucgagugccccgcccucgacgccgagcucuccgacggccaguccccccccgccgucccccgcccccccggcgacaagggcuccgagucccgcauccgccgccccaugaacgccuucauggucugggccaaggacgagcgcaagcgccucgccguccagaaccccgaccuccacaacgccgagcucuccaagaugcucggcaaguccuggaaggcccucacccucucccagaagcgccccuacgucgacgaggccgagcgccuccgccuccagcacaugcaggacuaccccaacuacaaguaccgcccccgccgcaagaagcaggccaagcgccucugcaagcgcgucgaccccggcuuccuccucuccucccucucccgcgaccagaacgcccuccccgagaagcgcuccggcucccgcggcgcccucggcgagaaggaggaccgcggcgaguacucccccggcaccgcccuccccucccuccgcggcugcuaccacgagggccccgccggcggcggcggcggcggcacccccuccuccgucgacaccuaccccuacggccuccccaccccccccgagauguccccccucgacguccucgagcccgagcagaccuucuucuccucccccugccaggaggagcacggccacccccgccgcaucccccaccuccccggccaccccuacucccccgaguacgcccccuccccccuccacugcucccacccccucggcucccucgcccucggccagucccccggcgucuccaugaugucccccguccccggcugcccccccucccccgccuacuacucccccgccaccuaccacccccuccacuccaaccuccaggcccaccucggccagcucucccccccccccgagcaccccggcuucgacgcccucgaccagcucucccaggucgagcuccucggcgacauggaccgcaacgaguucgaccaguaccucaacacccccggccaccccgacuccgccaccggcgccauggcccucuccggccacguccccgucucccaggucacccccaccggccccaccgagaccucccucaucuccguccucgccgacgccaccgccaccuacuacaacuccuacuccgucuccuga

SEQ ID NO: 49993 - RNA, 1341 nt, Artificial Sequence
  derived and/or modified sequence opt2 from SOX8__Homo_sapiens__NP_055402
augcucgacauguccgaggcccgcucccagccccccugcucccccuccggcaccgccuccuccaugucccacgucgaggacuccgacuccgacgccccccccucccccgccggcuccgagggccucggccgcgccggcgucgccgucggcggcgcccgcggcgaccccgccgaggccgccgacgagcgcuuccccgccugcauccgcgacgccgucucccagguccucaagggcuacgacuggucccucguccccaugcccguccgcggcggcggcggcggcgcccucaaggccaagccccacgucaagcgccccaugaacgccuucauggucugggcccaggccgcccgccgcaagcucgccgaccaguacccccaccuccacaacgccgagcucuccaagacccucggcaagcucuggcgccuccucuccgaguccgagaagcgccccuucgucgaggaggccgagcgccuccgcguccagcacaagaaggaccaccccgacuacaaguaccagccccgccgccgcaaguccgccaaggccggccacuccgacuccgacuccggcgccgagcucggcccccaccccggcggcggcgccgucuacaaggccgaggccggccucggcgacggccaccaccacggcgaccacaccggccagacccacggcccccccaccccccccaccacccccaagaccgagcuccagcaggccggcgccaagcccgagcucaagcucgagggccgccgccccgucgacuccggccgccagaacaucgacuucuccaacgucgacaucuccgagcucuccuccgaggucaugggcaccauggacgccuucgacguccacgaguucgaccaguaccucccccucggcggccccgccccccccgagcccggccaggccuacggcggcgccuacuuccacgccggcgccucccccgucugggcccacaaguccgcccccuccgccuccgccucccccaccgagaccggccccccccgcccccacaucaagaccgagcagcccucccccggccacuacggcgaccagccccgcggcucccccgacuacggcuccugcuccggccaguccuccgccacccccgccgcccccgccggccccuucgccggcucccagggcgacuacggcgaccuccaggccuccuccuacuacggcgccuaccccggcuacgcccccggccucuaccaguaccccugcuuccacuccccccgccgccccuacgccuccccccuccucaacggccucgcccucccccccgcccacucccccaccucccacugggaccagcccgucuacaccacccucacccgccccuga

SEQ ID NO: 49994 - RNA, 1530 nt, Artificial Sequence
  derived and/or modified sequence opt2 from SOX9__Homo_sapiens__NP_000337
augaaccuccucgaccccuucaugaagaugaccgacgagcaggagaagggccucuccggcgcccccucccccaccauguccgaggacuccgccggcucccccugccccuccggcuccggcuccgacaccgagaacacccgcccccaggagaacaccuuccccaagggcgagcccgaccucaagaaggaguccgaggaggacaaguuccccgucugcauccgcgaggccgucucccagguccucaagggcuacgacuggacccucguccccaugcccguccgcgucaacggcuccuccaagaacaagccccacgucaagcgccccaugaacgccuucauggucugggcccaggccgcccgccgcaagcucgccgaccaguacccccaccuccacaacgccgagcucuccaagacccucggcaagcucuggcgccuccucaacgaguccgagaagcgccccuucgucgaggaggccgagcgccuccgcguccagcacaagaaggaccaccccgacuacaaguaccagccccgccgccgcaaguccgucaagaacggccaggccgaggccgaggaggccaccgagcagacccacaucucccccaacgccaucuucaaggcccuccaggccgacuccccccacuccuccuccggcauguccgagguccacucccccggcgagcacuccggccagucccagggcccccccaccccccccaccacccccaagaccgacguccagcccggcaaggccgaccucaagcgcgagggccgcccccuccccgagggcggccgccagccccccaucgacuuccgcgacgucgacaucggcgagcucuccuccgacgucaucuccaacaucgagaccuucgacgucaacgaguucgaccaguaccucccccccaacggccaccccggcguccccgccacccacggccaggucaccuacaccggcuccuacggcaucuccuccaccgccgccacccccgccuccgccggccacgucuggauguccaagcagcaggccccccccccccccccccagcagcccccccaggccccccccgccccccaggcccccccccagccccaggccgcccccccccagcagcccgccgcccccccccagcagccccaggcccacacccucaccacccucuccuccgagcccggccagucccagcgcacccacaucaagaccgagcagcucucccccucccacuacuccgagcagcagcagcacuccccccagcagaucgccuacucccccuucaaccucccccacuacucccccuccuacccccccaucacccgcucccaguacgacuacaccgaccaccagaacuccuccuccuacuacucccacgccgccggccagggcaccggccucuacuccaccuucaccuacaugaaccccgcccagcgccccauguacacccccaucgccgacaccuccggcguccccuccaucccccagacccacuccccccagcacugggagcagcccgucuacacccagcucacccgccccuga

SEQ ID NO: 49995 - RNA, 2658 nt, Artificial Sequence
  derived and/or modified sequence opt2 from SP100__Homo_sapiens__NP_001073860
auggccggcggcggcggcgaccucuccacccgccgccucaacgagugcaucucccccgucgccaacgagaugaaccaccuccccgcccacucccacgaccuccagcgcauguucaccgaggaccagggcgucgacgaccgccuccucuacgacaucgucuucaagcacuucaagcgcaacaaggucgagaucuccaacgccaucaagaagaccuuccccuuccucgagggccuccgcgaccgcgaccucaucaccaacaagauguucgaggacucccaggacuccugccgcaaccucguccccguccagcgcgucgucuacaacguccucuccgagcucgagaagaccuucaaccuccccguccucgaggcccucuucuccgacgucaacaugcaggaguaccccgaccucauccacaucuacaagggcuucgagaacgucauccacgacaagcucccccuccaggaguccgaggaggaggagcgcgaggagcgcuccggccuccagcucucccucgagcagggcaccggcgagaacuccuuccgcucccucaccuggccccccuccggcucccccucccacgccggcaccaccccccccgagaacggccucuccgagcaccccugcgagaccgagcagaucaacgccaagcgcaaggacaccaccuccgacaaggacgacucccucggcucccagcagaccaacgagcagugcgcccagaaggccgagcccaccgaguccugcgagcagaucgccguccaggucaacaacggcgacgccggccgcgagaugcccugcccccuccccugcgacgaggagucccccgaggccgagcuccacaaccacggcauccagaucaacuccugcuccguccgccucgucgacaucaagaaggagaagcccuucuccaacuccaaggucgagugccaggcccaggcccgcacccaccacaaccaggccuccgacaucaucgucaucuccuccgaggacuccgagggcuccaccgacgucgacgagccccucgaggucuucaucuccgccccccgcuccgagcccgucaucaacaacgacaacccccucgaguccaacgacgagaaggagggccaggaggccaccugcucccgcccccagaucguccccgagcccauggacuuccgcaagcucuccaccuuccgcgaguccuucaagaagcgcgucaucggccaggaccacgacuucuccgaguccuccgaggaggaggcccccgccgaggccuccuccggcgcccuccgcuccaagcacggcgagaaggcccccaugaccucccgcuccaccuccaccuggcgcauccccucccgcaagcgccgcuucuccuccuccgacuucuccgaccucuccaacggcgaggagcuccaggagaccugcuccuccucccuccgccgcggcuccggcucccagccccaggagcccgagaacaagaagugcuccugcgucaugugcuuccccaagggcgucccccgcucccaggaggcccgcaccgaguccucccaggccuccgacaugauggacaccauggacgucgagaacaacuccacccucgagaagcacuccggcaagcgccgcaagaagcgccgccaccgcuccaaggucaacggccuccagcgcggccgcaagaaggaccgcccccgcaagcaccucacccucaacaacaagguccagaagaagcgcuggcagcagcgcggccgcaaggccaacacccgcccccucaagcgccgccgcaagcgcggcccccgcauccccaaggacgagaacaucaacuucaagcaguccgagcuccccgucaccugcggcgaggucaagggcacccucuacaaggagcgcuucaagcagggcaccuccaagaagugcauccaguccgaggacaagaagugguucaccccccgcgaguucgagaucgagggcgaccgcggcgccuccaagaacuggaagcucuccauccgcugcggcggcuacacccucaagguccucauggagaacaaguuccuccccgagccccccuccacccgcaagaagcgcauccucgagucccacaacaacacccucgucgaccccugccccgagaacuccaacaucugcgaggucugcaacaaguggggccgccucuucugcugcgacaccugcccccgcuccuuccacgagcacugccacauccccuccgucgaggccaacaagaaccccugguccugcaucuucugccgcaucaagaccauccaggagcgcugccccgagucccaguccggccaccaggaguccgagguccucaugcgccagaugcuccccgaggagcagcucaagugcgaguuccuccuccucaaggucuacugcgacuccaaguccugcuucuucgccuccgagcccuacuacaaccgcgagggcucccagggcccccagaagcccauguggcucaacaaggucaagaccucccucaacgagcagauguacacccgcgucgagggcuucguccaggacaugcgccucaucuuccacaaccacaaggaguucuaccgcgaggacaaguucacccgccucggcauccagguccaggacaucuucgagaagaacuuccgcaacaucuucgccauccaggagaccuccaagaacaucaucauguucaucuga

SEQ ID NO: 49996 - RNA, 1668 nt, Artificial Sequence
  derived and/or modified sequence opt2 from SP110__Homo_sapiens__NP_001171944
augggccgcggcuuccgcauguucaccaugacccgcgccauggaggaggcccucuuccagcacuucaugcaccagaagcucggcaucgccuacgccauccacaagcccuuccccuucuucgagggccuccucgacaacuccaucaucaccaagcgcauguacauggagucccucgaggccugccgcaaccucauccccgucucccgcgucguccacaacauccucacccagcucgagcgcaccuucaaccucucccuccucgucacccucuucucccagaucaaccuccgcgaguaccccaaccucgucaccaucuaccgcuccuucaagcgcgucggcgccuccuacgaguggcagucccgcgacacccccauccuccucgaggcccccaccggccucgccgagggcuccucccuccacaccccccucgcccucccccccccccagcccccccagcccuccugcucccccugcgccccccgcgucuccgagcccggcaccuccucccagcaguccgacgagauccucuccgagucccccucccccuccgaccccguccucccccuccccgcccucauccaggagggccgcuccaccuccgucaccaacgacaagcucaccuccaagaugaacgccgaggaggacuccgaggagaugcccucccuccucaccuccaccguccaggucgccuccgacaaccucaucccccagauccgcgacaaggaggacccccaggagaugccccacuccccccucggcuccaugcccgagauccgcgacaacucccccgagcccaacgaccccgaggagccccaggaggucuccuccacccccuccgacaagaagggcaagaagcgcaagcgcugcaucugguccacccccaagcgccgccacaagaagaagucccuccccggcggcaccgccuccucccgccacggcauccagaagaagcucaagcgcgucgaccaggucccccagaagaaggacgacuccaccugcaacuccaccgucgagacccgcgcccagaaggcccgcaccgagugcgcccgcaagucccgcuccgaggagaucaucgacggcaccuccgagaugaacgagggcaagcgcucccagaagacccccuccaccccccgccgcgucacccagggcgccgccucccccggccacggcauccaggagaagcuccaggucgucgacaaggucacccagcgcaaggacgacuccaccuggaacuccgaggucaugaugcgcguccagaaggcccgcaccaagugcgcccgcaagucccgccucaaggagaagaagaaggagaaggacaucugcuccuccuccaagcgccgcuuccagaagaacauccaccgccgcggcaagcccaaguccgacaccgucgacuuccacugcuccaagcuccccgucaccugcggcgaggccaagggcauccucuacaagaagaagaugaagcacggcuccuccgucaagugcauccgcaacgaggacggcaccuggcucacccccaacgaguucgaggucgagggcaagggccgcaacgccaagaacuggaagcgcaacauccgcugcgagggcaugacccucggcgagcuccucaaguccggccuccuccucugccccccccgcaucaaccucaagcgcgagcucaacuccaaguga

SEQ ID NO: 49997 - RNA, 519 nt, Artificial Sequence
  derived and/or modified sequence opt2 from SP140__Homo_sapiens__NP_001005176
auggcccagcagggccagcagggccagauggccuccggcgacuccaaccucaacuuccgcauggucgccgagauccagaacgucgagggccagaaccuccaggagcaggucugccccgagcccaucuuccgcuucuuccgcgagaacaaggucgagaucgccuccgccaucacccgccccuuccccuuccucaugggccuccgcgaccgcuccuucaucuccgagcagauguacgagcacuuccaggaggccuuccgcaaccucguccccgucacccgcgucauguacugcguccucuccgagcucgagaagaccuucggcuggucccaccucgaggcccucuucucccgcaucaaccucauggccuaccccgaccucaacgagaucuaccgcuccuuccagaacgagaaccucuccuccuccgccguccucugccagcucgucucccccaacaaggacuggcgcucccacgaggagucccucgcccacaccggcacccuccgccgcuccugcauguga

SEQ ID NO: 49998 - RNA, 2358 nt, Artificial Sequence
  derived and/or modified sequence opt2 from SP1__Homo_sapiens__NP_612482
auguccgaccaggaccacuccauggacgagaugaccgccgucgucaagaucgagaagggcgucggcggcaacaacggcggcaacggcaacggcggcggcgccuucucccaggcccgcuccuccuccaccggcuccuccuccuccaccggcggcggcggccaggagucccagcccuccccccucgcccuccucgccgccaccugcucccgcaucgagucccccaacgagaacuccaacaacucccagggccccucccaguccggcggcaccggcgagcucgaccucaccgccacccagcucucccagggcgccaacggcuggcagaucaucuccuccuccuccggcgccacccccaccuccaaggagcaguccggcuccuccaccaacggcuccaacggcuccgaguccuccaagaaccgcaccgucuccggcggccaguacgucgucgccgccgcccccaaccuccagaaccagcagguccucaccggccuccccggcgucaugcccaacauccaguaccaggucaucccccaguuccagaccgucgacggccagcagcuccaguucgccgccaccggcgcccagguccagcaggacggcuccggccagauccagaucauccccggcgccaaccagcagaucaucaccaaccgcggcuccggcggcaacaucaucgccgccaugcccaaccuccuccagcaggccgucccccuccagggccucgccaacaacguccucuccggccagacccaguacgucaccaacguccccgucgcccucaacggcaacaucacccuccuccccgucaacuccgucuccgccgccacccucacccccuccucccaggccgucaccaucuccuccuccggcucccaggaguccggcucccagcccgucaccuccggcaccaccaucuccuccgccucccucgucuccucccaggccuccuccuccuccuucuucaccaacgccaacuccuacuccaccaccaccaccaccuccaacaugggcaucaugaacuucaccaccuccggcuccuccggcaccaacucccagggccagaccccccagcgcgucuccggccuccagggcuccgacgcccucaacauccagcagaaccagaccuccggcggcucccuccaggccggccagcagaaggagggcgagcagaaccagcagacccagcagcagcagauccucauccagccccagcucguccagggcggccaggcccuccaggcccuccaggccgccccccucuccggccagaccuucaccacccaggccaucucccaggagacccuccagaaccuccagcuccaggccguccccaacuccggccccaucaucauccgcacccccaccgucggccccaacggccaggucuccuggcagacccuccagcuccagaaccuccagguccagaacccccaggcccagaccaucacccucgcccccaugcagggcgucucccucggccagaccuccuccuccaacaccacccucacccccaucgccuccgccgccuccauccccgccggcaccgucaccgucaacgccgcccagcucuccuccaugcccggccuccagaccaucaaccucuccgcccucggcaccuccggcauccagguccaccccauccagggccucccccucgccaucgccaacgcccccggcgaccacggcgcccagcucggccuccacggcgccggcggcgacggcauccacgacgacaccgccggcggcgaggagggcgagaacucccccgacgcccagccccaggccggccgccgcacccgccgcgaggccugcaccugccccuacugcaaggacuccgagggccgcggcuccggcgaccccggcaagaagaagcagcacaucugccacauccagggcugcggcaaggucuacggcaagaccucccaccuccgcgcccaccuccgcuggcacaccggcgagcgccccuucaugugcaccugguccuacugcggcaagcgcuucacccgcuccgacgagcuccagcgccacaagcgcacccacaccggcgagaagaaguucgccugccccgagugccccaagcgcuucaugcgcuccgaccaccucuccaagcacaucaagacccaccagaacaagaagggcggccccggcgucgcccucuccgucggcacccucccccucgacuccggcgccggcuccgagggcuccggcaccgccacccccuccgcccucaucaccaccaacauggucgccauggaggccaucugccccgagggcaucgcccgccucgccaacuccggcaucaacgucaugcaggucgccgaccuccaguccaucaacaucuccggcaacggcuucuga

SEQ ID NO: 49999 - RNA, 1842 nt, Artificial Sequence
  derived and/or modified sequence opt2 from SP2__Homo_sapiens__NP_003101
auguccgacccccagaccuccauggccgccaccgccgccgucucccccuccgacuaccuccagcccgccgccuccaccacccaggacucccagcccuccccccucgcccuccucgccgccaccugcuccaagaucggcccccccgccgucgaggccgccgucaccccccccgcccccccccagcccaccccccgcaagcucguccccaucaagcccgccccccucccccucucccccggcaagaacuccuucggcauccucuccuccaagggcaacauccuccagauccagggcucccagcucuccgccuccuaccccggcggccagcucgucuucgccauccagaaccccaccaugaucaacaagggcacccgcuccaacgccaacauccaguaccaggccgucccccagauccaggccuccaacucccagaccauccagguccagcccaaccucaccaaccagauccagaucauccccggcaccaaccaggccaucaucacccccucccccuccucccacaagcccguccccaucaagcccgcccccauccagaaguccuccaccaccaccacccccguccaguccggcgccaacgucgucaagcucaccggcggcggcggcaacgucacccucacccuccccgucaacaaccucgucaacgccuccgacaccggcgcccccacccagcuccucaccgaguccccccccaccccccucuccaagaccaacaagaaggcccgcaagaagucccuccccgccucccagccccccgucgccgucgccgagcaggucgagaccguccucaucgagaccaccgccgacaacaucauccaggccggcaacaaccuccucaucguccagucccccggcggcggccagcccgccgucguccagcagguccaggucgucccccccaaggccgagcagcagcaggucguccagaucccccagcaggcccuccgcgucguccaggccgccuccgccacccuccccaccgucccccagaagcccucccagaacuuccagauccaggccgccgagcccacccccacccaggucuacauccgcacccccuccggcgagguccagaccguccucguccaggacuccccccccgccaccgccgccgccaccuccaacaccaccugcuccucccccgccucccgcgccccccaccucuccggcaccuccaagaagcacuccgccgccauccuccgcaaggagcgcccccuccccaagaucgcccccgccggcuccaucaucucccucaacgccgcccagcucgccgccgccgcccaggccaugcagaccaucaacaucaacggcguccagguccagggcguccccgucaccaucaccaacaccggcggccagcagcagcucaccguccagaacgucuccggcaacaaccucaccaucuccggccucucccccacccagauccagcuccagauggagcaggcccucgccggcgagacccagcccggcgagaagcgccgccgcauggccugcaccugccccaacugcaaggacggcgagaagcgcuccggcgagcagggcaagaagaagcacgucugccacauccccgacugcggcaagaccuuccgcaagaccucccuccuccgcgcccacguccgccuccacaccggcgagcgccccuucgucugcaacugguucuucugcggcaagcgcuucacccgcuccgacgagcuccagcgccacgcccgcacccacaccggcgacaagcgcuucgagugcgcccagugccagaagcgcuucaugcgcuccgaccaccucaccaagcacuacaagacccaccucgucaccaagaaccucuga

SEQ ID NO: 50000 - RNA, 2142 nt, Artificial Sequence
  derived and/or modified sequence opt2 from SP3__Homo_sapiens__NP_001017371
augggcccccccucccccggcgacgacgaggaggaggccgccgccgccgccggcgcccccgccgccgccggcgccaccggcgaccucgccuccgcccagcucggcggcgcccccaaccgcugggagguccucuccgccacccccaccaccaucaaggacgaggccggcaaccucguccagauccccuccgccgccaccuccuccggccaguacguccucccccuccagaaccuccagaaccagcagaucuucuccgucgcccccggcuccgacuccuccaacggcaccgucuccuccguccaguaccaggucaucccccagauccaguccgccgacggccagcagguccagaucggcuucaccggcuccuccgacaacggcggcaucaaccaggaguccucccagauccagaucauccccggcuccaaccagacccuccucgccuccggcacccccuccgccaacauccagaaccucaucccccagaccggccagguccagguccagggcgucgccaucggcggcuccuccuuccccggccagacccaggucgucgccaacgucccccucggccuccccggcaacaucaccuucguccccaucaacuccgucgaccucgacucccucggccucuccggcuccucccagaccaugaccgccggcaucaacgccgacggccaccucaucaacaccggccaggccauggacuccuccgacaacuccgagcgcaccggcgagcgcgucucccccgacaucaacgagaccaacaccgacaccgaccucuucguccccaccuccuccuccucccagcuccccgucaccaucgacuccaccggcauccuccagcagaacaccaacucccucaccaccuccuccggccagguccacuccuccgaccuccagggcaacuacauccagucccccgucuccgaggagacccaggcccagaacauccaggucuccaccgcccagcccgucguccagcaccuccagcuccaggagucccagcagcccaccucccaggcccagaucguccagggcaucaccccccagaccauccacggcguccaggccuccggccagaacaucucccagcaggcccuccagaaccuccagcuccagcucaaccccggcaccuuccucauccaggcccagaccgucacccccuccggccaggucaccuggcagaccuuccagguccagggcguccagaaccuccagaaccuccagauccagaacaccgccgcccagcagaucacccucacccccguccagacccucacccucggccaggucgccgccggcggcgccuucaccuccacccccgucucccucuccaccggccagcuccccaaccuccagaccgucaccgucaacuccaucgacuccgccggcauccagcuccaccccggcgagaacgccgacucccccgccgacauccgcaucaaggaggaggagcccgaccccgaggaguggcagcucuccggcgacuccacccucaacaccaacgaccucacccaccuccgcguccaggucgucgacgaggagggcgaccagcagcaccaggagggcaagcgccuccgccgcgucgccugcaccugccccaacugcaaggagggcggcggccgcggcaccaaccucggcaagaagaagcagcacaucugccacauccccggcugcggcaaggucuacggcaagaccucccaccuccgcgcccaccuccgcuggcacuccggcgagcgccccuucgucugcaacuggauguacugcggcaagcgcuucacccgcuccgacgagcuccagcgccaccgccgcacccacaccggcgagaagaaguucgucugccccgagugcuccaagcgcuucaugcgcuccgaccaccucgccaagcacaucaagacccaccagaacaagaagggcauccacuccuccuccaccguccucgccuccgucgaggccgcccgcgacgacacccucaucaccgccggcggcaccacccucauccucgccaacauccagcagggcuccgucuccggcaucggcaccgucaacaccuccgccaccuccaaccaggacauccucaccaacaccgagaucccccuccagcucgucaccgucuccggcaacgagaccauggaguga

SEQ ID NO: 50001 - RNA, 2355 nt, Artificial Sequence
  derived and/or modified sequence opt2 from SP4__Homo_sapiens__NP_003103
auguccgaccagaagaaggaggaggaggaggaggccgccgccgccgccgccauggccaccgagggcggcaagaccuccgagcccgagaacaacaacaagaagcccaagaccuccggcucccaggacucccagcccuccccccucgcccuccucgccgccaccugcuccaagaucggcacccccggcgagaaccaggccaccggccagcagcagaucaucaucgaccccucccagggccucguccagcuccagaaccagccccagcagcucgagcucgucaccacccagcucgccggcaacgccuggcagcucgucgccuccaccccccccgccuccaaggagaacaacgucucccagcccgccuccuccuccuccuccuccuccuccuccaacaacggcuccgccucccccaccaagaccaaguccggcaacuccuccacccccggccaguuccaggucauccagguccagaaccccuccggcuccguccaguaccaggucaucccccagcuccagaccgucgagggccagcagauccagaucaaccccaccuccuccuccucccuccaggaccuccagggccagauccagcucaucuccgccggcaacaaccaggccauccucaccgccgccaaccgcaccgccuccggcaacauccucgcccagaaccucgccaaccagaccguccccguccagauccgccccggcgucuccaucccccuccagcuccagacccuccccggcacccaggcccaggucgucaccacccuccccaucaacaucggcggcgucacccucgcccuccccgucaucaacaacgucgccgccggcggcggcaccggccaggucggccagcccgccgccaccgccgacuccggcaccuccaacggcaaccagcucgucuccacccccaccaacaccaccaccuccgccuccaccaugcccgagucccccuccuccuccaccaccugcaccaccaccgccuccaccucccucaccuccuccgacacccucgucuccuccgccgacaccggccaguacgccuccaccuccgccuccuccuccgagcgcaccaucgaggagucccagacccccgccgccaccgaguccgaggcccaguccuccucccagcuccagcccaacggcaugcagaacgcccaggaccaguccaacucccuccagcagguccagaucgucggccagcccauccuccagcagauccagauccagcagccccagcagcagaucauccaggccauccccccccaguccuuccagcuccaguccggccagaccauccagaccauccagcagcagccccuccagaacguccagcuccaggccgucaaccccacccagguccucauccgcgcccccacccucacccccuccggccagaucuccuggcagaccguccagguccagaacauccagucccucuccaaccuccagguccagaacgccggccucucccagcagcucaccaucacccccgucuccuccuccggcggcaccacccucgcccagaucgcccccgucgccgucgccggcgcccccaucacccucaacaccgcccagcucgccuccguccccaaccuccagaccgucuccgucgccaaccucggcgccgccggcguccagguccagggcguccccgucaccaucaccuccgucgccggccagcagcagggccaggacggcgucaagguccagcaggccaccaucgcccccgucaccgucgccgucggcggcaucgccaacgccaccaucggcgccgucucccccgaccagcucacccagguccaccuccagcagggccagcagaccuccgaccaggagguccagcccggcaagcgccuccgccgcgucgccugcuccugccccaacugccgcgagggcgagggccgcggcuccaacgagcccggcaagaagaagcagcacaucugccacaucgagggcugcggcaaggucuacggcaagaccucccaccuccgcgcccaccuccgcuggcacaccggcgagcgccccuucaucugcaacuggauguucugcggcaagcgcuucacccgcuccgacgagcuccagcgccaccgccgcacccacaccggcgagaagcgcuucgagugccccgagugcuccaagcgcuucaugcgcuccgaccaccucuccaagcacgucaagacccaccagaacaagaagggcggcggcaccgcccucgccaucgucaccuccggcgagcucgacuccuccgucaccgagguccucggcuccccccgcaucgucaccgucgccgccaucucccaggacuccaaccccgccacccccaacgucuccaccaacauggaggaguucuga

SEQ ID NO: 50002 - RNA, 1197 nt, Artificial Sequence
  derived and/or modified sequence opt2 from SP5__Homo_sapiens__NP_001003845
auggccgccgucgccguccuccgcaacgacucccuccaggccuuccuccaggaccgcacccccuccgccucccccgaccucggcaagcacuccccccucgcccuccucgccgccaccugcucccgcaucggccagcccggcgccgccgccccccccgacuuccuccagguccccuacgaccccgcccucggcucccccucccgccucuuccaccccuggaccgccgacaugcccgcccacucccccggcgcccucccccccccccaccccucccucggccucaccccccagaagacccaccuccagcccuccuucggcgccgcccacgagcucccccucaccccccccgccgaccccuccuaccccuacgaguucucccccgucaagaugcuccccuccuccauggccgcccuccccgccuccugcgcccccgccuacguccccuacgccgcccaggccgcccucccccccggcuacuccaaccuccucccccccccccccccccccccccccccccccaccugccgccagcucucccccaaccccgcccccgacgaccuccccuggugguccaucccccaggccggcgccggccccggcgccuccggcguccccggcuccggccucuccggcgccugcgccggcgccccccacgccccccgcuuccccgccuccgccgccgccgccgccgccgccgccgccgcccuccagcgcggccucguccucggccccuccgacuucgcccaguaccagucccagaucgccgcccuccuccagaccaaggccccccucgccgccaccgcccgccgcugccgccgcugccgcugccccaacugccaggccgccggcggcgcccccgaggccgagcccggcaagaagaagcagcacgucugccacguccccggcugcggcaaggucuacggcaagaccucccaccucaaggcccaccuccgcuggcacaccggcgagcgccccuucgucugcaacuggcucuucugcggcaaguccuucacccgcuccgacgagcuccagcgccaccuccgcacccacaccggcgagaagcgcuucgccugccccgagugcggcaagcgcuucaugcgcuccgaccaccucgccaagcacgucaagacccaccagaacaagaagcucaaggucgccgaggccggcgucaagcgcgaggacgcccgcgaccucuga

SEQ ID NO: 50003 - RNA, 1131 nt, Artificial Sequence
  derived and/or modified sequence opt2 from SP6__Homo_sapiens__NP_954871
augcucaccgccgucugcggcucccucggcucccagcacaccgaggccccccacgccucccccccccgccucgaccuccagccccuccagaccuaccagggccacaccucccccgaggccggcgacuaccccuccccccuccagcccggcgagcuccagucccucccccucggccccgaggucgacuucucccagggcuacgagcuccccggcgccuccucccgcgucaccugcgaggaccucgaguccgacuccccccucgcccccggccccuucuccaagcuccuccagcccgacaugucccaccacuacgaguccugguuccgccccacccaccccggcgccgaggacggcuccuggugggaccuccaccccggcaccuccuggauggaccucccccacacccagggcgcccucaccucccccggccaccccggcgcccuccaggccggccucggcggcuacgucggcgaccaccagcucugcgccccccccccccacccccacgcccaccaccuccuccccgccgccggcggccagcaccuccucggcccccccgacggcgccaaggcccucgaggucgccgcccccgagucccagggccucgacuccucccucgacggcgccgcccgccccaagggcucccgccgcuccgucccccgcuccuccggccagaccgucugccgcugccccaacugccucgaggccgagcgccucggcgcccccugcggccccgacggcggcaagaagaagcaccuccacaacugccacauccccggcugcggcaaggccuacgccaagaccucccaccucaaggcccaccuccgcuggcacuccggcgaccgccccuucgucugcaacuggcucuucugcggcaagcgcuucacccgcuccgacgagcuccagcgccaccuccagacccacaccggcaccaagaaguuccccugcgccgucugcucccgcgucuucaugcgcuccgaccaccucgccaagcacaugaagacccacgagggcgccaaggaggaggccgccggcgccgccuccggcgagggcaaggccggcggcgccgucgagccccccggcggcaagggcaagcgcgaggccgagggcuccgucgcccccuccaacuga

SEQ ID NO: 50004 - RNA, 1296 nt, Artificial Sequence
  derived and/or modified sequence opt2 from SP7__Homo_sapiens__NP_690599
auggccuccucccuccucgaggaggagguccacuacggcuccuccccccucgccaugcucaccgccgccugcuccaaguucggcggcuccuccccccuccgcgacuccaccacccucggcaaggccggcaccaagaagcccuacuccgucggcuccgaccucuccgccuccaagaccaugggcgacgccuaccccgcccccuucaccuccaccaacggccuccucucccccgccggcuccccccccgcccccaccuccggcuacgccaacgacuacccccccuucucccacuccuuccccggccccaccggcacccaggaccccggccuccucguccccaagggccacuccuccuccgacugccuccccuccgucuacaccucccucgacaugacccaccccuacggcuccugguacaaggccggcauccacgccggcaucucccccggccccggcaacacccccacccccuggugggacaugcaccccggcggcaacuggcucggcggcggccagggccagggcgacggccuccagggcacccuccccaccggccccgcccagcccccccucaacccccagcuccccaccuaccccuccgacuucgccccccucaaccccgcccccuaccccgccccccaccuccuccagcccggcccccagcacguccucccccaggacgucuacaagcccaaggccgucggcaacuccggccagcucgagggcuccggcggcgccaagcccccccgcggcgccuccaccggcggcuccggcggcuacggcggcuccggcgccggccgcuccuccugcgacugccccaacugccaggagcucgagcgccucggcgccgccgccgccggccuccgcaagaagcccauccacuccugccacauccccggcugcggcaaggucuacggcaaggccucccaccucaaggcccaccuccgcuggcacaccggcgagcgccccuucgucugcaacuggcucuucugcggcaagcgcuucacccgcuccgacgagcucgagcgccacguccgcacccacacccgcgagaagaaguucaccugccuccucugcuccaagcgcuucacccgcuccgaccaccucuccaagcaccagcgcacccacggcgagcccggccccggccccccccccuccggccccaaggagcucggcgagggccgcuccaccggcgaggaggaggccucccagaccccccgccccuccgccucccccgccacccccgagaaggcccccggcggcucccccgagcaguccaaccuccucgagaucuga

SEQ ID NO: 50005 - RNA, 1527 nt, Artificial Sequence
  derived and/or modified sequence opt2 from SP8__Homo_sapiens__NP_874359
auggccaccucccuccucggcgaggagccccgccucggcuccaccccccucgccaugcucgccgccaccugcaacaagaucggcucccccucccccucccccuccucccucuccgacuccuccuccuccuucggcaagggcuuccaccccuggaagcgcuccuccuccuccuccuccgccuccugcaacgucgucggcuccucccucuccuccuucggcgucuccggcgccucccgcaacggcggcuccuccuccgccgccgccgccgccgccgccgccgccgccgccgccgccgcccucgucuccgacuccuucuccugcggcggcucccccggcuccuccgccuucucccucaccuccuccuccgccgccgccgccgccgccgccgccgccgccgccgccuccuccucccccuucgccaacgacuacuccgucuuccaggcccccggcgucuccggcggcuccggcggcggcggcggcggcggcggcggcggcuccuccgcccacucccaggacggcucccaccagcccgucuucaucuccaagguccacaccuccgucgacggccuccagggcaucuacccccgcgucggcauggcccaccccuacgaguccugguucaagcccucccaccccggccucggcgccgccggcgaggucggcuccgccggcgccuccuccuggugggacgucggcgccggcuggaucgacguccagaaccccaacuccgccgccgcccuccccggcucccuccaccccgccgccggcggccuccagaccucccuccacuccccccucggcggcuacaacuccgacuacuccggccucucccacuccgccuucuccuccggcgccuccucccaccuccucucccccgccggccagcaccucauggacggcuucaagcccguccuccccggcuccuaccccgacuccgcccccuccccccucgccggcgccggcggcuccaugcucuccgccggccccuccgccccccucggcggcuccccccgcuccuccgcccgccgcuacuccggccgcgccaccugcgacugccccaacugccaggaggccgagcgccucggccccgccggcgccucccuccgccgcaagggccuccacuccugccacauccccggcugcggcaaggucuacggcaagaccucccaccucaaggcccaccuccgcuggcacaccggcgagcgccccuucgucugcaacuggcucuucugcggcaagcgcuucacccgcuccgacgagcuccagcgccaccuccgcacccacaccggcgagaagcgcuucgccugccccgucugcaacaagcgcuucaugcgcuccgaccaccucuccaagcacgucaagacccacuccggcggcggcggcggcggcggcuccgccggcuccggcuccggcggcaagaagggcuccgacaccgacuccgagcacuccgccgccggcuccccccccugccacucccccgagcuccuccagccccccgagcccggccaccgcaacggccucgaguga

SEQ ID NO: 50006 - RNA, 456 nt, Artificial Sequence
  derived and/or modified sequence opt2 from SPA17__Homo_sapiens__XP_011541172
auguccauccccuucuccaacacccacuaccgcaucccccagggcuucggcaaccuccucgagggccucacccgcgagauccuccgcgagcagcccgacaacauccccgccuucgccgccgccuacuucgagucccuccucgagaagcgcgagaagaccaacuucgaccccgccgaguggggcuccaaggucgaggaccgcuucuacaacaaccacgccuucgaggagcaggagccccccgagaaguccgaccccaagcaggaggagucccagaucuccggcaaggaggaggagaccuccgucaccauccucgacuccuccgaggaggacaaggagaaggaggaggucgccgccgucaagauccaggccgccuuccgcggccacaucgcccgcgaggaggccaagaagaugaagaccaacucccuccagaacgaggagaaggaggagaacaaguga

SEQ ID NO: 50007 - RNA, 885 nt, Artificial Sequence
  derived and/or modified sequence opt2 from SPACA1__Homo_sapiens__NP_112222
auguccccccgcggcaccggcugcuccgccggccuccucaugaccgucggcuggcuccuccucgccggccuccaguccgcccgcggcaccaacgucaccgccgccguccaggacgccggccucgcccacgagggcgagggcgaggaggagaccgagaacaacgacuccgagaccgccgagaacuacgccccccccgagaccgaggacgucuccaaccgcaacgucgucaaggaggucgaguucggcaugugcaccgucaccugcggcaucggcguccgcgaggucauccucaccaacggcugccccggcggcgaguccaagugcgucguccgcgucgaggagugccgcggccccaccgacugcggcuggggcaagcccaucuccgagucccucgaguccguccgccucgccugcauccacaccuccccccucaaccgcuucaaguacauguggaagcuccuccgccaggaccagcaguccaucauccucgucaacgacuccgccauccucgagguccgcaaggagucccacccccucgccuucgagugcgacacccucgacaacaacgagaucgucgccaccaucaaguucaccgucuacaccuccuccgagcuccagaugcgccgcuccucccuccccgccaccgacgccgcccucaucuucguccucaccaucggcgucaucaucugcgucuucaucaucuuccuccucaucuucaucaucaucaacugggccgccgucaaggccuucuggggcgccaaggccuccacccccgagguccaguccgagcaguccuccguccgcuacaaggacuccaccucccucgaccagcuccccaccgagaugcccggcgaggacgacgcccucuccgaguggaacgaguga

SEQ ID NO: 50008 - RNA, 648 nt, Artificial Sequence
  derived and/or modified sequence opt2 from SPACA3__Homo_sapiens__NP_776246
auggucuccgcccuccgcggcgccccccucauccgcguccacuccucccccgucuccucccccuccgucuccggcccccgccgccucgucuccugccucuccucccaguccuccgcccucucccaguccggcggcggcuccaccuccgccgccggcaucgaggcccgcucccgcgcccuccgccgccgcuggugccccgccggcaucaugcuccucgcccucgucugccuccucuccugccuccuccccuccuccgaggccaagcucuacggccgcugcgagcucgcccgcguccuccacgacuucggccucgacggcuaccgcggcuacucccucgccgacugggucugccucgccuacuucaccuccggcuucaacgccgccgcccucgacuacgaggccgacggcuccaccaacaacggcaucuuccagaucaacucccgccgcuggugcuccaaccucacccccaacguccccaacgucugccgcauguacugcuccgaccuccucaaccccaaccucaaggacaccgucaucugcgccaugaagaucacccaggagccccagggccucggcuacugggaggccuggcgccaccacugccagggcaaggaccucaccgagugggucgacggcugcgacuucuga

SEQ ID NO: 50009 - RNA, 327 nt, Artificial Sequence
  derived and/or modified sequence opt2 from SPAG11A__Homo_sapiens__NP_001075021
augcgccagcgccuccuccccuccgucaccucccuccuccucgucgcccuccucuuccccggcuccucccaggcccgccacgucaaccacuccgccaccgaggcccucggcgagcuccgcgagcgcgcccccggccagggcaccaacggcuuccagcuccuccgccacgccgucaagcgcgaccuccuccccccccgcaccccccccuaccagggcgacgucccccucggcauccgcaacaccaucugccgcaugcagcagggcaucugccgccucuucuucugccacuccggcaccggccagcagcaccgccagcgcugcggcuga

SEQ ID NO: 50010 - RNA, 312 nt, Artificial Sequence
  derived and/or modified sequence opt2 from SPAG11B__Homo_sapiens__NP_057596
augcgccagcgccuccuccccuccgucaccucccuccuccucgucgcccuccucuuccccggcuccucccaggcccgccacgucaaccacuccgccaccgaggcccucggcgagcuccgcgagcgcgcccccggccagggcaccaacggcuuccagcuccuccgccacgccgucaagcgcgaccuccuccccccccgcaccccccccuaccagguccacaucucccaccgcgaggcccgcggccccuccuuccgcaucugcgucgacuuccucggcccccgcugggcccgcggcugcuccaccggcaacuga

SEQ ID NO: 50011 - RNA, 552 nt, Artificial Sequence
  derived and/or modified sequence opt2 from SPAG16__Homo_sapiens__NP_001020607
auggccgcccagcgcggcaugcccuccuccgccguccgcguccucgaggaggcccucggcaugggccucaccgccgccggcgacgcccgcgacaccgccgacgccgucgccgccgagggcgccuacuaccucgagcaggucaccaucaccgaggccuccgaggacgacuacgaguacgaggagauccccgacgacaacuucuccauccccgagggcgaggaggaccucgccaaggccauccagauggcccaggagcaggccaccgacaccgagauccucgagcgcaagaccguccuccccuccaagcacgccguccccgaggucaucgaggacuuccucugcaacuuccucaucaagaugggcaugacccgcacccucgacugcuuccaguccgagugguacgagcucauccagaagggcgucaccgagcuccgcaccgucggcaacguccccgacgucuacacccagaucaugcuccucgagaacgagaacaagaaccucaagaaggaccucaagcacuacaagcaggccgccgaguacgucaucuucuga

SEQ ID NO: 50012 - RNA, 2781 nt, Artificial Sequence
  derived and/or modified sequence opt2 from SPAG1__Homo_sapiens__NP_757367
augaccaccaaggacuaccccucccucuggggcuucggcaccaccaagaccuucaagauccccaucgagcaccucgacuucaaguacaucgagaagugcuccgacgucaagcaccucgagaagauccucugcguccuccgcuccggcgaggagggcuacuaccccgagcucaccgaguucugcgagaagcaccuccaggcccucgcccccgagucccgcgcccuccgcaaggacaagcccgccgccaccgccgccuccuucaccgccgaggagugggagaagaucgacggcgacaucaaguccugggucuccgagaucaagaaggaggaggacaagaugcacuuccacgagaccgagaccuuccccgccaugaaggacaaccucccccccguccgcggcuccaacuccugccuccacgucggcaaggagaaguacuccaagcgccccaccaagaagaagaccccccgcgacuacgccgagugggacaaguucgacgucgagaaggagugccucaagaucgacgaggacuacaaggagaagaccgucaucgacaagucccaccucuccaagaucgagacccgcaucgacaccgccggccucaccgagaaggagaaggacuuccucgccacccgcgagaaggagaagggcaacgaggccuucaacuccggcgacuacgaggaggccgucauguacuacacccgcuccaucuccgcccuccccaccgucgucgccuacaacaaccgcgcccaggccgagaucaagcuccagaacuggaacuccgccuuccaggacugcgagaagguccucgagcucgagcccggcaacgucaaggcccuccuccgccgcgccaccaccuacaagcaccagaacaagcuccgcgaggccaccgaggaccucuccaagguccucgacgucgagcccgacaacgaccucgccaagaagacccucuccgaggucgagcgcgaccucaagaacuccgaggccgccuccgagacccagaccaagggcaagcgcauggucauccaggagaucgagaacuccgaggacgaggagggcaaguccggccgcaagcacgaggacggcggcggcgacaagaagcccgccgagcccgccggcgccgcccgcgccgcccagcccugcgucaugggcaacauccagaagaagcucaccggcaaggccgagggcggcaagcgccccgcccgcggcgccccccagcgcggccagacccccgaggccggcgccgacaagcgcuccccccgccgcgccuccgccgccgccgccgccggcggcggcgccaccggccaccccggcggcggccagggcgccgagaaccccgccggccucaagucccagggcaacgagcucuuccgcuccggccaguucgccgaggccgccggcaaguacuccgccgccaucgcccuccucgagcccgccggcuccgagaucgccgacgaccucuccauccucuacuccaaccgcgccgccugcuaccucaaggagggcaacugcuccggcugcauccaggacugcaaccgcgcccucgagcuccaccccuucuccaugaagccccuccuccgccgcgccauggccuacgagacccucgagcaguacggcaaggccuacgucgacuacaagaccguccuccagaucgacugcggccuccagcucgccaacgacuccgucaaccgccucucccgcauccucauggagcucgacggccccaacuggcgcgagaagcucucccccauccccgccguccccgccuccgucccccuccaggccuggcaccccgccaaggagaugaucuccaagcaggccggcgacuccuccucccaccgccagcagggcaucaccgacgagaagaccuucaaggcccucaaggaggagggcaaccagugcgucaacgacaagaacuacaaggacgcccucuccaaguacuccgagugccucaagaucaacaacaaggagugcgccaucuacaccaaccgcgcccucugcuaccucaagcucugccaguucgaggaggccaagcaggacugcgaccaggcccuccagcucgccgacggcaacgucaaggccuucuaccgccgcgcccucgcccacaagggccucaagaacuaccagaagucccucaucgaccucaacaaggucauccuccucgaccccuccaucaucgaggccaagauggagcucgaggaggucacccgccuccucaaccucaaggacaagaccgcccccuucaacaaggagaaggagcgccgcaagaucgagauccaggaggucaacgagggcaaggaggagcccggccgccccgccggcgaggucuccaugggcugccucgccuccgagaagggcggcaaguccucccgcucccccgaggaccccgagaagcuccccaucgccaagcccaacaacgccuacgaguucggccagaucaucaacgcccucuccacccgcaaggacaaggaggccugcgcccaccuccucgccaucaccgcccccaaggaccuccccauguuccucuccaacaagcucgagggcgacaccuuccuccuccucauccagucccucaagaacaaccucaucgagaaggaccccucccucgucuaccagcaccuccucuaccucuccaaggccgagcgcuucaagaugaugcucacccucaucuccaagggccagaaggagcucaucgagcagcucuucgaggaccucuccgacacccccaacaaccacuucacccucgaggacauccaggcccucaagcgccaguacgagcucuga

SEQ ID NO: 50013 - RNA, 1314 nt, Artificial Sequence
  derived and/or modified sequence opt2 from SPAG4__Homo_sapiens__NP_003107
augcgccgcuccucccgccccggcuccgccuccuccucccgcaagcacacccccaacuucuucuccgagaacuccuccauguccaucaccuccgaggacuccaagggccuccgcuccgccgagcccggccccggcgagcccgagggccgccgcgcccgcggccccuccugcggcgagcccgcccucuccgccggcguccccggcggcaccaccugggccggcuccucccagcagaagcccgccccccgcucccacaacuggcagaccgccugcggcgccgccaccguccgcggcggcgccuccgagcccaccggcucccccgucgucuccgaggagccccucgaccuccuccccacccucgaccuccgccaggagaugccccccccccgcgucuucaaguccuuccucucccuccucuuccagggccucuccguccuccucucccucgccggcgacguccucgucuccauguaccgcgaggucugcuccauccgcuuccucuucaccgccgucucccuccucucccucuuccucuccgccuucuggcucggccuccucuaccucgucuccccccucgagaacgagcccaaggagaugcucacccucuccgaguaccacgagcgcguccgcucccagggccagcagcuccagcagcuccaggccgagcucgacaagcuccacaaggaggucuccaccguccgcgccgccaacuccgagcgcgucgccaagcucgucuuccagcgccucaacgaggacuucguccgcaagcccgacuacgcccucuccuccgucggcgccuccaucgaccuccagaagaccucccacgacuacgccgaccgcaacaccgccuacuucuggaaccgcuucuccuucuggaacuacgcccgcccccccaccgucauccucgagccccacgucuuccccggcaacugcugggccuucgagggcgaccagggccaggucgucauccagcuccccggccgcguccagcucuccgacaucacccuccagcaccccccccccuccgucgagcacaccggcggcgccaacuccgccccccgcgacuucgccgucuucggccuccaggucuacgacgagaccgaggucucccucggcaaguucaccuucgacgucgagaaguccgagauccagaccuuccaccuccagaacgacccccccgccgccuuccccaaggucaagauccagauccucuccaacuggggccacccccgcuucaccugccucuaccgcguccgcgcccacggcguccgcaccuccgagggcgccgagggcuccgcccagggcccccacuga

SEQ ID NO: 50014 - RNA, 3582 nt, Artificial Sequence
  derived and/or modified sequence opt2 from SPAG5__Homo_sapiens__NP_006452
auguggcgcgucaagaagcucucccucucccucucccccuccccccagaccggcaagcccuccaugcgcaccccccuccgcgagcucacccuccagcccggcgcccucaccaacuccggcaagcgcucccccgccugcuccucccucacccccucccucugcaagcucggccuccaggagggcuccaacaacuccucccccgucgacuucgucaacaacaagcgcaccgaccucuccuccgagcacuucucccacuccuccaaguggcucgagaccugccagcacgaguccgacgagcagccccucgaccccaucccccagaucuccuccacccccaagaccuccgaggaggccgucgacccccucggcaacuacauggucaagaccaucguccucguccccuccccccucggccagcagcaggacaugaucuucgaggcccgccucgacaccauggccgagaccaacuccaucucccucaacggcccccuccgcaccgacgaccucguccgcgaggaggucgcccccugcaugggcgaccgcuucuccgaggucgccgccgucuccgagaagcccaucuuccaggagucccccucccaccuccucgaggaguccccccccaaccccugcuccgagcagcuccacugcuccaaggagucccucuccucccgcaccgaggccguccgcgaggaccucguccccuccgaguccaacgccuuccuccccuccuccguccucuggcucucccccuccaccgcccucgccgccgacuuccgcgucaaccacgucgaccccgaggaggagaucgucgagcacggcgccauggaggagcgcgagaugcgcuuccccacccaccccaaggaguccgagaccgaggaccaggcccucgucuccuccgucgaggacauccucuccaccugccucacccccaaccucgucgagauggagucccaggaggcccccggccccgccgucgaggacgucggccgcauccucggcuccgacaccgaguccuggauguccccccucgccuggcucgagaagggcgucaacaccuccgucaugcucgagaaccuccgccagucccucucccuccccuccaugcuccgcgacgccgccaucggcaccacccccuucuccaccugcuccgucggcaccugguucacccccuccgccccccaggagaaguccaccaacaccucccagaccggccucgucggcaccaagcacuccaccuccgagaccgagcagcuccucugcggccgcccccccgaccucaccgcccucucccgccacgaccucgaggacaaccuccucuccucccucgucauccucgagguccucucccgccagcuccgcgacuggaagucccagcucgccgucccccaccccgagacccaggacuccuccacccagaccgacaccucccacuccggcaucaccaacaagcuccagcaccucaaggagucccacgagaugggccaggcccuccagcaggcccgcaacgucaugcaguccuggguccucaucuccaaggagcucaucucccuccuccaccucucccuccuccaccucgaggaggacaagaccaccgucucccaggagucccgccgcgccgagacccucgucugcugcugcuucgaccuccucaagaagcuccgcgccaagcuccagucccucaaggccgagcgcgaggaggcccgccaccgcgaggagauggcccuccgcggcaaggacgccgccgagaucguccucgaggccuucugcgcccacgccucccagcgcaucucccagcucgagcaggaccucgccuccaugcgcgaguuccgcggccuccucaaggacgcccagacccagcucgucggccuccacgccaagcaggaggagcucguccagcagaccgucucccucaccuccacccuccagcaggacuggcgcuccaugcagcucgacuacaccaccuggaccgcccuccucucccgcucccgccagcucaccgagaagcucaccgucaagucccagcaggcccuccaggagcgcgacgucgccaucgaggagaagcaggaggucucccgcguccucgagcaggucuccgcccagcucgaggagugcaagggccagaccgagcagcucgagcucgagaacucccgccucgccaccgaccuccgcgcccagcuccagauccucgccaacauggacucccagcucaaggagcuccagucccagcacacccacugcgcccaggaccucgccaugaaggacgagcuccucugccagcucacccaguccaacgaggagcaggccgcccaguggcagaaggaggagauggcccucaagcacaugcaggccgagcuccagcagcagcaggccguccucgccaaggagguccgcgaccucaaggagacccucgaguucgccgaccaggagaaccaggucgcccaccucgagcucggccaggucgagugccagcucaagaccacccucgagguccuccgcgagcgcucccuccagugcgagaaccucaaggacaccgucgagaaccucaccgccaagcucgccuccaccaucgccgacaaccaggagcaggaccucgagaagacccgccaguacucccagaagcucggccuccucaccgagcagcuccagucccucacccucuuccuccagaccaagcucaaggagaagaccgagcaggagacccuccuccucuccaccgccugcccccccacccaggagcacccccuccccaacgaccgcaccuuccucggcuccauccucaccgccgucgccgacgaggagcccgaguccacccccgucccccuccucggcuccgacaaguccgccuucacccgcgucgccuccauggucucccuccagcccgccgagacccccggcauggaggagucccucgccgagauguccaucaugaccaccgagcuccagucccucugcucccuccuccaggaguccaaggaggaggccauccgcacccuccagcgcaagaucugcgagcuccaggcccgccuccaggcccaggaggagcagcaccaggagguccagaaggccaaggaggccgacaucgagaagcucaaccaggcccucugccuccgcuacaagaacgagaaggagcuccaggaggucauccagcagcagaacgagaagauccucgagcagaucgacaaguccggcgagcucaucucccuccgcgaggaggucacccaccucacccgcucccuccgccgcgccgagaccgagaccaagguccuccaggaggcccucgccggccagcucgacuccaacugccagcccauggccaccaacuggauccaggagaaggucuggcucucccaggaggucgacaagcuccgcgucauguuccucgagaugaagaacgagaaggagaagcucaugaucaaguuccagucccaccgcaacauccucgaggagaaccuccgccgcuccgacaaggagcucgagaagcucgacgacaucguccagcacaucuacaagacccuccucuccauccccgaggucguccgcggcugcaaggagcuccagggccuccucgaguuccucuccuga

SEQ ID NO: 50015 - RNA, 1455 nt, Artificial Sequence
  derived and/or modified sequence opt2 from SPAG6__Homo_sapiens__NP_001240783
augcacucccucaccauggaccucuggauccccaacggccaggccggcgucaugucccuccuccgcacccuccuccucgacgucguccccaccauccagcagaccgccgcccucgcccucggccgccucgccaacuacaacgacgaccucgccgaggccgucgucaagugcgacauccucccccagcucgucuacucccucgccgagcagaaccgcuucuacaagaaggccgccgccuucguccuccgcgccgucggcaagcacuccccccagcucgcccaggccaucgucgacugcggcgcccucgacacccucgucaucugccucgaggacuucgaccccggcgucaaggaggccgccgccugggcccuccgcuacaucgcccgccacaacgccgagcucucccaggccgucgucgacgccggcgccgucccccuccucguccucugcauccaggagcccgagaucgcccucaagcgcaucgccgccuccgcccucuccgacaucgccaagcacucccccgagcucgcccagaccgucgucgacgccggcgccgucgcccaccucgcccagaugauccucaaccccgacgccaagcucaagcaccagauccucuccgcccucucccaggucuccaagcacuccgucgaccucgccgagauggucgucgaggccgagaucuuccccgucguccucaccugccucaaggacaaggacgaguacgucaagaagaacgccuccacccucauccgcgagaucgccaagcacacccccgagcucucccagcucgucgucaacgccggcggcgucgccgccgucaucgacugcaucggcuccugcaagggcaacacccgccuccccggcaucaugaugcucggcuacgucgccgcccacuccgagaaccucgccauggccgucaucaucuccaagggcgucccccagcucuccgucugccucuccgaggagcccgaggaccacaucaaggccgccgccgccugggcccucggccagaucggccgccacacccccgagcacgcccgcgccgucgccgucaccaacacccuccccguccuccucucccucuacauguccaccgaguccuccgaggaccuccaggucaaguccaagaaggccaucaagaacauccuccagaagugcaccuaccuccccgcccucgagcccuuccucuacgacgccccccccaacauccucaagcacgucgucggccaguucuccaagguccucccccacgacuccaaggcccgccgccucuucgucaccuccggcggccucaagaagguccaggagaucaaggccgagcccggcucccuccuccaggaguacaucaacuccaucaacuccugcuaccccgaggagaucguccgcuacuacucccccggcuacuccgacacccuccuccagcgcgucgacuccuaccagccccucaacaacuga

SEQ ID NO: 50016 - RNA, 684 nt, Artificial Sequence
  derived and/or modified sequence opt2 from SPAG7__Homo_sapiens__NP_004881
auggccgaccuccucggcuccauccucuccuccauggagaagccccccucccucggcgaccaggagacccgccgcaaggcccgcgagcaggccgcccgccucaagaagcuccaggagcaggagaagcagcagaaggucgaguuccgcaagcgcauggagaaggaggucuccgacuucauccaggacuccggccagaucaagaagaaguuccagcccaugaacaagaucgagcgcuccauccuccacgacgucgucgaggucgccggccucaccuccuucuccuucggcgaggacgacgacugccgcuacgucaugaucuucaagaaggaguucgcccccuccgacgaggagcucgacuccuaccgccgcggcgaggagugggacccccagaaggccgaggagaagcgcaagcucaaggagcucgcccagcgccaggaggaggaggccgcccagcagggccccgucgucgucucccccgccuccgacuacaaggacaaguacucccaccucaucggcaagggcgccgccaaggacgccgcccacaugcuccaggccaacaagaccuacggcugcguccccgucgccaacaagcgcgacacccgcuccaucgaggaggccaugaacgagauccgcgccaagaagcgccuccgccaguccggcgaggagcucccccccaccuccuga

SEQ ID NO: 50017 - RNA, 1458 nt, Artificial Sequence
  derived and/or modified sequence opt2 from SPAG8__Homo_sapiens__NP_001034681
auggagaccaacgaguccaccgagggcucccgcucccgcucccgcucccucgacauccagcccuccuccgagggccucggccccaccuccgagcccuuccccuccuccgacgacuccccccgcuccgcccucgccgccgccaccgccgccgccgccgccgccgccuccgccgccgccgccaccgccgccuucaccaccgccaaggccgccgcccucuccaccaagacccccgcccccugcuccgaguucauggagcccuccuccgaccccucccuccucggcgagcccugcgccggccccggcuucacccacaacaucgcccacggcucccucggcuucgagcccgucuacgucuccugcaucgcccaggacaccugcaccaccaccgaccacuccuccaaccccggccccguccccggcuccuccuccggccccguccucggcuccuccuccggcgccggccacggcuccggcuccggcuccggccccggcugcggcuccguccccggcuccggcuccggccccggccccggcuccggccccggcuccggccccggccacggcuccggcucccaccccggccccgccuccggccccggccccgacaccggccccgacuccgagcucucccccugcaucccccccggcuuccgcaaccucgucgccgaccgcguccccaacuacaccuccuggucccagcacugccccugggagccccagaagcagccccccugggaguuccuccagguccucgagcccggcgcccgcggccucuggaagccccccgacaucaagggcaagcucauggucugcuacgagacccucccccgcggccagugccuccucuacaacugggaggaggagcgcgccaccaaccaccucgaccagguccccuccaugcaggacggcuccgaguccuucuucuuccgccacggccaccgcggccuccucaccaugcagcucaagucccccaugcccuccuccaccacccagaaggacuccuaccagccccccggcaacgucuacuggccccuccgcggcaagcgcgaggccaugcucgagaugcuccuccagcaccagaucugcaaggagguccaggccgagcaggagcccacccgcaagcucuucgaggucgaguccgucacccaccacgacuaccgcauggagcucgcccaggccggcacccccgcccccaccaagccccacgacuaccgccaggagcagcccgagaccuucuggauccagcgcgccccccagcuccccggcgucuccaacauccgcacccucgacacccccuuccgcaagaacugcuccuucuccacccccgucccccucucccucggcaagcuccuccccuacgagcccgagaacuaccccuaccagcucggcgagaucuccucccuccccugccccggcggccgccucggcggcggcggcggccgcaugacccccuucuga

SEQ ID NO: 50018 - RNA, 3936 nt, Artificial Sequence
  derived and/or modified sequence opt2 from SPAG9__Homo_sapiens__NP_001123999
auggagcucgaggacggcgucgucuaccaggaggagcccggcggcuccggcgccgucauguccgagcgcgucuccggccucgccggcuccaucuaccgcgaguucgagcgccucaucggccgcuacgacgaggaggucgucaaggagcucaugccccucgucgucgccguccucgagaaccucgacuccgucuucgcccaggaccaggagcaccaggucgagcucgagcuccuccgcgacgacaacgagcagcucaucacccaguacgagcgcgagaaggcccuccgcaagcacgccgaggagaaguucaucgaguucgaggacucccaggagcaggagaagaaggaccuccagacccgcgucgagucccucgagucccagacccgccagcucgagcucaaggccaagaacuacgccgaccagaucucccgccucgaggagcgcgaggccgagcucaagaaggaguacaacgcccuccaccagcgccacaccgagaugauccacaacuacauggagcaccucgagcgcaccaagcuccaccagcucuccggcuccgaccagcucgaguccaccgcccacucccgcauccgcaaggagcgccccaucucccucggcaucuucccccuccccgccggcgacggccuccucacccccgacgcccagaagggcggcgagacccccggcuccgagcaguggaaguuccaggagcucucccagccccgcucccacaccucccucaaggacgagcucuccgacgucucccagggcggcuccaaggccaccacccccgccuccaccgccaacuccgacgucgccaccauccccaccgacaccccccucaaggaggagaacgagggcuucgucaaggucaccgacgcccccaacaaguccgagaucuccaagcacaucgagguccaggucgcccaggagacccgcaacgucuccaccggcuccgccgagaacgaggagaaguccgagguccaggccaucaucgaguccacccccgagcucgacauggacaaggaccucuccggcuacaagggcuccuccacccccaccaagggcaucgagaacaaggccuucgaccgcaacaccgagucccucuucgaggagcucuccuccgccggcuccggccucaucggcgacgucgacgagggcgccgaccuccucggcaugggccgcgaggucgagaaccucauccucgagaacacccagcuccucgagaccaagaacgcccucaacaucgucaagaacgaccucaucgccaaggucgacgagcucaccugcgagaaggacguccuccagggcgagcucgaggccgucaagcaggccaagcucaagcucgaggagaagaaccgcgagcucgaggaggagcuccgcaaggcccgcgccgaggccgaggacgcccgccagaaggccaaggacgacgacgacuccgacauccccaccgcccagcgcaagcgcuucacccgcgucgagauggcccgcguccucauggagcgcaaccaguacaaggagcgccucauggagcuccaggaggccguccgcuggaccgagaugauccgcgccucccgcgagaaccccgccaugcaggagaagaagcgcuccuccaucuggcaguucguccccacccgcuucucccgccucuucuccuccuccuccaacaccaccaagaagcccgagccccccgucaaccucaaguacaacgcccccaccucccacgucacccccuccgucaagaagcgcuccuccacccucucccagcuccccggcgacaaguccaaggccuucgacuuccucuccgaggagaccgaggccucccucgccucccgccgcgagcagaagcgcgagcaguaccgccaggucaaggcccacguccagaaggaggacggccgcguccaggccuucggcuggucccucccccagaaguacaagcaggucaccaacggccagggcgagaacaagaugaagaaccuccccguccccgucuaccuccgcccccucgacgagaaggacaccuccaugaagcucuggugcgccgucggcgucaaccucuccggcggcaagacccgcgacggcggcuccgucgucggcgccuccgucuucuacaaggacgucgccggccucgacaccgagggcuccaagcagcgcuccgccucccaguccucccucgacaagcucgaccaggagcucaaggagcagcagaaggagcucaagaaccaggaggagcucuccucccucgucuggaucugcaccuccacccacuccgccaccaagguccucaucaucgacgccguccagcccggcaacauccucgacuccuucaccgucugcaacucccacguccucugcaucgccuccguccccggcgcccgcgagaccgacuaccccgccggcgaggaccucuccgaguccggccaggucgacaaggccucccucugcggcuccaugaccuccaacuccuccgccgagaccgacucccuccucggcggcaucaccgucgucggcugcuccgccgagggcgucaccggcgccgccaccucccccuccaccaacggcgccucccccgucauggacaagccccccgagauggaggccgagaacuccgaggucgacgagaacguccccaccgccgaggaggccaccgaggccaccgagggcaacgccggcuccgccgaggacaccgucgacaucucccagaccggcgucuacaccgagcacgucuucaccgacccccucggcguccagauccccgaggaccucucccccgucuaccaguccuccaacgacuccgacgccuacaaggaccagaucuccguccuccccaacgagcaggaccucguccgcgaggaggcccagaagauguccucccuccuccccaccauguggcucggcgcccagaacggcugccucuacguccacuccuccgucgcccaguggcgcaagugccuccacuccaucaagcucaaggacuccauccucuccaucguccacgucaagggcaucguccucgucgcccucgccgacggcacccucgccaucuuccaccgcggcgucgacggccagugggaccucuccaacuaccaccuccucgaccucggccgcccccaccacuccauccgcugcaugaccgucguccacgacaaggucuggugcggcuaccgcaacaagaucuacgucguccagcccaaggccaugaagaucgagaaguccuucgacgcccacccccgcaaggagucccagguccgccagcucgccugggucggcgacggcgucugggucuccauccgccucgacuccacccuccgccucuaccacgcccacaccuaccagcaccuccaggacgucgacaucgagcccuacgucuccaagaugcucggcaccggcaagcucggcuucuccuucguccgcaucaccgcccucauggucuccugcaaccgccucugggucggcaccggcaacggcgucaucaucuccaucccccucaccgagaccaacaagaccuccggcguccccggcaaccgccccggcuccgucauccgcgucuacggcgacgagaacuccgacaaggucacccccggcaccuucauccccuacugcuccauggcccacgcccagcucugcuuccacggccaccgcgacgccgucaaguucuucgucgccguccccggccaggucaucuccccccaguccuccuccuccggcaccgaccucaccggcgacaaggccggccccuccgcccaggagcccggcucccagaccccccucaaguccaugcucgucaucuccggcggcgagggcuacaucgacuuccgcaugggcgacgagggcggcgaguccgagcuccucggcgaggaccucccccucgagcccuccgucaccaaggccgagcgcucccaccucaucgucuggcaggucauguacggcaacgaguga

SEQ ID NO: 50019 - RNA, 1536 nt, Artificial Sequence
  derived and/or modified sequence opt2 from SPAM1__Homo_sapiens__XP_011514825
augggcguccucaaguucaagcacaucuucuuccgcuccuucgucaaguccuccggcgucucccagaucgucuucaccuuccuccucauccccugcugccucacccucaacuuccgcgccccccccgucauccccaacguccccuuccucugggccuggaacgcccccuccgaguucugccucggcaaguucgacgagccccucgacaugucccucuucuccuucaucggcuccccccgcaucaacgccaccggccagggcgucaccaucuucuacgucgaccgccucggcuacuaccccuacaucgacuccaucaccggcgucaccgucaacggcggcaucccccagaagaucucccuccaggaccaccucgacaaggccaagaaggacaucaccuucuacaugcccgucgacaaccucggcauggccgucaucgacugggaggaguggcgccccaccugggcccgcaacuggaagcccaaggacgucuacaagaaccgcuccaucgagcucguccagcagcagaacguccagcucucccucaccgaggccaccgagaaggccaagcaggaguucgagaaggccggcaaggacuuccucgucgagaccaucaagcucggcaagcuccuccgccccaaccaccucuggggcuacuaccucuuccccgacugcuacaaccaccacuacaagaagcccggcuacaacggcuccugcuucaacgucgagaucaagcgcaacgacgaccucuccuggcucuggaacgaguccaccgcccucuaccccuccaucuaccucaacacccagcagucccccgucgccgccacccucuacguccgcaaccgcguccgcgaggccauccgcgucuccaagauccccgacgccaaguccccccuccccgucuucgccuacacccgcaucgucuucaccgaccagguccucaaguuccucucccaggacgagcucgucuacaccuucggcgagaccgucgcccucggcgccuccggcaucgucaucuggggcacccucuccaucaugcgcuccaugaaguccugccuccuccucgacaacuacauggagaccauccucaaccccuacaucaucaacgucacccucgccgccaagaugugcucccagguccucugccaggagcagggcgucugcauccgcaagaacuggaacuccuccgacuaccuccaccucaaccccgacaacuucgccauccagcucgagaagggcggcaaguucaccguccgcggcaagcccacccucgaggaccucgagcaguucuccgagaaguucuacugcuccugcuacuccacccucuccugcaaggagaaggccgacgucaaggacaccgacgccgucgacgucugcaucgccgacggcgucugcaucgacgccuuccucaagccccccauggagaccgaggagccccagaucuucuacaacgccucccccuccacccucuccgccaccauguucaucuggcgccucgaggucugggaccagggcaucucccgcaucggcuucuucuga

SEQ ID NO: 50020 - RNA, 294 nt, Artificial Sequence
  derived and/or modified sequence opt2 from SPANXA2__Homo_sapiens__NP_663695
auggacaagcaguccuccgccggcggcgucaagcgcuccguccccugcgacuccaacgaggccaacgagaugaugcccgagacccccaccggcgacuccgacccccagcccgcccccaagaagaugaagaccuccgaguccuccaccauccucgucguccgcuaccgccgcaacuucaagcgcaccucccccgaggagcuccucaacgaccacgcccgcgagaaccgcaucaacccccuccagauggaggaggaggaguucauggagaucauggucgagauccccgccaaguga

SEQ ID NO: 50021 - RNA, 312 nt, Artificial Sequence
  derived and/or modified sequence opt2 from SPANXB1__Homo_sapiens__NP_115850
augggccagcaguccuccguccgccgccucaagcgcuccguccccugcgaguccaacgaggccaacgaggccaacgaggccaacaagaccaugcccgagacccccaccggcgacuccgacccccagcccgcccccaagaagaugaagaccuccgaguccuccaccauccucgucguccgcuaccgccgcaacgucaagcgcaccucccccgaggagcuccucaacgaccacgcccgcgagaaccgcaucaaccccgaccagauggaggaggaggaguucaucgagaucaccaccgagcgccccaagaaguga

SEQ ID NO: 50022 - RNA, 294 nt, Artificial Sequence
  derived and/or modified sequence opt2 from SPANXD__Homo_sapiens__NP_115793
auggacaagcaguccuccgccggcggcgucaagcgcuccguccccugcgacuccaacgaggccaacgagaugaugcccgagaccuccuccggcuacuccgacccccagcccgcccccaagaagcucaagaccuccgaguccuccaccauccucgucguccgcuaccgccgcaacuucaagcgcaccucccccgaggagcucgucaacgaccacgcccgcaagaaccgcaucaacccccuccagauggaggaggaggaguucauggagaucauggucgagauccccgccaaguga

SEQ ID NO: 50023 - RNA, 300 nt, Artificial Sequence
  derived and/or modified sequence opt2 from SPANXN4__Homo_sapiens__NP_001009613
auggaggagcccaccuccuccaccaacgagaacaagaugaagucccccugcgaguccaacaagcgcaaggucgacaagaagaagaagaaccuccaccgcgccuccgcccccgagcagucccucaaggagaccgagaaggccaaguaccccacccucgucuucuacugccgcaagaacaagaagcgcaacuccaaccagcucgagaacaaccagcccaccgaguccuccaccgaccccaucaaggagaagggcgaccucgacaucuccgccggcuccccccaggacggcggccagaacuga

SEQ ID NO: 50024 - RNA, 912 nt, Artificial Sequence
  derived and/or modified sequence opt2 from SPARC__Homo_sapiens__NP_003109
augcgcgccuggaucuucuuccuccucugccucgccggccgcgcccucgccgccccccagcaggaggcccuccccgacgagaccgaggucgucgaggagaccgucgccgaggucaccgaggucuccgucggcgccaaccccguccaggucgaggucggcgaguucgacgacggcgccgaggagaccgaggaggaggucgucgccgagaaccccugccagaaccaccacugcaagcacggcaaggucugcgagcucgacgagaacaacacccccaugugcgucugccaggaccccaccuccugccccgcccccaucggcgaguucgagaaggucugcuccaacgacaacaagaccuucgacuccuccugccacuucuucgccaccaagugcacccucgagggcaccaagaagggccacaagcuccaccucgacuacaucggccccugcaaguacaucccccccugccucgacuccgagcucaccgaguucccccuccgcaugcgcgacuggcucaagaacguccucgucacccucuacgagcgcgacgaggacaacaaccuccucaccgagaagcagaagcuccgcgucaagaagauccacgagaacgagaagcgccucgaggccggcgaccaccccgucgagcuccucgcccgcgacuucgagaagaacuacaacauguacaucuuccccguccacuggcaguucggccagcucgaccagcaccccaucgacggcuaccucucccacaccgagcucgccccccuccgcgccccccucauccccauggagcacugcaccacccgcuucuucgagaccugcgaccucgacaacgacaaguacaucgcccucgacgagugggccggcugcuucggcaucaagcagaaggacaucgacaaggaccucgucaucuga

SEQ ID NO: 50025 - RNA, 1995 nt, Artificial Sequence
  derived and/or modified sequence opt2 from SPARCL1__Homo_sapiens__NP_001121782
augaagaccggccucuucuuccucugccuccucggcaccgccgccgccauccccaccaacgcccgccuccucuccgaccacuccaagcccaccgccgagaccgucgcccccgacaacaccgccauccccucccuccgcgccgaggccgaggagaacgagaaggagaccgccgucuccaccgaggacgacucccaccacaaggccgagaaguccuccguccucaaguccaaggaggagucccacgagcaguccgccgagcagggcaaguccuccucccaggagcucggccucaaggaccaggaggacuccgacggccaccucuccgucaaccucgaguacgcccccaccgagggcacccucgacaucaaggaggacauguccgagccccaggagaagaagcucuccgagaacaccgacuuccucgcccccggcgucuccuccuucaccgacuccaaccagcaggaguccaucaccaagcgcgaggagaaccaggagcagccccgcaacuacucccaccaccagcucaaccgcuccuccaagcacucccagggccuccgcgaccagggcaaccaggagcaggaccccaacaucuccaacggcgaggaggaggaggagaaggagcccggcgaggucggcacccacaacgacaaccaggagcgcaagaccgagcucccccgcgagcacgccaacuccaagcaggaggaggacaacacccaguccgacgacauccucgaggaguccgaccagcccacccaggucuccaagaugcaggaggacgaguucgaccagggcaaccaggagcaggaggacaacuccaacgccgagauggaggaggagaacgccuccaacgucaacaagcacauccaggagaccgaguggcagucccaggagggcaagaccggccucgaggccaucuccaaccacaaggagaccgaggagaagaccgucuccgaggcccuccucauggagcccaccgacgacggcaacaccaccccccgcaaccacggcgucgacgacgacggcgacgacgacggcgacgacggcggcaccgacggcccccgccacuccgccuccgacgacuacuucauccccucccaggccuuccucgaggccgagcgcgcccaguccaucgccuaccaccucaagaucgaggagcagcgcgagaagguccacgagaacgagaacaucggcaccaccgagcccggcgagcaccaggaggccaagaaggccgagaacuccuccaacgaggaggagaccuccuccgagggcaacaugcgcguccacgccgucgacuccugcauguccuuccagugcaagcgcggccacaucugcaaggccgaccagcagggcaagccccacugcgucugccaggaccccgucaccugcccccccaccaagccccucgaccaggucugcggcaccgacaaccagaccuacgccuccuccugccaccucuucgccaccaagugccgccucgagggcaccaagaagggccaccagcuccagcucgacuacuucggcgccugcaaguccauccccaccugcaccgacuucgaggucauccaguucccccuccgcaugcgcgacuggcucaagaacauccucaugcagcucuacgaggccaacuccgagcacgccggcuaccucaacgagaagcagcgcaacaaggucaagaagaucuaccucgacgagaagcgccuccucgccggcgaccaccccaucgaccuccuccuccgcgacuucaagaagaacuaccacauguacgucuaccccguccacuggcaguucuccgagcucgaccagcaccccauggaccgcguccucacccacuccgagcucgccccccuccgcgccucccucguccccauggagcacugcaucacccgcuucuucgaggagugcgaccccaacaaggacaagcacaucacccucaaggaguggggccacugcuucggcaucaaggaggaggacaucgacgagaaccuccucuucuga

SEQ ID NO: 50026 - RNA, 1851 nt, Artificial Sequence
  derived and/or modified sequence opt2 from SPAST__Homo_sapiens__NP_055761
augaacucccccggcggccgcggcaagaagaagggcuccggcggcgccuccaaccccguccccccccgcccccccccccccugccucgcccccgccccccccgccgccggccccgcccccccccccgaguccccccacaagcgcaaccucuacuacuucuccuacccccucuucgucggcuucgcccuccuccgccucgucgccuuccaccucggccuccucuucgucuggcucugccagcgcuucucccgcgcccucauggccgccaagcgcuccuccggcgccgcccccgcccccgccuccgccuccgcccccgcccccguccccggcggcgaggccgagcgcguccgcgucuuccacaagcaggccuucgaguacaucuccaucgcccuccgcaucgacgaggacgagaaggccggccagaaggagcaggccgucgagugguacaagaagggcaucgaggagcucgagaagggcaucgccgucaucgucaccggccagggcgagcagugcgagcgcgcccgccgccuccaggccaagaugaugaccaaccucgucauggccaaggaccgccuccagcuccucgagaagaugcagcccguccuccccuucuccaagucccagaccgacgucuacaacgacuccaccaaccucgccugccgcaacggccaccuccaguccgaguccggcgccguccccaagcgcaaggacccccucacccacaccuccaacucccucccccgcuccaagaccgucaugaagaccggcuccgccggccucuccggccaccaccgcgcccccuccuacuccggccucuccauggucuccggcgucaagcagggcuccggccccgcccccaccacccacaagggcacccccaagaccaaccgcaccaacaagcccuccacccccaccaccgccacccgcaagaagaaggaccucaagaacuuccgcaacgucgacuccaaccucgccaaccucaucaugaacgagaucgucgacaacggcaccgccgucaaguucgacgacaucgccggccaggaccucgccaagcaggcccuccaggagaucgucauccuccccucccuccgccccgagcucuucaccggccuccgcgcccccgcccgcggccuccuccucuucggcccccccggcaacggcaagaccaugcucgccaaggccgucgccgccgaguccaacgccaccuucuucaacaucuccgccgccucccucaccuccaaguacgucggcgagggcgagaagcucguccgcgcccucuucgccgucgcccgcgagcuccagcccuccaucaucuucaucgacgaggucgacucccuccucugcgagcgccgcgagggcgagcacgacgccucccgccgccucaagaccgaguuccucaucgaguucgacggcguccaguccgccggcgacgaccgcguccucgucaugggcgccaccaaccgcccccaggagcucgacgaggccguccuccgccgcuucaucaagcgcgucuacgucucccuccccaacgaggagacccgccuccuccuccucaagaaccuccucugcaagcagggcuccccccucacccagaaggagcucgcccagcucgcccgcaugaccgacggcuacuccggcuccgaccucaccgcccucgccaaggacgccgcccucggccccauccgcgagcucaagcccgagcaggucaagaacauguccgccuccgagaugcgcaacauccgccucuccgacuucaccgagucccucaagaagaucaagcgcuccgucuccccccagacccucgaggccuacauccgcuggaacaaggacuucggcgacaccaccgucuga

SEQ ID NO: 50027 - RNA, 3834 nt, Artificial Sequence
  derived and/or modified sequence opt2 from SPATA13__Homo_sapiens__NP_001159743
augacccaggccgccguccgccccugggcccccugccucgagaacaugaccaccgcccccaacggccucggccccggccccgccgcccccugcgccggcuccgaccucaaggacgccaagauggucaccucccucgccugcggcaacggcgucugcggcugcucccccggcggcgacaccgacacccaggaggccaagcucucccccgccaagcucguccgccucuucuccaccucccgcaagcgcaccggcgcccaccccgagcgcccccacuccaugguccucgucggcaacuccuccaccuggaacacccucgccuccuuccgcaagaugggcuccuucaagaagcucaaguccuccguccucaagggcauccagucccgcgagggcuccaacgccugcuccaagggcgaggccuccgagcacggccucggcaaguccauccccaacggcgccguccccggcgcccaggccucccgcggcuccccccucgcccccggccccgccugcggcgcccuccgccccgccgaguggggcacccucgacggcuccgaccucgaggacaccgacgacgccuuccagcgcuccacccaccgcucccgcucccuccgccgcgccuacggccucggccgcaucugccuccucgacgccccccagaaccacgccacccccaccaucgccaccggccagguccccgccgucugcgagauccucguccgcgaccccgagaacaacuccaugggcuaccgccgcuccaaguccaccgacaaccucgccuuccucaagaaguccuccuucaagcgcaaguccaccuccaaccucgccgaccuccgcaccgcccacgacgcccgcgucccccagcgcacccucuccuccuccuccaccgacucccagaagcucggcuccggccgcaccaagcgcuggcgcucccccauccgcgccaaggacuucgaccgcgucuucaagcucgucuccaacgucaccgaggccgccuggcgccgcgaguccccccgcuccggcgcccccucccccggcgaggccucccuccgccuccaggcccacucccgccuccacgacgacuacucccgccgcgucucccgcuccaccgagcaggacucccgccgcggcggcgccgucaugcacggcaccaccgccaccugcaccgucgcccccggcuucggcuccgccaccuccaagggcccccaccucgacgccgacaccgccgucuucccccucgagaccaaguccuccugggccgucgaguccgacuccuccugcaccugcuccucccuccccucccccaucguccaggacguccucuccaaggacuccugcgaccccaacgccggcucccagcucaccuucgaccccgagcagccccccaccccccuccgccccaccacccccaagccccaguccccccaguccccccagucccccggcgccggcuccgccuccugccacuccaaccacuccgcccucuccgccaacuccgaggaguccgagggccgcgccgaggagcccgcccagcgcgagcccggccccgucucccuccaggacccccucgaggccacccacggcgacgagggcuccaaggaccuccucgucaacaucggcgucgccgccggccccgaggagaaggagaaggaggaggucguccccgacggccccuggcgccgcuccuccucccaggacgaggagcgcaccgaggcccagcgcacccccaagcgccgcuggggcuccggccgccgcccccgcccccgccccuucuccgacuacggccagcucgccucccgcucccucuccauccccgaggacuccgucgccgccgacccccagaaggaggaccgcgucgacgaggacccccaggccuccaugaccuccgccucccccgaggaccagaacgcccccgucggcugccccaagggcgcccgccgccgccgccccaucuccgucaucggcggcgucucccucuacggcaccaaccagaccgaggagcucgacaaccuccucacccagcccgccucccgcccccccaugcccgcccaccaggucccccccuacaaggccgucuccgcccgcuuccgccccuucaccuucucccaguccacccccaucggccucgaccgcgucggccgccgccgccagaugcgcgccuccaacgucuccuccgacggcggcaccgagcccuccgcccucgucgacgacaacggcuccgaggaggacuucuccuacgaggaccucugccaggccuccccccgcuaccuccagcccggcggcgagcagcucgccaucaacgagcucaucuccgacggcaacgucgucugcgccgaggcccucugggaccacgucaccauggacgaccaggagcucggcuucaaggccggcgacgucauccagguccucgaggccuccaacaaggacuggugguggggccgcuccgaggacaaggaggccugguuccccgccuccuucguccgccuccgcgucaaccaggaggagcucuccgagaacuccuccuccacccccuccgaggagcaggacgaggaggccucccagucccgccaccgccacugcgagaacaagcagcagaugcgcaccaacgucauccgcgagaucauggacaccgagcgcgucuacaucaagcaccuccgcgacaucugcgagggcuacauccgccagugccgcaagcacaccggcauguucaccgucgcccagcucgccaccaucuucggcaacaucgaggacaucuacaaguuccagcgcaaguuccucaaggaccucgagaagcaguacaacaaggaggagccccaccucuccgagaucggcuccugcuuccuccagaaccaggagggcuucgccaucuacuccgaguacugcaacaaccaccccggcgccugccucgagcucgccaaccucaugaagcagggcaaguaccgccacuucuucgaggccugccgccuccuccagcagaugaucgacaucgccaucgacggcuuccuccucacccccguccagaagaucugcaaguacccccuccagcucgccgagcuccucaaguacaccacccaggagcacggcgacuacuccaacaucaaggccgccuacgaggccaugaagaacgucgccugccucaucaacgagcgcaagcgcaagcucgaguccaucgacaagaucgcccgcuggcaggucuccaucgucggcugggagggccucgacauccucgaccgcuccuccgagcucauccacuccggcgagcucaccaagaucaccaagcagggcaagucccagcagcgcaccuucuuccucuucgaccaccagcucgucuccugcaagaaggaccuccuccgccgcgacaugcucuacuacaagggccgccucgacauggacgagauggagcucgucgaccucggcgacggccgcgacaaggacugcaaccucuccgucaagaacgccuucaagcucgucucccgcaccaccgacgaggucuaccucuucugcgccaagaagcaggaggacaaggcccgcuggcuccaggccugcgccgacgagcgccgccgcguccaggaggacaaggagaugggcauggagaucuccgagaaccagaagaagcucgccaugcucaacgcccagaaggccggccacggcaaguccaagggcuacaaccgcugccccgucgcccccccccaccagggccuccaccccauccaccagcgccacaucaccaugcccaccuccgucccccagcagcaggucuucggccucgccgagcccaagcgcaaguccucccucuucuggcacaccuucaaccgccucacccccuuccgcaaguga

SEQ ID NO: 50028 - RNA, 1710 nt, Artificial Sequence
  derived and/or modified sequence opt2 from SPATA16__Homo_sapiens__NP_114161
auggacgccggcuccucccgcucccucgagaacgccgucaaccgcaucuaccacgaccagcucguccccaagaucaacaccuccaagaagauguccacccucgcccacccccccaacauccucgagaugucccaggagaucaagaagaacugcggcggcaagcaggucgagaucacccucgagcgcaccaagaugaccaagggcaucaaggagaagcaguccaacgaccucgagaaggccgccuucaagcgcaaggccgagggcgaggagaagcccacccgcaagaagcaggccaagaucaccgagcucgacaaccagcucaucaccaugccccucccccacaucccccucaagaacaucauggacgucgagaugaagcucgucuacaucgacgagaugggcguccgcuacgaguucgucgaguccuucauguccaccggcucccagcccaccugccaggccgccgagaucgucgacccccucuccguccacaacuucuccuuccucccccagaucgacaaguggcuccaggucgcccucaaggacgccuccuccugcuaccgccagaagaaguacgcccucgccgccggccaguuccgcaccgcccucgagcucugcuccaagggcgccguccucggcgagcccuucgacgcccccgccgaggacaucgccuccgucgccuccuucaucgagaccaagcucgucaccugcuaccuccgcaugcgcaagcccgaccucgcccucaaccacgcccaccgcuccaucguccucaaccccgccuacuuccgcaaccaccuccgccaggccaccgucuuccgcugccucgagcgcuacuccgaggccgcccgcuccgccaugaucgccgacuacauguucuggcucggcggcggccgcgaggaguccaucuccaagcucaucaagcucuacuggcaggccaugaucgaggaggccaucacccgcgccgaguccuucuccgucauguacacccccuucgccaccaagauccgcgccgacaagaucgagaaggucaaggacgccuucaccaagacccaccccgccuacgccgaguacauguacaccgaccuccaggcccuccacaugcucccccagaccgucgacugguccuccuuccccccccagcaguaccuccucacccucggcuucaagaacaaggacgacggcaaguuccucgagaagaucuccucccgcaagcuccccaucuucaccgagcacaagacccccuucggccucacccgcgaggacaccguccgccagauggagaccaugggcaagcgcauccuccccauccucgacuucauccgcuccacccagcucaacggcuccuuccccgccuccuccggcgucauggagaagcuccaguacgccucccuccucucccagcuccagcgcgucaaggagcagucccaggucaucaaccaggccauggccgagcucgccaccauccccuaccuccaggacaucucccagcaggaggccgagcuccuccagucccucauggccgacgccauggacacccucgagggccgccgcaacaacaacgagcgcgucuggaacaugauccagaaggucggccagaucgaggacuuccucuaccagcucgaggacuccuuccucaagaccaagaagcuccgcaccgcccgccgccagaagaccaagaugaagcgccuccagaccguccagcagcgcuga

SEQ ID NO: 50029 - RNA, 1086 nt, Artificial Sequence
  derived and/or modified sequence opt2 from SPATA17__Homo_sapiens__XP_005273109
auggccacccucgcccgccuccaggcccgcuccuccaccgucggcaaccaguacuacuuccgcaacuccgucgucgaccccuuccgcaagaaggagaacgacgccgccgucaagauccaguccugguuccgcggcugccagguccgcgccuacauccgccaccucaaccgcaucgucaccaucauccagaagugguggcgcuccuuccucggccgcaagcaguaccagcucaccguccaggucgccuacuacaccaugaugaugaaccucuacaacgccauggccguccgcauccagcgccgcuggcgcggcuaccgcguccgcaaguaccucuucaacuacuacuaccucaaggaguaccucaaggucgucuccgagaccaacgacgccauccgcaaggcccucgaggaguucgccgagaugaaggagcgcgaggagaagaaggccaaccucgagcgcgaggagaagaagcgcgacuaccaggcccgcaagaugcacuaccuccucuccaccaagcagauccccggcaucuacaacucccccuuccgcaaggagcccgaccccugggagcuccagcuccagaaggccaagccccucacccaccgccgccccaaggucaagcagaaggacuccaccucccucaccgacuggcucgccugcaccuccgcccgcuccuucccccgcuccgagauccucccccccaucaaccgcaagcagugccagggccccuuccgcgacaucaccgagguccucgagcagcgcuaccgcccccucgagcccacccuccgcgucgccgagcccaucgacgagcucaagcucgcccgcgaggagcuccgccgcgaggaguggcuccagaacgucaacgacaacauguuccuccccuucuccuccuaccacaagaacgagaaguacauccccuccaugcaccucuccuccaaguacggccccaucuccuacaaggagcaguuccgcuccgagaaccccaagaaguggaucugcgacaaggacuuccagaccguccuccccuccuucgagcucuucuccaaguacggcaagcucuacuccaaggccggccagaucgucuga

SEQ ID NO: 50030 - RNA, 1617 nt, Artificial Sequence
  derived and/or modified sequence opt2 from SPATA18__Homo_sapiens__NP_660306
auggccgagaaccucaagcgccucgucuccaacgagacccuccgcacccuccaggagaagcucgacuucuggcucaaggaguacaacaccaacaccugcgaccagaaccucaaccacugccucgagcucaucgagcaggucgccaagguccagggccagcucuucggcauccucaccgccgccgcccaggagggcggccgcaacgacggcgucgagaccaucaagucccgccuccuccccuggcucgaggccuccuucaccgccgccucccucggcaaguccgucgacuccaagguccccucccuccaggacaccuucgaccgcgagcgccacaaggaccccuccccccgcgaccgcgacaugcagcagcucgacuccaaccucaacuccacccgcucccagugcaaccagguccaggacgaccucgucgagaccgagaagaaccucgaggaguccaagaaccgcuccgccaucucccuccucgccgccgaggaggagaucaaccagcucaagaagcagcucaagucccuccaggcccaggaggacgcccgccaccgcaacaccgaccagcgcuccuccgagaaccgccgcuccgagcccuggucccucgaggagcgcaagcgcgagcaguggaacucccucaagcagaacgccgaccagcaggacaccgaggccauguccgacuacaagaagcagcuccgcaaccucaaggaggagaucgccguccucuccgccgagaaguccgcccuccagggccgcuccucccgcucccgcucccccucccccgccccccgcucccgcuccugcucccgcucccgcuccgccucccccuccaccgccgucaagguccgccgccccucccccaaccgcuccaagcucuccaacgucgcccgcaaggccgcccuccucucccgcuucuccgacuccuacucccaggcccgccucgacgcccagugccuccuccgccgcugcaucgacaaggccgagaccguccagcgcaucaucuacaucgccaccgucgaggccuuccacgucgccaagauggccuuccgccacuucaagauccacguccgcaagucccucacccccuccuacgucggcuccaacgacuucgagaacgccguccucgacuacgucaucugccaccucgaccucuacgacucccaguccuccgucaacgacgucauccgcgccaugaacgucaaccccaagaucuccuucccccccgucgucgacuucugccuccucuccgacuucauccaggagaucugcugcaucgccuucgccaugcaggcccucgagcccccccucgacaucgccuacggcgccgacggcgaggucuucaacgacugcaaguaccgccgcuccuacgacuccgacuucaccgccccccucguccucuaccacgucuggcccgcccucauggagaacgacugcgucaucaugaagggcgaggccgucacccgccgcggcgccuucuggaacuccguccgcuccgucucccgcugccgcucccgcucccucucccccaucugcccccgcucccagaucggccucaacaccaugucccgcucccgcucccccucccccauccgcugcggccucccccgcuucuga

SEQ ID NO: 50031 - RNA, 504 nt, Artificial Sequence
  derived and/or modified sequence opt2 from SPATA19__Homo_sapiens__NP_001278921
augaucaucaccaccuggaucgucuacauccucgcccgcaagggcgucggccuccccuuccuccccaucaccuccuccgacaucgacgucgucgaguccgaggccgucuccguccuccaccacuggcucaagaagaccgaggaggaggccucccgcggcaucaaggagaagcucuccaucaaccaccccucccagggcguccgcgagaagauguccaccgacuccccccccacccacggccaggacauccacgucacccgcgacgucgucaagcaccaccucuccaaguccgaccuccucgccaaccagucccaggagguccucgaggagcgcacccgcauccaguucauccgcuggucccacacccgcaucuuccagguccccuccgagaugaccgaggacaucaugcgcgaccgcaucgagcagguccgccgcuccaucucccgccucaccgacgucuccgcccaggacuucuccaugcgccccuccuccuccgacugcuga

SEQ ID NO: 50032 - RNA, 2361 nt, Artificial Sequence
  derived and/or modified sequence opt2 from SPATA20__Homo_sapiens__NP_001245301
augcucggcgcccgcgccuggcucggccgcguccuccuccucccccgcgccggcgccggccucgccgccucccgccgcggcuccuccucccgcgacaaggaccgcuccgccaccgucuccuccuccguccccaugcccgccggcggcaagggcucccaccccuccuccaccccccagcgcguccccaaccgccucauccacgagaagucccccuaccuccuccagcacgccuacaaccccgucgacugguaccccuggggccaggaggccuucgacaaggcccgcaaggagaacaagcccaucuuccucuccgucggcuacuccaccugccacuggugccacaugauggaggaggaguccuuccagaacgaggagaucggccgccuccucuccgaggacuucgucuccgucaaggucgaccgcgaggagcgccccgacgucgacaaggucuacaugaccuucguccaggccaccuccuccggcggcggcuggcccaugaacgucuggcucacccccaaccuccagcccuucgucggcggcaccuacuucccccccgaggacggccucacccgcgucggcuuccgcaccguccuccuccgcauccgcgagcaguggaagcagaacaagaacacccuccucgagaacucccagcgcgucaccaccgcccuccucgcccgcuccgagaucuccgucggcgaccgccagcucccccccuccgccgccaccgucaacaaccgcugcuuccagcagcucgacgagggcuacgacgaggaguacggcggcuucgccgaggcccccaaguuccccacccccgucauccucuccuuccucuucuccuacuggcucucccaccgccucacccaggacggcucccgcgcccagcagauggcccuccacacccucaagaugauggccaacggcggcauccgcgaccacgucggccagggcuuccaccgcuacuccaccgaccgccaguggcacgucccccacuucgagaagaugcucuacgaccaggcccagcucgccgucgccuacucccaggccuuccagcucuccggcgacgaguucuacuccgacgucgccaagggcauccuccaguacgucgcccgcucccucucccaccgcuccggcggcuucuacuccgccgaggacgccgacuccccccccgagcgcggccagcgccccaaggagggcgccuacuacgucuggaccgucaaggagguccagcagcuccuccccgagcccguccucggcgccaccgagccccucaccuccggccagcuccucaugaagcacuacggccucaccgaggccggcaacaucucccccucccaggaccccaagggcgagcuccagggccagaacguccucaccguccgcuacucccucgagcucaccgccgcccgcuucggccucgacgucgaggccguccgcacccuccucaacuccggccucgagaagcucuuccaggcccgcaagcaccgccccaagccccaccucgacuccaagaugcucgccgccuggaacggccucauggucuccggcuacgccgucaccggcgccguccucggccaggaccgccucaucaacuacgccaccaacggcgccaaguuccucaagcgccacauguucgacgucgccuccggccgccucaugcgcaccugcuacaccggccccggcggcaccgucgagcacuccaacccccccugcuggggcuuccucgaggacuacgccuucgucguccgcggccuccucgaccucuacgaggccucccaggaguccgccuggcucgagugggcccuccgccuccaggacacccaggacaagcucuucugggacucccagggcggcggcuacuucugcuccgaggccgagcucggcgccggccucccccuccgccucaaggacgaccaggacggcgccgagcccuccgccaacuccgucuccgcccacaaccuccuccgccuccacggcuucaccggccacaaggacuggauggacaagugcgucugccuccucaccgccuucuccgagcgcaugcgccgcguccccgucgcccuccccgagaugguccgcgcccucuccgcccagcagcagacccucaagcagaucgucaucugcggcgaccgccaggccaaggacaccaaggcccucguccagugcguccacuccgucuacauccccaacaagguccucauccucgccgacggcgaccccuccuccuuccucucccgccagcuccccuuccucuccacccuccgccgccucgaggaccaggccaccgccuacgucugcgagaaccaggccugcuccguccccaucaccgaccccugcgagcuccgcaagcuccuccaccccuga

SEQ ID NO: 50033 - RNA, 2088 nt, Artificial Sequence
  derived and/or modified sequence opt2 from SPATA21__Homo_sapiens__XP_011539714
auggacaaccgcaacacccagauguacaccgagggccgcaccaaggcccccggcacccagcccucccccggccuccgcaucaccaucaagcgcgccggcgucgagcccaucauccccggcgucuccaaggucauguuccccgacgccuccgaggucggcuccaagaagcaccucuccuccgccucccgcggccccgagaagggcccccgccuccgcgacgccuucgagaagggccccuccgagcuccgcauccaggagcagggcccccccgcccgccccggcaagaagcagcccuccugggucccccaggagggcucccaggagcuccaggccggccaggaccaguccgagcucggccuccuccccuccuggguccccgagguccccgagggccuccagcagcucggcuccggcaaggagaucaagggccagcagggccgccagcgcaaccgcggcaucggcgaggaccagccccccgaguccugccagggcuccggcuaccaguccacccccucccaccaggccgacaugguccagcccgccgagcccugcugccgccucgccucccacggccagccccucggcggcaagcaccccaaggaggccggcgucccccacauccgcccccaggaggccccccccgagcccucccccggcggccacggcgacuccucccaggaggccaugccccccauguccgucgucgcccccgaggagaagaccgucaaccccuuccuccccuccacccccggccccaagaaggccaagggcggcggcgaggccgucgagacccaccccgcccccggcccccuccccccccccgagguccgcgacaucggcgagcgccgcgagcccgaccgcgcccagcagcagccccagaagcccgccgucgccgccggcacccagucccucggcaacuuccgccagggcuucaugaagugccuccucgaggucgagaagauggaggccucccaccgccgcgccuccaaggcccgcucccagaccgcccagaaguccccccgcacccucacccccguccccaccuccgcccccucccucccccagacccccgccuccguccccgccuccggccccuccugggcccgccuccccgcccccggccccgagcccgcccccaugggcgcccccguccccaccuccaugcccugccccguccuccucggccccgcccucgaccucggcuggcgccgcauggagcuccuccaccaguccuccgagcgcacccucuccuacgccaaggcccgccaggagcccgaggagcagucccuccagaagcucuaccagaaccgcgagaaguccgaggagcagcucacccucaagcaggaggaggccuuccgcuccuacuucgagaucuucaacggccccggcgaggucgacgcccagucccucaagaacauccuccuccucaugggcuucuccgucacccucgcccaggucgaggacgcccucauguccgccgacgucaacggcgacggccgcgucgacuucaaggacuuccucgccgucaugaccgacacccgccgcuucuucugcuccgucgagcagaacgcccucuccgacauggccccccacaacccccacacccuccucuucgagauccucucccuccucgucgagaugcucgcccuccccgaggccguccucgaggagaucaccaacuacuaccagaagaagcucaaggagggcaccugcaaggcccaggagauggaggccgccgucggccgccuccgccuccagaagcuccccuacaacccccagcaggaggaguccuccgagguccccgagcgcaagguccucuccauccucucccgccucaagcagcagaacuacgcccccaaccuccagucccccuacgcccagguccccugcauccuccucugcccccagcucgacaagaagaugguccgccgccagcccuccaaccacuacgcccucgaccagugcaccccccccggccucgaccccgacauccgcucccccuucuuccaguccggcucccagggcaaccgcgagcacaacuccgacucccgcaaguggcucuccuccguccccgcccgcacccacuga

SEQ ID NO: 50034 - RNA, 1092 nt, Artificial Sequence
  derived and/or modified sequence opt2 from SPATA22__Homo_sapiens__NP_001164166
augaagcgcucccucaacgagaacuccgcccgcuccaccgccggcugccuccccgucccccucuucaaccagaagaagcgcaaccgccagccccucaccuccaacccccucaaggacgacuccggcaucuccacccccuccgacaacuacgacuuccccccccuccccaccgacugggccugggaggccgucaaccccgagcucgcccccgucaugaagaccgucgacaccggccagaucccccacuccgucucccgcccccuccgcucccaggacuccgucuucaacuccauccaguccaacaccggccgcucccagggcggcugguccuaccgcgacggcaacaagaacaccucccucaagaccuggaacaagaacgacuucaagccccagugcaagcgcaccaaccucgucgccaacgacggcaagaacuccugccccgucuccuccggcgcccagcagcagaagcagcuccgcauccccgagccccccaaccucucccgcaacaaggagaccgagcuccuccgccagacccacuccuccaagaucuccggcugcaccaugcgcggccucgacaagaacuccgcccuccagacccucaagcccaacuuccagcagaaccaguacaagaagcagaugcucgacgacauccccgaggacaacacccucaaggagaccucccucuaccagcuccaguucaaggagaaggccuccucccuccgcaucaucuccgccgucaucgaguccaugaaguacuggcgcgagcacgcccagaagaccguccuccucuucgagguccucgccguccucgacuccgccgucacccccggccccuacuacuccaagaccuuccucaugcgcgacggcaagaacacccuccccugcgucuucuacgagaucgaccgcgagcucccccgccucauccgcggccgcguccaccgcugcgucggcaacuacgaccagaagaagaacaucuuccagugcgucuccguccgccccgccuccgucuccgagcagaagaccuuccaggccuucgucaagaucgccgacgucgagaugcaguacuacaucaacgucaugaacgagaccuga

SEQ ID NO: 50035 - RNA, 684 nt, Artificial Sequence
  derived and/or modified sequence opt2 from SPATA25__Homo_sapiens__NP_542175
auguccuacuuccgcaccccccagacccaccccggcccccuccccuccggccagggcggcgccgccucccccggccucucccucggccucugcucccccgucgagcccgucgucgucgccuccggcggcaccggcccccucucccagaaggccgagcaggucgcccccgccgcccaggccuggggccccgcccucgccaugccccaggcccgcggcugccccggcggcaccuccugggagacccuccgcaaggaguacucccgcaacugccacaaguucccccacguccgccagcucgagucccucggcugggacaacggcuacucccgcucccgcgcccccgaccucggcggccccucccgcccccgcccccucaugcucugcggccucuccccccgcguccuccccguccccuccgaggccgucggcaaggaggccuccucccagcccgacaucugcauccucacccucgccaugaugaucgccggcauccccaccguccccguccccggcguccgcgaggaggaccucaucugggccgcccaggccuucaugauggcccaccccgagcccgagggcgccgucgagggcgcccgcugggagcaggcccacgcccacaccgccuccggcaagaugccccucguccgcuccaagcgcggccagccccccggcuccugccucuga

SEQ ID NO: 50036 - RNA, 1563 nt, Artificial Sequence
  derived and/or modified sequence opt2 from SPATA2__Homo_sapiens__NP_001129245
augggcaagcccuccuccauggacaccaaguucaaggacgaccucuuccgcaaguacguccaguuccacgaguccaaggucgacaccaccaccucccgccagcgccccggcuccgacgagugccuccgcgucgccgccuccacccuccucucccuccacaaggucgaccccuucuaccgcuuccgccucauccaguucuacgaggucgucgaguccucccuccgcucccucuccuccuccucccuccgcgcccuccacggcgccuucuccaugcucgagaccgucggcaucaaccucuuccucuaccccuggaagaaggaguuccgcuccaucaagaccuacaccggccccuucgucuacuacgucaaguccacccuccucgaggaggacauccgcgccauccucuccugcaugggcuacacccccgagcucggcaccgccuacaagcuccgcgagcucgucgagacccuccaggucaagauggucuccuucgagcucuuccucgccaaggucgagugcgagcagaugcucgagauccacucccaggucaaggacaagggcuacuccgagcucgacaucgucuccgagcgcaaguccuccgccgaggacguccgcggcugcuccgacgcccuccgccgccgcgccgagggccgcgagcaccucaccgccuccaugucccgcgucgcccuccagaaguccgccuccgagcgcgccgccaaggacuacuacaagccccgcgucaccaagcccucccgcuccgucgacgccuacgacuccuacugggagucccgcaagcccccccucaaggccucccucucccuccgcaaggagcccgucgccaccgacgucggcgacgaccucaaggacgagaucauccgccccucccccucccuccucaccauggccuccuccccccacggcucccccgacguccucccccccgccucccccuccaacggccccgcccuccuccgcggcaccuacuucuccacccaggacgacgucgaccucuacaccgacuccgagccccgcgccaccuaccgccgccaggacgcccuccgccccgacgucuggcuccuccgcaacgacgcccacucccucuaccacaagcgcuccccccccgccaaggaguccgcccucuccaagugccaguccugcggccucuccugcuccuccucccucugccagcgcugcgacucccuccucaccugcccccccgccuccaagcccuccgccuuccccuccaaggccuccacccacgacucccucgcccacggcgccucccuccgcgagaaguaccccggccagacccagggccucgaccgccucccccaccuccacuccaaguccaagcccuccaccacccccaccucccgcugcggcuucugcaaccgccccggcgccaccaacaccugcacccagugcuccaaggucuccugcgacgccugccucuccgccuaccacuacgaccccugcuacaagaaguccgagcuccacaaguucaugcccaacaaccagcucaacuacaaguccacccagcucucccaccucgucuaccgcuga

SEQ ID NO: 50037 - RNA, 2682 nt, Artificial Sequence
  derived and/or modified sequence opt2 from SPATA5__Homo_sapiens__NP_660208
auguccuccaagaagaaccgcaagcgccucaaccaguccgccgagaacggcuccucccuccccuccgccgccuccuccugcgccgaggcccgcgcccccuccgccggcuccgacuucgccgccaccuccggcacccucaccgucaccaaccuccucgagaaggucgacgacaagauccccaagaccuuccagaacucccucauccaccucggccucaacaccaugaaguccgccaacaucugcaucggccgccccguccuccucaccucccucaacggcaagcaggaggucuacaccgccuggcccauggccggcuuccccggcggcaaggucggccucuccgagauggcccagaagaacgucggcguccgccccggcgacgccauccagguccagccccucgucggcgccguccuccaggccgaggagauggacgucgcccucuccgacaaggacauggagaucaacgaggaggagcucaccggcugcauccuccgcaagcucgacggcaagaucguccuccccggcaacuuccucuacugcaccuucuacggccgccccuacaagcuccagguccuccgcgucaagggcgccgacggcaugauccucggcggcccccaguccgacuccgacaccgacgcccagcgcauggccuucgagcaguccuccauggagaccuccucccucgagcucucccuccagcucucccagcucgaccucgaggacacccagauccccaccucccgcuccacccccuacaagcccaucgacgaccgcaucaccaacaaggccuccgacguccuccucgacgucacccagucccccggcgacggcuccggccucaugcucgaggaggucaccggccucaagugcaacuucgaguccgcccgcgagggcaacgagcagcucaccgaggaggagcgccuccucaaguucuccaucggcgccaagugcaacaccgacaccuucuacuucaucuccuccaccacccgcgucaacuucaccgagaucgacaagaacuccaaggagcaggacaaccaguucaaggucaccuacgacaugaucggcggccucuccucccagcucaaggccauccgcgagaucaucgagcucccccucaagcagcccgagcucuucaaguccuacggcauccccgccccccgcggcguccuccucuacggcccccccggcaccggcaagaccaugaucgcccgcgccgucgccaacgaggucggcgccuacgucuccgucaucaacggccccgagaucaucuccaaguucuacggcgagaccgaggccaagcuccgccagaucuucgccgaggccacccuccgccaccccuccaucaucuucaucgacgagcucgacgcccucugccccaagcgcgagggcgcccagaacgaggucgagaagcgcgucgucgccucccuccucacccucauggacggcaucggcuccgaggucuccgagggccagguccucguccucggcgccaccaaccgcccccacgcccucgacgccgcccuccgccgccccggccgcuucgacaaggagaucgagaucggcguccccaacgcccaggaccgccucgacauccuccagaagcuccuccgccgcgucccccaccuccucaccgaggccgagcuccuccagcucgccaacuccgcccacggcuacgucggcgccgaccucaagguccucugcaacgaggccggccucugcgcccuccgccgcauccucaagaagcagcccaaccuccccgacgucaaggucgccggccucgucaagaucacccucaaggacuuccuccaggccaugaacgacauccgccccuccgccaugcgcgagaucgccaucgacguccccaacgucuccugguccgacaucggcggccucgaguccaucaagcucaagcucgagcaggccgucgaguggccccucaagcaccccgaguccuucauccgcaugggcauccagccccccaagggcguccuccucuacggcccccccggcugcuccaagaccaugaucgccaaggcccucgccaacgaguccggccucaacuuccucgccaucaagggccccgagcucaugaacaaguacgucggcgaguccgagcgcgccguccgcgagaccuuccgcaaggcccgcgccgucgcccccuccaucaucuucuucgacgagcucgacgcccucgccgucgagcgcggcuccucccucggcgccggcaacgucgccgaccgcguccucgcccagcuccucaccgagauggacggcaucgagcagcucaaggacgucaccauccucgccgccaccaaccgccccgaccgcaucgacaaggcccucaugcgccccggccgcaucgaccgcaucaucuacgucccccuccccgacgccgccacccgccgcgagaucuucaagcuccaguuccacuccaugcccgucuccaacgaggucgaccucgacgagcucauccuccagaccgacgccuacuccggcgccgagaucgucgccgucugccgcgaggccgcccuccucgcccucgaggaggacauccaggccaaccucaucaugaagcgccacuucacccaggcccucuccaccgucaccccccgcauccccgagucccuccgccgcuucuacgaggacuaccaggagaaguccggccuccacacccucuga

SEQ ID NO: 50038 - RNA, 1704 nt, Artificial Sequence
  derived and/or modified sequence opt2 from SPATA7__Homo_sapiens__NP_001035518
auggacggcucccgccgcguccgcgccaccuccguccucccccgcuacggcccccccugccucuucaagggccaccucuccaccaaguccaacgccgccgucgacugcuccguccccgucuccgucuccaccuccaucaaguacgccgaccagcagcgccgcgagaagcucaagaaggagcucgcccagugcgagaaggaguucaagcucaccaagaccgccaugcgcgccaacuacaagaacaacuccaagucccucuucaacacccuccagaagcccuccggcgagccccagaucgaggacgacaugcucaaggaggagaugaacggcuucuccuccuucgcccgcucccucguccccuccuccgagcgccuccaccucucccuccacaaguccuccaaggucaucaccaacggccccgagaagaacuccuccuccucccccuccuccgucgacuacgccgccuccggcccccgcaagcucuccuccggcgcccucuacggccgccgcccccgcuccaccuuccccaacucccaccgcuuccagcucgucaucuccaaggcccccuccggcgaccuccucgacaagcacuccgagcucuucuccaacaagcagcuccccuucaccccccgcacccucaagaccgaggccaaguccuuccucucccaguaccgcuacuacacccccgccaagcgcaagaaggacuucaccgaccagcgcaucgaggccgagacccagaccgagcucuccuucaaguccgagcucggcaccgccgagaccaagaacaugaccgacuccgagaugaacaucaagcaggccuccaacugcgucaccuacgacgccaaggagaagaucgccccccucccccucgagggccacgacuccaccugggacgagaucaaggacgacgcccuccagcacuccuccccccgcgccaugugccaguacucccucaagccccccuccacccgcaagaucuacuccgacgaggaggagcuccucuaccucuccuucaucgaggacgucaccgacgagauccucaagcucggccucuucuccaaccgcuuccucgagcgccucuucgagcgccacaucaagcagaacaagcaccucgaggaggagaagaugcgccaccuccuccacguccucaaggucgaccucggcugcaccuccgaggagaacuccgucaagcagaacgacgucgacaugcucaacgucuucgacuucgagaaggccggcaacuccgagcccaacgagcucaagaacgaguccgaggucaccauccagcaggagcgccagcaguaccagaaggcccucgacaugcuccucuccgcccccaaggacgagaacgagaucuuccccucccccaccgaguucuucaugcccaucuacaaguccaagcacuccgagggcgucaucauccagcaggucaacgacgagaccaaccucgagaccuccacccucgacgagaaccaccccuccaucuccgacucccucaccgaccgcgagaccuccgucaacgucaucgagggcgacuccgaccccgagaaggucgagaucuccaacggccucugcggccucaacaccucccccucccaguccguccaguucuccuccgucaagggcgacaacaaccacgacauggagcucuccacccucaagaucauggagauguccaucgaggacugcccccucgacgucuga

SEQ ID NO: 50039 - RNA, 318 nt, Artificial Sequence
  derived and/or modified sequence opt2 from SPATA8__Homo_sapiens__NP_775770
auggcccccgccggcauguccggcgcccaggacaacuccugccucuaccaggagaucgcccccuccuuccagcgccuccccugcccccgcaccuccucccgccacuucuccgaggccaugaccugccccugcggcuggcgccccuucaagggcggccccggcggccucaagggccccgucuggcccgccaaggaggagaacuccugcucccacggccgcauccagcgcguccagcgccgccgcguccccuccgccuccccccucauccagaagaucaaccgccgcuccguccucuuccaccccuacugcugguccuga

SEQ ID NO: 50040 - RNA, 765 nt, Artificial Sequence
  derived and/or modified sequence opt2 from SPATA9__Homo_sapiens__NP_114158
augcccaucaagcccgucggcuggaucugcggccagguccucaagaacuucuccggccgcaucgagggcauccagaaggccaucauggaccucgucgacgaguucaaggacgaguuccccaccauccuccgccucucccaguccaaccagaagcgcgagcccgcccagaagaccuccaagauccgcauggccaucgcccucgccaagaucaaccgcgccacccucauccgcggccucaacuccaucucccgcuccuccaaguccgucgccaagcuccuccacccccagcucgccugccgccuccucgagcuccgcgacaucuccggccgccuccuccgcgaggucaacgccccccgccagccccucuacaacauccagguccgcaagggcucccucuucgagaucaucuccuuccccgccaagaccgcccucaccuccaucaucuacgccuccuacgccgcccucaucuaccucgccgucugcgucaacgccguccucaagaaggucaagaacaucuuccaggaggaggaguccauccgccagaaccgcgaggaguccgagaacugccgcaaggccuucuccgagcccguccucuccgagcccauguucgccgagggcgagaucaaggccaagcccuaccgcucccuccccgagaagcccgacaucuccgacuaccccaagcuccucgccaacaagcaguccaacaacauccagguccuccacuccgucuucgaccaguccgccgagaugaacgagcagaucuga

SEQ ID NO: 50041 - RNA, 1326 nt, Artificial Sequence
  derived and/or modified sequence opt2 from SPATC1__Homo_sapiens__NP_001127846
augucccuccucaccaacuacgagggccuccgccaccagaucgagcgccucguccgcgagaacgaggagcucaagaagcucguccgccucauccgcgagaaccacgagcucaaguccgccaucaagacccaggccggcggccucggcaucuccggcuucaccuccggccucggcgaggccaccgccggccucuccucccgccagaacaacggcgucuuccucccccccucccccgccgucgccaacgagcgcguccucgaggaggucggcaucauggcccucgccccccucgccgagaugcucaccucccuccagcccuccgccacccccggcucccucauguccccccucaccggcacccucuccacccuccucuccggccccgcccccaccucccaguccuccccccucaccuccuuccucaccucccccaucgccggcccccucaccggcacccucgccuccucccucggccuccccuccaccggcacccucacccccuccucccucgucgccggccccgucgccaugucccaguccuccccccucaucgcccccgucaugggcaccgucgccgucucccucuccuccccccuccucuccuccaccgccaccccccccggcgucucccagaaccuccucgccaaccccauguccaaccucguccuccccgaggccccccgccuccgccucgccgagccccuccgcggcggccccaccggcccccagucccccgccugcgucguccccaccgccaccaccaaggucccccucuccaccgagcccccccaguccacccaggaccccgagccccucuccauggccuucgccggcgccccccuccagaccuccacccccaucggcgccaugggcacccccgcccccaagaccgccuucuccuucaacaccuccgacacccaggcccagcccuccgccgcccaggagcaggucguccccgccuccguccccaccucccccaccaccucccccaccgucaccguccucgccuccgcccccgcccucgccccccaggucgccaccuccuacacccccuccuccaccacccacaucgcccagggcgccccccacccccccucccgcaugcacaacucccccacccagaaccuccccgucccccacugccccccccacaacgcccacucccccccccgcaccuccuccucccccgccuccgucaacgacucccgcggcccccgcaccaccgagcccuccaccaaguccaugauggaggucgagcgcaagcucgcccaccgcaagaccuccaaguuccccgagaacccccgcggcuuccccgagccccaguga

SEQ ID NO: 50042 - RNA, 594 nt, Artificial Sequence
  derived and/or modified sequence opt2 from SPC24__Homo_sapiens__NP_872319
auggccgccuuccgcgacaucgaggaggucucccagggccuccucucccuccucggcgccaaccgcgccgaggcccagcagcgccgccuccucggccgccacgagcaggucgucgagcgccuccucgagacccaggacggcgccgagaagcagcuccgcgagauccucaccauggagaaggaggucgcccagucccuccucaacgccaaggagcagguccaccagggcggcgucgagcuccagcagcucgaggccggccuccaggaggccggcgaggaggacacccgccucaaggccucccuccuccagcucacccgcgagcucgaggagcucaaggagaucgaggccgaccucgagcgccaggagaaggaggucgacgaggacaccaccgucaccauccccuccgccgucuacgucgcccagcucuaccaccaggucuccaagaucgagugggacuacgagugcgagcccggcauggucaagggcauccaccacggccccuccgucgcccagcccauccaccucgacuccacccagcucucccgcaaguucaucuccgacuaccucuggucccucgucgacaccgagugguga

SEQ ID NO: 50043 - RNA, 675 nt, Artificial Sequence
  derived and/or modified sequence opt2 from SPC25__Homo_sapiens__NP_065726
auggucgaggacgagcucgcccucuucgacaaguccaucaacgaguucuggaacaaguucaaguccaccgacaccuccugccagauggccggccuccgcgacaccuacaaggacuccaucaaggccuucgccgagaagcucuccgucaagcucaaggaggaggagcgcauggucgagauguuccucgaguaccagaaccagaucucccgccagaacaagcucauccaggagaagaaggacaaccuccucaagcucaucgccgaggucaagggcaagaagcaggagcucgagguccucaccgccaacauccaggaccucaaggaggaguacucccgcaagaaggagaccaucuccaccgccaacaaggccaacgccgagcgccucaagcgccuccagaaguccgccgaccucuacaaggaccgccucggccucgagauccgcaagaucuacggcgagaagcuccaguucaucuucaccaacaucgaccccaagaaccccgagucccccuucauguucucccuccaccucaacgaggcccgcgacuacgaggucuccgacuccgccccccaccucgagggccucgccgaguuccaggagaacguccgcaagaccaacaacuucuccgccuuccucgccaacguccgcaaggccuucaccgccaccgucuacaacuga
